United States Patent 9,061,059 (MODIFIED POLYNUCLEOTIDES FOR TREATING PROTEIN DEFICIENCY) - sequence listing, part 122

SEQ ID NO: 236712 - DNA, 1587 bp, Artificial Sequence
  Description of Artificial Sequence: Synthetic coding sequence
atgcttctgccccttttactcttgctacctatgtgttgggcagtagaagtaaagaggccccgtggagtctccttgaccaaccatcatttttacgatgagtcaaagccattcacatgcttggatggatcagctactattcctttcgaccaagtcaatgacgattactgcgactgcaaggatggttctgacgagcctggcaccgccgcttgcccaaatggatctttccactgtacgaatacgggctataaacctttatatatccccagcaaccgcgtcaacgatggagtttgtgactgctgcgatggaaccgacgaatacaattctggcgtgatatgcgagaacacttgtaaagagaaaggcagaaaagagcgcgagtctcttcaacagatggcagaagtaacaagggaggggtttcggctcaaaaagattcttatcgaggactggaagaaagccagagaggagaaacagaagaagctgatcgagctgcaggctggcaagaaatctcttgaagaccaggtggagatgctgcgaacagtcaaagaagaggcagaaaagcccgaacgagaggcaaaggagcagcatcagaagctgtgggaagaacagctggccgcagccaaagctcagcaggagcaagagctcgcagcagacgcattcaaagaattagacgatgacatggatggcacggtgagcgtgaccgaactgcaaacacacccagaactggacacagatggtgacggcgctctttcagaggcagaggcccaggcacttttaagtggggacacacagactgatgcaaccagtttctacgatagagtgtgggctgccattagggataaatacaggtctgaagctctgcccacggatctaccagcccctagtgccccagatctcactgagcccaaagaggaacaacccccagtgccatcctcccctaccgaggaagaggaagaagaggaggaagaggaagaagaagaggcagaggaagaggaggaagaagaagacagcgaagaggctcctcccccactatctcctccccagcctgcgagccccgcagaggaagacaagatgcccccatacgacgaacagacgcaggccttcatcgatgcagcccaggaggcccgaaacaaattcgaggaggccgagcggtctttaaaggacatggaggagtctattaggaacctagagcaggagatctcattcgactttggacccaacggcgagttcgcttacctgtattctcagtgctatgaactcacaaccaacgaatacgtgtacaggctctgccccttcaagctggtgagccagaagcccaagctcgggggttcaccaacttccctcgggacatggggaagttggataggccctgaccacgacaagttctctgctatgaagtacgaacaggggacaggatgttggcagggcccaaacaggtctacaaccgtccgcctgctttgtggcaaagagactatggtgacgagtactacagagccctcaagatgtgaatatttaatggagttaatgacgccagctgcttgcccagagcctccacccgaagcccctaccgaggacgatcatgatgaactctag

SEQ ID NO: 236713 - DNA, 1578 bp, Artificial Sequence
  Description of Artificial Sequence: Synthetic coding sequence
atgttgcttcccctgctgctcctacttcctatgtgctgggccgttgaggtaaagagacctcggggagtttctctcactaatcatcatttttacgacgaatcaaaacccttcacgtgcctggacggctctgcaacgatcccctttgatcaggttaatgatgactactgcgactgcaaggacggctctgatgaacccggaacggccgcttgccccaacggctccttccactgtacaaatacagggtataaacccctgtacatcccctcaaaccgtgtcaatgacggagtgtgcgactgctgcgacggtaccgacgagtataatagcggcgtgatttgtgagaacacatgtaaggaaaagggcagaaaggaaagggagagcctgcagcagatggccgaggttacacgggaaggtttccggttaaaaaaaatcctcatcgaggactggaagaaagccagggaggagaagcagaaaaaattaatcgagctgcaggccggaaaaaaatcactggaagatcaagtcgagatgctgcgcacagtgaaggaagaggcggagaagccagagagagaagcaaaagagcaacaccagaaactttgggaggagcagctggccgctgctaaggcccagcaggaacaagagctagctgcagatgcatttaaggaactggacgacgacatggatggaacggtatcggtgacagaactgcagacacaccccgagctggataccgatggggacggtgctctgtcagaggcagaggcccaggcattgctcagcggagacactcaaactgacgcgacctcattctacgaccgggtgtgggcagcaatccgagacaaataccggagcgaagcactgcctacagaccttccagccccttctgccccagatctgacagagcccaaggaagagcagccgcctgtcccatccagccctacggaagaagaggaggaggaggaagaagaagaagaagaggaagctgaagaagaggaggaggaagaagattccgaggtgcagggcgagcaaccaaagcctgcaagccccgctgaggaggataagatgcccccttacgacgagcagacccaggcattcatcgatgcagcccaggaggcccgaaataaatttgaggaggccgagcggtccttgaaggacatggaggaatctattcgaaacctcgagcaggaaatatccttcgattttggcccaaacggagagttcgcctatttgtacagtcagtgctatgagcttaccacgaacgagtacgtgtaccgtttgtgccctttcaaactagtgagccagaagcctaagcttggcggtagtcccacctccctgggcacctggggttcatggataggaccagatcacgacaaattctcggccatgaagtatgaacaggggacagggtgctggcagggacccaatcgctcaacaaccgttcgattactgtgtggtaaggaaacaatggttacttctactaccgaaccatccaggtgtgagtaccttatggagctgatgacaccggctgcctgtcccgagccccctccagaggcacccactgaggacgatcacgatgagctgtag

SEQ ID NO: 236714 - DNA, 2031 bp, Artificial Sequence
  Description of Artificial Sequence: Synthetic coding sequence
atggctccattcctcagaattgcttttaattcttacgagcttggttctttacaggcagaagatgaggcgaaccaaccattctgtgcggtgaaaatgaaggaagctctgtccacagaacgtggcaagacactcgtccaaaaaaaaccaacgatgtatcccgaatggaaatccacgttcgacgctcacatctacgaaggcagagtgatacaaatcgtgttaatgagagcagccgaggaaccggtcagcgaagtaaccgtgggggtctccgtcctagcagagagatgcaagaaaaataacggcaaggccgaattttggctagacctgcagccccaggctaaggtgctgatgtcagtacagtactttctcgaggacgtcgattgcaaacaatcgatgcgaagcgaggacgaagctaaattcccaaccatgaaccgcagaggggcaatcaaacaggccaagatccattacattaagaaccatgaatttatagcgaccttctttggccagccaacattctgctccgtgtgtaaagattttgtttggggactaaataaacaagggtataagtgccggcagtgcaatgcagctatacacaaaaagtgtattgacaagataattgggcgatgcaccgggacagcagccaactcccgcgacacgatttttcagaaagaaagattcaatattgatatgccccaccggtttaaagtgcacaactatatgtctcctactttttgcgaccattgtgggtccctgctgtggggcctcgtgaagcagggactcaagtgcgaggactgcggtatgaacgtacatcacaagtgccgcgagaaggttgccaatctgtgtggcatcaatcagaagctccttgcagaggctttgaaccaagtcacgcagagggcctcacggaggtccgattcggccagttctgaacccgtcggcatctatcaagggtttgagaagaagaccggggtcgcaggggaagacatgcaagacaactccggtacttatggtaagatctgggagggatccagtaagtgcaatattaacaacttcattttccataaggtcctgggcaaggggagttttggcaaggtgctgctcggcgagctaaagggcagaggggaatacttcgccataaaagctctgaagaaagacgtcgttttgatcgatgatgacgtcgaatgcactatggtagaaaaacgcgtcctgaccctggctgctgagaatccattcctaactcacttaatatgtaccttccagaccaaggaccacctctttttcgtgatggagtttttaaacggcggtgatctaatgtatcatatccaggataagggacgtttcgaattataccgggcaacattctacgccgctgaaataatgtgtggtctacaattcctgcactccaagggtataatctatcgggacctgaagctcgataatgttctcctggatcgcgatggccatattaagatcgcagatttcggcatgtgcaaggagaacattttcggcgaaagtcgggcatccacgttttgcggaacccctgactatatagccccagagattctgcagggtttaaaatacaccttttcggtggactggtggtcttttggagtcctgttgtatgagatgcttatcggacagagcccttttcacggggatgacgaggacgaattgttcgagtctatccgagttgataccccacactaccctaggtggatcacaaaggaatcaaaggacatcctggaaaagcttttcgagcgggagcctacgaagcgactcggggtcacaggcaacatcaagattcatccattttttaaaaccataaactggacactgctcgaaaaacgccgactggagcccccttttcgccctaaggtgaagagcccacgtgactacagcaactttgaccaagagtttctcaatgagaaggcacggctgtcttactcagacaagaatctgatagacagcatggaccaatccgcatttgcaggattcagtttcgtgaacccaaagtttgaacacttattagaggactag

SEQ ID NO: 236715 - DNA, 2031 bp, Artificial Sequence
  Description of Artificial Sequence: Synthetic coding sequence
atggccccattcctgcggatagcattcaatagctacgagctcggctcgctgcaggcggaagacgaggccaaccaaccattctgtgcagtgaaaatgaaagaagcactgtctactgaacgcggtaagacattagtgcagaaaaagccgaccatgtacccagagtggaagtcaactttcgacgcccacatctacgaaggtagggtcattcagatagtcttaatgcgcgctgccgaggagcccgtttctgaggtaaccgtgggcgtgagcgtcctggctgagaggtgcaagaagaacaacgggaaagcagagttctggctggaccttcagccacaggccaaggtgctgatgagtgtccagtacttcctcgaggacgtcgattgcaaacagtccatgagatcagaagacgaggccaagttccctacaatgaacaggagaggagctatcaagcaggccaaaattcattacataaaaaatcatgagtttatcgccacgtttttcggtcagcctaccttctgcagcgtgtgcaaggacttcgtgtggggcctgaacaagcagggctacaagtgtcggcagtgtaacgccgctatccacaagaaatgtattgacaagattataggtaggtgcacaggtaccgctgcaaattctagggacacaattttccagaaggagcggtttaacatagacatgccccaccgatttaaagtgcacaactatatgtctccaaccttttgtgaccattgcggttctctgctatggggccttgtcaagcaaggcttgaagtgtgaggactgtggcatgaacgtgcaccataagtgcagggaaaaagtggccaatttatgcggcatcaaccagaagctgctcgccgaagccttgaatcaggtgacacaaagagcgagcagacgcagcgattctgcctcatctgagcctgtgggaatttatcagggattcgagaaaaagaccggcgtggctggcgaggacatgcaggataattcaggcacttatggcaaaatttgggagggcagcagcaagtgcaacatcaacaactttattttccacaaggtgctgggcaaaggaagctttggaaaggttctcttgggcgaactcaaagggaggggggaatatttcgcaattaaggccctgaaaaaagatgtcgtattaatcgatgacgatgtcgagtgtacgatggtggagaagcgtgtgcttacgctggcagccgagaacccctttttgacgcacctgatttgtaccttccagacaaaagaccatctgttctttgtaatggagtttctcaatggtggagacctaatgtatcacattcaggataaaggaagatttgagttatacagggccaccttttacgctgcggagatcatgtgtggattgcagtttttacactcaaaggggatcatataccgtgacctcaaactcgataacgtgcttcttgaccgagacggtcacatcaagattgctgattttgggatgtgtaaggaaaacatatttggagagtccagagcctccaccttttgcggtacccccgattatatcgccccagagatcttacagggactgaagtatacattcagtgtagattggtggagttttggtgtgctcctatacgagatgctcatcgggcagtctcccttccacggagatgatgaggacgagttgttcgaatctattagggtggacacccctcattacccgaggtggatcaccaaggaatccaaggacatactcgaaaagctattcgagagagagcccactaagcgtctcggagtgactgggaacattaaaatccatccattcttcaaaaccatcaactggaccctactggaaaagagaagactcgagcctcctttcagacccaaagtcaaaagccccagagattacagtaattttgaccaggaatttctgaatgagaaggctagattgtcttattccgataaaaatctaatcgacagcatggatcagtccgcattcgccggattttcatttgtcaatcctaagtttgaacacctgcttgaggactag

SEQ ID NO: 236716 - DNA, 234 bp, Artificial Sequence
  Description of Artificial Sequence: Synthetic coding sequence
atggctccttttttgagaattgctttcaattcctacgagctcggcagccttcaagctgaagatgaggccaaccagcccttttgtgctgtgaagatgaaagaggccctcagtactgaaagagggaagacgttagtgcaaaagaagcccacaatgtacccagagtggaaatccacctttgacgcccacatctatgagggaagggtgatccagatagtcctgatgcgagccgcttag

SEQ ID NO: 236717 - DNA, 378 bp, Artificial Sequence
  Description of Artificial Sequence: Synthetic coding sequence
atggcacccttcctgcgaatcgcatttaacagctatgaactcggatctctgcaagctgaggatgaggctaaccagccattttgcgcagtgaagatgaaggaagccctgtctaccgagaggggaaaaaccctcgtgcaaaagaagccaactatgtacccagaatggaaaagcaccttcgacgcccacatctacgaaggcagggtgatccagatcgtccttatgagagcggcagaggagccagtgagtgaagttaccgtgggagttagcgtgctcgcggagaggtgcaagaagaataatgggaaggccgaattttggctggatctgcagccccaggccaaggtattgatgagtgtccaatactttcttgaagacgtttag

SEQ ID NO: 236718 - DNA, 2052 bp, Artificial Sequence
  Description of Artificial Sequence: Synthetic coding sequence
atgtctagcgggacaatgaagttcaacggatacttaagagtgagaattggagaggctgtgggactgcaacctaccagatggagcctcagacacagtctattcaagaagggccatcagctgctggatccgtacctcacggtgtcagtggatcaagtgcgcgtggggcagacatctacgaagcaaaagactaacaaacctacgtataatgaggaattttgcgctaatgtgacggatgggggacaccttgagctagccgtgttccacgagacccctctgggatatgaccattttgtggctaattgtacactccagtttcaggagctcttgaggaccacaggcgctagcgacacattcgaagggtgggtcgatctagagccggaaggcaaggtttttgttgtgataactctgactgggagcttcaccgaagccactctgcagagagatagaattttcaaacatttcacacggaagagacagagagccatgaggagacgcgtgcatcagatcaatgggcataaattcatggcgacatacctgagacagccaacatactgttcgcattgccgcgagttcatctggggcgtttttggcaaacagggctatcaatgccaggtgtgtacatgtgtggtacacaaaagatgccaccacttgatcgtgacagcatgtacatgccaaaacaacataaataaagtggactctaaaattgcagagcagaggttcggtatcaatatcccccataagttcagcatccataactataaagttcccactttctgcgaccactgcggcagccttttatggggaatcatgagacaggggctacagtgcaagatctgtaaaatgaacgtccacattaggtgccaagctaatgtggcacctaactgtggagtgaatgctgttgagctagccaaaaccttagccggaatgggcctgcagcccggaaatattagccctacctcgaagctggtcagtagatcaactttgcgccgacagggcaaggaatcctccaaagaaggcaacgggatcggtgtgaactcatccaaccggctgggaattgataacttcgaattcatccgggtgctgggtaaaggctccttcggtaaggttatgctggcccgagtgaaggagacgggcgatctgtatgccgttaaggtcctgaagaaggatgtgatactgcaggacgatgacgtagagtgtactatgactgagaagaggatcctgtcactggcaaggaatcatcctttcctcacccaactcttctgttgcttccagacacccgaccggctattctttgtgatggagtttgtgaatggtggggacttgatgtttcacattcagaagtctcggagatttgacgaagcccgagcacgtttttacgcagctgaaatcatcagcgcactaatgttcctgcacgacaagggcatcatctatcgcgatctaaaactggacaacgtgctgctagatcacgagggccattgtaagttagctgacttcggcatgtgtaaggagggtatttgtaatggtgtgacaactgctaccttttgtggcactccagactacatcgccccagagatcctgcaagagatgctgtatggccctgcagttgattggtgggccatgggcgtgctgttgtacgaaatgctttgtggccacgccccttttgaggccgagaacgaagatgacctttttgaagcaatcctcaatgatgaggtggtgtatccaacgtggctgcatgaggatgcaaccggtatcctgaaaagctttatgacaaagaatccaactatgaggcttgggtcactcactcaggggggagaacacgccattctgcggcatcccttttttaaggaaatcgattgggctcagttaaaccataggcagattgagcctccattcagacctaggatcaaaagccgcgaggatgtatcaaactttgaccctgactttataaaggaagagccagtgttgacaccaatagatgaaggccacctgccgatgatcaatcaggatgagtttaggaatttttcttacgtctcaccggaacttcagccatag

SEQ ID NO: 236719 - DNA, 357 bp, Artificial Sequence
  Description of Artificial Sequence: Synthetic coding sequence
atgtcgagcggtaccatgaaattcaatggttaccttcgtgtacgcatcggtgaagccgtaggcctgcagcctaccaggtggtccctcagacattctttgttcaaaaaggggcatcagttgctggacccatacctgacagtttccgtggatcaggtacgcgttggccaaacctctaccaaacagaagactaataaaccaacctataacgaggaattttgtgctaatgtgacggatgggggtcatctcgagctggccgtttttcatgagacccccctcggttatgaccatttcgttgccaactgcacgcttcagttccaggaactgctgcggaccaccggggcttccgacaccttttag

SEQ ID NO: 236720 - DNA, 1791 bp, Artificial Sequence
  Description of Artificial Sequence: Synthetic coding sequence
atgcccacacagagagatagctcaacaatgtcccacacagtggctggtgggggttcaggcgaccactcccaccaggttcgagtgaaggcatactataggggagacattatgatcacccactttgagccctcaatcagttttgaagggctgtgtaacgaggtgcgggacatgtgctccttcgacaacgagcagctctttaccatgaaatggatcgacgaggagggcgacccatgtactgtttcctctcagctggagctcgaggaggccttccggctctatgaactgaacaaagacagcgaattgttgatacacgtgttcccctgtgtgcctgagagacctggcatgccatgcccaggcgaggataagtcaatctaccggcgtggcgctagacgatggcggaaattgtattgtgctaatggccacacctttcaggccaaacgctttaaccggcgtgcccactgcgccatttgcacagatagaatctgggggttggggagacaaggctacaagtgcatcaactgcaagttactggttcacaagaaatgtcataagctcgtgaccatcgaatgtggaagacattccctacctcaggaacctgttatgccaatggatcagtcttcaatgcatagcgatcacgcacagaccgtgataccctataatccttcatcacacgaatcccttgatcaggtgggcgaggagaaggaggctatgaatacaagagagagtgggaaggcaagcagttcattggggttgcaggatttcgacttactccgcgtcattggcagaggatcgtatgcgaaggttctactcgtccgtctgaaaaagactgatcggatctacgcaatgaaagtggttaagaaggagctagtgaatgatgacgaagatattgactgggtgcagactgaaaagcatgtgttcgagcaggctagcaatcatcctttcctagtggggctacattcatgtttccaaacagaatcaaggcttttctttgtgatcgagtatgtgaatgggggtgacctcatgtttcatatgcagcgacagaggaagcttccggaggaacacgctcgtttctactcagccgaaattagcctagccctaaactatttacatgaaaggggaatcatatatcgggaccttaagcttgataatgtcctgctggactcagaaggccatatcaagctgacggactacggaatgtgcaaagaagggttgcgtcccggagacacgactagtactttctgtgggacgccaaattacatcgctcccgagatattgcgtggggaagactatggcttttcggtggattggtgggcacttggagtcctcatgttcgaaatgatggctggcaggtccccatttgatatagtagggtctagtgacaaccccgatcagaataccgaagattacttatttcaggttatcttagaaaaacagataagaatccctcggtctctttccgtgaaggccgcatcagtcttgaagtctttccttaataaggacccaaaggagcggctcggatgtcatcctcaaaccggtttcgcagatatacagggtcatccatttttcaggaatgttgattgggacatgatggagcagaagcaggtcgttccaccgttcaagccaaatatctctggtgagtttgggctagataattttgattcccagttcactaacgaacccgtccaactcacacccgacgacgatgacatcgtgcggaaaatagaccagtccgagtttgaggggttcgaatacattaacccactattaatgtcagccgaggaatgcgtgtag

SEQ ID NO: 236721 - DNA, 2121 bp, Artificial Sequence
  Description of Artificial Sequence: Synthetic coding sequence
atgtccccatttttgagaattggcctaagcaatttcgattgtggcagttgccagtcttgtcagggcgaagccgtgaatccttactgcgccgttctggttaaggagtacgtagagtccgagaatgggcaaatgtacatccagaagaaacccacaatgtatccgccatgggacagtacttttgatgcccatattaacaagggcagggtgatgcaaattatcgtcaaaggaaagaacgtcgatctgatttctgagactaccgtggagctctattcacttgctgagcgctgtcgcaaaaacaacggcaagacagagatttggctggagcttaagccacagggaagaatgttgatgaacgctcggtatttccttgaaatgagcgacactaaggacatgaacgagtttgagacagaagggttttttgccctgcaccaacgaaggggcgcaattaagcaggctaaggtccatcatgtgaaatgccacgagtttactgctacgttctttccacagcccacattctgttccgtctgtcacgagtttgtgtggggcctgaacaaacagggttatcagtgcaggcagtgtaacgccgctatccataagaagtgcattgacaaggtaatcgccaagtgtaccggaagcgcgatcaacagcagagagaccatgttccataaggagagatttaaaatcgacatgcctcatcgctttaaagtatataactataagagccccaccttttgtgaacattgtggcacattgctgtgggggcttgcccgtcagggcctgaagtgcgatgcctgcggcatgaacgttcaccacaggtgtcagactaaagttgctaacctgtgcgggatcaatcagaagctgatggccgaagcgctggccatgatagagtcaacacagcaagcgagatgtctgcgagatacggagcagatttttcgggaaggcccagttgagattggcttgccctgttcaattaaaaatgaggcacgaccaccttgcctccccacccccggtaagcgagagccccagggcattagctgggagtctcctctggacgaggtcgataaaatgtgccatcttccggaacccgaactcaataaggagcgaccaagcctgcaaatcaaactgaaaatcgaggattttatcctgcataaaatgctgggtaaaggcagcttcggcaaggtatttctggcggagttcaaaaaaacaaaccagttcttcgccataaaggctcttaagaaggatgtggtgctgatggatgacgatgttgagtgtaccatggtcgagaaaagagttctaagtctggcttgggaacacccgttcttgactcatatgttctgcacctttcagaccaaggagaatctgtttttcgtgatggaatatttgaacggtggcgacttaatgtaccacattcagagctgccacaaattcgacctcagcagagcaacattctatgctgcagagatcatcctgggacttcagtttctacactccaagggcattgtttaccgggatctgaaactggataacatcttactcgataaggacggccacattaagatagccgactttggcatgtgcaaggagaacatgttgggagatgccaagaccaatacattttgcggaactcccgattatatcgccccagagatcctgctaggccaaaaatacaaccatagcgtcgattggtggagcttcggcgtgctgctgtacgagatgctgatcgggcagtctcccttccatggccaggacgaggaggagctgtttcacagtatcaggatggataatcccttttatcctaggtggctagagaaagaggcaaaagacctgctggtgaagttattcgtcagagaacctgaaaagagattaggcgttcggggagatatcaggcagcaccccctgtttagggagatcaattgggaggaacttgagagaaaggaaattgaccctcctttcaggccaaaagttaaaagccctttcgattgtagcaactttgataaggagtttttaaatgaaaaaccccgtctgtcttttgcagaccgagcgctcataaactctatggaccagaacatgttccggaattttagctttatgaacccaggcatggagcggctgatctcttag

SEQ ID NO: 236722 - DNA, 1932 bp, Artificial Sequence
  Description of Artificial Sequence: Synthetic coding sequence
atgtctccattcttgcgcattggtctttcgaattttgactgcggctcctgtcagtcttgtcagggcgaggcagttaatccatattgcgccgtccttgtcaaggagtatgtggagagcgaaaatgggcaaatgtatatccaaaagaagcccacaatgtatccaccttgggacagcacttttgatgcgcacatcaacaaaggcagagtgatgcaaataatcgtgaaaggaaagaacgtggacctgatctctgagaccacggtagagctgtattccctggctgagcggtgcaggaagaacaatggcaaaaccgaaatttggctggaactgaaaccacaggggaggatgctgatgaatgcaagatatttcctcgagatgtctgacactaaagacatgaatgagtttgaaaccgaaggattttttgccctccaccaaagacgtggcgctatcaaacaagctaaggtgcaccacgtgaaatgccatgagtttaccgccacgtttttccctcagccaacgttctgttccgtatgccacgaattcgtatggggtttgaacaagcaagggtatcagtgtaggcagtgcaacgccgcaatccataaaaaatgcatcgacaaggtgattgctaaatgtacaggttcagctatcaactctcgcgagaccatgttccacaaggagaggtttaaaatcgacatgccacatcgattcaaagtgtacaattacaagtcgcccacgttttgtgagcattgtgggacgctcctttgggggcttgcgagacaaggactaaaatgtgatgcatgcggcatgaacgttcaccaccgttgtcaaaccaaagtggcaaacctctgtggcattaatcagaaacttatggcagaagctcttgctatgattgaaagtacccagcaagccaggtgcctccgtgacacagaacagatatttcgcgagggtccagttgagataggcttaccctgtagtatcaaaaacgaggctcggcctccatgcctcccaacacccggtaaacgcgaaccgcagggcattagttgggagtcccccttggacgaagttgacaagatgtgccacctgcccgaacctgagctgaataaggaacgaccgagtctgcaaattaagctgaagatagaagatttcatcctgcataaaatgttaggaaaaggttctttcgggaaggtgttcttagccgaattcaagaagacaaaccagttcttcgcaattaaagcattaaaaaaggacgtggtcctgatggacgatgacgttgagtgcactatggtggagaaaagagtcctgagtctggcctgggagcacccctttctaacccatatgttttgcaccttccagacaaaggaaaatctgttctttgtcatggagtatttgaacggtggtgatttaatgtaccatatccagagctgccataagtttgatctttcacgggctaccttctacgccgcagaaattattctgggcctgcaattcctgcactctaaagggatagtctatcgggatctgaagctggacaacatcctgttagataaggacggtcatattaaaattgcggacttcggaatgtgcaaggagaacatgctcggagacgcgaagactaataccttttgtggtaccccagactatattgccccagaactgttcgttagagagccggagaagaggttgggcgtgcgcggagacattaggcaacatcctctttttcgagagatcaactgggaggagttagagaggaaggaaatcgaccctccctttcgcccaaaagttaagagccccttcgattgcagtaactttgacaaggaatttctcaacgaaaagccacggttgtcgttcgccgatcgggctcttataaacagcatggaccaaaacatgttcaggaacttctcctttatgaatcccggaatggagagactgatctcatag

SEQ ID NO: 236723 - DNA, 1440 bp, Artificial Sequence
  Description of Artificial Sequence: Synthetic coding sequence
taactctcgctccttccctgtttgttatttctgcccacaatcatcccaaagaagatcgtcatccaacgagatagtcttccttctaagaagctgagctacggcttgattgcatgcgggatgaatgtccatcaccggtgccaaacgaaagtggcgaatctctgcggcataaaccaaaagctcatggctgaagccctggccatgatcgagagcacccagcaggctaggtgcctccgtgatacagagcaaatcttccgcgaagggcctgtggaaattggcctcccatgctctataaagaatgaggccaggcctccgtgtctgccaacaccaggaaaacgtgaaccgcaaggaatctcttgggaatcccctctggacgaggttgacaagatgtgtcacctccccgaacccgagctgaacaaggagcggccatcacttcaaatcaaactcaaaatcgaggattttatactccacaaaatgttaggcaaaggaagctttggcaaggtattcctagcggagttcaagaagacaaaccaattcttcgccattaaggcccttaaaaaagacgtggtactgatggacgacgacgttgagtgcacgatggtcgagaaaagggtgctcagtctcgcctgggagcatccttttctcacgcacatgttctgtactttccagactaaagaaaatttattcttcgtaatggagtatctgaacggcggagatctaatgtatcacattcaatcttgccataaattcgatctgagtcgagctaccttctacgcggctgaaatcatcctaggtttgcagttcctccactcaaagggaatcgtctaccgggacctgaaactggacaatatcctgcttgataaggatggacatattaaaatcgcagattttggtatgtgtaaagaaaatatgctgggcgatgctaaaaccaataccttttgcgggacccctgattatatcgcccctgagatccttctggggcaaaaatacaaccactcagttgactggtggtcttttggggtcctcctgtacgaaatgctaattggccagagccctttccacggacaggacgaagaagagctattccattctatacggatggacaacccgttctatcctcggtggctggaaaaagaggcaaaagatcttctggttaaattgtttgtccgcgagcctgagaaaagactgggagtacggggtgatataagacagcatccactgtttcgtgagattaattgggaagaacttgagaggaaagagatagaccctccgttcaggccgaaggtaaagtcgcctttcgattgcagcaactttgataaggaatttcttaatgagaaacctagacttagttttgccgatcgggcattaatcaactccatggaccagaacatgttcaggaatttctcgttcatgaacccaggtatggaaagactgatctcctag

SEQ ID NO: 236724 - DNA, 1746 bp, Artificial Sequence
  Description of Artificial Sequence: Synthetic coding sequence
atggataccaaggatatgaacgaattcgagactgagggcttttttgcactccaccagaggagaggtgcaattaagcaggcaaaagttcatcacgtgaagtgccacgaattcaccgcaaccttcttccctcagccaaccttctgtagtgtttgccatgaattcgtgtggggcctcaataaacagggataccagtgtcggcagtgtaacgcggctattcacaagaaatgtattgacaaagtgatagcaaaatgtaccggctccgccattaactcgagagagacaatgttccataaagaacggttcaaaatcgacatgcctcatcgcttcaaggtctacaactacaagagccctacattctgtgagcattgtggtacactcctttgggggctggcacgtcaaggactgaaatgcgatgcgtgcggcatgaacgtgcaccatagatgtcagactaaagtggctaacttgtgcgggatcaaccagaaactgatggccgaagccctcgccatgatcgagagcactcagcaagccaggtgtctccgggacacagagcagatctttcgggagggcccagtggagatcggcctcccatgctccattaagaacgaggcgagaccgccttgtctgcctacccccggtaaacgagaacctcagggaatcagctgggaatcaccactggacgaggtggataaaatgtgccaccttcccgaacccgagctaaacaaagagcgcccttctctacaaattaaactgaagatcgaagatttcatactgcacaagatgcttggcaagggatcttttggaaaggtattcctggccgagttcaagaagaccaatcagttttttgccatcaaagcactgaagaaagatgttgtgctgatggatgatgatgtggaatgtacaatggtggaaaaacgggtcctgagcttggcctgggagcacccctttttaacacacatgttctgtaccttccagactaaggagaacctcttcttcgtgatggaatatctgaacggaggggacctcatgtatcatatccagagctgtcacaagtttgatctctctagagccactttttacgccgctgagataattctagggctccagtttctacacagtaaaggtatcgtatacagagatttgaagttggataacattctgctggataaggatgggcacatcaagatcgcggactttggtatgtgtaaggagaacatgcttggtgacgctaaaacaaacacattctgcggcacccctgactacatcgcgccagagatcttgctgggccagaagtacaatcacagcgtagactggtggagctttggggtgctcctctacgagatgcttatagggcagagccccttccatggccaggatgaggaggagctatttcatagtattcgaatggacaaccctttctacccccgatggctggagaaagaggccaaggacctcctcgtgaagctgtttgttagggagcccgaaaaacggctgggcgtgaggggtgacatccgacagcatcctttattcagggaaatcaactgggaagaactagagcggaaagagattgaccccccttttcggcctaaggtgaagagccctttcgattgtagcaatttcgacaaggagtttctgaacgagaagcccaggctctcattcgctgaccgcgcactcatcaattccatggaccagaacatgttccgcaatttctctttcatgaatcctggaatggaaagactaattagctag

SEQ ID NO: 236725 - DNA, 1032 bp, Artificial Sequence
  Description of Artificial Sequence: Synthetic coding sequence
atggcttctaactcgtccgatgttaaagaattccttgcgaaagccaaggaagatttcttgaaaaagtgggagtccccggcacaaaacacagcccacctcgatcagttcgagagaatcaagactctcggcacgggcagttttggacgggtgatgctggtcaaacataaggaaactggtaaccactacgcgatgaagattctggacaagcagaaggtagttaagctgaagcagattgaacatacattgaacgaaaaacgtatcctgcaggcggttaatttccctttcctggtgaagttggagttctctttcaaggataatagtaacctgtacatggtgatggagtacgtgcccggtggtgagatgttctcacacctcaggcgtatcggacgtttttctgaaccccacgcaaggttctacgcagcccagattgttctgacatttgaatacctacactccttagatctcatataccgcgatctaaagcccgagaatctgctcatcgaccaacagggatatatacaagtgaccgattttgggttcgcgaagagagttaaaggcagaacctggaccctttgtgggacaccagaatatctcgcccctgagataatcttatcaaaggggtacaataaggctgtggactggtgggctctgggggtcctgatctatgagatggcagcgggttatcctcccttcttcgccgatcagcctatacagatttatgaaaaaatcgtgtcgggtaaggtcagatttcctagccatttctctagcgatttgaaggacctcctcagaaatctgttacaagtggacttaacaaagcggtttgggaacttgaagaatggcgttaacgatattaaaaaccacaagtggttcgctactacagattggatcgccatttaccagcgcaaggtggaggctcctttcatacctaaatttaagggcccaggcgatacatctaattttgacgactacgaggaggaagagatacgcgtatcgatcaatgagaaatgcggaaaggaattctctgagttctag

SEQ ID NO: 236726 - DNA, 1146 bp, Artificial Sequence
  Description of Artificial Sequence: Synthetic coding sequence
atggaatccggctctacagcggcttctgaagaagcacgctcgttaagggagtgcgagctttacgtacagaagcacaacattcaggccttactaaaagacagcatagttcagctttgcacggcacgtccggagcgaccaatggctttcttaagagagtatttcgaacgtctcgagaaggaagaagccaaacagattcagaatctgcagaaggctgggacacgcaccgactcacgtgaggatgaaatcagtcctccaccacctaatcctgttgtcaaggggagaaggcggcgaggtgctattagtgctgaagtttatacggaggaagatgccgcttcctatgtccgtaaagttatcccgaaggactacaaaacaatggcagctcttgctaaggcaatagagaagaacgttctcttctctcacctggacgataatgagagatcagacatcttcgacgccatgttctctgtgtctttcatagcgggtgagactgtcatccagcagggggacgagggcgataatttttacgtgatagaccagggggagaccgacgtttacgtcaataatgagtgggccacctccgtaggagaaggcggtagcttcggggaattggctctcatatacggcacgccgagagccgctacagtaaaagcaaaaacaaacgttaaactctgggggattgatagggattcctacaggcgcattttgatgggatccaccctgaggaagcgcaaaatgtacgaggaatttctcagcaaggtgagcatccttgagagtctcgataaatgggaaaggctgactgtcgccgacgctctggagcccgttcaattcgaggacggacagaaaattgttgtgcagggggaacctggtgacgaattcttcatcatcctggagggcagtgccgcagtcctgcagcgcagatccgagaacgaagaatttgtagaggttggcagactgggtcctagtgactatttcggcgaaatcgccttgctaatgaatcgaccccgtgctgccaccgttgttgctagggggcctttaaagtgcgtgaagcttgacaggcctcgcttcgagagagtcctaggcccttgttccgacatcctcaagaggaacatccagcagtacaatagctttgtgagtctcagcgtatag

SEQ ID NO: 236727 - DNA, 2739 bp, Artificial Sequence
  Description of Artificial Sequence: Synthetic coding sequence
atgagcgcaccaccagtgttacgccctccaagccctcttcttcctgtcgctgccgcagcagccgctgccgcagctgctctagtgcctggaagcgggccagggccagcgccatttcttgcccctgttgccgcaccagtgggaggtattagtttccacctgcaaattggcctgagccgtgagcccgtgctcctgctgcaggactccagtggggactattcccttgcccacgtgagagaaatggcatgctccattgtagaccagaaattccctgaatgcggattctacggtatgtacgataagatcctactctttcgacacgacccaacttcggaaaacatccttcaactggttaaggccgcatctgatattcaggagggcgatcttatcgaggtagtgctctcggcttctgcgaccttcgaggacttccaaatccgccctcacgcactattcgttcattcttaccgagccccagccttttgtgaccattgtggcgagatgctttgggggcttgtgcgccaggggctgaaatgtgaaggatgcggcctaaactaccacaagaggtgcgcatttaaaatacctaacaactgctccggtgtgaggagacgacgactgtctaatgtgtccctgacaggtgtgtctacaattcggacatctagtgccgagctgagcacttccgcgcctgacgagccactgctgcagaagagcccgagcgaatcattcatcgggagggaaaagcgctctaattctcagagttacatcggcagaccgatccacctcgataaaatcctgatgtctaaagtcaaggttccccatacgtttgtgatccactcctacacaaggcccactgtgtgccagtactgtaagaaattgctcaaaggactcttcagacaagggctgcaatgtaaagattgccgctttaattgccacaagcgctgtgcccctaaggtccctaataattgcctgggcgaagtcacaataaatggcgatttattgagccctggcgcagagtctgatgtggtcatggaagagggaagcgatgacaacgacagtgaaaggaatagcggcttgatggatgatatggaagaagcaatggtccaggacgcggagatggccatggccgagtgccagaatgacagcggcgagatgcaggatcccgaccctgatcatgaagacgcaaaccgcaccatcagcccgagtaccagtaacaacatacccttgatgcgtgtagtgcaatcggttaagcacaccaaaagaaagagttctacagtgatgaaggagggctggatggtgcactacacctctaaggatacactgaggaaacgtcattactggaggctcgattctaagtgcattaccttatttcagaacgatactgggtcccgctattataaggaaataccactgagtgaaatcctcagccttgagccagtgaaaacatccgcacttattcccaacggcgcaaatccgcattgttttgagatcaccacagcaaatgtcgtgtattatgtcggtgagaatgtagtgaatccctcatccccatcgccgaacaacagtgtgcttacttccggcgtaggcgcagacgtggcgaggatgtgggaaattgccattcaacacgctctaatgcctgtgatcccgaaagggagctctgtgggaaccgggactaatcttcaccgggacatatcagtaagcatatcagtctcgaattgccaaatccaggaaaacgtcgacatttctactgtgtatcagatttttccagacgaagtcctcggctcaggtcagtttggaattgtgtatggcggaaaacaccggaagacaggcagggatgtggctatcaagatcatagacaaattgcggtttccaaccaagcaggagtcacagcttagaaacgaagtggctatcttacagaacctgcatcatcctggagtggtgaacctggagtgcatgtttgagaccccagaacgcgtttttgtggtgatggagaagttacatggagatatgcttgagatgatactttccagtgagaaaggtaggttgcctgagcacatcaccaagtttctaatcactcagatcctcgtggctctccggcacctgcactttaaaaatatagtgcactgtgatctgaagccagaaaatgtcctgctcgccagcgcagacccgttccctcaggtcaagctctgtgatttcggcttcgcacgaataataggcgaaaagtctttcagacgttctgtggtgggaacccctgcatatctggctcctgaggtgttgcgaaataaaggttataaccgaagtctcgacatgtggagtgtgggagtcataatatatgtgtccctcagtgggaccttcccttttaatgaggacgaggatatccacgaccagattcagaacgcggcatttatgtaccccccaaacccatggaaagaaatttcccatgaggcaatagacctgatcaacaaccttctgcaagtgaagatgagaaagaggtactccgtcgataagactctttctcacccatggctgcaggactatcagacttggctggacctgagagaactggaatgcaaaattggcgaaaggtacattacccacgagtccgacgacctgcgctgggagaagtatgcgggagaacaaggtctgcagtacccaacccacttaatcaacccaagtgcatctcatagtgacactcctgaaacagaggaaactgagatgaaggcattaggggaaagggtatccatcttgtag

SEQ ID NO: 236728 - DNA, 2637 bp, Artificial Sequence
  Description of Artificial Sequence: Synthetic coding sequence
atggctaccgccccatcttaccccgctggactccctggtagcccaggacccggaagtccacctcctcctgggggactggagctccagtcccctcctccgctactcccccagatacccgctcctggctctggcgtgagctttcacatccagattggtctgactagagaatttgtcctcctacccgcagcatctgagttggcccatgtgaaacagctggcatgttcgattgtcgatcagaagtttcccgagtgtggtttttatgggctgtacgacaaaatactcttgtttaaacacgacccgacatctgccaacttattgcagcttgtccgttcatcgggagatatccaggaaggcgatttagtggaggtggtgctctctgcgtccgcgacctttgaagattttcaaatccggcctcacgccctcactgtccatagctaccgtgccccagctttttgtgaccactgtggagagatgctttttgggttggtgagacaagggttgaagtgcgacgggtgcggactgaactaccataaaaggtgcgccttcagtatccccaacaactgttccggagcaagaaaacggcgactgtcaagcacgtcactcgctagcgggcacagtgtgagactaggtacatccgagagcctgccatgtacagccgaggagctgagtcggagtactactgagctgctccccagaaggccaccatcctcttcctcctccagttcagcatcttcatacactggacggccaattgaactggacaagatgctgctgtctaaagttaaagtgccccacacgtttctcatccatagttacactcgccctactgtctgccaggcatgcaaaaaactcctgaaaggactctttagacagggcttgcagtgcaaggactgtaagttcaactgtcacaagagatgcgctacacgtgttccaaacgattgcctgggcgaagctctgatcaatggcgatgtgcccatggaggaagccacggattttagcgaagccgacaagtccgctctgatggatgagagcgaagatagtggcgtaattcctggcagccattcggaaaatgcgctacacgccagcgaggaggaggagggagaaggaggaaaagcgcagtccagcctcgggtacatccctctcatgcgagtggtccaatcagttaggcacaccacgcggaaatcctccaccacattgagagaggggtgggtggtccattatagcaacaaggatactcttcgtaaacgtcattactggagactagactgtaaatgtatcacactgtttcagaataacactaccaacaggtattacaaggaaatccctctgagcgagattcttaccgtcgagagtgctcaaaacttcagcctggtccctcccggaactaatcctcactgcttcgaaattgtgacagccaacgccacgtatttcgtgggcgaaatgcccggagggaccccgggaggaccatcaggacagggagcagaagctgccagaggctgggaaacagctatccgccaggctctgatgcccgtgatacttcaggacgctccctcagctccaggacacgctcctcataggcaagcctcactgtcaatctcagtctcaaactcacagattcaggagaacgttgatattgctacggtgtatcagattttccctgatgaagttttgggctccggccagttcggtgtggtttacgggggaaagcaccgcaagacaggaagggatgttgcggtcaaagtgatcgacaagttgcgcttccccacaaagcaggagtcccagttacgtaacgaggtagctatcctgcagtcgttaaggcatcccggtattgttaatctggaatgtatgttcgagacacccgagaaggtttttgtcgtcatggaaaagctgcacggcgacatgctcgaaatgatactctcctctgaaaaggggcgtctgcccgaacgtctgacaaaatttctcattacccagattcttgtcgctctgaggcatctgcatttcaagaacattgtgcactgcgatctgaaaccagaaaatgttctgctggcatccgctgacccctttccacaggtcaaactttgcgatttcggattcgcccgaatcataggggagaagtcatttcgccgatctgtcgttggaacacccgcatacctcgctccagaggtgttgctgaatcaaggctataatagatccctggatatgtggtctgtgggtgtcataatgtacgtcagcctgagcgggacatttccctttaacgaggatgaggacatcaacgaccagatccagaatgcagcctttatgtatcctgccagcccctggtcccacattagcgcaggagcaattgacctcataaacaacctactgcaagtgaaaatgcgaaagaggtactccgtggataaatccctgagtcacccgtggctgcaagagtatcaaacgtggttagacttgcgggaactcgaggggaaaatgggcgaaaggtacattacacacgaaagcgacgatgtgaggtgggagcagttcgcagccgaacatccactaccaggaagtgggctccccaccgacagagacctgggcggagcctgcccaccacaggaccacgacatgcaaggcctcgccgagcgaattagtgtgctatag

SEQ ID NO: 236729 - DNA, 2637 bp, Artificial Sequence
  Description of Artificial Sequence: Synthetic coding sequence
atggctactgcaccatcatatccggcaggactgcctgggagccccggacccggtagcccgccacctcccggtggtctggaactgcagtccccaccacctctactgcctcagatccccgctccagggtctggagtctccttccacattcaaattggccttacacgcgagttcgtactcttgcccgctgcttctgagcttgcgcatgtgaagcagcttgcatgctcgatcgtcgaccaaaaatttcccgaatgcggcttctacggcctgtatgacaaaattcttttgttcaaacacgaccccacttccgccaatctgctgcaactggtaaggtcgtcaggtgatatccaagagggggatttagtggaagtggtgctgtccgccagcgccacgtttgaagacttccagatccggccacatgctctgactgtgcattcttaccgagctccagcgttctgtgaccactgcggagaaatgctatttgggctggtgcgccagggcctaaagtgcgacggctgtgggcttaattatcataagagatgcgcttttagcatccctaataactgcagtggggctaggaagcgcaggctcagcagcacctccttagcatcaggacattctgtaagattaggcacgtccgaatctctcccctgcaccgctgaggagctatcccgctccactaccgagttgctgccaaggagacctccttcatcgtcatcaagcagtagcgcttcaagctacacaggcagacccatcgagctcgacaaaatgctcctcagcaaagtgaaagtacctcacactttcttgatccattcttatacccgtccaaccgtctgccaagcttgtaagaaactacttaaaggtttgtttcgtcagggcctccagtgtaaggactgcaagtttaactgccataagcgttgtgccacaagggtcccaaatgactgtctgggagaggcactcatcaatggcgacgtgcctatggaagaagcaacagatttttctgaagccgacaaatccgcactaatggatgagagcgaagattccggggtcatccctggatcacactctgagaacgccctacacgcctctgaagaggaggagggcgaggggggaaaagcacagagtagtctgggttatatacccctcatgcgcgtagtgcagtcggtccgacacactacgcgcaagtccagtaccactctcagagaggggtgggtggtgcactactctaacaaagatacgcttcgaaaaaggcattattggcgactggactgcaagtgcataaccctgtttcagaacaataccacaaacagatattataaggaaattccattgtccgaaatacttaccgtggaatcagcgcagaattttagtctggtgccaccgggaaccaaccctcattgttttgaaatcgtaaccgccaatgctacctacttcgtgggtgagatgcctggtggaaccccagggggtcctagtggacagggcgcagaagctgctcgaggttgggaaactgctatcagacaggcactgatgcccgtcatcctacaggatgccccaagcgcgccaggacatgcccctcacaggcaggccagcttgtcgatttccgtatctaactcccagattcaagagaatgttgacattgccactgtttatcagatattcccagatgaagtgctggggtctgggcagtttggagtcgtttacgggggaaaacatagaaagacaggtagggacgtagctgtgaaggtgatagacaaactgcggtttcctaccaagcaggaatcccagttgcgaaatgaggtcgccattctgcagtccttgcgacaccctgggatagtgaacttagaatgtatgtttgaaacacccgagaaggtgttcgtagtgatggaaaaactgcacggagacatgcttgagatgatcctgagcagtgagaaaggccgtctgcccgagcgcctcaccaagttccttatcactcagatattagttgcactgaggcatctacatttcaagaatattgtccactgcgacttaaaacccgagaatgtgttgttggcatccgccgaccctttccctcaagtcaagctgtgcgatttcggattcgctaggatcatcggtgagaaatcatttcgacggtctgtcgttggtacacctgcgtacctggcgcctgaagttctattgaaccagggatacaatcgctcactggatatgtggtcagtaggggttatcatgtatgtgtccctgtccggtacattcccttttaatgaggacgaggacatcaacgaccagattcagaatgctgctttcatgtaccctgcgagtccctggtcccatatctctgccggtgctattgacctcattaataatctactgcaggtgaaaatgaggaagcgatactccgtagacaagtctctgagtcacccttggctgcaagagtaccagacgtggctggacctccgcgaactggagggcaagatgggcgaaaggtacatcacacacgagtctgatgacgtccggtgggaacagtttgccgcagaacaccctctgcctgggagcggactgcccaccgaccgggatttagggggtgcttgccctccccaggatcacgatatgcagggacttgccgaacggattagcgtcctctag

SEQ ID NO: 236730 - DNA, 2166 bp, Artificial Sequence
  Description of Artificial Sequence: Synthetic coding sequence
atgctctttgggctggtgaggcagggtttaaaatgtgatggctgcggcttgaactaccacaagcgctgcgctttttctatacctaacaattgtagtggggctagaaagcggagactgagttctacctccttagcgtcaggccattctgtccggttgggcactagtgagtccctaccatgcacggccgaagagctctcccggtcgaccacggagctcttgccgagaaggcctccaagcagctcaagctcctcatctgcgtcaagttataccggcagaccaatcgaattagacaagatgctgctttctaaggtaaaggtgccgcatacgtttctgattcattcctacactcgccctaccgtatgccaggcctgtaagaagctgctgaaaggcttatttcggcagggcctgcagtgtaaggattgcaaattcaattgccacaagaggtgcgcaacccgcgtgcctaatgattgtctcggcgaggctctcatcaatggcgacgtccctatggaggaagccaccgacttcagcgaagctgataagtcagcgttgatggacgagtcagaggactccggcgtcataccaggaagccactctgagaatgccctgcacgcgtccgaggaagaagaaggtgaagggggtaaggcccagtcttcccttgggtacatcccgctaatgagggtggtgcaaagcgtgcggcataccacccgcaagtcttcgactaccttgcgggagggatgggtagttcactatagcaacaaagacacgctgagaaaacgtcattattggagactggattgtaagtgtattaccttgtttcaaaataatactaccaaccggtactacaaggaaattcccctgtcagagatcctgaccgtagagagcgctcaaaacttctccttggtgccaccgggaaccaatccccattgttttgagatcgtgacagctaatgccacctactttgtcggcgaaatgccagggggtacacctggcggtccttccggccaaggggcagaggcagctcgcggttgggagaccgctatcagacaggccctcatgcctgtgatactgcaggacgctcctagtgctccaggacacgccccacaccgccaggcctccctgtccattagtgtctctaatagccagatacaggagaacgtcgatattgccacagtctaccagattttccccgatgaagtgctcggaagcggccaattcggggtggtgtacggaggtaagcacagaaagactggaagggatgtcgcagtcaaggtgatagataagctgcgttttcctacaaagcaggagtctcagttgcggaatgaggtggcaatacttcagtcgctgcgccacccaggaattgtgaacctggagtgtatgttcgaaaccccggaaaaggtgttcgtcgtgatggagaagctccatggggacatgctggagatgatactgagctcagaaaaaggtaggttaccagaaaggttgaccaaattcctgattacgcagattctggtggccctgcgacatctgcacttcaagaacatcgttcattgcgacctgaaaccagagaacgtgctgctagccagtgccgaccccttcccgcaggtgaagctttgtgatttcggctttgccaggatcattggcgaaaaatcattcaggcgctccgtcgtgggcacacctgcctatctggctcccgaagtgctcctgaatcaaggctacaaccgatcgctggacatgtggagcgtgggagtgatcatgtatgtttctctgagcggaaccttcccttttaatgaggacgaggacatcaacgaccagattcagaacgcagcattcatgtaccctgcttccccctggtcccatatttcagcaggcgcaatcgatttaatcaataacctcctgcaagttaagatgcggaagcggtacagtgttgacaaatcactgagccatccctggctccaggagtaccagacatggttagacctgagggagctcgagggaaaaatgggcgagagatatattactcacgagtctgacgatgtaaggtgggaacagtttgcagctgaacaccctctgccaggttcaggcctgcccactgatcgggatcttggcggagcctgcccccctcaggaccacgacatgcaaggcttggcagaacgaatatcagttctctag

SEQ ID NO: 236731 - DNA, 1482 bp, Artificial Sequence
  Description of Artificial Sequence: Synthetic coding sequence
atgaggagaagacgcgcagctgtagcggctggcttctgcgcttctttcttgctcgggtctgtgctcaatgtgctgtttgccccaggcagcgagccaccaaggcctgggcagtcaccagaaccaagccctgcccctgggcctgggagacgcggaggacgcggagagctggcacgtcagattcgtgccaggtacgaagaggtccagcgatactcccggggtggcccaggtccaggcgcagggcgtccagaacggaggcgcctgatggacctcgcacccggtggcccaggcttgcctagacctaggcctccgtgggctcggccactcagtgacggtgctcctggttggccaccggctcctggaccaggaagtcccggaccagggccaaggctgggttgcgcggctctgagaaatgtctcgggggctcagtatatgggatccggatacacgaaggccgtttatcgcgtgcgcctgcccggtggcgctgcagtcgcactgaaggcagtggacttctctggccacgacctggggagctgtgtcagagagttcggcgtgcggagaggctgctacaggttggctgctcataagctcctcaaagagatggtccttttggagcgcctgcggcatcctaacgttctacaattgtatggctactgctaccaggattccgaagacatcccggacaccctaactacaattaccgaattaggggcaccagtggagatgattcaattgctgcaaacttcttgggaggatcggttccgcatctgtctgagtctcgggagattgctgcaccacttggctcactctcccttgggcagtgtcactctgctggatttccgccctcggcagttcgtgctcgtggacggcgagctcaaagtcacagatctggacgatgcgagggtggaggagaccccttgtgcaggcagcaccgactgcatcctcgaattccccgcacggaactttacgctgccctgctccgcgcagggttggtgcgaaggaatgaatgaaaagaggaacctctacaatgcctaccgcttcttttttacgtacctgctgccccattccgccccaccttcactacggcctttgctggatagcattgtcaacgcaactggggagttggcctggggggtggacgagacactggcacagttagagaaggtgctacacctatatcgatcggggcagtacttgcagaactctaccgcttcctcatctactgagtaccagtgcattccagattctacaatcccacaggaagactatcgatgctggccttcttatcaccacgggtcttgcctgttatcggtgttcaatttggccgaggccgtagacgtttgtgaatcccatgctcaatgtagagcattcgttgtaaccaaccagaccacttggaccggtaggcagctcgtgttcttcaaaacaggttggtctcaggttgtaccggacccgaataagacaacttacgtcaaggcgagcggatag

SEQ ID NO: 236732 - DNA, 2829 bp, Artificial Sequence
  Description of Artificial Sequence: Synthetic coding sequence
atggcctcagatgctgtgcaaagtgagcccaggtcatggagtctgctggagcagctcgggctcgccggagccgatctcgccgcaccaggagtgcaacagcaactggaactggagcgcgaacgccttcggagagaaatacgaaaggaacttaagctgaaggagggagctgagaacctgagacgtgcgacaaccgacctggggaggtccctgggccctgtggagcttctgttaaggggcagctcacgaagacttgacctcctgcatcagcagttgcaagaactccacgcccacgtcgtcctccctgatcctgcagccactcacgatgggccacagagtcctggagcagggggaccgacatgcagtgctaccaacctctcaagggtcgccggtctcgagaagcagctggctattgagcttaaagttaaacaaggcgctgagaatatgatccagacctatagtaatgggtcgactaaagatcgaaaactgcttttaactgcccaacagatgctccaggactccaaaactaagatcgatatcatcagaatgcagttgagaagagcacttcaggcaggtcagctggagaatcaggctgcgcctgacgatacacagggctccccagatcttggtgccgtggagttacggattgaggagctgaggcaccactttcgggtggagcacgcggtcgccgagggtgccaagaacgtcctgaggctcctgtctgccgcaaaggcgcctgatcgaaaagccgtgtctgaagcccaggaaaaattgaccgaaagcaaccagaagttaggcctattgcgcgaggcactagaaaggcgtctgggcgagttacctgccgaccatccaaagggacgcttgctgcgggaagagctggctgccgcaagtagcgcagccttttcaacgcgtctcgctggacctttccctgccacacactactcaactttgtgtaagcctgcgcctctgacagggaccctggaagtgcgggtcgttgggtgccgcgatctcccagagacaatcccctggaatcctacccccagtatgggcggacctgggacccccgattccagaccccctttcttatccaggccagctagaggcttgtactctcggtccggcagtctgtccggccgtagttctttgaaggccgaggccgagaacacatcagaggtgtccacagtcctgaagctcgacaatactgttgtgggtcagacctcctggaaaccatgcggaccaaatgcatgggaccagtcttttacattggagctggaaagagctcgagaactagaactagccgttttttggagggatcagcggggattgtgtgcgctgaagttcctgaaactggaagacttcctcgataacgagcgccatgaggtgcagctagatatggagccacagggttgcctcgtcgccgaagtcacctttagaaatcccgtgatagaacggataccgagacttcgccgacagaagaagatcttttcaaaacagcagggtaaggcatttcagagagctcgtcaaatgaatattgatgttgcaacttgggtccggctgctgcgcagactgattcctaatgcaacggggacgggtactttctcacccggagcgtccccaggctctgaagctcgaacgactggagatattagtgttgaaaaactcaacctcggcactgattcggattctagcccccagaagtcaagcagagacccaccgagctcaccgtcctcactttcctcacccatccaagagagcaccgcacctgaactcccatccgaaacccaggaaacccctgggcctgccctgtgctcacccctgagaaaaagtcctctgaccctggaagatttcaagtttttggccgtgctcggaagggggcactttgggaaggtgctgctaagcgaattccgacctagcggtgagctgtttgccatcaaagcgctcaagaagggggatattgtcgccagagatgaggtagaaagtcttatgtgtgagaagagaatactggctgctgtgacgtctgcaggccacccatttctcgttaatctgtttggctgcttccagacgcctgaacacgtgtgcttcgtcatggaatattcagcaggaggtgatttaatgctgcacatacacagcgacgtgttttcagagcctcgcgctatcttctacagcgcctgcgtggtgcttgggttgcagtttctgcatgagcataaaattgtgtaccgggatctcaaactggataacttgctcttggacaccgaaggctacgtgaaaatcgcagattttggcctgtgcaaggaaggaatgggttatggcgacaggacctcgactttttgcggaactccagaattcttagcacccgaagtgctgacggatacaagttacactcgggcagtcgactggtggggcctgggggtcttgctgtatgagatgctcgtgggagagtccccttttccaggcgacgatgaagaggaagtgtttgactccatagtaaatgatgaggtgagatacccacggtttctgtctgccgaggctatcgggatcatgagacgactgctccggagaaacccggaaagaagacttgggtcatcagaaagagacgctgaagatgtgaagaagcagccatttttccgaactctgggatgggaagcccttttagctagaaggcttccacccccttttgttccgaccctctccggtcggaccgatgtgtctaattttgatgaggagtttacgggcgaggccccaactctgagccctccccgtgacgctcgtccgctcactgccgcagagcaagccgcattcttggacttcgatttcgtggctggcggatgctag

SEQ ID NO: 236733 - DNA, 2847 bp, Artificial Sequence
  Description of Artificial Sequence: Synthetic coding sequence
atggctgaggctaacaacccttccgaacaagaactcgaaagtgaaccgagaagttggtctttgttggaacaactcggtctcgccggagcagacttagctgctcccggtgtgcagcagcagttagagctcgaacgggagaggctgcgacgtgagataaggaaagagctcaagttgaaggagggtgccgaaaacctgagaagggccacaacagacctcggacggagcttggggcctgtagagcttcttctacggggttcatcgaggcgcttagacctgcttcaccagcagctacaggaactgcatgcgcacgtggtgctgcctgatccagcggcaacacatgatgggcctcaaagccctggcgctgggggtcccacttgtagcgccaccaacctttccagagtggccggactcgaaaaacagcttgcaatcgagttgaaagtaaaacaaggggcagaaaacatgattcagacatactctaatggcagcacaaaagaccggaagctgctgctgactgcccagcagatgttacaggatagtaagaccaagatagatatcatccgcatgcagcttcgcagagccttgcaggcaggtcagctagaaaatcaggccgctcctgatgatacacaagggtcaccagatcttggggcagtcgaactgcgaatcgaggagctcaggcaccacttccgcgttgagcacgcagtggcagaaggggctaagaacgtcctgcgactgctgtctgctgctaaggccccagacaggaaggccgtctccgaagcacaggaaaagctcaccgagagcaaccagaagttgggcctgttgagggaggcactggagcggaggcttggtgagctgcccgcagaccatcccaagggacgccttcttcgggaggagcttgccgctgcctctagtgcggcatttagtacacggctggcaggcccattccccgcaacgcactactccacactgtgcaagccagctcccttgacaggcacccttgaggtgagggtagtaggctgtcgcgatctccctgagaccattccctggaatcccaccccctccatggggggtcccggaacccccgatagtcgccctccctttctctccaggcctgccagggggctttacagtagatcaggatctctgagcgggagaagttctctaaaggctgaggctgagaacacttccgaggtctccaccgtgctcaagctcgacaacaccgtagtggggcagacttcctggaagccctgcggcccaaatgcctgggaccagagcttcacgcttgagttggaacgtgctcgagaattggagctggctgtgttctggagggaccagcgaggtctctgcgctctgaagttcttgaaactggaagacttcttggacaacgagaggcacgaagtgcagcttgacatggaaccacagggttgtctggtcgccgaggtgacctttcgcaaccccgtcatcgagcgaattcctcggttacgaagacagaaaaagatcttcagcaaacagcagggcaaggccttccaaagagcccgtcaaatgaacattgacgtcgcgacttgggtgcgactgctgaggcggctgatccctaacgccactgggacagggacattctcacccggtgcctctccaggaagcgaagctcgcaccaccggagatatttccgtggaaaaattgaaccttggtactgactccgacagctcacctcagaagtcctcaagggatccaccaagcagtccaagctccctctcctcaccgattcaagaaagtacggctcctgagctgccaagcgagacacaagagaccccaggaccggctctgtgcagcccgctgaggaagtctccattaacccttgaagatttcaaattcctggcagtgttaggacgaggtcattttggcaaggttctgttatcagagtttagaccgagcggtgaactgtttgcgattaaagcgctcaagaagggagacattgtggcgagagacgaagttgagtcactgatgtgtgagaaacgcatcctggccgctgtgacaagtgctggccatccttttctggtgaacctgttcggttgctttcaaacacctgagcacgtgtgttttgtaatggaatatagcgcgggaggtgatctcatgctccatatccacagtgacgtgttctctgaaccacgcgcaatcttctattccgcctgcgttgtgctggggcttcagttcctgcacgaacataaaatcgtgtacagggatctaaaactggacaacttgctcctcgacaccgaggggtacgtgaagatcgccgacttcggcctctgcaaggaaggaatgggttacggcgatagaacttccacattctgcggcacccccgaattccttgctcctgaggtcctcacggataccagttacactagagccgtggactggtggggcctgggcgtcctgctgtacgaaatgcttgtgggcgagtcccctttccctggagatgatgaggaagaggtgtttgactccatcgtcaacgacgaagtcaggtatcctcgctttctgtccgccgaggccattggaatcatgcggcgattactgcgccgaaatcccgagaggcggctggggagcagcgagagggatgcggaggacgtgaagaagcagccatttttcagaactcttggctgggaggcgctgctggcacgtcgcttgcccccaccttttgtccctactctgagcggcagaacagatgtgagtaactttgacgaggagttcaccggtgaggccccaactctgagccctcctagagatgcgcgtcccctcaccgccgcagagcaggcagcctttctcgactttgactttgtggccggaggctgttag

SEQ ID NO: 236734 - DNA, 1815 bp, Artificial Sequence
  Description of Artificial Sequence: Synthetic coding sequence
atggcctctaatcctgagcggggagagatcctgctgaccgagctgcagggggattcacgatccctcccgttctctgaaaacgtgtctgcagtgcagaagctcgatttctctgataccatggtacaacaaaaacttgatgacattaaggataggattaagcgcgagattaggaaggagctgaaaatcaaggaaggcgcagaaaatttgcgcaaggttaccaccgataaaaagtctttggcctacgttgacaacatcttgaagaaatcaaataaaaaattagaggaactccatcataaattacaagaacttaacgctcacatcgtcgtctcagatcctgaagatattactgattgtccccgtacacctgacacgccaaataatgaccccaggtgtagcacctccaacaatcggcttaaggctctgcagaagcagcttgacatagagctgaaggtgaaacaaggagctgaaaatatgatccaaatgtattcaaatgggtcatccaaggacagaaaactgcacggcacagctcagcagttattacaggactccaaaaccaaaatcgaagtaattcgtatgcaaatcctccaagctgtccagaccaacgagctggcttttgacaacgcaaagccagtcatctcaccgctcgagcttaggatggaggaactgaggcatcacttcaggatcgaattcgctgtggctgaaggtgctaaaaatgtcatgaagttgctgggttccggtaaggtgaccgataggaaagccctgtctgaggcgcaggcccgtttcaatgaatcttcccaaaagttagacttgctcaaatattccctcgagcagcgcctcaatgaggtgcctaaaaatcaccccaaatctagaatcatcatcgaagaactgtctctggtagccgcatcccccaccttgagccctagacagagtatgatttccactcagaatcaatatagtactctctccaagcccgcagcactcactggcactctggaggtccggctcatgggatgccaggatattttggaaaatgttcctggcagaagtaaagctacctccgtggcccttcccggatggtctccttctgaaacccgctcatcctttatgagccgaacctccaagagcaaatctggtagctcccggaacctcctgaagaccgatgacctgagcaatgatgtctgcgcagtgcttaagttggacaataccgtcgtcggtcagacctcttggaagccaatttcaaatcagagctgggaccagaagtttacactggagcttgaccgcagtagggagctggagatctctgtgtattggcgggattggcggtcactgtgcgcagtcaagtttctcaggctcgaggacttcttggataaccaaaggcatgggatgtgcttgtacttggaacctcagggtactctttttgcagaggtgacctttttcaaccctgtgatagagagacgtcctaaacttcagcggcagaaaaaaattttctcgaagcagcagggcaagacatttttacgggctccccagatgaatattaatattgctacctgggggcgactggtgaggagggccataccaaccgtcaaccactccggcacgttcagcccacaagcaccggtaccgactacagtcccagtggtagatgtgcggatcccacagttggcccctccggctagatacgtaagcgagattctgtcaattagctacacgaagttgctggggcatagttacgtgcttattatagctggcgtcctctccctggcgtttttcccctcttccatactcaaagttgtgttctgtctgctgaaaaagtag

SEQ ID NO: 236735 - DNA, 2484 bp, Artificial Sequence
  Description of Artificial Sequence: Synthetic coding sequence
atgattcagatgtacagtaatggttcatccaaggatcggaaactgcacgggaccgcccagcagttgctccaggatagcaaaacaaagattgaggtcatccgtatgcagattctgcaggcagtgcagaccaacgaactggcctttgataatgccaagccagtgatttcccccctggaacttcgcatggaggagctgagacaccacttcagaatagaattcgctgtcgcagagggcgctaagaacgtgatgaagttgctcggtagcggaaaggtgacggatagaaaagccctctcagaggctcaagcgcgttttaacgaatcaagtcagaaactagatctgctcaaatatagcctggagcagcgtctgaatgaagtgcctaagaatcaccccaagtctcgcatcataattgaggaactttccctcgtagctgccagtcctacattaagcccaaggcaaagcatgatctccactcagaaccaatattcaacactcagcaaacccgctgccctgaccggtaccctggaagtgaggctgatgggttgccaagatattctggagaatgtccctggacgaagcaaagccaccagcgtggctctcccgggttggtctccctccgaaaccagatcttccttcatgagtaggacctcaaaaagtaagtcaggaagcagcaggaatctgctcaaaacagacgatctttcgaacgatgtatgtgccgtgcttaagttggacaacacagttgtcggccagactagctggaagcctatctccaaccagtcctgggatcagaagttcacattggaactggacaggtccagagagttggagatcagcgtgtattggagggattggaggagcctctgcgctgtcaaattcctgcgacttgaggacttcctggataaccagcggcatggcatgtgcctgtaccttgagccacagggtacactttttgcagaagtcactttctttaatcccgtgattgaacgacgcccaaagctgcagaggcagaaaaagattttcagtaagcagcaaggaaaaacatttctgcgtgctccccagatgaacattaatatcgctacctggggccgtctcgttaggcgcgctatccctaccgtaaaccattctgggacattttccccgcaagcaccagtcccaaccacggttcccgtagtagatgttcgcatccctcagctggctccgcctgcaagtgatagtacagtgaccaaactggatttcgatctggagccagaacctccaccagcccctccccgagcctcttccctgggcgaaattgatgagagctcagaactacgggtgctcgatatcccagggcaggattccgagaccgtgttcgacatccagaacgatcgtaacagcattctccctaaaagccaatctgaatacaagccagatacgccacaaagtggcttagagtactcaggcatccaggagttagaggataggcgttctcagcaaaggttccagttcaatctgcaagacttccgatgttgcgcagttttaggcagaggccactttggaaaggttctgctggctgagtataagaataccaatgaaatgtttgccatcaaagccctcaaaaaaggggatatcgtggccagggatgaagttgattctctgatgtgtgaaaagcgtatcttcgagaccgtaaattcagtgcgtcacccgtttttggtaaacctgttcgcctgtttccagaccaaggaacatgtctgtttcgtaatggaatatgcagccggaggagacttgatgatgcatatccatacagatgtcttctccgagcctcgtgcggttttctacgccgcatgtgtggtgctggggcttcagtacctgcatgagcacaagatcgtctatcgagaccttaagctggacaacttactgttggacaccgaaggcttcgtgaagattgcagactttggattatgtaaggaaggcatgggatacggtgatcggacaagtacattttgcggcacccccgaattcctggcgcctgaagttcttacagaaacaagctatactagggctgtcgactggtggggactcggagtcctcatttacgagatgttggtgggcgaatcgcccttcccaggagacgacgaagaagaggtcttcgactcaatagtgaatgacgaagtgcgctatccacgcttcctatctactgaagcgatctctattatgaggcggctgctcagacggaaccccgagaggcgacttggggcttctgagaaggacgctgaggacgtcaaaaaacacccgttcttccgactgatcgactggagcgccctgatggacaagaaagtcaaaccaccttttattccaaccatccgcggacgcgaggacgtctccaactttgatgacgaatttacatcggaggcgcctatactgacgccgccaagggaaccccgtatcctcagcgaggaggaacaggagatgtttcgagactttgactacattgctgattggtgttag

SEQ ID NO: 236736 - DNA, 2811 bp, Artificial Sequence
  Description of Artificial Sequence: Synthetic coding sequence
atggcttccaaccccgaacgaggagaaatcttgctgactgaactgcagggcgactctcggtccctgcccttctctgaaaacgtgtcggctgtgcagaaactggatttctccgacacaatggtacagcaaaagcttgacgatatcaaagatagaataaagcgtgaaatccgcaaagaattgaagattaaggagggagccgagaatctgcgcaaagtcactaccgataagaagtcattagcctatgtagataacattttaaaaaaaagtaacaaaaaactggaagaattgcatcacaaattgcaggaattaaacgcccatatcgtagtgagcgacccggaggacatcacagattgcccaaggacccccgacactcctaataatgaccccaggtgctcaacctctaataatagactgaaggccctgcaaaaacagctcgacattgaattaaaggtgaaacagggggcagagaatatgattcagatgtactccaatggatctagtaaggaccgtaaactgcacggtacagcacagcagctacttcaggacagcaagacaaagattgaggtgataagaatgcagatccttcaagctgttcagaccaacgagctggctttcgacaatgctaagcccgtaatcagcccgctggagctgcgtatggaagagctaagacaccacttccgaatagagttcgccgtagccgaaggagcgaaaaatgtgatgaaacttctgggctctggcaaagtgaccgacagaaaggctctgtccgaagcccaagcgagattcaacgagtccagccagaagctggacttgttgaagtactccttagagcagaggttgaatgaagtccccaagaatcatcctaagtcacgtattattatcgaggaattgtcgctcgtggccgcaagtcctacactgagccctcggcagagcatgatcagtacccagaatcagtacagcaccttgtcgaagcccgcagccctgactggtacccttgaggtgaggttaatgggttgccaggacatacttgagaatgtgcctggaaggtcgaaagctaccagcgtcgccctccccggatggtctccgagcgaaacccgcagcagcttcatgtcaagaactagcaagtctaagtctggaagttctcgcaacctcctcaaaactgacgatctgtccaacgatgtttgcgccgtgctgaagctggacaacacagtggtagggcagaccagctggaagccgatcagcaatcaatcctgggaccagaaattcaccttagaactggaccgggttacttttttcaaccctgtgattgagcgcaggcctaaacttcagagacaaaaaaagatcttttctaagcagcaggggaagacgttcctgcgagccccacagatgaacattaacatagctacgtggggacggctcgtaaggagggcaatccctacagtcaaccatagtggtacctttagccctcaggctccagtccctacaaccgttccggtggtcgacgtgcgcattccccagctggcccctcccgcttctgattccaccgtgacgaagttggactttgatcttgaacctgaacctccccctgccccaccccgagcaagctctctcggagaaatcgacgagagctctgagttacgcgtgctcgacattccaggacaagatagcgagacggtcttcgatatccagaatgatcgtaactctatcctcccaaaatctcaaagcgaatacaagccagacacaccgcagagcggactggagtattcaggcatccaggaacttgaggaccgcaggtcccagcagcggtttcaattcaatctacaggatttcaggtgttgtgctgtgttaggtcggggtcacttcggtaaggtcctgcttgcggagtacaaaaatacaaacgaaatgttcgcaattaaggccctgaaaaaaggggacatcgtggcaagagacgaagtggacagcctaatgtgtgagaaaagaatattcgaaacagttaatagcgtgagacacccttttctcgtcaacctgtttgcttgttttcaaacaaaagagcacgtgtgcttcgtgatggagtatgccgcagggggagatctgatgatgcacatacacactgatgttttttccgaacccagggccgtgttttacgctgcgtgtgtagtcctcggactgcaatacctgcatgagcacaagatcgtgtatcgggacctgaagctggacaacctgctgcttgataccgaggggttcgttaagatcgctgacttcggcctgtgcaaggagggaatgggatacggggaccggaccagtacgttttgtggaactcccgaatttctggccccagaggttcttacagagactagttatacaagagctgtggattggtgggggctgggcgtgctgatctatgagatgttggtgggcgagagtccatttcccggtgacgatgaagaagaggttttcgactcaatcgtcaatgatgaagttcgctatcctcgcttcttgtcaaccgaggccattagtatcatgagacggctgttaaggcgcaatcccgagaggagactgggagcaagcgagaaagatgcggaggatgtcaaaaaacaccccttcttccggctgatcgattggtctgcactgatggataaaaaagtcaagccgcctttcatcccgaccattaggggaagggaagatgtgagtaacttcgacgatgaatttacaagtgaggcccctattctgacaccaccgagagaaccaagaattctttctgaagaggagcaggaaatgtttcgcgattttgactacatcgctgactggtgttag

SEQ ID NO: 236737 - DNA, 2955 bp, Artificial Sequence
  Description of Artificial Sequence: Synthetic coding sequence
atggcaagcaacccagaacggggagaaatcttgctcaccgagctgcagggggattcgagaagtttacccttctccgagaacgtgagcgctgtgcagaaattggacttctccgatacgatggttcagcaaaagcttgatgatataaaagatcggattaaaagggagattcgtaaggagctgaaaataaaggagggggctgagaacctgcgtaaagtcaccaccgacaagaagagtttggcctatgtagataatatattaaagaaaagcaataagaagctggaggaactgcatcacaaacttcaggaactcaacgcccacatcgtggtttctgatccagaggacataactgactgtcccaggacccccgatacgcctaataatgatcccagatgctctacaagtaacaaccgactgaaggcccttcagaaacagctggacattgagctgaaggtcaaacagggcgctgagaacatgatacagatgtacagtaacgggtcttcaaaggaccgtaagctgcacggcacagctcagcagctgctgcaggactctaagaccaaaatcgaggtgatcaggatgcagatcctccaggcagtgcagacaaacgaactggcattcgacaatgcaaagccagttatctctcccttggagctccgcatggaagaactgagacatcatttccggatagagttcgcagttgcagagggggcaaagaacgtgatgaaactgctgggatccggtaaggtcacagatcggaaagcattgagcgaagcacaagcacggttcaatgaaagttcgcagaagttagatctgcttaagtattctctggaacagcgcctaaatgaagttcccaaaaatcacccgaaaagcaggatcatcattgaggagctgtcccttgtggcagcctcccctaccctgtccccgcgacagagtatgatcagcacgcagaaccaatattctacactgtctaaacctgccgctctgacaggaaccctggaggttagattgatgggatgccaggacatcctggaaaacgtgccagggcgttcgaaagctacgagcgtcgcactacctggatggtcgccctccgagacccgtagttcttttatgtcccggacaagcaaatcaaagtctgggtccagccgaaatctgcttaagacagatgacttgtccaatgacgtctgtgcggtcttaaaactggataacacggtggtcgggcagacatcatggaaaccaatttctaatcagtcatgggatcaaaaattcacattggagcttgacagatctcgggagctggaaattagtgtgtactggagggattggcggtctctgtgtgccgtcaagttcctgcgcctggaagattttcttgacaaccagaggcacggtatgtgcctctatctggaaccacaaggaactctgtttgcagaagtaaccttttttaatccagttatcgaacgaagacccaagctgcagcggcagaaaaaaatctttagtaagcagcagggtaagacattcttgagagctccccagatgaatatcaacatcgctacgtgggggagactggtaaggcgcgctatcccaaccgtcaaccatagtggtacgtttagtccccaggctccagtgccaactactgtccccgtggtggacgtaaggattccacagttggctcccccagcaagcgactctacagtgaccaagctggacttcgacctcgagcctgaaccccctcccgctcccccacgtgcaagttctctgggtgagattgatgagtcctctgagctccgggtcctcgacatccctggtcaggactctgagaccgtgttcgatattcagaatgacagaaacagtatcctccccaagtcgcagtcggaatacaaacctgataccccacaatcaggcctggagtattcagggattcaagaattagaggatcggagaagtcagcagcgattccagtttaacctccaggatttcagatgctgcgccgtgctgggcagagggcactttgggaaggtcctgctcgcagaatataagaataccaacgaaatgttcgcaattaaagcacttaagaagggggacatcgtggcgcgagatgaggtggacagcctcatgtgtgaaaagcgcatctttgaaaccgttaattctgtgcgccacccttttctggtgaacctctttgcttgtttccagacaaaggaacatgtttgctttgtgatggaatatgcggctggcggtgatctaatgatgcacatccacaccgacgtgttcagcgaacctcgtgctgtgttttacgcggcttgcgtcgtcctgggcttgcagtatctgcacgagcataaaatagtgtatcgagatctgaaattggataatctgctcttggataccgaggggtttgtgaaaatcgccgatttcggcctctgcaaagagggtatgggatacggcgaccggacatctactttctgtggtaccccagaattcctggccccagaggtgctcacggaaacctcatatactagagccgtggattggtggggactcggcgtgttgatctacgagatgctggttggggagtcacccttcccgggtgatgatgaggaagaagtgttcgactctatcgtgaacgacgaggtccgataccccagatttctctcaacagaagccattagcatcatgcggagactcctgcgcaggaacccagagcgaaggctgggggctagcgaaaaggacgcggaggatgtcaagaaacacccctttttccggctgatcgattggtcagccctgatggataaaaaggtgaaacccccattcattcccaccattagaggaagagaagatgtgagcaattttgatgatgaattcaccagcgaagccccaatcttgaccccaccaagagagcctcgaatcctctcggaggaagaacaggagatgttccgtgattttgactatattgccgactggtgttag

SEQ ID NO: 236738 - DNA, 636 bp, Artificial Sequence
  Description of Artificial Sequence: Synthetic coding sequence
taagaagaactaagacatcatttccggattgagtttgctgtggctgaaggtgcaaaaaacgtcatgaaactgctgggctcaggcaaggtcaccgatcgcaaagctttgagcgaggcacaagccagattcaatgagtccagtcaaaagctcgatttattgaaatactccctggagcagagattgaatgaagttcctaaaaatcacccaaagtcccgtatcattattgaggaactcagtctggtggcggcatctccgactttgagtcctaggcagagtatgatctctacccaaaaccagtactccaccctgagcaagcccgcagcgctcaccgatgacgtgtgtgccgtgctgaagctagacaacaccgttgtggggcaaacatcgtggaagcccataagtaaccagagctgggatcaaaaattcactctggaactcgatagatcaagagagctcgagatctccgtatattggagagactggcgttccttgtgcgccgtgaaatttttgcgtttagaagactttctggacaaccagcgtcacggaatgtgtctctaccttgaaccccagggaacactgtttgcagaggttactttctttaaccccgtgatagagcggagacccaaactgcagagatag

SEQ ID NO: 236739 - DNA, 198 bp, Artificial Sequence
  Description of Artificial Sequence: Synthetic coding sequence
tagggcttcgtcaagatcgcagacttcggcctgtgtaaagagggaatgggctatggcgaccgaacctccactttttgcggcacgcctgagtttcttgcccctgaagtgttgacggagacctcttataccagagctgtggattggtggggactcggggtgttgatatatgaaatgctcgtgggagaaacaagcgtctag

SEQ ID NO: 236740 - DNA, 1977 bp, Artificial Sequence
  Description of Artificial Sequence: Synthetic coding sequence
atgaactccacacttgaggtacggctgatgggctgccaggatattctggaaaacgtccctggccgttctaaggccacctcagtggcattaccgggttggagtccatcagaaacacggagctcattcatgagtcgcacaagcaagtctaagagcgggtcttcccgcaatctcttgaagaccgatgatctctctaatgacgtgtgcgccgtgctaaaactggataataccgtcgtgggtcagacatcctggaagcctatctctaatcagtcttgggatcagaagttcacattggagttggatcgaagtcgcgaactggagatatccgtctactggagagattggagaagcctgtgtgccgtcaagttcctgcgtctcgaagactttctggataaccaaaggcacggaatgtgcctttacctggaaccacagggcactctgtttgctgaggtgactttttttaatccagtgatcgaacggaggcccaaactccagaggcaaaagaagattttttccaagcaacaagggaagacctttttgcgcgctccacaaatgaacataaacatcgcgacatggggcaggctcgtccggagagccatccctacagttaaccattccggaaccttctccccgcaagcccctgttcccacgaccgtgcccgtggtagacgtcaggatcccacagctggccccaccagcctctgatagcaccgtgaccaaactggacttcgatctcgagcccgagccaccacctgcaccccctcgcgcatcgagtctgggagagattgatgagagctcagagcttagagtgttggatatcccaggccaagactccgagaccgtatttgatattcagaacgatcgcaactcaattctgcccaaatcacagtccgagtacaagcctgacactccccagtcaggtctcgagtactctggaattcaggagctggaggaccggcgaagccagcagaggtttcaatttaatctgcaggacttcaggtgttgcgcggtcttaggcaggggccattttggaaaggtcctgttagccgagtacaaaaatactaatgaaatgttcgctattaaggcccttaaaaagggggatatcgttgcgagagacgaagtagattcgctcatgtgtgagaaacgaatctttgagactgtgaattctgtgcggcatccatttctcgtcaatttgttcgcttgcttccagaccaaagaacacgtgtgcttcgttatggagtacgctgccggtggggatctgatgatgcacatccatactgacgtcttctccgagccacgtgccgtgttttacgcggcatgtgtggtgctgggcctgcagtatctgcatgagcacaagatcgtgtaccgcgatttgaaacttgacaacctgcttctggatacggagggtttcgttaagattgctgacttcgggctgtgtaaggagggaatgggctacggggatagaacctctaccttctgtggaacccctgaatttcttgcaccagaagtccttaccgaaacatcttacactcgcgctgtcgactggtgggggctgggagtgctcatctacgaaatgctggtgggcgagtcccctttccccggagacgatgaggaagaggtgtttgatagcatcgtaaacgacgaagtgcgctaccccagattcctttctacggaggcgatttctattatgagacggctgctgcgcagaaatcctgagaggcgcctgggtgcttctgagaaggacgccgaggacgtcaagaagcatcccttctttcggttgatcgactggtccgcgctcatggataagaaggttaaacctccattcatcccaacaatacgcggtcgggaagacgtttcaaacttcgacgatgagtttaccagcgaggctcccattcttaccccaccgagggagccccgaatcctgagtgaggaggaacaggaaatgtttagagattttgactatattgctgattggtgttag

SEQ ID NO: 236741 - DNA, 336 bp, Artificial Sequence
  Description of Artificial Sequence: Synthetic coding sequence
atgcacattcacaccgatgtcttctccgaacccagggccgttttttatgccgcttgtgtagtgctgggattacagtatctgcacgaacataagattgtatatcgagacttgaaactcgacaacttgctgctcgataccgaaggatttgtgaaaatcgctgacttcggactgtgtaaggagggtatgggatacggcgaccgcacctctaccttttgcggaaccccagaattcttggccccagaagtgctgactgagacatcatacacaagggcggtagactggtggggactcggcgtgcttatttatgagatgttggtgggcgagacatctgtatag

SEQ ID NO: 236742 - DNA, 2670 bp, Artificial Sequence
  Description of Artificial Sequence: Synthetic coding sequence
atggaggaaggagcaccgcgacaaccagggcctagccagtggcctcccgaggatgagaaagaggtcattcgccgagctattcagaaagaacttaaaatcaaagaaggcgtcgagaatctgagacgcgtggcaacagatcggagacacttggggcacgttcagcagctgctgcgctcttccaacagacggcttgagcagctgcacggagaattgagggagctgcacgcacggatcctgctgcccggacctggacctggacctgctgagcccgtagcctccggcccacgcccttgggctgaacaactccgcgctcgtcacttggaagcactcagaagacagctgcacgttgagctcaaggtgaaacaaggcgctgagaacatgactcatacttgcgcaagcgggacaccaaaagagaggaaactcctcgctgctgcccagcaaatgctgagagactctcaattgaaagtggcgttgctgaggatgaagatctccagcctggaggcatcaggcagtcccgagccaggcccagaactgttggctgaggaactgcaacatcgcctccatgttgaggccgctgtggctgaaggagcaaagaacgtagtcaaattgctgtcctctagaagaacccaggatcgcaaggctttagctgaagctcaagcacaactccaggaatcctcccaaaagttggacctgttacggttggcgctggaacagctcctcgaacagttgccccctgcgcaccctctgcggagtcgggtaactcgggaactgcgcgctgcggttccagggtatccccaaccttcaggcactcccgtaaagcctaccgccctgactggcactctgcaggtccgtcttttggggtgtgagcagctattaactgccgtccccggaaggtcacccgctgcagccttggcttcttcaccatcggagggttggctgcgcaccaaggccaaacatcaacggggacgtggagagctcgccagcgaggtcctcgccgtacttaaggtggacaaccgggtggtaggccagactgggtggggtcaggtggccgaacaatcctgggaccagacctttgtcattcctctcgagagggcccgtgagttggaaatcggcgttcactggcgagactggcgccagctttgcggggtggcttttctgaggctggaggatttcctggacaacgcctgtcaccagttatctttatctctggtcccacagggtctgctttttgctcaagtgacgttttgcgacccagttattgaacgtcggcctagactgcagaggcaagagaggattttttccaaacggcgtgggcaggattttttaagagcaagccagatgaacctggggatggctgcgtggggcagactggtgatgaacttgctccctccttgctcctcaccatccactatttcccctcccaaaggatgtccgagaaccccaacaacactgcgcgaagcttccgatccggctacaccgtcgaactttctccccaagaaaactccgctgggcgaagagatgactcccccacccaagcctcccaggctgtaccttccacaggagcctactagtgaggaaacgccgcgtacaaaacggccacatatggaacctcgcacccggcgagggccaagtccgcctgcatctcccacgcgcaaaccaccacgcctgcaggatttcagatgtctggccgtgctgggacgtggtcactttggcaaggttctcctggtgcagttcaaagggacgggtaagtactacgccattaaagccctgaaaaagcaagaggtcctgagtcgtgacgagattgaaagtttgtattgcgagaaacggatattggaagccgtaggttgcacaggccacccattcctgcttagcctattagcctgctttcagacgtcctctcacgcctgttttgtcaccgagtttgtgcccggaggagatctgatgatgcagatccacgaggatgtgttccctgaacctcaggctcgcttttatgtagcatgtgtggttctgggccttcagttcctccacgagaagaagattatttatcgtgacctaaaactagacaacctcttattggatgctcaggggttcctgaaaattgccgactttggcctgtgtaaagagggtatcggtttcggcgacaggacgtccactttttgcggtacccccgagtttttggcccctgaggtgcttacccaggaagcatacacccgagccgtggactggtggggcctcggcgtgctgctgtacgagatgctcgtaggagagtgtcccttcccaggagatacagaggaggaagtcttcgattgcattgttaatatggacgccccttatccaggcttcttatctgtgcaagggctggaatttatacagaaactgctccagaagtgtccagaaaagaggctgggcgctggagaacaggatgcagaagaaatcaaggtccagcccttcttccgtacaaccaactggcaggccctcctggcaaggactattcagcctcccttcgtgccaaccctctgcggccctgcagacctgcgctatttcgaaggcgagttcacaggcctgccaccagccctgactccgcctgcccctcattcactgttgaccgcgagacagcaggccgctttccgagactttgacttcgtcagcgaacgctttctggagccatag

SEQ ID NO: 236743 - DNA, 1725 bp, Artificial Sequence
  Description of Artificial Sequence: Synthetic coding sequence
atgcgacgtctgagctcatggcgcaaaatggccactgccgaaaagcagaagcatgatggtcgcgtgaaaatcggacattatattttgggagatacactgggcgtcggaacattcgggaaagttaaagttggtaagcacgaattaacaggccacaaagtggctgtgaagatcctcaatcgacagaagatacgcagtctggatgtggtcggaaagattaggcgcgagattcagaacctgaaattgtttcgccatccccacattattaaactgtatcaagtcatttctacaccaagcgacatatttatggtgatggagtacgtcagtggcggagagctgtttgactatatctgcaagaacgggagaaagagcgatgtccctggcgtcgtgaagacaggatctactaaagaactcgacgagaaagaaagtcgaagacttttccagcaaatattgtctggcgtcgattattgccacaggcacatggtggtgcacagggacctcaaacctgagaacgtattgctggatgcacacatgaatgctaaaattgcggacttcgggttgtctaacatgatgtcagatggagaatttctccgtaccagttgcgggtccccaaactacgccgctccagaggtcatcagtggcagactctatgcgggaccagaagtagatatttggtctagtggcgtgatcctctacgcattgctctgtggaaccctgcccttcgacgacgaccacgtaccgacactcttcaagaagatctgtgatgggatattctacacaccacagtacttaaacccgagtgtcatcagcctgctgaaacatatgctgcaagttgacccgatgaagcgagctacaatcaaagacattagagagcacgagtggttcaagcaggatctgcctaagtacctgtttcccgaagacccctcttacagctcaaccatgatcgacgacgaggcattgaaagaggtgtgtgaaaaatttgagtgctcagaggaagaggtgcttagttgcctatacaataggaaccaccaagaccccttagctgtggcataccatctcattatcgataacaggaggatcatgaacgaggcaaaagacttctatctcgcaacctctccccctgactctttcctggatgaccaccacctgacacgccctcaccccgagcgcgtgcccttcctggtcgctgagactcctcgtgcaaggcatacccttgatgagctcaacccacagaagtcaaagcaccagggtgtgcgcaaggccaaatggcacctaggtatccgctcccagtcccgccctaacgatattatggcggaggtgtgtcgtgcaattaagcagctggattatgagtggaaagtggtcaacccttactacctgagagtgagacggaagaatccagtgacgtccacttacagcaaaatgtccctgcagttgtatcaggtggatagccggacctacctcctggatttccgtagtatcgacgacgagattaccgaggccaagtcaggcaccgctaccccacagcgcagcggatcagtgtctaattacaggtcttgccagagatccgactccgacgccgaggcccaggggaagagttctgaagtgtctctcacttcttcggtgaccagcctcgacagcagcccagttgatctgacaccacgacctggctcacacaccatagaatttttcgagatgtgtgcaaacttgatcaaaatccttgcccagtag

SEQ ID NO: 236744 - DNA, 1680 bp, Artificial Sequence
  Description of Artificial Sequence: Synthetic coding sequence
atgaggcgattatcaagttggcggaagatggccactgctgaaaaacaaaaacacgacgggagagtgaaaattggacactacatcttgggtgatacgcttggcgtgggcacctttggaaaggtgaaagtgggcaagcacgaactcacgggccataaagtggctgtgaagattcttaaccgccagaagattagaagcctcgacgttgtagggaaaattcgaagagaaatccagaacctgaagctcttccgtcaccctcatatcatcaagctgtaccaagtgatctctacccctagcgacatttttatggtgatggaatatgtctcaggcggagagctgttcgattacatctgcaaaaacggcaggttagacgagaaagaatcccgtcggttgttccagcaaatattgtctggagtcgattattgtcaccgccacatggtagtgcatcgcgacttgaagccggagaatgtgcttcttgatgcacacatgaacgcaaaaatagccgattttgggctcagcaatatgatgtccgatggggagtttctgagaactagctgcgggtcacctaattatgccgctccagaagttatctcaggaaggctctacgccggtccggaggtggatatttggagcagcggcgtcatcctgtacgcactgctgtgcggcacactaccctttgatgatgaccatgtcccaactctgttcaaaaagatatgtgatggaatcttttacactcctcagtaccttaacccatccgtgattagcctgcttaagcatatgctgcaggtggacccaatgaaacgggctaccattaaggatattcgcgagcacgaatggttcaagcaggatctgcccaagtatctcttcccggaggaccctagctacagcagcactatgatcgacgacgaggccctcaaggaggtgtgcgaaaaattcgaatgctcagaagaagaggtccttagctgtctgtacaaccgcaatcaccaggatcccctggccgtggcatatcatctgatcatcgacaacaggaggataatgaacgaagcgaaagacttttatctggctacttcacctccagacagcttccttgacgaccatcatcttacccgaccacatccggagagagtgcctttcctggtggccgagacccctcgcgcacgtcacaccctggatgaactcaatccccagaaaagcaaacaccaaggtgtaagaaaggctaagtggcatctgggcatacggtcccagtcccgacctaacgacatcatggcggaagtgtgccgagctataaaacagctcgattacgaatggaaggtggtaaatccttactacctgcgcgtgcggagaaaaaacccagtgacatcaacttattccaagatgagcctgcagctatatcaggtagatagtcgaacatacttactggacttccgttctattgatgacgaaataactgaagccaagagtggcactgccaccccccaaagatccggttccgtgtcaaactaccggtcttgccagcgtagcgacagtgatgctgaggcacagggcaaaagttccgaagtttcactgacctctagcgtgacttccttagactcaagccctgtagacctgactccacggccagggtcacacaccatcgagttcttcgagatgtgcgctaatctgataaagatcctcgctcagtag

SEQ ID NO: 236745 - DNA, 1659 bp, Artificial Sequence
  Description of Artificial Sequence: Synthetic coding sequence
atggcggagaagcagaagcatgacggaagggtgaagattgggcactatgtgcttggggatacacttggcgtcggtacatttggcaaggtcaaaattggggaacatcagctgacaggacacaaggttgcggtgaaaattctcaacagacagaagatccgttcgttggacgtggtaggaaaaatcaagcgggagattcagaatttgaagcttttccggcacccccatatcattaaactgtaccaagtgatcagcacgcccacggatttctttatggtgatggaatacgttagcggaggagaattatttgattacatatgtaaacacggccgagtagaagagatggaggcccgtagactattccagcagatactgagtgccgtagactactgccacaggcacatggtggtccacagggatctgaagcccgagaatgtgctgctcgacgctcatatgaatgcgaagatcgctgatttcggactatccaatatgatgtccgacggtgagtttctgcgcacctcttgtgggtcacctaactacgccgctcctgaggtgatctctggtaggttgtatgcaggacctgaagtcgatatatggtcctgtggtgttatcttgtacgcactgctttgcggtactctgccttttgatgacgagcacgtgccaaccctttttaagaaaatcagaggcggtgtgttctacatcccggagtacctgaatcggtctgtggccaccctattaatgcacatgctgcaggtcgacccactcaagagagcaacaatcaaagatattcgagaacacgaatggttcaagcaagacctcccttcatatctttttcctgaggatcccagctacgatgctaacgtgatcgatgatgaagctgtgaaggaagtttgtgagaaattcgagtgcactgagagtgaggttatgaattctctctattcgggtgatccccaagaccagttagccgtggcgtaccatctgataatcgacaaccggaggatcatgaaccaggctagcgaattctatcttgctagttctccgccatcgggaagctttatggatgacagcgcaatgcatatacctcctggtctgaagccacaccctgaacgcatgcctccactcattgcagactcccccaaggccaggtgtccgctcgatgccctgaataccacgaaaccgaagagcctcgctgtaaagaaggctaagtggcatctggggatcaggagccagagtaaaccatacgacatcatggcggaagtgtatcgagccatgaaacagctggatttcgagtggaaggtcgtcaacgcataccacttgagggtgcggagaaaaaaccccgtgaccgggaactatgtcaagatgtctctgcagctgtacctcgtcgataacaggagttaccttctcgatttcaagtcaatagatgacgaggtcgtggagcagagatccggctcttcaacgccacagcgttcctgtagtgccgcaggactccacaggccccgttccagttttgattccacaacagccgagagtcattccctgagcggttctcttaccggctcattaactggctcaactttgagtagcgtgagcccacgtcttggatcccataccatggactttttcgagatgtgtgcctcactgataacaacactcgctcggtag

SEQ ID NO: 236746 - DNA, 744 bp, Artificial Sequence
  Description of Artificial Sequence: Synthetic coding sequence
atgctcaccattaccgatttcatcaacatacttcacagatattataagtctgcgctggttcagatctacgaactggaagaacataagatagagacctggagggaggtataccttcaggattcattcaagcccctggtatgtatcagccccaacgcatcactttttgatgcagtgtcaagccttatcagaaataagatccaccgactcccagtaatcgatcccgagtctggaaatactctttatattttgacccacaagcgcatccttaagtttctaaaactcttcattacagagtttccaaaacccgaatttatgagcaagtccttagaagaactacagatcggcacctatgcaaacattgccatggtccggacgaccaccccggtgtatgttgccctgggcatcttcgtgcagcatagggttagcgctttgccagtggtggacgagaaagggagagttgtcgacatttactcaaaattcgacgtcattaacctcgccgctgaaaagacttacaacaatctggacgtgtcagtcactaaggcccttcagcatcgaagccattatttcgagggggtactgaagtgttacttacatgaaacgttggagaccattattaatcgactagtggaggcagaggtgcacaggctcgtggtggtggacgaaaatgacgttgtgaaagggattgtgagcctgtctgatattttgcaggccttggtactgacgggtggcgaaaagaaaccatag

SEQ ID NO: 236747 - DNA, 996 bp, Artificial Sequence
  Description of Artificial Sequence: Synthetic coding sequence
atggagaccgtgatatcctcagattccagtccggctgtggagaacgagcatcctcaggagacgccagagagcaataactccgtatatacatcttttatgaaaagccacagatgttacgacctcatacctacctccagtaagctggtggtctttgatacctcactgcaggtgaagaaagccttcttcgcccttgtaaccaacggcgtccgagctgcgcctttgtgggactcgaagaaacagtcttttgttgggatgctgacaatcactgacttcatcaacattctgcatagatactacaagagcgccctcgtgcagatctacgaacttgaggagcacaagattgagacctggagggaagtctaccttcaagatagttttaagccgctggtttgcatatcacctaatgccagcctgtttgatgcagtttcctctctgattagaaacaaaatccatcggctgccagtcatcgatcccgagtcagggaacactttgtacatacttacgcacaaacgcatcctgaagttcttgaagctttttatcacggagttccctaaacctgagttcatgtctaagagcttggaggagctccaaattggaacatatgctaatatcgccatggtgcgtaccacaacaccagtttatgtggctcttggcatcttcgtacagcaccgggtgtctgccctacctgtggtggatgagaagggacgtgtggtggacatctactccaagtttgatgtaattaatctcgccgctgagaagacatataataaccttgatgttagcgttaccaaggcactgcagcacaggagtcactactttgagggagtccttaaatgctacctacacgaaacactggagaccatcataaataggctggtggaggccgaggtccatcgcctggttgtggttgacgaaaatgacgtagtgaaaggaatcgtcagccttagcgatatcctgcaggcactcgtccttactggcggagagaagaaaccttag

SEQ ID NO: 236748 - DNA, 1710 bp, Artificial Sequence
  Description of Artificial Sequence: Synthetic coding sequence
atgggctcggcagtcatggacactaaaaaaaaaaaagacgtgtccagtccgggaggcagcggcggtaagaagaatgcatcacaaaaaagaagaagcctgagagtgcatattcccgacttgtcatcctttgctatgcccctcctggacggagacttagaaggttctggaaagcactcgtcacgcaaagtcgacagtccattcggcccaggttcaccatccaaaggattctttagtagaggcccacagccacgcccatccagtcccatgagcgctccagtcagacccaaaacttcacctgggagccccaaaacggtgttcccatttagctatcaggagtccccccctagaagccctagaaggatgagcttttcaggaatttttcgctcctcaagcaaagagtcgtctcctaattccaaccctgcaacatctcccggaggcattcgcttttttagcagatcgaggaagacctctggcctttcatccagtccaagcacacctacacaggtgaccaaacagcatacctttccgctggagtcttataagcacgagcctgaacgcctggagaatcggatctacgcgtctagctcgccacctgataccgggcagagattctgcccttcctctttccaatcacctactagaccaccattagcctccccaactcactacgcaccgtcgaaagccgcagccctcgctgcagcactcggcccagccgaggccggaatgctagagaaacttgagttcgaggacgaggcggtggaggatagcgagagcggggtgtatatgaggtttatgcgcagtcataaatgttatgatattgtgcctacctcctcaaagttagtggtatttgatacaaccctgcaagtgaaaaaggcattttttgctctggtggcaaatggggttcgcgcagcaccactttgggaaagcaagaagcagagtttcgtcggtatgcttaccattacggacttcatcaatattctgcataggtactacaaatctcctatggtccagatctatgagctcgaagaacacaaaatagagacttggagggagctgtatctgcaggagacctttaaacctcttgtcaatatttccccagatgcgagccttttcgatgccgtgtattctctgataaagaataaaatccacaggctccctgtaattgacccgatcagtggaaacgccctgtacatcctgacacataagcgcatactcaaatttctccagctcttcatgagtgacatgcccaagcccgcttttatgaagcaaaacctggacgagttaggtatcgggacctatcataacattgccttcattcatccagatacccccatcatcaaagcactgaacattttcgtagagcggcgtataagtgccctgccagtcgttgacgagagcggaaaggtggtggacatttacagcaaattcgacgtgattaatttagcagcagaaaaaacctataataatttggacattacagtcacccaggccctccaacatcgttctcagtactttgaaggcgttgtcaagtgcaataagctggaaatcctcgaaacaattgtggacagaattgtgcgggctgaggtgcatagactggtggttgtcaatgaagcagactccatagtcggtataatcagcctgtccgatatcctgcaagccctaattctgactccggctggcgcaaaacagaaagaaaccgagacggagtag

SEQ ID NO: 236749 - DNA, 1335 bp, Artificial Sequence
  Description of Artificial Sequence: Synthetic coding sequence
atgaagaggttcggttccctgcgctccaataagaaacacaaggaccaaaaccgaagcacagagcgccgtcagagcgagcctcatggcctgttcgctagcggactgtctagcagtccctccacacccactcaggtgaccaagcagcatacattcccactggaaagttataagcacgagcccgaacgtctggagaaccgcatatacgcttccagttcgcctcctgacaccggccagcgtttctgtccatcctcattccagtcccccacacgaccacctctggcatcccctacccactatgcaccgtccaaagcagcagctcttgccgctgctctcggacccgcagaagccggtatgctggaaaaactcgagttcgaggacgaggtagaggacagcgagtcgggcgtgtatatgaggtttatgaggtcgcacaagtgctatgatatagtacccacgagttccaagcttgtggtcttcgatactaccctacaggttaagaaggctttcttcgccctggtggccaacggcgtccgcgcagctcccctgtgggagtccaaaaagcagtcatttgtaggcatgctgaccatcacagactttataaacattctccatcgatattacaagtcccccatggttcaaatctacgaattagaggagcataaaattgagacttggcgggaactctacctccaagagacgtttaagcctctggtgaatatcagtccggatgcctctctttttgatgcagtgtacagtttaattaaaaacaagatccaccggctgccagtaattgatcccatctccggtaatgcactgtatatcctcacgcacaagcggatattgaagttcttacaactgttcatgagtgacatgccaaaacctgctttcatgaaacagaacctcgacgaactcggcatcggcacttatcacaatattgcgttcatccatcctgatacacccattattaaggccttgaatatcttcgtggaacgacgcatctctgcccttcccgtggttgacgagagtggcaaagttgtggatatatatagtaaatttgacgtgatcaatctggctgccgagaagacctataacaaccttgacattaccgtcacccaggcgttgcaacataggagccaatacttcgagggggtcgtcaaatgtaacaagttagaaattcttgagactatcgtggaccggatagtgagggccgaggtccaccggttggtggtcgtaaatgaggctgactccattgttggcataatctccttgtccgatattttgcaggccttgattctgacacctgccggagccaagcagaaggagaccgaaaccgagtag

SEQ ID NO: 236750 - DNA, 309 bp, Artificial Sequence
  Description of Artificial Sequence: Synthetic coding sequence
atggctggtcaggctttcaggaagttcctgcctttattcgaccgcgtcttggtggagcgaagtgccgctgaaacagttacgaaggggggaataatgttacccgagaagagccaaggcaaggtgctgcaagctaccgtagtcgctgtagggagcggttctaaggggaaggggggagaaatccagccagtgtccgtgaaagttggagacaaagtgctgctcccggaatacggagggaccaaagtggtgctggatgacaaagattatttcctcttccgggatggagacattttaggcaaatatgttgactag

SEQ ID NO: 236751 - DNA, 1062 bp, Artificial Sequence
  Description of Artificial Sequence: Synthetic coding sequence
atggagcctggcctcgagcatgcactgcggaggacaccctcctggtctagtctgggaggctcggagcaccaggagatgtcctttttagagcaggagaacagcagcagttggccctctccggctgtgacttcttccagtgaaagaattagggggaagagaagagcgaaggcgctgcgatggacacgacagaagagtgtggaggaaggagaacccccaggccagggggaaggccctagatccagacctgccgctgagtccactgggttagaggctactttccctaagacgacccccctggcccaggccgatccagccggagttggaactcctcctacggggtgggattgcctgccctctgactgcaccgccagcgctgccggaagctctactgatgacgtggagttggcaacagaattccctgcgactgaggcctgggaatgcgaactcgaaggtctgctggaggagaggcctgcgctgtgcctgtccccacaggcaccttttcctaagctgggctgggacgacgagctcaggaaacctggagcacagatatacatgcgttttatgcaggaacacacttgctatgacgctatggcaaccagtagcaagctcgtcatatttgatactatgctggagatcaagaaagcatttttcgccttagtcgctaacggtgttcgtgccgctcctctttgggactctaagaaacagtccttcgtgggtatgctgactatcactgacttcatccttgtactgcatagatattacaggtctccgctcagatcaacatgcaaggccgcaagctccctttggagcccctctctgttgatgatcgcctgcctgaaattgtccactccatccagccggactggttcaatcgcatgtctattcctgacgcggtgccaggccacatactccacctcctcgcatacgaacgcatgtagctcttcctgtactagcctggtaccgtgctgcccaggccctccaagctcgaccgctctgtctaagatctgggccagcgcacactctgagacatggctgtggtgctggagacagcaccccagttag

SEQ ID NO: 236752 - DNA, 1395 bp, Artificial Sequence
  Description of Artificial Sequence: Synthetic coding sequence
atgtcctttctcgaacaggagaactcaagcagttggcccagtccggcagtgacttcatcttctgagagaatccgaggcaaaagacgagctaaagccctgcggtggacgcgccagaaaagcgtcgaggaaggggaaccacccggtcaaggggaagggccaagatcacgacctgccgcagagtctaccggcctggaagccacgttcccgaagactacccccttggctcaggcggaccctgccggagtgggtactccccctaccggttgggactgcttaccaagcgattgcacagcaagcgccgcaggaagctcaaccgatgacgtcgagctcgcgaccgaattccctgccactgaagcctgggaatgcgagctggaggggctgctggaggaaaggccagcactttgcctgtccccccaagctcctttccctaaactgggatgggatgatgaactcaggaagccaggcgctcagatctacatgagattcatgcaggaacacacatgctatgacgcaatggcgaccagctccaaattggtgattttcgacacaatgctggagattaaaaaagcgttcttcgctctggttgccaatggggtccgggcagctcctctttgggacagtaagaaacaaagcttcgtgggcatgcttacgattacagattttattctcgtactccatcgctactatcggtcaccattggtacagatctacgaaattgaacagcataaaatcgaaacctggcgcgagatatatctacaaggatgcttcaagccattggtttccatctcccctaatgacagcctctttgaggcagtgtacactctgatcaaaaacaggattcatcgattgccagtgcttgatcctgtttcaggtaatgttctgcatatactcacgcacaagcgccttttgaaattcttgcacatattcgggagcctgctgcccagacctagtttcctttatagaaccatccaggatctgggtatcggcaccttccgagacttggctgttgtcttggaaacggccccaattctcacagcgctcgatatcttcgtggacagaagggtttcggctctcccagtagtgaacgaatgcgggcaggtcgtgggcctctactctcgatttgatgtaatccatctcgcagcccagcagacttacaaccacttggatatgtctgtgggcgaagcactccgccagcgcacactctgcctcgagggcgttctctcttgccagccccacgaaagtttgggggaggtaattgaccgtattgccagggaacaggttcatagactggttcttgtggacgagacacagcacctattaggcgtcgtcagcctctctgacatcctccaagcccttgtgttgtcccccgctggcatagacgctctcggggcttag

SEQ ID NO: 236753 - DNA, 1470 bp, Artificial Sequence
  Description of Artificial Sequence: Synthetic coding sequence
atggaaccaggacttgaacacgccttacggcgtacaccaagctggagctcactgggaggctccgagcatcaggaaatgtcgtttctcgagcaggaaaacagttcctcttggccaagccccgctgtgacctcctcaagtgaacggatccggggaaagcggagagctaaggctcttaggtggacccggcagaagagcgtagaggagggagagcctcccggacagggtgagggccctaggtcgcgacctgccgcagagtccaccggtcttgaggcgacctttcctaaaacaacccccctggctcaagccgaccccgctggtgtgggtacccccccaaccggctgggactgccttccgtccgattgtactgccagcgccgcaggcagctctactgatgacgtcgaattggctacagaattcccggcaactgaagcctgggaatgtgaactggaggggctgttagaggagaggcctgctttgtgcctcagtcctcaggctcccttcccgaaactgggatgggacgacgaactgagaaagccaggcgctcagatctacatgaggtttatgcaggagcatacctgctatgacgcaatggccactagctcaaagctggtgatcttcgatacaatgctggaaattaagaaagccttcttcgccctggttgctaacggggtaagggctgcgcctctgtgggattccaaaaagcagtcattcgtcggcatgctgactattacagacttcatattagtgcttcatcggtattatcgctcacccttggtgcagatctatgagattgaacagcataagatagaaacctggagggaaatttatctgcagggttgctttaaacctctggtcagcataagcccgaacgatagcctgtttgaggcagtctatacacttatcaaaaatcggatccaccgcctgccagtgctggaccctgtgtctggcaacgtcctccatattctgacccacaagcggttgctgaaattcctgcatattttcgggagtctgctgcctaggcctagcttcctctatcgtacaatacaggacctggggataggaacgttccgggacctggccgttgtcctagagacagcacccatcttaactgccctggacatcttcgtagatcgcagagtgtccgctctccccgtggtgaacgagtgcggccaggtggttggactgtactcacgatttgacgtgattcatctagccgcacagcagacatacaaccatctggacatgtccgtgggcgaagccctgagacagcggacactttgcctggaaggagtattaagttgccaaccacatgagagtctgggagaagtcattgacaggatcgccagagagcaggtgcatcggctagtgctggtggatgaaactcaacacctgctaggagtggtatctttgtctgatatcctgcaggcgctcgtcttgtcccccgcagggatcgacgctctcggcgcatag

SEQ ID NO: 236754 - DNA, 918 bp, Artificial Sequence
  Description of Artificial Sequence: Synthetic coding sequence
atgaggtttatgcaggaacacacatgctatgatgcaatggccacgtcaagtaaactggtgatcttcgacactatgctagagatcaagaaagccttcttcgccctggtggccaacggagttagggcagctccactctgggacagcaagaaacagtcattcgtcgggatgttgacaattactgactttatcctcgtcctgcaccgctattatagatctcctctcgtgcagatctacgagatcgagcagcataaaatagaaacatggagagagatttacctgcagggatgctttaaaccactagtgtcaattagcccaaatgactcattgtttgaagcagtatacaccctaatcaagaataggattcatcgtctgccagtgctggatcccgttagcggtaatgtcctgcacattctcactcataaacgcctgcttaaattcctccacattttcggctcactgcttcccagaccatcctttctctacaggacaatccaggacctaggaattggaacgtttagagacctcgccgtggtccttgaaacagccccaatcttgacagctctagatatatttgtggaccgccgtgtctcggcactcccagttgttaatgagtgtggccaggttgttggtctgtatagcaggttcgatgtgatccacctggcagcccagcagacatataaccatctggacatgtcagtgggagaagcgctgcgccaaaggaccctgtgcctggagggggtgctcagttgtcagccgcatgagtctctaggtgaagtcatagaccgcattgccagggagcaagtgcataggcttgttctcgtggacgaaacacaacacctcctaggagtggtaagtctctcagatatcctccaagcactggtgctgagtccggctgggattgatgctctgggtgcctag

SEQ ID NO: 236755 - DNA, 1056 bp, Artificial Sequence
  Description of Artificial Sequence: Synthetic coding sequence
atgggaaatgcagccgctgcgaagaaggggtctgagcaggagagtgtcaaggagttcctggctaaggcaaaggaagactttctaaaaaagtgggagtctcctgcgcagaatacagcccacctggaccagttcgagcgtatcaaaacactggggacaggctcctttggacgggtgatgctcgttaagcacaaggaaactgggaaccactacgctatgaagatcttagataagcaaaaggtggttaagctgaagcagatcgagcataccctcaatgaaaaaagaatactgcaggccgtcaactttcccttccttgtgaagttggagttctctttcaaggacaatagtaatctgtatatggttatggagtatgtgcctggaggagagatgttctcccacctccgtcgcatcggtcgcttttccgaaccacacgccaggttttatgccgcacagattgtgctgactttcgagtacctccactcgctggacctgatctacagagatctcaagccagagaacctgctgattgatcagcaaggctacatccaggtgaccgatttcgggtttgcaaagcgcgtgaaaggtcgtacctggaccctctgcggaacgcccgaatatctggcgccagagattatactgtccaaaggatataacaaggccgtcgattggtgggctttgggcgtgttaatttatgagatggccgcaggctaccctccctttttcgccgatcaacctatccagatctatgagaaaatcgtgagcggaaaggtgcgtttcccaagtcacttcagcagcgatctgaaagatttgcttcggaacctgctccaggtggatctgacaaaaagattcggaaatctcaaaaatggagttaatgatatcaaaaaccataagtggtttgctaccactgactggattgccatttaccaaagaaaagtggaggccccatttatacccaagttcaagggcccaggtgatacctcaaacttcgacgactatgaagaggaggagatccgtgtcagcattaacgaaaaatgtggaaaagagtttagtgagttttag

SEQ ID NO: 236756 - DNA, 1032 bp, Artificial Sequence
  Description of Artificial Sequence: Synthetic coding sequence
atggccagtaattcgtccgacgtcaaagagtttctagcaaaagccaaagaagactttctcaagaagtgggaatctcccgctcagaatacagctcatctcgaccagttcgaaagaatcaagacattaggcacaggttcttttggcagggtgatgctggtgaagcataaggagaccggaaaccactatgccatgaagatcctggataaacaaaaagttgtgaaactgaaacagatcgaacacaccctaaacgagaagagaatcctgcaagccgtaaatttccccttcctagttaagcttgagtttagtttcaaggataattccaatctgtatatggtaatggaatacgtgcctgggggagagatgttttctcacttacggaggatcggacgtttttctgaacctcacgcccgtttttatgctgcccaaattgtgctaacttttgagtatctacactccctcgatttaatctaccgagatctaaaaccagaaaatctgctgatcgaccagcaaggctacatccaagttacagattttggttttgccaaacgcgtcaagggtagaacctggacattgtgcggaactcctgagtatctggcccctgagattatccttagcaaaggttataataaggcagtagactggtgggccttgggggtcctgatctatgagatggcagcaggctaccctcctttcttcgctgatcagccaatccagatctacgagaagatcgtctccggaaaggtgcggttcccgtcccacttttcctccgatttaaaggatttactccgcaacttgcttcaggtggaccttactaaaaggtttggaaacctcaagaacggggtgaacgatataaagaaccacaagtggtttgcgacaaccgattggattgctatctaccagcgaaaagtggaggcaccttttatcccaaaattcaagggacctggagacacttccaacttcgacgactatgaggaagaagaaatccgtgtcagtattaatgagaagtgtgggaaggagtttagcgaattctag

SEQ ID NO: 236757 - DNA, 1056 bp, Artificial Sequence
  Description of Artificial Sequence: Synthetic coding sequence
atggggaacgcggcagcggctaaaaaaggctctgagcaggagtctgtgaaggaatttctggccaaagcaaaggaagacttcctcaagaagtgggagtctcccgctcagaacactgctcacttggaccagttcgagcgcattaaaaccctgggtaccggcagtttcgggagagtaatgctggtcaagcacaaagaaacagggaaccattatgccatgaaaatactggataagcagaaggttgtgaaactcaagcagattgagcacacccttaatgagaagagaatactgcaggccgtgaattttcctttcctggttaaacttgagttctcctttaaggacaacagtaacctatatatggtgatggaatatgtcccgggaggggagatgttcagtcatctgaggaggataggcagattcagcgaacctcacgccaggttttacgccgctcaaattgtgctgacatttgaatatctgcactctctcgacttgatttatcgtgacctgaaacctgagaacctgctgatcgaccagcagggatatattcaagtgaccgactttggcttcgcaaagcgggtgaaagggagaacttggactttgtgtggtactccagagtacttagctcctgaaatcattctttccaagggctacaataaagcggtcgactggtgggctctcggagtgctgatatacgaaatggccgctggctatccccctttctttgccgaccagccaatccagatttatgaaaagattgttagcgggaaagtgaggttcccatctcacttcagctctgatcttaaggaccttctgagaaacctcttacaggtggatctcacaaaacgttttggcaaccttaaaaatggcgtcaacgatataaagaaccacaagtggtttgctacaacagactggattgctatctatcagaggaaagtagaagctccattcatcccaaagtttaagggcccaggcgatacgagcaactttgacgattacgaagaagaagagatccgggtgtccatcaacgaaaaatgcggcaaagaatttagtgagttttag

SEQ ID NO: 236758 - DNA, 693 bp, Artificial Sequence
  Description of Artificial Sequence: Synthetic coding sequence
atgctcgtgaaacacaaggagaccggaaatcactatgctatgaaaatcctggacaaacagaaggttgtgaagctgaagcagatagagcataccctcaacgaaaagcgcatccttcaggctgtgaacttcccttttcttgttaaactagagttctccttcaaggacaattcaaatctttatatggtcatggagtacgtccctggaggcgagatgttcagccacctgaggcggattgggagattctccgaacctcacgctcgcttttatgcggctcagatagtgctcactttcgaatatctgcacagtcttgacttgatttatagggacttgaagccagagaacctgcttatcgaccagcaggggtacatccaggtgacagattttggcttcgccaaacgtgtgaagggcagaacttggacgctctgtggaactccagagtacctcgctcctgaaatcatcctttcaaaagggtacaacaaggccgtggattggtgggccttaggcgtactcatctatgagatggctgccggttatcctccgttcttcgccgatcagccaattcagatctacgaaaaaatcgtatccggtaaggttagaagcggatgtggagacaccgcactggaggaaactgatcgatccctccttactcaccccattccctggggggctttgctggtggtgcgtataatctag

SEQ ID NO: 236759 - DNA, 1074 bp, Artificial Sequence
  Description of Artificial Sequence: Synthetic coding sequence
atgggtctgtctcggaagtcctcagacgcctctgcttgttcgagttctgaaatcagcgacttcgtgaaggaatttctggctaaggccaaagaggattttttgaagaagtgggaaaatccaacacagaataatgccggactcgaggacttcgagcgcaaaaaaactcttgggacaggcagcttcggtcgcgtcatgctggtgaagcacaaggcaacggagcagtattacgcaatgaaaatccttgacaagcagaaggtggtgaaattgaaacagatcgagcacaccctgaacgagaagcgaatcctgcaggctgtcaacttcccattccttgtgaggctggaatatgcgttcaaggataacagcaatctctatatggtaatggaatatgtcccgggaggagagatgttctcacatctacggcgtatcgggcgtttcagcgaacctcatgccagattctatgctgcccagatcgtgctcaccttcgaatacctgcactctctggacttgatttaccgcgacctgaagcctgagaacctgctgatcgatcaccaaggatatattcaggtgactgacttcggcttcgccaagagggttaaaggacgcacatggacactgtgcggcacacccgagtacctggcccctgaaatcattttatctaagggctataacaaggctgtagactggtgggccctcggggtgctgatatacgagatggctgctgggtacccccctttcttcgcggaccaacccattcagatatacgagaaaatcgtttccgggaaggtcagattccccagtcatttctccagtgatctgaaggatttgctgagaaatctgctgcaggtcgatttaactaagaggttcggaaaccttaaaaatggcgtctcagatattaaaacccataagtggttcgctaccacggactggatcgcaatttatcagaggaaggtcgaagccccatttattcctaaattccggggttctggagacaccagtaactttgacgactacgaggaggaagatatccgcgttagcatcactgagaagtgcgcaaaagagtttggagaattttag

SEQ ID NO: 236760 - DNA, 795 bp, Artificial Sequence
  Description of Artificial Sequence: Synthetic coding sequence
atgagtgccaggaagtcctctgacgctagcgcctgttctagtagcgagatcagcgactcctttgtgaaagaattcctcgcaaaagccaaggaggatttccttaaaaaatgggaaaacccgacgcagaataacgcagggctggaagatttcgaaagaaaaaaaacccttggcacagggtcgttcggcagggtgatgttggtgaaacacaaagctactgagcagtattacgcgatgaaaatcctagataaacagaaagtcgtgaagctgaagcagatagagcacactttaaacgagaaaagaatcctacaggcggtgaatttcccatttctggtccgcttggagtacgcctttaaggataattccaatctttacatggtgatggaatacgtcccaggtggtgaaatgttcagccaccttcgaagaattggtaggttctctgagccgcatgcacgcttttacgcggctcaaattgtattaacttttgaatacttacactctctggatctgatctatagagatttaaagcctgaaaatctgttgatagaccaccagggctacattcaggttactgactttgggttcgctaagagagtgaagggcaggacttggaccctgtgcgggacccctgagtacctggctcctgaaattatactcagtaagggctataacaaagcggtggactggtgggcccttggagtactcatctatgagatggcagcaggctaccctcctttttttgctgatcagcccatccagatatatgagaagattgtctccgggaagcagaacttttag

SEQ ID NO: 236761 - DNA, 942 bp, Artificial Sequence
  Description of Artificial Sequence: Synthetic coding sequence
atgccagatttgaagattctcaaggggaagactctcgggacaggctcgttcggtcgcgtaatgctggtgaagcataaggccactgagcaatactatgccatgaagatcctggacaaacagaaggtcgttaagcttaagcagatagagcacactctaaacgagaaacgaattctgcaggccgtgaacttcccattcctggtgagactcgaatacgcgtttaaggataatagcaatctatacatggtaatggagtacgtgcccggaggcgaaatgttttcgcaccttcgacggataggaaggtttagcgaaccacatgccagattctatgccgctcagattgtgctgaccttcgaatacctgcacagcttggacctcatttacagagaccttaagccagagaacctgctgatagaccatcaaggctacattcaggtgacagacttcggctttgccaaacgagtcaaggggaggacttggacactgtgcgggactccggagtatctggctcctgagattattttgagtaaagggtacaacaaggcggtggattggtgggcgttgggagtcctgatctacgaaatggccgctggttatccgcctttcttcgccgaccagcctattcagatttacgagaagatcgtgtccggcaaggtccgctttccttcccactttagttctgacctgaaagatctgctgaggaacttgctgcaggttgatctgaccaaacggtttgggaacctgaaaaatggggtgtccgatattaagacccacaagtggttcgcaacgacagactggattgccatatatcagcggaaagtggaggccccattcatcccaaaatttagaggcagcggcgacacttcaaatttcgatgattatgaggaagaggatatccgggtgagcatcactgaaaagtgtgcaaaagaattcggagagttctag

SEQ ID NO: 236762 - DNA, 1068 bp, Artificial Sequence
  Description of Artificial Sequence: Synthetic coding sequence
atgggcctgtctaggaagtcatccgatgcaagtgcatgcagttcttccgagatctctgtcaaggagttcctggcaaaggccaaggaagacttcctcaagaaatgggaaaatcccactcaaaacaacgccggtctggaggattttgaacgaaagaaaaccctaggaaccggtagtttcggaagagttatgcttgtgaagcacaaggcgactgaacagtactacgctatgaaaatcctggataaacaaaaggtagtgaagctcaaacagatcgagcatacgctgaatgagaagcgaatactgcaggcagtcaatttcccatttttggtccggctagagtatgctttcaaggacaatagcaatctgtacatggttatggagtatgtgcctggaggagaaatgtttagccacctcaggcggatcggtagatttagcgaaccacacgctcgattttatgccgcacagattgtcttaacatttgaatatctacacagtttggatctgatctatcgtgacctgaaacccgagaacctcttaatcgatcaccagggatatattcaggtaacagacttcggatttgctaaacgtgtcaaaggcagaacctggactctttgcggcaccccagagtacttagctcctgagatcattttgtctaaaggatacaacaaggctgtcgattggtgggctctgggtgtgctgatctacgagatggccgcaggttacccacccttcttcgccgatcagcctattcagatctatgagaaaattgtaagcgggaaagttagatttccctcacactttagttctgacttgaaggacctcctgaggaacttgctccaggtcgatctcaccaagagattcggcaacctgaaaaatggagtgtcggatattaagactcataagtggtttgctactacagattggatcgctatctaccagcggaaggtcgaggcgccattcattcccaagttccggggaagtggggacacatcaaattttgatgattatgaggaggaggacattagagtgagcataaccgagaagtgcgctaaagaatttggggagttctag

SEQ ID NO: 236763 - DNA, 738 bp, Artificial Sequence
  Description of Artificial Sequence: Synthetic coding sequence
atgggactactgaaagaattcctggccaaagcaaaagaagacttcttaaaaaagtgggaaaatccaacccagaataatgcagggttggaggactttgagaggaagaagacacttgggaccggatcctttggtagagtcatgctggtcaagcacaaagcgaccgaacaatactacgccatgaagattctggacaagcagaaggtggtgaagcttaaacagattgagcacaccctgaacgaaaaacgcatactgcaggcggtgaatttcccattcctggtgcgcttagaatacgccttcaaggacaattctaatctgtacatggtaatggagtacgtcccgggaggcgagatgttcagtcatttaagacggatcggccgtttcagcgagccccacgctcgtttttacgcggcacagattgtgttaacatttgagtatctccattccctggacctgatttaccgagatctaaagcctgagaacttgttgattgatcaccaaggctatatccaggtaactgatttcggcttcgcaaaaagggttaaaggtagaacgtggaccttgtgtgggacacctgagtaccttgctccggaaattatccttagcaaaggctataacaaggcggttgattggtgggctttgggagtgttgatctatgaaatggcggctgggtatccaccttttttcgctgaccaacccatccagatctatgagaagatcgttagcggcaaaaatttctag

SEQ ID NO: 236764 - DNA, 1197 bp, Artificial Sequence
  Description of Artificial Sequence: Synthetic coding sequence
atggcagcttaccgcgagcctccctgcaatcaatatacaggaaccactaccgcgcttcagaagttggaggggttcgctagcaggctcttccatcgccattctaaaggcaccgctcacgaccagaagacagctctggaaaacgattccctccacttcagtgagcacactgctttgtgggatcggagcatgaaagaattcttagccaaggccaaagaggatttcctcaaaaaatgggagaatcctacccagaacaatgcagggcttgaagatttcgagagaaaaaagacactgggaactgggtcgtttgggagggtaatgctggtaaagcataaggctacagaacagtactacgccatgaaaatcctcgacaagcaaaaagtggtgaagctcaagcagattgaacacacactgaatgaaaagaggatccttcaggctgtgaatttcccattccttgtgcggctggaatatgcttttaaagataattcaaacttgtacatggttatggaatatgtccccggaggcgagatgttttctcacctgaggcgcataggcagatttagcgaacctcacgcgcgtttctacgcagcccagatagtattgacttttgaatacctgcactccctggacctcatataccgggatctgaaaccggagaatctgctcatagatcaccaaggatatattcaagttactgactttggtttcgctaaaagagtcaaaggtaggacctggactctatgcggaaccccggagtaccttgctcctgaaattatcttatccaaggggtacaataaagccgttgactggtgggccttgggtgtactgatctacgagatggctgctgggtaccctcctttctttgccgaccagcccattcagatctacgagaaaatcgtgtccggaaaggtccggttcccctctcatttttccagtgatttgaaggatttattgagaaatttgttgcaagtggatctaaccaagagatttggtaatctcaaaaacggcgtctctgatattaagacccacaaatggttcgcaaccaccgattggatcgccatctaccagagaaaggtggaggcccctttcatccctaagttccgtggtagcggggacacttctaatttcgatgattacgaagaggaggacattagagtttcaataactgagaagtgtgcaaaagagtttggggaattctag

SEQ ID NO: 236765 - DNA, 774 bp, Artificial Sequence
  Description of Artificial Sequence: Synthetic coding sequence
atggggaatgctgctactgccaaaaagggttcagaggtcgaaagtgttaaggagtttctcgctaaggcaaaagaagacttcctgaagaaatgggagaacccaacacaaaacaacgcagggctggaggatttcgagcgcaagaagactttggggacggggtcctttgggagagtaatgcttgtgaagcacaaggccactgagcagtattacgcaatgaaaattctggataaacagaaggttgtgaaattaaagcagatcgagcacaccctgaatgagaagcggatactccaggcagtgaactttccttttctagtgcgtctcgagtatgcctttaaggataattccaatctgtatatggtcatggagtacgttccaggcggagaaatgtttagccatcttagaagaattggccgattcagcgaacctcatgctagattttacgccgctcagattgtgcttacttttgagtacctccatagccttgatcttatctaccgggatttgaagcccgagaacttgctcatcgaccatcaaggctacattcaggttacagattttgggttcgccaagcgggtcaagggcagaacatggaccctctgtggtaccccggaatatctggcgccagagattattttgagcaagggctacaacaaggcagtggactggtgggcattgggtgtactgatctacgaaatggcagccggatatccacctttctttgcggaccagcctattcaaatatatgagaagattgtgagcggtaagaacttttag

SEQ ID NO: 236766 - DNA, 1056 bp, Artificial Sequence
  Description of Artificial Sequence: Synthetic coding sequence
atggggaacgcggcaaccgctaagaaagggtctgaagtggaatctgttaaggagttcctggccaaagctaaggaggactttctaaaaaaatgggagaatcccacccagaacaacgcaggactcgaggacttcgagagaaagaagacgctcggtactggttcgttcggacgggtaatgttggtgaagcataaggcaactgagcagtattacgccatgaaaatcctcgacaagcagaaggtggtgaaacttaagcaaatcgaacatacactgaacgagaaaagaatcctgcaagccgtgaattttcccttcctggtgaggctggaatatgccttcaaagataactctaacctgtatatggtgatggagtacgtgcctggcggtgagatgttttctcaccttcggaggattggacggttctccgagccacacgccaggttctacgcagctcagattgtgctgacctttgagtatctgcacagtctggatctcatctatcgggatctgaaaccagaaaatctgctgattgaccatcagggttatattcaggtgacggattttgggttcgccaagagggtaaaggggaggacatggacactctgcggcaccccagaatacctggcccctgagattatcttatccaagggttacaataaagccgtggactggtgggccctgggtgttctcatctacgaaatggctgcgggatatcccccatttttcgcggaccagcctatccaaatttatgaaaaaattgtctcaggtaaagtgaggtttccctcccacttttctagcgatctaaaggacttgctccgtaatttgctgcaggtggatcttaccaagagattcgggaacttgaagaacggggtaagcgatattaagactcacaaatggtttgccacaacagattggatcgcaatctatcagcggaaagtggaggcaccttttatcccaaagttccgtggttctggtgacacatccaacttcgatgattacgaagaagaggatatcagggtttcaatcactgaaaaatgcgctaaagagttcggcgagttttag

SEQ ID NO: 236767 - DNA, 1077 bp, Artificial Sequence
  Description of Artificial Sequence: Synthetic coding sequence
atgggactgtctcgaaaatcttctgatgctagcgcatgctcatcctctgagatttcagattcattcgtaaaagagtttctggctaaggccaaagaggattttctgaagaagtgggagaatcccacacagaacaacgctggcctggaagattttgaaaggaaaaaaactctgggcacaggttcttttgggagggttatgttagtgaaacataaggccaccgagcagtactatgcgatgaagatactagacaagcagaaggtggtgaaactcaagcaaattgagcacacgctgaacgaaaagaggattcttcaggctgttaactttccctttctggtcaggctggagtatgccttcaaagacaactcaaatctctatatggtgatggagtatgttccgggtggagaaatgttctcccaccttagacggatcgggaggttctccgagccccacgccagattttatgcggcacagattgtgttgacattcgagtaccttcacagtctggatttaatatatcgggacctcaaacctgaaaaccttctgatcgatcatcagggatacatacaagtgaccgattttggatttgccaaaagagtaaaaggacgaacatggacactttgtggtactcccgaatacttggcccctgaaatcatcttgagtaagggatacaataaagccgtggactggtgggccttgggcgtgctgatctacgagatggctgctggataccccccattctttgctgaccagccaatacagatctacgagaagattgtctcgggcaaagtgcggttcccaagccattttagcagcgacctaaaggatctgctccggaacttattacaggtggacctcaccaaaaggtttggcaatctgaagaatggcgtgagcgatatcaaaacacataagtggtttgccactaccgactggatagccatctatcagcgaaaagtggaagccccatttataccgaaatttcgcggtagtggtgacacatcgaacttcgatgactacgaagaggaggacatccgagtgagcataacagaaaaatgcgccaaagagttcggcgagttttag

SEQ ID NO: 236768 - DNA, 966 bp, Artificial Sequence
  Description of Artificial Sequence: Synthetic coding sequence
atgagtgctcgcaagagcagcgatgcaagtgcatgctcctctagcgagatatccgtgaaagagtttctggctaaagcgaaggaggattttctgaagaaatgggagaaccctacgcagaataatgcaggactggaggacttcgagcgcaagaagacattaggcacgggcagctttggaagggtcatgctcgtgaagcataaagccaccgagcaatactatgctatgaagatactggataagcaaaaagacaatagcaacctctatatggtaatggaatacgtgcctgggggagaaatgttcagccatctgcggagaattggtaggttcagtgaaccccatgcacggttctatgcagcgcagatcgtgttgacatttgagtaccttcatagtctggacctgatctacagagaccttaagcctgagaatctcttaattgatcaccaggggtatattcaggtcacagatttcggctttgccaagcgcgtaaaggggagaacttggaccctatgcgggacccccgaatatctggctcctgagattatcctgtccaaggggtacaacaaggccgtagactggtgggcgctgggcgttctgatttacgagatggctgctggctacccaccattttttgctgatcaaccaattcagatatatgaaaaaatagtatcaggcaaggtgcgcttcccttcccacttcagctccgaccttaaggacctgcttagaaacctgctccaggtagatctgaccaaaaggtttgggaatctcaaaaacggagtgagcgatataaagacgcataagtggttcgccacaaccgactggatcgcaatctaccagcggaaagtggaggccccatttattccaaagtttcgcggatccggcgatacctcgaattttgatgactatgaggaggaggatattcgtgtgagcatcacggagaaatgcgctaaggagttcggggaattctag

SEQ ID NO: 236769 - DNA, 630 bp, Artificial Sequence
  Description of Artificial Sequence: Synthetic coding sequence
atgtctgcctgttcaagtagcgaaatctcagtcaaggaattcctcgctaaagccaaagaagattttctgaagaaatgggagaacccaactcagaacaacgctggactcgaagatttcgaaaggaagaaaaccctgggcactggctcatttgggcgtgtgatgttggttaaacataaggcaaccgagcaatactacgctatgaaaatcctggataagcaaaaagttgtaaaattaaagcaaatcgaacacaccctgaatgaaaagaggatcctgcaagcagtgaatttcccattcttagtccgcttagaatacgctttcaaggacaactccaatctgtacatggtcatggagtacgtcccgggaggagagatgttttcccacttgcgacgcattggtcggttctccgaacctcacgctcgattttacgcggcacagatagtcctaacgtttgaatacctccactccctagacttaatctatcgtgatttgaagcccgaaaaccttcttatcgatcatcagggatatatacaggtgaccgacttcggatttgcaaagcgagtgaaaggtagaacttggaccctgtgcgggacccccgaatacttggctcctgagataatcttgtcaaagtag

SEQ ID NO: 236770 - DNA, 594 bp, Artificial Sequence
  Description of Artificial Sequence: Synthetic coding sequence
atgagtgtcaaggagttccttgcaaaggctaaagaggacttcttaaagaagtgggagaaccctacgcagaataatgctgggctggaagactttgagcgcaaaaagaccttaggcactggctcctttggtagggtgatgctggtgaagcataaggcgacggagcagtattatgctatgaaaattctcgacaaacaaaaagttgtgaagctgaagcaaatagaacacacccttaacgagaagagaattctccaagccgtaaatttcccctttctggtccggctcgaatacgccttcaaggacaacagtaatctgtatatggttatggagtatgtgccaggaggggaaatgttttcccatctacgacgcatcgggagattttctgaaccccacgctcggttctacgccgcacagattgtactaacatttgagtacctccacagcttggacttgatttatagggacttgaaacctgagaatctgcttattgatcaccagggctacatccaagttacagatttcggttttgcaaagagggtcaagggtcgcacctggacactatgtggcactcccgagtacttggcaccagaaatttag

SEQ ID NO: 236771 - DNA, 645 bp, Artificial Sequence
  Description of Artificial Sequence: Synthetic coding sequence
atgggtctaagctgcagttcgtcagagatctccgtcaaagagtttcttgccaaggccaaggaggattttttgaaaaaatgggagaaccccacccaaaataatgccggtcttgaagactttgaacggaagaaaacacttgggactggtagtttcggcagagtgatgctggtgaagcacaaggccacagagcagtactacgccatgaagattctggacaaacagaaggtagtgaagttaaagcaaatcgaacatacgctgaacgagaagcgcatcttacaggccgtaaactttccttttctcgtgagactagaatacgcttttaaagacaactccaacttgtatatggttatggaatacgtcccgggaggcgaaatgttttcgcacctgaggagaatcgggagattcagcgaaccccatgctcgcttctacgctgcacagatagttctgacattcgagtacctgcatagcctcgatctgatttaccgggatttgaaacccgaaaatctgcttattgaccaccagggatatattcaggtaactgacttcgggttcgccaagagggtgaaaggcagaacctggactttatgtggaacacccgagtatctggctcctgaaatcattctgagcaagggatacaataagtag

SEQ ID NO: 236772 - DNA, 561 bp, Artificial Sequence
  Description of Artificial Sequence: Synthetic coding sequence
atgggactctcccgcaagtcctccgatgccagcgcatgctctagctcggagataagtgtcaaggaatttttggcaaaggccaaagaagatttcctcaagaaatgggaaaaccctactcaaaataatgcaggcctcgaggatttcgagcgcaagaagactctggggaccggatcatttggcagagtgatgttggttaagcacaaggcaacggaacagtattatgccatgaaaattctggacaaacagaaagtagtcaagctaaaacagattgagcataccctgaacgaaaagcgaatactgcaggcagtgaatttcccttttctggtgaggctggaatacgcatttaaggataatagcaacttatatatggtcatggagtacgtgccaggaggagaaatgttctcccacctccgccgtatcgggcgtttctcagaaccccacgccagattttacgctgcgcagatcgtgctgacctttgagtatctgcactctcttgatctgatttaccgagacctcaagccagagaacttactgattgatcaccagggctacatccagtag

SEQ ID NO: 236773 - DNA, 528 bp, Artificial Sequence
  Description of Artificial Sequence: Synthetic coding sequence
atggggttaagtagaaagagctcggatgcgtctgcctgcagcagttctgagatttccgatagcttcgtaaaagagtttctggccaaggccaaagaggattttttgaagaagtgggaaaatccaactcaaaacaatgcaggcctcgaagattttgagcgcaaaaagacgctcggtaccggctcatttggacgggttatgttggtaaaacacaaggctacagagcagtactatgcgatgaagatcctcgacaagcagaaggtggttaagctgaaacagattgagcatacgctgaatgagaaaaggatactgcaggcagtgaatttcccattcctcgttagactggagtacgcctttaaagataattccaacttgtatatggtgatggagtatgtcccaggcggagagatgtttagccatcttagacggataggcaggtttagcgagcctcacgcccgtttttatgccgcacagattgtgctaacgtttgaatacctacattcactggatctcatctaccgcgatttatag

SEQ ID NO: 236774 - DNA, 621 bp, Artificial Sequence
  Description of Artificial Sequence: Synthetic coding sequence
atgtccgcgagaaagagctcggacgcatctgcgtgttcttcctccgaaatctccgtcaaggagtttttggccaaggcgaaagaggattttcttaagaaatgggaaaatcccacacagaacaacgctggacttgaagacttcgagcgtaagaagaccttagggacaggttccttcgggcgagttatgctagttaagcataaggctacggagcagtactacgccatgaaaattcttgataagcagaaggtggtgaaacttaaacagatcgaacatacactgaacgagaaaaggatcttacaggccgtgaattttccctttctggtgaggctcgagtacgcctttaaggacaactctaatttgtatatggtcatggaatacgtgccaggaggggaaatgttcagccatctcaggagaattgggagattcagcgagcctcacgcacgcttttatgccgctcagattgtccttactttcgagtatctgcattccctcgatctgatttacagagatctaaaacctgaaaatctgctcatagatcatcagggatatatccaggttactgatttcggcttcgcaaagagagttaaaggtaggacctggaccctctgtggcactccgtag

SEQ ID NO: 236775 - DNA, 1056 bp, Artificial Sequence
  Description of Artificial Sequence: Synthetic coding sequence
atgggcaatgcgcctgccaagaaggacaccgagcaggaagagtccgtgaacgagttcctggccaaagcccgaggggactttctttaccggtggggtaatcccgcacaaaacactgcgtcttccgaccagttcgaaagattgaggaccttgggcatgggcagtttcggcagggtgatgctggttcgacaccaggaaaccggcggacattacgcgatgaagatcctcaacaagcagaaggtggtcaaaatgaaacaagtggagcacattcttaatgagaagcgaattttgcaggctatcgacttcccatttctcgtgaaacttcagttcagtttcaaagataactcttacttgtacctagtgatggagtacgtaccaggaggtgagatgttctcacgcctgcagagagtaggacgcttttctgaaccccatgcatgcttttatgctgcacaggtcgtgctcgcagtgcaatacctccacagtctggatcttattcacagggatttaaagcccgaaaacctgttgatagaccagcaggggtatctgcaggttacggacttcggcttcgccaagagagtgaaggggagaacctggactctttgtgggacccccgagtacctcgcaccagaaattattcttagcaaggggtataataaggcagtagactggtgggccttgggtgtgctgatttatgaaatggcagtgggctttccgcctttctacgccgaccagcccatccaaatttatgaaaagattgtgagcggtcgggttaggttcccaagtaagttatcttcggatttgaagcatctcctgagatctcttcttcaggtggatctcactaagcggttcggcaacctaagaaatggcgttggcgacatcaagaatcacaaatggttcgctaccacatcttggatcgcaatttacgagaagaaggtcgaggcccctttcatcccaaaatacacgggccctggcgacgcttcgaattttgatgactacgaagaggaggaactgcgaatctccattaatgagaagtgtgcgaaagagttctcagaattctag

SEQ ID NO: 236776 - DNA, 1146 bp, Artificial Sequence
  Description of Artificial Sequence: Synthetic coding sequence
atggaatccggaagtacagcggcttccgaagaagctaggtctctcagggagtgcgaactttacgtccagaaacataatatccaggccctactaaaagacagtattgtgcagctctgcaccgcacggcctgaacgcccaatggccttcttacgagagtattttgagagattggaaaaagaagaagcaaagcagatacaaaaccttcagaaagcaggcacgagaactgactctcgggaggatgagatttccccgcctccacctaatcctgtggtaaaaggccgaaggcgcagaggagctatctccgcagaagtatacaccgaggaagacgccgcaagttatgtcaggaaggtgatccctaaagattacaaaaccatggccgctctagccaaggccatcgagaagaacgtcctcttttcccacttggacgataatgagagaagtgatatcttcgacgccatgttctcagtgagcttcattgccggtgaaacagtgatccaacaaggcgacgagggcgataacttctacgtgatagaccagggtgaaactgacgtctatgttaataatgagtgggctacctccgttggtgaagggggatcatttggagaattggccctaatctatggtacccctagggccgcaacagttaaggcaaagactaacgttaagctctggggaattgaccgagattcttatcggaggatcttaatgggatctactctgaggaagcgcaaaatgtacgaggagttcctgtccaaagtttcgattctggaaagccttgacaaatgggagagactgaccgtggcggacgcactggaaccggtgcagttcgaagatgggcagaaaattgtggtgcagggagaaccgggagacgagttctttattatactcgaaggcagcgccgctgtgcttcaacgcagatctgaaaacgaggaatttgtggaggttggcaggctgggcccaagtgactacttcggcgagatcgcactgctgatgaacaggccacgagcggctacggtggtcgctcggggacctctcaagtgtgtgaaactggacaggcctaggtttgagagggtcctgggaccatgcagcgacattctgaagcgcaatatccagcaatataacagctttgtgtcattgtcggtgtag

SEQ ID NO: 236777 - DNA, 1146 bp, Artificial Sequence
  Description of Artificial Sequence: Synthetic coding sequence
atggaaagcggctccacagctgccagcgaggaggccaggtctctgagggagtgtgagttgtatgtgcagaagcacaacattcaagcactgcttaaggactctatcgtgcagttgtgcactgccaggccagaaaggcctatggctttcctcagggagtatttcgagcggctggagaaggaggaagcaaagcagattcaaaacctacagaaggctggaacacgcactgacagtagagaagacgagatctccccccctccaccaaatccggtcgtgaaggggaggaggaggaggggcgcaattagtgctgaggtttacaccgaagaggacgccgcaagctacgtgcgcaaagtgatacctaaagattacaagactatggccgctcttgcaaaagctattgagaaaaacgtacttttcagccaccttgatgataatgaaagaagcgacattttcgacgctatgttttcagtgtcgttcattgccggagagaccgtgatacagcagggcgatgaaggggacaatttctacgtgattgatcagggggagaccgatgtttacgtaaacaacgagtgggctactagcgtaggtgaggggggaagcttcggcgaactggcactgatatacggcacaccacgcgctgcgacggttaaagcgaagactaacgttaaactgtgggggatagatcgcgacagctatcggagaattctcatggggtcgactctcaggaagagaaagatgtatgaggagtttctgagtaaggtgagtatcctggagtcactggataaatgggagagactcacagtggccgacgccttggaacctgtgcagttcgaagatggtcagaagattgtggtgcagggagagcctggcgacgaattttttatcatcctggagggctccgccgctgtcctccagagacgcagtgaaaatgaggaattcgtggaggttggcaggttggggccatccgactatttcggagagattgccttattaatgaatcggccaagggcagccacagtagtggcgagagggcctttgaaatgtgtcaaactagatcgtcccaggttcgaacgggtgctgggcccatgctcagatattctcaagaggaatatacaacaatataactcgttcgtgagtcttagtgtgtag

SEQ ID NO: 236778 - DNA, 1146 bp, Artificial Sequence
  Description of Artificial Sequence: Synthetic coding sequence
atggaaagcggctcaacggcggcatcagaggaagccaggagtctgcgggaatgcgagctgtacgttcagaagcacaatatccaggcattgttaaaggactccattgttcagttatgcactgctcgcccagagcggcctatggcctttcttcgcgagtacttcgagagactggagaaggaagaagccaagcagatccagaatctccaaaaagccggtacccggactgatagcagagaagacgaaatatcccccccacccccaaacccggtcgttaaaggcaggagacgcagaggggcaattagtgcggaggtctacacagaagaggacgccgctagctacgtgcgtaaagttatcccaaaggactacaaaacaatggctgctctggctaaggccatagaaaaaaatgtgctgttttcacatctggacgataatgaacgaagcgacatcttcgatgcaatgttcagcgtctcctttatcgccggtgagacagtcatccagcagggtgatgagggtgataacttctacgtaatcgatcaaggcgagaccgacgtgtacgtgaacaatgaatgggcaacatctgtgggggaaggcggatctttcggcgaacttgcactgatttacggaactcccagggctgctacagtaaaggccaagactaatgtcaaactctgggggatcgacagagattcctacaggaggattctcatggggagcaccttgagaaagcggaagatgtatgaggaattcctcagtaaggtctctatcctcgaaagccttgacaaatgggaacgtctgaccgttgcagacgcactggagcctgttcagttcgaagatggccagaagatcgtggttcagggggaacccggtgacgaattctttattattttggaggggtctgcggcagtactgcagcggagaagtgagaacgaggaatttgttgaggtgggaagattggggccatctgattactttggggagatcgccctgctgatgaacagacccagagccgcaacggtggtcgcgagaggtcctctgaagtgtgttaagctggatagaccccgtttcgaaagggtcctgggcccatgcagcgatattctgaagaggaacatccaacagtataacagcttcgtgtccctgagcgtgtag

SEQ ID NO: 236779 - DNA, 1146 bp, Artificial Sequence
  Description of Artificial Sequence: Synthetic coding sequence
atggagagtggttcgaccgctgccagcgaagaggctcggagtctaagggaatgtgagctgtacgtccagaagcacaatatacaggctctgctgaaggatagcatagtacagctatgtactgctagaccagaacgacctatggccttcctgagagagtactttgagagattggaaaaagaagaggcaaagcagattcagaatttacaaaaggcaggaacccgcacggattctagggaggatgaaatttctccaccccctcccaatcccgtggttaaggggaggcggaggagaggagccatctcagctgaagtgtatacagaggaggacgctgcatcctatgtgcggaaggtcattccgaaggattacaagaccatggcggcactagccaaagcaattgagaaaaacgtactcttctctcacttggatgacaatgagaggagcgacatctttgacgcaatgttttcggtcagcttcatagcgggagagactgttatccaacagggcgatgaaggcgataatttttatgtaattgatcaaggagagaccgacgtttatgtgaataacgagtgggcaacatcagtcggtgagggcggttctttcggagagctggctcttatttacgggaccccgagggcagctaccgtgaaagccaaaacaaatgtgaagttgtggggaatcgaccgggacagttacaggcgaatcctcatgggcagtacactgagaaagaggaagatgtacgaagagttcctttccaaggtgagtatattggaatcactcgataaatgggaaagactgaccgtcgctgatgccctggagcccgttcaatttgaagatggacaaaagatcgtagttcagggggaacctggggacgagtttttcattatcttagaagggagcgcagccgtcctgcagcgtagatccgagaacgaagagttcgtggaggtcgggagactgggaccctcagattattttggagagatcgcactgctgatgaatcgtcccagagccgctacggtggtcgcacggggtccactgaagtgcgtgaagctggacagaccacgctttgaaagggttctgggaccatgttcagacattctcaaacgcaacattcagcaatataacagctttgtgagcctctctgtgtag

SEQ ID NO: 236780 - DNA, 243 bp, Artificial Sequence
  Description of Artificial Sequence: Synthetic coding sequence
atgggctctacccttaggaaaaggaaaatgtatgaggagtttctttccaaggtgtccatcctggagtccctggaaaagtgggagcgattaaccgtggcagatgcactggagcctgtccagttcgaagatggcgagaaaatcgtcgtgcaaggcgagccgggtgatgacttctacatcatcactgagaagaacctgccaggcgtggttgcccacgcatgtaatccgtcttacctgggaggatag

SEQ ID NO: 236781 - DNA, 1146 bp, Artificial Sequence
  Description of Artificial Sequence: Synthetic coding sequence
atggcttcaccaccggcatgtccaagcgaagaagacgagagtctgaaggggtgcgagctttatgtacagttgcacgggatacagcaggtactcaaggactgtattgtgcatctgtgcatttctaagcctgagcggcctatgaagtttctgcgcgagcacttcgagaagctggagaaggaagaaaacagacagattttggctagacagaagtctaattcccagtctgattcgcatgacgaagaggtgagtccgactcctcctaacccagtggtgaaggcgcgaaggaggcggggaggcgtgtccgctgaagtttataccgaggaagatgcagtcagctatgttcgcaaagtcatcccaaaggactacaaaactatgacagccctagctaaagcgattagcaagaatgtccttttcgctcacttagatgacaatgagaggagcgacattttcgacgccatgtttcccgttacacacattgccggagaaacagtgatccaacaggggaatgagggggacaatttctacgtggttgaccagggagaggtggacgtgtacgtgaatggtgaatgggtgactaacatttctgagggcggatcttttggagaacttgccttgatctacggaacgcccagggccgctacggtaaaggcgaagacagacctcaaactgtgggggatcgatagagactcataccggaggatcttaatggggtcaacactgcggaaacgtaagatgtatgaagaattcctgtcaaaagtgagtatccttgagtctctggagaagtgggaacgccttaccgtggcggacgcgttggagcccgtgcagttcgaagatggtgagaagatcgtggtccaaggagaaccaggcgacgacttttacattattacagaaggaactgcttccgtgctgcagagaaggagcccaaacgaagagtatgtggaggtcgggagattaggtccttccgactattttggcgaaatcgccctgctcctgaaccgaccacgagcggctaccgtagtggctaggggccctctgaagtgtgttaagttggaccggccacgcttcgaacgtgttctgggaccgtgctctgaaatactgaagcgcaacatccagcggtataattcatttatctctttgacggtgtag

SEQ ID NO: 236782 - DNA, 1146 bp, Artificial Sequence
  Description of Artificial Sequence: Synthetic coding sequence
atggcatccccccctgcgtgcccttccgaagaggatgagagcctcaaaggctgtgaactttatgtgcagctgcacggaattcagcaggttttaaaggactgcatagtgcatctttgtatctcaaaaccggagcgcccaatgaagtttctgagggaacactttgagaagctggaaaaggaagagaaccggcaaatcttggcacggcagaaatccaatagccaaagcgacagtcacgatgaagaggtgagcccgactcctccaaacccagtagtgaaggccagaagaagaaggggtggagtcagcgcagaggtctatactgaggaggatgctgtgagttacgttaggaaggtgatacccaaagattataagacgatgaccgcccttgccaaggcaatcagcaaaaatgtactctttgcccatttagatgacaacgagagaagtgacattttcgacgccatgttccctgtcacgcatattgcaggcgagacagtgattcaacagggtaatgagggcgacaatttttacgtggttgatcaaggggaggtggatgtgtatgtgaacggagagtgggtgacaaacatttccgagggcggaagctttggcgaactggccctcatatacgggacaccacgcgctgcaaccgtgaaggcaaaaactgatctgaagctttggggcatcgaccgcgacagctatagacgaattttgatggggtccaccctgcgaaagagaaaaatgtatgaagagtttttgtctaaggtcagcatcctcgagagcttggagaagtgggagcgcttgacggtggccgatgccctcgaaccagtgcagttcgaggatggtgaaaagatagtagtgcaaggagaaccaggggatgatttttatattattactgaaggtaccgcctctgtccttcagcgcaggagccctaacgaagaatacgtggaagtgggtcggttgggacctagcgactatttcggcgagattgctctgctactgaatcgcccacgggcagctacggtggtcgccagggggcctttgaagtgcgtgaaactggaccgtccgagattcgaaagagtcctggggccatgttctgagattttaaaacggaacattcaacgatataactccttcatctctctgacagtctag

SEQ ID NO: 236783 - DNA, 1146 bp, Artificial Sequence
  Description of Artificial Sequence: Synthetic coding sequence
atggcatcacccccagcttgcccctctgaggaagacgagtctctcaaaggctgtgaactctacgtgcaattacacggcatacaacaggttctgaaagactgcatcgtccacctgtgtatctctaaacctgagagacctatgaaatttttacgggagcatttcgaaaagcttgagaaagaagagaacagacagatccttgccaggcagaaaagcaattctcagagcgattcccacgacgaggaggtgagcccgacaccccctaaccccgtcgtaaaggccaggcggaggcggggaggcgtgagcgctgaagtgtataccgaagaagacgcagtaagttacgtaagaaaggtcatccctaaggattataaaacaatgaccgccctcgcaaaggcgatctctaagaatgtactgttcgcacacctcgatgacaacgaaaggagcgatatctttgatgccatgttcccggtgacccacatcgccggtgaaacggtgatccaacagggcaacgaaggcgacaatttctatgtcgtagatcaaggtgaggtcgacgtctacgtgaatggggaatgggtcacaaatatcagcgaggggggaagttttggagaattagctcttatttacggaacccctagggccgcaaccgtaaaggctaagacagatctaaaactatggggaatcgatcgggatagttacagacgaatcctcatgggcagcaccctgcgaaagaggaaaatgtacgaggaatttcttagtaaggtttctatcctggaatctctggagaagtgggaacggctgaccgtggccgacgccctggagcccgttcaattcgaggacggtgagaaaattgtcgttcagggagaacccggtgatgatttttatataattacagaaggtaccgcaagcgtgctgcagcgaaggtcccctaacgaagaatatgttgaagtcgggcgtctgggcccttcagattactttggtgagatcgccctgctactgaacagaccgcgtgcagccaccgttgtagctagaggtccactaaagtgtgtgaaactggaccggcctcgatttgagcgcgtgctcggcccttgcagtgagattctgaaacggaatattcaaagatacaatagctttataagcttaaccgtctag

SEQ ID NO: 236784 - DNA, 498 bp, Artificial Sequence
  Description of Artificial Sequence: Synthetic coding sequence
atggcctcaccaccagcttgtccgtccgaggaggatgaatctttgaaaggatgcgagctgtatgtgcagctgcacggcatccaacaggtacttaaggattgcattgttcacttgtgcatctccaaacctgaacgccctatgaaatttctacgagaacacttcgagaaactggagaaagaggaaaatcgccagatcctcgccaggcagaagtcaaattcacagtccgacagtcatgacgaggaggtgtctcccacaccgccaaaccccgttgttaaggctaggcgcaggagggggggagttagtgcagaggtttatactgaagaagacgccgtctcttatgtgcgcaaagttattccaaaggattataaaaccatgacagccttggcgaaggccatcagcaaaaacgtgctctttgctcacctggacgataacgagcggtccgacatatttgatgcaatgtttcccgtcacacacatcgccggagaaacggtgatttag

SEQ ID NO: 236785 - DNA, 894 bp, Artificial Sequence
  Description of Artificial Sequence: Synthetic coding sequence
atggctagccctcctgcctgcccttcagaggaggacgagtccctgaaggggtgcgagctatatgtccaactgcacggtatccagcaggtcctgaaagactgtatcgtgcacctgtgcatctccaaacccgagagacctatgaaattcctgagagaacatttcgagaagttagagaaggaggaaaacagacaaatcctagctcgtcagaagtccaactctcagagtgatagtcacgacgaagaggtatcaccaacgccgcctaaccctgtggtcaaggctcggaggcggaggggtggcgtctctgccgaggtctacaccgaagaagacgctgtttcttatgtccgcaaggtgatcccgaaggactacaaaaccatgacagcactggccaaggctatatccaaaaacgtacttttcgcccacctggacgataacgagcgttcagacatcttcgatgccatgtttcctgttacacatattgccggagagacagtgattcagcagggcaacgagggtgacaacttttatgtggtagatcagggtgaagttgatgtttacgtgaacggagagtgggtcactaacatcagtgaagggggatccttcggtgagctggcactgatttatggaacacctcgggctgcgactgtcaaggctaaaacggacctcaaactctgggggatagatcgcgatagttacagacggatccttatgggtagcaccctcagaaaaaggaagatgtacgaagaatttctatctaaggtgtcaatactggaaagcctggaaaaatgggaacgactgaccgtcgccgacgcactggaacccgtgcagttcgaagatggcgagaaaatcgtggtgcagggggaacccggagatgatttttacatcattaccgaatag

SEQ ID NO: 236786 - DNA, 177 bp, Artificial Sequence
  Description of Artificial Sequence: Synthetic coding sequence
atggccagccccccagcttgcccaagcgaggaggacgaatcattgaagggatgcgagttgtacgtccagctccatggaatccagcaggtgcttaaggactgcatagtgcacctgtgcatctcgaaacccgaacggcctatgaagtttctccgcgagcatttcgagaagctggagtag

SEQ ID NO: 236787 - DNA, 1146 bp, Artificial Sequence
  Description of Artificial Sequence: Synthetic coding sequence
atggccagtccgccagcctgcccctccgaagaggacgaaagcttgaagggctgcgaattgtacgtgcagcttcatggaattcaacaggtgctgaaggattgcattgttcacctgtgcatctcaaaaccagaaaggcccatgaagtttctccgggagcactttgaaaagcttgagaaggaagaaaaccgtcagatcctggctcggcagaaaagcaattcccagtccgactcgcatgacgaggaggtgagtcctacaccccctaaccccgttgtcaaagctcggaggcggcgtggtggggtttccgccgaagtctatacggaagaggatgctgtgtcctacgtacggaaagtcattcctaaggactataaaactatgacagcgttggcaaaggcaattagcaagaatgtgctctttgcccatctggatgacaatgagcgctcagatatcttcgacgctatgttcccagtgacccacatcgccggagagacagtcatccagcaggggaatgagggtgacaatttctatgtggtggaccagggggaagtggatgtgtacgtcaacggagaatgggtgactaatatcagcgagggcggatctttcggcgagctggccctaatctacggaaccccacgggctgccacggtgaaggccaaaaccgacctgaaactttggggaatcgatcgagactcctatagacgtatcctgatgggttccacattacgaaaacgcaaaatgtatgaagagttcctgtccaaggtaagtatcctggagagcctcgagaagtgggaacggctgacggtggcggacgctctcgagcccgtgcagtttgaagatggagagaaaatcgttgtccagggcgagccaggcgatgatttttatattatcaccgaaggtacagcctccgtgcttcaaaggcgctcgccaaacgaggaatacgtcgaagtgggaagattgggcccatccgactatttcggagagattgccttactgctgaataggccgagggccgcaactgtggtggccagaggacctctcaaatgtgtgaaattagatcggccacggttcgagcgcgtgctgggcccatgttctgagattctgaagagaaatatccaaagatataactccttcattagtctgaccgtttag

SEQ ID NO: 236788 - DNA, 1146 bp, Artificial Sequence
  Description of Artificial Sequence: Synthetic coding sequence
atggcaagtcctcccgcatgccccagtgaagaggacgaatccttgaagggttgtgaactgtatgtgcaacttcacgggatccagcaggtactgaaagactgtatcgtccatctttgtattagcaagcctgagaggcccatgaaatttctaagagagcattttgagaagctagaaaaagaggagaataggcagatccttgccaggcaaaagagcaactcgcagtccgactcccacgatgaagaggtgagccccacccctcctaaccccgtggtcaaagcacgacgtcggcgtggcggagtatctgctgaagtgtacactgaagaagatgccgtctcctatgtgcgcaaggtaattcctaaggactataagactatgacggcactagcgaaagccattagcaaaaacgttctgttcgcccacctggacgataacgaacgtagtgatattttcgacgccatgtttcctgtcacccatatcgccggagaaacggttattcagcagggcaacgaaggagataatttctacgtcgtggaccagggggaagtcgatgtctatgtgaacggcgaatgggtaacaaacatcagtgaagggggatcctttggcgaactggcactcatctatggaaccccaagggccgcaaccgtgaaagccaagaccgacctgaaactctggggcatcgaccgggactcataccgcaggatcctgatgggtagcactctgcggaagcgcaaaatgtatgaggagtttctgtctaaagtatctatcctggagagtttggagaaatgggaaaggctgacagttgccgatgcgttagagcccgtccaatttgaagatggggagaaaattgtggtgcagggagagccaggtgacgacttttacatcattaccgaggggactgccagcgtcctgcagcgccgatccccaaatgaggaatatgtggaagtcggacgactggggccatctgactacttcggagaaatagctctactgttgaaccggccaagagccgcaacagtggtggctagaggacctttaaagtgtgtcaaactggatcgtccacggttcgagcgggtcttaggcccttgttcagagatcttgaaacgaaacatccagcggtacaacagcttcatctccctcaccgtctag

SEQ ID NO: 236789 - DNA, 1215 bp, Artificial Sequence
  Description of Artificial Sequence: Synthetic coding sequence
atgtctcacatacagattcccccagggctgacagaactcctgcaaggctataccgtggaagtgcttcgccagcagcctcccgacttagttgaattcgctgtcgagtacttcacaaggctacgcgaggccagagcgccagcttccgttctcccagccgcaacccccaggcagtccttgggccatccaccgccagagccaggtcccgatcgagttgcggacgctaagggagactctgagtccgaagaggatgaggacctcgaggtgccagtgccttctaggttcaatcgccgagtcagtgtatgtgcggagacatacaaccctgatgaagaggaggaggatacagatccgagggtgatacaccccaaaacggacgagcaacgctgtcggttgcaagaggcttgtaaagatattttgctctttaaaaacctggaccaagaacagctgagccaggtccttgatgccatgtttgaacgtatagtaaaggctgatgaacatgtaatagatcagggggacgacggcgataatttttacgtgattgagcgagggacatacgacattttggtgacgaaggacaaccagactcgatctgttggacaatacgacaacagaggaagcttcggagagctggccttaatgtacaatacccccagagctgcaactatagtggccacttctgaaggtagcctatgggggttggatcgggttaccttccgcagaataattgttaagaacaacgcgaaaaagagaaaaatgttcgagtctttcatcgagagcgtgcccctgctcaaatctcttgaagtctccgagagaatgaagatcgtggatgtaataggggaaaagatctataaagatggggagagaataattacacagggtgagaaggctgattccttttacatcatcgagtctggggaggtctctatccttatcagaagccggacaaagagcaataaagatggcggtaatcaagaagtcgagattgcaagatgtcataagggtcagtattttggtgagttagcccttgtcactaacaagccaagggccgcaagcgcttacgctgtgggcgatgtcaagtgcctggttatggacgttcaggcatttgagaggctgctcggaccctgcatggatattatgaaaaggaacatttcccattatgaggaacagctggtgaaaatgttcggttcttccgtagacctgggaaatttggggcagtag

SEQ ID NO: 236790 - DNA, 1149 bp, Artificial Sequence
  Description of Artificial Sequence: Synthetic coding sequence
atgtctcatatccagatcccaccgggtctgacagagctcctgcaggggtacactgttgaggttctccgacaacagccacctgacctggtggagttcgcagtagaatacttcacacgcctgcgggaggcacgcgctcctgcgtccgtgttaccagctgccacgccaaggcagtctttgggccatccccctcctgaaccaggaccagatagagtggctgatgccaaaggagactcagaatccgaggaggatgaagacctggaagtacccgtgccctcacgcttcaacaggagggtgtcagtctgtgccgagacatataacccggacgaggaggaagaagacacagatccaagggtgatccatccgaagaccgatgagcagcgatgccgcttacaggaggcatgcaaagacattctccttttcaaaaacctcgaccaagagcagctgtcacaggtcctggatgcaatgttcgagcggatcgtgaaggccgacgagcacgttattgaccagggcgacgacggcgacaatttttacgtaatcgagagagggacatacgacattttagtcacaaaggataaccagacgcgatctgtcggccagtacgataacaggggcagcttcggcgagctggctctgatgtataacactcccagggctgccaccatcgtcgcaacttccgaaggcagcctgtggggccttgatagagttacatttcgcaggatcattgtgaaaaataacgccaaaaaacgcaagatgtttgagagcttcatcgagtccgtacctctgctgaagagcttggaggtatccgaacgcatgaagattgtcgacgtcatcggtgagaagatctacaaagacggtgagcgaatcatcacccagaccaagtcgaataaggatggaggcaaccaagaggtcgagatcgccaggtgccacaaggggcaatactttggtgagcttgcgctggtcacaaataagccaagggcagcgtcagcgtatgctgtaggggatgtgaagtgcttggtcatggatgtccaggccttcgagcgtctgttggggccttgtatggatattatgaagaggaacatcagccactacgaggagcagctcgttaaaatgtttgggagctctgtggacctggggaatctgggacagtag

SEQ ID NO: 236791 - DNA, 1215 bp, Artificial Sequence
  Description of Artificial Sequence: Synthetic coding sequence
atgtcccacatccaaataccacctggcttgaccgagctcctacagggttacactgtggaagttctgcgtcagcaacctccagatttagtggagtttgcagtcgagtactttactcggctcagagaggccagagccccagccagcgttctgcctgccgcaactccgagacagtctctgggccatcccccacccgaacccggacccgaccgggtagccgatgctaaaggagactctgaaagcgaggaagacgaagacctggaggtccccgtccccagcaggtttaacagacgcgtctcagtgtgcgccgagacctacaatccagacgaggaggaggaagacactgaccctagggtgatccatccaaagaccgatgagcagcgctgccggctgcaggaggcctgtaaggatattttgctcttcaagaacctcgaccaggaacagttatcacaagtcctcgacgccatgttcgaacggatcgtgaaagccgacgaacatgtgatcgatcaaggcgatgacggcgacaatttctacgtgatcgagagaggtacctatgatatactggtgaccaaagataaccagactcgctctgtcggccaatacgacaatagggggagctttggagaactcgctctcatgtataacacccctcgcgcagcaaccattgttgccactagcgaggggagcctgtgggggttggaccgggtgacctttaggaggattattgtgaaaaataacgcgaaaaagagaaaaatgtttgagagctttatcgagagtgtccccctgctgaagtctctggaagtgtcagaacggatgaagatcgtggacgtgattggcgagaaaatttacaaggatggagagcgaatcataacacaaggagagaaagccgacagtttttatatcattgagtccggcgaggtgtccattctgatcaggagtagaaccaagtctaataaagacggcggaaaccaagaagtggagatcgccagatgccataagggccaatatttcggagaactggcattggtgaccaacaaacctcgtgccgcatctgcctacgccgtaggcgacgtaaagtgccttgtgatggacgttcaagcattcgaaaggctgctgggcccttgcatggatatcatgaaaagaaacatctcacactatgaagagcagctggtgaagatgttcggaagttcagtggaccttggcaacctcggccagtag

SEQ ID NO: 236792 - DNA, 1257 bp, Artificial Sequence
  Description of Artificial Sequence: Synthetic coding sequence
atgtccattgagattccagctggcctcacggagcttctacagggattcaccgtcgaggtgctcagacatcaacctgctgacctcttggaattcgccctgcagcattttacccggctccagcaggaaaacgaacggaaagggactgcgcgatttgggcatgaggggcgaacctggggtgatctgggggcagccgctggcggaggcacaccttcaaaaggcgtgaacttcgcggaagagccaatgcagagcgattctgaggatggcgaagaggaagaagccgcacccgctgacgcgggagccttcaatgccccagtgatcaaccgcttcacaaggcgtgcgagcgtgtgtgcagaggcctacaatccagacgaggaggaggatgatgctgaatctagaatcattcaccctaagacagatgaccagagaaatcgcttgcaggaagcgtgtaaagatatattattgtttaaaaatctggacccggagcagatgtcacaggtgttggacgctatgttcgagaagctggttaaggatggcgagcacgtaatcgatcagggagatgacggcgataatttttacgtaatcgataggggtaccttcgacatatatgtaaaatgcgacggggtggggcgatgcgtcggcaattacgacaatagaggatcctttggtgagttagctctgatgtacaacacaccccgagccgcaaccatcaccgctacaagcccaggagcactgtggggcctggaccgcgtaaccttcagaagaattatagtgaagaataacgccaaaaagcgaaaaatgtacgagagcttcattgagtcactgccctttttgaaaagcttagaattctctgaaaggttgaaagtggtcgatgtcatcggcaccaaggtgtataacgatggtgagcaaattatcgcccagggagattcagccgattcattctttattgttgaaagcggtgaagtcaaaattaccatgaaaagaaaaggcaagagtgaggtcgaagagaatggtgccgtagagatcgctcggtgttcccgcggacagtatttcggtgagcttgccctcgttacaaataagcccagggccgcaagcgcacatgccatcgggaccgttaaatgcttggccatggacgtgcaggccttcgaaagactgctggggccatgcatggaaattatgaaacgcaacatcgccacgtacgaagagcagttggtggcactcttcgggaccaacatggacattgtggagcccactgcttag

SEQ ID NO: 236793 - DNA, 1218 bp, Artificial Sequence
  Description of Artificial Sequence: Synthetic coding sequence
atgtccattgagatcccagccggactcacagagctcctccagggtttcaccgtagaagttctgcggcaccagccagccgatctcttagagttcgccctgcagcacttcactagactgcaacaggagaatgagaggaaaggtactgcacgattcggccacgaagggcgtacttggggcgatctgggcgcagcagctggagggggaaccccgagtaaaggggttaatttcgcggaggaggcagctccagctgacgccggagcgttcaacgcgccagttatcaaccgctttactcggcgtgccagcgtgtgcgcagaagcatacaacccagatgaggaagaagatgacgctgaaagcagaattatccaccctaagaccgacgaccagaggaatagattgcaggaggcctgcaaggacatcttgttgtttaaaaatttggaccctgagcagatgtcccaggtcctggacgcaatgtttgagaaactagtgaaggacggagaacacgtgattgaccagggcgacgacggagacaacttctacgtaatagatcgcggaacatttgatatctacgtgaagtgcgatggagtgggcagatgtgtcggtaattacgacaatcgcggatcctttggcgagctggcactgatgtataacacccctagggcggcaacgatcactgccacctcccctggtgcactctggggactggaccgagtcacatttaggaggataatagtgaagaacaacgccaaaaaacgtaaaatgtatgaaagtttcattgaatccctgccctttctcaagtctttggagttctcggagcggctcaaggttgtagacgtgatcggaacaaaagtttataacgacggggagcagatcatcgctcagggcgatagcgcagattcattctttatcgttgagtctggcgaagtgaagattactatgaagagaaagggcaaatctgaagtcgaagaaaacggagccgtggagattgcgcgatgcagtcgcggtcaatatttcggggagctcgctctggttacaaacaaaccccgagcagcctcagcccacgccatcggcacagtaaagtgcctcgcaatggatgtgcaggctttcgagcggctgttagggccatgcatggaaatcatgaaacgaaacatcgcaacatacgaggagcagctggtcgcattgtttggaacgaatatggatattgtggagccaaccgcttag

SEQ ID NO: 236794 - DNA, 1257 bp, Artificial Sequence
  Description of Artificial Sequence: Synthetic coding sequence
atgtcaattgaaattcctgcgggactcactgaactgctccaaggattcacagtcgaagttctgcgacatcagccggctgacttattagagttcgcactgcagcatttcacccgcttacagcaagaaaatgagcggaagggcaccgcacgttttggacacgagggcaggacttggggagacttgggcgcagcggcagggggagggaccccctctaaaggtgtgaactttgccgaggaacctatgcaaagcgactcagaagacggagaggaggaagaagccgcaccggcagatgcaggagcattcaacgctccggtcatcaacagattcacacgcagagcatctgtttgtgccgaggcctacaaccctgacgaggaggaggatgatgcggagtctcgcatcatccatccgaaaacggacgatcagcggaaccgccttcaggaagcttgcaaggacatcctcctgtttaagaacttggatcctgaacagatgtcccaggtcctggacgctatgtttgaaaagctggttaaagatggcgagcacgttatcgaccagggggatgatggggataacttttatgtgatagacaggggcacttttgacatctacgtgaagtgcgatggtgtgggcaggtgtgtgggaaactacgataaccggggatcgtttggggaacttgcgcttatgtataacacgcccagagccgcaacgatcactgccaccagtcccggagctctatggggactggacagagtgaccttcaggagaatcatcgttaagaacaatgctaaaaagcggaaaatgtatgaatcctttatcgagtccctaccttttctgaaatctctggaattcagcgagcgcttaaaagtggtcgacgtgattggaaccaaagtgtacaatgatggcgagcagatcattgcccagggtgattcagcagactctttctttatagtcgaaagtggcgaagtgaaaatcactatgaaacgaaagggcaagtctgaggtggaagagaacggcgctgtcgagattgctaggtgttcaaggggccagtattttggtgagcttgcattggtaacaaataaaccccgagctgccagtgcgcatgccattggcaccgtgaagtgcctggctatggatgttcaagccttcgagcgcctgctcggtccctgcatggaaattatgaagcggaacatagcaacatacgaagagcaactcgtggcgctctttggtacaaatatggatatcgtcgagcctactgcctag

SEQ ID NO: 236795 - DNA, 1170 bp, Artificial Sequence
  Description of Artificial Sequence: Synthetic coding sequence
atggagaagcagaacatgtttctacacgggagttatattctgcgggaggacgtcagaactgccaatgtcatcgccgcagaggccgttacctgcctcgtgattgacagagacagctttaagcaccttattggaggcctggacgacgtatccaataaggcttacgaggacgctgaagcaaaagccaaatacgaagcagaggcagctttctttgctaacctgaagctgtccgactttaatataatagacacattgggggttggaggctttgggcgtgtggagctggttcagcttaagtcagaggagtccaagaccttcgccatgaagattcttaaaaagcggcacattgtcgacactcgacaacaggagcacattcgctcagaaaaacagatcatgcagggtgcccacagtgactttattgtcagactgtatcggacatttaaagatagtaagtacctctacatgttaatggaggcctgtctaggtggggagctgtggaccatcctgcgcgatcgaggctccttcgaggacagtaccactcggttttatactgcatgtgtggttgaagccttcgcttatctccactctaaaggtattatctatagagatttgaagcccgagaacctgattctagatcacagggggtacgcaaagctcgttgatttcggctttgctaaaaaaataggcttcggaaagaagacctggacgttctgtggaacccccgagtacgtagccccagagattatactcaataaaggccatgacatcagtgcagattactggtccctgggaatccttatgtacgagttgttgacgggcagcccacctttttccggaccagaccctatgaaaacttacaatataatccttcgcggaatcgatatgatcgagttcccgaaaaagattgctaaaaacgcagccaaccttattaagaagctctgcagggacaatccatctgaaaggctcgggaatctgaagaacggtgtcaaggatattcagaagcacaaatggttcgaaggatttaactgggagggattacggaagggcactttaacgccacctatcatcccgtcagtggcaagtcctactgatacatccaactttgacagcttccctgaggataacgatgagcctccaccagacgacaactctggttgggatattgacttttag

SEQ ID NO: 236796 - DNA, 852 bp, Artificial Sequence
  Description of Artificial Sequence: Synthetic coding sequence
atgaaaatcttaaagaaaaggcatatcgtggacacacgccagcaagaacatattaggagtgaaaagcagatcatgcaaggggcacattccgacttcatcgttcgcctctacagaaccttcaaagatagcaaatatctctacatgctgatggaggcatgcctcggcggagagttgtggacgatactgcgcgaccggggttcgtttgaggactctaccacacggttttacactgcatgtgtggtagaggcctttgcctacctgcacagcaagggtattatctacagggacctcaaaccagaaaatctcattttggaccaccgcggatacgcaaaacttgttgatttcggatttgctaagaagatcggatttggtaagaaaacctggaccttttgcggaactcccgagtatgttgcgcctgagatcatcctaaacaaggggcacgatatatctgctgactattggtccctgggtatccttatgtatgaattattaacgggttcccctccttttagtggccctgaccctatgaagacctacaatatcatcctgagggggattgatatgatcgagtttccaaaaaagattgctaagaatgccgcaaacctgatcaaaaagctgtgcagagataacccctctgaacgtcttggcaatcttaaaaatggagtgaaggacatccagaagcacaaatggttcgaaggcttcaactgggagggattgagaaaaggaactcttactcctcctataattccctccgtggcgagccccaccgacacgagcaacttcgattcatttcccgaggataatgacgaaccaccccctgacgataatagcggttgggatatcgacttttag

SEQ ID NO: 236797 - DNA, 546 bp, Artificial Sequence
  Description of Artificial Sequence: Synthetic coding sequence
tcttgtattatcaaggagggagacgtgggcagcttggtctacgtgatggaggacgggaaggttgaggtgaccaaagaaggagtgaaactatgtaccatgggccctggtaaagtattcggtgagctggcaattctgtataactgcacacgaacagccactgtgaagaccctggtcaacgttaagctgtgggctattgaccgccagtgtttccagactatcatgatgcggacaggtctgattaagcacacagaatatatggaattcctgaagtccgtacccacatttcagagtctgcctgaagagattttatcaaagctcgcagacgttttagaggaaacacactatgagaatggagagtatattattaggcagggagcccgaggggacacgttttttattatttcgaaaggcacggtgaacgtcaccagagaagactccccgtcagaagatcctgtgtttttgaggacgcttgggaaaggcgactggttcggggagaaagctcttcagggctggacctggaacctgttcgaatatgtggtcgagtag

SEQ ID NO: 236798 - DNA, 2061 bp, Artificial Sequence
  Description of Artificial Sequence: Synthetic coding sequence
atggggacgctgagagacctgcagtatgctctgcaagaaaagatcgaggagcttcggcagagagacgctctgatagatgaactcgagctagaactagatcaaaaagatgagcttattcaaaaactgcaaaatgaactcgataagtatcgctcggttatccggccagccacacaacaggctcagaagcagtctgcctctacattgcagggggaacccagaacgaagcggcaagctatcagcgctgagcctacggcttttgacatacaggacctatcccacgtgacgctgccattctaccctaagagcccccagagcaaggatctgatcaaggaagcaatcctggacaatgactttatgaagaacctggaactttctcagatacaggagatcgtggactgtatgtatcccgtggagtacggcaaggattcctgcattataaaggaaggggatgttggatcacttgtatacgtgatggaagatggtaaggttgaggttaccaaggagggagtgaagctgtgtacgatgggccctggaaaggtattcggggagcttgcaatactttataattgtactcgaaccgcaacagtcaagaccctcgtaaacgtcaaactctgggccatagatcgacagtgctttcagacaatcatgatgcgaaccggtctgataaagcacaccgagtatatggagtttttgaaaagtgtgccaacctttcagtccctccccgaggaaatcctgtcgaaacttgctgatgtccttgaagaaactcattacgaaaatggcgaatatatcatccgccagggagcacgaggcgatactttcttcattattagcaagggcaccgtgaacgtgacaagggaagattccccctccgaagatcccgtatttttaagaacactgggcaagggcgattggtttggtgagaaggctctgcagggagaagacgtcagaactgctaacgtgatcgctgccgaggccgtcacgtgtctagtcattgaccgggattcttttaagcacctaattggaggcttggatgacgtgtccaataaagcttatgaagatgccgaggctaaggcaaagtacgaagctgaagctgcattttttgctaatctgaagctatctgatttcaacatcatcgatacccttggagtgggaggctttggccgagtggagctcgtccagctgaaaagtgaagaatcaaagaccttcgcgatgaaaatcctcaaaaagagacacattgtcgatactcggcagcaggagcacataaggagcgaaaaacagatcatgcagggcgcacattctgattttatcgtgagactctataggaccttcaaagatagtaaatacctgtatatgctaatggaagcgtgcctcggcggtgagctgtggacgatcctgcgtgatcgaggatcatttgaagacagcactactagattttacaccgcctgcgttgtggaggcattcgcttacctgcactccaagggcattatttaccgggatctgaagccagagaatctgatcctcgatcaccgagggtatgcgaagctggtggacttcggttttgcaaagaagattggctttggcaagaagacatggaccttctgcggcacaccagaatacgtggctcccgaaatcattctcaacaagggccacgacatctcggcagattactggagcttgggaatccttatgtacgaactcctcactggctctccacccttcagtggacccgacccaatgaagacttacaatattattctgagaggcatagatatgatcgaattcccaaaaaagatcgcaaaaaatgcagctaacctcattaagaagttatgccgcgataacccttcagaacgcctaggaaatttgaagaatggggtaaaggatattcagaagcacaagtggtttgaagggtttaattgggaagggctgcgaaagggtactcttacacctcccattatccctagcgttgcgtctcctacagatacctcaaactttgactctttcccggaggacaatgacgagcccccaccagacgataactcagggtgggacatcgatttttag

SEQ ID NO: 236799 - DNA, 1980 bp, Artificial Sequence
  Description of Artificial Sequence: Synthetic coding sequence
atgctgaaggaggaacgaataaaagagctagagaaacgactgtccgagaaagaagaagaaatccaggaactcaagagaaagcttcataagtgtcagtcagtgctgcccgtccccagtacacacataggacccaggacaactagagcccagggcatatccgcagaaccacaaacgtaccgctctttccatgacctccggcaggcctttcggaagtttaccaagagcgagcgcagtaaggaccttatcaaagaggcaatcctggacaatgacttcatgaaaaatcttgaactgtcccagattcaggagatcgtcgattgtatgtatcctgttgaatacgggaaggactcttgcattattaaagaaggagatgtcggttctttagtatacgtgatggaagacggtaaggtggaggtcacaaaagaaggcgtgaagctgtgtactatgggacctggtaaggtgttcggagagctcgccatcttgtataattgcactcggacagccaccgtaaaaaccctggtgaacgttaagctctgggcaatcgaccggcagtgtttccaaacgataatgatgcgaactggtttaataaagcataccgagtacatggaattcttaaaatccgtgcctacgtttcagagtctccctgaggagatcttgtccaaactggcggacgtgctggaggagacgcattacgaaaacggggagtacataattaggcaaggggctaggggcgatactttttttattatttctaaaggaaccgtcaacgtgactcgggaagattcaccaagtgaggaccccgtcttcctgcgtactctgggaaagggtgattggtttggagagaaggctttacagggcgaggatgtgcgaacagccaacgtgattgctgccgaggcagtaacctgtcttgtgatagatcgggatagcttcaaacatctgattgggggtctagacgatgtttctaataaagcatatgaggatgccgaagctaaggccaaatatgaagcagaggcagccttctttgctaatcttaaattatccgatttcaatatcattgacacgctcggtgtggggggatttggtagggtggagctggtgcaactcaaatctgaagagagcaagacttttgccatgaaaatcctcaaaaagcgtcatattgtcgacacccggcagcaggaacacatccggagcgagaagcaaattatgcagggcgctcattccgacttcatcgtgcgtctgtatcgaacctttaaggattccaagtacctgtatatgctcatggaggcatgtctcggaggtgagttgtggactatcctaagagatagaggttcttttgaagacagtacaactcggttttacacagcatgtgttgtagaagccttcgcctatcttcacagtaagggtattatctatcgcgatctgaagcccgaaaatctgatccttgatcaccgagggtacgcgaagctggtcgactttgggttcgctaagaaaatcggttttgggaagaaaacatggacattctgcggaacgccagaatacgttgccccagagatcatccttaataagggacatgatatctccgccgattattggagcttgggtattcttatgtatgagctactgactggctctccgccattcagcgggccagatcctatgaagacctacaacattatattgcgcggtattgatatgatcgagttccctaaaaaaattgctaaaaatgcagcaaacctgatcaagaagctttgtagagacaacccctcagaacggttgggcaatctaaagaatggtgttaaagacatccagaagcacaaatggttcgagggattcaattgggaagggctgcggaagggcactcttacccctccaatcatcccctccgtggccagccctactgatacctccaatttcgatagcttcccagaggataacgacgaaccaccccctgatgacaactcaggctgggatattgacttttag

SEQ ID NO: 236800 - DNA, 2016 bp, Artificial Sequence
  Description of Artificial Sequence: Synthetic coding sequence
atgtcagagttggaggaagattttgccaaaatcttaatgcttaaagaagagagaataaaagaactggagaaacgcctttccgagaaggaagaagaaatccaggaactgaagcggaagttacacaagtgtcaatctgttctacccgtcccctctacccacattgggcctcgaactacacgggctcagggcatttcagcagagcctcagacctatcgatcatttcacgatctacgtcaggcattcaggaagtttacaaagagcgagagatctaaagatctgattaaagaagccatcctcgacaacgacttcatgaagaatctagagctgtctcagattcaggaaattgtggactgcatgtacccagtggagtacgggaaggattcatgcattatcaaagaaggagacgtaggctcgcttgtgtatgttatggaagacggcaaggtggaggtgaccaaagaaggcgtgaagttgtgcacaatgggacctggcaaggtgtttggggaattggccatcctctataactgtaccaggaccgcgacagtaaaaacactggtgaacgtgaaactgtgggctattgaccggcagtgctttcagaccattatgatgcgcaccggcctgattaaacacactgagtacatggaatttctgaaatccgtacctaccttccagtccttgccagaggaaattttaagtaaactagctgacgtcctagaggagacccactatgagaacggggaatacattattcggcagggcgctcgtggcgacaccttctttatcatttctaaaggaactgtgaacgtgacgcgtgaagactccccaagtgaggatcctgtgtttctcagaacactggggaaaggggattggttcggcgagaaggccctccagggcgaggacgtcaggaccgccaatgtaatcgctgcagaggcggtcacttgtctggttatcgaccgggactcttttaaacacctgataggaggacttgacgatgtgtcaaataaggcttacgaagacgctgaagctaaggcaaaatatgaggcagaggcagcgttctttgctaatctgaagctgagtgacttcaatattatcgacacgctcggcgttgggggttttggtagagtggagctggtgcagctgaagtctgaagaaagcaagacttttgctatgaagatcctgaagaaaaggcacatcgtggatacgaggcagcaagagcatatcaggagcgaaaagcagattatgcagggggctcactcagactttatcgtccggctctataggacctttaaagactcaaaatacctgtatatgctcatggaagcttgcctggggggagagttgtggaccatcttgcgggacaggggatcctttgaagatagcaccacccggttctacaccgcctgcgtggtggaggcatttgcttatctccactcaaaaggcattatatatagagacttgaaacctgaaaacctgatcttggaccatagagggtacgccaaattggtggacttcggcttcgcaaaaaagattggtttcggaaaaaagacatggaccttctgcggaacacccgagtacgtggcaccagaaatcatcttgaacaagggacacgatattagcgctgactattggtctctaggcattcttatgtacgagctccttactggctctcctccgttttctggtcctgatccaatgaaaacatacaacatcatcctgcgcggaatcgatatgatcgagttcccgaagaagatcgccaagaatgccgcaaacctcatcaaaaagctttgtagagacaacccttccgagcggcttggtaaccttaaaaatggcgtgaaagacattcagaaacacaagtggttcgaagggtttaattgggagggactaagaaaaggcactctgacccccccaattattccgagcgtcgcgtctcctaccgacacatccaatttcgactcctttccagaggataacgacgagccccctcccgatgataactccgggtgggacatcgatttttag

SEQ ID NO: 236801 - DNA, 2289 bp, Artificial Sequence
  Description of Artificial Sequence: Synthetic coding sequence
atgggaaacggttcggtcaaacctaagcattcaaagcatcctgacgggcattctggaaatctgactactgacgcgctgcggaacaaagttactgagttggaacgcgaactgagacgtaaggatgcggagattcaagagagagagtaccacctgaaggagcttagagagcaactgtctaagcagaccgtcgccatcgctgagctgaccgaggagttgcaaaacaaatgtattcagctgaacaaactccaggacgttgtgcatatgcagggtgggagcccactgcaagcttctcccgataaggttccattggaggtacaccgaaagacaagcggcctggtgtcgctacactcgcggcgtggtgcaaaggcaggagtttctgcagagcccacaacccgcacgtacgatttgaacaaaccacccgagttttcatttgaaaaagccagagtacggaaggattcctctgaaaagaaactgattaccgatgcgctgaataagaaccagtttctgaaaagactggacccgcagcaaattaaagacatggtcgagtgtatgtacgggcgtaactatcagcagggctcctatattatcaagcagggagagcccggtaaccacatttttgttctcgctgagggccgtcttgaagtgttccaaggggagaagctgctgtcaagcatccctatgtggacgacattcggagagctcgctattctttacaattgtactcgaaccgcctctgttaaggcaatcaccaacgtgaagacttgggcacttgaccgagaggtattccagaacatcatgagaagaacagcgcaggcgagagatgagcagtacagaaatttcctcaggagcgtctcgcttctgaaaaacttgcctgaggacaaacttaccaagattatcgattgtttggaagtcgagtattacgataaaggagactatatcatccgggagggagaggagggcagcacgttctttattctggctaaggggaaagttaaggtcactcagtctactgaggggcatgaccaaccccagcttatcaaaacccttcagaaaggcgagtacttcggcgaaaaagctttgatcagtgatgatgttcggtccgctaatatcattgccgaagaaaacgatgtcgcttgcctggtgattgatcgagagacgttcaaccagaccgtgggcaccttcgaagaactccaaaaatatctggagggttacgtggccaacctgaatagagatgacgaaaagaggcatgccaaacggagtatgagcaactggaagctgagcaaggctctgagtttggaaatgatccaactgaaggagaaggtggccagattctccagctcatcccctttccagaatttagagatcatcgctactttgggggtcggagggttcgggcgagtggagcttgtcaaggtcaagaacgaaaacgtggccttcgccatgaagtgcatcaggaagaagcatatcgttgacacaaaacagcaggagcacgtctacagcgagaagcgtatcttagaggagctgtgtagcccttttatcgtgaaactgtacaggaccttcaaggacaacaagtacgtgtatatgttgctcgaagcctgtctggggggagagctgtggtccattctgagagatcggggtagcttcgacgagccaacgagtaaattttgcgtggcctgcgttacggaggccttcgactacctccataggttgggtattatctatcgggacctgaaaccagaaaacctaatactggatgccgagggctatctgaaactggttgactttggattcgctaagaagattgggagcggacagaaaacgtggaccttctgcggcacccccgagtacgtggccccagaggtgatcctgaataaagggcatgactttagcgtcgacttttggtccctgggaatactggtgtacgagcttcttacaggcaatcccccattctcaggggtagaccaaatgatgacatacaacctgatccttaaaggaatcgagaagatggattttcctcgaaaaatcactcggcgtcctgaagacctcatcaggagactctgcaggcagaacccaaccgaacggctggggaatcttaaaaatggaataaacgacatcaaaaagcaccggtggctgaatgggtttaactgggaaggcctgaaggctagatcactgccctctccactccagcgcgaactcaagggcccaattgatcattcctactttgataaataccccccagagaaagggatgccccctgacgagctctcgggctgggataaagatttctag

SEQ ID NO: 236802 - DNA, 2289 bp, Artificial Sequence
  Description of Artificial Sequence: Synthetic coding sequence
atgggcaatggatctgtgaaaccaaaacactcaaagcatccagatggtcactccggtaacctgacgaccgatgcattacggaataaagtcacggaacttgaaagagaactgagaagaaaggacgccgaaatccaggaaagagagtaccacctcaaggaactgagggaacagctctccaagcagacagtggccatcgccgaactgacagaagaactgcagaacaagtgtatacagctgaataagctgcaggatgtggtgcacatgcaagggggatccccactgcaggctagccctgataaggtccctcttgaagtgcacagaaaaacttcaggccttgtctccttgcacagtagaagaggcgctaaagccggtgtctccgctgagccgactactcgcacatatgacctgaataagcctcccgagttctctttcgaaaaggctagggtgcggaaggattcaagtgagaaaaagctgatcacggacgccctcaacaagaatcaatttcttaagaggctggacccccagcagatcaaggatatggtggaatgtatgtatgggcgaaactatcagcaagggagctatataataaagcagggcgaacccggaaatcatatcttcgttctggcggagggcaggctggaagtattccagggagaaaagctgctgtcgtccatccccatgtggaccacgttcggagaacttgccatcctgtataattgcactcgcacagcaagtgtgaaagccatcactaatgtcaaaacctgggcactggatagggaggtctttcagaacataatgcgcagaaccgcccaggcccgagacgagcagtaccgcaactttctgcggtctgtatcactgctgaagaatctccctgaggataaactgaccaaaatcatagattgcttggaggttgagtactacgataagggcgattacatcatccgcgagggagaagagggcagcacctttttcattctggccaaggggaaagttaaggtcacgcaaagcacagagggccatgaccaacctcaactgattaaaacactacagaagggcgagtacttcggagaaaaagctctgattagtgacgatgtgcgttcagcaaatataatcgctgaggagaatgatgtagcctgcctcgttattgacagggagaccttcaatcaaactgtgggaacatttgaagagctccagaaatacctggaaggctacgtcgcaaatctgaatagggatgatgagaagagacatgctaaacgaagtatgagcaattggaagctgtcgaaggccctgagcctggaaatgatacagcttaaggaaaaagtggctcgtttctcttcctcttcaccttttcaaaatcttgagatcatcgctaccttgggggtagggggtttcggacgcgtggagctggtcaaggttaaaaacgagaacgtagcatttgcaatgaaatgcatccgcaaaaaacatatcgtcgatacaaaacagcaggaacacgtgtactccgagaaacgcatactggaggagctctgcagtccattcatcgtcaagctgtaccgcacatttaaggacaacaagtacgtgtacatgctcctcgaggcgtgtctgggtggagagctttggagtatcctgagagaccggggatcatttgacgaacccacatccaaattctgcgtggcatgcgtaacggaggcgtttgattacttgcatagactgggtattatctacagggacctgaagcctgaaaacttgatcttggatgccgaagggtacctcaaactggttgatttcggcttcgccaagaagattggaagtggacagaaaacatggaccttctgcgggacacccgaatacgttgcacctgaagtcatcttgaataagggtcacgatttttcagttgatttttggtccttgggtatcttggtttacgagctcctgacaggcaaccctccattctccggtgtcgatcagatgatgacatataatctgattctgaaagggatcgagaagatggacttcccgcgaaagattactcgcagaccggaagaccttatccgaaggctgtgcaggcaaaatcccacggagcgtctgggcaacttgaagaacggcatcaatgatatcaaaaagcacaggtggctgaacgggttcaactgggagggtctgaaggcgcgaagcctgccctcccctttgcagcgcgaattgaaaggccctatcgatcatagctatttcgacaaatacccccctgaaaagggcatgccccctgacgagttgagcgggtgggataaggacttctag

SEQ ID NO: 236803 - DNA, 2202 bp, Artificial Sequence
  Description of Artificial Sequence: Synthetic coding sequence
atgggcaacggatcagtgaaacccaagcactccaagcatcccgatgggcattctggaaacctcactactgatgctctaagaaataaggtgaccgagctggagagggagctacgcaggaaagatgcggagatccaggaacgagagtatcacctgaaggagctaagggagcaactgagtaagcagacagtggccatagcggaattaacggaagagttacaaaacaagtgtatccagctgaacaagctccaagatgttgtacacatgcaaggcggatctccacttcaggccagccccgacaaggttccactcgaggtgcaccggaagacatccggcctggtatccctgcacagcaggcggggagcgaaagctggggtgtccgccgagccgactaccagaacttatgacctaaacaaacccccagaattttcttttgaaaaggcccgagtaagaaaggactccagtgagaaaaagctaattacggatgcactaaacaagaaccagttcctgaaacgtcttgacccccaacagataaaggatatggtggagtgtatgtacggaagaaattatcagcagggttcttacatcattaaacagggagagcctggcaatcacatattcgttcttgcggaggggaggttggaggttttccagggcgagaagctgctgtccagcattccgatgtggactacctttggagagcttgctattctttataactgtacaaggacagcatctgtgaaagccatcaccaacgtgaagacctgggccttagacagagaggtgttccagaacatcatgcgacgcaccgctcaggctagggatgaacagtataggaatttcctccgcagcgtaagcctgctcaaaaacctgcccgaagacaaactgaccaagattatcgattgtttggaagtcgaatattatgataaaggagattatataatccgtgaaggtgaagaaggcagtactttctttatccttgccaaagggaaagtaaaggtcacgcagtccacagagggacatgatcagcctcagttaatcaagacactgcaaaagggcgagtacttcggggaaaaggctttaatctcagatgacgtgagatctgctaacatcatagccgaggagaacgatgtggcttgtttagtgattgaccgcgagacttttaaccagacagtcggcacattcgaggagcttcagaagtacctggaaggctacgtggccaaccttaaccgtgacgacgagaaacgacatgccaaaagatccatgagcaactggaagctctcaaaagctctgtcactggaaatgatccagctgaaggagaaagtgaaggttaagaacgagaacgtggcctttgcgatgaaatgcattcggaaaaagcacattgtagataccaagcagcaggagcatgtgtacagcgaaaagagaatcctcgaggaactgtgttctccctttattgtcaagttgtaccggacttttaaggacaataaatatgtctacatgctgctggaagcttgtttaggtggggaactgtggagcatcctgagagatagagggtccttcgacgagcctacatccaagttttgcgtcgcttgtgtgaccgaagcctttgactatctgcataggttggggattatctaccgggatttgaaaccagagaatctaatactagacgcagaaggatacctgaaactcgtggattttggttttgcaaagaagatcggttctggacagaaaacgtggactttctgcggcaccccggagtacgtggctcccgaggtaattctcaataagggccatgatttcagtgttgacttctggagcttgggaatcctggtttacgagttgctgaccggtaatcctcctttctccggcgtggatcagatgatgacctacaatctgattctcaaagggatagaaaaaatggacttcccacggaaaattacacgcagaccagaagacctgattcgaaggctgtgccgacagaatcctactgaaaggctaggaaatcttaaaaacggcattaacgacatcaagaaacaccgctggctgaacggctttaattgggagggtctgaaggctcgttctctcccttcacccctccagcgcgagcttaagggccctatagaccattcgtactttgacaagtaccctccagagaaaggcatgccacccgatgagctttctggatgggacaaggacttctag

SEQ ID NO: 236804 - DNA, 1029 bp, Artificial Sequence
  Description of Artificial Sequence: Synthetic coding sequence
atgtctaattggaaattgtcgaaagccttgtccctcgagatgatccaactgaaggaaaaggtggctaggtttagtagttccagtcccttccagaacctcgagattatcgccaccctgggagtgggtggcttcgggagggtggaacttgtaaaggtgaaaaatgagaatgttgctttcgctatgaaatgcatccgcaagaagcatatcgttgatacgaagcagcaagaacacgtgtattccgaaaagagaatcctggaagaattatgttccccgttcattgtgaagctctacagaaccttcaaagacaacaagtacgtgtacatgttgctcgaagcttgtctgggaggcgaactctggtccatactgcgagataggggatcttttgatgagccgacttctaagttttgtgtcgcttgtgtcactgaagcctttgactatttgcatcggctgggaattatttaccgcgacctgaagcccgagaatctcatactggacgccgagggctacctcaagcttgtagactttggtttcgccaagaaaattggatcgggccaaaagacatggaccttctgtggaaccccagaatacgtcgctccggaggttattttaaataagggtcatgatttttctgttgacttttggtcgctgggtatccttgtgtatgagctgctgacaggcaatccgccattctctggcgttgatcaaatgatgacatataacttgattctgaaagggatcgaaaagatggatttccccagaaaaattaccaggagaccagaggatctgattagaaggctgtgccgccagaacccgactgagagactcgggaacttgaagaacggcatcaacgatattaagaaacaccgctggctgaacgggtttaactgggagggactcaaagcacggagcctgcctagtccccttcagagagagctgaaggggccaatcgaccactcttacttcgacaaatacccacccgagaagggcatgcctcccgatgagctttcaggatgggataaggacttctag

SEQ ID NO: 236805 - DNA, 942 bp, Artificial Sequence
  Description of Artificial Sequence: Synthetic coding sequence
atgtcacagtccaggcaccgcgcagaggcacctccgctggagcgtgaggatagtggcacgttttcactggggaagatgatcaccgccaaacctggcaaaacccccatacaagtactccacgagtacggcatgaagaccaaaaacatacctgtatacgagtgcgagagatccgatgtccagattcacgtgccaacctttacgttccgcgtaacagtgggagacattacatgtactggcgaaggaacaagcaagaagctggccaagcacagagccgcagaggccgcaattaacattcttaaggcgaacgcgtctatctgtttcgctgtgcctgatccactaatgcctgaccccagtaagcaacctaagaatcagctgaatcctattgggtccctgcaggagctggcgatccaccacggctggcgcttacctgagtacaccctctcacaggagggtgggccagcccacaagcgagagtataccactatatgccgcttagagagtttcatggaaaccggcaaaggggcaagtaaaaaacaggcgaagagaaacgctgctgaaaagttcctagctaagtttagcaatatatctccagaaaaccacatctcactgacaaatgtggtaggccactctctggggtgtacctggcatagcctgcgtaattctcctggggagaagatcaatctcctgaagcgttcactcctgtcaatacctaatacagactatatacagctgttgtccgaaattgccaaggaacaaggcttcaatatcacatacttagatatcgacgagctgtccgcaaatgggcagtaccagtgtttggccgagctatccacctccccgattaccgtctgccatgggtctggaatatcttgcggtaatgcacagtcagacgctgcacataatgctctgcagtaccttaagattatcgcagagcgcaagtag

SEQ ID NO: 236806 - DNA, 909 bp, Artificial Sequence
  Description of Artificial Sequence: Synthetic coding sequence
atgcagtccactcccttctgtggcttctgttccctcgggaagatgatcactgctaagccaggtaagacacccatccaggtgcttcacgagtacggcatgaaaaccaaaaatattccagtatacgaatgtgagagatcagacgtccagattcatgttccaacctttacctttagagttaccgtaggagatatcacctgtacaggcgaaggcacatccaagaaattggccaaacaccgggcagcagaagctgccatcaacatactgaaagccaacgcgtctatatgcttcgcagtgcctgaccctcttatgccagacccttctaaacagcctaagaaccagctgaaccccattgggtcactccaggaattggctatacaccacggctggcggctgcctgagtacacgctgagccaggaaggcggacccgcacataagagggaatatacgacgatctgtcggctggagtcctttatggagactgggaaaggcgcttccaagaagcaggccaaaaggaacgccgctgagaaattcctggccaagttctctaatatatctcctgagaaccacatttccctaacaaacgtggtgggacactccctgggttgcacgtggcattcccttagaaatagtccaggagaaaagatcaatctcttaaaaagaagcctgctgtctatccccaataccgactatattcagctgctcagtgagatagctaaggagcaggggttcaacattacatacttagatatcgacgagctgagcgccaatgggcaatatcagtgcctggctgagctgtcaacctcaccaatcacggtgtgtcacgggagcggcatttcctgtggcaacgcccagtccgacgcggctcataacgcccttcaatatctgaagattatcgccgaacgaaagtag

SEQ ID NO: 236807 - DNA, 603 bp, Artificial Sequence
  Description of Artificial Sequence: Synthetic coding sequence
atgcccgatccttcaaagcaacccaaaaaccagctaaacccaatcgggtcattgcaggagctagctatccaccacggatggaggctgccagaatacactctgagccaggagggaggcccagcccacaaacgtgagtataccactatctgccgacttgaaagtttcatggaaacaggcaaaggcgcttccaagaagcaagccaagcgcaatgctgcagagaagtttttagcaaagttcagcaatatttctcccgaaaatcacatctctttgactaacgtggtcggccactcactaggctgcacatggcacagcctccgcaactcccctggggaaaagatcaacctcctgaagagatccctgttatctattcccaacaccgattacatccagctgttgtctgaaatcgccaaggagcaggggtttaatattacatatttagacatagacgagctttccgcaaacggacagtatcagtgccttgccgagctgtcaacgtctccaatcaccgtgtgtcacggtagcggcatctcatgcgggaatgcacagtcggacgcagcccacaatgcgctgcaatacctgaaaattatcgccgagcgcaagtag

SEQ ID NO: 236808 - DNA, 867 bp, Artificial Sequence
  Description of Artificial Sequence: Synthetic coding sequence
atgataactgccaaacctggcaaaactcccatccaagtgctgcacgaatatggcatgaaaaccaaaaatatccctgtgtacgaatgtgaaagatccgacgtgcagattcatgtgcctacatttacctttcgcgtgacagtcggcgatataacctgtactggagaaggaacctctaagaagctggccaaacatagagctgcagaggcagctatcaatattctgaaggctaacgcctctatctgctttgccgtgcccgacccgctaatgccagacccttcaaaacagcctaaaaatcaattgaatcctattggatcccttcaggaactggctatccatcatggatggagacttccagagtacacattaagtcaggagggcggacctgctcacaagagagagtacactaccatctgtaggctggagagctttatggaaactggcaaaggagcctccaagaagcaggccaaaaggaatgccgctgagaaattcctggcaaaattttctaatatctccccggaaaatcacatttctctgaccaacgtcgtcggtcacagtttagggtgtacatggcattctctcagaaatagccccggagagaaaattaatctccttaagcgctctctactttccatcccgaacactgactatatccagctgctgtctgaaattgctaaagagcagggttttaacatcacgtacctggacatcgatgagctctccgccaatgggcagtaccagtgtttagcggaattgagcaccagccctataacagtctgtcatggatctggtatttcttgcggaaacgctcagtctgacgcggcacataatgctctgcagtacctgaagatcatagcggagagaaagtag

SEQ ID NO: 236809 - DNA, 1077 bp, Artificial Sequence
  Description of Artificial Sequence: Synthetic coding sequence
atggaagctcctggcttggcacaggccgctgccgctgagagcgactcaaggaaagtggcagaggagactcctgacggggctcctgcgctctgcccctccccagaggcactgagtccagagcccccagtgtactcgctgcaggactttgacactcttgccactgtcggaactggcaccttcggtcgggtacacctggtcaaagaaaagacagcgaaacacttcttcgccttaaaggtcatgtctatccctgatgtgattaggctgaaacaagaacagcacgtgcataacgaaaaatccgtattaaaagaggtcagtcatcctttcctgattagattattttggacttggcatgatgaaaggtttctatatatgctgatggagtatgtgccaggcggtgagctgttctcttatctgcgtaatagggggcgtttcagtagcaccactggcctgttctactccgccgagatcatatgcgccatcgaatacctccattccaaagaaatagtttacagagacctgaaaccagagaatattctgctggatagggacggccacatcaagctgactgacttcgggttcgcaaagaaactcgttgataggacctggacactttgcggaacccccgaatacctggcacccgaggtgatccagtccaaaggtcacggaagagccgttgactggtgggccttgggaattctcatctttgagatgttgagtggattcccgccattcttcgatgacaatccctttgggatctaccagaagatcctcgcgggtaaaatagacttcccacgccacctggatttccacgtgaaagatctaatcaaaaagttattagtggttgacaggacccgacgcctagggaacatgaaaaacggagccaacgatgtaaaacaccatcggtggttcagaagcgtggactgggaggcagtgcctcagcgcaagctgaaacctccaatcgtaccaaaaatagccggagacggggatactagcaactttgagacatacccagagaatgattgggacacagccgctcccgtgccccagaaagatctggaaattttcaagaatttctag

SEQ ID NO: 236810 - DNA, 1983 bp, Artificial Sequence
  Description of Artificial Sequence: Synthetic coding sequence
atggatgactggaagccctctcccctcattaaaccatttggtgccaggaagaagagatcctggtatttaacctggaaatacaagcttactaatcagcgggcactgcggcgattttgtcaaaccggcgcagtgctattcttacttgtcacagtgatcgttaatattaaattgattctggatactaggagagccatatctgaagctaacgaggatccagagcctgagcaggattacgatgaggcactcggaagattggagccaccacgtagaaggggttcaggtccacgccgagtcctcgatgtagaggtgtattcctcaagaagcaaagtgtatgtggctgtggacggtacaactgtgctggaggacgaagcaagagagcagggacgcggaatacacgttatcgtactgaaccaggctacaggacatgtgatggccaagcgcgtctttgacacatacagcccccacgaggatgaggctatggtgttgtttctgaacatggtggcacctggtcgcgtgcttatttgtactgtgaaggacgaggggtcctttcatctgaaggacaccgcaaaggcgctgctccgcagccttgggagtcaggcagggcctgctctcggttggcgtgacacctgggcgtttgtcggcagaaagggcggtcccgtctttggtgagaagcacagcaaatcacccgctctgagcagttggggcgatccggttcttctgaaaacggacgtcccactgagctcagcggaagaggccgagtgccactgggcagacacagaactgaacagaagaagacgcagattttgtagtaaagtcgagggttatggaagtgtttgttcctgcaaagatccaacaccgatcgagttttccccggatcctttgcccgataacaaagtccttaatgtaccggtggccgtgattgccggaaaccgccctaactacctatatcgtatgttgagatccctgctctcagcccagggcgtgagccctcaaatgattactgtttttatcgacggatactacgaagagcccatggatgtggtggccctcttcgggctacgcggtatccagcatacgcccatttctattaagaatgcccgtgtctcacaacattacaaagctagcctgactgccactttcaacttgttccccgaggctaagttcgccgtggttctggaggaggatctcgacatcgctgtcgactttttcagcttcttgtcgcagagcattcacttgctagaagaggacgatagcctgtattgtatcagtgcttggaatgatcaagggtacgaacacaccgcggaagaccccgctcttctatatagggtagaaaccatgcctggcctggggtgggttctacgacgaagcctgtacaaggaagaactggagcctaaatggccaactcctgaaaaactctgggactgggacatgtggatgcgtatgcccgaacaacggcgagggagagagtgcattatcccagacgtgagccgtagttaccactttggcatcgttggccttaacatgaacggctatttccatgaagcgtatttcaagaagcacaaattcaacaccgtgcctggagtacagctccggaacgtggatagcctgaaaaaagaggcctacgaggtcgaggtacaccggttgctcagcgaagcagaggtgctggatcattctaagaatccctgtgaggactcattcttacctgatacagaagggcacacatacgtggcctttataagaatggaaaaagacgatgacttcaccacctggactcagttggccaaatgcctccatatatgggacctcgatgtgcggggaaatcaccgcggactgtggcgactatttaggaaaaaaaaccacttccttatggtcggagtgcccgcatccccatactccgtaaaaaagcccccttcagttacccccatctttctggagcccccaccgaaagaggaaggagcgcctggcgctcccgagcagacgtag

SEQ ID NO: 236811 - DNA, 2247 bp, Artificial Sequence
  Description of Artificial Sequence: Synthetic coding sequence
atggacgattggaagcctagcccattgatcaaaccttttggtgctaggaagaagcgctcatggtatctcacatggaagtacaaattgacaaatcaaagagcacttaggcggttctgccagactggcgctgtgctctttctgcttgtgaccgttattgtgaatataaagttgattttggatacacgccgagctatctccgaagccaacgaggaccccgagcccgagcaggattatgacgaagccctcggccgtctagagccccctaggcgtcgcggtagtggccctcgccgagtattggatgttgaggtctatagttcacgcagcaaagtctacgtcgccgttgacggcaccaccgtactggaagatgaggcacgggaacagggacgaggcatccacgtgattgtcctcaatcaggcgaccggacacgtgatggcaaagcgcgtgtttgacacatacagccctcatgaggacgaggcaatggtgttgttccttaacatggtcgcccctggtcgggtgcttatctgcactgtgaaagacgaagggtcattccacctgaaggatacagcaaaggcgctgctcagatctttgggtagccaagcgggacctgcactaggctggcgagatacatgggcattcgttggtaggaagggaggacccgtattcggtgagaaacatagcaaaagccctgccctgagttcttggggtgacccagtgcttcttaaaactgatgtgcctctgtccagcgcggaggaggcagaatgtcactgggctgacaccgagctgaacagaaggcggagaagattttgctccaaggtggaagggtatggctccgtctgcagctgcaaggatcctaccccgatcgagttcagtcccgatccgctgcctgataataaggttctgaatgtgccagttgccgtgatcgccggaaacagacccaactatttgtatagaatgctgcggtctttgttgtcggcgcagggtgtcagtccacaaatgattacagtcttcatcgatgggtattacgaggaacccatggatgtggttgccttatttggactgagagggatccagcacacaccaatctctataaaaaacgctcgggtctcccaacactacaaggcatcactcaccgcaacctttaacctatttcccgaggctaagtttgctgtcgtcctcgaagaagatctagatatcgctgttgacttcttctcattcttgagtcaatccattcacttattggaggaagacgacagtctctattgtatcagtgcttggaatgaccaggggtacgagcacactgcagaagatcccgcactcctttatcgcgttgagaccatgcctggcctgggatgggtcctgcgtagaagcctttataaagaggagctggaaccaaaatggccgacacccgaaaagctctgggattgggacatgtggatgcgtatgccggagcagcggagaggcagagagtgtatcatccctgatgtttcgaggagttatcatttcggcattgtgggactgaatatgaatggatacttccatgaagcctacttcaaaaagcacaaattcaacactgtgcctggggtgcagctaagaaacgttgattccttgaagaaagaggcctacgaagtggaggttcaccgcttgctctcagaggcagaagtgctcgatcactctaagaatccatgtgaagactcattccttccagataccgaggggcatacatacgtagcattcattcggatggagaaagacgatgacttcacaacctggactcagctggctaaatgtctccacatttgggacttagacgttcgtggaaatcaccggggactgtggcgacttttccgtaaaaagaatcactttctgatgagcgaggaggctactctgtcccacccgaattttcccggagccaccccaaaaggaggtgggtccccgcgttctcccagaaccgatatgcggccaccccctggtccatgcggagcagggccaggaagcgagagcaatttgtttatcgattgtcctgaaggccttgaaaacaggcctaatctcgaaggcttggacttctttctaggttggaatgccgctttgcgcgtgggcttagcgttgacccaggagacagcagttcccaacccgtggacgggccctgcaggcgcacacatgctcacacagacacatagtgaaactctgagacactggacgcggcctcctctctctctactttttgtccaaataagcaaagccggatag

SEQ ID NO: 236812 - DNA, 2247 bp, Artificial Sequence
  Description of Artificial Sequence: Synthetic coding sequence
atggacgactggaaaccatcgcccctcattaagccttttggagcaagaaagaagcgatcctggtacctgacttggaaatacaaactgacaaaccaacgtgcacttaggcgattctgtcagaccggcgctgtccttttccttctagtgacagtgatcgtcaatataaagctgattctggacacgaggagagccatctccgaagcaaatgaggaccccgagcctgagcaggactatgatgaagccctgggcagactggagccccctagacgacgcggatcaggcccaagacgtgtactcgatgtcgaagtgtatagctcccgttccaaggtgtacgtggcagtggatgggactaccgtcctggaggacgaagccagggagcagggacgcggaatccacgtaatcgtgctcaaccaggccaccggacacgtcatggctaagcgggtttttgacacgtatagtccccatgaagatgaggccatggtacttttcctgaacatggttgctcccggaagggtccttatttgcacagtaaaagacgagggaagcttccaccttaaggacaccgccaaggctttgttgcgctcactgggctcccaagcgggacccgcattggggtggcgagatacctgggcctttgtcgggagaaaggggggtccagtgttcggcgagaagcattccaaatctccagctttatcaagttggggggatcctgtcctcttaaagacagacgtgccgttatcaagtgctgaggaagccgaatgccactgggctgacaccgagttgaaccggagaaggcgaaggttttgctctaaagtggaaggctatggtagcgtctgtagttgcaaagatccgacccctatcgaattttcgcccgatcctctgccggataataaagtactcaatgtgcctgtggccgtgatcgccggaaatagaccaaactatctctaccgtatgctcagaagtcttttgtctgcacagggcgtgagccctcagatgatcacagtgttcatagacggttattatgaggaaccaatggatgtggttgctctgttcggcctacggggaatccagcatacccccatttccatcaagaatgccagagtcagccagcattacaaggcctcactaaccgcaactttcaacctgtttcctgaggcaaagttcgccgtggttttggaggaggatttggacattgccgtggatttctttagcttcctcagccagagcatacatttgctcgaagaggatgactctctttactgtatcagtgcctggaacgaccaaggatatgagcacacagctgaagatccagcgctcctctaccgtgtcgagacgatgccgggtctgggttgggtgcttagaagatccctttataaagaagagctcgaacccaaatggcccacacccgagaagctgtgggactgggatatgtggatgaggatgccagaacagcgcagaggtcgcgagtgtatcattccagatgtctctcggtcataccacttcggcattgtgggcttgaacatgaatgggtacttccacgaagcctactttaagaagcataagttcaacacagtgccaggtgtgcagctccggaatgtggactccctgaagaaagaggcttacgaagtggaagtccatagactgctgagtgaagccgaagtgctggaccactcaaagaatccctgcgaggactcgttccttcctgacacagaggggcacacttacgttgccttcattcgtatggagaaggacgatgactttaccacatggacacagttagcgaaatgtctgcacatctgggaccttgatgtgcgaggaaaccacaggggactatggcgcttatttagaaagaagaaccactttctcatgagcgaagaggccaccctttcgcaccctaactttccgggtgcaacaccaaaaggaggtggcagcccgcgatcgccgagaacagatatgagaccccctccaggcccttgcggcgctggtccaggaagcgaatcaaatctcttcatagattgcccggaagggttagaaaacaggccaaacctggagggtctcgattttttccttgggtggaatgccgcactccgagtcggcctggccttaacacaggaaactgcggtgccgaatccttggacaggccctgctggggctcacatgctgacacagacccacagtgaaaccctgagacattggaccagaccccctttgtcacttctgttcgtgcaaatcagcaaggccggatag

SEQ ID NO: 236813 - DNA, 603 bp, Artificial Sequence
  Description of Artificial Sequence: Synthetic coding sequence
atggacgactggaagccaagcccacttatcaagccctttggagcgcgaaagaagcggagctggtatctgacctggaagtacaaactgacaaaccagcgagccctccggagattttgccagacgggcgctgtgctcttcctcctggtgaccgtgatcgtaaatattaaactcatacttgacacaaggcgcgctataagtgaagcgaacgaggatcccgaacctgagcaagactatgatgaggcccttgggcgactagagccaccccgaagacgcggatcaggtccgagacgcgtgttggacgtggaagtttacagcagcagaagcaaggtgtacgtcgcagtagacggtactacagtgctggaagatgaggccagagaacaggggagaggcatacacgtgatcgtcctgaaccaggcaacagggcacgtgatggcgaaacgagtttttgatacatactcaccccacgaggatgaggctatggtgttgtttctgaacatggttgccccaggcagggtcttaatatgcaccgttaaagtgctgagttcgggcaggaacattctcaaccacctcccgtcactgcctggcggtacccagtcctgttag

SEQ ID NO: 236814 - DNA, 1917 bp, Artificial Sequence
  Description of Artificial Sequence: Synthetic coding sequence
atggaaggcactaaggagataaaagttagcaaccgcaggattcaggaacattggaccggggctgtcctgttcctcctggtgacagtgatcgtgaatataaagttgattctggatacccggcgagccatatctgaagccaatgaggatcccgaaccggagcaggactacgatgaggctctgggacgcctggaacctccaaggagaaggggatctggccctcggcgagtattagatgtcgaggtgtatagttcaagatcaaaagtgtacgtggctgttgatggaactaccgtgttggaggatgaagcaagagaacagggacgcggaatccatgtcattgtactcaatcaggctactggccacgtcatggctaaacgcgtgtttgacacatattcccctcacgaagacgaggccatggtgctgtttctgaacatggtcgctcctggcagggtccttatttgcaccgttaaggatgagggttcatttcacctcaaggatacagctaaggccctgctgaggagtctggggagccaagctgggccagctctcggctggcgtgatacttgggcctttgtgggcaggaaaggtggccctgtatttggcgaaaaacacagcaaaagccctgctctgtcttcatggggagacccggttcttctgaaaaccgatgtgcccctctcatccgccgaggaggccgagtgccattgggctgataccgagttgaaccggaggcggcgaagattttgtagcaaagttgagggctatgggtctgtatgtagctgcaaggatccgacccccatcgaatttagccctgaccccctgcctgataacaaggtgctgaacgtgccagtcgctgtcattgccggtaaccgccctaattatctctaccggatgctgcggagcctgctatctgcccagggagtgagtccacagatgatcacagtgttcatcgatgggtattacgaagagcctatggatgtcgtcgctctgttcggcctcagggggatccagcataccccaatctccatcaagaacgcccgtgtgtcacagcattataaagcaagcctcacagctacgttcaatctgtttccagaggcaaagttcgccgtagtcctggaagaggacctggacattgccgtcgatttcttttcctttttaagccagtccatccacttactcgaggaggatgattcgttatactgtatatcggcttggaatgaccagggctacgagcacactgccgaggaccctgcgttgttgtacagggtagagaccatgccaggcttgggatgggtgttgaggcgcagcctgtacaaggaagagctggaacctaagtggccaacccctgagaaattgtgggattgggatatgtggatgaggatgccagaacaaagacgtggacgggaatgtatcataccagacgtgagtcgcagctaccacttcggaatcgttgggcttaacatgaatggctattttcacgaagcttattttaaaaagcacaagttcaacaccgtacctggcgtacagctccgtaatgtggatagtctgaagaaagaggcttatgaagtggaagtgcaccgcctcctgtccgaagctgaagtgctggaccactcgaagaatccgtgtgaggactcttttctgcccgatactgaaggccacacatatgtagcctttatccgcatggagaaagatgatgatttcactacatggacacagctggctaagtgtctgcacatttgggacctcgacgtgcgaggcaatcatagaggactttggaggctttttagaaaaaaaaaccattttctgatggtgggcgttccagcaagcccttactctgttaagaagcctccttcggtaactcccatcttccttgaacctccacccaaggaagagggcgctcccggagccccagaacagacttag

SEQ ID NO: 236815 - DNA, 861 bp, Artificial Sequence
  Description of Artificial Sequence: Synthetic coding sequence
atgtctgactccgagaagttaaacctggacagtatcattggcagattgctggaaggggatattcacggccaatactacgatttgctacgcctgtttgaatatggaggctttccacccgaaagcaactatctgttcttgggcgattacgtggaccggggaaaacagagtctggaaacgatctgtcttttactcgcctataagattaaatatccggagaatttttttcttctcaggggaaaccacgagtgcgcctctatcaacaggatctatggtttctatgacgagtgcaagaggaggtataacattaaactgtggaagacctttacggactgctttaattgcctgcctatcgccgctatagtggacgaaaaaattttttgttgtcacggcggactgagccctgatctccagagcatggagcagatccggaggattatgagacccactgacgtacccgaccagggcttgctttgcgacctcttgtggtccgatcccgacaaggatgtgcagggctggggagagaatgataggggagtatcattcacattcggagcagaagtggtggcaaaatttctccacaagcatgatctggacctgatatgccgcgctcaccaggtagtggaagacggctacgaattttttgctaaacggcagctggtcaccctctttagcgcacctaactactgtggggaatttgacaatgccggagccatgatgtctgtggacgaaaccttgatgtgttccttccagatactgaagcctgcggacaagaataagggcaaatacgggcagtttagcggcctgaatcctgggggacggcctataaccccccctagaaactccgcaaaggcaaagaaatag

SEQ ID NO: 236816 - DNA, 1548 bp, Artificial Sequence
  Description of Artificial Sequence: Synthetic coding sequence
atggcagaactggagcatctcggcggaaaacgcgctgagtcagcgcgtatgcgcagagccgagcagctgcgcaggtggcgcggatcccttacagagcaggaacctgctgaaaggagaggagccggacgtcaacctcttacacggagaggtagcccaagagtgcgctttgaagacggggcagtgtttttggccgcttgtagtagtggcgataccgatgaggtcagaaaacttctcgcaaggggtgctgacataaatactgtgaatgtagacggtctgaccgccctgcaccaagcctgcatagacgagaacttggatatggtaaagtttttagtggagaatcgcgctaatgttaatcaacaggacaatgaaggatggaccccactgcacgctgcagcctcgtgtggatacttaaacatagccgagtattttatcaatcacggagcttcagtgggcattgtgaactccgagggagaagttccttcagacctagcagaggagcccgcaatgaaggatttactgctagagcaagtcaagaaacaaggagtggacctagaacagtctcggaaggaggaggagcagcagatgctccaggatgcccgacagtggctgaattccgggaagatcgaggacgtaaggcaagcacggtcaggagctaccgccctgcacgtcgcggctgcaaaagggtactccgaagtgctgagactgcttatacaggccggttacgaattaaacgtgcaagactacgatggttggactcccttgcatgcagcggcacactggggagtgaaagaggcgtgctccatcctggctgaagcgctgtgcgacatggatatacgcaacaagcttggtcagacccctttcgatgtggccgacgagggtctggtggaacatttggaattactccagaaaaaacagaatgtccttcgcagtgagaaggagacaagaaacaaacttatcgaatccgatttaaacagtaagatccagtccggatttttcaaaaacaaagagaagatgttgtacgaggaagaaacccccaaatcgcaagagatggaggaagaaaacaaggaatcgtcatcaagctcttccgaggaagaagaaggcgaagatgaagcatcagaatcagaaacagaaaaggaggccgataaaaaaccggaggccttcgtgaaccattctaactctgaaagcaaaagcagtattaccgagcagataccagctcccgctcaaaatacttttagcgccagctctgccaggaggttctcctcagggctcttcaacaagccggaagagcctaaggacgagagtccttcctcctggcgcctgggcttgcgtaaaacaggttctcataatatgttgtccgaagtcgccaatagcagggagcccattagagacagaggcagcagcatttatcgctcgagcagcagcccgaggatcagtgccttgctagacaacaaagataaggttcaattcggcagggtctggggcaattctaaagccgttttcttctttcatgagaacagcattctcggaactaacgaaaacatcttctag

SEQ ID NO: 236817 - DNA, 4125 bp, Artificial Sequence
  Description of Artificial Sequence: Synthetic coding sequence
atgttgaagacagaatcctccggggagaggacgactcttagaagtgccagtcctcaccggaacgcgtacagaacagagttccaagcactgaagagcacatttgataagccgaaaagcgacggggagcaaaaaacaaaggagggagagggcagccagcagagtcgcggacgcaaatatgggagtaacgtgaatcgcattaagaacctgttcatgcagatgggcatggaacctaatgaaaatgccgctgtgattgccaaaacgcgaggcaaaggaggtcattcatccccccagagacggatgaagcctaaagagttcctcgagaagactgacggttcagtggttaaacttgaaagctctgtctccgagcggatcagtcggttcgacacaatgtatgacggtccatcctactcaaagttcactgaaactaggaagatgtttgaaagatctgtccacgagagcgggcagaataacagatacagccctaagaaggagaaggccggagggagtgagccgcaggacgagtggggcggttctaaatccaatagagggtccactgactctttggattccctcagctccaggaccgaagcggtgtctcccactgtttctcagctgagtgcagtgttcgagaatacagatagcccatcagccatcatttcggaaaaggccgaaaataacgaatactcagttactggccactatcccctgaatcttccctccgtaacagtgacaaacctcgacacctttgggcacctaaaagactccaactcctggccaccaagcaacaaacgcggagtggacacagaagacgcccataaatcaaatgcgacgccggtaccggaggtggcgagcaaatctacgagtcttgcctcaatccccggagaggagattcaacagtcgaaggaaccggaagactctaccagtaaccagcaaacgcccgacagtattgataaagatggcccagaggaaccttgcgctgagtcaaaagccatgcccaaaagcgagattccatctccccagtcccagttgttagaagatgcagaagcaaatctggtggggagggaggccgcaaaacaacagcggaaagaactggccggtggcgattttacttcccccgacgcgtcagcctcctcgtgtgggaaggaggtaccggaagactcaaacaattttgacggctctcatgtgtacatgcactccgattataacgtgtacagagtgaggtctaggtacaatagcgactggggcgagaccggcactgagcaggacgaagaagaagattccgacgaaaacagctattatcagcccgacatggaatactccgagatcgttggcctgcccgaagaagaggagattcccgctaatcggaaaataaaattttccagtgcccctatcaaggtgtttaacacttactccaatgaagactacgacagacggaatgatgaggtggatccagtcgcagccagtgccgagtacgaacttgagaaacgcgtggaaaaactggaactgtttcccgtcgagctggagaaagacgaggacgggttgggaatatctattattgggatgggagtgggagctgatgcaggactggagaaactgggcatcttcgttaaaactgtcacagaagggggtgctgcccagcgcgatggccgaattcaggtgaatgatcagatcgttgaggtggacggcatatccctggtcggggtgacccagaacttcgcagccactgtccttcgtaacaccaagggtaacgtcagattcgtgattggcagagaaaagccaggccaggtctccgaggtggcacagctaattagccagacgttagagcaggaaaggcgccagagagaactcctcgaacagcactatgcacaatatgatgcggatgatgatgaaaacactgttgctgagttgcagggaatgtctggtaattgcaacaacaataataattactttctgaaaactggcgaatatgcgaccgacgaggaagaggacgaggtcggaccagtcctcccagggtctgatatggcgatcgaggtgtttgagctgccggaaaatgaggacatgttctcaccaagcgaattggacacctcaaaactgtcacataagttcaaggaacttcagatcaagcatgctgtcaccgaggccgaaatccagaagttgaagacaaagctgcaggctgctgaaaacgagaaggtccggtgggagctggagaagacccagttacaacagaatatagaggagaacaaggaacgtatgctgaaattggagagctactggatcgaagcacagactctttgccacaccgtgaatgagcacctaaaggagacccagagccagtatcaggccctggaaaaaaaatataataaagccaaaaaattaattaaagatttccagcagaaggagttagatttcattaagcgtcaggaggcggaaaggaaaaagatcgaagatctggagaaagcacacctggtggaggtccagggtctgcaggtgcgtatacgagacctcgaggccgaagtgtttaggctcctgaaacaaaatggaacacaagtgaacaataacaacaacatctttgagcgacgtacaagcttgggtgaagtttcaaagggagatacgatggagaatctcgacgggaaacaaacatcatgccaggatgggctctcacaggatctgaacgaagcagttccggaaactgaaagattggattctaaggcactgaaaacacgggcacagctctcagtgaagaacaggcgacagagaccgtcaagaacccgcctctatgactcggtgtcttccacggacggagaagacagcttggagcgtaagccttccaacagcttttataaccatatgcacatcaccaagttattaccccctaagggcttgcgtacaagcagccccgaaagcgattcaggcgtccctcctctgacccccgtggatagcaatgtgcctttctcctccgaccacatagcagagttccaggaagaacctctcgaccctgagatgggccctttgtcctctatgtggggagatacctcgctcttctctactagcaaaagtgaccatgacgtcgaagaatcaccctgtcaccaccagacaaccaacaagaaaattctcagagaaaaggacgacgccaaagaccccaagagtcttagagcttctagctctttggccgtgcaaggtggtaagattaagcgaaaatttgtggatttgggcgctcccctgcgtaggaacagctctaaaggcaagaagtggaaagagaaagagaaagaggctagccggtttagcgccggatcaaggatattccggggacggctagaaaactggaccccaaagccttgcagcacagcacagacctccactcgctccccctgcatgcccttcagctggtttaacgacagccgtaaggggtcctacagtttcaggaacctacccgctccaacctccagcctgcaaccatctcctgagacacttatctccgataaaaaaggcagtaaggtggaaaacacatggattaccaaagccaacaagcggaatcccaatccctcatcaagcagcatcttcgggagacattcacagctaatgtcagtggtttggatccaggaaacaaacaacttcacatttaacgatgacttttctccatcatctacctccagcgcagacttatcagggcttggcgcagagcctaagacacccggtctatcccagagccttgctctttcaagcgacgagattctggacgatggacaatcccccaagcatagtcaatgccagaaccgagccgttcaggagtggtccgtccagcaggtatcacattggcttatgtccttaaacctggaacagtatgtttccgaattcagcgcccagaacatcactggggagcagctcctgcaattagatgggaacaaactgaaagcactcggaatgaccgctagtcaggaccgcgcagtggtgaagaagaagttaaaagaaatgaagatgagcctggaaaaagccaggaaggcccaggagaagatggagaagcagcgggagaagttgagacgaaaggagcaggaacagatgcaaagaaagagcaagaagaccgagaagatgactagtactacagccgagggggcaggagagcaatag

SEQ ID NO: 236818 - DNA, 1026 bp, Artificial Sequence
  Description of Artificial Sequence: Synthetic coding sequence
atgtctgacagcgagaaactgaacctggacagtattataggaagacttctggaaggatccagagttctgactcctcattgcgccccagtccagggctcccggccaggaaaaaacgtgcaactgactgagaacgagattcggggtctgtgcctgaagtccagggagattttcctcagccagcccattctgctggagctggaggcacctcttaagatctgcggcgacattcacggccagtattacgatctgttaagactgttcgaatacggaggattccctcctgaaagcaactacctttttcttggcgactacgtcgacagagggaagcagtcgctggagacaatttgcctgttgttggcatataagatcaagtatcccgaaaacttcttcttgttgagaggaaatcatgagtgtgcgtctattaacaggatttatgggttctacgatgaatgcaaacggaggtacaacatcaagttgtggaaaaccttcaccgattgctttaattgcctccctattgctgcaattgtggatgagaagattttctgctgccacggaggtttgtccccagatctccaaagtatggaacagattagacggatcatgcggccaaccgatgtcccagaccaggggctactctgcgatcttctctggtcagacccagacaaagatgtgcagggctggggggaaaatgaccgcggtgtgtcttttaccttcggcgcagaggtcgtggccaagtttctccacaaacatgatctggaccttatctgcagagctcaccaggtggtggaagatggctatgagttcttcgctaaacggcaactggtcaccctgtttagcgcacctaactattgcggcgaattcgacaatgctggagctatgatgagcgtggacgaaactctcatgtgttcttttcagatcttaaagcccgctgataaaaataagggaaagtacggacagttttccggtcttaaccccggtggacgccctattacaccccctagaaactccgcaaaagcaaaaaaatag

SEQ ID NO: 236819 - DNA, 993 bp, Artificial Sequence
  Description of Artificial Sequence: Synthetic coding sequence
atgtcagattcagagaagctcaacctggatagtattatcggacgcctcctcgaagtacagggttctcgacccggtaagaacgtacagttgactgaaaacgagattcgaggcctttgtctaaagtcccgcgaaatttttctctcgcagcccatcctgctcgaattagaggcacccctgaagatctgcggggatattcacgggcagtattacgacttgctccgactttttgagtacgggggtttcccaccggaatccaactatcttttcctgggcgattatgtggatcgcggaaagcagtccctcgaaacaatctgcttactgctagcgtacaagattaagtaccctgagaatttttttcttctgcgtgggaaccacgaatgcgcttccattaatcggatatacggcttctacgatgagtgcaagagacgatacaatatcaagctgtggaagacctttaccgattgcttcaactgtctgccaatcgccgctattgtagacgagaaaatcttctgttgccatggcggtctgtcacctgacctccagagcatggagcagatcagacggatcatgcggccaactgacgtgccggatcaggggctcctgtgcgatctgctctggtcggatcctgacaaggacgtgcagggttggggtgaaaacgacaggggagtgtcattcaccttcggggctgaagtggtggcgaaattcctccataagcatgatctcgacctgatatgcagagctcaccaggtggttgaggacggatacgagtttttcgccaaaaggcaactggttacgctgttctctgctcctaattactgcggggagtttgacaacgccggtgcaatgatgtctgttgacgagaccctaatgtgctctttccagatactgaagcccgctgataagaataagggtaaatatggccaattctcaggcctgaatcccggtggacggccaattaccccgcctagaaactctgctaaagccaaaaaatag

SEQ ID NO: 236820 - DNA, 1245 bp, Artificial Sequence
  Description of Artificial Sequence: Synthetic coding sequence
atgcggcagcgggctgacagacggagcatggtgtccacatcaggcgctgctaccgcttccagtgccgcaggaccaagtcgaggagccgctcattccccaagctcagcaccgcatgccagccggcacaggcctcctttcagcagcagggccaccggcctgctgcagcaacgccagcactgtgtccaccactgcacacagctctgtccaagagtccaaaccccctgtctacctccccctccagcccctgccactgaactccacagttatctacagcagggcggtgagagaggcttgctggacactactcctggaaccgctggttggggtactagcgctactggtgccgttcaaggttcccgcccaggcaaaaacgtgcagctgactgagaatgagataaggggcctgtgtctgaagtcccgggaaatctttcttagtcagcccatattgctcgagcttgaggcccctttgaaaatctgcggcgacatccacggccagtattatgatttgctgcggttattcgaatatggagggtttccgcctgagtcaaactatctgttcttaggtgattacgtagaccgcggaaagcagtccctggagactatatgcctgctgctcgcttacaagatcaaatatccggagaattttttcctgctgcggggtaaccatgagtgcgcctcgatcaatagaatttatgggttttacgatgagtgcaagaggaggtataacattaagctgtggaagacttttactgactgctttaattgtttaccaattgcagctatcgtggatgagaagattttttgttgccacgggggtctgtcacccgacttacagtccatggagcagatccgccgaatcatgcgtccaactgacgtgcctgaccagggcttactctgtgatttgctgtggagtgatccggacaaggacgtacagggttggggagagaatgaccggggtgtttcctttaccttcggcgcagaagtggtggctaaatttcttcacaagcatgatctagacctgatttgccgggctcatcaggttgtggaggacgggtacgaatttttcgctaaacgccagctggtgactcttttttcagctccgaactattgcggagagtttgataatgccggagccatgatgtccgttgacgagactttgatgtgctctttccagatcctgaaaccagccgacaagaataaggggaaatacggccagttttccggtctgaaccccggtggcaggtag

SEQ ID NO: 236821 - DNA, 984 bp, Artificial Sequence
  Description of Artificial Sequence: Synthetic coding sequence
atggccgacggtgagttaaacgtagattcccttataacaaggttgttggaagtcaggggatgcaggcccggtaagatcgtgcaaatgactgaggccgaagtgcgcggactgtgcatcaagagcagggaaatttttctgagccagcccattttgctggagttggaagcccctctgaaaatatgcggtgatattcacggccagtacacggatcttctgcgcctgtttgagtatgggggatttccgcctgaggccaattacttgttcttgggtgactatgtcgaccgcggaaaacaaagcctggaaacgatttgtctattgcttgcgtataaaatcaagtatcccgagaacttttttctcttgaggggcaaccacgagtgtgcctccattaaccgcatctacggcttttacgacgaatgcaaacggagattcaacatcaagctgtggaagacctttacagattgctttaactgtctgccaatcgccgcaattgttgatgaaaagattttttgttgtcatggaggactcagccccgatctccagtcaatggagcaaatccgtcgcatcatgcggcctacggacgtccccgacaccggcctcttgtgtgatcttctgtggtctgatcctgataaagacgtgcaagggtggggagagaatgaccgcggagtatctttcacctttggggcagacgtggtcagcaaattcctcaaccggcatgacctcgatctgatctgcagggcccaccaggtcgtagaagatggttacgagtttttcgcgaagaggcagctagtgactctcttcagtgcccctaattactgcggggaatttgataacgccggaggaatgatgagtgtcgacgaaaccctcatgtgttcttttcagatcttgaaaccaagcgagaagaaggctaaatatcaatatggcggacttaactccggtcgaccagtcacgccacctagaaccgccaacccacccaagaaacggtag

SEQ ID NO: 236822 - DNA, 984 bp, Artificial Sequence
  Description of Artificial Sequence: Synthetic coding sequence
atggcagacggcgaactgaacgttgattctcttattacaagactactggaggtacgaggctgcagacccggaaaaatagtccagatgacagaggcagaggttcgcggactgtgcatcaaatcaagagaaatattcctgtcccagcctatattgctggagctggaagctccactcaagatttgtggtgacattcatggacagtacaccgacctgcttcgactgttcgagtacgggggtttcccgcctgaagccaactatttgtttttgggagattacgtggatagaggaaaacagtctttggagacaatttgcctcctactcgcatacaagatcaagtatccagagaattttttcctgctacgcggaaaccacgagtgtgccagtatcaatcgcatttacgggttctatgacgagtgcaagcgccgattcaacataaagctctggaaaacgttcactgattgttttaattgcctgccaattgccgcaattgtcgatgaaaagatattctgctgccatgggggtctgagtcctgaccttcagtctatggagcaaatccggaggatcatgcggcctacggatgtccctgacacgggcctgctctgtgatcttctgtggagcgaccctgacaaagacgtgcagggttggggcgaaaacgaccggggtgtatcattcacattcggggctgacgtagtctcaaagtttcttaatcggcacgatctggatctgatctgccgggcacaccaagtagtggaggatgggtacgaattctttgccaagcgacaactcgtgacactcttcagcgctccaaattattgcggtgaatttgataatgcaggaggcatgatgtcagtcgacgaaactctcatgtgctccttccaaatcttgaaacccagcgagaagaaggccaaataccaatacggaggcttgaactccggccgtccggttacgcccccacgcactgccaaccccccaaagaagcgctag

SEQ ID NO: 236823 - DNA, 984 bp, Artificial Sequence
  Description of Artificial Sequence: Synthetic coding sequence
atggctgatggtgagcttaatgtggatagtctaatcacccggcttttggaagtgcggggatgtcggcctggtaaaattgtgcagatgactgaggctgaggtcagaggcctgtgtattaaatcaagagagatcttcctgagccaacccatactgctagaacttgaagcaccgctgaaaatctgtggcgacatccatggccaatataccgacctcctgcgactgtttgagtacggcggattccctcctgaggcgaattatctttttctaggggattacgtggatcgaggtaaacagtcattagaaaccatatgtttgttattggcatataagataaaatatcccgagaacttcttccttctacgcggaaaccatgaatgcgcctctatcaatagaatctacggtttctacgatgagtgcaaacgaagattcaacatcaagctgtggaaaacatttactgactgcttcaactgcctgccaattgccgctattgtggacgagaaaattttttgctgccacggaggcctgtccccggacctgcaatctatggagcagatacgcaggataatgagaccaactgacgtgcccgacacaggcctgctgtgcgatctgttgtggagcgatccggataaagatgtccagggctggggagagaacgatcgcggagtctcgttcaccttcggagctgatgtggtcagcaagttccttaacagacacgacttggatttaatctgtcgagcccatcaagtggtggaggatggttacgagttctttgcgaagaggcagctggttaccctgttctcagcacccaattattgcggcgaattcgataatgctggtggcatgatgtcggtagacgagactttgatgtgtagttttcagatccttaaaccatccgagaagaaagctaaatatcagtacggagggctcaatagcggaagaccagttacgccaccgcgaacagctaatcctcccaaaaaaaggtag

SEQ ID NO: 236824 - DNA, 378 bp, Artificial Sequence
  Description of Artificial Sequence: Synthetic coding sequence
atggccgatggcgagctgaacgtggacagcctgatcacgcgactgcttgaggtgcgcggatgtaggcccggaaagattgttcagatgaccgaggctgaagtgcggggtctgtgcattaaaagcagggaaatatttctctcacaaccaatattgcttgagctggaagcccctctaaagatctgtggagatatccacggtcaatatacagacttgctgaggctcttcgagtatggcggatttccccctgaggctaactacttatttctcggcgactacgtggataggggcaagcagagtcttgagaccatctgtctccttctagcttataagatcaagtaccccgagaattttttcttgcttcggggaaaccacgaatag

SEQ ID NO: 236825 - DNA, 417 bp, Artificial Sequence
  Description of Artificial Sequence: Synthetic coding sequence
atggctgatggcgaactcaacgttgacagcttgatcactcgtctcttggaggtgagagggtgtaggcccggtaagattgtgcagatgaccgaggcagaggttcgcggactgtgtattaagtcaagagagatttttcttagccagcccattctcctagagttggaggccccattgaagatctgcggggatatacatggtcaatacacggatttacttcggctcttcgagtacggcggattccccccagaagcaaactatctgttcctcggtgactacgtggatcgcggtaagcagagcctggaaaccatctgtctgctcctggcttataagatcaagtaccctgaaaattttttcctgttgcgcggaaatcatgagtgtgcttcaataaatcgcatatatggattctatgacgaatag

SEQ ID NO: 236826 - DNA, 510 bp, Artificial Sequence
  Description of Artificial Sequence: Synthetic coding sequence
atgaccgaagcagaggttagggggctgtgcatcaaaagtcgggaaatattcttgtcacagcccatactgctagaattggaggcccctctcaaaatatgcggagatatccacgggcagtatactgatcttctccgactctttgagtacggaggctttcctccagaagccaactatctctttcttggcgattacgtggaccggggaaaacagagtttagaaacaatttgtcttcttctggcttataagatcaaataccccgaaaattttttccttctgaggggtaatcacgagtgcgctagtataaacagaatttacggtttttacgatgagtgcaagcggcgtttcaatattaagctatggaaaacgttcaccgactgcttcaattgcctccctattgcagctattgtggacgagaaaatattttgttgccacggcggtttatctcctgatctacagtcgatggagcaaataagacgaatcatgcgtccaactgatgttccagacacttag

SEQ ID NO: 236827 - DNA, 972 bp, Artificial Sequence
  Description of Artificial Sequence: Synthetic coding sequence
atggccgacctcgacaaattgaacattgatagcatcattcagaggctgttggaggtgcgtggctccaaacccggtaagaatgtgcagctgcaggaaaacgagattaggggactctgccttaaaagtcgcgagatcttcctgtcacaaccaatcttgctcgagctagaggctcccctgaagatctgtggagacattcatggccaatattacgacttactgcgcttgtttgagtacggagggttcccccctgaaagcaattacctgttcctgggtgactatgttgacagaggaaaacagtcactggagactatctgtcttctgcttgcctataaaatcaaataccccgagaatttcttcctcctcaggggtaaccatgaatgcgcgtcgatcaacagaatctacggcttttacgatgagtgtaaacggaggtacaacatcaaactgtggaagaccttcaccgattgtttcaactgtctacccatcgcagcaattgtggacgagaagatcttctgttgccacggaggactgagcccagatctccagtcaatggaacaaataaggcggattatgcgtccaacagacgttccagaccaaggcctgttgtgtgacctgctgtggtccgaccctgacaaggacgttctgggatggggcgaaaatgatcgtggggtcagctttacctttggcgctgaggttgttgccaaatttctccacaagcatgacttagatctcatttgtcgcgcacatcaagtagtggaagatggctacgagttcttcgctaaaagacagctggttactctgttttccgcacccaattactgtggcgaatttgacaacgccggtgctatgatgtcagtagatgagacgctcatgtgtagcttccagatcttgaaaccagcagaaaagaaaaagccaaatgcgactcggcctgtgactcccccacgaggcatgatcaccaaacaagctaaaaagtag

SEQ ID NO: 236828 - DNA, 1014 bp, Artificial Sequence
  Description of Artificial Sequence: Synthetic coding sequence
atggcagatctcgataagctgaacattgactctataatccaacgcctcctcgaagtgcgaggatctaagcccggtaagaatgtgcagctgcaagaaaacgaaattcgaggcctttgtcttaaaagtagagaaatatttctgtctcagccgatcttgttagaactagaagcgcctctgaagatatgcggcgacattcatggacagtactatgacctgctccgactgtttgaatatggtggctttccaccagagtctaactacctgttcctgggggattatgtcgacaggggaaaacagtccttggagacaatctgtctgttattggcttataaaattaagtaccctgaaaacttctttcttctcagggggaaccacgagtgcgcttccattaatcgcatttacggcttttacgatgaatgtaaacgcagatacaatatcaaactctggaaaacgtttacagattgctttaattgcctgccaatcgcagctattgtcgacgagaagatattttgctgtcacggcggactgtcgcccgaccttcagtcaatggaacagatccggagaattatgagaccgacagatgtaccagatcagggccttctgtgcgatctgctgtggtctgatcctgataaagacgtcctgggctggggtgaaaacgatcggggagtctcattcaccttcggagccgaggtggtagccaaattcctgcataaacatgacctggacctgatctgccgtgcccaccaggtggtggaggacgggtatgaattctttgctaaacggcagttggtcacactgttctccgcccctaattattgcggcgaatttgataacgctggggcaatgatgagtgtagatgagacgctgatgtgttcattccagatcttgaagcccgcagaaaaaaagaagcctaacgctacccgaccggtgacgccacccagggtagctagtggtctgaatccatctattcagaaagccagcaactaccggaacaacactgtcttgtatgagtag

SEQ ID NO: 236829 - DNA, 999 bp, Artificial Sequence
  Description of Artificial Sequence: Synthetic coding sequence
atgttcctccccctgtatctcaacctggtgctatattttgtattctggctccactggacaaactgcgacttctcattagcggtgcggggttctaaacccggaaaaaatgtgcaactgcaggagaatgagatccgaggcctctgtttgaaaagcagagagatattccttagccagccaatcctgctggagctcgaagctcctctcaaaatatgtggggacatccacgggcagtactacgacctgctaagattgttcgagtacggagggttcccccctgagagcaattatctgtttctgggggattatgtagacagaggtaagcaatccctggagacgatttgtctgctcctcgcctacaagatcaagtatccagagaattttttccttcttcggggaaaccacgaatgtgccagcatcaaccgaatctacggcttctacgatgagtgtaagcgccgttataacatcaagttatggaagacattcactgactgcttcaactgtctcccaattgcagccatcgtggacgagaaaatcttttgctgccacggagggctgtctcctgatctgcagtcaatggaacagatcaggcgaattatgcgcccaactgacgtgcccgatcaaggtctgctttgtgatttattgtggtcagatcccgacaaggacgtgctcgggtggggggagaacgacagaggggtgagcttcaccttcggcgctgaggttgtcgcaaaattcctgcataagcacgacttggacctgatctgccgagcccaccaggtggtagaggacggctacgagttttttgccaaaaggcagctcgtgacactgttcagcgctcccaattattgtggggagtttgacaacgctggcgcaatgatgtctgtagacgagactctgatgtgtagcttccaaatcctgaaacccgcagagaagaagaagcctaacgccacccggccagtgacgccccctaggggtatgattacgaagcaagctaaaaagtag

SEQ ID NO: 236830 - DNA, 426 bp, Artificial Sequence
  Description of Artificial Sequence: Synthetic coding sequence
atggagcaaatccgaagaatcatgagaccaacagatgtgcctgatcaggggttactctgtgacctcctgtggtctgaccctgacaaggatgtccttggttggggagaaaatgataggggcgtgagctttaccttcggggcagaagtggtagcaaagttcctccataaacacgacttagacttgatatgccgtgctcaccaggtcgttgaagatggatacgagtttttcgcgaaacgtcagttggtcacacttttctccgccccaaattactgtggtgagttcgataacgccggagcaatgatgtcagtggacgagacattaatgtgctccttccagatactcaaacccgcagagaagaagaagcccaacgctaccaggccggtgacaccccctagagggatgattactaagcaggccaagaagtag

SEQ ID NO: 236831 - DNA, 225 bp, Artificial Sequence
  Description of Artificial Sequence: Synthetic coding sequence
atggggagacgcagtagcaaatgctgttgtatttatgaaaaacctcgagcatttggcgagtcaagcacagagtccgacgaggaggaagaggaaggttgtggccacactcactgcgttagagggcatcggaaaggccgtcgtagggccactttgggcccaactcccactacgcccccacagccgccagacccgtctcagccaccgcctggccctatgcaacactag

SEQ ID NO: 236832 - DNA, 225 bp, Artificial Sequence
  Description of Artificial Sequence: Synthetic coding sequence
atgggacgcagatcgagtaaatgttgttgcatatatgaaaagccaagggctttcggagagtcctctacggaatccgacgaagaagaagaggaaggctgtgggcacacccattgtgtccgcggacataggaagggaaggcggcgtgctacactcggccctactccaactacccctccacagcctccagatccaagccaacctccgcctgggcctatgcagcactag

SEQ ID NO: 236833 - DNA, 225 bp, Artificial Sequence
  Description of Artificial Sequence: Synthetic coding sequence
atggggaggcgctcatctaaatgctgctgcatatacgagaagccgagagccttcggcgaatcctcgaccgagagcgatgaagaggaagaggagggctgtggccacacccactgcgtacgtggacataggaagggcaggcggagggcaactctcgggccaacacccaccactccaccacagccaccagaccctagtcagcctccgccaggacctatgcagcactag

SEQ ID NO: 236834 - DNA, 225 bp, Artificial Sequence
  Description of Artificial Sequence: Synthetic coding sequence
atgggccgacgatcgtccaagtgctgctgcatctatgagaagccccgagcattcggagaatccagcactgagagtgacgaagaggaggaagaaggatgcggccacactcactgcgtgcgtgggcatcgaaaaggcaggaggcgcgcaacacttgggcctacgcctaccaccccacctcagccgcctgacccatcccagcctccccctggaccaatgcagcattag

SEQ ID NO: 236835 - DNA, 381 bp, Artificial Sequence
  Description of Artificial Sequence: Synthetic coding sequence
atggctgaggccggagcaggactgtcagaaactgtcacagagaccaccgttaccgtcactaccgagcccgagaatcggagccttaccattaaactgcgcaagcgaaaacccgagaagaaagttgagtggacgtctgacaccgttgacaacgaacacatgggaagaaggtcttctaaatgctgctgcatttacgaaaagccgagagcattcggagaatcctccactgaaagtgacgaggaagaagaggaaggctgcggacacacccactgcgttagaggacacaggaaggggaggagaagagctaccttaggacctacacctacgacgccccctcaacccccagatccatctcaaccacctcccggtcctatgcagcattag

SEQ ID NO: 236836 - DNA, 225 bp, Artificial Sequence
  Description of Artificial Sequence: Synthetic coding sequence
atgggccgtcgaagctccaagtgttgctgtatctatgaaaagcctcgtgcattcggagagtcttccacagagtcggatgaggaggaggaagagggctgtggacatacacattgtgtaagaggtcatagaaaaggacggagaagggcaacactaggcccaactcccaccacacctcctcagcctccagatcctagccagccacccccaggcccaatgcagcactag

SEQ ID NO: 236837 - DNA, 381 bp, Artificial Sequence
  Description of Artificial Sequence: Synthetic coding sequence
atggccgaggcgggagcgggactgtccgagactgtcacagagaccaccgtcactgttaccacagagcctgaaaaccgcagtctgaccataaaactgcgcaagcggaaacctgagaagaaggtggagtggaccagcgacactgtcgacaacgaacatatggggagaaggagctctaaatgctgttgtatctatgagaagccaagagctttcggcgagagttccaccgaatcagatgaagaggaggaggagggttgcgggcacactcactgtgtccggggacatcgcaagggtaggaggcgcgcaactctggggcctacaccaacaaccccaccccagccaccagacccctctcagcctccccctggaccaatgcaacactag

SEQ ID NO: 236838 - DNA, 225 bp, Artificial Sequence
  Description of Artificial Sequence: Synthetic coding sequence
atgggcagaagaagcagcaaatgttgttgcatctacgagaagccaagagcattcggcgagagtagtacagaatctgacgaggaagaagaggaaggatgtggccatacgcattgcgtcaggggacaccgcaagggaaggcggagagccacgctgggacctacaccaacaactcctccacagccccctgatccttcacagccccctcctggccctatgcagcactag

SEQ ID NO: 236839 - DNA, 225 bp, Artificial Sequence
  Description of Artificial Sequence: Synthetic coding sequence
atgggcaggcggtctagtaagtgttgttgcatctacgagaagccgcgagcttttggcgagagctccactgagtctgatgaggaagaggaggagggttgcggacacacccactgcgtcaggggacatagaaaagggagaaggcgcgctacgttagggccaacacccaccacacctccacagccccctgacccatctcagccacctccgggtcctatgcagcactag

SEQ ID NO: 236840 - DNA, 225 bp, Artificial Sequence
  Description of Artificial Sequence: Synthetic coding sequence
atgggacgccgaagctcgaagtgttgctgtatttacgagaagcctcgagctttcggggagtcatccaccgaatccgacgaagaggaggaagagggatgtgggcatacccattgcgtgcgcggacatcggaaaggtagacgtcgggctacgctcgggcctacacctaccacacctccccagccccctgacccgtcccagccgcctcccggaccaatgcaacactag

SEQ ID NO: 236841 - DNA, 225 bp, Artificial Sequence
  Description of Artificial Sequence: Synthetic coding sequence
atggggaggagatcaagcaaatgctgctgcatttatgaaaaacccagagctttcggcgagtcctctactgaatctgacgaagaggaggaagaaggctgtggccacacacactgtgtccggggtcacaggaagggcagacggagagccacgctggggcctaccccaaccacccctcctcagccacctgacccctctcagccccctcctgggccaatgcagcattag

SEQ ID NO: 236842 - DNA, 225 bp, Artificial Sequence
  Description of Artificial Sequence: Synthetic coding sequence
atgggtcgccgttcatctaaatgttgctgtatttacgaaaagccacgtgcctttggagaatctagcactgaatccgacgaggaggaagaggaggggtgtggccacacacactgcgtacgcggacatcggaaaggcaggcggagggcaacgctgggccctactcccaccactccgccacaaccgcctgaccccagtcagccacccccaggtccaatgcagcactag

SEQ ID NO: 236843 - DNA, 225 bp, Artificial Sequence
  Description of Artificial Sequence: Synthetic coding sequence
atgggcagaaggagtagcaaatgctgctgtatctacgagaagccgagggctttcggagagtcttccaccgaatctgacgaggaagaagaggagggctgcgggcatacacattgtgttcgaggacaccggaaaggcagaaggcgcgcaactctgggccctactccaaccacaccacctcagcccccagatcctagccagcctccacctgggccaatgcagcactag

SEQ ID NO: 236844 - DNA, 225 bp, Artificial Sequence
  Description of Artificial Sequence: Synthetic coding sequence
atggggagacgcagcagtaaatgttgttgtatttatgagaaacctcgggcttttggggagtcgtcaacagaaagcgacgaggaagaggaggaaggctgtggacacacacattgcgttcgtggtcaccgtaaaggacggcgtcgcgctactctggggccaacgccaaccacacctccccagccacctgacccatcccaaccacccccagggcctatgcaacactag

SEQ ID NO: 236845 - DNA, 225 bp, Artificial Sequence
  Description of Artificial Sequence: Synthetic coding sequence
atgggaaggcgctcatctaagtgctgctgtatctatgagaagccacgggctttcggagaatcttccacagagtccgatgaggaagaggaagagggctgtgggcatacgcactgcgtgagaggacaccgcaaaggcagacggagagccacgttaggcccaacacccacgactccccctcagcctcctgaccctagccagcctcctccgggtcctatgcagcactag

SEQ ID NO: 236846 - DNA, 225 bp, Artificial Sequence
  Description of Artificial Sequence: Synthetic coding sequence
atggggaggaggtccagcaagtgttgttgcatttatgagaagcccagggcttttggagagtcttctactgaatcggacgaagaggaggaggaaggctgtggccacacacactgtgtgagggggcatcggaagggcagacgccgtgctaccttgggtcctacgcccaccacacctccccagcccccagacccttcacaacctccaccaggcccaatgcaacattag

SEQ ID NO: 236847 - DNA, 225 bp, Artificial Sequence
  Description of Artificial Sequence: Synthetic coding sequence
atgggacgcaggtcttctaagtgctgttgtatctatgagaagccacgagccttcggtgagtcctctacagaaagcgacgaggaggaggaagaaggatgtggacacacacattgtgtgcgtgggcaccgcaaggggaggcgaagagccacactaggccctacaccaactacacccccacagccacccgacccaagtcagcccccaccaggtcccatgcaacattag

SEQ ID NO: 236848 - DNA, 225 bp, Artificial Sequence
  Description of Artificial Sequence: Synthetic coding sequence
atggggcgtagatcatctaaatgttgttgcatttatgaaaaacccagagctttcggggaatccagtacagagtctgacgaggaggaggaggagggatgcgggcatacccattgcgtgcggggtcaccggaaagggaggcgccgagccactctcggaccgacacctacgaccccaccacagcctccggatcctagtcaaccaccgccagggccaatgcagcactag

SEQ ID NO: 236849 - DNA, 225 bp, Artificial Sequence
  Description of Artificial Sequence: Synthetic coding sequence
atgggacgcagatcctctaaatgttgctgtatctacgagaaacccagagcttttggcgagagttcaaccgaaagcgatgaggaagaagaggaaggctgcgggcacactcactgcgtaagaggtcatcgaaaaggtcgaagaagggcaacgttggggcctacacccactacacctcctcagccccctgacccatctcaacctccacccggacctatgcagcactag

SEQ ID NO: 236850 - DNA, 225 bp, Artificial Sequence
  Description of Artificial Sequence: Synthetic coding sequence
atgggaaggaggtccagtaagtgttgctgcatctacgagaagccaagagcgttcggggagagctcaacagaatcagacgaggaggaagaagaagggtgcggccatactcactgcgttcgagggcaccgcaaaggtcgcaggcgggcaacacttgggccaacccctacaaccccaccacagccccctgacccctcacaacctccgccaggccctatgcagcattag

SEQ ID NO: 236851 - DNA, 225 bp, Artificial Sequence
  Description of Artificial Sequence: Synthetic coding sequence
atgggcaggaggtcttcgaagtgttgctgtatctacgaaaagcctagagcctttggcgaatcttcaactgagtccgacgaagaagaggaggaaggatgcggccacacgcactgcgtgcgagggcataggaagggccgaagacgcgctacgcttggccctactcctacgactcctccgcagcctcccgatcccagccagccccctcccggacccatgcaacattag

SEQ ID NO: 236852 - DNA, 225 bp, Artificial Sequence
  Description of Artificial Sequence: Synthetic coding sequence
atgggtagaagatccagcaaatgttgttgcatttacgaaaagcctagggcgttcggagagagctccacagaaagcgacgaagaagaagaagagggttgtggtcatacccattgcgtgaggggacacaggaagggccgtcggagggctaccctaggaccaactcctacgaccccgccacagccacccgatccttctcagccacctccaggcccaatgcagcattag

SEQ ID NO: 236853 - DNA, 381 bp, Artificial Sequence
  Description of Artificial Sequence: Synthetic coding sequence
atggcggaagctggcgcagggctgagcgagaccgtgactgagacaacggtcaccgtcacaacggaacctgagaataggtctctgacaattaaactgcgcaagcgtaagcccgagaagaaagtcgaatggacatctgacactgtggataacgaacacatggggcgaaggtcatccaaatgttgctgcatttacgaaaaacccagagccttcggcgaatctagtaccgaaagcgatgaagaggaggaggaagggtgcgggcacacacactgcgtcaggggacacagaaaagggcgacgaagagcaacactcgggccaacccccactaccccaccacagcctccagatccttctcaaccacctcccggtcccatgcagcattag

SEQ ID NO: 236854 - DNA, 381 bp, Artificial Sequence
  Description of Artificial Sequence: Synthetic coding sequence
atggcagaggccggtgctggcttaagcgagacggtgacagaaactaccgtgactgttacaactgaaccggagaaccgctcccttacgattaaactgcgcaagaggaagcccgagaagaaggtggaatggacttcagacaccgtagataatgaacacatggggagaagatcatccaagtgctgctgtatctacgaaaaaccacgggctttcggggagagttctacggaatccgacgaggaggaagaagaaggatgcggccacactcactgtgttcgaggtcaccgcaaaggccgaagaagggctacattgggacccactccaactacgccaccacagcctccggatccttcccagcccccaccaggacccatgcagcattag

SEQ ID NO: 236855 - DNA, 225 bp, Artificial Sequence
  Description of Artificial Sequence: Synthetic coding sequence
atgggacgaagatcgtccaaatgttgttgtatttacgagaagccccgagctttcggcgagagttccacagagtctgacgaagaggaagaagagggatgtggccacactcactgcgttcgtggccatcgaaaaggccgaagaagggcaactctcggacccaccccaacgacgcccccacagcctcccgacccatctcagccaccccctggacccatgcaacactag

SEQ ID NO: 236856 - DNA, 225 bp, Artificial Sequence
  Description of Artificial Sequence: Synthetic coding sequence
atgggtcggagatcttctaaatgctgttgcatttacgagaaaccccgagcctttggagagtcctctaccgaatctgatgaagaggaggaggaaggctgcgggcatacccactgcgtgcggggtcatcgaaagggacgacgtcgtgccacactgggacctacaccaactacaccacctcagcctcccgacccgtctcagcctcccccaggcccaatgcagcactag

SEQ ID NO: 236857 - DNA, 225 bp, Artificial Sequence
  Description of Artificial Sequence: Synthetic coding sequence
atgggcagacgctcgtccaaatgttgctgcatttatgagaaaccgagagcattcggcgaaagttctacagaatccgatgaggaggaggaagaggggtgcggacatacccactgtgtacgagggcataggaaagggagacgccgagcaaccctgggacccaccccaacaacaccaccacaacccccagacccttcccagcctccacctgggccaatgcagcattag

SEQ ID NO: 236858 - DNA, 381 bp, Artificial Sequence
  Description of Artificial Sequence: Synthetic coding sequence
atggccgaggctggagccggactgtccgagaccgttaccgagactactgtaacagtgacgacagagccagagaaccgcagcctgaccatcaagctcaggaaaaggaagccagaaaaaaaggtcgagtggacttctgacaccgttgacaacgaacatatgggcaggcggtcttcaaaatgctgttgcatctacgagaaacctcgtgcctttggcgagtcatctaccgagagtgacgaggaagaagaggaaggatgcggacacacccattgcgtgcgcggtcaccgcaagggcagacggagggctaccctgggcccaacaccaacaaccccccctcagccccctgacccctcccagcctcccccaggcccaatgcagcactag

SEQ ID NO: 236859 - DNA, 225 bp, Artificial Sequence
  Description of Artificial Sequence: Synthetic coding sequence
atgggacggaggagcagcaagtgctgctgtatctacgaaaaacctagggcgttcggggaatcctcaaccgaatctgatgaggaggaggaggagggctgcggacatactcattgcgtgagaggacatagaaaaggaagaaggcgggctaccctgggaccaacacccacaactcctcctcagcccccagacccatctcaaccaccaccaggtccaatgcagcactag

SEQ ID NO: 236860 - DNA, 225 bp, Artificial Sequence
  Description of Artificial Sequence: Synthetic coding sequence
atgggcaggcgttcaagcaaatgttgttgcatctatgagaagcccagggctttcggtgaatcttccacagagtccgatgaggaggaagaggaaggatgcggacatactcactgcgtgcgcggacacagaaaaggtcgtagacgggcaaccctcggcccaactcccacaacacctccgcagccccctgatcctagccagccacccccaggacctatgcagcattag

SEQ ID NO: 236861 - DNA, 381 bp, Artificial Sequence
  Description of Artificial Sequence: Synthetic coding sequence
atggctgaggcaggcgcaggactgtccgaaaccgttacagaaaccactgtgaccgtgacaacagaaccagagaacaggagtctgacaatcaagttgcgcaaacgcaagccagagaagaaggtggaatggacctctgacaccgtcgacaacgaacacatgggcagacggagttcaaagtgttgttgtatctatgagaagccgagggccttcggagaatcttctacagagtcggacgaggaagaggaagagggctgtgggcatacacactgcgtccgcggtcacagaaagggccgtaggcgtgcgactctcggccctacgcctaccactccccctcagcccccagacccaagccagcccccacctggccctatgcagcactag

SEQ ID NO: 236862 - DNA, 225 bp, Artificial Sequence
  Description of Artificial Sequence: Synthetic coding sequence
atgggtagacgcagtagcaaatgttgctgtatttacgaaaaaccacgcgcattcggggagagcagcaccgagagcgatgaagaggaggaagagggatgtggacacacccactgtgtgcgaggccatcggaagggacgaaggcgagccaccctcgggccaactccgaccacacctccacagccacctgatccatcccagccaccccctggcccaatgcagcattag

SEQ ID NO: 236863 - DNA, 225 bp, Artificial Sequence
  Description of Artificial Sequence: Synthetic coding sequence
atgggtcgcaggtccagtaaatgctgctgtatctatgagaaacccagggccttcggtgagagtagcacagaatctgacgaggaggaggaggaagggtgtgggcatacacactgcgtcaggggccaccgcaaaggacgcaggcgtgcaaccttgggccctacccccacaactcccccacagcctccggacccctctcagccaccccctggaccaatgcaacactag

SEQ ID NO: 236864 - DNA, 225 bp, Artificial Sequence
  Description of Artificial Sequence: Synthetic coding sequence
atggggagacgttcatccaaatgttgctgtatctatgaaaaaccgcgagcctttggagaaagtagcactgaaagtgacgaagaagaagaggagggatgtgggcatacacactgcgtgagaggtcaccgcaagggacggaggagagcaacactgggcccaacccctacgaccccacctcaaccacctgacccgagccagccaccacctggcccaatgcagcactag

SEQ ID NO: 236865 - DNA, 225 bp, Artificial Sequence
  Description of Artificial Sequence: Synthetic coding sequence
atgggcaggcggtcttcgaaatgttgctgcatctatgaaaagcccagagcattcggcgaaagtagcactgagagtgacgaagaggaagaggaaggctgtggacacacgcactgtgttaggggccacaggaagggtcgaagacgggcaacattagggccaacccccacaactccccctcagcccccagatccatcccagcctccccctggacccatgcagcattag

SEQ ID NO: 236866 - DNA, 225 bp, Artificial Sequence
  Description of Artificial Sequence: Synthetic coding sequence
atgggcaggagatccagcaaatgctgctgcatctacgagaagcccagggcgttcggcgagagtagcacagagtcagatgaagaggaggaagagggttgcggacacacccactgtgtacgcggacatcggaagggtcgcaggagggctactttaggccctacacccacgacgccacctcagccacctgacccatcccaacccccacctggaccaatgcagcattag

SEQ ID NO: 236867 - DNA, 225 bp, Artificial Sequence
  Description of Artificial Sequence: Synthetic coding sequence
atgggcaggcggtcatctaagtgctgctgcatttacgagaagccccgagccttcggagaaagcagcactgagtcggacgaagaggaggaagaaggctgtggccatacgcactgcgtgcggggtcatcgcaaagggcgtcgaagggccacgctcgggcctactcctactacaccacctcagccaccagacccaagccagcccccaccaggtccgatgcagcactag

SEQ ID NO: 236868 - DNA, 381 bp, Artificial Sequence
  Description of Artificial Sequence: Synthetic coding sequence
atggcggaggccggagctggcctatccgagaccgtgacggagacaactgtgaccgtaacaacagagcccgagaaccgcagtctcactataaaactcaggaagagaaagcctgagaagaaggtggagtggaccagcgatacggtagacaatgagcatatgggcaggaggtccagcaagtgctgctgcatatacgagaagccacgtgcgtttggagagtctagcacagagtctgacgaggaggaagaggaaggatgtggtcacacacattgcgtacgcggtcataggaaggggcgtcggcgtgcgaccttgggcccaacaccgactacccccccacagccacctgatccatctcagccaccaccaggcccaatgcaacattag

SEQ ID NO: 236869 - DNA, 225 bp, Artificial Sequence
  Description of Artificial Sequence: Synthetic coding sequence
atggggcgacgtagttctaagtgctgctgtatctacgaaaaacccagagcttttggcgagtcctccacggaaagcgacgaagaggaggaggaagggtgtggccacacacattgcgttagaggtcatcgtaagggcaggcggagagccaccttgggaccaaccccgactactcccccacagccgcctgatccctctcagcctccacctgggcctatgcagcactag

SEQ ID NO: 236870 - DNA, 225 bp, Artificial Sequence
  Description of Artificial Sequence: Synthetic coding sequence
atgggaagacggtcatccaagtgctgctgcatctacgagaaaccccgtgcattcggagagagctctaccgagagcgacgaggaggaggaagaaggatgcggccatacacactgcgtgcggggtcaccggaaaggaagacggagggccacccttggtcccacacccaccacgcctcctcaaccacctgacccttctcaacctccacccggtccgatgcaacactag

SEQ ID NO: 236871 - DNA, 225 bp, Artificial Sequence
  Description of Artificial Sequence: Synthetic coding sequence
atggggcgtcgtagtagcaagtgttgttgcatctatgagaagccacgggcattcggagagagcagtaccgagtcagatgaagaagaggaagaaggttgtggacatacccattgtgtgcgagggcacagaaaaggtcggcgtagggcaactcttggacccacccccaccacgcctccacaaccccctgaccccagtcaacctcctcccggtcctatgcaacattag

SEQ ID NO: 236872 - DNA, 225 bp, Artificial Sequence
  Description of Artificial Sequence: Synthetic coding sequence
atgggccgtcgaagcagcaaatgttgctgcatctacgaaaagcctcgggcttttggggagagttccactgagagtgacgaagaagaggaagaagggtgtggacatacccactgtgtccggggtcatagaaaaggcagaagaagagccacccttggaccaactcccaccacacctccgcaacctcccgatccatcacagccacctcctggacccatgcagcattag

SEQ ID NO: 236873 - DNA, 225 bp, Artificial Sequence
  Description of Artificial Sequence: Synthetic coding sequence
atggggaggcgctcgtccaagtgttgttgtatttacgagaagccgagagcatttggcgaaagttcaacggaatccgatgaggaggaggaggaagggtgcggtcacacccactgcgtcagggggcacaggaagggcagaaggagagctacactggggccaacacctacgacccctcctcagcctccggacccctcccagcctcctcctgggcctatgcagcactag

SEQ ID NO: 236874 - DNA, 225 bp, Artificial Sequence
  Description of Artificial Sequence: Synthetic coding sequence
atgggcagacgctcctctaagtgttgttgtatctacgagaagccgagggcctttggggagagctccaccgaaagtgatgaggaagaggaagagggctgtgggcacacccattgcgtgcggggtcatcggaagggaagaagacgggcaaccctgggtccaacccccacaacaccccctcagcctccggacccaagccagcccccacctggtcctatgcagcactag

SEQ ID NO: 236875 - DNA, 381 bp, Artificial Sequence
  Description of Artificial Sequence: Synthetic coding sequence
atggccgaagccggagccggattgtctgaaaccgtgacagagacaacagtgacagttacaaccgaacctgagaatcggagcctgaccattaaattgaggaaacggaaacctgaaaagaaggttgagtggacatccgacaccgtagacaatgaacatatgggcaggcggtctagtaagtgctgttgcatctacgagaaacctagggctttcggagaaagtagtacagagtcagacgaggaagaagaggagggctgtggccacactcactgtgtacgcggtcacaggaaaggcaggcgacgggctaccctgggacccactccaacaaccccccctcaaccccctgacccctctcagcctcctcccggacccatgcaacactag

SEQ ID NO: 236876 - DNA, 225 bp, Artificial Sequence
  Description of Artificial Sequence: Synthetic coding sequence
atggggagaagatcctcaaagtgttgctgcatttacgagaagcctagagccttcggagaatcttccactgaatctgacgaggaggaggaggagggctgtggtcacacgcactgtgtgagaggacaccggaagggcaggcggagagctactctgggccctacccctacaactccgcctcaacctcctgacccaagtcagccccctccgggacccatgcagcactag

SEQ ID NO: 236877 - DNA, 225 bp, Artificial Sequence
  Description of Artificial Sequence: Synthetic coding sequence
atgggaaggagaagttctaaatgttgttgcatttatgagaagcccagggcatttggcgaatcatctacggaaagcgacgaagaggaggaggagggctgtgggcacacacattgcgtgcggggtcaccggaagggaaggaggcgcgcaaccctcgggccaacaccaacgactcccccacaacctccggacccatctcagcccccaccaggacccatgcaacactag

SEQ ID NO: 236878 - DNA, 225 bp, Artificial Sequence
  Description of Artificial Sequence: Synthetic coding sequence
atgggaagaaggtcttccaaatgttgctgcatatatgagaaaccgagggcatttggtgaatcaagcaccgagtctgatgaggaagaggaagagggctgcgggcatacccactgcgtccgtggacacagaaagggcagacgtcgagccacacttggaccgaccccaactacaccaccacagcctcctgatccctctcagcccccacctggcccaatgcagcactag

SEQ ID NO: 236879 - DNA, 444 bp, Artificial Sequence
  Description of Artificial Sequence: Synthetic coding sequence
atggccgactctggcaccgcaggcggagccgctctggccgctcccgctcctggacccggaagcggagggccaggtccacgggtgtacttccagtccccaccaggtgccgcaggcgaaggcccaggcggagccgatgacgaaggccctgtccgcagacagggtaaggtgacagtgaagtatgaccgcaaggagttgaggaagaggctgaatctggaagagtggatccttgaacaactgacccggctgtatgattgccaagaggaggagattcccgagcttgaaatcgacgtcgacgagctgctggatatggaatctgatgacgctagagccgcaagggtgaaggaattgcttgttgactgctataaacctaccgaggcatttataagcgggttgttagataagatcagggggatgcaaaaattgagtacaccccagaagaagtag

SEQ ID NO: 236880 - DNA, 498 bp, Artificial Sequence
  Description of Artificial Sequence: Synthetic coding sequence
atgagcgttgccacgggcagcagcgaaaccgcgggaggcgcatctggaggcggagcccgtgtgttttttcagtctccaagaggcggagcgggaggctcaccaggttcaagcagtggttccgggtctagcagagaggattctgccccagttgctacagcagccgcagcaggtcaggtgcagcagcaacagcaaagaaggcaccagcagggcaaggtaactgtgaaatacgaccggaaagagctcagaaagaggctagttttggaggagtggatcgtcgagcagctggggcaactatatggatgcgaggaggaggaaatgcctgaggttgaaattgacatcgatgacctgctggacgccgatagtgacgaggagcgcgcttcaaagctccaggaggcgctggttgactgctacaaacctacagaggaattcatcaaagagctgctgtcccgaatcagaggaatgcggaaactgtctcctccacagaaaaaatccgtgtag

SEQ ID NO: 236881 - DNA, 438 bp, Artificial Sequence
  Description of Artificial Sequence: Synthetic coding sequence
atgctgtcgtctagtccggcttcttgcacgtccccgtcaccggacggggaaaacccgtgtaaaaaggtgcactgggcctcgggtcgcagaaggactagtagtacagacagcgaatctaaaagccatcctgatagtagcaagatccctagaagcagacgaccctccagacttacagtcaagtatgacagaggccaattgcaacggtggctggagatggagcaatgggtggacgcacaagttcaggaactatttcaggatcaagctacgccatctgagccggaaattgatctggaggcccttatggacctaagcaccgaggagcagaaaacccaactagaagcgattttgggcaactgtcctagaccaactgaggcattcataagcgaattactgtctcaactcaagaagctgagaaggttatccaggccgcaaaagtag

SEQ ID NO: 236882 - DNA, 603 bp, Artificial Sequence
  Description of Artificial Sequence: Synthetic coding sequence
atgttaagcagcagccccgcttcatgtacttcccctagccctgacggcgagaatccatgtaagaaggtgcattgggcctccggacgccgtcgcacatctagtactgatagtgagtccaaaagtcatcccgattctagtaaaattcccaggtcaaggaggccgtcaaggctaacagtcaagtacgatcgaggccagctccagcgctggttggagatggagcagtgggtcgatgcccaggttcaagagctgtttcagagtctcgcactgtccccacgcttggaatgttcgggagtgatccacagcctccagttgttgccgcctggctttaacagatttagttgcctgagcagctggagttcgtgggactatggtattaaacagcccctcctgagcctgaggctgacctggaaactgtcttggatatacccccaacggagtcgtcgattgtcctggcgcccattcctgggcactgcccctgcgccacagcggcttctgtcccttagttgctccgtcaattccagaaacagcggcgactctgctggcctgaggaacaaacccgagaggccatcgctggccgcttccgcccttcccggattgccctag

SEQ ID NO: 236883 - DNA, 516 bp, Artificial Sequence
  Description of Artificial Sequence: Synthetic coding sequence
atggagcaggataacagcccgaggaagatccagtttacagtacctctactagagccccacctggatcctgaggcggctgaacagatcagacggaggaggcctacaccagccacactggtgctcacttccgaccagtcatcgcccgagatagacgaagacagaatccctaacccacatcttaagagcaccctcgccatgtctccaaggcagcggaagaaaatgactcggatcaccccaacaatgaaggaactgcagatgatggtcgaacatcacttgggacagcaacagcagggcgaggagccagagggcgctgcagaatccaccgagactcaagagtccagacctcccggaatcccagatacagaggtcgagagtagacttgggacaagtggaaccgctaagaagactgccgaatgcattcccaagacccatgagaggggttccaaggagccctctactaaggaaccctctacccacattcctcccctcgatagcaagggagctaattctgtgtag

SEQ ID NO: 236884 - DNA, 462 bp, Artificial Sequence
  Description of Artificial Sequence: Synthetic coding sequence
atggaacaggataattcccctcgcaagatccaattcacggttccacttctcgaaccacacctggatcccgaggcagccgagcagattagaaggaggaggcccacccccgctacgctagtcctcaccagtgaccagagctcacccgagatcgatgaagatcggattcctaatccgcacctgaaaaaactgcagaatgcatcactcaagctgacacgagaggccgtacgtaaccccgcacagaaaaaccctcaacctatttatcaccattggatacctcgggaacccacacggtgtcacagacgaggcggtacaggtgggcagaagagcgtcggaggattcccctgctccactcatacactggcgccattttacgtgttcacgcgctctatcttgctgctaaagagaggggaaaggatgtcccatccgctcgagcctcgagacgatcccacaaagatgccttag

SEQ ID NO: 236885 - DNA, 330 bp, Artificial Sequence
  Description of Artificial Sequence: Synthetic coding sequence
atggaacctaattcacctaagaagatccaattcgccgtgccggtgttccagtcacaaatcgcaccggaggctgcagagcagattaggaagcgcaggcctacccccgcttcactggtgatcctgaatgagcacaaccctcccgaaatcgatgacaagcgaggtccaaatacgcagggtgaactgcaaaacgcaagcccaaagcagcgtaaacagtctgtgtatacgcccccaaccatcaaaggtgtcaaacatctgaaaggccagaacgaatcagccttccccgaggaagaggaaggcactaacgaaagggaagaacagcgcgatcattag

SEQ ID NO: 236886 - DNA, 330 bp, Artificial Sequence
  Description of Artificial Sequence: Synthetic coding sequence
atggaaccgaatagcccaaaaaagatccagttcgcagtgccagtgtttcagagccaaattgctcctgaagccgctgagcagatacgcaagcggagacctacgccggcttccctggtcatactgaacgagcacaacccgccagaaattgatgataagcgcggacccaatacccagggtgagctgcagaatgctagtccgaaacagcgcaagcaatcagtctacaccccaccaacgatcaaaggggttaagcacttgaaaggccaaaatgaaagcgcctttcccgaagaggaggagggaaccaacgaaagagaagaacagagggaccattag

SEQ ID NO: 236887 - DNA, 330 bp, Artificial Sequence
  Description of Artificial Sequence: Synthetic coding sequence
atggagcccaacagcccgaaaaagatccagtttgccgtacccgtttttcaatcacagattgctccagaggcggctgagcagatacgcaaacgcagacctacacccgcatccttggtaattctgaatgagcacaatcctcccgagatagatgacaaaagaggaccaaacactcagggtgaattgcagaatgccagccctaaacagaggaagcagagcgtgtacacaccccctaccatcaagggcgtgaagcatctgaaaggccaaaacgagagtgccttccccgaggaggaagaggggacaaatgagcgagaggagcaaagagaccattag

SEQ ID NO: 236888 - DNA, 618 bp, Artificial Sequence
  Description of Artificial Sequence: Synthetic coding sequence
atggccgcttccactgctagccaccggccaatcaaaggcattcttaagaacaagacatccacgacatcatctatggtcgctagcgccgaacagcctcggggtaacgttgatgaggaattaagcaaaaagagtcagaaatgggacgagatgaatattcttgccacctatcatcccgcagacaaggattacggacttatgaagatcgatgagccctccactccctatcattctatgatgggcgacgacgaagacgcctgcagcgatacagaggctaccgaggctatggcgcctgacatcctggcacgcaaattggcggctgcagaaggattggagcccaagtataggatccaggagcaggagtctagcggcgaggaggactctgacctcagccccgaggagagggagaaaaaacgccaatttgagatgaagcggaaattacactataacgagggcctcaacataaagctagcaagacagctgataagcaaagacctccacgacgatgatgaagacgaggagatgctcgagaccgctgacggagaatctatgaataccgaggagtcgaatcaggggagcaccccttctgatcagcaacagaataagttgaggagtagctag

SEQ ID NO: 236889 - DNA, 3093 bp, Artificial Sequence
  Description of Artificial Sequence: Synthetic coding sequence
atgaaaatggccgacgcaaaacagaaacgcaacgagcagctgaagcgctggatagggtcagaaaccgacctcgagccgccagtagttaaacggcagaaaaccaaggttaaattcgacgatggcgcagtgttcttggccgcttgtagcagcggggacactgacgaggtgctcaagcttttacataggggagccgacataaactacgcaaacgtcgacggcctaacagcattgcaccaggcctgtatcgacgataatgtcgatatggtaaaattccttgtggaaaacggcgcaaacattaaccaacccgacaatgaggggtggatcccgcttcatgccgctgcatcatgcggctatctggatatcgccgaattccttattggccagggagcacacgtcggggcagttaacagcgaaggtgatacccctctcgacattgccgaagaggaggccatggaagagctattgcagaatgaggtgaaccgccagggagtggacattgaagccgctaggaaggaagaggagagaattatgctacgggatgctcggcagtggttgaacagcggtcatattaacgacgtgagacatgctaagagtgggggtacggctctgcacgtcgctgctgcaaaggggtacactgaagtcctcaagcttctcatccaggccggttacgatgtgaacatcaaggactacgacggttggactccgctacacgcagccgcacattggggtaaggaggaggcatgtcgcattctagtggataacctttgcgatatggagatggtgaacaaggttggacagactgctttcgacgtcgctgacgaggatattctgggctatttggaagagctacagaaaaaacagaatctcctgcactctgagaagcgggacaagaagagccccctcatcgagagtaccgccaatatggataacaaccagtcccagaagacattcaaaaataaggaaacccttattatcgagccagagaaaaatgcctctcggatcgaatctctggagcaggaaaaggtggatgaggaagaggaggggaagaaggatgagtcctcgtgcagctcagaagaagacgaggaagacgactccgagtctgaggctgagactgacaaaacgaaacctctggcctccgtaactaacgcgaatacgagctcgactcaggctgcccctgtggctgtaacgaccccaacggtcagtagcggacaggctactcctaccagtccaattaaaaaattcccaacaacagcgaccaaaataagcccgaaggaagaagaacggaaggacgaatccccggctacttggaggctggggttgagaaagactggctcctacggggcactggccgaaattacggcatccaaggaggggcaaaaagaaaaggatacagcaggcgtcaccagatccgcatcgtcgccccgtctaagttcctctctcgacaacaaggagaaggagaaggactcaaagggcactcgcttagcatatgttgcccctaccatcccgaggagattagcgtccacttcagacattgaggagaaggaaaacagggattcaagctccctgcgaacaagctcctcatatacccggagaaaatgggaagacgatttgaagaagaattcttccgtcaatgaaggaagcacgtaccacaaaagctgtagcttcggcaggcggcaggacgacctgatttcttcatcggtgccctcaacgacctctacacccactgtgacaagcgcggcaggcctccaaaagtctctcctgagtagcacatctacgacaacgaagataactaccggcagctcctcagctgggacccagtcaagtacctcaaatcgcctgtgggccgaagactccacagagaaggaaaaggactcggtaccaaccgctgtgactattcccgtggctccaaccgttgtgaatgccgctgcctcaacaaccactttgacaacaacaacagcagggacagttagctcaactaccgaagtgagggaaaggagacggtcgtatctgacccctgtgcgtgacgaagaatcagaaagtcagcgcaaggcacggagccgccaggctcgacagtcaaggcggtccacacaaggggtgaccctgaccgacctgcaggaagcggagaagaccattggtcgaagtagatccacaagaactagggagcaggagaatgaagaaaaggagaaagaggagaaagagaaacaggacaaagaaaaacaggaagagaagaaggagtctgaaacatctcgtgaggatgagtacaagcagaaatactctagaacttacgatgagacgtatcaaagatatcgaccagtctctaccagctccagcaccacaccatcatccagcctgtctacaatgtcctcaagtttatacgctagcagtcaacttaatcgccctaattccctagtgggaataacctcagcctatagccggggaattacaaaggaaaacgaacgagaaggcgagaaacgggaagaggaaaaggaaggcgaagacaaatcacagcccaaatccatccgtgagaggaggaggccaagggaaaagcgtagatctacaggggtctccttttggacccaggatagtgacgaaaacgagcaggaacagcagtcagacaccgaagaagggtccaataaaaaagaaacccaaaccgacagcatctctcgatacgagacctcatcaacaagcgcgggtgaccgatatgactctctcctcgggagaagcggctcatactcctacctggaagagagaaagccttattcctctcggctggagaaggacgatagtactgacttcaaaaaactctacgagcagattctggccgagaacgaaaagctgaaggctcagctgcacgacacaaacatggagttgacagacctgaaacttcagctggaaaaggctacccagagacaagaaagattcgctgatagatctctcctagaaatggagaaacgcgagcgaagggccttggagaggcgcatctcagaaatggaagaagaattaaaaatgctgcctgatctaaaagccgacaatcagcgacttaaggatgaaaatggagccctcatacgggtgataagcaagctttccaagtag

SEQ ID NO: 236890 - DNA, 2916 bp, Artificial Sequence
  Description of Artificial Sequence: Synthetic coding sequence
atgaaaatggctgatgcaaaacagaaaagaaacgaacaattgaagcgctggataggatctgagaccgatttagagcctccggtggtcaagcgccagaagactaaggtcaagtttgatgacggagctgtgtttctcgctgcctgtagtagcggagacacagatgaagtactgaaattgttgcatagaggagccgacattaactatgccaatgtggacggtctcaccgctctgcatcaagcctgtatagacgacaatgtggacatggtgaagtttcttgtagaaaatggcgcaaatatcaaccaacccgacaatgaggggtggattcccctccatgccgctgccagctgtggatacctggacatagctgagtttctgatcggtcaaggagcacacgtgggtgccgtgaattcagagggcgatacgccattagatatcgcagaagaagaagctatggaagagctgttgcagaacgaggtaaatcggcagggcgtcgacattgaagccgcacgcaaggaagaagaaagaataatgttacgcgacgcccgacaatggctcaactcagggcatatcaatgatgttcgtcatgccaagtcaggcggtaccgctcttcacgtggcggcagccaaagggtacaccgaggtgctcaaactgctaattcaagctgggtatgatgtaaatattaaggactacgatggctggactccactgcacgccgcagcacattgggggaaagaagaagcatgtaggatccttgtggataatctgtgtgatatggaaatggttaataaggtggggcagacagcctttgacgtagccgatgaagacatcctgggatatctggaggaattgcaaaagaagcagaacctgcttcacagcgagaagcgtgataaaaagagcccactgatcgaaagtaccgcaaatatggacaacaaccagagccagaaaacatttaaaaataaagaaacacttataatagagccggagaagaatgcatcacgcattgaaagtctggaacaggagaaggtcgacgaagaggaggagggtaagaaagatgagagcagctgtagttctgaggaggacgaggaggatgactccgaaagcgaagccgagacggacaaaactaagcccctggccagcgtgaccaatgcgaacacatcctccactcaggcagctcccgtagcagtcacgactcccactgtgagctctggacaagccacacccacctcaccaataaagaagttccctacaaccgccacaaaaatcagtcccaaggaagaggagagaaaagatgaaagcccagcaacatggcggctggggctccggaagaccggcagttatggtgcactggccgaaattactgctagtaaagagggccagaaagaaaaggatactgcaggagtcactaggtcagcgtcaagtcccaggctgtcgtcttctctcgacaacaaagaaaaagagaaagactctaagggcacgcgtctagcttatgtcgctcctacgattcccaggaggctggcatctacttctgacatcgaagaaaaagaaaatcgcgacagttcctccctgcggacttcctctagctacacacgtcgaaaatgggaagacgatcttaagaaaaactctagtgttaacgaaggatccacgtaccacaaatcatgtagctttgggaggagacaagatgatttaatctcatcaagcgtgccatctaccacatccacaccaacagttacaagcgctgcaggcttacagaagagcctgctgtcttcaaccagtacgaccactaagatcaccaccggcagcagttcggcaggcacacagtctaggagctatctgactccagtgagagatgaggagagcgaatcccagaggaaagctcgctctagacaggctaggcagtcccgccgatccactcagggggtcaccttgactgacctccaagaggccgagaagaccattggacgttcccggtcaacaagaactcgggaacaggaaaatgaagaaaaagaaaaggaggaaaaggagaaacaggataaagaaaagcaggaggaaaaaaaggaatctgaaacaagtcgtgaggacgaatataagcagaaatacagcaggacctatgacgaaacataccagcgataccgaccagtgagcacatcttccagtacaaccccttccagttctctgtccactatgtccagcagtctttatgcttcttctcaactgaacaggccaaatagtctcgttggaatcacttctgcctatagcagaggcatcactaaggagaacgagcgagagggagagaagcgagaggaggagaaggaaggcgaggacaagtctcaacctaaatctatccgggaacgcaggagacccagagagaaacgtagatccacgggggtcagtttttggacacaggattctgatgagaacgagcaggagcaacagagcgacacagaggagggctccaataaaaaggagacgcaggtcaatacaatcaccttgtacgaaaccagctctacctcagcaggggacaggtacgattcactgctgggcaggagcgggtcttattcatacctagaggaacgaaaaccctatagttctaggctcgagaaagatgattccacagactttaagaagctctatgaacagatcctagctgagaacgagaagctgaaggcacagcttcatgacactaatatggagctgacggatttgaagctccagctggaaaaggccacccagagacaggaacgctttgcggaccggtcactactagaaatggaaaagcgcgaacgtagagcactcgagcgtagaatcagtgagatggaagaggaattaaaaatgctgcccgacctgaaagcagataaccagagactgaaagacgaaaatggcgctctgattcgagtcatctctaaactgtcaaagtag

SEQ ID NO: 236891 - DNA, 2925 bp, Artificial Sequence
  Description of Artificial Sequence: Synthetic coding sequence
atgaaaatggctgatgctaaacaaaaaagaaatgagcaactgaaacggtggattggaagcgaaacagaccttgagccgccagtcgttaagcgacaaaagacgaaggtgaagtttgatgacggggcagtgttcctggcagcctgcagcagcggtgacactgatgaagtcctgaagctgttacatcgaggagcggacattaactatgccaacgtggacggcttgaccgctctccaccaggcctgtatcgacgataatgtggatatggtgaagtttctagtggaaaacggagccaatataaatcagcccgacaatgagggatggatccccctgcacgcagccgcttcatgcggatatttagacatagccgagtttctcattggccaaggcgctcacgtcggcgctgtgaattctgaaggggatacgcccctggacattgccgaagaggaagccatggaggagctgctgcaaaacgaagtgaacagacaaggggtggacatcgaagccgcacgaaaggaagaggagcggataatgctccgggacgctcggcagtggctaaactctggccacattaatgacgttcgccacgcgaaatctggcggaactgctctgcacgttgcggcagccaaagggtatactgaggtgttaaaattgctgatccaggccggttatgatgtaaatattaaggactatgatggatggacccccctgcatgctgcagcccattggggaaaggaagaagcctgccggattcttgtggacaacctttgtgatatggagatggtcaacaaggtgggccaaactgcgttcgacgtcgccgacgaagacatactgggttatctggaggagctgcagaagaagcaaaacctgctgcactcagagaaaagagataagaaaagccctctgatcgaatcaactgcgaatatggacaacaatcagagccagaagacattcaagaataaagagactctgatcattgagcctgaaaaaaatgcctcgcgcattgagagcctggaacaggaaaaggttgacgaagaagaggaaggtaaaaaggatgaaagctcttgctcatccgaggaggatgaagaagatgactcggagtcagaagcagaaactgataagaccaagccactcgcctcagtgaccaacgctaacacgtcatctacccaggctgctcccgttgcagttaccactccaacagtttcttcaggccaagcaacacctacctcaccaattaaaaagttcccaacaacagcgacgaagatctcccctaaggaggaggagaggaaagatgaaagtcctgctacttggcgcctgggcttaagaaaaacaggctcttacggagccttggcggagatcaccgcatctaaggaggggcagaaggagaaagacaccgcaggggtcacacgaagcgccagctccccaagactgagttcaagcctggataataaggaaaaagaaaaagacagcaaaggcacacgtcttgcatatgtggcacctaccatccctcggcgtttggcgtctacttctgatatcgaggagaaggagaatagagattccagctctctaaggacttcttcatcctacactcggaggaaatgggaggacgatctgaagaaaaacagtagcgtgaacgagggctccacctatcataagagcacctccaatcggctatgggcagaggactccacagagaaggagaaggatagcgttccgaccgccgttacaatccccgttgcccctactgtggtcaacgccgctgcttccaccacgacgttaaccaccaccacagctggtactgtgagtagtaccacagaagtgcgggagaggcgccgttcttacctgactccagtgagggacgaagagagcgaaagtcagaggaaggcccgttcacggcaggccaggcaatcccggagatcgacgcaaggtgtgacattgaccgatctgcaggaagctgaaaaaacaattggacggtccaggtcaacgcgcacacgcgaacaagagaatgaggaaaaggaaaaagaagaaaaggagaagcaggacaaggaaaaacaggaggagaaaaaagagtccgaaacttctcgggaagacgagtataagcagaagtactcccgcacttatgatgaaacataccagcgatacagacctgtttcaacaagtagctcgacgacacctagttccagtctttccacaatgagctcgtcattgtatgctagttcgcagctaaaccgacccaattctctagtggggatcacttccgcctacagccgcggaattacaaaggagaacgaaagagagggcgaaaaacgggaggaggagaaggaaggcgaggataaatcccagcctaagtcaattcgtgagaggcgcaggcctcgggaaaaaaggcggagtacaggagtgtcattttggacccaggactccgacgaaaatgagcaggaacagcagagcgatacggaagagggtagcaacaaaaaggagacccaggtcaataccattaccttgtatgaaactagttcaacctccgctggagacagatacgattctctcctggggaggagtggcagctacagttatttagaggaacgtaaaccatattcctctcgcctggagaaagatgattcaactgactttaaaaagctctacgaacagattttggcagaaaatgaaaaactgaaagcccaacttcacgataccaatatggaacttactgacctcaagctgcaacttgagaaggccacccaacgacaggaacgctttgccgataggagtctcctagagatggagaagcgcgaacgtcgcgcactggagcgcaggatatctgagatggaagaagagttaaaaatgctgcctgatcttaaagctgacaatcaaagactcaaggatgaaaatggggcattaattagagtgataagcaagctttctaaatag

SEQ ID NO: 236892 - DNA, 2988 bp, Artificial Sequence
  Description of Artificial Sequence: Synthetic coding sequence
atgaagatggccgatgctaaacagaagcggaacgaacaattgaaaaggtggatcggttcagagactgacctcgagcctcccgtggtgaagcggcagaaaaccaaggtcaagtttgatgatggcgctgtattcctcgcagcctgctccagcggagataccgacgaggtactcaaactgctgcatagaggcgcagacataaattacgccaacgtcgacgggctcacggccctgcatcaagcttgcattgacgacaatgtcgacatggttaaatttctcgtcgaaaatggtgccaacatcaatcagcctgataacgagggatggattccactgcatgccgctgctagttgcggatacctggatatcgccgaattcttaatcggtcagggcgcacacgtcggagccgttaattcagaaggtgatacaccccttgatattgccgaggaggaggccatggaagaactcctgcagaacgaagtaaatcgtcagggcgtggatatcgaagccgcacggaaagaggaggagcgaataatgctccgagacgccaggcagtggctcaatagtggtcacatcaacgacgtgcgtcatgcaaaaagcggtggcacggccctgcacgtggccgcagctaagggttacaccgaggtactcaaactgcttatacaggctggatacgacgtcaatattaaagactacgacggatggactccgctccatgctgccgcacactgggggaaggaggaggcctgccgaattcttgtggataacctttgcgacatggaaatggttaacaaggtcggccagactgcgttcgatgtcgcagacgaagatatcctcggctacctagaagaactgcaaaaaaagcaaaatctgcttcactccgagaagagggataagaaaagtcccctgatcgaaagtacggctaacatggacaataatcagtctcaaaagacctttaagaataaggaaaccctgatcattgagccagagaagaatgcttcacgtattgagagcctggagcaagaaaaggttgatgaagaggaggagggcaagaaagatgagtcaagttgctctagcgaagaagacgaggaggacgactcagaatctgaagccgaaaccgataagacaaaaccgctagctagtgttacaaatgcgaacacttccagcacccaggccgcacctgttgccgtgaccactcctactgtgtcctctggccaggccacgcccacgtcccccataaagaagttccctaccactgcgaccaaaatcagccccaaagaggaggagcggaaagacgaaagccctgcgacttggcggcttgggctgcgaaaaacaggatcctacggggctttagcggagattacggctagtaaagaaggccagaaggaaaaggacacggcaggagtcacccgttctgctagcagccctaggctctctagcagtctggataataaagaaaaggagaaggattcaaagggcacgcggctggcttatgtggcaccaaccattccaagacgtcttgcaagtaccagtgatattgaagaaaaggagaatagggactctagctcacttcggactagctcttcctacaccaggcgcaaatgggaggatgacctcaaaaagaactcatccgtgaacgagggatccacttaccataaatcctgctctttcggaaggagacaggacgacttgattagcagcagcgtcccaagcactacttctacacccactgtaacctccgcggctggattgcagaaatcactcctatcgtctacatccaccacaactaagattacaacaggatcctcctcggcaggcacacaatctagcactagcaatcgcctgtgggcggaagatagtacagaaaaagagaaagatagtgtgccaacagcagtgacaattcctgtcgccccaaccgtggtgaacgcagcagcctccactacaacactgaccacgactacagccggtactgtgtccagtaccaccgaggtgagggagcggagacggtcatatttgacgcctgtgcgagatgaagagtcagaatcacagcgcaaagctcgctctcgccaggcccgtcagagtcgaagatcaacgcaaggagtcaccctcactgacctgcaggaggctgagaaaaccatcggccgttcccggtcaacaagaacccgggagcaggagaacgaggagaaggaaaaggaggaaaaggaaaaacaggataaggaaaaacaggaagagaaaaaggagagcgagaccagtagagaggatgaatacaaacaaaaatactctagaacctacgatgagacgtaccagagataccggcctgtaagcacatcatcaagcactactcccagtagttcactttctactatgagtagcagtctgtatgcaagcagccagctcaatcgccctaactcattagtgggtatcacatccgcctacagccgtgggattacaaaagagaatgagcgtgagggcgaaaagagagaggaagagaaagaaggagaggacaaatctcaacctaagtctattagagagcgcagacgacctagagagaaaaggagatccaccggagtgtccttctggactcaggatagcgacgaaaatgagcaggaacagcaatccgacaccgaagagggcagcaataaaaaagagacccaagtgaacaccattacactgtacgaaacgtccagtactagtgcaggcgacaggtatgacagtctgcttggccgatctggcagctacagttatctggaagaaagaaagccttactcttctcgcctcgagaaagacgatagcacagacttcaagaagcgacaggaacgctttgccgatcgctcacttctcgagatggagaagagagagcgacgtgctctggagcgtcggatttccgagatggaagaggagctcaaaatgcttcccgatcttaaagcggataatcagaggctaaaagacgagaacggagctctgattcgtgtaatctccaagttgtccaagtag

SEQ ID NO: 236893 - DNA, 2988 bp, Artificial Sequence
  Description of Artificial Sequence: Synthetic coding sequence
atgaaaatggccgacgccaaacagaagagaaatgagcagcttaagagatggatcgggtccgaaactgatctagagcctccggtggtcaagcgccagaagaccaaagtcaagttcgacgatggtgctgtcttccttgctgcctgctcatccggcgacacagatgaagtccttaagttgcttcaccggggagctgatatcaactatgctaacgtcgacggcctaaccgcgctccaccaagcatgtattgacgataatgtggacatggtgaaatttctagtcgagaacggggcaaatatcaaccagccagacaacgagggctggattccgctgcatgccgctgcctcctgtggctacctagatatcgccgaattcttgatcggccagggggctcatgtgggagcagttaactcagaaggagacaccccactggatatcgccgaggaggaggccatggaggaactccttcagaacgaagttaatagacagggagtggacatcgaggctgctagaaaggaggaagaaagaatcatgcttagggacgccaggcaatggctcaactccggccacatcaatgacgtgcgacatgctaaatcagggggtacggcactgcatgtagccgcagctaaggggtatactgaagtcctgaaacttctaattcaggctggttacgatgttaacatcaaagactatgatgggtggacaccgctccatgccgcagcccattggggcaaagaggaagcttgcagaatcctggtggataacttatgtgatatggaaatggtcaacaaggtcggacagacggctttcgatgtggcagacgaggatatcttggggtacctggaagaattacagaaaaaacagaacctgttgcattcagaaaagcgtgataaaaagagtcctctgatcgagtctacagccaacatggacaacaaccagagccagaagaccttcaagaataaggaaaccctgattattgaacctgaaaaaaatgcctctaggatcgagtcactggaacaggagaaggtagatgaggaggaggaaggcaaaaaggacgagagttcatgctccagtgaggaagacgaggaggatgatagcgagtccgaggcggagactgacaagaccaaacctcttgcctccgtcactaatgctaatacaagcagtacccaggcggctccagtggcggtaaccaccccaaccgtgtcatcaggccaggctaccccaactagcccaattaagaaatttcccaccacagctaccaagattagcccaaaagaggaagagcgcaaggacgaaagccctgccacctggcgcctgggactgcgcaaaacgggttcctacggtgctctggccgagatcaccgctagcaaggaagggcagaaagagaaggacaccgccggagtgacccgctccgccagctctcctagattgtcgagttctctcgacaacaaggagaaggagaaggactccaagggcacaaggctcgcctatgtggctccaaccatccctcggagactcgcctctacatccgacatagaagagaaagaaaaccgcgacagctcttcactacggacctcctcttcctacacaagaaggaagtgggaagatgatcttaagaagaacagttccgttaacgagggctcaacttaccataaaagctgcagcttcggacgcaggcaggatgacttgatctcttcgtccgtgccgtcgaccaccagcactcctactgttaccagtgcggctgggctgcagaagtccctgctttcatccaccagcacaacaaccaaaatcaccacgggcagcagtagcgctggcacacaaagttctacatcgaaccgcttgtgggctgaggattcaactgagaaagaaaaagacagcgtgccaacggccgttaccataccagtggcgccaacagtggtgaatgccgctgcctccaccacaacacttacaaccacaacggccggtacagtgtcttcaactaccgaagtgagagagcgacgcaggtcatacctgaccccagttcgagatgaagagtccgaatcgcagcgcaaagcacgcagtaggcaagctagacaaagccgtcggagtactcaaggagtcacactcaccgatctgcaggaagctgagaaaaccattgggagatcacgttcaactcgcaccagggagcaggagaacgaagagaaggagaaggaagagaaagagaaacaggataaagagaagcaggaagagaagaaggagtcagaaaccagcagggaagatgagtataaacagaaatatagtcggacctacgatgagacctaccaaaggtatcggcctgtgtccacaagctcatctacaacgccaagttcgtccctgtcaacaatgagcagtagcctttacgcgagtagtcagttgaatcgcccaaacagccttgtgggcattaccagtgcatacagccgtggaatcaccaaagaaaatgaaagggaaggcgagaaacgcgaagaggagaaggagggggaggacaagtcgcagccgaagagcataagagagagacgtaggcccagggagaaaaggaggtccacgggggtcagtttttggacacaggacagcgacgaaaatgaacaggaacagcagagcgataccgaagaagggagcaataagaaggagacccagacagacagcatttccaggtacgaaacgtccagcactagcgctggagaccggtatgacagcctcctcggcagaagtggttcatatagctaccttgaagagcgaaaaccttatagcagtagactggaaaaagatgattcgacagacttcaagaagagacaggagcgatttgctgacagaagcttactggaaatggaaaaacgagaaaggcgagcgttggagcgccgaatttccgagatggaagaagaactgaaaatgcttcctgatctcaaggcagacaatcaacgcctgaaagatgaaaatggggcattgattcgagtcatatctaagctgtctaaatag

SEQ ID NO: 236894 - DNA, 3093 bp, Artificial Sequence
  Description of Artificial Sequence: Synthetic coding sequence
atgaagatggccgatgccaaacagaagcgcaacgaacaactgaagcggtggatcgggagtgagacggacctggaacctcctgtagtcaagcgtcagaaaaccaaagtcaagttcgacgacggggcagtattcctggccgcttgctcgtctggagacactgatgaggtgctgaagttgctccatcgtggggctgatataaattacgctaacgtggatggactcaccgcattacaccaggcttgcatcgatgataatgtagatatggtgaaattcctggttgaaaatggcgcaaacatcaatcagccagataatgaggggtggattcccctacacgccgcagcctcttgcgggtacttggatatagccgaattcctaatcggccagggcgcacatgtgggagcggtgaactcagaaggagacacaccactggatatagcagaggaagaggccatggaggaactgctccagaatgaggtgaacaggcagggtgtcgatattgaagcagctcgaaaggaggaggagagaataatgttgcgcgacgctcggcagtggcttaactccggccacatcaacgacgttcgtcatgccaagagcggcggaaccgccctgcacgtggccgctgctaaagggtacactgaagtgcttaaacttttgattcaggcgggatatgatgtcaacatcaaagattatgatggttggaccccactgcacgctgcggctcactgggggaaagaagaagcttgtagaatcctggtcgataacttgtgcgatatggagatggtcaacaaagttggacagaccgcatttgatgtggcagatgaggacattctgggctatttagaggaactgcagaagaagcagaatcttttacatagtgagaaacgcgataagaaatcgccactgatcgaatccacagcaaatatggataacaatcagtcacagaaaaccttcaagaacaaggagactctcataatcgaacctgagaaaaacgcgtcgcgcattgaatcccttgaacaggaaaaggtcgatgaggaggaggaagggaagaaagacgaatcatcctgttcctcggaggaagacgaagaggacgatagcgagtctgaggccgagacagataaaacaaagccccttgcaagcgtcactaacgccaacacctcttctacccaggctgctccagtagccgttaccaccccaacggtgtcctccgggcaggcgactcccaccagccccataaagaaattcccaacaacagcaaccaagatttctccgaaagaagaggagcggaaagacgagtcaccggctacttggcgtctgggtctccggaaaaccggatcctacggcgctttggcagagataactgcaagcaaggaggggcaaaaggaaaaagataccgcgggagttacccgttccgcgagcagcccgagactttcatctagtctggataataaagagaaagagaaagacagtaaaggcaccagactggcatatgtggctcctactatcccacgcaggttagcttcaaccagtgacattgaggagaaggaaaacagagactcgtctagcctacggaccagttcctcttacaccagacgcaagtgggaagacgatttgaaaaagaactcgagtgtgaatgagggctctacctaccacaagagctgctcattcggcaggcgacaagacgatctgatttcctcctccgttccctccactacctctacccccacggtaacgtctgctgcaggacttcagaaatcactgttatcgagcacgtccacaacaaccaagatcaccacggggtcgtcctcagcaggtacgcagtcttcaacctccaataggctgtgggcagaagattccaccgagaaggaaaaggattcggttccgaccgccgtgaccatcccagtcgccccaactgttgtgaacgccgcagccagcactacgacgctgaccaccacgacagctggcacagtttccagcaccaccgaagtcagggaacgcaggcgctcttacctgaccccggtgcgggacgaagaatcagagagccagcgcaaagccaggtcccggcaggctcgccagtccagacggtcaactcagggggtcacactgaccgacctacaagaggccgagaaaactatcggacgatctaggtcaactagaacaagagaacaggagaacgaggagaaggagaaagaggagaaagaaaagcaagataaggagaaacaggaggaaaagaaggaatctgaaacttcccgggaagacgagtacaaacagaaatactcccgaacatacgacgaaacgtatcagcgctatcggcctgtgtccactagttcgtccactaccccaagcagcagcctatctactatgtcatcatccctgtacgcaagttcacagctgaacagaccaaatagcctggtggggataacttcagcctactccagagggatcacgaaggaaaatgaacgcgaaggggagaaaagagaagaggagaaagaaggggaggacaagagccagccaaagtctattcgggaacggaggcgtcctagggaaaagcgtagaagcacaggcgtaagcttttggacccaggattcagacgagaacgagcaggaacagcagtctgacacagaggagggctctaacaagaaagaaacacagacggactccatcagccgctacgagactagcagcacaagcgccggtgaccgttatgactcccttctgggaaggtcgggctcttattcctatttagaggagcgaaaaccctactcgagcaggttggaaaaggatgacagcactgactttaaaaaattgtatgaacagattcttgctgagaacgagaagctcaaggctcagttacacgacaccaatatggagctgactgatctaaaacttcagttagagaaggcaactcaacggcaggagaggttcgccgaccgctcactgcttgaaatggagaaacgagaaagacgggcactcgaacgccgaattagcgagatggaagaagagctaaaaatgttgcccgatctgaaagccgataatcagcggctaaaggatgagaacggagccctaattagagtcatcagtaaactttcaaagtag

SEQ ID NO: 236895 - DNA, 3093 bp, Artificial Sequence
  Description of Artificial Sequence: Synthetic coding sequence
atgaagatggcggatgcaaagcaaaagcgcaacgaacagttgaaaagatggatcggttccgagactgacttagagccacctgttgtgaagcgtcagaagacaaaagtgaagtttgatgatggagccgtgtttctcgctgcttgctcatccggtgataccgacgaagtattgaaactcttgcataggggggctgatatcaactatgccaacgtggatggcctaacagccctccatcaggcttgtattgatgacaatgtggatatggtgaagttcttggtggagaacggtgccaatattaaccagccagacaatgaaggttggatacctctccacgccgcagctagctgcggctatttagatatcgctgaatttttaattggacagggagctcacgttggagccgttaattctgagggggacacccccctagacattgctgaagaggaggctatggaagagctgctgcaaaacgaagtgaaccgacagggggtggacatagaggccgcaagaaaagaagaggaaagaattatgctgagagacgcgaggcagtggctgaatagtggccacatcaacgatgtgcgtcatgcgaagtctggaggcaccgccctacacgtcgccgctgctaagggctacacagaagtcctgaagctgctgatacaggccggatatgatgtcaatatcaaagattacgacgggtggaccccattgcatgcagctgcccactggggcaaggaagaagcatgtcgcatcctggtggataacttatgtgatatggagatggttaataaagtgggacagactgcgtttgacgtggcagacgaagacatactgggctacttagaggagttgcagaagaagcagaatcttctgcacagcgaaaagcgtgataaaaagagccctcttatcgagtccacagcgaacatggacaataatcaatctcagaagacatttaaaaataaggagacactgatcattgaacctgaaaagaacgcatctagaattgaaagtctggagcaagagaaggtcgacgaggaagaagaggggaagaaggatgagtcatcatgttcttccgaggaggacgaagaagacgactcagaaagcgaagcggagaccgataaaaccaaacccctcgccagtgtgactaatgccaacacatcaagtacccaggcagctcctgtagctgtgacaacaccaacggtctcctctggccaggccacccctacctcgcctatcaagaaatttccaacgacagcaacaaagatcagccccaaggaagaagaacggaaagatgaatctcctgcgacttggcgcctcggactaaggaagaccggatcatacggtgccctggcggagataacagcctcaaaggaggggcaaaaagaaaaggacacagcgggagtgacccggagcgcttcaagcccacggctttcttcctccttggataacaaggaaaaagagaaggacagtaagggaacacgactcgcctatgtggcacctactattccacgcagactcgcaagcacatcagacattgaagagaaggagaatcgcgattctagttcactgaggacctcaagctcatacacaaggcggaaatgggaagacgatctgaaaaagaatagttcagtaaacgaaggttcaacctatcacaagagctgcagctttggccgaaggcaggacgacctaatttccagctctgtaccctctaccacctcaacacccacggtgacatctgccgcagggctgcagaaaagcctgctgtcctcaacttccacgaccacgaagattacaacgggttcaagctctgctggaactcagagcagtacttccaaccggctgtgggcagaagacagcaccgagaaggaaaaggactccgtcccaacagccgttaccattcccgtcgctccaaccgttgtgaacgccgcagcatccacgacgaccctgacgacaaccactgccggaactgtgtctagcacaaccgaggtccgcgaacgcaggaggagttaccttacccctgtcagagacgaggagagcgaaagccagcggaaagccagaagtcggcaggctagacaatcccggaggagtacccaaggagtgaccctcaccgacctccaggaggccgagaaaactattggcaggagtagaagtacacggacccgcgagcaggagaacgaagaaaaagaaaaagaagaaaaggagaaacaagataaggagaagcaggaagagaagaaagagtcggagacttccagggaagatgaatataaacaaaagtattccaggacatatgacgagacgtaccaacgctatcggcctgtgagcaccagctccagtacaacccctagcagctctctgtcaactatgtcatccagcttgtatgcctctagtcagttgaatcgcccaaactcactggtaggcatcacaagcgcctattctagaggcattacaaaagagaacgaacgagaaggcgagaagcgggaggaggaaaaagaaggggaagacaagtcccagccgaaaagtatccgtgaaagaagacgccctcgcgagaaacgaagatcgactggtgtaagcttttggacccaagacagtgacgaaaatgaacaggagcagcagtcggatactgaggaaggatcaaataagaaagagactcaagttaacactatcacactgtacgagaccagttcaacgagcgccggtgatcggtatgatagcctactaggacgctctggctcgtattcctatctcgaggagcgtaaaccgtactcctcacgccttgagaaggatgatagcactgatttcaagaagctctacgagcagattttagctgagaatgagaagctgaaagctcagctacatgatacaaacatggagctcacagacctaaaattgcagctggagaaggctacacaacgccaggaacgcttcgctgacagatcactgctggagatggaaaaacgggaaagaagagccctcgagaggagaatctcagagatggaagaggagctcaaaatgcttcctgacctgaaagcagacaaccagaggctaaaggatgaaaacggtgctctcatacgggtcatttccaagcttagcaaatag

SEQ ID NO: 236896 - DNA, 2832 bp, Artificial Sequence
  Description of Artificial Sequence: Synthetic coding sequence
atggtcaagttcctcgtagagaatggggcaaacattaaccagccagataacgagggctggattcccctgcacgctgcagccagttgtgggtatctcgatatcgcagagttcttgatcggccaaggggcacacgtcggggctgttaactccgagggggatacacctctcgatattgcggaagaggaggccatggaagagttgctgcagaacgaggttaatcgacagggggtggatatcgaggccgcacgaaaagaggaagagaggataatgctcagggacgctaggcagtggcttaattccggacatatcaatgatgtcaggcacgctaaatctgggggtaccgcccttcacgtagccgcagctaaggggtatactgaggttctgaagctcttaatccaggcaggatacgacgtgaacataaaggattacgacggttggacacccttacatgctgccgctcactggggtaaggaagaggcatgccgaattctcgttgataacctgtgtgacatggaaatggtaaataaggttggtcaaacagctttcgacgtcgctgatgaagacattctgggctacctggaggaacttcagaagaagcagaatctcctgcattctgaaaaacgcgataagaagtctccgctcattgagagcacagccaacatggacaataatcagtcacaaaaaacattcaaaaacaaggaaaccctgatcattgagccagagaagaatgcctctcggatcgaatccttagagcaggagaaggtggacgaagaagaagagggcaagaaggatgagagcagttgcagcagcgaggaggatgaggaggatgacagcgaaagtgaagcagagacagataaaactaaacccctcgcgtctgttaccaatgctaacacttcaagcactcaggccgctcccgttgcggtcaccaccccgacggtcagtagtgggcaggcgaccccaactagccctattaagaaatttccgactaccgctacaaagattagcccaaaggaggaagagcggaaagatgaaagccccgcaacttggcggctgggcttgaggaaaacagggtcctacggcgctctggctgaaatcactgccagcaaggagggacagaaggaaaaagacaccgccggagtcactaggagcgcttcatcgccacgcctgagtagcagcttggataacaaggagaaggaaaaagacagcaagggaacacgcttagcctacgttgccccaactatcccacggagactggccagcacgtccgatattgaggaaaaagagaatagggattcctcatccctgagaacatcctctagttacaccaggcggaagtgggaggatgatctgaaaaagaattcctccgttaatgaagggagcacttatcataaaagctgcagctttgggcgtaggcaggacgacctcatcagctccagcgtcccctctactacctcaacaccaacggtgacatcggccgcaggattgcagaagagcctcttaagttccacaagcactaccacaaagatcactaccgggagcagcagcgccggaactcagagctctactagtaatcgcctctgggccgaggattctacagaaaaggaaaaggacagtgtgcccacagccgtgaccattcccgtggcaccaacggtggtaaacgcagcagctagcacgacaacacttaccactactaccgccggaaccgtctcttccacgaccgaggttcgggaacggcgacggagctatttaacacctgtacgggacgaagaatccgagtctcagcgtaaggccaggtcgaggcaggctcgtcagagtcgacgtagcactcagggcgttacactaaccgatctgcaagaagccgagaagacaattgggagatcacggtcaactcgcactcgtgaacaggaaaacgaagagaaggagaaagaggaaaaggaaaagcaggataaggagaaacaggaagagaaaaaagaatcggaaacaagccgggaggacgagtacaagcagaaatactcccgtacctacgacgaaacgtatcagagatacagaccagtaagtacaagttcctcaactactccttctagcagtctgtcaacaatgagctccagcctgtacgcaagctcacagttgaatagacctaatagcctagtgggcatcacatccgcttactcacggggtattaccaaggagaatgagcgagagggagagaaaagagaggaggagaaagaaggagaggacaaatcacagccaaaatccatccgagagaggcgcagaccaagggaaaagcgaaggtcaaccggcgtgtctttttggactcaagattctgatgagaatgaacaggagcagcaatctgacacagaagaggggtcgaataaaaaggaaacgcaaacagatagtattagccgttacgagaccagtagtacaagtgcaggcgatagatacgactccctgttggggcgatcgggatcctactcctacctggaagaaagaaagccatactcctctcgactggagaaggatgattcaacagatttcaaaaagctatacgaacagattttggctgagaacgaaaaactgaaggcccagttacatgacacaaacatggaattgactgacctcaagcttcagcttgaaaaagctacccagcgtcaagaaaggtttgcggaccgctctctcttagagatggagaaacgagaaaggagggcgctagagagaagaatcagtgagatggaagaagaattaaagatgttaccagatcttaaagccgacaatcagcgacttaaggatgaaaacggggcacttatcagggtaattagcaagctgtccaagtag

SEQ ID NO: 236897 - DNA, 2925 bp, Artificial Sequence
  Description of Artificial Sequence: Synthetic coding sequence
atgaagatggcagatgccaaacaaaaacggaacgagcagttgaagagatggatcggcagcgagaccgacctggagccccctgtggtcaaaaggcagaaaacaaaggtgaagttcgacgatggtgcagtgttcctggccgcatgctcgtccggagacacagacgaggtgctcaaactgctccaccggggtgcagacatcaactatgccaacgttgatggccttaccgctctgcatcaggcctgtatcgatgataatgtggacatggttaagtttctggttgagaatggcgctaacatcaaccaacctgacaacgaggggtggatcccactccatgcggcagcctcctgtggatacctggatatagctgaattcttaattggccagggcgcacacgttggggcagtgaactctgagggagatacccctctggatattgccgaggaggaagctatggaagaactgttgcagaacgaagtaaataggcagggcgtggacatagaagctgctcgtaaggaggaggaacggatcatgcttcgggatgccaggcagtggctcaatagcggtcacattaacgacgtccgccatgccaagtctggaggaaccgcactccacgtggctgccgctaaaggatatacggaagtgcttaagctgctaatccaggcagggtacgacgtcaatataaaagactacgacgggtggaccccccttcatgccgctgcccattggggtaaggaagaggcctgtcggatcttagtagataacttgtgtgatatggaaatggtcaacaaggtaggccagactgcctttgacgtcgctgacgaagacattctgggctatctggaggagctgcagaaaaagcagaacctccttcacagcgagaagcgcgataaaaaaagtccactgattgagagcacggctaacatggataataatcagtcccaaaagacattcaaaaacaaagagacattaatcattgagcccgaaaaaaacgcaagccgtatcgagtctctggagcaggagaaagtagacgaagaagaggaaggcaagaaggacgaatccagttgctcttcagaagaggatgaagaagacgattcagagtctgaagcagaaactgataaaaccaaacctctggcttccgtaacaaacgccaacacaagttcaactcaggccgctccagttgccgtgactactccaacagtttctagtggccaagctacccccacatcccccatcaagaagtttcctacgaccgccacgaagattagtcctaaagaagaagagaggaaagatgagtcccccgctacatggagacttggtcttcgaaagacagggtcctacggcgcactcgctgaaatcactgctagcaaagaagggcagaaggagaaagacaccgcaggggttacccgcagcgccagcagccctcgactttcatcatctttggataataaagagaaagagaaggacagtaagggcacacggctagcctatgtggcccctacaatcccccgacgtctggcctcaacatctgacatcgaagagaaagaaaatcgggactcctccagccttcggacgtcttcatcctatacgcgcaggaagtgggaggacgatctgaagaaaaatagcagcgtgaatgaaggaagcacctaccacaagtcgacgtctaacaggttatgggctgaggacagcaccgaaaaagaaaaagattccgtccccaccgcggtaaccattcccgtggcaccgactgtcgtgaacgccgcagcatccacaactacattaactaccacaactgccggaaccgtgagcagcacaaccgaagtccgcgagcgccgacgctcctacctgacccctgttagggacgaagagagcgagtcccaacggaaggccagatctaggcaagcccgacaatccaggcgaagtacgcagggggtaaccctgactgatctgcaggaggcggagaaaacaattggacgctcccgatccaccagaactagagaacaggagaacgaagaaaaagagaaggaggaaaaggaaaagcaggacaaggaaaaacaggaggagaagaaagagagcgagaccagccgagaggatgaatataaacagaagtactcccggacttatgatgagacataccagcggtaccgcccagtgtctacaagtagttccacgacccccagttcctctcttagtaccatgagctcgagcctgtatgccagcagccagctcaataggccaaactccctcgtaggaatcacctccgcatacagtagaggcattactaaagagaatgaacgggaaggggaaaagagggaggaggaaaaggaaggggaggacaagagtcagcctaaatctattagggaacgacggaggccgcgagagaagaggaggtctactggtgtttcattctggacccaggatagcgacgagaatgagcaggagcaacagagcgatacagaggaaggttccaacaagaaggaaacccagaccgactccattagccggtacgagacttcaagtacttctgccggtgataggtatgacagtctgctcgggcgatctggcagttatagctacctcgaagagagaaagccttactcctcccgcttagagaaggatgactctacggatttcaagaaactgtatgagcagatccttgcggagaatgaaaagctgaaagctcaactacacgatactaatatggagcttactgatctaaaactccaactggagaaagcaactcagagacaggaacggttcgcagataggtcactgttggaaatggagaaaagggagcgcagagccttagagaggaggatctctgagatggaggaggaactgaagatgctcccagacttaaaggccgacaaccagcgactcaaggatgagaacggcgctttgatcagagtgattagcaaactgagtaagtag

SEQ ID NO: 236898 - DNA, 2949 bp, Artificial Sequence
  Description of Artificial Sequence: Synthetic coding sequence
atggctgaactggagcatttgggtggaaaacgggctgagtccgccagaatgcgcagagccgaacagttacggagatggaggggtagtctgaccgagcaggaacctgcggagcgtaggggagccggtcggcagccactgactcgcagaggtagccccagagtgcgattcgaagacggggcagtcttccttgctgcatgcagctccggcgacacagatgaggtgaggaaactgctcgccaggggtgccgatattaatactgtgaacgtggatggtttgacggctttgcaccaggcttgtatagacgaaaaccttgatatggtcaagttcctagtggaaaaccgggcaaatgtgaaccagcaagataatgagggatggactcctctgcatgcagccgcatcctgtggatatcttaatatcgcagagtactttataaaccacggcgcatcggttggtatcgtgaactctgaaggggaggtcccatcagatcttgctgaggaacccgctatgaaagaccttcttttagagcaagtgaaaaagcagggtgtcgatctcgagcaaagcagaaaggaggaggagcagcagatgctgcaagacgcacggcaatggctgaattccggcaagatcgaagacgttcggcaagccaggagcggagccaccgctctgcacgtggctgctgcgaaaggatattccgaagtcctacgcctgctgatccaggcagggtacgaattgaacgttcaggactatgatgggtggacacctttgcacgccgcagcacactggggggtgaaagaggcttgctccatcctggctgaagctctgtgtgacatggacatcagaaacaagttgggccaaactcctttcgatgtcgcggatgaaggcttggtggagcatcttgagctattgcaaaaaaagcagaatgttctacgtagcgagaaggaaacgcgcaataagcttatagagtcggacctgaatagcaagatacaatcaggattcttcaaaaacaaggagaagatgctatatgaggaagaaacgccaaagtcccaagagatggaagaagagaacaaagaatcatcctctagtagtagcgaagaggaagagggtgaggatgaggccagtgaaagcgaaaccgagaaagaggcagataaaaagccagaagcatttgtgaatcactctaattcagaatccaaaagcagcatcaccgagcagattcctgctccagcacagaacacattctctgcgtcaagtgctcgccgatttagcagtggtttattcaacaaaccggaggaacccaaggatgagtctccaagttcttggaggctgggcctgcgcaagacaggttctcacaacatgctgagcgaagtagccaattcccgcgaaccaatccgggaccggggtagctccatataccgttccagttcctctccgagaatttctgctctgctggataacaaggataaggagagagagaataagtcatatatcagttccctggccccacggaaactgaatagtacctctgacatcgaggagaaggagaacagggagagtgccgttaacttagtgcggtcgggcagctacacgagacagctctggcgcgatgaggccaagggaaacgaaatcccccagaccattgctccatccacctatgtctccacctatctgaagaggacccctcataaaagtcaagctgacaccaccgctgagaagacggccgataacgtcagcagctcaactcctctgtgcgtgatcaccaacagaccacttcctagcacggctaatggagtcacggccacaccagttctctctataaccggaactgatagctctgttgaagctcgggaaaagagacggagctacctgacaccagtaagggacgaagaggccgaaagtctgcgtaaggcgcgttccagacaggccagacaaacccgaaggtccactcagggcgtcactctgaccgacttacaggaagcagagcggacctttagcagatccagagccgagaggcaggctcaggaacagcctagggagaaacctacagacacagaaggtttagagggatcccctgagaagcatgaaccttctgctgtgcctgctacagaggccggagaaggccagcagccatggggaaggagcctggatgaagaacccatttgtcaccggttaagatgtcccgctcagcctgacaaacccacaacgcctgcatctccatctacctcccgacccagcctttacactagtagtcatctgctctggaccaataggttcagcgtccctgatagcgagagtagcgaaaccacaacaaatactaccacggccaaggagatggataagaatgagaatgaagaagctgaccttgatgagcaatccagcaagcggctgagtattcgggaacgaagaagaccaaaggaaagacgcaggggtacaggcataaatttctggacaaaggatgaggacgaaaccgatggatccgaggaagtgaaggaaacctgggctgagaggttgaagagattggagagtggaggtagcaatccaactacctccgatagttacggggacagagcaagcgccagggccaggagagaggccagggaagctaggctggccactctgacctcacgtgtcgaggaggattcaaacagagattacaaaaaattgtacgaatccgctttaacagaaaaccagaagctaaaaacgaaactgcaggaggctcaactcgaactggctgacattaagagcaagctcgagaaagtggctcagcagaaacaggaaaaaacttctgatagatcttctgttcttgaaatggaaaaacgcgaaaggagggccctggagaggaagatgtctgaaatggaggaggaaatgaaggtcctgactgaattaaagtcggacaaccagcgcttaaaggatgagaatggtgccctgatcagagttatctccaagttgtcaaaatag

SEQ ID NO: 236899 - DNA, 1161 bp, Artificial Sequence
  Description of Artificial Sequence: Synthetic coding sequence
atggctgaacttgaacacctagggggaaagcgggctgaaagcgctcggatgagacgagccgaacagctgcgcaggtggagaggaagcctgaccgaacaagagcccgcagagcgcagaggagctgggagacagcctcttacaaggcgtggcagcccaagggtacggtttgaagatggggcagtgtttctcgctgcatgctctagcggcgatactgatgaggtcaggaagctcttggctcgcggagctgatattaataccgtgaatgttgacggcctgactgctctgcaccaggcatgcattgatgaaaatctggatatggtcaagttcctggtagagaaccgcgctaatgtcaatcagcaggacaacgagggttggacacctctgcacgcagctgccagttgtgggtatcttaacattgcagaatactttattaatcatggcgcaagcgtgggcattgtaaattccgagggcgaagtccccagtgatcttgccgaagaaccggctatgaaggacctgttactggagcaagtgaaaaagcagggagtggacttagagcagtcacgcaaggaggaggaacagcaaatgctccaggacgctcggcaatggctgaatagtggcaaaatcgaggacgtgcgccaggcccgaagcggcgcaacggccctgcatgttgcagctgccaaaggatactctgaggtgctccggcttctcatccaggccggttatgagttgaacgttcaggactatgatgggtggacacctctgcatgctgctgcacattggggcgtaaaagaagcctgctccatccttgccgaagcgctctgcgatatggatataaggaacaagcttggccagacaccatttgacgtcgccgacgagggcctcgtggaacatctggagctcctgcagaagaagcagaacgttctgaggtcagagaaggagacgcgcaacaagttgatagagtctgacctcaattcaaagattcagtctggtttcttcaagaataaagagaaaatgttgtacgaagaggaaaccccgaagagccaggagatggaagaggagaataaagagtcttctagctcttccagcgaggaggaagaaggcgaagatgaggcaagcgaatccgagactgagaaggaggcagtgctcttttggcccttttag

SEQ ID NO: 236900 - DNA, 675 bp, Artificial Sequence
  Description of Artificial Sequence: Synthetic coding sequence
atggacaagaatgaaaatgaagaggcagacttggatgaacaaagttccaagcggttaagcataagggaaagacggcgtcccaaagagaggagacggggaactggcatcaacttctggacaaaggatgaggatgaaacggacgggagcgaggaggtgaaggaaacctggcacgaacgactgagtcgattagagtctggaggctccaaccctacaacatctgattcttatggggacagggcgagtgctagagcgcgtagggaggcccgtgaagcccgactggctacacttacatcccgcgtggaagaagatagcaaccgcgattacaaaaagctgtacgagagcgccttgactgaaaaccagaaattgaaaactaaactgcaggaggctcaactggaacttgccgacattaaaagcaagctggagaaggttgcacagcaaaagcaggaaaagacatctgatcggagttctgttctcgagatggagaagagggaacgtagagcgctggagcggaagatgagcgagatggaggaggagatgaagaatttgcatcagcttaaacagatccagacgctgaaacagatgaacgagcagctgcaagctgaaaaccgggcattgacccgcgtggtggctaggctgtccgagagtatcgagtcctccgacacccaggagctttag

SEQ ID NO: 236901 - DNA, 627 bp, Artificial Sequence
  Description of Artificial Sequence: Synthetic coding sequence
atggacaagaacgaaaatgaggaggccgacttggacgaacaatcctctaaaaggttaagcatccgggagcggagacgccctaaagagcgccgtcggggaaccggcattaatttttggaccaaagacgaggacgaaaccgacggttcagaagaagtaaaggaaacgtggcatgagcggctgagccgactagaatcggggggaagcaatcctacaacctccgacagttacggagaccgggcaagtgctcgtgccaggcgggaagctcgcgaggcaaggttggccactttaactagccgagttgaagaagactccaacagagattataaaaagctgtacgaatctgccctaactgaaaatcaaaaactcaagacaaagttacaagaagctcaattagaactcgccgacatcaagtccaagctggagaaggtggcacagcagaaacaggagaaaacttccgaccgtagcagcgtgctggagatggagaagcgggagcggcgtgcactggagaggaaaatgagcgagatggaggaagaaatgaaagtattaaccgaattgaagagtgataaccagcggctgaaagatgagaatggggctcttattcgggttataagtaagctgagcaagtag

SEQ ID NO: 236902 - DNA, 2949 bp, Artificial Sequence
  Description of Artificial Sequence: Synthetic coding sequence
atggctgagctggaacatttggggggaaaacgagcagagagcgccaggatgaggagggccgagcagctgcgtaggtggaggggatctctgaccgagcaagaaccagctgaacgccgtggagcaggcaggcaacccctgacaagacgaggcagtccacgcgtccgcttcgaagacggcgcagtgtttctggctgcatgttcatcaggagataccgatgaagtgaggaagctcctggctaggggcgcagacatcaacacagtgaacgtcgatggcctcacggcgctgcatcaggcttgcatagatgaaaacctagatatggtgaagtttctcgtagagaaccgggctaatgtcaatcagcaagacaacgagggctggacccccctccatgcagcagcctcatgtggataccttaacattgccgagtattttattaaccacggcgcttccgttgggatagtaaattccgaaggggaagtccctagcgacctcgccgaagaaccagctatgaaagaccttctattggagcaggtgaagaagcagggcgtagacctggagcagtccaggaaggaggaggagcagcagatgcttcaggacgctcggcagtggctgaactctggaaagatagaggacgtgcgacaggcaagatcaggcgcaactgcccttcatgtcgcggctgccaagggttactccgaggtgctgcggctgctgatccaggccggatacgagctgaacgtccaggactacgacggatggaccccactgcatgccgctgcccactggggagtcaaggaagcttgcagcattttggctgaagcactttgcgatatggacatccgcaacaagctcgggcaaacaccgtttgatgttgctgatgagggtctcgtcgagcatctggagctactgcagaaaaaacagaatgtgcttaggtcggagaaagagactcggaataagttgattgagtctgacctgaattctaagatccaaagtggattcttcaaaaacaaggagaagatgctatacgaggaggagacacccaaatcccaggaaatggaagaagagaacaaagagtcctccagtagctcttcggaagaagaggaaggcgaagatgaggcctctgagtccgaaacggagaaagaggcagataaaaaacccgaagcctttgtcaaccatagtaactccgagagtaagagcagcatcactgagcaaatcccagcccctgctcagaataccttttcagcctcttcggctagacgcttttcgtcgggtttgtttaataagccagaagaaccaaaggatgaatccccgagctcatggcgccttggacttcgaaaaacggggagccacaatatgctctccgaggtagctaactctcgcgagcccattcgagaccggggatcttctatctatcgcagctcttcatctccacgcatcagcgccctgctcgacaataaggataaggaaagagaaaacaaatcctatatctctagtctcgcaccaaggaaactcaacagtacttctgatattgaggaaaaggagaaccgggaatctgctgtgaacttggtgaggtctgggtcatacactaggcagctttggcgtgatgaagcaaaggggaacgagattccccagacaatcgcacctagcacctatgtttccacctaccttaaaagaactccccataagtcgcaggctgacaccacagcggagaaaaccgccgacaatgtgtcatcctctacccccctctgcgtcataaccaacagaccgctcccctcgactgcaaacggcgttacagccacaccagttctttctattaccggaaccgacagcagcgttgaggctcgcgaaaaacgtcgcagctacctgactccagtgcgcgatgaagaggcagagtccctgcgtaaggcgcgaagccggcaggccaggcagacaagacgcagtacccaaggtgttactctgaccgacttacaggaggctgagcgcacctttagtcgctccagggcagaacggcaagcacaagagcaaccacgcgaaaaaccgacggatacggaaggcctggagggctcccccgagaaacacgaacctagtgcggtcccagcgactgaggcaggtgagggccaacagccctggggccgatcactcgatgaagaacccatctgtcatagactaagatgccccgctcagccagataagcccactacccctgcttccccctctacctcccgcccttccctatacacttctagtcatttgttatggaccaatagattcagtgtgcccgacagcgagtcatccgaaaccacgactaataccactacggctaaggagatggacaaaaatgagaatgaggaagccgatctagatgagcagagctccaagcgcctgagtattagggaacggagaaggcccaaggagcggagacgaggaaccggaatcaacttttggaccaaggatgaagatgaaacagacggttccgaagaggtgaaggaaacctggcatgagagattaagccgattggaatcaggagggtctaatccaacaacctcggatagttacggggaccgtgcctctgcgagagctagaagggaagctagagaggcgaggctggctaccctgacatctcgcgtggaggaagactccaatagggattacaaaaagctgtacgaatctgcactaacggaaaaccagaaattgaagaccaagctccaggaggctcagctcgagcttgcagacattaaaagtaaactggaaaaagtggcccagcaaaaacaggagaaaacgagcgatcgaagcagcgtcctggaaatggagaaacgggaacggcgagctttagagcgcaaaatgtctgagatggaggaggaaatgaaggtgctgaccgagctgaagtccgacaatcagaggctgaaagacgaaaatggcgcattgatccgggtgataagtaagctgtcaaagtag

SEQ ID NO: 236903 - DNA, 2349 bp, Artificial Sequence
  Description of Artificial Sequence: Synthetic coding sequence
atgtccggagaggacggtcccgcagccggacctggggcagctgccgctgcagctcgggagagacgaagggaacaacttcggcaatggggcgctcgagccggtgccgagcctggaccaggcgagaggcgggcacggacagttcgctttgaaagagcagccgagttcttggcggcttgtgccggtggtgatttagatgaagcacggctgatgctccgggcagcagacccaggcccaggagcagaactagatcctgcagccccaccccctgctcgagcagttcttgacagcacgaatgcagatgggataagcgcccttcatcaggcttgcattgacgaaaatctcgaggtagtgaggtttcttgtggaacaaggtgctaccgtcaatcaggcagacaatgaaggctggaccccgttgcacgttgccgcttcatgcggctatctagatattgctagatatttgctgtctcatggtgcaaatatagctgctgtgaactctgacggcgacctccctttagatctagccgagtctgacgccatggaaggcctgttgaaagcggaaatcgccagacgtggggttgatgtggaggcagccaagcgcgctgaggaggaactgttgctgcacgacacaaggtgttggctgaacggtggcgcaatgcctgaggcgagacatcctaggaccggggcatctgccctgcatgtcgccgcagccaaaggatacatagaggtcatgaggctactactccaggccggttatgatcccgaactccgagacggcgatggctggacgccactgcacgccgcagctcactggggtgttgaagatgcctgtaggctgctggccgagcatgggggtggcatggattctctgactcatgcaggccagcgcccatgtgatcttgccgacgaggaagtattatcccttcttgaggagttggcccgaaaacaggaggacctccggaatcagaaggaagccagccagtcccgtggtcaggagccacaggctccttcctctagcaagcatcgccgaagctcagtatgcagactgtcatcaagggaaaagatctctctgcaggatctttctaaggaacggagacctggcggtgccggtggcccacccattcaggacgaggacgagggcgaggaaggcccaactgaacctcccccagccgagccacgaactcttaacggagtttcctccccgcctcatccctcacccaaatcccccgtccaactcgaggaggcccctttctcgaggcggttcggtctccttaagacaggcagcagcggggctctcgggccacctgagcgcaggacggccgaaggggctcctggtgccggacttcagagaagcgcatccagctcgtggttggaggggacctccacccaagccaaggaactcaggctggctcgcattaccccaactccttccccgaagttacctgagcccagcgtgcttagcgaggtgaccaagcctcctccgtgcctggaaaattcatcaccaccaagcaggattcccgaaccagaatctcctgccaaacccaatgtgccaaccgcctccaccgcccctccagccgactctagggatcggcgtcgctcctaccagatgcccgttagagatgaggagtcagagtctcagagaaaagccaggtccaggttaatgcggcagtcaaggcgcagcactcagggagtcacactcacggacctgaaggaggcagagaaggctgccggaaaggcacctgagtccgagaaacccgcacagtcactggatccttctaggagaccacgcgtcccaggtgttgagaattccgattcacctgcccagcgcgcagaggcgccagatgggcagggtcctggaccccaggccgctcgggagcaccgcaaagttgggaaggaatggagagggccagcagaaggcgaagaagccgagcccgcagacaggagccaggagagctccacccttgagggaggcccatccgccagacgccagagatggcagcgagacctgaaccccgagcctgaacccgagtcagaggagccagacggaggctttcggacgctgtatgctgaacttcgccgtgagaacgaacgcctccgcgaggctctgactgaaacaactcttcgccttgcccagctcaaagtggagctagagagggccacacagcggcaggagagattcgccgaaaggcctgctttactggaactggaacgatttgagcggagagcactggaaagaaaagctgcagagctggaggaagaattgaaagccttatcggatctgcgcgcagacaaccagcgcttaaaggacgagaatgcagcgctgattagagtgatttcgaaactctcaaagtag

SEQ ID NO: 236904 - DNA, 2160 bp, Artificial Sequence
  Description of Artificial Sequence: Synthetic coding sequence
atgagcggcgaggacggccctgcagccggacctggagctgcagcggctgctgcgcgtgagagacggagggagcagctcaggcagtggggggcaagagcgggagccgagccgggtcctggggagcgtcgggcaagaaccgtccggttcgaacgcgctgcggaatttctagcggcttgcgctggaggagatctggacgaagcccgtcttatgttgcgggctgccgatcctgggcctggagctgagctggatcctgctgcgcctccccctgctcgggcagttctcgacagcaccaatgctgacggcatttctgctttgcatcaggcctgtatcgatgagaacctcgaagtcgttagatttttggttgaacaaggcgcaacagtcaaccaggctgacaatgaagggtggactccactgcatgtcgcagcttcctgcggatatctcgatatagcacggtacctgctgagccacggtgccaatattgccgctgtgaattccgatggagatcttccgctggatctggcagaatccgacgctatggaggggctgctaaaagcggagatcgccagaagaggcgtggacgtggaggccgcaaaacgagctgaggaagagttgttgctacacgatacccgctgttggctcaacgggggagctatgcccgaagcgcgtcatccgcgaacaggggcttcagctttacatgtggcagctgccaaggggtacatcgaggttatgcggcttctcttacaggcagggtatgatcccgaactcagggacggcgacggttggacccccctacacgccgcagcccactggggggtggaggacgcatgcaggctgctggcggaacatggcggaggaatggacagcctcactcatgccggacagaggccttgtgacctggcagacgaagaggtgctgtctctcttggaggagcttgctagaaaacaggaagacttacgtaaccagaaggaggccagccagtcacgcggacaagagccacaggccccatccagctcgaagcaccggcgatctagcgtgtgtagactcagctcccgcgagaagatttccctacaggatctgagcaaggaaaggagacctggtggagccggaggtccccctatccaggacgaggatgagggagaagaaggcccaactgagcctcctccagcggagcccagaaccctcaacggagtctccagccccccacatccctccccgaagagccccgtgcagttggaggaggcccctttctcaagacgcttcggcctgctcaaaactggcagcagtggggctctgggccctcccgaacgtcggaccgcagagggagccccaggagctggcctgcagaggagtgcttcttcctcatggctggaaggtacatcgacccaggcaaaggagttgcgtttggcccgaattactcccactcccagcccgaagctccctgaaccaagtgtgttgtctgaggtcacaaagccccctccctgcctggagaactcgagtcccccttccagaatccccgagccagagtctcctgcaaaaccgaacgttccaacagcctcgaccgctccccctgctgattcgcgtgatcgcagaaggtcataccagatgccggtgagagacgaagagtctgaatcacaacgaaaggctcggtcccgcctgatgcgccagtcccgtaggtccacacagggggtgacgctgacggacctgaaagaggctgagaaggccggtgaggaagctgagcccgcagaccggtcccaggaaagcagcacactagagggcggtccaagcgccagacgccagaggtggcagagagatttaaatccggaaccagagcccgagagcgaagagcctgatggagggtttaggaccttatacgctgagctgagacgggagaacgagcggttacgcgaagctctgaccgagactacactgcggttagctcagttaaaggttgagttggagcgagccacgcagcgtcaggagcggttcgccgaacgcccagccctgcttgaactggagaggtttgagagacgagcactagagcgcaaggccgcagagctggaggaggagctgaaggctctgagcgacctgagagccgataaccagagactaaaagacgagaatgctgccctgattcgagtgatttccaaactttccaaatag

SEQ ID NO: 236905 - DNA, 2124 bp, Artificial Sequence
  Description of Artificial Sequence: Synthetic coding sequence
atgcggaatgggggtccctgtcagccactcgccgcagggcctcgcgctgagggggcaagcgtgaactggagcgtaaccgcttggggtccaggcacacaggcctgcatcgacgagaatctcgaggtggtgaggtttttagtcgagcagggtgctacagttaatcaagccgataatgaaggatggacacccctgcacgtcgctgctagctgtggctacttagatatcgccaggtatctgctgtcacacggcgcaaatattgccgctgtgaacagcgacggtgacctcccactggacctggctgaatctgatgcaatggagggcctgctcaaagcggaaattgccagaagaggggtggatgtcgaggccgctaagagagccgaagaggagctcttacttcacgacacccggtgctggctcaacggcggtgccatgccagaagctagacatcccagaaccggagccagtgctttgcacgtggccgctgccaagggttatatcgaggttatgcgcctgctgctgcaggctggatatgaccctgaactgcgcgatggagatggctggaccccgcttcacgccgcagcgcactggggagttgaggacgcttgccggctgctggctgaacatgggggtggcatggactcactcacccatgccggtcagaggccttgcgacttggccgacgaggaggtgctctccctgctcgaggagcttgcgagaaaacaggaggatctgcgcaaccagaaagaagcatctcagtcaagaggccaggagcctcaggcaccctcttccagtaaacatagaaggtcctcagtgtgtagacttagttcccgagagaagattagtttacaggacctgagtaaggaacggcgacctggaggcgctggcggtccccctatccaggacgaagacgaaggcgaggaggggcctacggagccaccacctgctgaacctcgcacccttaatggggtttcctcaccccctcacccttcaccgaaatcaccagtacaactggaggaagctccattctccagacgctttggcttgttaaagaccggaagctcaggtgcactgggacccccagaaagacgcacagcggagggggcacctggggctggtctccagagaagcgcctcctcaagctggttagaaggcacatctactcaggccaaagaattgcggctcgcacgcattacgccgacccccagtccgaaactgccagaaccttccgtcttgagtgaggtgacgaagccccctccttgcctcgagaacagtagcccaccctcccggattcccgaacctgagagcccagctaagcccaatgttcccactgcttctactgcccctcctgcagactccagagacaggcggaggtcgtaccagatgccagtgcgggacgaagaatcggagtcacagcgtaaggcaaggtcacgcctaatgagacagagccgcagaagtacacagggagtaacactgacagatctgaaggaggccgaaaaagctgccggtaaagcccctgagtcagaaaaacccgcacagtccttagatcctagccggcgtcctcgggtgcctggagttgagaattcagacagtccggcacaaagggaggcacctgacggccagggtcctggccctcaggccgctagagaacacagaaaagtaggtaaggagtggcgaggacctgcagaaggcgaggaggctgagcctgccgacagatcccaggagtcctctaccctggagggtgggccatccgcccgaaggcagaggtggcagagggatttgaacccagagcctgaaccagagtctgaagagcccgacggaggtttcaggactctgtatgccgaacttcggagagagaacgaaagactacgggaagctctgaccgagacaaccctcagactggcccagctgaaggtagaacttgagagagcaacgcagcgccaggaacgattcgccgagagaccagccctgttggaacttgagagatttgaaaggcgggctctcgaaaggaaagccgctgagcttgaggaggaacttaaagcgctcagtgacctgcgagcggataatcagcgcctgaaagacgaaaatgctgctctgattcgggtaatctctaagctgtcgaaatag

SEQ ID NO: 236906 - DNA, 2142 bp, Artificial Sequence
  Description of Artificial Sequence: Synthetic coding sequence
atggagcccggaacaggagggagtcgcaagagactcggccctagggccggtttccggttttggcctcctttcttccccagaaggagtcaggcaggttcgtctaaatttccgactcctttaggccctgagaacagcggtaatcctacccttctgtccagcgcccagccagagaccagagtcagctactggaccaagctgctgtcccagctgctggccccactgccagggcttctacaaaaagtactgatatggtcccagctgtttgggggaatgttcccaaccaggtggctggatttcgccggagtgtattctgccctccgggcactcaagggacgggagaaacccgcagcacctaccgctcagaaatccctctcatccctgcagctggatagtagcgacccatccgtaacctcacctctcgactggctggaggagggaatccattggcagtattctccccctgaccttaagctagagctaaaagccaagggaagcgccctcgacccagcggctcaagcttttttgctggaacagcaactatggggggttgaactactgccctcctctctgcaatctagactctattcaaacagagagctgggatccagtccaagcggccctctcaatattcagcgcatagataactttagcgtcgtgtcatacctgcttaatcccagctacctcgactgcttccccaggctggaggttagttaccagaattccgacgggaatagcgaggtggttgggttccagactttgactcccgagagtagttgcctgcgcgaagaccattgtcatcctcaacctctcagcgcagaactcataccagcaagctggcaaggctgccccccactctcaaccgagggccttccagaaatccatcacctgagaatgaagagattggagttcctacagcaggcaaataaggggcaggacttgcctacccccgatcaagacaatggttatcattcactggaagaggagcacagtctgcttaggatggaccctaagcattgtcgcgataacccaacacagtttgtacccgctgccggagacataccgggaaatactcaagagagcacagaagagaaaatcgagctgctaactaccgaagtgcccctcgcactggaagaagaatccccttcagagggatgcccaagcagtgagatacccatggagaaggagcctggagagggccgtatcagtgtggtagattacagttacctcgagggggatcttcccattagcgctagacccgcatgtagtaataagctaattgattacattcttggaggtgccagcagcgatctagaaacgtcttctgacccagagggtgaagattgggacgaagaagccgaggacgatggctttgattctgactcatctctcagcgacagtgacctggagcaggatcctgaaggcctacatctttggaattccttctgttccgtggatccttacaaccctcagaatttcaccgcaactatccaaaccgccgctcggatcgtcccggaggaaccaagtgacagcgaaaaggatctgtccggaaagagcgacctggaaaattcctctcagtctgggtccctgccggagactcctgaacactcatccggtgaggaggacgactgggagtcgtcagccgacgaggcggagtccctgaagctgtggaattctttttgcaatagcgacgatccatataaccctctgaactttaaggccccatttcagaccagcggcgagaatgagaaaggctgccgtgattccaaaaccccctccgaatccatcgttgctattagtgaatgccatactttgctctcctgcaaagtgcagttgctaggatcccaggaatccgagtgccccgacagtgtccagcgggacgtactgagcggcggtagacacacccacgtcaaacgcaaaaaggtaacttttctggaggaggtgacagagtattacatctctggcgacgaagacagaaaggggccatgggaggagtttgcaagagacggctgtaggttccaaaagcggattcaggagaccgaggatgccatcggctactgtcttacattcgagcacagagaaagaatgttcaaccgacttcaagggacttgctttaaggggcttaatgtgttgaaacagtgctag

SEQ ID NO: 236907 - DNA, 1872 bp, Artificial Sequence
  Description of Artificial Sequence: Synthetic coding sequence
atgttccctactcgatggctagatttcgccggagtgtactctgcccttagggcactcaaggggcgagaaaagcctgctgccccaactgcccagaagtctctttcctctctgcaactggattctagcgacccttcagtgacttcaccgctcgattggctggaggaaggcattcactggcagtattctcctcccgatctgaaactcgagctaaaggcgaagggatccgccctggaccctgcagcacaggcatttctcttagaacagcagttgtggggtgtggagctgctcccaagttcgttacaatctaggctgtatagcaatcgggagctcgggagttctccttcgggtcccctgaacattcagaggatagataatttttcagtggtgtcttatttgttgaacccgagctatctggactgttttccaaggttggaagtctcatatcagaattcggatggtaacagcgaagttgttggctttcaaacactgacccctgaaagtagctgtctgagggaggatcactgccatccccagcctttatcggcagaactaatcccagcttcttggcagggatgtcctccactgtccactgagggactgcctgaaattcaccatctccgcatgaagcgcctcgagtttctccagcaagccaataaaggacaggacctgcccacacctgaccaggataatggctatcacagcctcgaggaagagcattccctcttaagaatggatccaaagcactgccgagataaccccacacagttcgtccctgccgctggcgacataccaggaaacacccaagagagtaccgaggagaagatagaactcctcacaacagaagtacccctggctttagaggaagagtcccctagtgagggatgtccctcttccgagatcccaatggagaaagagcctggcgaggggcgaatctcagtagtcgattactcatacttagagggcgatcttccaatttctgcacgccctgcatgcagcaataaattgatagattatattctggggggagccagctcggacttggagacatcatcagatccagagggtgaagactgggacgaagaggctgaagatgacggcttcgatagtgattcttcgctgagcgatagtgaccttgagcaggatccagagggactgcatctgtggaactcattttgcagcgtcgatccgtacaacccacaaaactttaccgctacaattcagaccgcagcacgtattgttcccgaagagccctctgattccgagaaagacctgagtggaaaatcagatctggagaactcctcacagagcggctctctcccagagacccccgaacatagtagcggtgaggaggatgactgggagtcatcagccgatgaggccgaatctctcaaactttggaattcattttgtaatagcgacgacccttacaatcccctgaacttcaaggctcccttccagactagcggagagaatgaaaaaggatgccgggactcgaagacgccatccgagtccattgtggctatttccgagtgccacacactattgtcatgcaaggtgcagttgttaggaagccaagaatcagaatgccctgactctgtgcagcgcgacgtgctgagcgggggaagacatacccacgttaaaagaaagaaggtgactttcctagaagaagtgaccgaatattatatcagtggcgacgaggacagaaaagggccttgggaggagttcgccagagatggctgccgctttcagaaacgcatacaggaaaccgaagatgcaatcggctattgcctaaccttcgaacacagagagcgcatgttcaatcgcctccagggtacctgttttaagggcctgaatgtccttaagcagtgttag

SEQ ID NO: 236908 - DNA, 1704 bp, Artificial Sequence
  Description of Artificial Sequence: Synthetic coding sequence
atggcgtctcatgtcgatctgctgactgaactgcagctgctggaaaaagttcccacacttgagcgtctccgtgctgcgcagaagaggagagcccaacagctgaagaagtgggctcaatacgagcaggatctccaacaccggaagcgaaaacacgagagaaagaggtcaacgggaggccgtaggaaaaaggtgagctttgaggcatcagtagccctgctagaagcttccttgcgaaatgacgcagaggaggtaagatacttcctgaaaaataaggtgtcacctgatctttgcaatgaagatggtcttacggctctgcaccagtgctgtatagataacttcgaggaaatagtgaagttgctactgtcacatggtgctaacgtcaacgccaaagacaatgagttatggacccctcttcacgctgctgccacttgcggacacattaacctggtgaagattctcgtccagtacggagccgaccttctcgctgtgaactccgacgggaacatgccttacgatctgtgtgaagatgagcccacactagacgtgatcgaaacctgtatggcttatcagggaattacacaggaaaaaataaacgagatgagggtagccccagagcagcagatgatagctgatatccactgtatgattgccgcagggcaggatcttgactggattgatgcccagggcgctactctgctgcacatagcaggagccaacgggtatctacgggcagccgaacttctgcttgaccacggggtgagagtagatgtgaaagactgggacggctgggagcccctacacgccgctgccttctgggggcaaatgcagatggctgaactgcttgtgagtcatggtgctagcctgtctgctaggacatcgatggacgagatgcctatagatctgtgcgaggaggaggagtttaaagtcctcctgctagaactgaagcacaagcacgatgtgatcatgaaatctcagctgaggcataaatcgtccctcagccgcaggactagctccgctgggtctcgaggcaaggtagttagacgtgcatctctgtctgatagaacgaatctttatcggaaggagtatgagggcgaggctatcctctggcagagaagtgccgcagaggatcagcggacttctacttacaatggggatattcgtgaaacccgcacagatcaggaaaacaaagatcccaacccacgtctggaaaagccagtgctgctcagcgagtttcctaccaaaattccacgcggtgagctggacatgccggtggagaacggcttgcgcgctcctgtcagtgcctaccaatacgccctagctaacggcgatgtctggaaagtgcatgaagtgccagactactctatggcctacgggaatcctggggtggccgacgctacgccaccttggtcctcttacaaagaacagtcgccccagacactgttggagctgaaacggcagcgggcagcagctaagctactttcccaccccttcctaagcacccatttggggagctcaatggcccgaactggtgagagctcctcggaaggaaaggcccctctgattggaggtcgtacatctccttattcttctaatggtactagcgtctactataccgtcacgtctggcgatcctccgttgctgaaattcaaagctcctatagaggagatggaggaaaaggtccacggttgctgccggatctcctag

SEQ ID NO: 236909 - DNA, 1578 bp, Artificial Sequence
  Description of Artificial Sequence: Synthetic coding sequence
atggcaagccacgtagaccttctgaccgagttgcaactgctcgaaaaggtgcctactttagaaaggctccgcgcagcccagaagcgccgagcccagcagctgaaaaagtgggcccagtacgagcaggatctgcagcataggaagcgcaagcacgaacgtaagcggtctactggcggtcgaaggaaaaaggtcagcttcgaggcatcggtcgcgctcttagaggcatcactgagaaatgacgccgaggaagtgcgttattttttgaagaataaggtcagtccggacctgtgcaacgaggatgggctgactgccttacaccaatgttgcattgacaattttgaggagatcgtcaagctgctcctgagccatggagcgaatgtgaacgcaaaggacaacgaactgtggacaccactccatgcagcagcgacgtgcggccatatcaatctggttaagatcctcgttcaatatggtgcagacctcctggccgtgaactcggacggtaatatgccctacgacctttgcgaggacgagccaaccctcgatgtcattgagacctgcatggcctaccagggcattacccaggagaagattaatgagatgcgggtggcccctgagcaacagatgattgccgatatccattgtatgatagctgccggacaagatttagattggattgacgcacagggtgcaacactgatgcagatggccgagctgctggtgagccatggcgcttctctttcagcacgaacgagcatggacgaaatgccgatcgacttatgtgaggaagaggagttcaaagtgctccttttagagctaaagcataaacacgatgtgatcatgaaaagtcaactgaggcacaagtctagtctttcccgacgcacgagttcagcaggaagcagaggaaaagtggtgcggagggcatcactctccgaccggactaacttgtacagaaaagagtacgagggagaagcaattctgtggcagcgctcagctgccgaggaccagcgaacatccacctacaacggtgacattagagagacaagaactgatcaggagaacaaagaccccaatcccagattggagaagcctgtactattaagtgagttcccgaccaagattccgcgtggagaattagacatgcccgtagaaaacggactgcgtgccccagtaagcgcatatcagtacgctctcgccaacggtgatgtctggaaggttcacgaagtgccagactactctatggcttatggaaatccgggtgttgcggacgcaacccctccatggtccagttataaagagcaaagcccccagacactcctggagctgaagagacaaagagctgctgcaaagctgctcagccatccctttcttagtacgcatctcggctcatcaatggccaggaccggcgagagtagctctgagggcaaagctccccttatagggggacgcacaagtccatattcgtccaacggaacatcagtttattataccgtgaccagcggggaccccccactgctgaagttcaaggcacccatcgaagagatggaggaaaaggtgcacggctgttgccgcatcagctag

SEQ ID NO: 236910 - DNA, 3369 bp, Artificial Sequence
  Description of Artificial Sequence: Synthetic coding sequence
atggagcctagcgaggtgccgtcacagattagcaaggataacttcctagaggtgcccaacctttccgactccctgtgcgaggatgaagaagtgacatttcagccgggtttcagcccacaaccttccagacgcggttccgattcttccgaggatatatatctggacacgccctctagcggtacccgccgagtgtcgtttgcagattcttttggttttaacctggtatccgtcaaggagttcgactgttgggagcttccatctgccagcacaacttttgaccttggaacggatatattccacactgaggagtatgttctggctccactttttgatctgccctcctctaaggaagatctgatgcagcagttacagattcagaaggctattctggaatccaccgagtccctgttgggctcaacgtcgattaagggtattataagggtgcttaacgtgtcattcgaaaagctcgtatatgttcgcatgagcctggacgactggcagacccattacgatatcctggctgaatatgtccccaacagttgcgacggagagacagaccagtttagttttaaaattgtgttggtccctccatatcaaaaggacgggtccaaggttgagttttgtattcgctacgaaacatccgttggcaccttctggtcaaacaacaacggaaccaattacacattcatttgccagaagaaagagcaagagcctgagcccgtaaaaccatggaaggaagtcccaaaccgacaaatcaaaggatgccttaaggtgaagagctcaaaagaggagtcctctgtcacttcggaggaaaacaactttgaaaatccaaagaacacagacacctacattccaacaatcatttgcagccacgaagacaaggaggatctcgaagccagtaaccgcaatgtgaaggatgtgaacagggagcacgacgagcacaatgaaaaggagttagagctgatgattaatcagcaccttattcggacgcgcagcacagctagtagagatgagcgcaataccttttctaccgatcctgtcaacttccccaacaaggccgaggggctggaaaaaaaacagatccatggtgaaatctgcacggacctctttcagagaagtttaagtccctcatcaagtgctgagtccagtgttaaaggagacttttactgcaatgagaaatattctagtggggacgactgcacccaccagccttccgaggagactacctctaacatgggggaaataaagccaagtctgggcgacacaagctccgatgagcttgtgcaactgcacacgggctcgaaggaagtgctcgatgacaacgccaatcctgctcatgggaatggcacagtacagataccttgccctagttcagatcagcttatggccggaaacctcaacaagaagcatgaaggaggggcaaaaaacatcgaagtcaaggaccttggctgtctgcggagagatttccacagtgatacctccgcttgcctaaaggaaagcacagaggagggcagttcaaaagaagattactatggaaatggcaaggatgatgaagagcagcggatctatctaggggtgaatgagaaacagcggaaaaacttccagaccatcctgcatgatcaggagaggaaaatggggaatccaaaaatatcagtcgccggaataggggcttcaaatcgggatcttgctacccttctgagcgagcacactgctatccccactcgggcaataacggccgatgtctcgcactcgccccgaaccaacctctcatgggaagaagccgtgttaacacccgaacatcaccacctcactagcgaggggagcgccctgggtggcataacggggcaggtctgtagctctcgtacaggaaacgtccttcgcaatgattaccttttccaggttgaagagaagtccgggggtatcaacagtgaggatcaggacaattcaccccagcacaaacagagttggaatgtgctggaaagccagggcaagtctagggaaaataagactaatataaccgaacatattaaaggccagaccgattgcgaggatgtctgggggaagcgggataacacgagatctctgaaagccactaccgaggagttgtttacctgccaggagactgtctgctgtgaacttagcagcctcgctgaccatgggattacagagaaagccgaggccggtacagcatatattattaagaccacctccgaaagcactcctgaaagtatgtcagctcgagaaaaggccatcatcgcaaagcttccccaagagaccgcacgctccgacaggccgatcgaggtcaaggaaaccgcctttgatcctcatgagggacggaacgacgatagccactacaccctctgccagagggacaccgtgggggtcatatacgacaacgactttgaaaaagaatcgcgcctcggcatttgcaacgtgagggttgatgagatggaaaaggaggagactatgtctatgtataatccacggaagactcacgacagagagaaatgtggcaccggaaatatcaccagtgtcgaggaatcgtcttgggtaatcaccgagtatcagaaggctaccagcaagctggatctgcagttagggatgttgcccacggataagaccgtcttctcagagaaccgggaccttcgtcaggtccaggagcttagtaaaaaaactgattcagacgccatagtgcattccgcattcaacagcgacaccaaccgagctccgcagaacagcagccccttctctaagcaccatactgaaattagcgtgagcacaaacgaacaggctatagcggtggagaacgcggtgaccacaatggcaagccagcccattagtactaagagcgagaatatatgcaacagcacgcgagagatccagggaattgaaaaacacccttacccagagtcgaaacccgaagaggtatccagatcatctggcatcgtgacttctgggagtagaaaagaaaggtgcatcggccaaatattccagacggaagaatactcggtagagaagtcactggggcctatgatcctcataaataagcccctggaaaacatggaagaagccagacacgaaaacgaggggctcgtttctagtggccagtccctttatacttcgggcgaaaaagaatccgactccagtgcaagcacatccctgcctgtggaggaaagccaggcgcagggtaacgagtctttgttttccaaatatacaaactccaaaattccctacttcttactcttcctgatcttcttgataacagtgtatcattacgacctcatgatcggattgactttttacgttctgtccctctcatggctgtcatgggaagaagggaggcaaaaggaaagtgtgaaaaaaaaatag

SEQ ID NO: 236911 - DNA, 954 bp, Artificial Sequence
  Description of Artificial Sequence: Synthetic coding sequence
atgtcttgtacacgcatgatccaggttttggaccctaggcctttaacctcatcagtgatgcctgtggacgttgcgatgaggctatgtctggcgcacagcccgcctgtgaagtcatttttaggtccctatgatgaattccagagacgacatttcgtgaataaactcaagccactgaagagctgtctgaatataaagcataaagccaagagccagaacgattggaaatgtagccataatcaggcgaagaagcgagtggtgttcgccgattccaagggtttgagcctcacggctatccacgtgtttagtgacctgcccgaagagcctgcctgggacttgcaatttgatctgctggacttaaacgatatttctagcgccctaaagcaccacgaggaaaagaatctgatcttggactttcctcagccgagcactgattacctctcttttcgaagtcacttccagaaaaatttcgtctgtctggagaattgctcattgcaggagaggacggtgacaggaaccgtgaaagtgaagaatgtgtcattcgaaaagaaagtgcagatacgcattacatttgactcttggaaaaactacacagacgtcgactgtgtgtacatgaaaaatgtttatgggggaactgacagcgatacgttctcatttgccattgatctgccaccggtgatacctaccgagcaaaagatcgaattctgtatatcgtaccatgccaacgggcaggtcttctgggataataacgatggacagaattataggattgtccatgttcaatggaaacccgacggggtccagactcagatggctccccaagattgcgcgtttcaccagacatcaccaaagactgaactagaatcgactattttcggctcacccaggctggcctctggcctgtttcccgagtggcaatcctggggccgtatggagaatcttgccagttacaggtag

SEQ ID NO: 236912 - DNA, 894 bp, Artificial Sequence
  Description of Artificial Sequence: Synthetic coding sequence
atgtcctgtaccagaatgatacaagtgttggatcctcgccctcttaccagtagcgttatgccagtggatgtggcaatgcgcctgtgtctcgcacactccccccctgtgaagtcctttctaggaccttacgacgagttccagcgcaggcactttgtcaacaagctgaagcccctgaaatcctgtctgaatattaaacataaggcaaaatcccagaacgactggaagtgtagccataaccaggctaagaagagggtcgtgttcgcagatagcaagggcctgtctttgacagccattcatgtcttctccgacctgcctgaagagccagcttgggacctgcaattcgacctgctagacttgaacgatatttcttccgccctgagttttcgatctcattttcaaaagaacttcgtctgtctggagaactgttctctgcaggagcgaaccgtgactggcaccgtgaaagtcaaaaacgtgtccttcgaaaaaaaagtgcagatcagaatcacattcgattcatggaagaactacaccgacgttgactgcgtatatatgaagaacgtgtacggcggaacggactccgacaccttttcttttgccatagatctgcctcccgtgattccaactgagcaaaagatcgaattttgcatttcctaccatgcgaatggccaagtgttctgggacaacaacgatggacagaactatcgaatcgtccacgtgcagtggaagccagatggtgtgcaaactcagatggcccctcaggattgtgcatttcatcagaccagtcccaagaccgaattggaatccacaatctttggctcccccaggcttgcgtcaggactgtttcctgagtggcagtcctggggacgcatggagaaccttgcgagctataggtag

SEQ ID NO: 236913 - DNA, 600 bp, Artificial Sequence
  Description of Artificial Sequence: Synthetic coding sequence
atgagcagtcctactagccccctcaaacatcacgaggaaaagaatctgatactggactttccacaaccctcgacagattatttgtcgttcagaagtcacttccaaaagaactttgtgtgcctagagaactgtagccttcaggaaaggaccgttacagggactgttaaggtgaagaacgtgagttttgagaaaaaggtccaaattcggataacatttgattcatggaaaaactatacagatgtcgattgtgtttacatgaagaacgtgtacggagggacagactcagacacattctcatttgcaatcgatctgccacccgttattcctacagagcagaaaattgaattctgtatcagctatcacgctaacggacaagtgttctgggataacaacgacgggcagaactatagaatcgtgcatgttcagtggaaacccgacggggtgcagacccaaatggccccacaagactgcgcctttcatcaaaccagtccaaaaaccgagttggagtctactatctttggatcacctagactggcatctggattattcccagaatggcaaagctgggggaggatggaaaacctggccagctatcgatag

SEQ ID NO: 236914 - DNA, 900 bp, Artificial Sequence
  Description of Artificial Sequence: Synthetic coding sequence
atgagtcggggaccctctagcgctgtactgccctccgctctggggtctcgtaaattaggcccaagatcactcagctgcctaagtgatttggatgggggagtggcacttgagccaagggcctgcaggccccctgggagtcctgggagggctccacctcctacacccgcaccctcggggtgtgatccacgcttgagaccaattatcctgcggagagcccgatcattaccctcctcacctgagcgtcgtcagaaagctgctggggctccgggtgctgcctgcaggccaggctgctcccaaaagctgagggtgcgcttcgccgacgctctcggtctggagctcgcacaggtgaaggtgtttaacgccggagatgatccaagcgtgccactgcacgtgctgtctaggctggctatcaactcagacctatgttgttcctctcaggatctggagttcaccttgcactgcctggtgcccgactttccccctcctgttgaggccgctgactttggagaaaggctgcaaaggcagttggtctgtttggaacgagtcacatgttcagacctgggtattagtggcaccgtgagagtgtgtaacgtcgccttcgagaaacaggtggcggtcagatacactttctctggctggcgctccacccatgaagcagtggcgaggtggcgcggtcccgcaggccctgaaggaacagaagacgtctttacgttcggatttcctgtgcccccatttttacttgagctcggaagccgcgtccattttgccgtcaggtatcaggtcgcaggcgctgagtattgggataacaatgatcatcgggattatagcctcacctgcagaaaccatgctctccacatgccacgcggtgagtgcgaggagagctggatccacttcatttag

SEQ ID NO: 236915 - DNA, 756 bp, Artificial Sequence
  Description of Artificial Sequence: Synthetic coding sequence
atgacaagacttacagtattggcactgttggccggtctgttagcaagctcaagggctgggagtagtcccttgctggacatagtaggtggcaggaaggctcgccctcgccagttcccatttctagcttctattcagaaccagggaaggcatttttgtggtggagctctgattcatgctcggtttgtaatgaccgccgctagttgcttccagagccagaatcccggagtgtccactgtagtcctcggcgcatatgatctgcggagacgcgaacggcagtctcgacagacgttcagcatcagcagcatgtcggagaatggatacgacccacagcaaaatctgaatgacctgatgctgctgcagctggatcgagaggctaatctgactagcagtgtgaccattctgcctctcccactgcagaatgcaacagtggaggctggcacaagatgccaagtggccggatggggatcccagcgctccggcggtagacttagtcgcttcccgagattcgtcaacgtaacagttacccccgaagatcagtgccgtcctaataatgtgtgcacaggtgtgttaactagaagaggaggcatctgtaatggcgacggtggcactcctttggtgtgcgaaggcctagcacacggcgtagcgagtttttctctgggaccctgtgggcgaggcccagacttcttcacccgggtagctttatttagagattggatagacggtgtcctgaacaaccctggtcctggccctgcttag

SEQ ID NO: 236916 - DNA, 954 bp, Artificial Sequence
  Description of Artificial Sequence: Synthetic coding sequence
atggctgccgagcggggagctggccaacagcagtcccaggagatgatggaggaggagcacgaactgcccgttgatatggaaaccattaatttggatcgggacgccgaggacgtggatctgaaccactacagaattggtaaaatcgagggattcgaggtgttgaaaaaagtaaaaacgctgtgtctgaggcagaatctgatcaagtgcatcgaaaatctggaggaattgcagtcactgcgggagcttgatctgtacgataaccagatcaaaaagatcgagaacctggaagcattgactgagctggagatcctcgacattagcttcaacctcctgcgaaatatcgagggggtcgacaagctcacacggctgaagaagttgttcctggtcaacaacaagattagcaagatcgaaaatctttctaatctacatcagctgcaaatgctggagctggggtccaatcgcattagggccatcgagaatatcgacaccctgactaacttggagagcttgtttctgggaaagaataaaatcacaaagctgcagaacttggacgccctaaccaacctgaccgtgctgagcatgcagagtaacagactcacaaagattgaaggattacaaaacctggttaacttaagggaactgtatctgtctcataatggtattgaggttatcgaaggcctcgagaataataacaagctgaccatgctggatatagcctctaatcgtataaagaaaatcgagaacatctctcacctgaccgaacttcaagaattttggatgaacgataacctcctggaatcttggtcagatctggacgaactgaagggcgctagatctttggaaaccgtgtacctggagcggaaccctttacagaaagatccgcaataccggaggaaggtaatgctggccttgccttccgtcaggcaaattgatgccacgttcgtcaggttctag

SEQ ID NO: 236917 - DNA, 714 bp, Artificial Sequence
  Description of Artificial Sequence: Synthetic coding sequence
atggccgcagagaggggtgctggccagcagcagtctcaggagatgatggaggaagaacatgagctaccagtggacatggaaacaatcaacctggacagagacgcagaagatgttgacttgaatcactacaggatcggtaagattgagggttttgaagtgctcaaaaaggtcaaaactctgtgcctgcggcagaatctcattaaatgtattgaaaatttggaggaactgcagtccctccgcgagcttgacctctatgacaaccagattaagaaaattgaaaacctagaagctctgactgaactggaaattctggatatcagtttcaatctgctgagaaacatagagggggtagacaaattaacgcgcttgaagaagctgttcctggtaaacaataaaatcagcaagatcgagaacttgagtaacctgcaccaattacaaatgctcgagctgggcagtaacagaataagagccattgagaatattgataccttgaccaatttagagtccttgttccttggcaaaaacaaaatcaccaaactgcaaaaccttgatgccctcaccaacctgacagtgttgtccatgcaatcaaatcgacttaccaaaatagaggggttgcagaatttggtgaatttgcgcgagttatacctctctcacaacggcattgaggtcatcgagggccttgagaataatgtccaggacagcctgacctattag

SEQ ID NO: 236918 - DNA, 843 bp, Artificial Sequence
  Description of Artificial Sequence: Synthetic coding sequence
atggctgcagaaagaggtgcgggtcagcaacaaagtcaggagatgatggaagtggacagacgagttgagagcgaggaatcaggtgatgaggaaggtaaaaaacactctagtggaattgtggccgacctctccgaacagtctttaaaggatggcgaggaacgcggagaagaagatcctgaagaggaacacgagcttcctgtggatatggaaacgattaatctagacagagacgctgaagacgttgacctaaaccattaccgcatcggcaagatcgaaggttttgaagtgctgaagaaagtcaagacactctgcttgagacagaatctcatcaagtgcatcgaaaatctggaggagctgcagtcactcagagagctggacctttatgataatcaaatcaaaaagatcgagaacctggaagccctcacagagctggaaattctggatatctcatttaaccttctgagaaacatcgagggcgtcgataagctgactaggctcaaaaagctgtttctggtgaataacaaaatatctaagattgaaaacttgagtaatctgcaccagctacagatgctggagttaggctccaatcgcattcgagccattgagaatatcgacactttgaccaatctcgagtcactgttcctcggcaagaacaagatcaccaagctgcagaatctggacgccctcacaaacctgaccgtcctttcgatgcagagcaataggctaacaaaaatagagggcttgcagaatctggtgaacttgcgggaactatacctctcccataacggaatagaggtgatcgagggccttgaaaacaacgtccaggattcgctcacatattag

SEQ ID NO: 236919 - DNA, 1083 bp, Artificial Sequence
  Description of Artificial Sequence: Synthetic coding sequence
atggccgcagagcgtggtgcaggccaacaacagtctcaagaaatgatggaagtggaccgtagggtggaatcagaggagagtggcgacgaagaaggcaagaagcatagttcaggcatcgtggcggacctttccgagcagtctctgaaagacggtgaagaacgtggagaggaggaccccgaggaggagcacgagctgcctgtggatatggaaacaatcaacctggacagggatgcagaggatgtggacctgaaccactatcggattgggaagatcgaagggttcgaggtgcttaagaaggtgaagaccttatgcctacggcagaatctgattaagtgtatagagaatcttgaggaactgcagagcctgcgagaattggacctgtacgacaatcagatcaagaagatcgagaacctagaagccctgaccgagcttgaaatcctcgatatcagcttcaatctccttcggaatatcgagggcgtagacaagttaacccgcctcaaaaaactgtttctggttaataacaagatttccaaaatcgagaacctcagtaatttacatcaacttcagatgctggaacttggttctaatagaatccgagccatcgagaatatcgacacactgactaacctagagagtctcttcctcggtaaaaacaagattactaagctgcagaatctggatgccttgacgaacctgaccgtgttaagcatgcaatccaaccgcttaactaaaatcgagggtctgcaaaatttggtgaacctgcgagagctgtacctcagccacaatggaatcgaagtgatcgaggggttggaaaacaataataaattgactatgctcgatattgctagtaataggattaaaaaaatcgaaaatatctcgcacctgacagagctgcaggaattttggatgaacgataacttgctggaaagctggtccgatctggatgagcttaagggggcacgctcacttgagacagtttacctggagcgaaacccgcttcagaaggatccccagtatcgacgcaaagtcatgctcgccctgccctcagtgaggcagattgatgcgacctttgtcaggttctag

SEQ ID NO: 236920 - DNA, 384 bp, Artificial Sequence
  Description of Artificial Sequence: Synthetic coding sequence
atggtgcaaacagcagtggtgccagtcaagaagaaacgggtcgaagggcctgggagcttagggctggaggaatctggatcccggaggatgcaaaatttcgctttctctgggggactttacggcggactgccccctacgcactcagaggccggttctcagccccacgggatccatggcacagccttgattggaggcctgcctatgccgtaccccaatctggcgcctgacgtcgacctgaccccggtagtcccaagcgccgtcaacatgaatcctgctcctaatcccgcagtctataatccggaagctgtgaatgagccaaagaaaaagaagtatgcgaaagaagcgtggccaggcaaaaaacctacaccatcattgctgatctag

SEQ ID NO: 236921 - DNA, 1056 bp, Artificial Sequence
  Description of Artificial Sequence: Synthetic coding sequence
atggccgcagccgctaattccggcagcagtcttccacttttcgactgccccacttgggccggtaaaccacctcccggattgcacctggatgttgtcaagggggataaactcatagaaaaactaattattgacgaaaaaaagtactacctattcggacggaatcccgatttgtgtgattttaccattgaccatcagtcatgctcacgagtgcatgccgctctggtctatcataaacatcttaagagagtgtttctcattgatctgaattctacacacggcacctttctaggtcatatccgtctggagccccataaaccccagcagatccctatagacagtacagtgagcttcggggcttctaccagggcctataccttgcgagaaaaaccacagaccctaccatccgcagtcaaaggggacgagaagatggggggtgaagacgatgagttgaagggactacttggccttcccgaagaagagacggaactcgacaatcttaccgaattcaataccgcacataacaaacggattagtaccctcaccattgaggaaggaaatctggatattcaacgccctaagcggaaaagaaaaaactcccgggttacattctcagaagacgatgaaataattaatcctgaggacgttgatccatctgtcggtaggtttcgaaacatggttcagaccgctgtcgtgcctgtgaagaagaagagagtggagggtcctggctctctcggactggaagagtctggctcaagaagaatgcagaattttgccttttcgggagggctgtatgggggtctgcccccaactcacagcgaggctggaagccagccgcatggtatccatggtaccgcactgattggcggactgcctatgccttatccgaatctggccccagatgtagacttgacacccgttgtcccttctgcggtgaatatgaatcctgcccctaatcctgctgtttacaaccccgaggcggttaatgagcccaagaagaagaagtatgccaaggaggcttggcctggtaaaaagcccaccccttcgctccttatctag

SEQ ID NO: 236922 - DNA, 630 bp, Artificial Sequence
  Description of Artificial Sequence: Synthetic coding sequence
atgggcggtgaggacgatgagctgaaggggctcctaggtctgccagaggaggaaacagaactggacaatctgacggaatttaacactgcacacaataagcgaatctcaacactgaccatcgaagagggtaatctggacatccagcgtccaaagcggaagcgcaagaattctagggtgacattttccgaagatgatgagatcataaatcccgaggatgtggacccaagtgtgggacgattccgaaacatggtgcagaccgccgtggtcccggtgaaaaaaaagagagtggagggcccaggatctttaggtctggaagagtccggatcccgaagaatgcagaatttcgcctttagtggagggctgtacggtgggctgccacctacccattctgaagctggctctcagccccatggtatacacgggaccgctctaatcgggggattaccaatgccctaccccaacctggcaccggatgtagacttgacgccagtggtgccaagtgcagtaaatatgaaccctgcgcctaatcccgctgtttacaacccagaggctgttaacgagccaaagaagaagaaatatgccaaggaagcttggcccggaaagaagcctacccctagcttgctgatctag

SEQ ID NO: 236923 - DNA, 711 bp, Artificial Sequence
  Description of Artificial Sequence: Synthetic coding sequence
atgggtggcgaggatgacgaactgaagggcctactggggctgccagaagaagaaactgaactggataatttgacagaattcaatactgctcacaacaaacgcatcagcacgctgactatcgaagaaggtaaccttgatattcaaagacctaagcggaaacggaaaaactcacgtgttaccttctccgaggatgatgagatcattaacccagaagacgtcgatccttctgtgggtagattcagaaacatggtgcagactgccgtggtccccgttaagaagaaacgggtggaaggacctggttctcttggactggaggagagcggttcccgcaggatgcaaaattttgcctttagcggtggtctctatggagggctaccccctactcattccgaggccggatctcaacctcatgggatccacggcaccgccttaataggcggactcccgatgccctacccgaaccttgcccctgacgtcgaccttacgcccgtggttccctcagctgtgaacatgaatccagctcctaaccctgcagtgtacaatccggaagcggttaatgaaccaaaaaagaaaaagtatgcaaaggaagcctggcctggatgtgagtttgtttcacagtccctcatcgccactgctatctggaaatgcctgctgaaagcccagtccctcgggctcgggggaaatgcgccttcaccattgtactataaatag

SEQ ID NO: 236924 - DNA, 618 bp, Artificial Sequence
  Description of Artificial Sequence: Synthetic coding sequence
atgggtggggaagatgatgagttgaaaggtctgctcggactgccggaggaggagactgagctggacaatttgacagaatttaatactgctcataataaaagaatttcaacacttacgatagaagaaggtaatcttgacattcaacggccaaaacgaaaacgaaagaactctagagtaacattttcagaggacgatgagataattaatccagaagacgtcgatcccagcgtaggtcggttccggaacatggtgcagactgcggttgtccctgtaaagaagaaacgagttgagggacctggctcactgggcctggaggaatccggttcccgtaggatgcagaacttcgccttttcagggggactgtatggcggactgccccctactcattctgaagctggttcccaaccccacgggattcacggaacagcactgatcggcggtctgccaatgccgtatcccaatctggccccagacgttgatcttactccagtagtgccttccgctgttaacatgaaccctgcaccgaacccagccgtatataaccccgaggctgtgaacgaaccgaagaagaagaagtacgcgaaagaggcttggcccggaaagaagcctaccccttag

SEQ ID NO: 236925 - DNA, 600 bp, Artificial Sequence
  Description of Artificial Sequence: Synthetic coding sequence
atggctgccgcagccaatagcggcagttctctgcctctgtttgactgtcctacgtgggccggaaagcctccccctggtctgcatctcgacgtagttaaaggggacaagttgattgagaagctcatcatcgatgaaaaaaaatactacttgtttgggcgtaaccctgatttgtgcgacttcactatcgaccaccaatcatgtagtagggtccatgccgcattagtataccataaacacttgaagagggtgttcctcatagaccttaactccacccacggaacatttcttgggcacatcaggctggaacctcacaagccccagcagatcccaatcgattccacagtcagcttcggtgcctccacccgagcatacacactgcgagagaaacctcagaccctcccctctgccgttaagggtgatgagaagatgggcggtgaggacgatgagttgaaggggctgctgggattgccagaggaagagaccgaactcgataacttgactgagtttaacactgcacacaaccacatggcctccatgggacagcattcttccgttgcatgcccttgtcacacacagacactgccattaatgtggacctag

SEQ ID NO: 236926 - DNA, 3891 bp, Artificial Sequence
  Description of Artificial Sequence: Synthetic coding sequence
atgctcaaaacagagtctagcggcgagcggactactttgagatctgcttcccctcatagaaatgcataccgaacagagtttcaggctcttaaaagcactttcgataaaccaaagtcagatggcgagcaaaagactaaagaaggggagggctctcaacagtctcgtggcaggaagtacgggagcaatgtgaacaggataaaaaacctgtttatgcagatgggcatggaacctaatgagaatgcggcagtcattgcaaagacacgcggaaagggaggtcactcatcccctcagagaaggatgaagccgaaggaatttttagaaaagactgacggatccgtggttaagctcgaaagtagcgtaagtgagcggatctcgcgctttgatactatgtacgacggtccttcgtactcaaaatttacagagacaagaaaaatgtttgaaagatctgtccacgagtctgggcagaacaatcggtactcacccaagaaggagaaggctggtggaagcgagccccaagatgaatggggcggaagtaaatcaaacagggggtccactgactcactcgactccctgtcttccaggacagaggccgtgtccccaacagtaagccagctgagtgcagtcttcgagaatacagatagcccgtcggccatcataagtgagaaggcagaaaacaacgagtactccgttacggggcactatcccctgaatctccccagcgtgaccgtgaccaacttagacacgttcggccacctcaaggactctaattcctggccgccttccaataaacgcggtgttgatacagaggatgcacacaaatccaacgcgacaccagtgcccgaagtcgcatctaagagcaccagcctggccagcattcctggtgaagagatccagcagagtaaagagcctgaagatagcacttccaaccagcagacccctgatagcatcgacaaggacggcccagaagagccttgcgccgaatccaaggcaatgcctaagtctgaaatccctagcccccagtctcagctgctagaggacgctgaggcaaacctagtgggcagagaggccgctaaacagcaacggaaggagttagcaggcggagatttcacatctccggacgccagtgctagcagctgtggcaaggaggttcctgaagatagtaataactttgacggttctcacgtgtacatgcatagcgattataatgtgtacagggttcggagccgttacaatagtgattggggagaaacaggaaccgagcaggatgaggaggaggattccgatgagaatagctattaccagccagacatggaatattccgagattgtggggctacctgaagaagaggagattcctgcaaatcggaagatcaagttttcctcagccccaatcaaagtgttcaatacttatagtaatgaggattacgacagacgtaacgacgaagttgacccggtggctgcttctgcggagtatgagttggaaaagagggtggaaaaactggagttattccctgtggagttagaaaaggatgaggacgggctgggaatctctatcatcggaatgggtgtcggtgccgacgccggactggaaaagctggggatcttcgtcaagactgtgacggaaggtggcgcagctcagagggatggacggattcaagtcaacgaccagatcgtcgaggtggacggcatatcgctggtaggtgtgacccaaaacttcgcagccactgtcctgaggaacaccaaaggtaatgtgaggtttgttatcggacgggaaaagcccggacaggtctctgaagtcgcacaactgatttcacagacattggagcaagagcgaagacagagggagctgttggagcagcattatgcgcaatatgatgccgacgacgatgaaaccggtgaatatgccaccgatgaagaagaagatgaagtgggacccgtacttccagggagcgatatggcaatcgaggtgttcgagttgccagaaaacgaggatatgttcagtccgtccgagctcgacacctcgaaactgtcacacaaattcaaggaacttcagataaaacacgccgttacggaagctgaaatccagaagctgaagactaagcttcaagccgcagaaaatgaaaaggttcgctgggagttagagaaaacccaactgcagcagaacatcgaggagaataaggaaaggatgctaaagcttgaatcctactggatcgaggctcaaacgttgtgccacaccgtgaatgaacaccttaaagagacacagtcacagtaccaggcattagagaagaaatataacaaagcgaagaagctcattaaagacttccaacagaaggagcttgatttcattaagagacaggaggctgagcgcaaaaaaattgaggatctcgagaaagcccatctggtggaggtgcaaggcctgcaagttcgcatcagggatcttgaggctgaggtcttcaggctcttgaagcagaatgggacccaggttaataataacaacaatatatttgaaagaaggacgtcactcggggaagtgtccaagggcgatactatggaaaatttggacggaaagcagacctcatgtcaagatggactcagccaagaccttaacgaagccgtcccggaaactgagagactggactcgaaagctcttaaaacaagggcccaactgagtgttaaaaataggaggcaaagaccaagtcgcaccagactctacgactcagtgtcatctactgacggagaagatagtctggagagaaaaggattgagaacttcctcacccgaatctgattcaggcgttcctcctctgactcccgtcgatagtaatgtgccattctccagcgatcacattgcagagttccaagaggagcctttagatccagagatgggcccactgtcctctatgtggggagacacttcactgttttccacctccaagtctgatcacgacgtagaagaatctccatgccaccaccagactacaaacaaaaaaatcctaagagagaaggacgatgccaaagatccgaaaagcctcagagcttcctcttccctcgcagtccagggtggtaagattaagcggaaattcgtggaccttggagctcccttgagacgaaattctagcaagggcaaaaaatggaaggagaaggaaaaggaagcatccaggttctctgccggttcacgcatttttagagggaggctggagaactggaccccaaaaccttgctccactgctcagaccagcactagatcgccttgcatgccattctcctggttcaacgatagtcgtaagggttcctattcattccgcaatcttcctgcccctaccagttctttgcagccttctcctgagaccttgatcagcgataagaaaggttctaagaatttcaccttcaacgacgattttagccctagctctaccagctccgctgacctctccggacttggcgcagagcccaaaactcccggactgtcccagagcctggcactgagctctgacgaaatcttggatgatggccaaagtcctaagcactctcaatgtcagaatcgcgcagtacaagagtggagtgtgcagcaggtgtctcattggcttatgagcctcaatctcgaacagtacgtgtcagaattttcagcccagaacattacgggcgaacaattgctgcagctggatgggaataagctgaaagctttgggaatgaccgccagccaagaccgtgccgtggtcaagaaaaagctgaaggagatgaagatgtctctggagaaggccagaaaggctcaggagaagatggaaaaacagcgtgagaaactgagaagaaaagaacaagagcaaatgcagcgcaagagtaagaagaccgaaaaaatgacttccactactgccgagggcgcaggcgagcagtag

SEQ ID NO: 236927 - DNA, 3297 bp, Artificial Sequence
  Description of Artificial Sequence: Synthetic coding sequence
atgctgaaaacggaatcgagcggagagaggactaccttacgatcagcatctccacaccgcaacgcttataggactgaatttcaagccctgaaaagcacctttgataagcctaagtccgacggggagcaaaagacaaaggaaggcgaaggcagccagcagtcacgcggaaggaagtatgggtccaatgtcaaccgcattaagaacttattcatgcagatgggcatggagccaaacgagaatgcagcggttatcgcaaagactagaggaaaggggggacacagttctccccagagacgcatgaagcctaaagagttcctggagaagactgacgggtccgtggtgaagctggaatcaagcgtctcggagaggatctctaggttcgatactatgtacgatggcccaagctactccaagtttactgaaacccgcaagatgttcgaaagaagtgttcatgaaagcggacagaataaccggtattcgcccaaaaaggagaaagccggaggctcggaacctcaggatgagtggggtggctctaaatctaataggggttcaactgactctctcgatagtttatcaagtcggacggaggctgttagcccaaccgtctctcagctgagcgcggtgttcgaaaatactgattctcccagtgccataatctcagagaaggcagagaacaacgagtattctgtgactggccactaccccctgaacctgcccagtgttaccgtaaccaacttggatacctttggtcatctgaaagattctaattcctggcccccttctaataagcgaggggtggacactgaggacgcacacaaatcaaatgccactcctgtgcctgaggtagcatcgaagtcaacctcgctggcatccataccgggagaggagatccagcaatctaaagagccggaggattctacttctaatcaacaaacacccgatagtatcgataaagatggcccagaagaaccatgcgccgagtcgaaggccatgcctaaatctgagattccatcaccccaatctcaattgttggaggatgctgaagctaacctggttggtcgcgaagctgccaaacagcagagaaaggagctagccggaggagacttcacctccccagatgcctccgcttcttcatgcggaaaagaggtgcccgaggacagtaataactttgatgggagccatgtgtacatgcattcagactataatgtctatcgagtgcgatcccgatataattccgactggggggaaactggcactgagcaggacgaggaagaggattctgacgaaaacagctattaccaacctgacatggaatactctgaaatcgtgggactgcccgaggaggaggagatcccagctaatagaaaaattaaattctcctctgctccaattaaggtctttaacacatattccaatgaggactatgacagacgtaatgatgaagtggaccctgtcgcggcttccgctgagtacgaacttgaaaagcgggtcgagaagcttgagctattccctgttgagctggaaaaagacgaagatggcctggggatttccatcattggaatgggcgtgggtgcagatgccggtctggaaaaactgggaatctttgtgaaaacagtgaccgagggcggtgcggcacagcgcgacggccgtatccaagtcaatgaccagattgtggaggttgatggtatcagcctggtcggagttacccagaacttcgcggctactgtattacggaacactaagggaaatgtgagattcgtgattggaagggagaaaccgggtcaagttagcgaggttgctcaattgatatcacagacactagagcaagaacgcagacagagagagctgcttgagcaacactacgcccaatacgacgctgacgatgacgagacgggggaatatgcaactgatgaggaggaagacgaggtgggccctgtgctgcccggatcagatatggctatcgaagtattcgagctccctgaaaacgaggacatgttctcaccgagtgagctcgatacaagcaagttgagtcacaagtttaaagagctccagatcaaacacgctgttactgaagccgaaatccagaaactaaagactaagctgcaggcagcggagaatgagaaggtcagatgggaacttgagaagacccaactccaacaaaatatcgaagagaacaaagagagaatgctcaaactggaatcttattggatcgaggctcagactctgtgtcacaccgttaatgagcacctcaaggagacccagagccaatatcaagctttggagaaaaagtataataaagccaaaaaactcattaaagattttcaacagaaagagctggatttcataaaacgtcaagaggctgagcgaaagaaaatcgaggacctagagaaggcccatcttgtcgaggtgcagggcctacaggtccgcattcgcgacctggaggccgaggtgtttcgcctcctcaaacaaaatggcacgcaggtgaacaataataacaatatcttcgagcgacggaccagtttgggagaggttagcaaaggggacacaatggagaatctggacggcaaacagacctcatgccaggacggcttgtctcaggatctcaacgaagcggttcctgagacggaacggctcgattccaaggcgttaaaaacaagggcgcaattgagtgtgaaaaataggcgccaacggccatcaagaaccagactgtatgattctgtgtcgtctaccgatggagaagatagcctggagcgtaaaaactttacattcaacgacgacttctctccctcctccacatctagcgccgatctcagcggcctgggagctgaacccaaaacccccggactttcccagtcccttgccttgtctagtgatgaaagcctggacatgatcgacgatgagatcttagacgacggccagtcaccgaaacattcacagtgtcagaatagagccgtacaagagtggagtgtgcagcaggtgtctcactggcttatgagcctgaacctcgagcagtacgttagcgagttctccgcacagaatatcaccggcgaacagttactgcagcttgacggcaacaaactgaaggcactggggatgacagcaagccaggaccgggcagtggtgaagaagaaactcaaggagatgaagatgtcccttgagaaggcccgaaaagctcaggaaaagatggagaagcagagagagaagctgcgaagaaaggagcaagagcagatgcagcgaaagagtaagaagaccgagaagatgacatccacaaccgctgaaggagcaggtgagcagtag

SEQ ID NO: 236928 - DNA, 222 bp, Artificial Sequence
  Description of Artificial Sequence: Synthetic coding sequence
atgctcaagacggagtcttctggggagcgaaccacacttcgctctgcatcacctcacaggaatgcatacaggacagaattccaggcgctgaaatccaccttcgataagcccaaaagcgatggagaacagaagactaaagagggtgagggcagtcagcagtctagagggagaaaatacgggagtaatgtgaaccggattaaaaacctgttcatgcagatgtag

SEQ ID NO: 236929 - DNA, 126 bp, Artificial Sequence
  Description of Artificial Sequence: Synthetic coding sequence
atgttgaaaactgaatcgagtggcgagaggacaactctgcggagcgcctccccccacaggaatgcctataggacagagtttcaggctctcaagtctacatttgacaagccgaaatcagatgggtag

SEQ ID NO: 236930 - DNA, 3297 bp, Artificial Sequence
  Description of Artificial Sequence: Synthetic coding sequence
atgctgaagaccgagagcagcggggagagaacaacgctgaggtctgcttctcctcataggaacgcttacaggactgaattccaggccctgaagtccaccttcgataaacccaagtccgacggggagcagaagactaaagagggtgagggttctcaacagagcaggggtcgcaaatatggatctaacgtgaatcggatcaaaaatctctttatgcagatgggtatggaacctaatgagaatgccgcagtgatcgcaaagactagaggcaaagggggacactctagcccccagcgaaggatgaaacccaaggaatttctggagaagactgacggatctgtggttaaactggagtccagcgtgagtgaaaggatcagccgctttgatactatgtacgacggtccgagctatagcaagtttacggagacaaggaagatgtttgagaggagtgtgcacgaatctggccagaataacaggtacagtccaaagaaagaaaaggccggtggctccgaacctcaggatgaatgggggggatccaaaagcaaccggggtagtactgattccctggacagcctatcctctagaactgaagcagtaagccccaccgtctcccagttaagtgccgtgttcgagaacaccgactccccgtcagcgattattagcgagaaggccgaaaataacgagtactccgtcacaggacattacccactaaacctgcccagcgtaactgtgaccaatctggatacatttgggcaccttaaggattccaattcatggcccccttccaacaagaggggggtcgacacagaggacgctcataaaagtaatgcaacacctgttcccgaggtggcgagtaagtcaactagcctggccagcattcctggagaagagatacagcagagcaaggaacccgaggattccacttctaaccagcagacgcccgacagtatcgacaaagatggcccagaagagccttgtgcggaatctaaggcgatgccaaagtccgaaatcccctcccctcagagccaactattggaggatgcagaggcaaatctggtgggccgagaggcggctaagcaacagagaaaggaacttgcaggcggagattttacttcaccggatgcttccgcctctagttgcgggaaagaagtaccagaggactcaaacaacttcgacggaagtcacgtttatatgcatagcgattataatgtgtatagagtcagatcccggtacaactcagattggggggagacagggacagagcaggacgaggaagaggacagtgacgaaaactcatattaccagcctgatatggaatactctgagatcgtgggactgccagaggaagaagagatccctgcaaatcgaaaaattaaatttagctccgctcccatcaaggtttttaatacctacagcaatgaagactatgacaggcgaaatgacgaggtggaccccgtggccgctagcgctgagtatgagttggaaaagcgggtcgaaaaactggaattattcccggtcgaactggaaaaagatgaagatggactgggtatctctataataggcatgggtgtcggggctgatgccggactagaaaagttgggcatatttgtaaagaccgtcactgagggaggtgccgctcagcgagacgggcgaattcaggttaacgaccaaatcgttgaggtggacggaattagcctggtgggggtcacccagaactttgctgctactgtgctacgcaatacaaagggcaacgtgcggttcgtcattggtagggagaaaccaggccaagtgtccgaagtggcccagctgatcagccagacactggagcaggaaaggagacagcgtgaactcctagaacagcattatgcacagtatgatgcggacgatgacgaaaccggggagtatgcaaccgatgaggaggaggacgaggtcggccctgtgctacctgggtcggatatggctatcgaggtgttcgaattgccggagaacgaagacatgtttagcccttctgagctcgacacaagcaaattgtcccacaagttcaaagagttgcaaattaaacacgctgtcactgaggctgagatacagaagcttaagaccaaattgcaagcagcggaaaacgaaaaggtgaggtgggaactagaaaagactcagcttcagcaaaacatagaagaaaataaagagcggatgctcaaattggagtcttactggatcgaggcgcagacactatgccatactgtgaacgaacacctgaaggagacccagtcgcagtaccaggcacttgagaagaaatacaacaaagcaaagaagctgatcaaagacttccaacaaaaagagcttgactttattaagcgccaagaagcagagaggaaaaaaatcgaagaccttgaaaaggcccacctggtcgaagtccagggccttcaggttaggatccgcgatctggaagccgaagtgttcaggctactcaaacaaaacggtacacaggtcaacaacaataacaatattttcgagagacggacaagcctgggcgaagtgagtaagggtgatacaatggaaaacctcgatggaaaacagacaagttgtcaagatggcctttcacaggacctcaacgaagccgtgcccgaaacagagaggcttgattctaaggccctgaagacaagggctcagctatccgttaaaaaccgcagacagaggccatcgcggacaagactctatgattctgtctcctcaaccgatggcgaagactccctggagaggaaaaatttcacctttaacgatgacttctccccaagctcaacctctagcgctgacctgtcaggattaggagctgaaccaaaaacacctggcctgagtcagagcctggctttatcttcagatgaatctcttgatatgatcgacgacgagatactcgacgacggccaatctcctaaacattcgcagtgccagaacagggctgtgcaggagtggtcggtccagcaagtgtctcactggctcatgagtctcaacctcgagcagtacgtgagcgagttcagcgctcaaaatatcacaggtgagcagctcctccagttggacggaaataaattgaaggccctgggcatgactgcctctcaggatagggccgtggtgaagaaaaaactcaaggagatgaagatgtcgctggaaaaggcccgaaaagcacaggaaaaaatggagaagcagagggagaagctgcgcagaaaagagcaagagcagatgcagagaaagagtaaaaagacagagaaaatgacctccaccacggcggagggcgctggtgaacaatag

SEQ ID NO: 236931 - DNA, 3762 bp, Artificial Sequence
  Description of Artificial Sequence: Synthetic coding sequence
atgctgaaaacggaatcttcgggcgagagaaccactctcaggtcagctagcccccataggaatgcatatcgtacggaattccaggcccttaagtcgacattcgataaacctaagtctgatggagagcagaaaactaaggagggggagggtagccaacagagcagaggaaggaaatatgggtccaacgtaaacaggatcaagaacctgttcatgcagatgggcatggagccaaacgaaaatgcagcagtcatcgccaagacacggggaaaggggggtcatagctctccacagagaaggatgaaacctaaggaatttttggaaaagacagacggatctgtcgtgaaactcgagagcagcgtgtcggagaggatctcacgttttgacaccatgtatgacggcccttcatactctaagttcaccgaaaccagaaaaatgttcgaaaggagcgtccatgaaagcggacaaaataaccggtactcccccaaaaaggagaaggccggtggtagtgaaccccaggatgaatgggggggatcaaaatctaacagagggtccaccgacagcttagattcactatcctcccgcactgaggcagtttctcctactgtatcccagttaagcgctgtgtttgagaacactgattccccttctgcaatcatctcagagaaagctgagaataacgagtacagcgttacaggtcactacccattaaacctccccagtgtcactgtgacaaacctcgacaccttcggccatctgaaagacagcaatagttggcccccttccaataagaggggagtggacacagaggacgcccacaagtctaatgctacgcctgtccccgaggtggcctcaaagtccacctctctagcctctatacccggagaggagattcagcagtctaaagagcccgaggattcaacctcgaatcagcagaccccggatagcatagataaagacggacctgaggaaccttgcgctgaaagcaaggccatgcctaaatctgagatcccaagtccacagagccagttgttagaagacgccgaggcaaatcttgtcggcagagaagctgcaaagcagcagcggaaagagctagccggtggcgacttcacatccccggacgctagcgctagctcttgtggcaaggaggtgcctgaagacagtaataacttcgatggaagccacgtctacatgcattccgactacaacgtctacagagtcaggtccaggtataattcagactggggagagacaggaactgaacaggatgaggaagaagacagtgacgagaattcttactatcagccagatatggagtatagcgaaatcgtgggcctcccagaggaggaagagattcccgctaacagaaagattaagtttagctctgcacccatcaaggtatttaatacttactcaaatgaagactatgaccggaggaacgatgaggtggatccagtggctgcctccgcagagtacgagctcgagaagagggttgaaaagcttgaactttttcctgtggagctcgaaaaagacgaagatggccttggcattagtataatcgggatgggcgtgggcgcagacgccggattagaaaagctggggattttcgttaaaaccgtaacagaaggtggtgcagcacagcgagacgggagaatacaggtgaacgaccaaatcgtggaggtcgatggaatctcactcgtgggagttacgcaaaattttgcggcaacagtgctgcggaacactaaagggaatgttaggttcgttatcgggcgagagaaaccaggccaggtcagcgaagttgcacagttgatcagtcagacattggagcaggaacgacgtcagagagagcttctggaacaacactatgcccagtatgatgccgatgatgatgagaccggagagtatgctaccgacgaagaagaggatgaagtggggcctgtcctgccagggagcgatatggccatagaagtcttcgagttacccgaaaatgaggacatgttttcgccctccgaactggatacaagcaaactatctcataaattcaaagaactgcagataaagcacgccgtaacagaagccgaaattcagaaactcaagacaaagttgcaggccgctgagaacgaaaaggtgagatgggagcttgagaagactcagcttcagcagaatattgaagagaacaaggagcgtatgctgaagctcgagtcttactggatagaggcgcagactctttgccacaccgtgaatgaacacctgaaggaaacacagtctcagtatcaggcactggaaaaaaaatacaacaaagcaaagaagctgattaaagatttccagcaaaaagaactcgacttcatcaaacggcaagaggcagaacgcaagaaaatagaagatctggagaaagcccatctggtggaggtccagggcctgcaagtgcgcatacgagatttagaggcagaggtcttccgcctgcttaagcaaaacggtacacaggttaataataataataatattttcgagagaagaaccagcttaggcgaagtgtccaagggcgatacaatggaaaacttggacgggaaacaaacctcctgccaggacggactcagccaggatctcaacgaagctgtgccagagaccgagaggttggatagcaaagctctaaagacccgtgcccaattatctgtaaagaatcggagacagaggccttcacggacacgcctgtacgatagcgtgtcttccaccgatggggaggattccctcgagaggaagccctctaactccttttacaaccatatgcacattacaaaactgctccccccaaaaggtcttcgaaccagtagcccggagtcagattcgggggtgccacccctcacccccgtcgactccaatgtgccatttagttctgatcatatcgccgagtttcaggaagagccactcgatccagagatgggtccgttaagtagcatgtggggggatacatccttattttctacctccaagtcagaccatgatgtggaagagtccccatgccaccatcagactaccaataagaagatcctgagggaaaaggacgacgctaaggacccgaagagcttacgagccagctctagtttagccgtgcagggtggaaagatcaaaaggaaattcgtcgatctgggtgccccactgagacgcaactctagtaaggggaagaaatggaaggaaaaggaaaaggaagcctctcgatttagcgccggaagcaggatcttccgagggcgactcgagaactggactccgaaaccttgtagcactgcccagacatccacacgctcaccttgcatgccattttcatggtttaatgattctagaaaggggagctactcttttcgtaatcttccagctcccacctcaagtctacaacctagtccggaaactcttattagtgataagaaggggtccaaaaatttcacatttaacgatgacttctctcctagcagcactagctcagcagatctcagtggacttggcgctgaaccaaagaccccaggattaagccagtctcttgctctgtccagtgacgaagcactgggaatgacagcgtcacaggatcgcgctgtcgtgaaaaagaagctaaaggagatgaagatgagtctggaaaaggcgagaaaagctcaagaaaaaatggaaaagcaacgcgaaaaactccgccgaaaagaacaggagcagatgcagagaaagagtaagaaaactgagaagatgacctccacgacagccgaaggggctggcgagcaatag

SEQ ID NO: 236932 - DNA, 930 bp, Artificial Sequence
  Description of Artificial Sequence: Synthetic coding sequence
atggacgagaaggtgtttaccaaagagctggatcagtggatcgagcagctaaatgaatgcaaacagctatccgaaagtcaggtcaaaagcctgtgtgagaaggccaaagaaatactgactaaggagagcaacgtccaggaggtgaggtgtccagtaacagtctgcggggatgttcatggtcagtttcacgaccttatggaacttttcaggatcgggggtaaatctccggatacaaactacctgttcatgggtgactacgttgatcggggttattacagcgtagagacagtgacactgctagtcgcactaaaggttaggtaccgagaacgtattaccattctgagaggaaaccacgagtcccgtcagataacacaggtgtacggattttacgatgagtgccttcgcaaatacgggaacgcaaacgtctggaagtattttaccgacctatttgactatctgcctctcaccgccctggttgatggacagatcttctgcttgcacgggggattatctccaagtattgatacactcgaccacattcgggctctcgacaggctgcaagaggtgccccacgaagggcctatgtgcgacttattatggtcggaccccgacgacagggggggatggggcatcagtccaagaggcgcagggtacaccttcggccaggacattagcgagacgtttaatcatgccaatggattaacccttgtctcacgtgcccaccaactagtgatggagggctacaattggtgtcacgataggaacgtggttactatcttttcagcacctaactattgttatagatgcggcaaccaggctgcgatcatggaactggacgatacgctgaaatactcttttctgcaatttgatccagctccacggcgaggagaaccccacgtcacacgcagaacacctgattatttcctctag

SEQ ID NO: 236933 - DNA, 1407 bp, Artificial Sequence
  Description of Artificial Sequence: Synthetic coding sequence
atggctccacccccagccagagtccacctcggcgctttcttggctgtcacccccaaccccggtagcgccgctagcggaaccgaggctgctgctgcaacacccagcaaggtgtggggctctagtgccggtaggatagaaccacgcggtggaggaagaggggctttgcctacctctatgggccagcacggacccagtgcccgtgcgcgagcaggcagggcccctggaccacgacctgctagagaagctagtccgcgtctgcgagtgcacaaaactttcaagtttgtcgtggtaggagtgcttctacaggtcgtccctagttcagcggctacgatcaagctgcacgaccaaagcatcggaacacagcagtgggaacactcacccctaggagagctttgccccccaggttctcacagatccgaacacccaggagcttgtaataggtgtaccgagggagtcggctacactaatgcctctaacaacctgttcgcctgtctgccttgcaccgcctgtaaatctgatgaggaagagagatccccttgtactaccacccgaaacaccgcctgccagtgcaagcctgggaccttccgcaacgacaatagtgccgagatgtgtcgtaagtgtagtcggggatgccccagagggatggtcaaagtgaaggattgcaccccctggtccgacatcgaatgtgtgcataaggagtcgggcaacgggcacaatatctgggtgatacttgtcgtgaccctggtggtaccactgctcctggtcgccgtgctcattgtttgttgttgtatcggaagtggctgtggcggtgaccccaaatgcatggatcgagtatgtttctggcgcttggggcttctacgtggcccaggggcagaagacaacgcccataatgagatcctgagcaatgcggacagcctgagtacattcgtgtccgagcagcagatggagtcccaggaaccagctgatctgacgggtgtgacggtgcagagccccggagaggcacagtgcctgttagggccagcagaagctgagggctcccagagaagacgactgctggtgccggcaaacggggctgatccaaccgagacattgatgctgtttttcgacaagttcgcaaacatcgttccatttgatagctgggaccaacttatgcgccagttggacttgacaaagaatgaaatagatgtcgttagagcgggtaccgccggacccggagacgcactgtatgccatgcttatgaagtgggttaataaaaccggtcgtaacgctagcattcacacgcttctggacgccttggagcgcatggaagagcggcatgcccgagagaaaatccaggaccttctcgtcgacagcggtaaattcatctaccttgaggacgggacgggcagtgctgtgtcactggagtag

SEQ ID NO: 236934 - DNA, 930 bp, Artificial Sequence
  Description of Artificial Sequence: Synthetic coding sequence
atggacgacaaggcctttaccaaggagctcgaccagtgggtggagcagctgaatgagtgtaaacagttaaacgagaatcaagtacgtactctgtgcgaaaaggccaaagagatccttacaaaagagagcaacgttcaagaggtgcgctgccctgtcaccgtgtgtggggacgtacatgggcaattccacgaccttatggaattgttccgaatcggcggaaagtccccagatactaattacctgttcatgggggactacgtggatcgcggttactacagtgtggagacggtgacattgttggtcgccctgaaggtccgatacccagaaaggatcacaatcctaaggggcaaccacgagtcgaggcagatcacgcaggtgtatggattctatgacgaatgcctgagaaaatacggaaatgcgaatgtgtggaaatactttacggatttgttcgactacttgcccctgacagctctcgtggacggacagatcttctgcttgcacggtggcctgtctccatctatcgacacattagaccacattcgagcactggatcggctacaagaagtaccccatgaaggaccaatgtgcgaccttctgtggtccgatcccgatgacagaggagggtggggaatctcacctcgaggcgcaggctacacctttggtcaggacatttctgaaactttcaatcacgctaacggcctgactctcgtgtcacgcgcacaccagttagtgatggaaggttacaactggtgtcacgatcgcaacgtggtgaccatctttagcgcaccaaattactgttatcgatgcgggaatcaagcagctatcatggaattggacgatacattgaagtattcgttcctgcagtttgatccggctccaagaaggggtgagccccacgtgactagacggacaccggactacttcttatag

SEQ ID NO: 236935 - DNA, 1461 bp, Artificial Sequence
  Description of Artificial Sequence: Synthetic coding sequence
atgtcctctagcagtccccctgcaggcgcagcatctgcagcgatcagtgcctcggaaaaggtggacggctttactcgtaaaagtgtgaggaaggcccagcgccaaaagcgcagtcagggcagcagccagtttaggtctcaggggagccaggcagagctccaccctctcccccagctgaaagatgctacttccaatgaacagcaggaattgttctgccagaagttacagcagtgttgtattctatttgacttcatggactctgtgtctgacttaaagagcaaagaaattaagcgagcgaccttgaacgagcttgtcgagtacgtatctactaaccgaggggtgatcgtggaatctgcctactctgacatcgttaaaatgatctccgctaacatcttcagaactctgcccccttctgataatcctgattttgaccccgaagaggacgaacccacattggaggccagttggccacatatccagttagtatatgagttcttcctgcggttcctggagagccctgacttccaaccctctattgctaagcggtatattgatcagaaattcgtccagcagctactggagctgttcgattccgaggatccccgagagagggacttcctaaagacggttctccacagaatttatggcaaatttctgggcttgcgggcatttataagaaagcagattaataatatatttctgcggtttatctatgagaccgaacacttcaacggcgttgctgagttgctagaaattctcggctcgatcattaatggttttgctcttccgcttaaagccgaacacaagcagtttctgatgaaagtgctgatcccaatgcacaccgcgaagggcctcgccctctttcacgcccaactggcttactgtgtggtgcagttcctcgagaaagataccacgctaacagagccagttattagaggcttacttaagttctggcccaagacatgttctcagaaggaagtgatgtttttgggggagattgaagagattctggacgtgatcgagcccacccagttcaaaaagattgaggagcccctgttcaagcagatttcaaagtgtgtcagcagttctcactttcaggtcgccgagcgagccctttacttctggaataatgagtacattctaagtctgatagaggagaacatcgacaaaattctgcccatcatgtttgctagtttgtataagatcagtaaggagcactggaatccaacaattgtggctctggtttacaatgtccttaagacactgatggaaatgaatggaaaattgtttgacgatctgacatcctcatacaaggccgagcgccagcgagagaaaaagaaggagctagagagggaggagctgtggaagaaattagaggaattgaagttgaagaaggcacttgagaaacagaatagcgcctataacatgcattcaattctgtcgaacacaagcgcggagtag

SEQ ID NO: 236936 - DNA, 1290 bp, Artificial Sequence
  Description of Artificial Sequence: Synthetic coding sequence
atgataatgaacgccacaagcaacgagcagcaggagctgttctgccagaaattgcaacagtgttgtatactcttcgattttatggattcagtctcagatctcaagtccaaggagatcaagcgcgctaccctgaacgagctagttgagtacgtcagcacaaataggggcgtcattgtggagtccgcatactccgacatcgtgaaaatgatcagtgcaaatatctttcgcacactccccccttctgacaatcccgattttgatcctgaggaagatgagcccaccctggaggcaagctggccccacattcagctcgtttacgagttcttcctaagattcctagaatcacctgatttccagccttccattgcaaagcgctacattgatcagaagttcgtccagcagttgctagagctttttgattcagaagaccccagagagcgggatttcttaaaaaccgtgttacacaggatctacggaaagtttctagggctccgtgcctttattcggaagcagatcaataatattttcctccgatttatctatgagacggagcacttcaatggtgtcgccgagttactggagatccttgggagtattataaacgggtttgccttacctctgaaagccgagcacaagcaatttttgatgaaggttcttatcccaatgcacaccgcgaagggcctagccctgtttcacgctcagctggcttattgtgtggtgcagtttttagaaaaggataccacattaaccgagccagtaatccgcggattgctaaagttctggccaaaaacttgttcacagaaggaggtgatgtttctgggggagattgaggagatcctcgacgtgattgagccgacacagtttaaaaaaatcgaagaacctctctttaaacagatatcaaagtgtgtttcaagctcccacttccaagtggccgagcgtgctctctatttctggaataacgagtatatactgtctctcatagaagaaaatatcgacaaaatcctgcccataatgttcgcctctctctataagatcagcaaagagcactggaacccaactatcgtggctttggtctataacgtgcttaagactctcatggaaatgaatgggaaattatttgatgacctgacatcctcctataaagcagaacggcagagggagaagaagaaggagctcgagagagaagaactctggaaaaagctggaggaattgaagctgaagaaggctcttgaaaagcagaatagtgcatacaacatgcatagtatactcagcaacacctcagctgaatag

SEQ ID NO: 236937 - DNA, 1461 bp, Artificial Sequence
  Description of Artificial Sequence: Synthetic coding sequence
atgtcttcaagcagcccgccagccggtgctgcaagtgccgctatttcggcgtccgaaaaagtcgatgggttcacgcgcaaatccgtgcgtaaggcccagcgtcagaagagatctcagggaagctcccagttccggtcccaaggttctcaggcagagctccatcccctgccgcagttgaaggacgcgacatccaatgagcagcaggaactattttgtcaaaaactgcaacagtgttgcattttatttgactttatggattccgtgagtgaccttaagtccaaggagattaaacgcgcaacgctgaacgagcttgtagagtacgtaagcacgaacaggggggtcatagtcgagagtgcctattcagacatagtaaaaatgatatctgccaacatttttaggacgctcccaccttctgataatcctgatttcgacccggaggaagacgagcctaccctggaggccagctggcctcacatccagttggtttacgaatttttcttaagattcttagagtctcccgatttccagccgtctattgcgaagagatacatcgatcaaaaattcgtgcaacagcttctggaactgttcgactcagaagaccccagagaaagggatttcctgaaaactgtgctgcacaggatctatggaaaatttctgggcctccgtgcttttatccggaaacagatcaacaatatcttcctgaggtttatctatgaaacagaacattttaatggagttgctgagctgctagagattctgggatcaattataaacgggtttgctctccccctaaaggctgaacacaagcagtttctcatgaaagttctgatccccatgcacaccgctaagggcctggctctgttccatgcacaactggcttactgcgtggtgcagttccttgagaaggatacgacgctgacggaacctgtgattcgcggtctcttgaagttctggcccaagacttgttctcagaaagaagtgatgttcctaggggagattgaagagattcttgacgtcatagaacctacacagtttaaaaagattgaagaacccctatttaagcagatatccaaatgcgtgtcttcgtcccactttcaggtggctgagcgggcactgtacttttggaacaacgagtatatactgagtctcattgaggagaacattgacaagattctgccaataatgtttgcatcgctgtataagatctcaaaagagcattggaaccctacaatcgtggctctggtatacaatgtgctgaaaaccctgatggaaatgaatgggaaattattcgatgacctgacaagttcctacaaagcagagcgacaacgggaaaagaagaaagagctcgagcgcgaagaattgtggaagaagctggaggagcttaaactgaagaaggccttagagaaacagaacagcgcatacaacatgcactccatcctcagcaatacatccgcggagtag

SEQ ID NO: 236938 - DNA, 1341 bp, Artificial Sequence
  Description of Artificial Sequence: Synthetic coding sequence
atgaagtgcttcagccgatatttgccttatatctttaggccccctaatacaattctttcttcctcttgccacacggaggctgatatcatctcaaccgtagagtttaaccataccggcgaactcttggctacaggggataagggagggagagttgtgatctttcaaagagaacaggaaagtaagaatcaggtgcaccgccgaggcgaatacaatgtctattcaacttttcagagccatgagccagagtttgattatctcaaaagtctggagatcgaggaaaaaattaataaaatccggtggctgccccagcagaacgctgcgtatttcctgctgagcacaaatgacaaaaccgtgaagctctggaaggtaagcgagagagataaacggcctgagggatataacttaaaagatgaggagggaaggttgcgggaccctgccaccatcactactttacgtgtgcccgtgctgcgaccaatggacctgatggttgaggccacacctagaagggtctttgccaatgcccatacctatcatattaattctattagcgtaaattctgattatgagacctacatgtctgccgatgatctgagaattaatctgtggaatttcgagatcacgaaccaaagttttaacatcgtagacatcaaacccgctaacatggaggagctgacagaagtaattacggccgctgagtttcacccccaccattgcaacacttttgtttatagtagcagcaaaggcacaatacgcctctgcgatatgcgtgccagtgccctgtgcgataggcataccaagttctttgaagagccagaagacccatcgaatcgctccttcttcagcgagattatatcctctatatccgatgtcaaatttagccatagtggacgctacatcatgacccgtgactaccttaccgtgaaagtctgggacctcaatatggaaaataggcctatcgaaacctaccaagtgcacgactacctgaggtcaaagctctgtagcctgtacgaaaacgattgcatcttcgacaaattcgagtgtgtctggaatggttcggactctgtgattatgacaggctcatacaacaacttcttccggatgttcgatcgaaacactaaacgggatgtaacccttgaagctagtagagaaaactctaaaccacgggcaatcctgaagccacggaaggtctgcgtgggaggaaaaagaagaaaagacgaaatcagtgtcgatagcttagatttttctaaaaagatcctccacaccgcttggcacccaagtgagaacatcattgctgtggcggctacgaacaacctctatatctttcaggacaaagtcaactag

SEQ ID NO: 236939 - DNA, 1332 bp, Artificial Sequence
  Description of Artificial Sequence: Synthetic coding sequence
atggaagaggacatcgacacaagaaagatcaacaattcgtttctgagagatcatagctacgccactgaggcagatatcatttccaccgtggaatttaaccatactggtgaactgctagccaccggcgacaagggcggacgcgtcgtcatcttccagagggagcaggagtctaagaatcaggtgcacagaaggggcgagtacaatgtgtatagcacctttcagagccacgaacctgagttcgactatcttaaatctctggaaatcgaagagaagatcaacaaaatcagatggcttccgcagcagaacgccgcttactttttgctgtccactaacgataaaaccgtgaagctgtggaaagtgagcgagcgagataagagaccagagggctacaacctcaaggacgaggagggtcgcttgagagatcccgcaactatcactacccttcgggttccagtacttcggccaatggacctgatggttgaagccacaccccgtagagtctttgcaaatgcgcatacctatcacatcaattctatcagtgtaaattcagactacgagacatatatgtctgctgatgacctgaggattaacctttggaatttcgagatcaccaaccagagctttaatattgtcgacatcaaaccagccaacatggaagagctgaccgaggtgatcacggctgctgagttccatcctcaccactgcaacacatttgtgtacagctcgtcgaaaggcacgatacgactttgtgacatgagggccagtgcactgtgcgataggcacactaagtttttcgaagaaccggaggatccctcaaatagatctttcttttccgaaattatctcatctatctccgatgtgaaattttcacatagtggtaggtatattatgacgagagactatctcacggtgaaggtctgggatctgaacatggagaacagacctatcgaaacctaccaggtgcatgattacttgagatccaagctgtgtagcctgtacgagaatgattgcatttttgacaagttcgagtgtgtatggaacggttccgattctgtgatcatgaccggtagctataataacttcttccggatgttcgaccgtaatactaaacgcgacgtgactctggaagcctctcgagagaactctaagccaagagccattctgaaacccagaaaagtctgtgtgggcggtaagcgacgcaaggacgaaataagcgtggactcgttagacttttctaagaagattttgcatacagcatggcatccaagcgaaaatattatagccgtcgccgctactaataacctgtacatctttcaggacaaagttaactag

SEQ ID NO: 236940 - DNA, 1506 bp, Artificial Sequence
  Description of Artificial Sequence: Synthetic coding sequence
atggtgctgcaaccgagcgaacgccattacagggattggaaccaccgacgccttggcccttggtgctctccaaccggatccccagcgcctctgtcttgcgagaccggatgcggtgaaggctcctggatcctcgtgtgtagactacttgttccaacccaggtgagtttactgtccatggaggaggacattgacactcgcaaaatcaataattcattcttgcgggatcattcctacgctaccgaagcggacatcatctctacagttgaattcaatcatacaggtgagctgttggccacaggggataaaggcggaagagttgtgatttttcagcgagaacaggaatctaaaaatcaggtgcaccgacgcggagaatacaatgtgtatagcactttccagtcccatgagcctgaattcgactacctgaaatctctcgaaatcgaggaaaagatcaataaaatccgctggctgccccagcagaatgccgcatacttcctgttatccacaaacgacaagaccgttaaactgtggaaagttagtgagagggataaacgacctgaaggatataatctcaaagacgaagaaggaagacttagagaccccgcaacaatcacgacccttagagttcctgtcctgaggcctatggacctgatggtagaagccacccccagacgcgtgttcgccaatgcacacacctatcacattaactccatctctgtgaacagtgactacgagacctatatgtcggccgacgatctgagaattaacctgtggaacttcgaaatcacgaaccagtcctttaatatcgtcgacatcaagccagctaacatggaagagttgactgaggtcatcacagctgctgagtttcatcctcatcattgcaatacattcgtgtactcttcaagcaagggcaccattcggctttgtgacatgagagccagcgcactctgtgaccgacacacaaagttcttcgaggagcccgaggatccgtccaacaggagcttcttcagcgaaataattagcagcatatcagatgtcaagttctcccactctgggcgatacataatgacaagggattacttgaccgttaaggtgtgggatctgaatatggagaataggccaattgagacctatcaggtccacgactacctgaggtctaagctgtgcagtctctatgaaaatgactgcatttttgacaaattcgaatgtgtctggaacggttccgactccgtgattatgacgggcagttacaacaatttttttcgcatgtttgataggaacactaagcgggatgtgacattggaggcctcccgtgaaaattcaaagcccagagcgattctcaaaccgaggaaagtgtgcgtcggaggcaaaaggagaaaggacgaaatcagtgtggattctctcgacttctctaagaaaatcttgcacactgcctggcatccgtcagaaaacattatcgctgtggcggctacgaataatctctatatattccaggataaggtgaactag

SEQ ID NO: 236941 - DNA, 1299 bp, Artificial Sequence
  Description of Artificial Sequence: Synthetic coding sequence
atgaactatcccgacgagaacacctatggaaataaagctgacatcatcagtacagtggagtttaatcacacaggggagctgttagctaccggagacaaaggtggccgagttgtgatattccaaagagaacaagagtccaaaaaccaggttcatagacgtggcgagtacaacgtctactccactttccagtctcatgaaccagaattcgactacctcaaatcactggagatagaagagaagatcaataaaatccgatggctccctcaacaaaatgctgcatatttccttctcagtactaacgataaaactgttaagttgtggaaggtgtctgaaagagataaaagacccgaagggtataatctgaaggatgaagagggaagactccgagatcctgccaccattaccaccctgcgcgtgcctgtgctccggcctatggacctgatggtggaagcgacacctcggcgagtatttgctaacgctcatacctaccacatcaattcgatcagcgttaactctgattacgaaacctacatgtcagccgacgatctgagaatcaatctttggaattttgaaatcactaatcaatcctttaacattgtcgatataaaaccagctaacatggaggaactgacagaggtgattacagccgcagaatttcatcctcatcattgcaacacctttgtctactcttcctctaaagggactatccggttatgcgatatgagggcatctgccctgtgcgacaggcacacgaaattctttgaggaacctgaagatccaagcaaccggtctttcttctcagaaatcatatcctccatttcggacgtgaaattttctcactctggcagatatataatgacacgagactatttaacagtcaaggtgtgggaccttaacatggaaaataggcccatcgagacatatcaggtacatgactatctgcggtcaaagctgtgcagcctgtatgagaatgattgtatcttcgacaagttcgaatgtgtctggaatggcagtgactcagtcattatgaccggcagttataataatttcttcagaatgttcgatagaaacacgaaacgtgacgtcacactggaggcctcgcgcgaaaattccaagcccagggctatactgaaacccaggaaggtatgcgtgggcggaaaaagacgcaaagatgagatatctgtggattccctggacttctcaaagaaaattcttcacactgcatggcacccctccgagaacatcatcgctgttgctgcaaccaataacctctacattttccaggataaggttaactag

SEQ ID NO: 236942 - DNA, 1332 bp, Artificial Sequence
  Description of Artificial Sequence: Synthetic coding sequence
atggaagaagatattgacacacggaaaattaacaactctttcctgagggaccactcctacgcgactgaggccgacatcatttcaactgtggagtttaaccacacaggagaactgctcgcaactggagataagggcggtcgggtcgtgattttccaaagggagcaggaaagcaaaaaccaggttcataggcggggagagtataacgtgtactcaacgttccagtcacacgaacctgaatttgattacctgaagagcctggagattgaggaaaaaatcaataagatcagatggttaccccagcaaaacgcggcttactttctcctgtctaccaacgacaagacagtgaaactgtggaaggtcagcgaacgggacaaacggccagaaggttacaacctgaaggacgaagaagggcgattgagggatccagcaactatcacaacactgagggtgccagtgttaagacccatggatctgatggtcgaggccacaccacgtcgcgttttcgcgaacgcccacacctaccacattaacagcatcagcgtaaactcagactacgagacctacatgtccgctgacgaccttcgcattaatctgtggaacttcgaaattaccaatcaatcattcaacatcgtggacatcaaacctgctaatatggaggagttgactgaagttattaccgccgctgagtttcatccccatcattgcaataccttcgtttattccagctcaaaggggaccatcagactgtgcgacatgcgggcttccgccctgtgcgaccgtcacaccaaatttttcgaggagccagaggacccctccaacagatctttcttctcggagatcatcagctctatcagcgacgtgaaattcagccattccgggagatatattatgacgcgcgattatctcacagtgaaggtgtgggatcttaacatggaaaataggccaatcgagacgtaccaggttcacgattacctgaggtctaaactgtgttccttgtatgagaacgactgtattttcgacaagttcgagtgcgtttggaacggctcagacagcgtcattatgaccgggagctacaacaacttttttcggatgttcgataggaacacaaagagagacgtgactctcgaagcatccagagaaaatagcaaaccacgagcaatactgaagcctaggaaggtctgtgtcggaggtaaacgtagaaaggacgaaatttcagttgacagcctggactttagtaaaaaaattctgcacaccgcatggcatcctagcgagaacatcatagctgtggccgctacaaataacctgtacatctttcaagataaagtaaattag

SEQ ID NO: 236943 - DNA, 1332 bp, Artificial Sequence
  Description of Artificial Sequence: Synthetic coding sequence
atggaagaggatattgatacgcgtaagatcaacaacagcttccttcgcgatcattcttatgccactgaggctgacattatcagcactgtcgagtttaaccacaccggggagctgctggccacgggagataagggcggaagagtggtgatctttcaaagagaacaggagtctaagaatcaggtgcaccgcaggggagaatataacgtgtatagcacctttcagtcgcatgagcccgaatttgactacctgaagtccttggaaatagaggagaagatcaacaagattcgctggctgccacagcaaaatgcggcatactttctcctcagcaccaatgacaagacagtaaaactgtggaaagtgtcagagagagacaagcgacccgaggggtataacctgaaggatgaagaggggagattgagggatcctgcaactatcaccacactgcgggttccggtgctccggcctatggacttgatggttgaggctacccctcgacgcgtgttcgcaaacgcccatacctatcacatcaacagcatcagcgtcaactccgattacgaaacatatatgtcggcggatgatctgcgaattaacctatggaacttcgagattacaaatcagtcctttaatatcgtggacatcaagcccgctaacatggaagagctaactgaggtaatcacagctgcagaatttcatcctcatcactgcaacacttttgtttattcctccagtaaagggactatcagactgtgtgatatgcgagcttcagccctttgtgacaggcacaccaaatttttcgaagaacctgaggatccttcaaacaggagctttttcagcgagatcatctctagtattagcgacgtgaagtttagtcattctggacgctacatcatgacccgagattatctgacggtaaaggtctgggacctgaatatggagaatcgccctattgagacctatcaggtacatgattatttgagatcgaaattgtgtagtctttatgagaacgactgtatcttcgacaaatttgaatgcgtgtggaacggtagtgacagtgtgataatgaccggatcttacaacaacttcttccggatgtttgacagaaacaccaaacgcgacgtcacgctggaggcttcccgtgaaaattccaagccacgcgcaatcctgaagcctcgcaaggtgtgcgtgggaggcaagcgtcggaaggacgaaatatctgtggatagtcttgacttctccaagaagatattacacactgcgtggcatccatcagagaatatcatcgctgtagcagctaccaacaatctttatatttttcaagacaaggtcaactag

SEQ ID NO: 236944 - DNA, 1530 bp, Artificial Sequence
  Description of Artificial Sequence: Synthetic coding sequence
atgttactgtccttacccgctctgcacctgcagactagtgagcaccacccattcttccagctcccacaccgccgtctcggcccatggtgttctcctactggatcccccgctcccctgtcatgtgaaacaggttgcggggaaggcagctggattctggtctgtcgactcctggtcccaacacaggtgtcattgttaagcatggaagaagatatagatactcggaaaattaacaattcattcctccgcgaccactcctacgctacggaagcagacattatctctacagtcgagtttaatcacaccggagagttattggcaactggggataagggcggtcgtgtggtaatttttcaaagggagcaggaaagcaagaatcaggtacacagacgaggcgagtacaacgtctacagcacctttcaatcccacgagccagagtttgactatcttaagtcactggagatcgaggaaaaaatcaacaaaatccggtggttgccacagcaaaacgccgcttactttctgttatctaccaacgacaagaccgtcaagttatggaaggttagtgaaagggataaacgacccgagggatataacctgaaagacgaggaaggcaggctgagagaccccgctacaatcaccactttgcgagtgccagtcctgcggccaatggatctgatggtcgaggccaccccccgacgagtgtttgccaatgctcacacctatcatataaacagtattagcgtgaatagcgattacgaaacttatatgtcggccgacgatctgcgcatcaatctgtggaactttgagattaccaatcagtctttcaatatcgtggacattaaaccagctaatatggaggaactgactgaggtgattactgccgctgagtttcacccacaccactgtaatacgtttgtatattctagctctaagggcactatccgtctgtgcgacatgagagcctctgcattgtgtgaccgccacaccaagttcttcgaggaaccggaagacccatctaataggtcttttttttcggagatcatatctagcattagtgacgtgaagttcagtcattccggaaggtacatcatgactcgggattacttaactgtgaaggtttgggacttaaacatggagaacaggcctatcgagacatatcaggtgcacgactacctaaggtcgaagctgtgttctctctatgaaaacgactgcatcttcgataagtttgaatgtgtttggaatgggagtgactctgtgatcatgaccggatcctataacaatttttttaggatgtttgaccgtaacacaaaacgagatgtaactctcgaagcatcccgcgaaaattccaagcccagggcgatcctcaagccgcgtaaagtctgtgtgggcggtaagcggaggaaggatgaaatcagcgtggattcccttgacttctctaagaagatcctccatacagcgtggcacccttctgagaacatcattgccgtggccgctacgaataacctatatatctttcaggacaaggtgaactag

SEQ ID NO: 236945 - DNA, 1332 bp, Artificial Sequence
  Description of Artificial Sequence: Synthetic coding sequence
atggaggaagacattgatacgaggaagattaataattctttcctcagagatcacagctacgctacagaagcagacataatctctaccgtagagtttaatcacacaggggagctcctcgctaccggggacaagggtggaagagtggtgattttccagagggaacaggaatccaaaaaccaggtccaccgcagaggggaatacaacgtgtatagtacattccagagccacgaacccgaattcgactatttgaagtcgctggaaattgaggagaagatcaacaaaattcgctggctgcctcagcagaatgccgcatatttccttctgtctactaatgataaaaccgtaaagctgtggaaagtgtcagaaagggataagcggccagaggggtacaaccttaaagatgaagagggcaggcttagggatccagcgacaatcaccaccttgcgggttcctgtgctgagacccatggacttgatggtggaggccaccccacgtcgggtgttcgccaatgctcatacataccacatcaactccatttccgtcaatagcgactatgagacatacatgtccgcagacgatctgagaatcaatttgtggaatttcgagattacaaatcaaagcttcaatatagttgacattaaaccagctaacatggaggagctgactgaggtgattacagccgctgagttccatccccatcattgtaatacgttcgtctactcaagctctaagggcacaatcagactttgcgatatgcgagcctcggccctgtgtgatcggcataccaaattcttcgaggaacctgaggatccatccaaccggtctttcttttctgagattatttcatctatttcggatgtgaagtttagccacagtggcagatacatcatgacccgagattacctgaccgtgaaagtctgggatctgaatatggagaatcgcccaatcgaaacgtaccaggtccacgattacttgaggagcaaattgtgtagtctttacgagaacgactgcatcttcgataagttcgagtgcgtgtggaatggcagtgacagtgtaatcatgactggatcttataacaattttttccgaatgtttgatcggaacaccaaaagggacgtgactcttgaggcctcgagagaaaactccaagcctagagctatcctgaaaccccgtaaagtgtgtgtgggcggaaaacgccgaaaagatgagatctcggtggactcactcgattttagcaagaaaatattacacactgcttggcatccatcggagaatattattgctgttgccgctactaacaacctatatattttccaggacaaagtgaattag

SEQ ID NO: 236946 - DNA, 1350 bp, Artificial Sequence
  Description of Artificial Sequence: Synthetic coding sequence
atgattccgggaataggcacactgactcaagacaccttgtggtgctttagccaagtgaagggcaccatcgaaattggcactaccgaggccgacatcatcagcactgtggaattcaatcatactggcgagctgctggcgacaggcgacaagggtggacgtgttgtgatcttccagagagagcaagagtcaaagaaccaggtgcacagaaggggagagtacaacgtctactcaacttttcagtcccacgagcctgaattcgattacttgaaaagcttggagatagaggagaagatcaacaaaattcgatggctcccccaacagaatgctgcctattttctgctgtcaaccaacgacaaaaccgtcaagctgtggaaagtgtccgagagggataagcgacctgagggctacaatctcaaggatgaggaaggcagactgagagatcctgctaccatcaccacccttcgtgtgcccgtgttgagacccatggatcttatggtcgaggctacgcctcgcagggtgttcgccaatgcacatacataccatattaatagcatcagcgtgaacagtgactacgagacttacatgtctgcagacgatctgaggataaacttgtggaattttgaaatcacaaatcagtcttttaatattgtcgacattaaaccagctaacatggaggaactgaccgaggtgattacagctgcggagtttcacccacatcactgtaatactttcgtctattctagtagcaaggggacaatcagactctgtgatatgagagctagcgccctttgcgatcgtcatacaaagttctttgaggaacccgaggaccccagcaatcgctccttcttttccgaaattatctcttcgatctccgacgtaaagtttagccatagtggaaggtacataatgaccagggactatctaactgtaaaagtttgggacttgaacatggagaacaggcctattgagacctaccaggtgcacgattacctgaggtctaaactgtgtagcctttatgaaaacgactgcatctttgacaagttcgaatgcgtgtggaacggctccgactccgtgatcatgactggaagctacaacaatttcttccgtatgttcgacaggaacactaagagagacgtgacccttgaagccagtagagaaaacagtaaaccgagagcaatcctcaagccacggaaagtatgcgtggggggtaagcgccgaaaagacgagatttctgtcgacagccttgacttcagtaaaaaaattttgcatacggcctggcatccctccgaaaacataattgcagtggcggcaacaaataatttgtatatttttcaggacaaagtgaactag

SEQ ID NO: 236947 - DNA, 1299 bp, Artificial Sequence
  Description of Artificial Sequence: Synthetic coding sequence
atgaactaccctgacgaaaacacctatgggaataaggctgacataatctccactgttgagttcaaccacaccggcgagctgctggctaccggtgacaaagggggacgtgtggtcattttccagagggaacaggaaagtaaaaaccaggtccacaggcgaggagagtataacgtgtactccacattccaaagccacgagcccgaatttgattatctgaaatcgctggaaatagaagagaaaataaacaagatccgctggctccctcaacagaatgcagcctactttctgttgtccacgaatgataagactgtaaagctctggaaagtcagcgagcgggacaaacggccagagggctacaacctaaaggatgaagaaggacgcttacgcgacccagcaacaattaccacgctaagagtgcctgttctgagacccatggatctgatggtagaggctaccccgaggagagtgttcgctaacgcccacacataccatatcaactccatttccgttaatagcgactacgagacctatatgtcagctgacgacctccggattaacctttggaactttgagattacaaaccagtctttcaatattgtagatataaagccagccaacatggaagagctgactgaagtcatcacagccgcagagtttcatccccatcattgtaatacttttgtgtacagttcctctaagggtaccattcgcctgtgtgacatgcgcgcaagcgccctttgtgatcggcacacaaaattcttcgaagagcctgaggacccctccaacaggtccttcttcagcgagattatttcttccatttctgacgtgaagttttctcatagtggacggtacatcatgactcgtgattatctgaccgtgaaagtctgggacctgaacatggaaaatagaccaatagagacatatcaggttcacgattatctccggtctaagctctgttcgctttatgaaaatgattgtatattcgataagttcgaatgtgtatggaatgggtccgactccgtcatcatgactggttcttataacaacttcttcaggatgttcgaccggaatactaaaagagacgttacactcgaggcaagtagagagaattctaagcccagagcaatcctgaagccccgaaaagtttgcgtgggtggcaaacgtagaaaggacgagattagcgtcgactcgctggatttcagcaagaagattttgcacacagcatggcatccaagcgagaacataattgctgtggccgctacaaacaacctatatatttttcaagacaaggtgaactag

SEQ ID NO: 236948 - DNA, 1494 bp, Artificial Sequence
  Description of Artificial Sequence: Synthetic coding sequence
atggaaacaaagctccccccagccagcactcctacgtctccatctagccccggtctatcaccagtgccgccaccagacaaagttgatggctttagtcgtcgctcgctacggagggctaggccgcgtcgaagccatagcagtagccaattcagataccagtctaatcaacaggaactaacacccctgccactcctcaaagacgtccccgcatctgaattacacgaactgctttctcgcaagctggcccagtgcggggtgatgttcgactttttggactgcgtggcagatcttaaaggaaaagaggtaaaaagggccgcactgaacgaactggtggagtgtgtgggctcaacaagaggcgtgctcattgaaccggtctacccggatataatccgcatgatttctgtcaatatttttcgtaccctgccgccatccgagaaccccgagttcgatccagaggaagacgaaccgaatctggagccaagttggcctcacctgcaactggtgtacgaattcttcctccgatttctggaatcccctgactttcagccatcagtcgccaaacggtacgttgaccagaagttcgtcctgatgctgttggaactgttcgactccgaagatcctcgcgagcgcgagtatctgaagacaatcctccaccgtgtgtatgggaagttcctcggcctgagagcctacatcagaaagcagtgtaaccatatctttctccgctttatctacgaattcgagcacttcaatggcgtagccgagcttttggaaatactgggaagtatcattaacgggttcgcactgccactgaagacagaacacaagcagtttctggtgcgcgttttgattcccctccactctgtgaaatccttatccgtttttcacgctcagctggcctattgcgtggtgcaattcttggagaaagatgcaaccctgaccgagcatgtaatcagaggcttgttgaagtattggcccaaaacttgcacgcagaaagaagtgatgtttctgggcgagatggaggaaatcctggatgtcatcgagcctagccaattcgtgaaaatccaggaaccattattcaagcaggttgcgcgatgtgtctctagtccccactttcaggtcgcggagcgggcactgtatttctggaacaacgagtacatcctgagcctcattgaggataattgtcatactgtactgcctgcagttttcgggacgctgtaccaggtcagtaaggaacattggaatcaaactattgtttctctcatatacaacgtactgaagactttcatggagatgaacggcaaactattcgacgaattgactgcctcatacaagttagaaaagcagcaggaacagcagaaagcccaagagaggcaggaactgtggcagggtctcgaggaactgagacttaggcgattgcaagggacccagggggcaaaggaggctccgttacaacgcttgacaccccaggtggcagctagtggcggacagtcctag

SEQ ID NO: 236949 - DNA, 1107 bp, Artificial Sequence
  Description of Artificial Sequence: Synthetic coding sequence
tcagttcaatctcaccctgccccacctaggccgagagagaatcctagagggagcgagtccttgccgtgtcgccttaccgctatggagactaagcttccgcctgcatctactcccacctcaccatcctcccccggtttaagccctgtgccaccccctgataaggtggatggtttctcccgtcgctcacttcggcgagctagacctcgcagatctcatagcagcagtcagtttcggtatcagtctaaccagcaggaactgacccccttacccctgctgaaggacgtcccagcatcggagcttcatgaactgctgagtcggaagcttgcccaatgcggtgtgatgtttgattttctggactgcgtggcagacctcaagggaaaggaagtcaaacgtgcagctcttaacgagctggttgagtgtgtggggagcaccagaggggtgctgatagaaccggtctacccagatattataaggatgatttccgttaacatcttccggacccttcccccatccgagaatcctgaattcgatccagaggaggatgagcctaacctggagccgtcctggccacatcttcagctcgtgtacgagttcttcctccgatttctggaatcacctgatttccaacctagcgtcgccaagcggtacgtggaccagaagtttgtgctgatgttgctggagctattcgatagcgaggatcccagagagagagagtatttaaaaaccatcttacaccgcgtgtatggtaagttcttggggctgagggcatacatacggaagcagtgtaaccatattttccttaggtttatttatgagttcgagcatttcaatggcgtggccgaattgctcgaaatactgggttccatcattaacggcttcgccctgcctcttaaaacagagcacaaacccggttcaagaccagatccaccggcactctgccaagtcgctgtctgcctgccatgccctgctggcattctctgtggcgcagtgcccggagaaggttgtcatagtgatagagcccgagatccgggagccgcacagatcctcgccaagaacctgcatcccgaaggtggcgatgtgagcgggggtgatggccgtgactcctag

SEQ ID NO: 236950 - DNA, 582 bp, Artificial Sequence
  Description of Artificial Sequence: Synthetic coding sequence
atggaaactaagctgcctcccgcatctacacccacctcgccttcatcccctggactgtctccagtgcctcctcctgacaaggtggatgggttttctaggcggagtttaagaagggcacgtcctcggagatcccactcttcctctcagttcaggtaccaatcaaaccaacaagagctcacaccgcttcctctcctcaaggacgtgcctgcctctgaactgcacgagcttctgtcacgaaagttggctcagtgcggcgttatgttcgactttctcgactgcgttgcagatttgaaagggaaggaggtgaagcgcgcagctctgaacgagctcgtggagtgcgtgggatctacacgtggtgtgttgatcgagcccgtctatcctgacataatacggatgattagcgtcaacatcttccggacattacccccttccgaaaacccagagtttgaccctgaggaggacgagccaaacctcgagccatcgtggccccatcttcagttggtgtacgagttctttctgcgcttcttagagtcacctgatttccagccttccgtagctaaacggtatgtagaccagaagtag

SEQ ID NO: 236951 - DNA, 1494 bp, Artificial Sequence
  Description of Artificial Sequence: Synthetic coding sequence
atggagaccaagctcccgccagcctcaactcccacatctccttcaagccccggtctgtccccagttcctcccccagataaggtggacggcttttccagaaggtccctcaggagagcccgaccccgtaggtcccactcgagtagccagttccggtatcagagcaatcaacaggagttgacccccctgccactgctcaaggacgttccagcctccgagctgcacgagctgctgtctcgtaagttggcacagtgcggggtcatgttcgacttcctggattgtgtggctgacctgaaagggaaagaagtgaagcgcgctgccctgaacgaacttgtggagtgtgtcgggtcaacccgcggagtgctgattgagcccgtctacccggacatcattaggatgataagcgttaatatctttcgcacactgccccctagtgaaaatcctgaattcgatccagaggaggatgaacctaacttggaaccatcatggccccatttgcaactggtctacgagttcttcttgaggtttctggagagccctgatttccagcccagcgttgccaagcgatatgtggaccagaagtttgtgttaatgctgctggaattgttcgactccgaagaccccagggagcgcgaataccttaaaaccattctgcatcgcgtttacggtaagttcttgggccttagagcctatatccgcaaacagtgtaatcatatcttccttcgcttcatttatgagttcgagcacttcaatggtgtagctgaactgcttgaaattctcggctcaataatcaacggatttgccctccccctgaagaccgaacataagcagttcctggtgagggtgttgataccactgcatagcgtaaagtccctgtctgtgttccatgcccaactggcctattgtgtggtgcagttccttgagaaggatgctactcttactgagcatgtgatacggggactgttgaagtattggcctaagacctgtacgcagaaagaagtgatgtttctgggtgagatggaggaaatcctggacgtaatcgagccatcacagttcgtgaagatccaggagccactttttaaacaggtcgcacggtgtgtgtcgtccccccatttccaggtggccgaaagggctctgtatttctggaataacgagtatattttatctctaatcgaggataactgtcataccgtcctgcccgcagtatttggcaccctctatcaggtatctaaggagcactggaaccagaccatagtgtccttaatctacaacgtactgaagacattcatggagatgaacgggaaacttttcgatgaactcactgcaagctataaacttgagaagcagcaggagcagcagaaagcccaggagcggcaggagctatggcagggactcgaggagctgcgattgcgacgcttgcagggcactcaaggggctaaagaagcgcctctgcagagactcacacctcaggttgccgcttcgggaggccagtcctag

SEQ ID NO: 236952 - DNA, 408 bp, Artificial Sequence
  Description of Artificial Sequence: Synthetic coding sequence
atggaggaactcaccgaggttatcacagccgcagaattccatcctcaccagtgtaacgtctttgtgtatagctcttccaagggcacaattcgcttatgtgacatgcggtcgagcgctctgtgtgatcgacattctaagttttttgaggagcctgaggatcccagttctaggtctttttttagcgaaatcatttcttcaattagcgacgtaaagttctcgcattctggcaggtacatgatgactcgagacccagtaggcgagggagtgggccctcaacaccgggcaggaagatggcggcctactcgctccacttccacctgtgcagcaagcagtgccctctcaatgagaactactgcaagtctgacctccctgagcgtggctggcactgtacgaatcgctccgagttag

SEQ ID NO: 236953 - DNA, 1269 bp, Artificial Sequence
  Description of Artificial Sequence: Synthetic coding sequence
ctgaccgccgacattatatctaccgtcgaattcaattacagtggtgatctgcttgccaccggggataagggaggacgcgtcgtgattttccaaagagaacaggagaacaaatctaggccgcattctaggggggagtacaatgtgtatagtacattccaatctcatgagcccgagttcgactacctaaaatcactagagattgaggagaagatcaacaagattcgatggctgccccaacagaacgcagcccattttctgctgtccacaaacgataagacaattaaactctggaagatctcagagagagacaagagagctgaaggctataatcttaaggatgaggacggcaggttgcgagatcctttcagaattacggcgctaagagtgcctatcctgaagcctatggacctgatggtagaggcttcccccagaagaatattcgcaaacgcccatacttaccatattaactcaatctctgttaacagcgaccatgagacatatctcagcgctgatgatctgcgcatcaacttgtggcaccttgagattacagatcgttcattcaacattgtcgatatcaagcctgcaaacatggaagagcttacagaagtcatcaccgcagccgagtttcacccccaccaatgcaatgtgtttgtgtacagctcaagtaaaggaacaatcaggctctgtgacatgcgaagttccgccctctgtgatagacactctaagttcttcgaggaacccgaggacccatcatctcgaagcttcttcagtgagatcatcagtagtatctcggacgtgaagttcagccactcaggcaggtacatgatgacccgggattacctgagcgtgaaggtctgggatctcaatatggagtcccgtcctgtcgagacacaccaggtacacgagtatctcaggagtaagttgtgtagcctgtacgagaacgattgcattttcgacaagtttgagtgttgttggaatgggagcgactcagctattatgaccggatcctataacaacttctttagaatgtttgaccgtgatacaaggcgcgacgtaaccctggaggcttctagagaaagctctaagcctcgcgcatctctaaagccgcgaaaggtatgtaccggaggcaagagacgtaaggacgagatatccgtcgatagtcttgacttcaataagaaaatcctgcacactgcctggcatccagtggataacgtgatcgccgtggctgccaccaacaacttgtatatcttccaagacaagattaactag

SEQ ID NO: 236954 - DNA, 1713 bp, Artificial Sequence
  Description of Artificial Sequence: Synthetic coding sequence
atgccttacaaactcaagaaagagaaggagcctccgaaggttgccaaatgcactgctaaaccgagtagctcagggaaggatggcggtggagaaaatactgaggaggcacagcctcaaccacagccgcagccacagccccaggctcagagccaaccccctagcagcaacaagcgcccttcaaattccacaccacctcctacacagctctcaaaaatcaaatactctggtggccctcagattgtcaaaaaggagctgtttattcagaaattgcgtcagtgctgtgtgctgttcgactttgtgagcgatccgctgagtgatctgaaatttaaagaggtcaagcgtgccggtctgaatgaaatggtcgagtacataacacattcccgcgacgttgtgacagaggccatatatcccgaagcagtgaccatgttcagtgtcaacttatttagaacgctgcccccaagctccaaccccacaggcgctgagtttgatccagaagaggatgagcccactctcgaggccgcttggccacacctccagttggtgtacgaattcttcttaaggttcctggagtcgcccgattttcagccaaacatcgcaaagaaatacattgatcagaagttcgtcctggctctgctggacctctttgattccgaggatccacgagagagggactttctcaaaacaattctgcaccgaatctatgggaagttcctcgggctgcgggcttacattagaaggcagatcaatcatattttctataggttcatctatgaaaccgagcatcataacggtatcgcagagctcctagagatcctgggatcaataataaacggcttcgcactgcctcttaaagaggagcataagatgtttctgattcgcgtcttactccctctacataaagtgaagtccctgagtgtataccatcctcagctggcctactgtgtcgtgcagttcctcgagaaagagagttccctcactgagcctgtcattgtgggcctactgaagttttggcccaaaacacatagcccaaaagaggtcatgtttctgaacgaactggaggaaatcctggacgtcatcgagccttccgagttcagcaaagtcatggagccgctgttcagacagctggcaaagtgcgtgagctcaccccatttccaagtggccgaaagggccctctactactggaacaatgaatacatcatgagcctgatctctgataatgctgctcgcgtgcttcctattatgttcccagccctgtatagaaattcgaaatcacactggaacaagaccattcacggcctgatatacaacgcgctaaagctgttcatggaaatgaatcagaagctgtttgacgattgtacacagcagtacaaggcagagaagcagaagggtcgatttcgcatgaaggagagggaagagatgtggcagaagatcgaagagttggcacgcctgaatcctcagtaccctatgttccgcgctccgcctccactgcccccagtatatagcatggagacagaaacccctaccgctgaagatattcaactgttgaagaggaccgtggaaaccgaagctgtccagatgctcaaggatatcaagaaagaaaaggttttgctccgcaggaagagtgagctgccacaggatgtctacactatcaaagctctagaggctcataagcgtgccgaagagtttctaacggcaagtcaggaagcattatag

SEQ ID NO: 236955 - DNA, 1491 bp, Artificial Sequence
  Description of Artificial Sequence: Synthetic coding sequence
atgccatacaagttgaaaaaggaaaaggagctgttcatccagaaacttagacagtgttgcgtgctgtttgactttgtgagcgatcccctgtctgacctgaagttcaaggaggtgaagagagccggactgaatgaaatggtggagtacatcactcactccagagacgtagtgacagaggcaatctaccccgaggccgttactatgttctccgtaaatctctttagaacgttgccgccttctagcaatcccaccggagctgagtttgaccctgaggaggacgaacctacattagaagctgcgtggcctcacctgcagctcgtgtatgagttcttcctccgatttctggaatcgcccgacttccaacccaacattgctaaaaagtatatcgaccagaagtttgtgcttgctctacttgatctatttgactcggaagaccctcgtgaaagagatttcttgaaaactatactccatcgcatttatgggaaattcctgggactgcgggcttatatccgaagacagataaaccacatattctaccgcttcatttacgaaactgaacaccacaatggcattgcagagctgctggagattctcggaagtatcatcaatgggtttgccctccctttgaaggaggaacataaaatgtttttgatacgagtgctgctcccgttgcataaggtcaagagcctgagtgtttatcatccacagttggcatattgtgtggtacagtttcttgaaaaagagtcctcattgaccgagccagtgattgtgggtttgctcaagttttggccaaagactcactcgccaaaggaggtaatgttcctgaacgagctggaggaaattctggacgtgatagagcccagtgaatttagcaaagtgatggaacccttattcaggcagcttgccaaatgcgttagctctcctcatttccaggtggccgagcgcgcactctattattggaacaacgaatatatcatgtcacttataagtgacaacgccgcaagggtcctgccaattatgtttcctgctctctaccgcaattccaagtctcattggaacaaaactattcatggactcatttacaatgcccttaaactgtttatggaaatgaaccagaaactgtttgacgactgtacccaacaatataaagccgagaagcagaagggtaggtttaggatgaaggagcgggaggaaatgtggcagaagatagaggaactggccagactgaacccgcagtaccccatgttccgcgcaccccctcccttacctccagtctacagcatggagacagagaccccaacagcagaggatattcagctgctcaaaagaaccgttgagactgaggctgtgcaaatgctgaaagatataaagaaagagaaagttctgctcagaagaaagtcagagctgccacaggatgtttatactatcaaggcactggaggctcataaaagggccgaggagttcctgaccgccagtcaggaagccttatag

SEQ ID NO: 236956 - DNA, 1515 bp, Artificial Sequence
  Description of Artificial Sequence: Synthetic coding sequence
tagaagaaggaacgtaggcaaagtagtagccgcttcaatcttagtaaaaatagagagctccagaagttgcctgctctgaaagatagtcctactcaagaacgtgaggagctgtttatacagaaattacgccagtgctgcgtgctgttcgactttgtgtcagacccccttagcgatttgaaattcaaagaagttaagagggccggtctcaacgagatggtggagtatattacacactctagggacgtcgtgaccgaggcgatctacccagaggctgtaaccatgttttctgtgaacctgtttcgcacacttccccctagctctaatcccactggagctgaatttgatccagaagaagacgagcctactctcgaggcagcctggccacatcttcagctggtctacgaattcttcttaagatttctcgagagccctgattttcaaccaaacattgctaaaaagtacatcgatcagaaattcgtcctggccttgctggatctctttgattccgaagaccctcgggaaagggacttccttaagaccattttgcatcgaatatatggaaaatttctggggctcagggcctatataaggcggcagatcaaccacatcttttatagattcatatatgaaacggagcaccataatggtatagcagaactcttggaaatactggggagcattattaacgggtttgcactgccacttaaggaggagcataagatgtttctcatccgggtcctgctccccttgcacaaggtgaagtcattgagcgtctaccacccccaggtgatcgtcgggctgctcaaattctggcccaaaactcactccccgaaggaagtgatgttcctaaatgaactggaagagatcctggacgttattgagccctccgagttctccaaggtgatggaaccgctgttcaggcagttggccaaatgcgtttcctctcctcactttcaagttgccgaaagggctctctattattggaataacgaatatattatgagccttatatcagataatgctgctcgtgtgttgcctattatgttccctgctctttaccgcaatagcaagagtcactggaataaaactattcatggacttatctataacgctctcaaactgttcatggagatgaatcagaaactcttcgacgactgcactcagcagtataaagccgagaaacagaaagggaggttcaggatgaaagaaagagaagagatgtggcagaaaatcgaggagctagccagactcaaccctcagtatccaatgttccgggctcctcctccactgccccctgtctactccatggagaccgaaactcccactgctgaagacatacaactgttgaagaggacagtcgagacggaggctgtgcagatgctcaaggatataaagaaggagaaggtactgttgcgtcggaaatccgagctgcctcaagacgtgtacacaatcaaggcactcgaggcccataagcgggctgaagagtttctaacagcttctcaggaagccctgtag

SEQ ID NO: 236957 - DNA, 1809 bp, Artificial Sequence
  Description of Artificial Sequence: Synthetic coding sequence
atgccttataagctgaaaaaagagaaggagccaccaaaggtcgcaaaatgcaccgccaaacctagctcatcgggcaaagacggtggaggagagaacactgaagaagcccagccccagccacagcctcagcctcagccacaggcacagtcccagccaccatcctccaataagagaccaagcaactcaacccctccgcctacccaactgagcaaaataaagtactctggtggccctcagatcgtaaagaaagagagacgccagtccagcagcagatttaacctgagcaaaaatagggaactgcagaaactccctgctctgaaagacagccccacccaagagcgagaagagctcttcatccagaaattacgacaatgctgcgtgctgttcgatttcgtgtctgatccactgtctgacttgaaattcaaagaggtaaaacgggcaggcctaaacgaaatggtcgagtatatcacacacagccgcgatgtcgtcactgaagctatctacccagaagccgttactatgtttagtgtcaatcttttccgaactttacccccatcatctaaccccactggagctgaatttgatccagaggaagatgagcctacgctggaggctgcctggccacacctgcagctggtttatgagttcttcctgcgctttctggagtcacctgatttccagccaaatattgctaaaaagtacatagaccagaagttcgtgttggcactcctggacttgtttgattccgaagacccacgtgagagagacttcttgaaaacgattctgcaccgtatctatggcaaattcctagggcttcgcgcatacatccggaggcagatcaatcacatcttctataggttcatctatgaaacagaacaccataacggcatcgccgagctgcttgagatattaggcagcattattaacggattcgcgctccccctaaaggaagaacacaagatgtttttgataagggtgctgttgcctcttcataaggtcaagtcactgtcagtataccatccacagctcgcttattgtgtggttcagtttcttgagaaggaatcatccctaacagagcctgttatcgtggggctgttgaagttctggcccaagacccattctccgaaagaggtaatgtttttgaacgagttggaggagatcctggacgtgattgaaccctcggagttctctaaggtcatggagcccctgtttcgacagcttgccaagtgcgttagcagtccccattttcaggtcgcggagcgagccctctattactggaacaatgagtatattatgtctctgatcagtgacaatgccgctagggtgctcccaatcatgtttcccgctctctacagaaactccaagtcccactggaacaagaccatccacgggctcatatacaacgccctgaaactgtttatggagatgaaccagaagcttttcgacgattgtactcaacagtacaaagctgagaagcagaagggtcgatttaggatgaaagaacgtgaagaaatgtggcagaagattgaggaactggctcggctgaacccacagtatccaatgtttcgcgctcccccaccactgccacctgtgtatagcatggaaacggagacccccacagcagaagacattcagctgctgaagagaaccgttgaaaccgaggctgtgcagatgcttaaggatatcaaaaaggagaaagttttgctgcgaagaaaatcagaacttccccaagacgtgtatacaatcaaagcgctcgaggcacacaaacgtgctgaagaattcctgaccgcctcgcaagaggctctgtag

SEQ ID NO: 236958 - DNA, 1755 bp, Artificial Sequence
  Description of Artificial Sequence: Synthetic coding sequence
atgccatacaaattaaaaaaagagaaggaaccacccaaagtggcgaagtgcacggccaagccgtcgtcaagtggtaaggacggaggcggagagaatacagaagaggcgcagccccagccccaacctcaacctcaaccgcaagctcagagtcagccaccttcaagtaataagagacctagcaatagcacgcccccaccaacacagctgtctaagatcaagtactctggcggacctcaaattgtcaaaaaggaacgccgtcagagcagcagccgcttcaacctgagcaagaatagagagctccagaaactgcctgccctgaaagattcccctactcaggagcgggaggaactgtttatacaaaagctcaggcaatgctgcgtcttgtttgatttcgtgagcgaccccctctctgacctgaagtttaaggaggtgaagagggctggtcttaacgaaatggttgaatatattacccactcacgggatgttgtcaccgaagctatctatcccgaagcggtgacgatgttctccgttaacctattcagaactctgcctccctcgagtaatcctaccggtgcggagtttgacccagaggaagacgagcccacactcgaggcagcttggccccacctgcagcttgtctacgaattctttctgagattcctcgagtccccagacttccagcctaatatcgccaagaaatatattgaccagaaatttgtcctcgcccttctggatctgtttgattccgaagatcctagagagcgcgactttctgaaaacgatcctgcaccgcatctacgggaagtttttgggactgagagcatacattcgcaggcaaattaaccatatcttctacagattcatctacgaaacagagcatcataatggcatcgctgaactgctcgaaatcctaggttccatcatcaatggctttgcactccctcttaaagaagagcataagatgttcctaatccgggtcctcctgcctttgcacaaggtcaagtctttatctgtgtatcaccctcaggtgattgtgggcctgcttaagttttggcctaaaacgcatagccccaaagaggttatgtttttgaacgagctggaggagatactagacgtgatagagccgtctgagttcagtaaagtgatggagcccctgtttcggcagttagctaagtgcgtgtccagtccacacttccaagtggccgagagagcattgtactattggaacaatgagtatataatgtccctgatctcggataatgcagcaagggtgttgcccatcatgtttcctgccctttacaggaactcaaaatctcattggaacaagacgattcacggcctgatatataacgccctcaagctctttatggaaatgaaccagaagctcttcgatgactgcacccagcagtacaaagcagaaaagcagaaaggtcgcttcagaatgaaggagcgggaggaaatgtggcagaagatcgaagagctggcaagattgaatcctcagtatcccatgttccgagctccaccgccattgcctcccgtttatagcatggagacagaaacacccaccgctgaagacattcaactcttgaaacgaaccgtggaaacagaagcggtgcaaatgctgaaagatattaaaaaggagaaagtgctccttcgcagaaaaagcgagctgcctcaggatgtttacacaataaaggcactggaagcccacaagcgcgcagaagaatttctgaccgccagccaggaggctctctag

SEQ ID NO: 236959 - DNA, 1404 bp, Artificial Sequence
  Description of Artificial Sequence: Synthetic coding sequence
atgtcatcggcaccaacgaccccaccgtcggtggataaagtggatgggttctcccgaaagagcgtccgcaaggccagacagaaacggtctcaatcctcctcccaattccgcagccagggcaagcccatcgagctcactcctcttcctctcttaaaagacgttccatccagcgagcaacctgaactgtttctaaagaaactgcaacagtgttgtgttatttttgattttatggacactctgagcgacctgaaaatgaaggaatacaagaggtctacccttaacgagcttgtggattatataacaattagcagggggtgtctgacagagcaaacgtaccctgaggtcgtccggatggttagttgtaatatctttcggacactgccaccatccgatagcaatgaatttgatcctgaggaagatgaacctaccctggaagcatcttggcctcacctccaactggtctatgagtttttcatccggtttctggagtcgcaagagtttcaaccatctattgccaagaagtacattgatcagaaatttgtcctccagctgctggaactctttgattccgaggatccaagagaacgtgactatctcaagacggtgttgcatcgtatttatgggaagttcctcggcctgagggcctttattagaaaacagattaataacatctttctgcgcttcgtgtacgagactgaacattttaatggcgtggctgaacttctagaaatcctgggtagtatcataaatggattcgctctaccactcaaggcagaacataagcaattcctggtcaaggttctgatccctttgcatacggtacggagcctctcactgttccatgcccagctagcatattgcatcgtgcagttcctggaaaaggatcccagcctcaccgagcccgtgatccgcggtctgatgaagttttggcccaagacttgttcacaaaaggaggtgatgtttctgggagagctggaagagatattagatgtcattgagccttcacaattcgtgaagattcaggagccactattcaagcagatagcgaaatgcgtcagttccccccacttccaggtcgccgaacgcgctctttattactggaacaacgagtacatcatgtcccttatcgaagagaacagtaatgttatcctgcctatcatgtttagtagcctctaccgcatttctaaagagcattggaatcctgcaatagttgcacttgtctataacgtattaaaagcattcatggaaatgaatagcacgatgttcgacgaacttaccgcaacctacaagagcgatcggcaaagagagaaaaagaaggagaaggaacgcgaggagttgtggaaaaagctggaagaccttgagctgaagaggggacttcgtcgagatggcataattcccacctag

SEQ ID NO: 236960 - DNA, 1176 bp, Artificial Sequence
  Description of Artificial Sequence: Synthetic coding sequence
atggacacgctgtctgacctcaagatgaaagaatataagaggtcaacgctgaacgaactggtggattacataactatttctaggggatgtctcactgaacagacctatccagaggttgtacggatggtctcatgtaatatctttagaacattgccgcctagcgacagcaacgaattcgacccggaagaggacgagcccaccttggaagcgtcctggccccacctgcaattagtttacgagttttttatcagattcctagagagccaagagtttcagccttccatcgccaagaaatatattgatcaaaagtttgtcctgcaactgttggagctcttcgacagcgaagaccccagagagagagattaccttaagactgtgttgcatagaatttatggtaagttcctcgggcttcgggcattcatccgtaaacagattaacaacatctttctgcgatttgtctatgagactgagcactttaatggcgtcgccgaattactggaaatcctaggctcgatcattaacggcttcgccctgccgttaaaagccgaacataagcagttcctcgtgaaggtgctaattcctcttcacaccgtccggagcttaagtctatttcacgctcagctcgcctactgcatcgtgcagtttcttgaaaaagacccctctcttaccgagcccgttattcgtggcctgatgaagttttggcctaaaacatgttcgcagaaggaggtgatgttcctgggcgaattggaggaaatcttggatgtaattgagccttctcagttcgtgaagatccaagaaccacttttcaagcagattgctaagtgcgttagcagtccacactttcaggtagctgagcgagccctgtattattggaacaatgagtatattatgagccttatcgaagaaaatagcaacgttattttacctatcatgttttcatcgctgtaccgaatctcaaaggagcattggaatccagcaattgttgcactagtatacaatgttctgaaggcctttatggagatgaatagcactatgtttgatgaactgaccgctacgtacaagagcgaccggcagagagagaaaaaaaaagaaaaggaaagagaggagctgtggaagaaactcgaggatctggagttgaagagaggtctgagacgggacgggatcatccccacttag

SEQ ID NO: 236961 - DNA, 1389 bp, Artificial Sequence
  Description of Artificial Sequence: Synthetic coding sequence
atgtcaagtgcccctacaactcccccttctgtggacaaggtggacgggtttagtaggaagtcagtgagaaaagcccgtcagaaaagaagtcagtcatcttcccagtttagatcccagggaaagcccatcgaactgacgccgctgccactcctgaaggatgtcccctcttctgagcaaccggaactgtttttgaaaaaactgcaacaatgctgtgtgatttttgattttatggatacccttagcgacctgaaaatgaaggaatacaaaaggtcgacgctgaacgagctcgtcgactatattactatttctaggggatgtctgaccgaacaaacgtaccccgaggtcgtgcggatggtgtcctgcaatatctttaggacactccccccttccgattccaatgaattcgacccggaagaggatgaacctacgttggaggcctcttggcctcacctccagttggtttatgaattctttattcgctttttggagagtcaggagttccagccctctattgctaagaaatatatagaccagaaattcgtcctgcagctgttagagctattcgattctgaagaccctcgagagcgagattacttaaaaacagtcctccacagaatctacggaaaattcttaggcctccgggctttcattaggaagcagatcaataacatttttctcaggttcgtctatgagaccgaacacttcaacggcgtggccgaactgctcgagatcttgggcagcatcatcaacggattcgccctcccactgaaggccgaacataagcagtttttggtgaaggtactcataccccttcacactgtcaggtcgttgagtttgttccacgcccagttggcttattgcattgtccaatttctggaaaaagacccatcactgaccgagccggttatccggggactgatgaaattctggcctaagacctgcagtcagaaggaagtaatgttccttggcgagcttgaggaaatcttggacgtcatcgagcccagccagttcgtcaaaatacaagagcccctctttaagcaaatcgctaaatgtgtcagtagcccccattttcaggtcgccgaacgcgcactgtattactggaataatgagtacataatgagtcttatagaggaaaattctaacgtcatcctgcctatcatgttcagttccttataccgcattagtaaggaacactggaaccctgctatcgtggcactggtgtacaacgtgctgaaagcctttatggagatgaattcaaccatgtttgatgaactgacagcaacctacaacgagaagaagaaagaaaaagagcgagaggaactgtggaaaaagcttgaggaccttgagctgaaacgtggcttgagaagagacggaatcataccaacttag

SEQ ID NO: 236962 - DNA, 1344 bp, Artificial Sequence
  Description of Artificial Sequence: Synthetic coding sequence
atgggtctgtccttcttctcaaagcaccttcccatacaggaggggcagccttgggcattgaaaacccccgctgacataatctcaacagtagagttcaaccatactggtgagctgctggccacaggtgacaagggaggtagggttgtcattttccagcgagagcccgagtctaaaaacgcacctcacagtcagggcgaatatgatgtctattctacattccagtcacacgagcctgagttcgactatttgaagagcttggagatagaggagaaaatcaacaagatcaagtggctaccccagcagaacgcagcacattccctgctaagtactaatgacaagacaatcaagttgtggaagatcactgaaagggacaagcgacccgaaggctacaacctaaaagacgaagagggcaagctgaaagatctgtctaccgtgacgtcactccaagtgcccgtgctcaagccgatggacttgatggttgaagtgtcgccacgtcgcatctttgccaatgggcatacataccacattaactccatttccgtcaatagcgattgtgaaacatacatgtccgcggacgatctaagaatcaatctctggcatctggcaataaccgaccgcagcttcaacattgtcgacatcaaaccagcgaacatggaggacctcaccgaagtaatcactgcatctgagtttcacccccaccactgtaacctgttcgtgtatagttcatccaagggctctctcaggctgtgtgatatgagagccgcagctctctgcgataagcacagtaagctgttcgaagaacccgaggatccctctaatcgcagtttcttttcggaaataatctcctctgtgtcagacgttaagttctcccactcagggaggtatatgcttactagagattacttaaccgtcaaggtttgggacctgaatatggaggcaaggccaatcgaaacataccaagtgcatgactatttgaggagtaagttatgcagtctctatgaaaatgactgcatttttgacaaattcgagtgcgcatggaacggatctgatagtgtaatcatgacaggagcatacaataacttcttcaggatgttcgaccggaatacaaagcgggacgtgaccttggaggcaagccgggaaagcagcaaaccgagagccgtactcaaacccaggcgcgtgtgcgtggggggaaaacgtaggcgagatgacatcagtgtggatagtctggacttcacaaaaaagatcctccacaccgcctggcaccctgccgaaaatatcatcgctattgccgcaactaacaacctgtacattttccaggacaaagtcaatagcgatatgcattag

SEQ ID NO: 236963 - DNA, 1344 bp, Artificial Sequence
  Description of Artificial Sequence: Synthetic coding sequence
atgggcgaggatacggatactcggaaaatcaaccactcgttcctgcgggaccactcgtatgtcactgaggctgatatcatcagcaccgtcgagtttaatcataccggtgagctgctggctacaggggacaagggcggaagagtggtcatttttcaaagagagcctgagtccaagaacgcacctcactcccagggggagtatgatgtgtacagcacctttcaatcacacgagcccgaattcgattacctcaaaagcttggaaatcgaggagaagattaacaagatcaaatggctcccacagcagaacgctgcacacagcctcctgagcacaaacgacaaaaccattaagctgtggaagataacagagagggacaagcgcccagagggctacaatctgaaggacgaggaggggaagctaaaggatctgagtacggtgactagcttgcaggtgcccgtgctcaagccgatggacctgatggtggaagtttcgccaagacgcatttttgccaacggtcacacctaccatataaactccatctctgtgaactccgattgtgaaacctacatgagcgctgatgaccttaggattaatctctggcatctggctattaccgataggtcgtttaacatcgtcgacatcaaacccgcaaatatggaggatctgacggaagtcataacggccagcgaattccatccccatcattgtaacctcttcgtgtactcaagctcgaaaggctccctgcgcttgtgtgacatgcgggcagcagccttgtgtgataaacacagcaaattgtttgaagaaccagaggatccgtcaaaccgctctttctttagtgaaattatatctagcgtgagtgacgtgaagttttcccacagtgggaggtacatgttgacgagggattacctcactgtgaaggtgtgggatctgaacatggaggctaggccaatcgaaacttaccaggtccatgattacctgaggtcgaaactttgcagtctctacgaaaatgactgtatcttcgacaagttcgagtgcgcttggaacggtagtgattcggtgattatgactggtgcatacaataacttcttccggatgttcgataggaataccaagcgggatgtgaccctcgaagcatctagagagtcctccaaaccccgtgccgtgttgaagcccaggcgagtgtgcgttggtggcaagcgacgacgtgacgatatcagtgtggactccctcgactttaccaaaaagatcctgcataccgcatggcacccagcagagaacattattgcaattgccgctacaaacaatttgtacatatttcaagataaggtgaatagcgatatgcattag

SEQ ID NO: 236964 - DNA, 1323 bp, Artificial Sequence
  Description of Artificial Sequence: Synthetic coding sequence
atgcgagaagcggatacactccgcccacctcagctgatggaagtgagcgctgacattatttcaaccgttgagtttaaccataccggtgagctgttggcgactggggataagggcggtagagttgtgatcttccagagagagccagagagcaagaatgcacctcactctcagggggagtatgatgtgtattccactttccaatcccacgagccagagtttgattatctcaaatctctggagattgaggagaagatcaacaagatcaagtggctcccacaacagaacgctgcccattctctcctgagtactaacgacaagacaatcaagctgtggaaaattactgaaagggacaagcgtccggagggctataatctcaaggatgaagagggtaagttaaaagacctgtctaccgtgaccagtctacaggtaccagtgctcaaacctatggacctgatggttgaagtgtctcccagaaggatttttgcaaacgggcacacttaccacatcaacagcatctctgtcaacagcgattgcgaaacatacatgagtgccgacgatttgcggattaatctttggcacctagccatcaccgatagatcatttaacatagtggatataaagcctgccaatatggaggaccttacggaggttattaccgcctcggaattccacccccaccattgcaacctgttcgtctactcttcatctaaaggatccctgcgattatgcgatatgcgcgcagcagcactctgcgacaagcattcaaaactgttcgaggaacccgaagatccttctaacaggagttttttctccgaaatcatctcttccgtcagtgatgtgaaattcagccatagcggaaggtacatgcttacccgggattatctgacggtcaaggtctgggatctaaatatggaagccaggcccatcgagacctaccaggtacatgactatctacggagcaagctttgctctctgtacgagaacgattgtattttcgacaaatttgaatgtgcatggaacggctccgacagcgtcatcatgacaggcgcatacaataatttcttccgcatgtttgacagaaacacaaaacgcgacgtgaccttggaagctagtcgggagtcatctaaaccgcgagctgtactcaagcccaggcgagtgtgcgtgggaggtaaacgcaggagggacgacatctctgtggattctctggattttacaaagaaaattctccacacggcctggcaccccgcagagaatatcatagcaatcgctgccacgaacaatctctacatattccaggataaagtcaatagcgatatgcattag

SEQ ID NO: 236965 - DNA, 1323 bp, Artificial Sequence
  Description of Artificial Sequence: Synthetic coding sequence
atgagggaggctgacaccctgcggcctccgcagctgatggaggtatcggccgatattatcagtactgtggagtttaaccacaccggcgaacttctcgcgactggagacaaaggaggtagagtcgtcatttttcagcgggaaccggagtcgaagaatgcccctcacagtcagggagaatatgatgtctacagtacatttcaatctcacgagcccgagttcgactatctgaaatctttagaaatcgaggaaaagatcaataagattaagtggctcccccagcagaacgctgcccattctctactctccactaatgacaagactattaagctatggaagattacggaacgggataagcgtcctgaggggtacaacttaaaggatgaggaggggaagctcaaggacctgagtaccgttacttccttgcaggtcccggtgctcaagcctatggacttgatggttgaagtctccccaagaaggatttttgccaacggccacacgtaccatataaacagtatttccgtcaatagcgactgcgaaacatatatgtccgccgacgatctcaggattaacctctggcacctcgcgatcaccgataggtcatttaatatagtcgacatcaagccagccaatatggaggacctcacagaggttatcacggcaagcgagttccatccccaccactgcaacctctttgtgtattcctcgtccaaaggctcattacggctctgtgacatgagagccgcagcactatgtgacaagcattccaagctgttcgaggagcccgaggacccaagcaatcgcagtttcttcagcgaaatcatctccagcgtgagtgacgtcaagttcagccatagtggtcgctacatgctgacaagagattacctgacggtcaaagtctgggacttgaacatggaagccagaccaatcgaaacttatcaggtacatgattatttgaggtcaaagctctgcagcctgtatgaaaacgactgcatcttcgacaaatttgaatgtgcctggaacggcagcgatagcgtgataatgacaggggcatacaacaacttcttcaggatgttcgaccggaacaccaaacgcgacgtgacactagaagcaagtcgcgagagctctaagccacgtgctgtcctgaaacccaggagagtctgtgttgggggaaagcgccgacgcgatgacatctccgtagacagccttgattttactaaaaagattttacacaccgcatggcacccagcggagaacatcatcgccattgccgctaccaataatctctatatctttcaggacaaggtcaatagtgatatgcactag

SEQ ID NO: 236966 - DNA, 1293 bp, Artificial Sequence
  Description of Artificial Sequence: Synthetic coding sequence
atgggtaaacgcgacacagcggatatcatttctaccgtggagttcaatcataccggggagcttctggcgacaggcgacaagggtggcagagtcgtgatttttcagcgcgaaccagaatccaaaaacgcaccccattcccagggtgaatacgacgtttatagcacttttcaatctcacgagcccgagtttgattatctcaaatcactcgaaattgaggaaaagataaacaaaattaaatggctcccacagcaaaatgctgctcactctttgctgagcaccaatgacaaaactattaagctgtggaagattacggagagggacaagcgtcctgagggatacaatctgaaggatgaagagggcaaactaaaggacctgagtacggtcacttccctgcaggtcccggtgctcaaaccaatggatctgatggtggaagtgtcaccacggagaatttttgctaacgggcacacctaccacatcaactctatatccgtgaattctgattgtgaaacatacatgtcagccgacgatctgcgaataaacctctggcaccttgctataactgacaggtccttcaatattgtggatataaagcccgctaacatggaagatcttacagaagtgatcacagcctcagaattccaccctcatcattgtaatctgttcgtatactcatcctcaaaggggtctttaaggttgtgtgacatgcgtgccgctgccctgtgtgacaagcactcaaaactgtttgaagagccagaagacccctccaatcgatcctttttttctgaaattatcagcagcgtgagtgacgtgaagtttagccacagcggcaggtatatgcttacaagagattaccttactgttaaggtttgggatctgaatatggaagctagacctattgagacctaccaggtgcatgattatctgaggtcaaaactttgctctctctacgagaacgactgcatattcgataagttcgaatgcgcttggaatgggtccgattccgtaataatgacaggggcatataacaatttctttagaatgttcgatcggaacacaaagagggacgttacactggaagcctcacgggagagctctaagccgagggccgtgctcaaaccaaggagggtttgtgtcggcggaaaacggcgtcgcgacgatataagtgttgatagccttgatttcacaaagaagatcttgcacacagcttggcaccctgctgagaacatcatcgcgatcgctgctacgaacaatctgtatatcttccaggacaaggtgaactctgacatgcactag

SEQ ID NO: 236967 - DNA, 1623 bp, Artificial Sequence
  Description of Artificial Sequence: Synthetic coding sequence
atgcctaacaagaataagaaggagaaggaatcaccgaaagccggaaagtcagggaaatcatccaaagagggtcaggatactgtggaatccgagcagatatcagtgcggaagaacagtctggtcgctgttccatccactgtaagcgcgaagatcaaggtccccgtgtcccaacctattgtaaagaaggacaaacgacagaacagttctagatttagtgctagcaataatagggagctccagaagttgccttctctgaaagacgtgccgccagcggaccaggagaagctctttattcagaaactccgccagtgttgcgtgctgtttgatttcgttagcgacccactgtctgatttaaaatggaaggaagtgaagcgcgcagccctgagcgaaatggtggagtacatcacacataaccgtaatgtaattacagaacccatctatccagaggtcgtgcatatgttcgcagtgaacatgttccgtacactgccccctagttccaacccaaccggtgccgaattcgatcccgaagaagatgaaccaacgctggaggccgcatggccacacctgcaactggtatacgagttttttttgcgttttctagagagcccagatttccagccaaatattgccaaaaaatacattgatcagaagttcgtgcttcaacttctggagctgtttgactcagaggaccccagggagcgggatttcctgaaaacaacgctccatcggatttacggtaaattccttggcctcagggcctacatccggaagcaaattaacaatattttctacagatttatctacgaaaccgaacatcacaacggcattgcagaactgctcgagatcctggggtccatcatcaatggttttgcactgccactgaaagaggaacataaaattttcttgctcaaggttcttctgcccttacacaaagtcaagagcttatccgtgtaccacccacagctggcgtattgtgtggtgcagtttctcgaaaaggactctaccctgacagagccagtagtcatggctttgctgaagtattggccaaaaacccactctcctaaagaagtaatgttcctcaacgaactcgaagagatcctcgatgtcatagagccgagcgagtttgtgaagattatggaacctctcttccgccagctggccaagtgcgtaagtagccctcattttcaggttgcagagcgcgctctgtactattggaataacgaatacatcatgtctctgatctcagacaatgcagccaaaatcctgcccatcatgttcccaagcctctacaggaattctaagactcactggaacaagaccattcatggcctcatttataacgccctcaaacttttcatggagatgaaccaaaaactcttcgatgactgtacccagcaatttaaggctgaaaaactcaaggaaaaactgaaaatgaaagagcgggaagaggcttgggtgaaaatcgaaaatctcgctaaagcgaatccacaggcccagaaggaccctaaaaaagataggccgctggccagacggaagtccgaactgccacaggatccgcacaccaagaaggccctggaggctcactgtagagccgacgaactcgctagccaggacggccgttag

SEQ ID NO: 236968 - DNA, 1575 bp, Artificial Sequence
  Description of Artificial Sequence: Synthetic coding sequence
atgctgacctgcaataaggcagggagtcgcatggtggttgatgcagccaatagcaacgggcctttccagcccgtagtgttgctacatatccgagacgtaccaccagctgaccaggagaaactgttcatccagaagctgcggcaatgttgtgtgctgttcgatttcgtcagcgacccactgagcgaccttaaatggaaggaggtaaagagagctgccctttcagagatggtcgagtacataactcacaacaggaatgtgatcaccgaaccaatctatcccgaggttgtgcatatgttcgccgttaatatgtttagaacgcttccgcctagctcgaacccgactggagctgagtttgacccagaagaggatgagcctaccttggaggcggcttggccacacctgcagctcgtatacgagttctttttacgttttctggagtcccctgatttccagcccaatattgcaaagaaatatattgatcagaagtttgtcttgcagcttctagagctctttgactccgaggacccgagagagagggacttcctgaagaccaccctgcatcgcatatatggcaagtttctcgggctaagggcttacatccgcaaacaaatcaataacattttctaccgctttatctacgaaaccgagcatcataacggtattgccgaacttctggagatccttggttccataataaatggattcgcccttcctctgaaagaggagcacaagatctttctgttaaaagtacttctgcccctgcacaaggtgaaaagtctgagcgtatatcaccctcagctggcctactgcgtcgtgcagttcctcgaaaaggattctacacttaccgagcccgtcgttatggctctgttaaaatactggccaaaaacgcatagcccaaaagaggtgatgttccttaatgaacttgaagagattctggacgtaattgaaccctctgaattcgtgaagatcatggagccactgttccgccaactagccaagtgcgtgtccagccctcacttccaggtggccgagagggcgctatattattggaacaatgagtacatcatgagcctgatctccgacaacgctgctaagatcttacctatcatgttccctagtctgtaccggaattccaaaacccattggaataagactatccacgggttgatttacaatgcccttaagcttttcatggaaatgaatcagaaactgttcgatgattgcacacagcagtttaaggccgagaaacttaaggaaaaactcaagatgaaggaaagggaggaagcatgggtgaagatcgagaatttggctaaggccaatccacagtacacagtctatagccaggccagcactatgtccatcccagttgccatggagacggatggccctctgtttgaggatgttcaaatgctgcgcaagactgtcaaagatgaggcgcatcaggcccagaaggatcccaagaaagaccgtccccttgcccgaagaaagtctgagctgccacaggacccccacacgaaaaaggcactcgaagcccattgccgagccgacgagctagcatcccaggacgggcgatag

SEQ ID NO: 236969 - DNA, 783 bp, Artificial Sequence
  Description of Artificial Sequence: Synthetic coding sequence
atgttccggacattgcccccttctagtaatcccaccggtgctgagtttgaccccgaggaggacgagccaaccttagaagccgcatggccgcatttacagttagtttacgaattctttttgcgttttttagagtcacccgatttccagcctaacattgctaaaaaatacatcgatcagaagtttgtgttacagctgctcgagctgtttgatagtgaagaccctcgcgaaagggatttcttgaaaaccactctccaccgaatatacggaaagttcctcgggctgcgggcttacattagaaaacaaattaataacatattttaccggttcatctacgaaaccgagcaccacaatggcatcgcagaacttttggaaatcctaggcagcattatcaatggtttcgctttgccgcttaaagaagaacacaagatctttcttctcaaggtgctgctcccgttgcataaggttaaatccctgagcgtgtaccaccctcagctcgcgtactgtgttgtgcagtttcttgaaaaggatagcactttgacagagccggtggttatggcactgctgaaatactggccaaaaactcacagccctaaagaagtaatgttcctgaatgagcttgaggagatcttagacgtgattgaaccttccgaattcgtgaaaatcatggaacccctcttcagacagctggcaaagtgtgtgagtagccctcatttccaagacaatacgtggcttgatatccagaggccagaagccctgcacggcgacgaaccgaaagccatctag

SEQ ID NO: 236970 - DNA, 1458 bp, Artificial Sequence
  Description of Artificial Sequence: Synthetic coding sequence
atgttgacatgcaataaggctggttcacgcatggtggtggatgccgcaaattccaacggtccttttcagcctgtcgtgttgctgcacatcagggacgtgcctccagctgaccaagagaaactatttattcagaagctgcggcagtgttgcgtgctgttcgactttgtctccgaccctcttagtgacctgaaatggaaggaagtgaagcgggcagccttgagcgaaatggtcgagtacatcacccataacaggaatgtcatcaccgaaccaatttaccccgaggtggttcatatgtttgccgtcaacatgttcaggaccttgccaccatcatcaaacccaactggggcagagttcgacccagaggaggacgagcctaccctagaggctgcgtggccccatctccaactggtgtacgaattctttctgaggttcctggaaagcccagacttccagcccaacatcgccaaaaaatatattgatcagaaatttgtgcttcaactcctagagctgttcgatagcgaggacccacgggagcgggattttctcaagactacacttcatagaatatatgggaaatttctcggcctgcgagcctatatccggaaacagataaacaatatcttttatcgattcatctatgagacagaacatcacaacggcattgcagagttgttggagatcctgggtagcatcatcaacggattcgccctgcctctcaaagaggaacacaaaatctttctgcttaaggtgctcctgccactccacaaggtgaaaagcctctcagtatatcacccgcaattagcgtactgtgtagtgcagtttctggaaaaggatagcaccctgaccgagcccgtcgtgatggcattgctgaaatactggccaaaaacccactcccccaaagaggtcatgtttctcaatgagctcgaagaaattttagacgtcattgagccatctgagttcgtgaagattatggagccgctcttcaggcagttggcaaagtgcgtgagctccccccatttccaggtggcagagcgagccctttactactggaataacgagtacatcatgtcgctgatatctgacaacgcagctaagatccttcctattatgttcccaagtttatatcgtaacagcaagacccactggaataaaaccatacacggtctcatctacaacgccctgaagctttttatggaaatgaatcagaagctttttgatgactgtacgcagcagtttaaagcagagaaattgaaagagaaacttaaaatgaaagaacgagaggaggcttgggttaaaatcgaaaatctcgccaaggcaaacccgcaggctcagaaggaccccaagaaagacaggccacttgctcgtagaaaatctgagctacctcaggatccacacacaaagaaagccctagaggcccattgcagagcagacgagctggccagccaggacgggcgatag

SEQ ID NO: 236971 - DNA, 1668 bp, Artificial Sequence
  Description of Artificial Sequence: Synthetic coding sequence
atgccaaacaagaataagaaagagaaggagagccccaaagcaggaaaatccggtaagtccagtaaggaaggccaagacacagtggagagtgagggcacaagtcccgaagagcccagttcacctaaggtgccccctccactcctccccgagctcctagtgctcatatttggcggactccaggggagagatgtgccacctgcagatcaggagaaattgttcattcaaaagttgcggcagtgttgcgtactatttgactttgtctccgacccattgagtgacctcaagtggaaggaggtcaagcgcgctgccctttcagagatggtggagtatataacacataaccggaatgtgatcaccgagcccatctacccagaggtggtgcacatgttcgctgtgaatatgttccgtactcttcctccctcctctaatcccaccggagctgagtttgatcccgaagaggacgagcctaccttggaagccgcatggccacacctccaactggtctacgagttttttttgagattccttgagagcccagactttcagccaaatatcgccaaaaagtacatagatcagaaattcgtacttcagctgctggagctttttgacagtgaggacccaagagagagggacttcctgaaaacaaccctccacaggatctatggaaaattcctggggctgagggcatacattcggaaacaaatcaataatatattttatcgtttcatatacgaaactgaacaccacaatgggatcgccgaactcttagagatcctgggcagcatcataaacggctttgcactcccccttaaggaagaacacaaaattttcttactgaaggtgctcctgccactgcataaggttaagagcctgtccgtgtatcatccacagctagcctactgcgtcgtgcagtttcttgaaaaggacagtacactaactgaacctgtcgtgatggcattactcaaatattggcctaagactcacagccccaaggaggtgatgtttctcaacgaactggaggagatactggacgtcatcgaaccatccgagttcgtgaagatcatggaacctttatttaggcaacttgcaaagtgtgtgagcagtccccactttcaggtggccgagagagctttgtactactggaacaatgaatacattatgagcctcataagcgacaacgcagctaagattcttccgatcatgtttcctagtctctacaggaattccaagacacactggaacaaaaccatccatggccttatatataacgccctgaagctgtttatggagatgaaccagaagctgttcgatgactgcactcagcagttcaaggcagaaaaattgaaggaaaaactgaaaatgaaggaacgcgaggaagcatgggtgaaaatcgaaaacctggccaaggcgaacccccagtacaccgtgtacagccaggcctcaacgatgtccatccccgttgctatggaaactgacgggcctctgttcgaggatgtacagatgcttaggaagaccgttaaagacgaagcccaccaggcccagaaggatccaaagaaggataggcccctggcgcgaagaaagtcagagttaccccaggatccccacactaagaaagccctggaggcacattgcagagccgacgagctggccagtcaagatgggaggtag

SEQ ID NO: 236972 - DNA, 1350 bp, Artificial Sequence
  Description of Artificial Sequence: Synthetic coding sequence
atgttgacttgcaacaaggctggctcgcggatggtggtcgatgctgcgaattccaatggcccttttcagccagtagttctcctccacatccgagatgttccacccgcagaccaagagaagttgttcatccagaagttaaggcagtgttgcgtactgtttgactttgtatctgaccctctgagcgatcttaagtggaaagaggtcaaacgcgcagcgctttccgagatggtcgagtatataacgcataaccgaaacgtcattacagagcctatataccctgaggtcgtgcatatgttcgccgtcaatatgttccgcaccctgccaccctcctctaacccaactggggctgagtttgatcctgaggaagacgaaccaactctggaagctgcctggccacacttgcagctggtctacgagttcttcctgcggtttctggagtcgcctgattttcagcctaatattgccaaaaagtacatagaccagaagtttgtcctgcagctgttggagctgtttgactcagaggatcctagagagcgcgacttccttaagacaaccctgcacaggatctacggaaagtttcttggtctcagagcctatattcggaaacaaataaataatattttttacaggttcatatatgaaacagagcatcataatggcatagccgaattactcgaaatcctgggttccattatcaatggcttcgccctgcccctgaaagaagagcacaagatctttctgctcaaggtgctgcttcctctacataaagttaagagtctgtctgtataccacccgcagttggcttattgcgtcgtgcagttcctggagaaagactcaacgttgaccgaaccggtggtgatggcactgctgaaatattggcctaaaactcatagtccaaaagaggtaatgttcctcaacgaattggaggaaattttggacgtgatcgaaccttccgagtttgtcaaaattatggaacccttgtttcggcagcttgcaaagtgcgtgagtagtcctcacttccaagtggccgaacgagccctatattattggaacaacgaatatattatgagcctcatctcggataatgccgcaaagattctgcctattatgttcccctccctttatcggaactcaaaaacccattggaataaaacaattcacgggttgatttacaatgcactgaagctgttcatggaaatgaaccaaaaactgtttgatgactgcactcaacagtttaaagctgagaagctgaaagagaaactcaaaatgaaggagcgcgaggaagcatgggtcaaaatcgagaatctggctaaagccaacccccaagttttgaaaaagcggatcacctag

SEQ ID NO: 236973 - DNA, 1155 bp, Artificial Sequence
  Description of Artificial Sequence: Synthetic coding sequence
atgctgacctgcaataaggccggatcaaggatggtcgtggacgctgcaaacagtaacggcccatttcagcccgtggtgctgcttcacattagagatgttcctcctgcagatcaggagaagctttttattcagaagctgagacagtgctgtgtcttattcgatttcgtcagtgatcctctttctgatctcaaatggaaggaggtaaaaagagccgcattaagcgagatggtggagtatatcacacataacaggaatgtaatcaccgagcctatctatcctgaggtcgttcacatgtttgccgtgaacatgtttaggacacttcctccctcttccaaccccaccggcgctgagtttgacccagaagaggacgagccgacgctcgaagctgcctggccccatcttcagctggtgtacgagtttttcctacgctttctggagagtccagactttcagccgaacatcgccaagaaatacattgaccagaagttcgtgctccagctgctggaattattcgatagcgaggacccaagggagcgtgatttcctcaaaacaacgttacaccgaatatacggcaagtttctgggactcagggcctacattcggaaacaaatcaataacatcttttatagattcatttatgagacagaacatcacaacgggatcgccgaactcctcgagattttgggctcaataattaacggattcgcactgcccctgaaagaagaacataaaatattcttattgaaggttctattacccctgcataaggtcaagtcgctgtctgtgtaccacccacagctggcttattgtgtagtccagttcctggaaaaagactctactctgactgagcctgtcgttatggccctgctgaagtactggcccaaaacacattctcccaaggaagttatgttcctcaacgagctggaagagatcctggacgttatcgaaccgtcggaattcgtgaaaatcatggagcccttgtttaggcaacttgccaagtgtgtatcttctccccatttccaggtggccgaacgtgcgctctactattggaacaatgagtacatcatgtctttaatctccgataacgctgctaaaatcctgcccatcatgtttccttctctatataggaattcaaagacccactggaacaaatag

SEQ ID NO: 236974 - DNA, 1662 bp, Artificial Sequence
  Description of Artificial Sequence: Synthetic coding sequence
aataaaaataaaaaagagaaggagtcacccaaagccggtaaatctggcaaaagctctaaagagggccaggacaccgtcgagagcgaaggtacttccccagaggaaccatcaagtcctaaggtaccccctcccctcctgcccgagttgctcgttctgattttcgggggtctacaggggcgagatgttcctcctgccgatcaggaaaagttgttcattcagaaacttagacagtgttgcgtcttattcgactttgtctccgatccactatctgacctgaagtggaaagaggtcaaacgagcggctttgagtgagatggtagagtatataacccacaatcggaatgtgattaccgaacctatttacccggaggtggtgcacatgtttgccgtaaacatgttccgcacccttcccccttctagtaaccctacaggtgctgagttcgatcccgaggaggatgagcccactctggaggctgcttggccacacctccagctcgtatatgagttcttcttgcggtttctcgagtctccggattttcagcccaatatcgctaagaagtatattgatcagaagtttgtgcttcagttgcttgagctgtttgatagtgaagatccacgcgagcgcgacttcttgaagaccacactacataggatttacgggaaattcctgggactgagggcctatatcagaaagcaaatcaacaatattttttaccgttttatctatgaaaccgagcaccataacggaatagcggaattgttggaaatcctcggttccattatcaacgggtttgcactccctcttaaagaagagcacaaaatttttttactaaaagtgctcctgcctttgcacaaggtcaaaagtctttctgtataccatccccagctcgcctactgtgtcgtgcagtttttggaaaaagactccacattaactgaacccgtcgtgatggcactgctaaaatactggcctaagactcactctccaaaagaagtcatgtttcttaacgagctggaagagatattagatgtgattgagcctagtgagtttgttaaaattatggaacctctgttccgacagctcgctaagtgtgtatcttccccccatttccaggtggcagaaagagcactgtattattggaacaacgaatatatcatgagtcttatttcagataacgccgctaagattctgcctataatgtttccaagcctctatagaaactccaagactcattggaacaaaacaatccacggtctcatttataatgctttgaagctgttcatggagatgaaccaaaaactgttcgacgactgcacacagcaattcaaggcggagaaactgaaagaaaaattgaagatgaaggaaagggaggaagcctgggtgaaaatcgagaacttagctaaagcgaacccgcagtacactgtttactcccaggcatcgaccatgtcaatccccgttgctatggagacagatggcccactctttgaagacgttcagatgctgcgcaagacagttaaagatgaagcacaccaagctcagaaggaccccaagaaggatcggcctcttgccagacgtaaaagtgaactcccacaggacccccacactaagaaagctctagaagcccactgtcgagcagacgagctggcatcccaggatggacgttag

SEQ ID NO: 236975 - DNA, 1077 bp, Artificial Sequence
  Description of Artificial Sequence: Synthetic coding sequence
atggctgagggggaacgccagcctcctccggactctagtgaggaggccccacccgcaacgcagaacttcatcatacccaagaaggaaattcacactgttcccgacatgggaaagtggaaacgttctcaagcatatgcggactacatcggttttatcttgacacttaacgagggcgtgaaaggcaaaaagctcacttttgagtacagggtgtctgagatgtggaacgaagtccacgaggagaaagaacaggctgcaaaacaatcagtatcctgcgacgagtgtataccactgcctagggccggacactgtgccccatccgaggccatcgaaaagttagtggcattgctgaatacactggaccgatggatcgacgagactccccctgtagatcagccaagccgctttggcaataaggcatatagaacctggtacgctaagttagacgaagaggctgagaatttagtggctacagttgttcctactcatttagctgcggctgtacccgaagtagcggtgtatctaaaagaatctgtagggaatagtacgaggatcgactacggcacaggccacgaggccgctttcgcagccttcttgtgttgtctgtgtaagatcggggtgctgcgtgtggacgaccaaatcgctatcgtgttcaaagtatttaacaggtatcttgaggtgatgcggaagctgcagaaaacctacaggatggaaccagcgggatcccagggcgtgtgggggctcgacgacttccagtttctgcctttcatatgggggtcttctcagctcattgaccacccctatctggaaccccgacacttcgtggatgagaaagcggttaatgagaaccacaaggattacatgttcctcgaatgtatcctttttatcacagagatgaagactggcccattcgctgagcacagtaaccagttgtggaatatttctgcagtcccctcatggtctaaagttaaccagggcctgatccgcatgtacaaggccgagtgtttggagaaattcccggtgattcagcacttcaaattcggttcccttctgcctatacacccagtgacatccggctag

SEQ ID NO: 236976 - DNA, 990 bp, Artificial Sequence
  Description of Artificial Sequence: Synthetic coding sequence
atggccgaaggggagcgccagccaccacctgattcatcagaagaggcacctcccgctacgcagaacttcatcattccaaaaaaagagattcacaccgtacctgacatgggaaagtggaagagatctcaagtgcctttcggtaccgtagcctatgccgactatatcgggtttattctgaccttgaatgagggtgtgaagggaaaaaagctaacattcgagtatagagtaagcgaggctatagagaaattggttgcactgctcaatactctagacaggtggatcgatgagactccccctgtggatcaaccctccagattcgggaataaagcataccggacatggtacgctaagctggacgaggaagctgagaacctggtggcaacggttgtgccaacccacttggcggcagccgtacccgaagttgctgtgtatttgaaggagagcgttggaaacagtactcgtattgactacggcacgggtcacgaggccgcttttgccgcattcctgtgctgcctgtgcaagatcggtgtcctgcgagtagacgaccagatagctatagtgttcaaggtgtttaacagatacttggaagttatgcgaaagctgcagaagacctatcgcatggaacctgccggatcccaaggagtatggggcctggatgactttcaattccttccattcatctgggggtcttctcagctgatcgaccacccttatctggaacctcgccatttcgttgacgagaaggctgtgaacgaaaaccacaaagattatatgtttctggagtgcatattgttcattaccgaaatgaagaccggccctttcgcagagcactccaaccaactgtggaacatttccgcagtaccttcctggtctaaagtaaaccagggcctaattcgaatgtataaggcagaatgcctggaaaaatttcccgtgattcaacatttcaaattcggatctttgctgcctatccaccccgtaacatccgggtag

SEQ ID NO: 236977 - DNA, 846 bp, Artificial Sequence
  Description of Artificial Sequence: Synthetic coding sequence
atggctgagggggagagacagcccccaccagactcctcagaagaagcacccccagctacacagaacttcattatacccaagaaggagatccacacagtgccagatatgggcaaatggaagagaagccaagcttacgccgattatatagggtttatcttgactttaaatgaaggtgttaaggggaagaaattaacgtttgaataccgcgtaagcgaggaagccgaaaacctggtggccacagtggtgccaactcatcttgccgctgcggtgcctgaagtcgccgtgtacctaaaagaatctgttggaaattccacaagaatagactacggaactggtcacgaagctgcctttgccgcattcctctgctgcctatgtaagatcggggttcttagggtggatgaccagatcgcaattgtgttcaaggtattcaacaggtacttggaagttatgcgtaagctgcagaaaacttatagaatggaaccagccggttcccagggagtttggggtctggacgatttccagtttctcccctttatttggggctcaagtcagctgatagatcacccgtacctggagcctaggcatttcgttgacgagaaagccgtcaatgaaaaccacaaggactatatgtttttagagtgcattctttttattaccgagatgaagacaggcccatttgctgaacactcaaaccagctgtggaacatcagcgcagtgccatcctggtccaaagtgaaccagggcctgatccgcatgtacaaggcggaatgcctggaaaagttcccagtgatccaacacttcaaatttggctctctccttcctattcacccagttaccagtggctag

SEQ ID NO: 236978 - DNA, 885 bp, Artificial Sequence
  Description of Artificial Sequence: Synthetic coding sequence
atggctgagggtgagaggcaaccacccccagacagtagcgaggaagcccctcccgcaacccagaactttattataccaaaaaaagagattcacaccgtgccggatatgggtaaatggaagaggtcccaggctattgagaagctggtagccctgcttaacactctagacaggtggatcgacgagacccctccagtggatcaaccctcacgctttggcaacaaagcttacaggacgtggtacgcgaagctcgatgaggaggccgaaaatctagttgctacagtggtccccactcacctggctgcagccgtgcccgaagttgcggtgtacctgaaggagagtgtgggaaatagcaccaggattgattacggcacaggacatgaggccgctttcgcggcttttctgtgttgcttgtgcaaaatcggtgtcctccgggtagacgatcaaattgccatcgtcttcaaagtctttaatagatatctcgaggtcatgcggaagctgcagaaaacataccgaatggaaccagctggctcacaaggcgtttggggcctggacgactttcaatttttacccttcatttggggttcaagccagctcattgaccatccctatctggagcctcgccatttcgttgacgagaaggctgtaaatgagaaccacaaggattacatgtttctggaatgtatcctcttcattacggagatgaagaccggcccttttgccgagcacagtaaccaactctggaatatatccgctgtgcctagctggtcaaaggtgaaccagggtctgattcgaatgtacaaggccgagtgcctggaaaagtttcccgtgatccagcacttcaagtttgggtctttactgcccattcacccagttacttctgggtag

SEQ ID NO: 236979 - DNA, 972 bp, Artificial Sequence
  Description of Artificial Sequence: Synthetic coding sequence
atggcagagggcgaaaggcagccgcctcctgactcttctgaggaagccccacccgcaactcagaatttcataattccaaaaaaagaaattcacaccgtccccgatatgggcaaatggaagaggagtcaggcctatgctgattatatcgggttcattcttactcttaacgagggcgtgaaaggaaaaaagttgacattcgagtatcgggtgagcgaagccatagagaagctagttgccctcctgaatacgctcgaccggtggatcgacgagaccccccctgttgatcagcccagcaggttcgggaataaggcttatagaacttggtacgccaaactggacgaggaagcggagaacctggtcgccacagtggttccgacgcacctagctgccgcagtgcccgaggtcgcagtgtaccttaaagagtcagtcggaaattctactaggattgactatggcaccggccacgaagctgcctttgctgcctttttgtgctgcctatgtaagataggggtgctgcgggttgacgatcaaattgccattgtatttaaggttttcaaccgttatttagaagtaatgcgcaagctgcagaagacatatcgaatggagccggctggatcccaaggcgtctgggggctggacgacttccagttcttgccatttatctgggggagttctcagctaattgaccacccgtacctggagccacgccacttcgtggatgaaaaggcagtcaacgaaaaccacaaagattacatgttccttgagtgcatcctcttcataactgagatgaagaccggaccatttgctgaacacagcaatcaactatggaacatcagcgcggtgcctagctggtcgaaggtcaatcagggtctgattaggatgtacaaggcggaatgcctggagaagttccccgttatccagcattttaagtttggctctcttctgccaatccatccggttaccagcggctag

SEQ ID NO: 236980 - DNA, 972 bp, Artificial Sequence
  Description of Artificial Sequence: Synthetic coding sequence
atggccgagggggagcggcaacctcctccagacagttcagaagaagcgcctccggcaactcaaaatttcatcataccgaaaaaggaaatccacacagttcctgatatgggaaagtggaaacgaagtcaggcctatgcggactacattggctttatactcaccctgaacgaaggtgtgaagggcaagaaattgactttcgagtaccgtgtctcagaagccattgagaagctcgtggcgttgttaaatacactggatagatggatcgacgaaacccctccagtcgatcagcctagtcggtttggaaacaaagcatatcgtacttggtatgctaagctagacgaagaagcagagaacttggtggcaactgtggtgcccacccacctggctgccgctgttcccgaggtggccgtgtatctgaaagagtctgtgggcaacagtactagaattgattatggcacaggtcatgaagctgctttcgccgcttttttatgctgcctctgcaagattggagtgctgagagtagatgaccagatcgccatcgttttcaaggtttttaaccgctatttggaggtgatgcggaaacttcagaagacgtaccgaatggagccagccggatctcaaggagtctgggggctagatgactttcagtttttgccttttatttggggctcaagccagctaattgatcacccctacctagaacccaggcacttcgtggacgagaaggctgtgaatgagaaccacaaagattatatgttcctagagtgcatactgttcattactgaaatgaagaccggtccgttcgctgagcacagcaatcagctctggaatatctcggctgtgccgtcctggtccaaagtcaatcagggtttgatcaggatgtacaaagccgaatgcctcgagaaatttccagtgatccagcatttcaagttcggctcacttttacccatacaccccgtgacaagtggatag

SEQ ID NO: 236981 - DNA, 792 bp, Artificial Sequence
  Description of Artificial Sequence: Synthetic coding sequence
atgggcaagtggaaaaggtctcaggcttatgccgattatatcggcttcattctgactctgaacgagggggtcaaggggaaaaaactgacttttgagtaccgcgtctctgaggccatcgagaaactggtcgcgctgctgaacaccctggatcgctggattgatgaaactcctcctgtagaccaaccatctcgtttcggcaacaaagcataccggacctggtacgcaaagcttgatgaagaagccgaaaaccttgtagctaccgtggtgcctactcatttggcagcagccgtacccgaagtcgccgtctatttaaaggagtcggtgggcaattctacgaggattgattacggcacaggtcacgaagcggcatttgccgcatttttgtgctgcttatgtaagattggcgtcctcagagttgatgaccagatcgcgatcgtgttcaaagtgtttaacagatacctagaagtgatgagaaagctgcagaagacgtaccgcatggaacccgctggcagccagggcgtctggggcctggacgactttcaattcctaccgtttatctggggaagcagtcaacttattgatcacccttatttagagccccgacactttgtggatgaaaaggctgtcaatgagaatcataaggactatatgtttttggaatgcatccttttcataaccgagatgaaaactggcccattcgctgaacacagtaatcagctgtggaatatctctgccgtccccagctggagcaaagttaaccaagggctgatccgaatgtacaaagccgaatag

SEQ ID NO: 236982 - DNA, 1125 bp, Artificial Sequence
  Description of Artificial Sequence: Synthetic coding sequence
atggcagagggcgaacgtcagccaccccctgatagttccgaagaagccccaccggcaactcagaacttcatcatcccaaagaaagagattcatactgtcccagacatgggaaaatggaagagatcccaggcatatgctgattatatcgggttcattctcactctgaatgagggcgtcaagggtaagaagctcacatttgaatatcgcgtctcagagatgtggaatgaggttcacgaagagaaagaacaggccgctaagcagagtgtgagttgcgatgagtgtatccctctcccaagggctgggcactgtgcaccttctgaagccatcgaaaagcttgtggcattgctcaacacgctcgatcggtggattgacgagacaccgccagtagaccaaccaagtaggtttggtaacaaagcataccgaacctggtacgccaaattggatgaggaagccgaaaatttagtggctactgttgtccctacacacctggccgcagcggtgcctgaagtagcagtctacctgaaagagtcggtgggcaattctacccgtatcgattatggaaccggccatgaggccgcattcgctgccttcctctgctgcctctgtaaaatcggggtgctaagagtggatgaccagatcgctattgtgttcaaagtgttcaaccggtatttggaagtgatgaggaagcttcagaagacgtacaggatggaaccggctggcagccagggggtttgggggctcgacgactttcagttccttccttttatctgggggtcatctcagctcatcgaccacccatatctagagccaagacactttgtggacgaaaaggcagtcaatgaaaatcacaaagattatatgttcctcgaatgtattctctttataacagaaatgaagaccggcccattcgcagagcatagtaaccagctgtggaatatctccgctgttccgtcatggtctaaggttaaccaaggcctcattaggatgtacaaagcagaggcaagcccttcggatacatggggactggggatcagccatcttggacatgggcagtcggaaaaacatcaacctccacagccacgcaaggctgctgttcagctctgccccgacgaactaggcggatag

SEQ ID NO: 236983 - DNA, 456 bp, Artificial Sequence
  Description of Artificial Sequence: Synthetic coding sequence
atgaagacggggcctttcgcggagcacagtaaccaactgtggaatatatccgctgtgcctagttggtcaaaggtgaaccagggattgatacgcatgtataaagcggaagtgagcgggggatggcctgtatgtccttcactattacctcacttggtgttggggtggggccaaagcaagaggtgtgggacatggggttcctgcttcctgctcccccattgcttcgcgctgaatttaagaccagcccctctgaccctcggagcatcagagtcacccatatggggtatgggttcccagcgcagcacctcgcaccccagccctgaaaaactccagtcttctagcgtgcttatgtctctcgaggccgaagctcggacttgttgcatggggagcggaggcgacgggggactgcccagccccttgtccagcggacagagattgctcaaagcgcgtgctgtgtag

SEQ ID NO: 236984 - DNA, 2802 bp, Artificial Sequence
  Description of Artificial Sequence: Synthetic coding sequence
atggccgatctgtctttgttacaggaggaccttcaggaggacgctgatggctccctggatttcgtgagtcaagatgagatgctcactcccctggggagactggataagtacgctgctagtgagaacatatttaaccgacagatggtggcgcgatccctcttggatactctgagggaagtttgcgatgacgagcgggactgtatcgccgttcttgaacgtatcagccggttggccgatgattcggagcccaccgttagggccgaactgatggaacaagtgcctcacatcgcgctgttttgtcaagagaatcgcccatccataccgtacgcattctcaaagttcctgctgccaattgtcgtgcgttacctggccgaccagaacaaccaggtcagaaaaacaagccaagcagcactcctggccttgctagagcaggagctcattgagcgctttgatgtcgagacaaaagtctgtcccgttctgatagaattgaccgcgccagattccaacgatgacgtcaagactgaagccgttgccattatgtgtaagatggctcccatggtcggaaaggacattacggagcggctcattttaccaagattctgtgaaatgtgctgtgactgtaggatgttccatgtccgcaaggtctgcgcggctaattttggcgatatttgtagcgtggtgggccagcaggctaccgaagagatgcttctgcccagattctttcagctctgcagtgataacgtgtggggcgtgagaaaggcctgtgctgaatgctttatggcagtgagttgcgccacatgtcaggagataaggcgcactaaactttcggccttgttcataaatttgatatccgatccaagccggtgggtgcgccaggccgcttttcagtcactggggccattcatcagcacattcgccaatcctagcagcagcggacaatacttcaaagaggaaagtaagagttccgaagagatgtcagtggagaacaagaaccgaactcgagaccaggaagctccagaggatgtgcaggttagaccagaggatactccttccgacttatcagtctccaactcatccgtgatcctagaaaacactatggaggaccacgccgctgaggcatccggcaagcccctcggggaaatttctgtgccactcgactcttctctgctctgtacactttctagcgaaagccatcaagaagcagcttctaatgaaaacgacaagaaacccggaaactataagagcatgctgaggccggaggttggcacgacctcccaggattccgcactgctggaccaggaactgtacaatagcttccacttttggcgtaccccgctcccggaaattgacttagacatcgagctcgaacaaaactctgggggtaagccttcacctgagggaccagaggaggaatcagaagggcctgtgccgtcaagtccaaatatcactatggccaccagaaaagaactggaggagatgatcgaaaacctagagccgcatatcgacgaccccgacgtcaaggcacaagttgaggtcttgagtgccgcactgcgtgcctcatctctggatgcccatgaggagaccatctcaattgagaaacggagcgatttgcaagacgaattggacatcaatgagctgcccaactgcaagattaatcaggaagacagtgtacctctcattagcgatgcagtcgaaaatatggattctaccctgcactatatccactccgactcagacctgagtaataactcctcttttagtcccgacgaagagcgtaggaccaaagtgcaagatgtggtgcctcaggctcttttagatcaatatctgtctatgaccgatccctccagagcgcagaccgtggacaccgagatagccaaacactgtgcctactctcttcctggtgttgcactcacactgggcaggcagaactggcattgtctcagggagacgtatgagacactcgcttccgatatgcaatggaaggttcgcagaaccttggcattcagcatacacgagcttgccgtcatcctgggcgaccagcttactgccgcagacctggtgcccatcttcaatggctttctgaaggatctagacgaggtgaggatcggagtactcaaacatctgcatgatttcctgaagcttctgcatattgacaaacgtagggagtatctgtaccagctccaagagttcctcgtcaccgacaacagcaggaattggaggtttcgagccgagttagctgagcagctcatactacttctcgagctgtactccccgagggatgtgtacgactatctgcggccaattgcattaaacctgtgcgccgataaagtcagttccgttcggtggatcagctacaagctcgtttcggagatggtgaagaaactccacgctgctactccacctacgtttggggtggacctgatcaacgagctggtggagaacttcggcaggtgccccaagtggtccggcagacaggccttcgtctttgtttgtcagaccgtgatcgaggatgactgtctgccaatggaccagtttgcagtgcatctgatgcctcatctgttaactctggccaacgacagagtaccaaacgtaagagtgctgctcgccaaaaccctgaggcagacattgttagaaaaggactacttcctcgcctcggcttcatgccatcaggaggcagtggagcaaaccatcatggccttacaaatggaccgcgatagcgatgtgaagtacttcgcatctatccaccccgcttcaaccaaaatctcagaagacgctatgagcactgcctctagtacctattag

SEQ ID NO: 236985 - DNA, 924 bp, Artificial Sequence
  Description of Artificial Sequence: Synthetic coding sequence
atggctgagatctcagacctggataggcagatcgaacagctccgacgatgcgaacttataaaggaatcggaagtgaaagccctctgtgccaaagccagagaaatattagttgaagaaagtaacgtgcagagagtcgactctcctgtcacagtgtgtggcgacatccacggacagttctacgacttgaaggaactattcagagtaggcggtgatgtgccagagacaaattatctgtttatgggggattttgttgaccgcggtttctactctgtggaaacattcctgctcctcttggcactcaaggtccgctatcccgatcggataaccctgatccggggaaatcatgagtcaagacaaattacccaagtgtacggcttctatgatgagtgtctgaggaagtacggcagtgtcaccgtgtggaggtattgcaccgaaattttcgattacctgtctctaagcgcgattatcgatggaaaaatcttttgcgttcacgggggactgagcccaagcatacagacactggatcaaattaggacaatagaccggaagcaggaggtccctcacgacggacctatgtgcgatctcctgtggtctgaccccgaagatactacaggatggggcgtaagtcctagaggggcaggctacttatttggaagcgacgttgtggcccagtttaatgcagccaatgatattgacatgatctgccgggctcaccagctggtgatggagggctacaaatggcattttaatgagaccgtgctaaccgtgtggtctgctccaaattactgctatcgatgcgggaacgttgccgctatcctcgaactggatgagcatttgcagaaagactttattattttcgaggcagcccctcaggaaacgagggggatcccctccaagaaacctgtcgccgattatttcctgtag

SEQ ID NO: 236986 - DNA, 1413 bp, Artificial Sequence
  Description of Artificial Sequence: Synthetic coding sequence
atgttacaggttcgcacctatcttactgaaccaacagtgcgcgctgaattgatggagcaggtaccgcacattgctctgttttgtcaagagaatcgcccatccatcccatacgcattttccaaattcttgctacccatcgtggttagatacctggccgaccagaacaaccaggttcggaagacttcacaggccgcactgctggcactgctggaacaggagctgatcgaaagattcgacgtggaaacaaaagtgtgtccagtgctgatcgaactgactgcgccagacagcaatgatgatgtgaaaaccgaagccgtggctatcatgtgcaagatggcgcctatggtcggcaaggacatcacagagaggctgatcttacctaggttctgcgaaatgtgctgtgattgtagaatgtttcatgtgcggaaagtctgtgcagcgaactttggggatatctgttctgtagtgggccagcaggccaccgaggagatgctcctgcccagattcttccaactttgctcagataacgtgtggggggtccggaaagcctgcgcagaatgtttcatggcagtgtcatgcgcgacctgtcaggagataagaaggacaaagttgtccgccctgttcatcaatttaatttccgacccatcccggtgggttcgtcaggctgccttccagtctctgggaccttttatatctacgtttgctaatcctagttcgagcggacagtattttaaggaggagtcaaaatcgagtgaagaaatgtctgtggaaaacaagaacagaacccgggaccaagaggcccctgaagacgtccaggtacgtcccgaagatacccctagcgatctgagcgtgtccaactcaagcgtcatcttggaaaataccatggaggaccacgctgccgaagcctctgggaaacctttaggggagatctctgtgcctttggactcatcgctattgtgtacattgtcttccgagtctcatcaggaggctgccagcaacgaaaatgacaagaagcccggaaattacaaaagcatgctcagacccgaagttggcacaacttctcaggatagtgctctgctggatcaagagctgtataatagctttcatttctggcgaacacccttgccggaaatcgatctggatatcgagctggagcaaaactcaggtggtaagccgagccctgaggggcctgaagaagagtccgagggaccagttccttcttcccccaacataacaatggcaacccgcaaagaactagaggagatgatcgaaaatctggaacctcatatcgatgatcctgacgtcaaggctcaggtagaggtccttagcgccgcattgagggcttcttcgctggatgcccatgaagaaaccatctcaatcaagagagaggtgatctgcaaaatgaattggatctag

SEQ ID NO: 236987 - DNA, 2853 bp, Artificial Sequence
  Description of Artificial Sequence: Synthetic coding sequence
atggcggatctctcactgctacaggaagatctgcaggaagacgcagacggcttcggcgtggacgattactcgagtgaatcggacgtcattatcattccaagcgccctggacttcgttagccaggatgaaatgctgacacccctgggcagacttgacaagtatgcagcaagcgagaacattttcaaccgccagatggtcgcacgctccctgctggacacactgcgcgaggtgtgtgacgatgaacgggattgcatcgcagtgctggagcgcatttcacggctggcagacgattctgagccaactgtgcgggcagagctgatggaacaggtgcctcatatcgctctgttttgccaggagaatcggcctagcattccttacgcattttccaagtttctcctacctatcgttgtgcgctatttagcggaccagaataaccaggtgagaaaaacgtcccaagctgcattactggctcttttggaacaagaactcatcgagaggttcgacgtggagaccaaggtgtgccctgtgctgatcgagcttacagctcctgactcaaacgacgacgtaaagacggaggcggtggccatcatgtgtaagatggccccaatggtggggaaggacataaccgagcgcctgatccttccgcgtttttgtgagatgtgctgcgattgcagaatgtttcatgtgagaaaggtttgtgccgctaactttggcgacatctgcagtgtggtcggccaacaggcgaccgaagagatgctgttgcctcgcttctttcaactgtgtagtgacaatgtctggggcgtgcgcaaggcctgcgccgagtgcttcatggccgtgtcctgcgcaacatgccaggaaataaggcggaccaagttgtcagcactgttcattaatttgatcagtgatccttcccggtgggtcaggcaggcagccttccagagcctcggaccattcatctcgacttttgcgaacccctctagctctggacagtactttaaggaggagagtaagtcctctgaagagatgtctgtggagaacaagaacagaacgagagaccaggaagcccctgaggacgtgcaggtgagacccgaagatactcccagcgacttgagcgtgagcaatagtagcgtgatccttgaaaatacaatggaggaccatgctgcagaggctagtggtaaacctctcggggaaatatctgttccacttgatagctcattgctgtgcactctgagtagcgagtcccaccaggaggccgcatcaaatgagaatgacaagaagccagggaactacaaaagtatgctgcgacccgaggttgggaccacctctcaagactcagctttgctggaccaggagctttataactccttccacttttggcgcacccccctccccgagatcgacctcgatatcgaattggaacaaaactcaggtggcaaaccatcccccgagggccctgaagaggaatccgaaggccctgtgccaagctctcctaatatcacaatggcgacgcgtaaggagcttgaggagatgatcgaaaatcttgaacctcacatcgacgacccggacgttaaggcccaggtggaggttctgtccgcggctctccgggcatcaagtcttgatgcgcacgaggaaaccatctccattgagaaacgctctgatctgcaagacgaactcgacattaatgaactgcccaactgcaagattaatcaggaagattcagtgcccctcatatcggacgcagtggaaaatatggattcgacattgcactatatccacagtgatagtgacctgagtaacaacagttctttctctccagatgaggagcggagaacaaaagtgcaagatgtggttccacaggcactcctcgatcagtacctcagtatgacggacccgtctagggcgcagacggtggataccgaaatcgctaaacattgtgcttactcattgccaggagtggctctaacactcgggaggcagaactggcactgcctcagagagacatatgagaccctggccagcgacatgcagtggaaggtcagaaggaccctcgctttctcgatacacgagctagctgtgattctcggtgatcagctgacagctgctgacttggttccaatctttaacggcttccttaaagacttggacgaggtgcgcatcggcgtcctaaagcacctgcatgatttcctgaagctgctccatatcgacaagcggcgagagtacctgtatcagctgcaggaatttttggtgaccgacaactccagaaattggcggtttagggccgagctggccgaacagctaatacttttacttgaactatactctcccagagacgtgtacgactacctgcgccctatcgccctcaatctatgcgcagacaaagttagttctgtccgctggatatcctacaaacttgtgtccgagatggtgaaaaaactccacgcagccactccccctacgttcggggtcgatctgatcaatgagctggtcgaaaatttcggacggtgccctaagtggtcaggtaggcaggccttcgtatttgtctgccagaccgtcatagaagacgattgcctgcccatggatcagttcgcagtccacttaatgccccatctcttaactctagccaatgatagagtcccaaacgtacgagtccttttggccaaaaccttgaggcagacactccttgagaaagattactttctggcttctgcttcctgccaccaggaagccgtcgaacagaccatcatggcgctccaaatggatcgggattctgatgtgaagtactttgcctctatccatcctgccagcactaagatctcagaggacgcaatgtcgactgcgtcttccacttactag

SEQ ID NO: 236988 - DNA, 1086 bp, Artificial Sequence
  Description of Artificial Sequence: Synthetic coding sequence
atggacgacttccggaccagtgccccagagcctagagggcctcctaatcccaacgtcgagtacatcccattcgacgagatgaaagagcgcatacttaaaatcgtcacagggtttaatggtattccatttaccatacagaggctttgcgagcttttgactgatccacgacgcaattacacaggtacagacaagttcctcaggggagtcgagaagaatgtcatggtggtcagctgcgtgtacccctcatccgaaaaaaataacagcaactcacttaacaggatgaacggggtgatgtttccagggaatagtcctagttacaccgaaaggtccaatattaatggcccaggcactccaagacccttaaaccggccaaaagtatcgctgtcagcccctatgaccaccaacggccttccagaatccactgattcaaaagaggccaatcttcaacagaacgaggaaaagaatcacagcgattctagtacttccgaaagcgaggtttcatcagtaagcccacttaaaaataaacatccggatgaggacgccgtggaagccgagggccacgaagtcaaaaggctcaggtttgacaaagaaggagaggtcagggaaactgcttcacaaactacctcttcagagattagtagcgtcatggtgggggagactgaggcatcaagtagctctcaggacaaggataaggattctagatgcacaagacaacactgtaccgaagaagacgaagaggaggacgaagaggaagaagaggaatctttcatgacgagtagggagatgatccccgagaggaaaaaccaggagaaggaaagtgacgatgccctcacagtcaacgaagagacctcggaggagaacaaccagatggaagagtctgacgtcagccaggcagaaaaggaccttctccattccgaaggatccgaaaatgaaggccctgtatctagctcatccagcgattgtagggaaaccgaggagctggttggttccaattcgagtaagaccggcgagattctctcagaaagctcaatggagaacgacgacgaagccaccgaagtcactgacgagccaatggaacaggactag

SEQ ID NO: 236989 - DNA, 1254 bp, Artificial Sequence
  Description of Artificial Sequence: Synthetic coding sequence
atggatgtggagagactgcaagaagcgctaaaggatttcgagaagcgcggtaagaaagaagtctgtcctgttctggaccagttcctttgccacgtcgcaaaaacaggagagactatgatccagtggagtcagttcaagggatacttcatctttaaacttgagaaggtgatggatgattttagaacctcagctccagagccaagaggcccacctaatcccaatgtggaatacatcccgttcgatgagatgaaggagaggatcctaaagatcgttactggattcaatggtattccttttaccatccagaggctgtgtgaacttctgaccgaccctaggagaaactacacaggaacagataaatttctacgaggagtggaaaagaatgttatggtagtgtcctgtgtgtatccttcgtcagaaaaaaacaactcgaattctcttaataggatgaacggcgttatgttccccggtaactcccccagctacactgaacgcagcaacataaacggccctggcacccctcgaccactgaatagacctaaagtgtctctatctgcacccatgacaaccaatggattgccagaatctactgactctaaagaagcaaatctccagcaaaatgaggaaaaaaatcacagtgactcatcaactagtgagtctgaggtaagctcggtgagcccactgaaaaacaaacacccagatgaggatgctgtcgaggccgagggtcatgaggtgaagcgcctgaggtttgataaagaaggagaagtaagggagacagcgtcgcaaacaacctcctccgaaatctcgagcgtaatggtcggggaaacagaggcttcctcctccagtcaggataaggataaggatagccgctgcactagacaacattgcacggaagaggacgaggaggaagatgaagaggaagaggaagaatcatttatgacgtcaagagagatgatacccgaaaggaaaaaccaagagaaggaaagcgatgacgcccttaccgtgaacgaagagacatccgaagagaataaccagatggaagaatctgatgtcagtcaggcggagaaagatttgctgcacagtgaagggagcgaaaacgagggcccagtgtccagctcctctagtgattgccgggagacagaggagcttgttggatcaaactcctccaagaccggggagatcctctcggagtcttccatggaaaacgatgatgaggctacggaggtgacggatgagcccatggagcaggattag

SEQ ID NO: 236990 - DNA, 1083 bp, Artificial Sequence
  Description of Artificial Sequence: Synthetic coding sequence
atggatgtcgagcggctgcaggaagctctgaaagacttcgaaaagcgcggaaagaaagaagtgtgtcccgtcttggaccagttcctgtgccatgtagccaagactggagagacgatcatccccttcactatacagaggctctgcgagcttctgaccgacccccgaagaaattatactgggactgataaattcctcagaggtgtggagaaaaacgttatggtggtctcatgcgtgtacccaagctccgagaaaaataatagcaatagtctcaaccggatgaatggcgtcatgtttcccggaaactctccctcgtacactgaaaggtctaatatcaacggcccaggcaccccacgcccattaaacagacctaaagtttccctgagtgctcctatgacgacaaatggcctgcctgaatccacagatagcaaggaggccaacctgcagcagaatgaggagaaaaaccacagcgatagttctacctctgaaagcgaggtgtctagcgtttcaccgctcaagaacaaacatcccgacgaggatgcagttgaagcagaaggccacgaggtaaaaaggctgagattcgataaggaaggtgaagtgagggaaaccgcctctcaaacgactagttccgagattagctctgtcatggttggcgagactgaagcatccagttcctctcaggataaggataaagactctagatgcactcggcaacactgtaccgaggaagacgaggaagaggatgaggaggaggaagaggaaagtttcatgacctcgcgggaaatgatacccgaaaggaagaaccaggaaaaggaaagcgatgatgctttgaccgtgaatgaagaaacttcggaggagaacaaccagatggaggagtccgatgtgtctcaggctgagaaggacctactccattcagaagggagcgagaacgaaggcccagtgtcctcttctagtagcgattgcagggaaacggaggaactcgtgggaagtaatagctcgaagactggcgaaatcttgagtgaaagctctatggagaacgatgacgaggctactgaagtcaccgatgaaccaatggaacaggattag

SEQ ID NO: 236991 - DNA, 1116 bp, Artificial Sequence
  Description of Artificial Sequence: Synthetic coding sequence
atggcgcttgggaaattcagggcagccctgagggactatgaaacagtggtgaaagtcaagccccacgacaaggatgctaagatgaagtaccaggagtgtaacaaaatagttaagcaaaaggcctttgagcgagctattgcaggcgatgagcataagaggtcagtcgtggacagtctcgacatcgaatccatgacaattgaagatgaatattcggggcctaaactggaagatggcaaagttaccatttcgttcatgaaggagctgatgcagtggtacaaggaccagaaaaagctgcaccgtaagtgcgcatatcagaccgaaaagatcaccgtctgcggagacacccacggccagttctatgacctcctgaacatttttgaacttaatggtcttccgagtgaaactaatccctacatcttcaacggcgatttcgtggacagggggtctttttcagtcgaagtgattttaacactgtttggcttcaagttgctgtatccggatcatttccacctgttaagaggaaaccacgagacggacaacatgaatcagatctacggcttcgagggagaagtcaaagcaaaatacaccgctcagatgtatgaactgttctcagaggtctttgaatggctgcccctagcccagtgtattaacggtaaggttctgattatgcacgggggactgttctccgaggacggggttacactggatgacatccggaaaatcgaaagaaaccgccagccaccggactctggtcctatgtgtgatctgctgtggtcagacccacagccacagaatggcagaagtatctctaaacggggagtgagctgccaattcggcccagacgtaactaaagccttccttgaggaaaacaacctggattacattattagatcccatgaagtgaaagctgagggctacgaagtggcccacgggggtcggtgtgtaaccgtgttttcagcacccaattactgtgaccaaatgggcaataaagcctcctatatccacctccaaggctcagacctgagaccacagtttcatcaatttaccgccgtgccacaccctaacgtgaagcccatggcctacgcaaatacccttctacagcttggtatgatgtag

SEQ ID NO: 236992 - DNA, 1500 bp, Artificial Sequence
  Description of Artificial Sequence: Synthetic coding sequence
atggccatggccgagggagagagaaccgagtgtgctgaaccccctcgcgatgagccaccggcagacggcgctctcaagcgggcagaggagctgaaaactcaggcaaatgactatttcaaagctaaagactacgaaaacgccattaagttctatagccaggcaattgagttgaacccttcgaacgcaatatattatggcaacaggtcccttgcttacttacggaccgagtgttatggttatgcactaggggatgccacacgggctatcgagctggataagaagtacataaagggctattaccgacgagcggcttcaaatatggcactgggtaagttccgcgctgccctgcgggattacgagacggttgtgaaggtcaagccccacgacaaagacgctaaaatgaagtaccaggagtgcaacaagatagtcaaacagaaggcctttgaacgtgcaatcgctggtgatgagcataagcgtagtgtggtggactcattagacattgaatctatgaccatcgaagatgagtattcaggacctaagcttgaagacgggaaggtgacaatcagcttcatgaaggaactgatgcagtggtacaaagaccaaaagaagctgcacagaaagtgtgcataccagattctggtgcaggtaaaggaggttttatctaagctgtcaacattggtggaaaccaccctgaaagagacagaaaaaatcacagtctgtggcgacacccacggccaattttacgacctcctcaacatcttcgagctcaacggccttccctctgagacaaacccctacatcttcaacggcgattttgtcgaccgcggatctttctctgtcgaagtgatcctgacattgtttgggttcaagctgttataccctgatcacttccacctgctgagaggtaaccacgagacagacaacatgaaccagatctacggctttgagggtgaagtcaaggccaaatacaccgctcaaatgtacgaacttttctcagaagtgtttgagtggctgcccctggcccagtgtatcaacggcaaggtcctcattatgcacggaggcctgttttctgaggatggtgtgactcttgatgacattaggaaaattgagcgtaaccgccagccccctgactctggcccaatgtgtgaccttctgtggagtgacccacagccacagaacggccgatctatctctaagcgcggagtcagttgccaattcggcccagacgttacaaaggcttttctcgaagaaaacaaccttgactatattatcagatcccacgaggtcaaagctgaggggtacgaggtggcccatggtggtcggtgcgtgacagtatttagtgccccaaattactgtgatcaaatgggaaataaagcttcctatatccatttacagggatctgacctgcgaccacagtttcaccagtttacagccgtgcctcacccaaatgtcaagccaatggcatatgcgaataccctcctgcagctgggcatgatgtag

SEQ ID NO: 236993 - DNA, 1461 bp, Artificial Sequence
  Description of Artificial Sequence: Synthetic coding sequence
atggcgatggccgaaggagaacgaacggagtgtgctgagcctccacgagacgaaccccctgccgacggggctcttaagagagcagaagaactgaagacacaagctaacgactattttaaagccaaggattatgagaatgctatcaagttttactcacaagccattgaactcaatccctccaacgcgatctactatggttacgcgctcggggacgcaacaagggcaattgagttggacaagaaatatatcaagggatactacaggcgagcagcaagcaacatggcgttgggcaaattccgggctgctctgagggattacgagacagtggtcaaagtgaaaccccacgataaggacgcaaagatgaagtaccaagagtgcaacaaaatcgtgaagcagaaggcttttgagcgtgcaatcgcaggcgatgaacacaagaggagcgttgttgacagcctggacatagagtctatgacgatcgaagacgaatatagcggacccaaacttgaggatgggaaagtgaccatctctttcatgaaagagttaatgcagtggtataaggaccagaaaaagctgcacagaaagtgcgcctaccagattctggtacaggtcaaggaagttctctcaaaactgtctaccctggtcgaaaccacactcaaggagaccgagaagatcactgtttgtggcgatacccacggtcaattctatgacttgctgaatatttttgagctcaacgggctcccttctgaaaccaacccttatatttttaatggggactttgtagatcggggaagtttttccgtggaggttattcttactctcttcggcttcaaactactgtacccagaccactttcatctccttcgagggaatcacgagactgacaatatgaaccagatatatggctttgaaggagaagtcaaggcgaaatataccgcccagatgtacgagctgttctctgaggtgtttgagtggttgcctctggcccaatgtataaatgggaaggttcttataatgcacggtgggctgttctctgaggatggagtaaccttagatgacatcagaaagatcgaaagaaacaggcagccccctgactctggtccaatgtgcgacctgctgtggtcagatccacagccccagaatggccgttcaatctccaagcggggagtcagctgccagtttgggccagacgtgacaaaggctttcctggaagagaacaatctggattatatcatccgtagccatgaagtaaaggccgagggttacgaggtggcccacgggggacggtgtgtgacagtgtttagtgctcccaattactgcgaccagatggggaataaagcctcgtatattcacctccaggggtcagacttgcggcctcagttccaccagttcactgccgtgccgcatcctaacgtgaaacccatggcttatgctaatacacttcttcaactcggcatgatgtag

SEQ ID NO: 236994 - DNA, 1458 bp, Artificial Sequence
  Description of Artificial Sequence: Synthetic coding sequence
tagatggcagaaggcgagagaaccgaatgcgctgagcccccaagagatgagccacctgccgacggggctctgaaacgcgctgaagaactgaaaactcaggccaacgattacttcaaagcaaaggactatgagaatgcaatcaagttctactcccaggcgatcgaactgaacccatccaatgccatctattacggaaatagatcacttgcttacctgcgtaccgaatgttacggatatgccctcggggatgctactcgcgctatagagctcgacaagaagtacatcaaggggtattatagaagagctgcctccaacatggcgcttggtaagttcagagctgctttacgcgattatgaaaccgttgtgaaggtaaagccacacgataaggatgcaaagatgaaataccaagaatgtaacaagatagtgaagcaaaaagcctttgagcgggcaatagctggagatgaacataagcgctcagtggtcgacagcctggatatagaatctatgaccattgaggatgaatactccggaccaaagctggaggacggtaaggtcaccattagctttatgaaggaactgatgcagtggtacaaagaccagaaaaagctacacaggaagtgcgcctaccagatattggttcaggtgaaggaggtcctgagcaagctgtctaccttggtggagaccacattgaaggagaccgagaagatcacggtctgcggggacacacatggacaattctatgacctacttaatatcttcgagctaaatgggctgcccagcgagaccaacccttacatcttcaatggggattttgtggaccgtggtagcttctccgtggaggttatcctcactctgttcggctttaagcttctctaccctgaccattttcacctcctgcggggaaaccacgagaccgacaatatgaaccagatttacggctttgagggagaggtcaaagccaaatacactgcccaaatgtacgaactgtttagcgaggtttttgaatggttgccactggcccaatgtatcaatggaaaggttctgatcatgcatggaggtctgttcagtgaagatggagtcactctggatgacatccgaaagattgagcggaatagacagccacccgactcaggcccaatgtgcgacctgctgtggtccgatcctcagccccagaatggtcgatctatctcaaagcgcggagtttcttgccaattcggaccagacgttacaaaagcctttttggaggaaaacaatttagactatatcatcaggagccatgaagttaaagccgaggggtacgaggtcgcccacggcggtagatgtgtgactgtgttctcggccccaaactactgcgatcagatgggtaacaaagccagctacattcacttgcagggtagcgatctccgcccacaatttcaccagttcaccgctgttggccgaccctcctcgggttcttag

SEQ ID NO: 236995 - DNA, 477 bp, Artificial Sequence
  Description of Artificial Sequence: Synthetic coding sequence
atgttgactgtggctgcactgattgacgagcagattctgtgcgtgcacggcggactgagtcctgacatcaagacattggatcagatccgtacaattgaacggaatcaggaaatcccacacaagggcgctttctgcgatttggtgtggagtgaccccgaggatgtggatacctgggcaattagccctcggggagccggatggttatttggtgctaaggtgacaaatgaatttgtgcacatcaacaacctaaaattgatctgccgggctcaccagttggtgcacgaagggtacaagtttatgtttgatgagaaacttgtgacggtctggagcgctcccaactattgctacagatgtgggaatatcgcgtctatcatggtattcaaggatgtcaacaccagagaacccaaattatttcgggcagtgccagactcggaacgggttatccctcctcgtaccacaacaccctacttcctgtag

SEQ ID NO: 236996 - DNA, 918 bp, Artificial Sequence
  Description of Artificial Sequence: Synthetic coding sequence
atggccccactggacctggacaagtacgtggagatcgcacgtctttgtaagtatctgccggaaaatgacctgaagcgtctatgtgactatgtgtgcgatctgttattagaagagagtaacgtgcaacctgtgtccactcccgttacagtgtgtggggacattcacggacagttttacgatctgtgcgagcttttcagaacagggggacaggtgcctgacaccaattacattttcatgggtgacttcgttgatcgcggatattactctctggagacatttacctacctcttagccctcaaggccaagtggccagataggattacattactaaggggtaaccatgagagcaggcagatcacccaggtctacggattctatgatgagtgccagaccaaatacgggaatgccaacgcatggcggtattgtactaaggtgtttgatatgctcacagtcgcagctcttattgacgagcagattctctgtgtgcacggcggactttcacctgacatcaagactcttgaccaaatcaggacgatagaacggaaccaggagattccccacaagggtgctttttgcgatctcgtgtggtcagacccggaggatgtggacacctgggcaatctcaccccgaggcgcaggctggctgttcggcgcaaaagttaccaacgaatttgtacacattaataacctgaaactaatctgtcgcgcacaccagctcgtgcacgagggttacaaatttatgtttgatgagaagctggtgaccgtctggtccgcccctaactattgctatagatgcggaaatatcgcttcaattatggtgtttaaggatgtcaacacccgagagccaaaactgttcagggctgttcccgatagcgaacgagtgatcccccctagaaccacaaccccctactttctctag

SEQ ID NO: 236997 - DNA, 852 bp, Artificial Sequence
  Description of Artificial Sequence: Synthetic coding sequence
atggctccactggacctggataagtacgttgaaatagccaggctgtgtaaatacctgccagagaatgaccttaagcgcctgtgtgactatgtgtgcgatctcctcctggaggaaagtaatgtgcaacctgtctccaccccagtaacagtatgcggagacatccatgggcagggcgactttgttgaccggggttactatagcctggaaactttcacgtacctgttggccttgaaggccaagtggcccgaccgtattacactgctgagaggaaatcacgaaagtaggcagattactcaagtgtatgggttttatgatgagtgccagacaaagtacggcaacgctaatgcctggcgctactgcaccaaggtatttgacatgctgaccgtggccgcacttattgacgaacaaattctgtgcgtgcatggcggactgtcccctgatattaagacactggaccaaattcggaccatcgagagaaatcaggaaattcctcataagggcgctttctgcgatctcgtctggagcgatccagaggatgtcgacacatgggccataagccccagaggcgcaggatggctgtttggggcaaaagttacgaatgagtttgttcacattaataatctaaagctgatctgtcgggctcaccagctggtgcacgaaggctataagttcatgttcgatgagaagttggtgaccgtgtggtctgcaccaaactactgctatcggtgcggcaatattgccagcatcatggttttcaaggacgtcaacactagggagccgaagctgttcagggccgtgccagattccgaaagagtcattcccccacggaccactaccccttatttcttgtag

SEQ ID NO: 236998 - DNA, 1029 bp, Artificial Sequence
  Description of Artificial Sequence: Synthetic coding sequence
atggccccactggatctcgacaagtacgtggagatcgctagactctgtaagtacctacctgagaatgacctaaaagttagcccaatctgcggccttgctcccagtgggtgcggggctccggcaggtcgcccttttctgagtcccggtccccctcctgtgttccacttccttcggttccttaaggaaagactgtgcgattacgtctgtgaccttttgttggaggaatccaatgtccaaccagtctccacacccgtcacagtgtgtggcgacattcacgggcaattttacgacctttgtgagctctttagaaccggcggtcaagtgcctgacaccaactacatctttatgggcgatttcgtggacagaggttattactcattagaaacattcacgtacctcttggcactcaaagcaaaatggcctgacaggataaccctactccgagggaaccatgagtccagacagataacacaagtgtacggtttctacgacgagtgtcagaccaaatacggtaacgccaatgcctggagatattgcacgaaggtctttgacatgctgaccgttgcagccctgattgatgaacagatcttgtgcgtccatggcggactcagccctgatatcaagacgctggatcaaattcgtacaatagaacgtaaccaggaaataccccataaaggggctttctgcgacttggtgtggtcggaccccgaagacgtggacacatgggcaataagtcctaggggcgcaggatggctttttggtgcaaaagttacgaacgagttcgttcacatcaacaacctgaagctcatatgccgcgcacatcagctggtccacgagggatataagttcatgtttgacgagaagcttgttacggtctggtcagcaccgaactattgttaccgctgcggcaacatcgcctccattatggtatttaaagatgtgaatacaagggagccaaagctgttcagggctgtgcctgactctgagcgcgtcattccgcctcgcacaacgaccccctacttcctctag

SEQ ID NO: 236999 - DNA, 378 bp, Artificial Sequence
  Description of Artificial Sequence: Synthetic coding sequence
atgttcctgttgcctcgtctccagctactaggtcagatgcgcttatgtgactacgtttgtgacctgttgctggaggagtcaaatgtgcaacctgtctccactcctgttacagtttgcggagacatccacgggcagttttacgatttgtgtgaattgttccggaccggcggtcaggttccagatacaaactatatttttatgggagactttgttgaccgcggatactactccctggagacctttacatacctgctggccttgaaagcaaaatggcccgacagaataacactcctgcgcggtaatcacgagtcccgccagattactcaagtgtacgggttttatgacgagtgccagactaaatacggcaacgccaattag

SEQ ID NO: 237000 - DNA, 1161 bp, Artificial Sequence
  Description of Artificial Sequence: Synthetic coding sequence
atgagcgccttggagaaatccatgcacctcggaaggctgcctagtcggccacctttacctggatctggaggatctcagagcggagccaagatgcgtatggggcctggcaggaaacgtgactttagccctgtcccatggtcgcagtatttcgagtccatggaggatgtcgaggtggagaacgaaacaggcaaagacacatttagggtgtataaaagcggctctgagggcccagttcttttgctgcttcacgggggaggccactccgcactgtcctgggcggtgttcacagcggcaatcattagccgtgtgcagtgcaggatagtcgcattagacctccgctcccatggggagacaaaggtcaaaaatccagaggacctgtccgccgaaacaatggcgaaggatgtggggaatgtggtggaagccatgtatggggacctcccaccaccaataatgcttattggacactccatggggggagcgatcgccgtgcatactgcctcatccaatcttgtgcccagcctgctgggcctgtgtatgattgatgtggtagagggcacagcaatggacgccctgaactcaatgcaaaatttcttgaggggcaggccaaaaactttcaaatccttggagaatgccattgagtggtccgtgaaaagcggacaaattcgcaacctggaatccgcgagggtgtcaatggtcggccaggtcaaacagtgcgaagggattacatcccctgagggcagcaagagtattgttgagggcatcattgaagaggaggaggaggacgaagaaggatctgagagcattagtaagaggaaaaaagaagacgatatggagacaaaaaaggaccacccctacacatggagaattgagctggcaaagactgagaaatattgggatggatggttccgtggcctgtcaaatctgttcctttcgtgccctatcccaaagttgctcttactcgccggagtggaccgccttgataaggatctaaccatcggacagatgcagggcaaattccagatgcaagttttaccccaatgtggccacgccgtgcacgaggacgcaccagacaaagtcgctgaggccgtcgctaccttcctcattcggcatcggttcgccgagcctataggcggattccaatgtgtgttcccaggctgctag

SEQ ID NO: 237001 - DNA, 600 bp, Artificial Sequence
  Description of Artificial Sequence: Synthetic coding sequence
atggatgctctgaacagcatgcagaacttccttagagggcgacctaagaccttcaaaagccttgagaatgccatagagtggtcagtgaaatcggggcagatcaggaacctggagagtgcacgggtgtcaatggtgggacaggtgaaacagtgcgagggaatcacgagtcctgaagggagcaagtcaatcgtggagggaattatcgaagaggaggaggaagacgaggaaggcagtgaatcaatcagtaaaagaaagaaagaggacgacatggaaactaagaaggatcacccctatacatggagaatcgaactcgcaaaaacggagaagtattgggacggctggttccggggattgtctaatctctttctcagttgtcccattcctaaactcttgctgctggcgggtgtggacagactggataaagatctgacgattggacagatgcagggcaagttccagatgcaagtgctccctcagtgcggacacgccgtccatgaggatgcaccagacaaagtggccgaggcagtggcaaccttccttattcgacatagatttgccgaacctatcggcggattccagtgcgtttttcctggatgctag

SEQ ID NO: 237002 - DNA, 1203 bp, Artificial Sequence
  Description of Artificial Sequence: Synthetic coding sequence
atgagcgccttagagaagtcgatgcacctgggacggttgccgtctagaccaccgttaccgggtagtggcggaagccagtctggcgctaagatgagaatggggcctgggcgaaagcgggacttttctcccgtgccatggtcgcagtatttcgagtccatggaggacgtcgaagtggagaatgagacagggaaggacactttccgcgtttacaagtcaggctcagaagggccagtgctcctattgttgcatggtggaggccatagtgccctttcatgggcagtatttaccgccgcaatcattagtagggtgcagtgccgcatagttgccctcgacctccggtcccacggcgaaactaaagttaagaatccggaggatctgagcgctgaaaccatggccaaagatgttggcaacgtcgtggaggcaatgtacggggacctgccgccacctattatgctgataggacattcaatgggcggagcgattgccgttcataccgcgagcagtaatcttgttccatcactactgggactctgtatgattgatgtggtggagggcactgccatggacgcactgaacagtatgcagaattttctccgagggagacccaagacatttaagagcttagaaaacgccattgagtggagcgtcaagtccggccagataaggaacctcgaatccgctagggtgtcaatggttgggcaagtgaaacagtgtgaggggatcacctccccggagggtagtaaatccatagtcgagggtatcattgaggaggaggaagaggatgaggaagggagtgaatcgatctcgaagcggaagaaggaggacgacatggaaggcttaccctctgagacacagaatttactgctcttcctacagacaaaaaaggaccacccctatacttggcgtattgagctagcaaagactgagaaatactgggatggatggttccgcggactctctaacctgtttttgtcatgcccaatccctaaactgcttctgctggccggagttgataggctcgataaggatctcactatagggcaaatgcagggcaagttccaaatgcaggtgctgccacagtgcggccacgccgtgcatgaggacgctcctgacaaggttgctgaagctgtggccacctttttgatcaggcatcgattcgccgagcctataggtggtttccagtgcgtgtttcccggatgttag

SEQ ID NO: 237003 - DNA, 1776 bp, Artificial Sequence
  Description of Artificial Sequence: Synthetic coding sequence
atgggatgctctagtagttccactaaaactagacgaagcgataccagcctccgggcagccctcattattcaaaattggtatcgcggttacaaggcgagattgaaagccaggcagcattatgccctaactatttttcagagcatagagtacgctgatgaacagggccagatgcagctctccaccttcttttctttcatgcttgaaaattacacccacatccacaaagaagaactagaactccgtaaccaaagccttgagagcgagcaagacatgcgcgacagatgggattacgtagactctattgacgtacctgattcatataatgggccacgcctgcaattccccctgacctgtacagatatcgatttactacttgaggcctttaaagagcagcaaatcctgcatgcccattacgttctggaagtgctgtttgagaccaaaaaggttttgaaacagatgcctaactttacacacattcagacctccccatcgaaagaagtaactatctgtggggacctgcacggaaaactggatgatctgttcctaattttctacaagaacggcctgcctagtgaacggaatccctacgttttcaacggagacttcgtggacagaggcaaaaattcgattgagatccttatgatcctgtgtgtctcattcctggtctaccctaatgacctgcacctgaaccggggaaaccatgaagatttcatgatgaaccttagatatggattcactaaggagattctgcacaaatacaaactccatggaaaacgcatcctgcagatcctcgaagagttttacgcctggctcccgatcggaaccattgtcgacaacgagattttggtcatccacggagggatttccgaaactacagacttgaacctgttacaccgggtcgaacgtaataaaatgaaatctgtgctcatccctccaactgaaacaaaccgggaccatgacaccgactccaagcacaataaggtaggtgtcacattcaatgctcatggacggattaagacaaacggaagccccacagaacacctcaccgaacacgagtgggagcaggtggtgaccattttttctgcctccaactactacgaagaagggtccaacagaggcgcatatataaagctgtgttcagggacgacgcccaggttcttccagtaccaggtgactaaagccacgtgttttcagcccctgagacagagggtagacactatggaaaatagtgccatcaagattctccgagagcgcgtgatctccagaaagtccgatctgacccgcgcttttcagctacaggaccatcggaaaagcggaaaactctctgtgtcccagtgggctttttgcatggaaaacatcctaggccttaacttaccatggcgctcgctcagctcaaacctggttaacattgaccaaaatggcaatgtggaatacatgagctcttttcagaatatcagaattgagaaacccgtccaggaagcccacagcacccttgtggaaacactctatcggtatcgatcagatctggagatcatattcaacgctattgacaccgaccattcgggcttgatatcagtagaggagtttcgggctatgtggaaactgttcagcagccattataatgtccatattgacgattctcaagtgaacaagctcgccaacataatggatttgaacaaggacggatctatagacttcaatgaattcttaaaggccttttacgttgtgcacaggtatgaagacctcatgaagcccgacgttactaatcttggctag

SEQ ID NO: 237004 - DNA, 1803 bp, Artificial Sequence
  Description of Artificial Sequence: Synthetic coding sequence
atggggtgcagcagcagcagtacaaagaccagacggtccgatacatcactgcgggcagctctgatcattcagaattggtaccgtgggtacaaagcgaggttgaaggctaggcagcactatgctctgacaatcttccagagcatcgagtacgccgatgagcagggccaaatgcagttgtccaccttcttttcatttatgctcgagaattatactcacattcataaggaggagctggaaattctgcatgcccattacgttctggaagtgctgttcgagactaagaaggtgctaaaacagatgcctaatttcactcatattcagacttctccctcaaaggaagtcaccatatgcggtgatttacacggtaagctggacgatttgttcctgatcttttacaaaaacggactgcccagcgagaggaacccttacgtatttaacggagattttgtagataggggcaagaattctattgagatcttaatgatcctgtgtgtctcatttctggtttatcccaatgacctacatctgaatcgtggaaaccacgaggattttatgatgaacctccgttacggatttactaaggaaatcctccataaatacaagctccacgggaagcgtattctccagatactcgaggagttctatgcatggctgcccatcggtacaatcgtggacaacgaaatcctggtcattcatggtggcatttctgagacaactgatcttaatctgctacatcgtgtggaacgcaacaagatgaagagtgtactgatcccccctactgagaccaaccgcgaccacgacacagatagcaagcacaacaaggtaggcgtgaccttcaacgcgcacggcagaattaaaacaaatgggtctcctaccgagcacctcaccgagcacgagtgggaacagatcatcgatattctgtggagcgatccccgagggaaaaatgggtgctttccaaacacctgtcgaggagggggatgctactttggcccagacgtgacatcgaagatcctcaataagtatcagctgaagatgctcatccggtcgcatgagtgtaaacctgaaggttacgagatatgtcacgatgggaaagtggtgaccatatttagcgcttcgaattactatgaagagggctccaaccgcggtgcatatatcaaactgtgctcaggcacaacacccagattttttcagtaccaagtgacaaaggcaacatgcttccagccactccgacagcgcgtggatacaatggagaattcagccataaagatcctgagggagagggtcatttcccgcaagtctgacctcacaagggcgttccagttgcaagaccataggaaatcgggaaaactaagtgtcagtcagtgggctttctgcatggagaacatcctagggttgaacctgccttggcgtagcctctcttccaaccttgtcaacatagatcaaaatggcaacgttgagtacatgtcctccttccagaatattaggatagagaagccagtccaggaagcccactctactctggtggaaaccctgtacagatatagatcggatttagagattatatttaacgccatcgataccgatcatagtgggttgatatctgtcgaagaatttcgcgcaatgtggaagctcttctcctctcattacaatgtgcatatagatgactcacaggtgaataagctagccaacataatggacctgaacaaggatgggagcatcgactttaatgagttccttaaggcattttacgtggtgcatcgctacgaggatctgatgaaaccagatgtgactaaccttggctag

SEQ ID NO: 237005 - DNA, 1962 bp, Artificial Sequence
  Description of Artificial Sequence: Synthetic coding sequence
atgggctgtagctcttcgagtaccaaaacccggaggtccgatacctccttgagagcagccctcataatccagaattggtaccgtgggtataaggctaggctgaaggctcggcaacactatgccctgacaatcttccagagtattgaatacgccgatgagcaggggcagatgcagctgtcgacgttcttttcgttcatgctggagaattatacccatattcataaggaagaactggagctgaggaaccagagcctcgaaagtgaacaagacatgcgtgacaggtgggattatgtggattctatcgacgtccccgacagctacaacggtccacgactgcagtttcctcttacctgtaccgacattgacctcctgctggaagccttcaaggaacagcagattctgcacgcccactacgtgctcgaggtgctgtttgaaacaaaaaaagtgctgaagcagatgcccaatttcacccacatccagactagcccatctaaagaagtgactatttgcggtgatctgcacggcaagcttgatgatcttttcctaatattctataaaaacgggctgccaagtgaacgaaacccttacgtattcaacggggactttgttgatcgcggaaagaatagtatcgaaattctgatgatcctgtgtgttagtttcctcgtgtaccctaacgacctgcacctgaatcgcggaaaccacgaagacttcatgatgaacctgaggtacggatttactaaggaaattttgcataagtataaactgcatggaaagagaatactgcaaattctcgaggagttttatgcctggctgccaatcggaaccatagtggataacgagatcctggtgattcacggaggtatctcagagacaacggatttgaaccttctgcatagggttgaaagaaacaaaatgaaatccgtccttattccacctacggagaccaatagggaccatgacacagatagcaaacataacaaggtgggtgttacctttaacgctcacgggaggatcaaaactaatggcagccctactgagcacctcaccgagcatgagtgggaacagattattgatattctgtggtcagatcctaggggcaaaaacggctgctttccaaatacatgtcggggaggcggatgctacttcgggcctgacgttactagcaagattttaaataaatatcaactgaagatgctgatccgcagccacgaatgtaaacctgaaggatacgaaatctgccacgatgggaaggtggtgaccatcttctccgcctcaaactattacgaagaggggtctaataggggtgcctacattaaattgtgctccggaactacgccccgtttcttccagtatcaggtcacgaaagccacgtgttttcagcctctccggcagagagtggacacaatggagaattctgccatcaagatactccgagagcgggtgattagccgcaaatcagacttgacacgagctttccagctacaggaccaccgtaagtctggaaagctcagcgtgagccagtgggcattttgcatggagaacattctggggttgaacttgccatggcgctctctgagcagcaatctggtcaacatcgaccagaatgggaatgtcgagtacatgagctcatttcagaacatccgtatcgagaagcccgtgcaggaggcacatagtacccttgtcgagacattatatcggtacagaagcgatctcgaaatcatctttaacgcaatcgatacagaccattccggactaatctccgtggaggagtttagagctatgtggaagctattttcatcccattacaacgttcacattgatgattctcaggttaataagctggctaacattatggatctcaataaagacgggtccattgacttcaacgagttcctgaaggctttttatgtggtgcaccgctatgaagatttaatgaagcccgatgtgaccaacctcggctag

SEQ ID NO: 237006 - DNA, 1131 bp, Artificial Sequence
  Description of Artificial Sequence: Synthetic coding sequence
atgggatgcagttcgagttctacaaagaccaggaggtcagacacttccttgcgcgctgctctcataatccagaattggtacaggggatataaggcacgccttaaggctcggcagcactacgcccttacaatcttccaatcgatcgagtatgccgacgagcagggccagatgcaattgtccacattcttctccttcatgctcgagaattacacgcatatacacaaagaggaacttgagttgcgcaatcaaagtctcgagtccgagcaagacatgagggataggtgggattacgttgacagcatcgacgtcccggacagctacaatggtcctaggctgcagttccctctaacctgcacagacatagacttgcttctcgaagcatttaaggagcagcagattctgcatgcgcattacgtcctggaggtactgtttgaaacaaagaaggttctgaaacaaatgcctaacttcacacacattcaaaccagcccaagtaaagaagtgactatctgtggcgacctccatggaaaattggacgatttatttctgattttctataagaatggtttacccagcgaaaggaacccttatgtcttcaacggggacttcgtcgatagaggcaaaaacagcatcgagatcctgatgattttgtgtgtaagctttttggtctatcctaacgacttgcacctgaaccgtgggaaccacgaggattttatgatgaatttgcggtatggcttcactaaagagattcttcacaagtataagctgcacgggaagagaattctccaaatcctggaggaattctacgcctggctccccattggaacaattgtagacaacgagattttggttattcatggaggaattagcgaaaccactgacctaaacctgcttcaccgagtggagagaaataaaatgaaatccgtcttgattccaccaactgagaccaatcgggaccacgacacggattctaagcacaacaaagtgggagtcaccttcaacgcgcacgggagaattaagactaacggttctcctacagagcatctgacagagcatgagtgggaacagagtgggtattatggtaaacaaagacaccaggacatcaagcgcgagtccgacttcacaaagaagtag

SEQ ID NO: 237007 - DNA, 1767 bp, Artificial Sequence
  Description of Artificial Sequence: Synthetic coding sequence
atgctcgagaactacacgcacatacacaaggaggaactagagcttcggaaccagagccttgaaagtgagcaagacatgcgtgatcgctgggattacgtggacagcattgacgtcccagactcatacaacggccctcgcctgcagtttcctctgacttgtaccgacatagatttgttgttggaggcgttcaaagagcagcagatcttgcacgcacattatgttctggaggtgctttttgaaacaaaaaaggtcttgaagcagatgccaaacttcacccatatacagacaagccctagcaaggaggtgaccatttgtggagatctacacggcaagttagacgacttgttcctgattttctacaaaaacggattgccttccgagcgcaacccgtacgtctttaatggcgacttcgtggacaggggaaagaattcgatcgagattctgatgatcctgtgtgtgagttttctggtatatcctaacgatctccatttgaatagaggaaaccacgaagactttatgatgaatttgcgctacggctttactaaagaaatactgcacaaatacaaactgcatgggaaacgcattctacagatcttggaggagttctacgcgtggctgcccattggcaccatcgtggacaacgagatactggtgatacacggaggaattagtgagacgacagacctgaatctccttcaccgcgttgaaagaaataaaatgaaatcagtgctgattcctccaacagagacaaatcgcgaccatgataccgacagtaagcacaacaaggtgggcgtaacctttaacgcccacggacgcatcaagacaaatggatccccgactgagcacctcaccgagcatgagtgggaacaaataattgatatcctctggagcgatccacgtggcaagaatggatgttttccaaatacatgcagggggggtggctgttactttggccctgacgttacttccaagatccttaataaatatcagcttaaaatgctgatccgaagccatgagtgcaaacctgaagggtatgagatttgccatgatgggaaagtcgtgaccatattttctgccagcaactattatgaagagggctccaacagaggggcttacattaagctgtgctctgggacaaccccacgcttttttcaataccaggtaaccaaggccacctgctttcagcctctgcgacagagggttgataccatggagaactccgcgattaagattctcagggaacgggtgatttcacgtaagtccgatctcacaagagcattccagctccaggaccatcgcaagagcggaaaattgtctgttagccagtgggctttctgtatggaaaatatccttggcttaaacctgccgtggagatcattgtcttcaaaccttgtcaacattgaccagaatggaaatgtcgagtacatgagttcctttcagaatattagaatcgagaagccggtacaggaagcacactctacacttgtggagaccctttatcgttatcgaagtgatctcgagatcatctttaacgcgatcgatacagatcacagcggtctcatttctgtcgaggagtttagggccatgtggaaactgtttagctcgcattataatgtgcatattgatgatagtcaagttaataaactggccaacatcatggatttaaacaaggatggcagcatcgatttcaacgagttcctgaaggccttttatgtcgttcaccgttatgaggatttaatgaaaccagatgtcacaaacctgggttag

SEQ ID NO: 237008 - DNA, 2262 bp, Artificial Sequence
  Description of Artificial Sequence: Synthetic coding sequence
atgggcagcgggacctctactcaacaccacttcgctttccagaacgccgagcgggctttcaaagccgctgcgctgatccagcgttggtacagacggtacgtggcgaggctggaaatgagacgcaggtgcacatggtcaatttttcaaagcattgaatatgcagggcagcaagatcaggttaagctgcacgacttcttctcctacctgatggatcattttattccctctagccataacgaccgagacttcctgacccgcatcttcactgaggacagatttgcccaggatagcgagatgaaaaagtgcagtgattacgagagtatcgaggtgccggactcatataccggtcctcgcctctcctttccactgcttcccgatcatgctaccgctctggtggaagccttcagattgaagcaacaactacatgctcggtacgttcttaacctgctatacgaaactaaaaaacacttggttcagctccccaacattaatcgggtttccacgtgctacagcgaggagattacagtttgtggggacctccatggacagctggatgatctgatcttcattttttataagaacggcctcccttctcccgagcgaagttacgtattcaacggcgattttgtcgatcggggaaaggacagcgtcgaaatcctgatgatcctctttgcctttatgctagtttatccaaaagagttccaccttaaccgaggaaatcatgaagatcacatggtcaatcttcgttacggctttacaaaagaagtcatgaacaaatacaaggttcatggaaaagaaattctgcgcaccctccaagatgttttctgctggctgcccctggctacactgattgatgaaaaggtcttaatcttgcatgggggtgtgtcagacattactgatctcgagctcttggacaagatcgagcggtctaagattgtgtccacgatgagatgtaaaacccgccagaaatccgaaaagcagatggaagagaaaagacgcgcaaatcagaagtccagcgcacaggggcctatcccctggttcttgcccgaaagtcggagtctaccctcctcgccgctcagactgggatcctataaggcccagaagactagtcgttcgtccagcataccttgtagcggctcactggacggacgcgagttatcgcggcaagtgcgtagtagcgttgaacttgaactagagcggtgccggcagcaggctggactgttagtgacgggggaaaaggaggaacccagtcgtagcgctagtgaggcagatagcgaggccggagaattgcgcaagcctactcaggaagagtggcgacaggtcgtggatattttgtggtccgatcccatggcccaggaagggtgtaaagccaataccatccgcggaggaggatgctattttggccctgacgtgactcagcagttgttgcagaagtacaacatgcaatttcttatccggtcccatgagtgcaagcccgagggatacgaattctgccacaacaggaaggttttaacgattttcagtgcctccaactattatgaggtaggcagcaatcggggagcatatgtgaaactaggtccagccttgactccccacattgtgcagtaccaggcgaacaaggttacacacactcttaccatgcgccagagaatcagtcgggtcgaggagtctgctcttcgagccctgagggagaagctgttcgctcatagctcagatttgctttctgagttcaaaaagcacgatgcggataaggtgggattgattactctttctgattgggcggcagctgtcgaatctgtcctgcaccttgggctgccgtggcgcatgttacgaccacagctggtgaacagtagcgcagacaatatgcttgagtataagtcttggctgaagaacttggcaaaggagcagctttcccgagagaacatacagagctcgctgctggaaacactttatcgcaacagatctaatctagaaactatatttcgaatcattgacagcgaccactccgggttcatatcgctggatgagttccggcaaacatggaagcttttctcctcccatatgaacatagacattactgatgactgcatctgcgacttggcccgttcaatcgacttcaacaaagatgggcacatcgatatcaacgagttcctggaagctttccgcctggttgaaaagtcctgcccagagggcgatgcatccgagtgtccccaggcgactaatgctaaagatagtggctgttcaagccctggcgctcactag

SEQ ID NO: 237009 - DNA, 1797 bp, Artificial Sequence
  Description of Artificial Sequence: Synthetic coding sequence
atggggtctggaaccagcactcaacatcacttcgcatttcagaacgcagagagagctttcaaggccgctgcactcattcagcgctggtaccgccgttacgtcgctcgcctagaaatgcgtaggcgatgtacctggagcatttttcagtccatagagtacgccggtcaacaagatcaagtgaaacttcacgacttcttctcctacttgatggatcattttatccccagtagtcacaatgaccgcgacttcctaaccaggatcttcactgaggaccggttcgcccaagactctgaaatgaaaaaatgtagcgactacgaatctatcgaggtgccggatagctacacgggtccccgtctctctttcccactcctaccagatcacgccactgctctggtagaggcttttcgtctcaaacagcagcttcatgctcggtacgttctcaacctgctctacgagaccaagaaacacttggtgcagctgcctaatattaaccgggtctccacctgctattcagaagagataactgtctgcggagatttacatggccaattagatgatcttatctttatcttctataaaaacggactcccctcgccagagcgatcctacgtcttcaacggcgatttcgtggaccggggaaaggattctgtggaaatattgatgattctcttcgcctttatgctggtgtatcctaaggaatttcatctgaatcggggaaaccatgaagaccatatggtgaatttgcggtatggattcacaaaggaggtgatgaataagtacaaagtacacggaaaagagatattaaggacgttacaagatgtcttctgctggctgccattagccactctcatcgatgagaaagtgctaattctgcacgggggtgtgtcagacatcaccgatcttgaactgctggacaagatcgagagatctaagattgtaagcaccatgcgctgcaaaacccggcagaaatccgagaagcagatggaagagaagaggagggcaaaccagaaatcaagtgctcagggacccatcccttggtttctgcctgaatcacggtctcttccttcttcacccctccgtttaggcagctacaaggcccaaaagaccagccggagctcatctattccttgttctggaagcctggacggtagagagctttcaaggcaggtgagaagcagcgtcgaactagagctcgagagatgccgccagcaggcaggcctcctcgtgactggggaaaaggaagagccatccagaagtgcttcggaggcggactccgaggcaggcgagctacgtaagcctacccaagaggaatggaggcaagtggtggatatcctgtggagcgatccaatggcacaggaggggtgcaaggcgaacacgattcgcggaggagggtgctactttggccctgatgtgactcagcaactgctgcagaagtataacatgcagtttctgatcagatcccacgagtgtaaacccgaagggtatgagttctgccataatcggaaggtattgactattttcagtgcttcaaattactacgaggtggggagcaaccggggagcctatgtgaagttggggccagcccttacaccccacatcgtccagtatcaggctaataaggtgacccacacactcaccatgcggcagcggatcagccgcgtcgaagagtccgctctgcgtgcactgagagaaaaacttttcgcccattcaagtgatttgctgagcgaatttaagaagcacgacgccgacaaggtcggcctcgcatcgtcccaattgtgttactaccagcaaaaatag

SEQ ID NO: 237010 - DNA, 1440 bp, Artificial Sequence
  Description of Artificial Sequence: Synthetic coding sequence
atgggtgcatttcttgacaagccaaagaccgagaaacacaatgcacacggggcaggcaacggtctgcggtacggcctgtctagcatgcaggggtggcgagtcgaaatggaggacgcgcacacagccgtggtcggaattccacatggactagaagattggtctttttttgcagtgtatgacggccacgcaggcagccgggtggccaattactgttccacacatttgctggagcacattaccaccaatgaggactttagagcggcaggaaagtctggttccgcactggagttgtctgttgagaacgtcaagaacggtataaggacagggttcctcaagatcgatgagtacatgcggaatttctctgatctcagaaacggtatggaccgatccgggtccaccgccgtaggtgtgatgataagccccaagcacatatattttatcaattgcggtgactcccgcgctgtattgtacagaaacgggcaggtgtgctttagcacccaggatcacaaaccttgtaacccacgggaaaaggagcgcattcagaacgccggaggcagcgttatgatccaaagagttaatggtagtctggcagtgtcccgggctttaggcgattacgattataagtgtgttgatggcaaagggcctaccgagcagctagttagtccagagccggaggtgtacgagatcctacgggctgaagaagatgagttcataatactggcatgcgatgggatatgggacgtgatgagtaatgaggagctgtgcgagtatgtcaaaagtaggctggaggtgtccgacgatctggagaatgtttgtaattgggtagtggatacttgcctgcacaagggctcaagagacaacatgtccattgtgctcgtgtgcttctccaacgccccaaaggtatccgacgaggctgtaaagaaagattctgaacttgacaaacatttggaaagcagagtggaggaaattatggaaaagtcaggagaagagggaatgcctgacctggcacatgtgatgcgcatcctttctgccgagaacatcccgaatttgccaccgggaggcggattggctggcaaacgcaatgtgatagaagccgtgtattctaggttaaacccccatcgtgagtccgatggagctagtgacgaggcagaggagagtgggtcacagggcaaactcgttgaggctctgcgtcagatgcgcattaatcacaggggcaattaccggcagctgctggaggaaatgctgacaagctataggctggctaaagttgagggggaagaatcccctgccgagcccgctgccactgctacctcatctaattctgacgcaggaaatcccgttactatgcaggaatcgcataccgaatcagaaagcggccttgccgaactagatagttccaatgaagacgccggtacaaagatgtctggagagaagatatag

SEQ ID NO: 237011 - DNA, 579 bp, Artificial Sequence
  Description of Artificial Sequence: Synthetic coding sequence
atgagcatcgtgttggtgtgtttcagcaatgcccctaaggtgagcgatgaggccgtaaagaaagatagcgagttggacaaacatttggaatcaagggtggaagagatcatggagaagtcaggggaggagggtatgccggacctcgctcatgtaatgaggatcctcagtgccgaaaacattcccaatctgcctcctggcggtggcttggctggcaaacggaacgtcatcgaggccgtttactcacgcctgaatccacaccgggagtccgacggcgcttctgatgaagcagaagagtcaggttctcaggggaaactcgtggaagccttaagacagatgaggatcaaccatagaggtaactatcgtcagctgctggaagaaatgctgacatcataccggctggcaaaggtggaaggggaggagagtcccgctgaacctgccgcaactgccaccagctccaatagtgacgccggaaatccagtcacaatgcaggaatctcacactgaaagtgagtcggggctagcagaactggactcttctaatgaagacgccggtacaaaaatgtcaggcgagaaaatatag

SEQ ID NO: 237012 - DNA, 1164 bp, Artificial Sequence
  Description of Artificial Sequence: Synthetic coding sequence
atgggggctttcctggacaaacctaaaaccgagaaacataacgcacatggggctggaaacggtctgcgatatggtctgtctagcatgcagggttggcgcgtggagatggaagatgcacacaccgctgtggtgggcatccctcacgggctggaagactggagtttcttcgcggtgtatgacggtcatgcaggcagcagggtcgcgaactactgtagtacccatctgctggagcatatcaccactaacgaggactttcgcgctgctggtaagtccggaagtgccttagagttatcagttgagaacgtcaaaaacgggatccgcactggtttcttaaagatcgacgaatacatgaggaacttttcagatctacgcaatggaatggatcgatctgggtccaccgctgtcggggtgatgatcagcccaaagcacatatacttcatcaattgcggggattcacgcgcagttctttacagaaatggccaggtctgcttttcaacgcaggaccacaagccctgcaatccccgagagaaggaacgcatacagaatgcagggggtagcgtgatgattcaacgggtgaatggctctctagccgtaagcagggccttgggagattacgactataagtgtgtcgatggcaagggaccaaccgagcaactggttagcccagagcctgaagtgtacgaaattctgcgggctgaagaagatgagtttattattctcgcctgtgacggcatctgggatgtcatgagcaacgaggagctgtgcgagtatgtaaagtctcgcctcgaggtgagcgatgatctagagaatgtctgcaactgggtggtagatacttgcctgcacaaagggtcccgcgataatatgtccattgtacttgtgtgcttctccaatgcacctaaagtgagcgacgaggctgtcaagaaagactcagaactggataagcatctggaaagccgggtggaggagattatggaaaaatccggcgaggagggtatgccggatcttgcccacgtgatgcgaattctcagcgccgaaaacatccccaatctgccacctggaggcggactcgcaggaaagcggaacgtcatcgaggcagtgtacagcaggctcaaccctcatcgagaaagcgatggcggagcgggagacctggaagatccttggtag

SEQ ID NO: 237013 - DNA, 1143 bp, Artificial Sequence
  Description of Artificial Sequence: Synthetic coding sequence
atgggtgcatttctagataagccaaaaactgagaagcacaacgcacatggagccggaaatggcctgcgctacggactgagcagcatgcagggctggcgagtagagatggaagatgcccacactgccgttgtgggaatccctcatggcctcgaggactggtccttttttgctgtctatgacgggcatgcgggatctagagtggccaactattgttctacacacctgctggaacatataaccacaaacgaggacttccgagccgcagggaaatcgggaagtgccctcgagctttctgttgaaaacgtgaagaatgggattcggaccgggttcctgaagatagatgagtacatgcggaactttagcgatctacgtaatggcatggataggagcggaagtaccgctgtaggcgtgatgattagccctaagcatatttacttcattaattgcggtgactcccgggcagttctgtacaggaacggccaggtgtgcttcagcacccaagaccataagccgtgcaacccacgggaaaaggagagaatccagaacgctggaggcagcgtgatgattcaacgagttaatggtagcctggccgtaagccgcgcactgggcgattacgactacaaatgtgttgacgggaagggtccaactgaacaattagtgtctccagaacctgaggtttacgaaattctgcgagccgaggaagatgagtttatcatactggcctgtgacgggatttgggacgtcatgagtaacgaagagctgtgtgagtatgttaagtcgaggctggaggtgagcgatgacctggagaacgtgtgcaattgggtagtagacacatgtctgcacaagggctcacgtgataatatgtcgatagttctggtttgtttcagtaacgcgcctaaagtgtctgatgaagctgttaaaaaagacagtgagctcgacaaacacctcgagtccagggtcgaagaaataatggagaagagtggggaagaggggatgcccgacctcgcccatgtgatgcgcatcctctccgccgaaaatatcccgaatctacccccagggggtgggctagccggtaaacggaacgttatcgaagctgtctactccagactgaatccacaccgggagagcgatggccagaagtag

SEQ ID NO: 237014 - DNA, 984 bp, Artificial Sequence
  Description of Artificial Sequence: Synthetic coding sequence
atgggagcctttctggacaaaccaaagacagagaagcacaatgctcatggggctgggaatggcctgaggtacggtttgtcatccatgcaaggttggcgcgtagagatggaagatgcccacaccgccgtagtcggaatcccgcacggactagaggattggtcctttttcgcagtgtacgacgggcacgccggtagtagggtggccaactattgcagcacccacctcctggaacatattactacaaacgaggacttccgagctgctggaaaatcaggctcagctcttgagttgtctgttgagaatgtgaagaacggcattcgcacaggttttctcaagattgacgaatacatgcgtaatttctcggatttaagaaatgggatggaccggagtggcagtacggcagttggcgtgatgatatctccgaaacacatctactttattaattgtggggacagccgtgccgtgctgtatcggaatgggcaagtgtgtttttcaacccaggatcataagccttgcaatccaagagaaaaagaaagaattcagaacgccggaggctcagttatgatccagcgcgtcaacggttccctggcggtgagccgggctcttggggattacgactacaagtgtgttgatggtaaaggaccaactgagcagttagtctccccggagccagaggtttacgaaattctcagagcagaggaggatgaatttattattcttgcatgtgatggtatctgggacgtgatgagcaacgaagagctgtgtgagtatgttaagtcccgacttgaggtgtccgacgatctggagaatgtgtgcaactgggtcgtagacacctgtttgcacaaggggagtagggataacatgagtatagttctggtgtgtttctccaacgcccctaaggtgtcagacgaggcagttaaaaaggattctgagctagacaagcacctggagtctcgcgtggagggaaagacaaacgcgttctag

SEQ ID NO: 237015 - DNA, 1137 bp, Artificial Sequence
  Description of Artificial Sequence: Synthetic coding sequence
atgggcgcatttctggataagcctaagacagaaaagcacaacgcccatggcgcagggaatggattacgatacggcctgtccagtatgcagggctggcgggtggagatggaggacgcgcatactgccgttgttggaataccacacggccttgaagactggagttttttcgccgtgtacgatgggcatgcagggtcacgcgtggcaaactactgctccactcatcttctcgaacacattactaccaatgaagacttccgagcagccggtaaatcgggcagtgcgctggagctgtctgtggagaatgtcaaaaacgggattagaaccggcttcctgaagattgatgagtatatgcggaacttctccgacttgaggaacggtatggatagatcagggagtaccgctgtaggagtgatgatcagcccaaagcatatctacttcataaactgtggagacagcagggccgtgctgtacagaaacggacaggtgtgcttttccacacaggaccataagccctgcaatccaagagaaaaggaacgaattcaaaacgccggaggctctgtcatgatacagagggtgaatggcagtcttgcagtttctagggcactaggcgattatgattacaagtgcgtcgatggaaaagggcctaccgagcaactggtctcccctgaacctgaagtgtatgagatattacgagctgaagaggacgagtttattattttggcctgtgatggaatttgggacgtgatgtccaatgaggaactatgcgaatacgtcaagagccgccttgaggtgtccgatgacttggagaacgtgtgcaactgggtggttgacacgtgcttgcacaagggatcccgggataatatgagcatcgtgctggtctgttttagtaatgcccctaaagtgtccgacgaggccgtgaaaaaggattccgaattagacaagcacctggaatcaagagtcgaggagataatggagaagagcggggaagagggtatgccagacctggcccatgtgatgcggatcctgtctgcggagaatatcccaaatctgcctcccggaggcggactggccggaaagcgaaacgtgattgaagctgtgtacagccgcctgaacccccaccgcgaatcagacgggtag

SEQ ID NO: 237016 - DNA, 1518 bp, Artificial Sequence
  Description of Artificial Sequence: Synthetic coding sequence
atgctgaaccgagttcgtagtgccgtcgcacatctcgtctcatccgggggtgctccccctcctaggcctaaatcgcccgatctgcccaacgctgctagcgcacctccagccgctgcacctgaggctcctaggtcccctccggctaaagccggtagcggtagcgctacacctgctaaggctgtggaagctagagcctccttttcacgtccgacctttctccaactttctcccggaggactcaggagagcagacgaccatgctgggcgagccgtccagagcccacccgacacgggccgacggttgccctggtccaccggatacgcggaggtgatcaacgccggaaaaagtcgccacaacgaggatcaggcttgctgcgaggtggtttacgtagaaggcaggagatcagtgaccggcgtgccacgtgaacctagcaggggacagggcctgtgcttctattattggggactgttcgatggccatgctgggggtggcgctgccgagatggcctctagactgttgcatcgacatatcagagaacagctcaaggacctggtggagatactccaagatccatcccctccacctctgtgcctgcccacaactcccggtacccctgattcaagcgatcctagccacttgttgggtccccagtcatgctggtctagccagaaggaagtctcgcatgagagtctggtcgtgggagccgttgaaaatgcctttcagctaatggacgagcagatggctagggaacgacgaggccatcaagtcgaagggggttgttgtgccctggtagtgatctacctgctcgggaaggtctacgtagcaaacgccggagatagcagagcaattattgtgaggaatggtgagattataccaatgtccagggagtttactccagaaaccgaaagacagaggctacagcttctggggtttctgaagccagaattgctgggatctgaatttactcacctggagtttccacggcgagttctccctaaggagctgggccagagaatgctgtatagggaccagaacatgaccggctgggcctacaaaaagatcgaattggaagatctcagatttcccttagtctgcggtgaaggcaaaaaggcaagggtgatggccacaattggcgttacaagaggattgggcgatcacagcttgaaggtttgcagctcaacccttcccattaagccttttttgtcatgtttccctgaagttcgggtttatgatctgacgcagtatgagcactgcccagatgacgttctggttctcgggaccgacggtctgtgggatgtgaccaccgattgcgaggtagccgcaaccgttgacagggttcttagcgcctacgagcccaatgaccactccagatacaccgccctggcacaagccctggtgctgggtgcccgaggtactcctcgtgatagagggtggcgattgccgaataacaagttaggctctggcgacgatatcagcgtatttgttatacccctggggggaccaggctcatactcttag

SEQ ID NO: 237017 - DNA, 900 bp, Artificial Sequence
  Description of Artificial Sequence: Synthetic coding sequence
atggcatcaaggctgctgcatcggcacatcagagaacagctgaaggacttgaaagaagtctcccacgaatcgctggtggtgggcgcagtggagaacgcattccaactcatggatgaacagatggccagggagcggcgtggtcaccaagttgagggcggttgttgcgccctggtggtcatatatctgctgggcaaagtatacgtagcgaacgcgggagatagccgtgcgattattgtgcgcaacggggaaataattccgatgtcacgcgagttcacacctgaaactgagaggcagcggctgcaactactgggatttttaaagcctgagcttctgggaagcgagttcacacatctggagtttccaagaagggtcctccctaaggagctcgggcagcgaatgctgtacagggaccagaacatgacggggtgggcctataaaaaaattgagttagaggatttgcgatttccactcgtttgtggcgagggcaaaaaagcgagggtgatggccacaataggcgtcacaaggggcctgggcgaccactctctgaaggtctgctctagcacactgcctatcaaacccttcttgagttgtttcccggaagtaagagtatacgatctgacacagtatgaacattgcccagatgatgtgttggtcctcgggactgacggtctgtgggatgtcacaacggactgcgaagtagcagccacagttgatcgggtgctgtctgcttacgagccaaatgaccactccaggtatactgcactggcgcaggcgttggtgctaggggcacgtggtacacccagagaccgaggatggcggctgccaaataacaagctcggctcaggagatgacatcagtgtattcgttatcccactcgggggacctggcagctattcatag

SEQ ID NO: 237018 - DNA, 1119 bp, Artificial Sequence
  Description of Artificial Sequence: Synthetic coding sequence
atgagtacagcagctcttattaccctggtccgcagcggtgggaaccaagtgcgcaggagggtgctcctttctagcagactcctgcaggatgatagacgcgttacgcctacctgtcacagttcaacttccgaaccccgatgctcacgctttgaccctgatgggtccggcagcccggcaacgtgggataactttggcatttgggacaacagaatcgatgaacccattctgctgccaccaagcatcaaatatggtaaacccattccaaagatttcactggagaacgtgggttgcgctagccaaatcggaaaaaggaaggaaaatgaggaccggtttgactttgctcaactcaccgacgaagttctgtatttcgcagtgtacgacgggcacgggggtcctgcggcagcggatttctgtcatacgcacatggagaagtgcattatggatctgctcccgaaggagaaaaacctggagactctcttgaccttggccttcctggaaattgacaaggcgttttcatcacacgcaaggctgagcgccgatgccacattattgacttccgggactactgctactgttgctctgctgcgcgatggaatcgaactggttgttgcaagtgtcggagattctcgagccattctatgtcgcaaaggcaaacctatgaagctaacaattgatcacacgcccgagcgaaaagatgagaaggagcgaatcaagaagtgcgggggatttgtggcttggaattcgcttggtcagccgcatgtcaatggacgactggctatgacaagaagcatcggcgatctagatcttaaaacttccggtgtaatcgcagagcctgagactaagcgcattaagctgcaccacgcagatgactcattccttgtactgaccactgacggaattaatttcatggtgaactcccaggagatctgtgacttcgtcaaccagtgtcacgacccaaatgaggccgctcacgccgtgacagaacaggctattcagtacggtacggaggataattccacagcagtggtcgtaccctttggcgcatgggggaagtataaaaatagcgaaataaatttttcattctctaggtcatttgcaagctccggcagatgggcctag

SEQ ID NO: 237019 - DNA, 702 bp, Artificial Sequence
  Description of Artificial Sequence: Synthetic coding sequence
atgtccaccgcagctctgatcacactggtgagaagtgggggtaaccaggtgcgacgtcgagtcctgctgagctctcggctgctgcaggatgaccggagggttacccctacatgccacagcagcactagcgaacctaggtgctcccgcttcgacccggacggcagcgggtctcccgctacatgggacaattttggtatctgggataataggatcgatgaacctatcttgcttccaccctctattaaatatggtaaaccaatcccgaaaattagcttggagaacgtaggttgcgcttctcagatcgggaaaaggaaggaaaacgaagacaggttcgactttgctcagctcaccgatgaggtactgtacttcgccgtttatgatggtcacgggggacccgctgctgctgatttctgccacacacacatggaaaagtgcatcatggatctcttgcccaaggagaagaatctagagactttgcttacacttgctttcctggaaattgataaggctttttcctcccacgcacgtctatctgcagatgaaaattgcgcctggagcgctgctctggatctggaaccagtcgataccatttgtggagcgtctgtcgagcgggagatctgtctcatcctttctcaggtcaaagagagcagtggcagttatccaggcctccgcgaaggaagccacatcagccttagccactag

SEQ ID NO: 237020 - DNA, 702 bp, Artificial Sequence
  Description of Artificial Sequence: Synthetic coding sequence
atgtcgactgcggctctgatcaccttggtacgatcgggtggcaaccaagttaggcgccgagtgctattatccagtcggctcctccaagatgatcgaagagtcacacctacatgtcattctagcacatccgaacccaggtgttcgcggtttgatccggatggcagtggatcccctgccacctgggataacttcggcatctgggataatcggattgacgaaccaatcctactcccaccatcaatcaaatacggcaagcccatacccaagattagtcttgaaaacgttggctgtgcgtcacagatcggaaagaggaaggagaatgaagatcggttcgatttcgcccagttaaccgatgaggtcctatattttgccgtgtacgatggccacgggggacctgcagcagccgatttttgccacactcatatggagaagtgtattatggacttattaccaaaagagaaaaacctggagacgctgctcacattggcatttctggaaatcgataaagccttttcctcacacgctagactgtctgcagacgagaactgcgcctggagcgcagctcttgacctggaacccgtcgacacaatttgcggcgcttccgtagaaagggagatttgtctcattttatcccaggtgaaagaaagttccgggtcctatccgggactgagggagggctcacatatctcattgagccattag

SEQ ID NO: 237021 - DNA, 585 bp, Artificial Sequence
  Description of Artificial Sequence: Synthetic coding sequence
atgattgaagataccatgacactgcttagcttgcttggaagaatcatgcggtacttcctgctgcgtcctgagacactgttcctgctatgtatcagccttgccctgtggagctatttttttcacacggacgaagtgaagactattgtcaagagcagccgagatgctgtgaagatggtgaaaggtaaagtggcagagatcatgcagaacgatagattggggggactggacgtgctggaagctgaattcagcaaaacctgggagtttaagaatcacaatgtggctgtgtacagtatccaggggagaagggatcacatggaggataggttcgaggtgctgaccgaccttgcgaataaaacacacccatcgatcttcggcatattcgatggccacggaggcgagaccgcagccgagtatgttaagtctcgccttcccgaagcattaaaacagcatttgcaggactacgagaaggataaggaaaattccgttctgtcttaccagaccatcctcgagcagcagatcctgtcgattgatcgtgagatgctcgaaaagctaaccgtgtcttacgatgaggctgtgaccttttag

SEQ ID NO: 237022 - DNA, 1083 bp, Artificial Sequence
  Description of Artificial Sequence: Synthetic coding sequence
atgattgaagataccatgactttgctcagcctcctgggtagaattatgagatactttctgctacgcccagaaacgttgtttcttctctgtatctccctcgctctgtggagctatttctttcatacagacgaggtgaagacgattgttaagagttcccgagatgcagtgaagatggtgaagggtaaagtggcagaaatcatgcagaacgataggcttggtggtctggatgtcctcgaagctgagttttctaagacatgggagtttaagaatcataatgttgccgtctacagcatccagggtagacgcgatcacatggaagatcgatttgaggtgctgacggacctcgccaacaagactcacccttctatctttggcatctttgatgggcatggcggtgagaccgcagccgaatacgtgaagagcagacttcctgaggcactgaagcagcatcttcaagactacgaaaaggacaaagagaattccgttctgagttatcaaacaattttggagcaacagatattatccatcgaccgtgaaatgctcgagaagctcaccgtaagctatgacgaggctggaaccacctgtttgatagccctcttgagcgataaggatcttacggtagcaaatgttggcgacagtcgtggcgtactctgcgataaggacgggaatgccatccctctgtcccacgatcacaagccttatcaactgaaagagagaaaacgcatcaaaagagcagggggtttcatcagtttcaacgggtcttggcgggtgcaggggatcttggctatgtcccgctcattaggagactatcctctaaaaaacctgaatgtggtgattccagatccagatatccttactttcgatcttgacaagcttcagccagagttcatgatactcgcctccgatgggctctgggacgctttctccaatgaagaagcagtgcgctttatcaaggagaggctggacgagccccacttcggcgcaaaaagcattgtgctgcagtctttctatagaggatgtccagataacattactgttatggttgtgaagtttagaaatagtagtaagaccgaggagcagtag

SEQ ID NO: 237023 - DNA, 813 bp, Artificial Sequence
  Description of Artificial Sequence: Synthetic coding sequence
atgcaccttaatggccgatgcatttgcccatccgatcctcaatttgttgaggagaaaggcattcgagcggaagacctggtaattggggcactggaatccgccttccaggaatgtgatgaggtaatcggcagagaactagaggccagcggtcagatggggggttgtaccgctcttgtagctgtgagccttcagggcaagctatatatggccaatgcaggagattccagggctatcctcgtgcggagagacgaaatccgccctttgtcgttcgaattcacccccgagactgagaggcagcgaatccagcagctggccttcgtgtatcctgagctgttagcaggggaattcacacgtctggaattccccaggaggttgaaaggtgatgacctggggcagaaggtgctcttccgcgatcatcacatgtcagggtggagctataaaagagtggaaaagagtgaccttaagtaccctctaattcatggccaaggtcgtcaggcacggttgttgggaaccctcgcagtatctcgcggtctgggagaccatcagctaagagtgctcgacaccaacatccaattaaaaccttttctgctgtctgtcccgcaagtcaccgtgctggatgttgatcagttagagttgcaggaagacgacgtggtggtgatggccactgatggtctgtgggacgttctttctaacgagcaggtggcctggcttgttcgcagttttttaccaggaaaccaggaggatccacaccggtactgtagctgctggggacccgcttgggcctgggtcggcgctagttcaaagcccaaatag

SEQ ID NO: 237024 - DNA, 897 bp, Artificial Sequence
  Description of Artificial Sequence: Synthetic coding sequence
atgcacctcaacggcaggtgcatatgtccctctgaccctcaatttgtggaggaaaaaggtatcagggcggaggatctcgtgatcggggctcttgaatcggccttccaggaatgcgacgaggtgatcgggagggagctcgaggcatccggtcagatgggtggctgcaccgccttagtcgccgtatcccttcaaggaaaactgtatatggctaacgcgggagatagtagagccatcctagtgagaagagatgaaatcagacctttgtcatttgaattcacgcccgagaccgagcgtcagcgaatccaacagttagcattcgtctaccctgagctgctcgcaggagagttcactcggttggagtttccgagacgactaaagggagatgacttagggcagaaagtcctatttcgggatcatcacatgtccggctggtcctacaagagagtagagaaatcggatctgaagtaccctcttattcatgggcaggggcgacaggcccgtctcctcggcactcttgctgtgtccagggggctgggcgatcatcagctccgcgttctggatactaatattcagctgaagcccttcctcctcagcgtgccccaagtgaccgtgcttgacgtggaccagcttgaactgcaggaagacgatgtggttgttatggctaccgacgggctgtgggacgtcttgagcaacgaacaggttgcctggctggtacgtagcttcttaccaggtaaccaggaggatcctcaccgcttctcaaagctggcacagatgttgatccacagcacccagggtaaggaggattcactgactgaggagggtcaggtgtcctatgacgacgtgtcagtcttcgttatcccacttcactcacagggacaagagagctctgaccactag

SEQ ID NO: 237025 - DNA, 744 bp, Artificial Sequence
  Description of Artificial Sequence: Synthetic coding sequence
atggggggttgcaccgccctcgtagccgtcagcctccaggggaagctctacatggccaacgccggagactcccgagcgatcctggtgagaagggacgaaatcaggccactgtcatttgagttcactcccgagaccgagcggcagcgcattcagcaacttgccttcgtatatcctgaattacttgcgggagagtttactcggctggagtttcctcggagactgaaaggtgacgacctgggtcagaaggtcctattccgcgatcaccacatgtccggatggtcctataaaagagtagagaagtctgacctgaaatatccactcatacacggccagggcaggcaggccaggctcctgggaacactggccgtgtctcgagggctcggtgatcatcagctccgcgtgctcgacactaatatccaacttaagccctttttactgagcgtgccccaggtcacagtacttgatgttgaccagctcgagctgcaggaggacgatgttgtagtgatggctactgatggtctgtgggacgtcttgagcaatgaacaggtcgcttggctggttcgtagcttcctgccaggcaatcaagaagacccacaccggttctctaaactggcccaaatgctcatccacagcacccagggcaaagaagatagcctgacagaagagggacaagtctcttacgacgatgtgtctgtcttcgtgatccctcttcattcccagggacaggaaagctcggaccattag

SEQ ID NO: 237026 - DNA, 1380 bp, Artificial Sequence
  Description of Artificial Sequence: Synthetic coding sequence
atgtctgctggctggtttcgccgacgattcctccctggggaaccactaccagctcccaggccaccgggtccgcacgccagtcctgtgccttataggagaccgaggtttctccgagggtcatcctcgagtcccggtgcggcagatgcaagccgacggcctgactcacgaccagtccggtcacctgccaggggcaggaccctgccatggaatgcaggctacgctgaaataattaacgcagaaaaatctgagttcaacgaagatcaggctgcatgcggtaagctttgtattcgcagatgtgagtttggggcagaagaggaatggcttacactttgccccgaagagttcctgacaggacattactgggcgctgttcgatggccatggcggtccggcagctgctatcctggctgctaacacccttcactcttgtctacgaagacagttggaggccgtggtggaagggctggtggcaacccagccaccaatgcatctgaatggcagatgcatttgtccctcagacccacagttcgtggaggaaaaagggataagggctgaagacctcgtgattggggctctggagtcagcctttcaggagtgcgacgaggtcatcggccgagagctcgaagcatctggacagatgggtgggtgtacagccctggtcgcggttagtctgcaaggaaaactgtacatggctaatgcgggagactcgcgagctattctagtgcgaagagatgagattagacctctcagtttcgaatttacacccgaaaccgagcgacagcgcattcagcagctggcattcgtatacccagagctccttgccggagagtttacacgacttgagtttcctcgccgactgaaaggcgatgacctcgggcagaaggtgttattccgtgatcatcatatgtccggttggtcctacaagcgggtggaaaaaagcgaccttaaatacccactcatccacggtcaagggcgtcaagcaagactgcttggtacactggcggtgagccgaggcctgggggatcaccagcttagggtgctggataccaatatccagctgaaaccatttctactgagtgtgccgcaggttactgtgttagacgtggaccaactggaactgcaggaggacgacgtggtagtcatggcaacagacggtctgtgggacgttctctctaacgaacaagtcgcgtggctcgtgaggagtttcctgccagggaaccaagaagaccctcaccggtttagcaaactcgcccagatgctaattcattcaacccagggaaaagaagacagccttactgaggagggacaggtcagttatgacgacgtgtccgtgtttgtgatcccactacattcacaaggtcaggagtcctctgatcactag

SEQ ID NO: 237027 - DNA, 1821 bp, Artificial Sequence
  Description of Artificial Sequence: Synthetic coding sequence
atgcggaggtccgaggtgcttgcagaggagtcgatagtctgtctgcaaaaggccctcaaccatctgagagagatttgggagctcatcgggatccctgaggatcagaggcttcaacggaccgaggtcgtcaagaagcacatcaaagagctcttagatatgatgattgctgaggaggaatccttgaaggaaagactcataaagagcattagcgtgtgccagaaggaattgaacaccctatgttccgagctccacgttgaacccttccaggaagaaggcgagaccaccatactgcaacttgaaaaagacctgcgcactcaggttgaactgatgagaaaacagaagaaagagcggaagcaggaactgaaacttcttcaggaacaggaccaagaactctgcgaaatcttgtgtatgccccactatgacatcgactctgcatcagtacctagtctcgaggagttaaaccagtttcggcagcatgtcactaccctccgggagaccaaagcctctaggagagaggaattcgtgtccatcaagcggcagataatcctatgcatggaagccctggaccacactcccgatacctctttcgaacgggatgttgtgtgcgaagacgaggacgcgttttgtctttcgttggaaaatattgcaactctgcagaagctgctgaggcaactggagatgcagaagtctcaaaacgaagctgtctgcgaggggctgaggacccagatcagggaactgtgggatagacttcagatacccgaggaggaacgcgaagcagttgctaccatcatgtccggatctaaagcgaaggtacggaaggccctccaattggaggttgatcgtctggaggaacttaagatgcagaacatgaaaaaggtgatagaagcaataagagtagaattggttcaatactgggatcaatgtttctacagccaagagcagcggcaggcgttcgctccgttctgcgctgaggattacacggagtcccttctgcagctacacgatgccgagatcgtgaggcttaaaaactactatgaagtgcacaaggagctgttcgaaggggtgcagaaatgggaagagacgtggcgactgtttctcgagtttgagaggaaagcctcagatcctaataggtttacgaacagaggaggcaacctcctgaaggaagagaaacagagagctaaactccagaagatgctccctaaactggaagaggaactgaaggcaaggatcgagctatgggaacaggagcactccaaggcatttatggtaaacggccagaagttcatggagtatgtcgcagaacagtgggaaatgcaccggcttgagaaggaacgggctaaacaagagcgacaactaaagaataaaaagcaaactgaaactgagatgttatatggttccgctcctcgcaccccatcgaagaggcggggtttagccccaaacacgcccggaaaggctcggaaattaaacacaaccacgatgagtaatgcaactgccaacagttctatcaggcccatttttggcggaactgtgtaccacagtcctgtgagtcggctaccacccagcggctccaagcctgtggcagccagcacgtgctccgggaagaaaactcctcgcaccggacgccatggagctaataaagaaaacctggaattgaatgggagtatcttgtccggtggttatcctggctctgcccctctgcagcgaaacttcagcattaattctgtggcatccacttactctgagttcgcgagagaacttagcaaagccagtaagtcagatgccacatccggcattctaaactccactaacatccagagctag

SEQ ID NO: 237028 - DNA, 1701 bp, Artificial Sequence
  Description of Artificial Sequence: Synthetic coding sequence
atgcgtagatctgaagtgctggctgaggaaagcatcgtgtgtcttcaaaaggcccttaaccatttaagggagatctgggagctgatcggtattccagaggaccagaggttacaacggactgaagtggtgaaaaagcacatcaaggagctgctagacatgatgatcgctgaagaagagtccctgaaagaaaggcttatcaagtccatctcggtgtgccagaaggaattgaacacactctgttcggagttgcacgtcgagccctttcaggaagaaggggaaacaactatactgcagctcgaaaaggatttgagaacacaggttgaactgatgcgaaaacagaaaaaagagcggaaacaggagctcaagctgctgcaagagcaagaccaggaactgtgcgaaatcctgtgtatgcctcattacgacatcgacagcgctagcgtgccatccctggaagagctcaaccagttcaggcagcatgtcacgactctcagagagaccaaggcctcccgtagagaggagtttgtgtcgatcaagcgacagatcatcctgtgcatggaagcattggatcatacccccgacacaagtttcgagagggatgtagtgtgcgaggatgaagatgccttttgcttgtcattggagaacatcgccaccctgcagaagctacttcgtcagcttgaaatgcagaaatctcagaacgaagcggtgtgcgagggcctccggactcaaataagagagctgtgggaccggctacagattccggaggaggagagggaagcagtcgctacgatcatgtctggatcaaaggccaaagtgaggaaggccctccagttagaggtcgatagactggaagagttaaaaatgcaaaatatgaagaaggttattgaggctatccgagtcgagctcgttcaatactgggaccagtgcttttacagccaggagcaacggcaggcttttgcgccattttgcgccgaggactatacagaatcactcctccagcttcatgatgctgaaattgtgagacttaagaattattacgaggtacacaaggaacttttcgagggcgtccaaaaatgggaggagacatggcgcttatttctggagtttgagcggaaggcaagcgatccaaaccgcttcaccaatcgtggagggaatctgcttaaggaggagaaacagcgggcaaaacttcagaaaatgctccccaaacttgaggaggagttgaaggccaggattgaattatgggaacaggagcactcaaaagcctttatggtgaacggacagaagttcatggagtacgtggcagagcagtgggagatgcacagactggagaaagagagggccaaacaggaaagacagctcaaaaacaagaagcagacagagacagagatgctgtatggctccgctcctcgtaccccttcgaaaaggcggggactggctccaaataccccaggcaaggcccgtaagttgaatactacaaccatgtctaatgctaccgccaattcttcaattcgtcctatctttgggggaacagtttatcatagtcctgtgtcccgactgccgccttctggaagtaagcccgttgcggcttccacatgtagcggaaagaagacaccacgcaccggtagacatggggcaaataaggagaatctcgagctcaatggatccattctatcggcacgcacctttaaagggttccagatttag

SEQ ID NO: 237029 - DNA, 1863 bp, Artificial Sequence
  Description of Artificial Sequence: Synthetic coding sequence
atgaggcgctctgaggtactggcagaggagtcaatcgtgtgcctacagaaggctctgaaccacctgagggagatatgggaactaattggtattcctgaagatcagaggctgcagcgcactgaagtagtgaaaaagcacatcaaagagttgctggatatgatgattgccgaagaggagtccctgaaagaacggctgatcaaaagcatctccgtctgccagaaggagctaaacactctctgtagtgaattacatgttgagccttttcaggaagaaggagagactactatcctgcaacttgagaaggatctgagaactcaggtggagctgatgcgtaagcagaaaaaagaacggaaacaggagctcaaactgctgcaggaacaggatcaagagttgtgcgaaatcctgtgcatgcctcactacgatatcgactccgcgagcgtcccttccctggaagagctgaaccagttcaggcagcacgtgactaccctgcgggagacaaaagcaagcaggcgcgaggagtttgtctccatcaagcgccagataattctctgcatggaggccttagaccatacgcctgacaccagctttgagagagatgtcgtctgtgaggatgaagacgctttttgtctgagtttggagaatatcgccaccctacagaagcttctgaggcagctggagatgcagaaaagccaaaatgaggccgtctgcgaaggactaagaacccagatcagagaactttgggatcgcttgcaaattccggaggaagaacgggaggcagtagctacaattatgtctggctctaaagcaaaggtcaggaaggccttgcagttggaggtggacagactggaggagctgaagatgcagaatatgaaaaaggtgattgaggcaatacgtgtagagctggttcagtattgggatcagtgcttctattcccaggagcagagacaggccttcgcacccttttgtgccgaagattacaccgaaagcctgctacagctacacgatgctgagattgtgaggttaaaaaactattacgaggtgcataaagaactgtttgagggcgtgcagaagtgggaggaaacgtggcggttgttcctggaattcgaacggaaagcatccgaccccaatcgcttcacaaatagggggggtaatctgcttaaagaggaaaaacagagggctaaactgcaaaagatgctaccaaaattagaagaggagttaaaagcgaggattgagctgtgggagcaggaacattccaaagcctttatggtgaacggtcaaaagtttatggaatacgtggctgagcagtgggaaatgcaccggctggaaaaagaacgagctaagcaagaacgccaactcaagaacaaaaagcagaccgaaacagagatgctttacggctccgcaccccgaactccctctaagcggcgtggtcttgccccaaataccccgggaaaggccaggaaattgaataccacaactatgtccaacgccaccgccaactctagcatccgccctatcttcggcggaactgtctatcattctcccgtgtccaggttgccaccgtctggcagcaaacctgttgcagctagcacctgcagtggtaagaagactccccgaacaggtcggcacggtgcaaacaaagaaaacttagagcttaatgggtcgatcctgagcggcggataccctggctcggctcccctccaacggaacttctccataaattcggtcgcttctacttactctgagttcgccaaggatccatccctgagtgattcttccacagtcggcctgcaacgagagctatccaaggcctctaagtccgatgctacaagcggcatcctgaactccaccaacattcagagttag

SEQ ID NO: 237030 - DNA, 1578 bp, Artificial Sequence
  Description of Artificial Sequence: Synthetic coding sequence
atgaggagatccgaagtgctggctgaagagtcaatcgtctgtctgcaaaaagctctcaaccacctcagagaaatttgggagctgatcggcatccccgaggaccaaaggctgcagcgaaccgaggtggtcaagaaacatataaaagaagagggcgaaaccactattctccaattggaaaaggatttgcggacccaggtagaactgatgaggaagcaaaaaaaagagcgcaagcaggagctgaagctgttgcaggagcaggatcaggagttgtgcgagatcttgtgtatgccacattacgatatcgactctgccagtgttcccagcctcgaagaactgaaccaatttcggcagcatgtcaccaccttacgagagacgaaagcaagccgccgagaagagttcgtcagtatcaagcgccaaattatcctgtgtatggaggctcttgatcacaccccagatacctccttcgagagggacgtagtttgcgaagatgaagatgccttctgtttgtcgttggagaacatcgcaacattgcagaagctcctcaggcagttagagatgcaaaagtcgcagaacgaggccgtatgtgaagggctccgcacccaaattcgcgagctttgggatcgcttgcagattcccgaggaggaacgcgaagccgtggccaccattatgtccggctcaaaggccaaggtgagaaaagccctgcaactcgaggttgatagactggaagagttgaagatgcagaacatgaagaaggtgatcgaggctattcgggtcgagctcgtgcagtattgggatcaatgcttttatagccaggaacagaggcaggcgttcgctccattctgcgcagaagactacaccgaatcactactgcagctccatgatgccgagattgtgagactgaagaattactatgaagtgcataaggagttgtttgaaggcgtccagaagtgggaagagacatggagactgttcctcgagtttgagcgaaaggcctctgatcccaatcgttttaccaatcggggaggtaacttgctaaaagaagagaaacagcgcgctaagctacagaagatgttaccaaaacttgaagaagagctcaaagctcgcatcgagctgtgggagcaggagcactctaaggctttcatggtcaacgggcagaagtttatggagtacgttgcggagcagtgggaaatgcacaggctcgagaaggaacgagccaagcaagagagacaactgaagaacaagaagcaaactgaaaccgagatgttgtacggaagtgctccgagaacaccttcaaagaggaggggattagccccaaacacaccagggaaagccaggaaactgaacacaacaacaatgagcaacgcgaccgcgaatagcagcatccggccaattttcggagggactgtgtatcactctccagtgtcaaggctgccacctagtggcagtaagccagttgcagcctctacctgtagcggaaagaagacgccaaggactggtcgacacggcgcaaataaggaaaacctggaactgaacggtagtatactgagtgcaaggacctttaaggggtttcagatatag

SEQ ID NO: 237031 - DNA, 696 bp, Artificial Sequence
  Description of Artificial Sequence: Synthetic coding sequence
atgagggtactgggaggacggtgtggcgcattattagcttgcttgttactcgtcctcccggtatctgaggctaatttctgtctctatttccgcaatgactttatctataatagagcttgtatatctgtgttggtgggccttagcggatgcaactttttctacagcatctgtttcttgtctaaacagcaggcttctcaggtgctcgtgcgcaaaaggcgcgcaaacagcctcttggaggagactaagcagggcaaccttgagagggaatgcattgaagagctctgcaataaggaggaggccagggaggtcttcgaaaatgatcctgaaactgattacttctacccaaagtacctggtttgcctgcgctccttccagacgggcctttttacagcggctcgtcagagcaccaatgcatatcctgacctgaggtcttgtgttaatgcaatcccagaccagtgcagtcctctgccctgtaacgaggacggttatatgtcatgtaaggacggcaaagcctcattcacctgtacttgcaagcccggttggcagggcgagaagtgtgagttcgacatcaacgaatgcaaagatccaagtaacattaatggagggtgtagtcagatctgtgataacacacccggtagttatcactgcagctgtaaaaacgggttcgtgatgttatccaataaaaaagattgctag

SEQ ID NO: 237032 - DNA, 2031 bp, Artificial Sequence
  Description of Artificial Sequence: Synthetic coding sequence
atgagagtgttggggggacgatgcggcgctttacttgcctgcctgttgctggtgcttcccgtcagtgaggccaatttccttagtaaacagcaggctagccaggtgcttgtacgcaaaagacgcgcaaacagcttgctcgaggaaacaaagcaaggtaacctcgagcgcgagtgcatcgaagagctctgtaataaagaagaggcacgagaggtattcgaaaacgatcctgagacggattatttttatccgaaatatctggtgtgtctgaggtctttccagaccggcttatttacagccgctcgccagtccaccaatgcttatcccgacctccggtcctgcgtcaacgccatcccggatcaatgctctccactcccatgtaatgaggacggctacatgtcctgtaaagatgggaaggccagctttacctgcacctgtaagccgggatggcagggcgaaaaatgcgagttcgacattaacgagtgcaaggatccttccaatattaacggcggttgcagccaaatctgcgacaacacacctggatcttaccactgtagctgcaaaaatggttttgtgatgctttccaataagaaagattgcaaagacgtcgacgagtgttcactgaagcctagcatctgcgggacagcggtgtgcaaaaacattcccggagatttcgagtgcgagtgccccgagggctaccggtacaacctgaaatctaagagttgtgaggacatcgacgagtgctcagaaaatatgtgcgcacagctttgcgtgaattatcctggaggctacacttgttattgcgatggaaagaagggctttaagctggcacaggaccagaaaagttgcgaggtcgtaagtgtgtgtctgcctctgaatttagatacgaaatacgagctgctctatctcgccgagcagtttgctggcgtggtattgtacctgaaatttcgtttgccagagatctcaaggttctccgcagaatttgacttccgaacctatgatagcgaaggcgtgattctctacgctgagtccattgatcactccgcctggttactgatcgcccttcgcggagggaagatcgaggtccagttaaaaaatgaacatacaagcaagattaccaccgggggagatgtgatcaacaatggtctctggaatatggtgtccgttgaggagctagagcactcaataagtatcaagattgcaaaggaggcagtgatggacataaacaagcctgggccattatttaagcctgagaatgggttgctcgaaaccaaggtctatttcgctggcttccctcgaaaagtggagtctgagttgatcaagcctatcaatccccgtctggacggttgcatacgctcttggaatctgatgaagcagggagcatctggcataaaagagatcatccaagagaagcagaacaagcactgcctagttactgtcgaaaaaggtagttactacccaggaagcgggattgctcagtttcatattgactacaacaacgtcagcagcgctgaaggctggcatgtgaatgtaactctgaatatacggccttcgacaggaactggggtcatgctggccctggtttcaggaaataacactgtcccttttgccgtatctctggtcgatagcacttctgagaagagccaggatattctgctctccgtagagaacacagtgatttaccgaattcaggccctgtccctctgctcggatcagcagtcacacctggagttccgggttaatcgaaataacctggaactgtccactcctctaaagatcgagactatttcccacgaggatctccagcgtcagctggccgtgcttgacaaggcgatgaaggccaaggtggctacgtatctgggaggcctgcctgacgtgcccttcagcgccacccctgttaatgctttttacaacgggtgtatggaagtgaatatcaacggggtgcagctggacctcgatgaagccatctccaaacacaatgacatcagggctcatagctgccctagcgtgtggaagaagaccaaaaattcctag

SEQ ID NO: 237033 - DNA, 1275 bp, Artificial Sequence
  Description of Artificial Sequence: Synthetic coding sequence
atgggctgcggcacatcaaaggtactccctgaaccccctaaagacgtgcagcttgacctagtaaaaaaggtggaacccttttccggaactaaatccgacgtgtataagcactttatcactgaagttgactctgtcggacccgttaaggctgggttcccagccgcatcccagtatgcccacccctgccccggaccgccaacggctggacatacagagcctcctagtgagccacccagacgcgcaagagtagcaaagtatcgtgccaaattcgacccaagggtcaccgccaagtacgacataaaggccctcattgggagaggtagttttagtagagtagtaagggtcgagcacagagcaacacgacaaccgtatgcaataaagatgatcgaaaccaagtaccgagaaggccgtgaagtgtgtgagtctgagctccgtgtgctgcgcagggtgcgccacgcaaatatcatacagctggtggaggtcttcgaaacccaggagcgcgtctatatggtgatggagctggcaactggaggggaactctttgataggatcatcgctaagggcagctttactgagcgggatgcaacacgcgtgctgcagatggtgttggatggagtcaggtatcttcacgccctgggcattacccatcgagatctgaagccagagaatctcctgtactaccaccccggaaccgacagcaagattataatcaccgactttggcctggcttcagcacgcaaaaaaggtgatgattgcctgatgaaaacgacctgtgggacaccggaatatattgcgcctgaggtcttggttaggaaaccttacactaacagtgtcgacatgtgggcactgggtgtgatcgcctacatcttactctccggaaccatgccatttgaggacgataaccgaacgcgcctttataggcaaatactgcgtggaaagtattcctattcaggtgaaccgtggccaagcgtatctaatctggcaaaagatttcatcgacaggctgctgacggtcgaccccggtgctcgaatgaccgcactgcaggcgctccgtcacccgtgggtcgtgtcaatggcagcaagcagttcaatgaagaatctacacagatccatcagccagaatctgctcaagcgggcaagctctcgctgtcagagtactaagtcagctcagtcaacaagatcttcccggtcaacacggtcaaataaatctcgtagggtaagggagagggagctgagagagctgaatttgcgatatcaacagcagtataacggctag

SEQ ID NO: 237034 - DNA, 1953 bp, Artificial Sequence
  Description of Artificial Sequence: Synthetic coding sequence
atggcctgcagggagttcgagatgggcaggaagaaatgtgagcgttactggccactgtatggggaggaccccatcacattcgccccttttaaaatctcatgcgaagacgaacaggcccgtactgactatttcatcagaaccttgctgctggagtttcagaacgagtcccgccgattgtatcagtttcattatgtcaactggcccgatcacgacgtgccttcctcattcgactcgatactggacatgatttcgctaatgcgcaagtaccaggagcacgaagatgttccaatctgtatacactgtagtgcaggatgtggcaggaccggcgctatctgcgctattgactacacctggaatctgctgaaggccggaaagatcccggaagagttcaatgtgttcaacctaatccaggagatgcgaactcagcgccactcagcagtccagaccaaggagcaatatgaacttgtgcacagggcaattgcacagcttttcgagaagcaactgcagctgtacgaaatccacggagctcagaaaattgcagacggagttaacgagatcaataccgagaatatggtgtcaagtatcgagcctgaaaaacaagatagtccgccaccaaaacccccacgaacacggtcgtgccttgtggaaggcgacgcgaaggaagagattttacagcctcctgagccccaccctgtgccacctattctgacacctagcccgccttccgctttcccgacagtgaccacagtctggcaggacaacgacagatatcatcctaagccagtactgcatatggtctcttccgagcagcattctgccgatcttaacaggaactatagcaaatctaccgagcttcccggaaagaacgagtctacaattgaacaaatcgacaaaaaactcgaaagaaacttaagctttgagatcaagaaggtaccgctgcaagagggcccaaaatcttttgacggcaatactctattgaaccgtggccatgccatcaaaatcaaatctgcatcaccttgtatcgccgataaaatctctaagcctcaggagttgtcatccgacctgaatgtgggcgatacaagtcagaactcctgtgtggattgctctgtgacacagagcaataaggtgagcgttacaccgcctgaagagagtcaaaactctgacaccccacccaggcccgacagattgcctctggacgaaaaaggccacgtgacctggtcattccacggcccagaaaacgccattcccatacccgatctgagtgagggtaacagcagcgatattaactaccagactagaaagaccgtgtcactgacacctagcccgacaacacaagtggagaccccagaccttgtggatcacgacaatacatctcctctattccgtacgcccctgagcttcactaatcccctgcactctgacgacagcgatagcgacgaaagaaacagcgatggcgcagtgactcagaacaaaacaaacatttccaccgcctcagccaccgtttctgctgctacatctacagaatcaatcagcacccgtaaagtgttacctatgtcaattgctagacacaatattgccggaactacgcattctggagctgagaaggacgtggatgtctcggaggattctccacctcccctaccggaacgcacgccagagagcttcgtgcttgccagtgagcacaacacacccgtgaggagcgagtggagcgagctccaatctcaggagagatcagagcagaagaagtcggaaggactgatcacaagtgagaatgagaagtgtgatcatcctgccggaggtattcattacgaaatgtgcatcgagtgcccaccaaccttctctgacaagagggagcaaatcagcgaaaaccctacggaggccactgacattggttttggcaaccgatgcggcaagcccaaaggtcctcgcgaccccccatccgaatggacatag

SEQ ID NO: 237035 - DNA, 1062 bp, Artificial Sequence
  Description of Artificial Sequence: Synthetic coding sequence
atgtctagatctctggattctgccagatcctttctcgagcgcctggaagcgcgaggaggacgcgagggagccgtgctggcaggcgagttttcaaagcgctgcgaaagatattgggcccaggagcaggagccattacagacaggactcttctgcataacactaatcaaagagaaatggcttaatgaagacattatgctgcggaccttgaaagtgaccttccaaaaggaaagccgctcggtgtatcagcttcagtatatgtcttggcctgacaggggcgtgcccagcagcccagatcatatgctggctatggtcgaagaagcccgtagactacagggaagcggacctgagcccctgtgtgtgcactgctccgcaggctgcggaagaactggggtgctgtgcactgtggactacgtgaggcagctattattgactcagatgatacctcccgatttcagtctgttcgacgtggtgctcaaaatgcggaaacagcgccctgcagcagttcaaacagaggaacagtatcggtttttgtatcataccgtggcccagatgttttgctcaaccctccaaaatgcatcaccccattatcagaacatcaaggaaaattgtgctcctctgtatgacgacgcactgttcttaagaacaccgcaggccttactggccatccctagaccacctggtggcgtgctgcgctctatatcggtcccaggctcccctgggcacgctatggctgacacatacgcagtagtccagaagagaggggctcctgccggagcaggatctggaacacagacagggaccgggacaggcactggggctaggtcagcagaggaggctccactgtactcgaaagtcaccccacgcgctcagcgccctggggctcacgcagaggatgctcgtggcacccttcctggccgtgttccagccgatcagtcacccgctggatccggcgcatacgaggacgttgcaggaggggcacaaactggtggattggggttcaacctgcggattggaagaccgaagggcccacgagaccccccagccgagtggactcgcgtgtag

SEQ ID NO: 237036 - DNA, 1233 bp, Artificial Sequence
  Description of Artificial Sequence: Synthetic coding sequence
atgccaacaaccatcgagcgggaatttgaagagctggatacgcagcgcagatggcagcccctgtacctagaaattcgaaacgaaagtcacgactacccccacagggtggctaaattcccagagaacaggaataggaataggtaccgtgacgtgagtccctatgaccattcgcgcgtgaagctgcagaatgcagagaacgattacataaacgcaagcttggttgatattgaagaggctcagaggagttatattctgacacagggtcctctaccaaacacatgctgccacttctggctgatggtgtggcagcagaaaacaaaggcagtggttatgttgaatcgaatcgtggagaaagaaagcgtcaaatgcgcgcagtactggcccacagacgaccaagagatgctctttaaggaaacaggctttagcgttaagctcctttctgaagacgtgaaaagctattatacagtgcatctgctgcagttggagaacattaactatatcgaaaacctctggatcacactgtatctcaaactcttgatgcttgacgtaaagcggagtttaaagtcgggggagaccagaacgatttcccactttcactacaccacatggcccgactttggggtgccggagtccccagcttcatttctaaacttcctattcaaggttcgagaaagcggctcactaaaccctgaccacgggccagccgtgattcattgcagcgccggtattggccgaagtggcacgtttagtttggtcgacacgtgtctggtgctgatggagaagggggacgatattaacattaagcaagtgctgctaaatatgagaaagtatcgtatgggcctcatccagacgcctgaccagctgagattctcctacatggccatcatcgaaggagctaaatgcattaagggtgatagttctatccagaagcggtggaaggagttgagtaaagaggaccttagcccagccttcgatcattctccaaacaagatcatgaccgagaaatacaacggcaacaggatcgggttggaagaggagaagctgacgggggatagatgtactggtcttagttctaaaatgcaggacaccatggaggagaacagtgagagtgccttgcggaagcggataagggaggacaggaaagctacaacagctcagaaagtgcagcagatgaaacagcgactgaacgaaaacgaacggaagcgaaagcgcccacggttgacagacacatag

SEQ ID NO: 237037 - DNA, 2259 bp, Artificial Sequence
  Description of Artificial Sequence: Synthetic coding sequence
atggaccagagagaaattctccagaaatttctggatgaggcccagtctaagaagatcaccaaggaagaatttgcgaacgagttcctcaaactaaagcggcagtctactaagtataaggccgataaaacctatccaactacagtggccgagaaacctaaaaatatcaagaagaatcgatacaaagacatcctcccatatgattattctagagttgaactatcgctgattacatctgatgaagactcctcctacatcaatgccaactttattaaaggggtttatggacctaaagcctatatcgcaacgcagggcccactttccaccacactgctggacttctggcgcatgatctgggagtattccgtgctcatcatcgtgatggcctgcatggaatacgaaatgggaaagaaaaaatgcgaacgctattgggccgagcctggcgaaatgcagctagaatttgggcctttttctgtgtcgtgcgaagcagagaaaaggaagtcagattacataatccggacactgaaagtgaagttcaacagcgagacaaggactatctatcaattccattataagaattggcctgaccacgatgttcctagctccatcgatcctatcttagagctgatttgggacgtccgctgctatcaggaggacgactcagttccaatttgtattcattgtagcgcaggctgcgggcgaacaggtgtgatctgtgccatcgattatacctggatgctgctgaaagacggctcccaggccaaacactgcatacccgagaaaaaccataccctccaggctgacagctactcccccaatctgcctaaaagtactacaaaggctgccaaaatgatgaatcagcagaggacaaaaatggagataaaggaatcctccagtttcgactttaggacctccgagatttctgctaaggaggaactggtcttgcatccagctaaaagcagtacaagcttcgatttcctggaactcaattattccttcgacaaaaatgctgacactaccatgaaatggcaaactaaggccttccccatcgttggcgaacccctgcagaagcatcaaagtctcgacctcggcagtctgttattcgagggatgctctaactcgaagcccgtgaacgctgccggacgctatttcaactcaaaagtgcccatcactcggacaaaatctactcccttcgaactaatccagcaaagagagaccaaagaggtggactccaaggagaacttttcctatctggaatctcagcctcatgactcatgtttcgtggagatgcaggcccagaaggtgatgcacgtcagctctgccgaactgaactactcactcccgtacgatagcaagcatcaaatcagaaatgcttcaaatgtgaagcaccacgattcttctgctttgggggtgtattcctacattccactggtggagaacccctactttagcagctggccacctagtgggacgagtagcaaaatgtccctggatcttcccgaaaaacaggacggcacggtgttcccttcctcgctgctgcctacaagctcaacaagtctgtttagttactacaattctcatgactctttgagtctgaattcgccaactaacattagtagcctgctgaaccaggaatccgcggttctagcgacagcacccaggatcgacgacgaaatccctccaccattgccggtctggactcccgagagcttcatcgttgtcgaggaagctggagaattcagcccaaacgttccgaagtcccttagcagtgcagtgaaggtcaagatcgggacatcattagagtggggcggtacttctgagcccaagaaattcgatgattccgttattctgcgcccaagcaagtctgtgaagctgagaagccctaaatcagagctgcatcaggataggagctcccccccacctccgttaccagaaaggaccctcgagtccttctttctcgcagacgaggattgtatgcaggcccaatctatcgagacttacagtacctcgtacccagataccatggagaactctacaagttctaagcagacactgaagaccccgggaaaatccttcacccgtagcaagtctctcaagattttgcggaacatgaagaagagcatctgtaacagctgtccgcctaacaaacctgcggagtccgtccagtccaacaacagctcttcgtttctgaattttggtttcgccaaccgcttttctaagcctaagggcccacgcaatccgcctccgacctggaatatatag

SEQ ID NO: 237038 - DNA, 5723 bp, Artificial Sequence
  Description of Artificial Sequence: Synthetic coding sequence
atgttaagtcatggcgctgggcttgccttgtggattaccctttcactgctgcaaactggtctggccgaacctgaacgctgcaacttcacactagccgagtctaaagcctccagccactcggtgtcaatacagtggcgcatcttaggatccccttgtaactttagcttaatttacagtagcgatactctaggcgcagcgctgtgtcccacctttcgcatcgacaacaccacctatggctgcaacctgcaggatcttcaggcgggaacaatatacaacttccgaatcatatctttggacgaagaacgaacagtcgtcctccagaccgatcctctgccaccagcaagattcggcgtttccaaagaaaagaccaccagcacctccctgcatgtttggtggacacctagcagcggaaaagtcaccagctatgaagtgcaactcttcgatgaaaataatcagaaaatccagggggtgcaaattcaggagtcgaccagttggaatgagtacaccttctttaatctaactgcgggttccaaatataacatcgcgattacagctgtaagtggagggaaaaggagtttcagcgtctatacaaacggcagcaccgtgccctcacccgtgaaggatatcggaattagtaccaaggctaactccttactcatatcttggagtcacggtagcggtaacgtggaaaggtatcgcttgatgctaatggataagggaatcctggtccacggcggtgtggttgacaagcacgcaacatcttatgcattccatggccttacccccggttatctctacaatctcacagtcatgacagaggcggctggcctgcagaactacagatggaaattggtcagaacggcccctatggaagtatccaatctcaaggtaacaaatgacgggagtctgaccagccttaaggttaaatggcagagaccaccagggaacgtcgactcgtataacatcaccctgagccacaaagggaccattaaggaatcccgcgtcctcgctccctggatcaccgaaacacacttcaaagaactcgttcccggtaggctgtaccaagtcacagtctcttgtgtgtctggagaattgtctgctcagaagatggcggttggtcgcacatttcctgataaagttgcaaacctggaggctaacaataatgggcgtatgcgatcactggtcgtctcttggagtcccccagccggagactgggagcaataccggatcctgctcttcaatgactccgtggtcttacttaatattactgtcggtaaggaggagacccagtacgttatggatgataccggccttgtccccggaaggcaatacgaagtcgaggtgatcgtggagtctgggaacctgaagaactcagaacggtgccaggggagaacagtgcctttagcagttcttcaattgcgagtcaagcacgctaatgagactagcttgagtatcatgtggcagacaccggttgccgagtgggagaagtacataataagtctcgctgacagggatctgctactgattcataaatcactttccaaagatgctaaggaattcaccttcacagatctggtacccggacgaaaatacatggccaccgtaacgtccataagcggggacctcaaaaatagctcatctgtcaaaggtcggactgtacccgcacaggtcacagacctgcacgtcgccaatcagggaatgacaagcagtttgtttacaaattggacacaggctcagggtgatgtagaattttaccaagtgctcctgattcacgagaacgttgtcattaagaatgagtccatcagctctgaaacatcgaggtatagttttcattcccttaaatccgggagcctctactctgtggtagtcacaactgtctcagggggaataagttctcgccaggtggtggtggaaggacgaacagtgccatccagcgtgtcaggcgttacggtaaacaattcaggccgtaatgattacctgtcagtgtcgtggctgctcgcaccaggagatgtagataactacgaggtaacgctgtcccatgacggcaaggtggtccagtctctcgtcattgctaaaagcgtgagggagtgttcttttagttccttaactcctggacgactctacactgtgaccataaccactcgcagcggcaaatatgagaaccactcattctcacaggagcgaactgtcccggacaaggtgcaaggagtttcagtcagtaacagtgcaaggagcgattacctccgagtgtcttgggttcacgcgaccggcgatttcgaccactacgaagttacaataaaaaacaagaacaattttatccagaccaaatcaattcctaagtccgagaacgagtgtgtgtttgttcagctagtgcccggacgtctgtactcagtgactgtgaccactaagagcggtcagtatgaagccaacgagcaggggaatgggagaacgattccagagccagtgaaggacctgacattgcgaaacagatccactgaagatctccatgttacgtggtccggggctaacggggacgtggaccagtatgagatccagttgctgttcaacgatatgaaagtttttccgccttttcacctcgtgaacaccgccaccgagtaccgctttacaagcctcacccccggacggcagtacaaaatccttgtgctaacaatctccggagatgtccagcaatctgcctttatcgagggtttcacagtgccatcagctgtgaaaaatattcatatcagccctaacggagccactgatagtctcaccgttaattggacacctgggggtggtgatgtggattcctacacggtcagcgccttcaggcactcacagaaggtcgattcccagacgattcccaagcacgtgttcgagcacaccttccacaggctggaggccggagaacagtatcagatcatgattgccagtgtctctggaagtctaaaaaaccagatcaatgtagttggaagaaccgtcccggctgcagttactgacctgcgtatcaccgaaaactccaccagacatctgtcctttagatggacagcgagtgaaggagagttatcttggtataatatctttctgtataaccccgatggaaacctgcaggagagagctcaggtggaccccctggtccagtccttctctttccaaaacctgctgcagggtcggatgtataagatggtcattgtaacacattccggagagctcagtaacgaaagttttatctttggcaggacagttccggcatctgttagccatttaagaggctctaatcgaaatacaacagactcactgtggtttaattggtcacctgcatcaggagatttcgatttttacgagctgattctgtataaccccaacggtacgaaaaaagaaaattggaaggacaaagaccttacagaatggagatttcaggggcttgtgcctgggcgaaaatatgtcctctgggtagtgactcacagcggagacctgtccaacaaggtaaccgctgagagccgcaccgccccttcaccccctagcttaatgtccttcgccgatatcgccaacacttcccttgccatcacttggaaagggcctcccgactggactgactacaacgatttcgagctgcagtggttgccgcgagatgccttgaccgtgtttaatccttataacaaccgaaagtcagagggacggatcgtgtatggcctgagacccggacgctcgtaccagttcaatgtcaaaactgttagtggggactcatggaagacctacagtaagcctatctttggtagcgtaagaaccaaacccgataaaattcaaaatctgcattgccggccacagaatagcacggccattgcttgcagttggatcccaccagactccgactttgacggatattctattgagtgccgcaagatggatacgcaggaagtggaattttctaggaagctcgagaaggaaaagtcgctactgaacattatgatgctcgtcccccataaaagatacttggtgtcaatcaaggtccagtcagcagggatgacatcagaggtggtcgaggactcaactatcaccatgatagaccgtccgccaccacctcccccacatattagagtgaatgaaaaagatgtgctcatcagcaagtcctccatcaatttcactgtcaactgctcctggttctccgacactaatggagccgtgaaatattttactgtggtcgtgagggaagccgatggtagcgacgagttgaagcctgaacagcaacacccattgcctagctacctggaatacaggcataatgcaagcatccgcgtgtaccagactaattacttcgccagtaagtgtgcagagaatcccaactctaatagtaaatccttcaacataaaactgggtgcggagatggaatccttggggggaaagtgcgaccccactcagcaaaaattctgcgacggacccctcaaaccgcatactgcgtataggatctctatacgggcttttacccagctgttcgacgaagacctcaaggagtttacaaagccactatattccgataccttcttctctctccccatcactaccgagagcgagccactcttcggtgcaatcgaaggtgttagtgccggactctttctcatcggcatgctggtcgccgtggtggccctgctgatttgcaggcagaaggtttcccacggcagagagcggccaagtgcgagactaagtatcagacgtgatcgtcccctttccgtgcaccttaatctgggccagaaaggaaacagaaaaacctcatgccccattaagatcaaccaattcgaaggccatttcatgaaattacaggcagactccaattacttgctgtctaaggagtacgaggaacttaaggatgtgggaaggaatcaatcttgtgatattgccctcctgccagaaaaccggggtaaaaaccgttataacaatatattaccctatgacgcaacccgggtgaagttgagcaatgtcgatgacgacccctgttcagattacataaacgcatcgtacataccaggcaataacttccgacgggaatacattgttacccagggccctttacctggcacaaaggacgacttttggaagatggtgtgggagcagaacgtgcacaatattgttatggtgacgcagtgcgtggagaaagggagagtcaagtgcgaccattactggcctgctgaccaggatagcctctactatggggaccttatcctacagatgctttctgagtctgtcctgcctgagtggactatcagagaattcaagatctgtggggaggagcagctggacgctcaccgcctcatccgccactttcactataccgtctggccagatcacggtgtgccggagaccactcagtctttgatacagttcgtgcggaccgtgagagactatattaaccggagtcctggggcaggccctacagtggtccattgcagcgctggagtgggacgaaccggcacttttatcgccttagatagaatcctgcagcaactggattcaaaagatagcgtcgacatttatggcgcagtgcacgacctccgactgcaccgggtgcacatggttcagaccgagtgtcagtacgtgtatctgcatcagtgcgtgcgtgacgtgttgcgagccagaaagctccggtctgagcaggaaaatcccctatttcctatctacgaaaatgtcaaccccgagtaccacagggatcccgtgtactcacgacatta

SEQ ID NO: 237039 - DNA, 4518 bp, Artificial Sequence
  Description of Artificial Sequence: Synthetic coding sequence
atggtccacgtggctcgtctgttgctccttctgctgacctttttcctcaggacggatgcagagacacctcctcggttcacccgcacccctgtcgaccagacaggtgtgtctgggggagttgcaagtttcatctgtcaggctacaggagacccaaggcctaaaatcgtttggaataagaagggtaagaaggtcagcaaccaacgcttcgaagtgattgagtttgacgacggcagcggaagcgtcctcagaatccagcccctgcgcacacccagagacgaggctatctatgagtgcgtggccagcaacaacgtgggcgaaatctcagtgagtactcgcctcacagtcctgcgggaagatcagatcccacgaggattccctaccattgatatgggaccccagttgaaagtggtggagcgcactagaactgcgacgatgctgtgtgctgccagcgggaaccctgatcctgagattacatggttcaaagactttctgcctgtcgatacaagcaataacaacgggcgaattaaacagctgcggagcgaatcaatcggcgcactgcagatcgagcagagtgaggagtcagatcagggaaagtatgagtgcgtggccactaatagcgccggtacgagatacagcgcccctgctaatttgtacgtgcgcgtgagacgagtcccccctcgcttcagcatccctcccaccaatcacgagataatgcctggaggctcagtgaatataacttgcgtcgccgttggctctccgatgccttatgtgaaatggatgttgggagccgaggatctgactcccgaagatgatatgcccattgggaggaatgtcctggagctgaacgacgtaagacagagcgctaactacacgtgcgttgccatgtctactttgggtgtcatagaggctatcgctcaaatcactgtcaaagctcttcccaagcctcccggaacacctgtggtcaccgagtctactgccaccagcatcacactcacatgggactccggcaacccagaacccgttagctactatatcatccagcataagcccaagaactctgaggagttgtataaggagatcgacggtgtcgctacaactagatactccgtggctggcctaagtccttacagtgattatgagtttcgagtggtggctgtgaacaatattggaagagggccaccctctgagcctgtgttaacccagacatcagagcaagcaccatcctctgcgccaagggacgtacaggcaaggatgctgtcatccaccaccatcctagtccagtggaaggagccggaagaacccaacggtcagatacaggggtacagggtatactatacaatggatccaactcagcatgtaaataattggatgaagcacaacgtagcggactctcagattacgaccattggcaatctggtcccgcaaaaaacctactccgtgaaagtgctggcttttacaagcattggggatgggccattatcaagtgatattcaggtcatcactcaaaccggcgtgcctgggcaacctctgaacttcaaggcagaacccgaatcagaaacatctatcttactcagttggacccccccacgctccgatacaatcgctaactacgagctggtgtataaagacggagaacacggtgaggagcagcgaataacaatcgagcccggaacctcttatcggctccaggggctgaagccaaatagcctttactattttagactggccgcaaggtcccctcaggggcttggggcatcgaccgctgagatttccgcacggaccatgcaatcaatgtttgctaagaatttccatgttaaggccgtcatgaagacttcagtcttgctcagttgggagatcccggagaactacaatagcgcaatgccctttaagattctgtatgatgacggcaagatggtggaggaggttgatgggagggccacccaaaaacttatcgtaaatctgaagcccgaaaagagctactctttcgtcttgacaaataggggaaatagtgcgggtggactccagcatcgagtgacggccaagacagcgccagatgtactgcgaactaaaccagccttcatagggaaaacaaatctcgatgggatgatcactgttcaactgcctgaagtacctgccaacgaaaacatcaagggctactatataatcatcgtgccccttaagaagtccaggggtaaatttattaaaccctgggagtcccctgatgaaatggagctggacgagttgctcaaagagatctcgagaaagcgacggtctatcagatatgggagggaagtagaactcaagccatacatcgccgctcattttgacgtcctccctactgagttcactctgggcgacgacaagcattatggtggtttcaccaacaagcagttgcagtctggtcaagagtacgtgtttttcgtgcttgcagtgatggaacacgccgagagcaagatgtacgctacatcgccctacagtgatccagtggtctcaatggaccttgatccacagcctattacggatgaggaagaagggttgatttgggtcgtaggccctgtgctggccgtcgtgtttattatctgcatcgtcatagctattctcttgtacaagcgcaagcgcgcagaaagcgattcccgcaaatctagcatccctaacaataaggagatcccatcacatcaccctaccgatccagttgagctgagacggctcaactttcagacccccggaagcgatgattcgggctacccgggtaaccttcattcttcttctatggctagccacccaccaatccctattctggagttggctgatcatatagagaggctcaaagccaacgacaatcttaagttttcacaggaatacgagtcgattgaccctggacagcagtttacctgggaacattctaatctggaagtgaacaagcctaagaaccgctatgcaaatgttatagcttatgaccacagtcgcgtgttgctctccgcaatagaaggaatcccgggaagtgattatgtgaacgccaattacattgacggataccggaaacagaacgcatacatcgctacacaaggctcactgcccgagacctttggggatttttggcgcatgatttgggagcagcgttctgctacagttgtcatgatgaccaagctggaggagcggtctcgggtgaaatgcgaccaatattggccctctcgaggcactgagacacacgggcttgttcaggtgacactcctggacactgtggaactggctacttactgcgtaaggacctttgctctctacaaaaatgggtcatcagaaaagagagaagtgaggcagtttcaattcacagcttggcccgaccacggagtgcctgaacaccctacacccttcttggcgttcctgcgcagagttaaaacctgcaatcctcctgacgcgggacctatggtcgttcactgcagcgccggtgttgggcgaacgggttgctttattgtgattgatgcaatgctggagcgtatcaagcacgagaaaaccgtagacatttatgggcacgtaaccctgatgcgcgcacaaagaaattatatggtgcagaccgaggatcagtatatcttcatacatgacgctctgctggaggctgtgacctgtggaaacactgaggtgccggctcgcaacctatatgcttacatccagaagctgacccaaatcgaaaccggcgagaatgtgacagggatggagctagaattcaaacgacttgctagctcaaaggctcacacctcccgctttatttctgccaatctgccctgtaataaattcaaaaacagactggtgaacatcatgccatacgagtctacaagagtgtgtctgcagcccattagaggcgtagaaggcagcgattacatcaacgctagtttcattgatggatacagacagcagaaggcatatatagccacccagggcccactggcagagacaaccgaggatttctggcggatgttatgggaacacaactcgaccatagtcgtaatgctgacaaagctgcgggagatgggcagggagaagtgccatcagtactggcctgccgaacgcagcgcacgctatcagtacttcgtcgtcgaccctatggctgaatataacatgccacagtatattcttagggagttcaaagtaaccgatgctcgcgacgggcagtcccgcaccgtaagacagtttcaatttacagactggccagaacagggagtccctaaatcaggggaaggattcatcgacttcatcggtcaggtgcataagacaaaggagcagttcgggcaggacgggccaatctccgttcattgctccgccggtgtggggcgaaccggggtcttcatcacactcagtatcgtgctggaaaggatgcggtatgagggtgtggtcgacatctttcagaccgtaaaaatgctgaggacccagcggccagctatggttcaaactgaagaccagtaccagttcagctaccgggctgccctagagtatctgggtagctttgaccattatgccacttag

SEQ ID NO: 237040 - DNA, 4398 bp, Artificial Sequence
  Description of Artificial Sequence: Synthetic coding sequence
atgaggggactcggaacgtgtctggcgactctggctggcctgctcctaacggctgcgggagagactttctcagggggttgccttttcgacgaaccctactccacctgtgggtactcccagagcgagggagatgactttaattgggagcaggtgaatacgctaacgaaaccaacttcagacccctggatgccctccggctctttcatgctggtgaatgcctcaggccgtcccgagggccaacgcgctcaccttctgttacctcagctcaaggaaaacgatacccattgtatcgatttccattacttcgtttctagcaaaagtaatagtcctcccggattgctcaatgtgtacgtcaaggtaaacaacggccctttagggaaccccatttggaatatctcaggcgatcccacccggacttggaatcgggctgagctggccatttcgaccttctggccaaatttttatcaggtcatattcgaggttatcacaagcggccatcagggttatctcgcaattgatgaagtgaaagtgctgggccatccatgcacccgcacaccccattttctacgcatacagaatgtcgaagtgaacgccggacaatttgccacttttcagtgctccgccataggcaggacagtggccggtgatagattgtggctccagggaatcgacgtgagggatgcacccttaaaggagatcaaggtcaccagttccagacgttttatcgcgtctttcaacgtggtaaatacgaccaagcgggacgccggtaagtaccggtgcatgattagaacagagggcggtgttgggatttcgaactatgctgaactcgtggtgaaggaacctcccgtcccaatcgcgcctccacaactcgcaagcgtgggggcaacctacctgtggattcagctgaacgctaacagcattaacggtgatgggccaatcgtcgctagagaagtggagtactgtaccgcgagtgggagctggaacgaccggcagcccgttgactccacttcttacaaaatcgggcacttagacccagacactgagtacgagattagcgtgctgttgacacggcctggcgagggagggacagggagccccggtcccgcactcagaacccgaaccaagtgcgccgatcctatgcgaggcccacgcaaactggaggtggtggaggtgaagtcaaggcaaattactatccgttgggaaccttttggatataacgtcaccaggtgccattcttacaatctgactgtgcactattgttatcaggtgggcggacaggagcaggtcagagaggaagtgtcatgggacaccgaaaatagccacccacaacatactatcacaaatctgtctccttacacaaacgtcagtgttaaattgatcctgatgaacccagaaggaaggaaggaaagccaggagctcattgtccagaccgatgaggaccttcctggcgcagtccccaccgagtcaattcagggctccaccttcgaggaaaaaatcttcttgcagtggagggaacctacccaaacctacggagtgattacactctacgagataacctataaggccgtcagctcctttgatcctgagattgatctttcgaaccagtccggaagagttagtaaacttggcaatgagacacacttcctttttttcggcctgtaccccggaacgacatatagttttacgataagagcgtccactgccaaagggttcggtccacccgctacgaaccaattcacaacaaaaatctctgctcctagtatgccagcatatgaacttgaaacacctctcaatcagaccgataacacagtaactgtgatgttgaaacccgcacactcaaggggtgccccagtgtcagtctaccagatcgtggtcgaggaggaacgcccaagacgcacaaaaaaaaccaccgaaattttgaaatgttacccggtgcccattcacttccagaatgcaagcctcttaaactcccaatattacttcgccgcagaattccccgctgattccctgcaagccgctcagccatttactatcggtgacaacaagacttacaacgggtattggaacactcctttgctaccctacaagtcctataggatttacttccaggcagcttctagggctaatggggagaccaaaattgattgtgtgcaggtcgcaaccaaaggtgccgctacacccaagcccgtgcctgaacccgagaagcagactgaccacactgttaagattgcgggagtgatcgccggaattctcctcttcgtgatcatattcttaggagtggtgctcgtgatgaaaaaaagaaagctcgcaaagaaacgcaaggaaaccatgagctctacgcgccaggagatgactgtgatggtgaactccatggacaagagctacgccgagcagggtactaactgcgacgaagccttctcatttatggacacacacaatctgaatggcagaagtgtgtcctctccatcctcttttactatgaagaccaacactttgtccacttctgttccaaatagttattaccccgacccgtttgtgcccactgcaatcctagtgcctatcaacgacgaaacgcacacaatggcatccgacacctcatccctggttcagtctcacacctacaaaaaacgtgaacctgccgacgtaccctaccagaccggccagttacaccccgcaatacgtgtcgccgatctgctgcaacacatcactcaaatgaaatgcgctgagggctacggtttcaaagaggagtatgaatctttcttcgaaggacagagcgccccatgggactctgccaagaaggatgagaacagaatgaaaaaccgttatggcaatatcatagcttacgatcacagtcgcgtcagattgcaaacgattgaaggcgatactaattccgactatatcaacgggaactacattgacggctaccatcgacccaatcactacattgctacccagggccctatgcaagagaccatctacgacttctggcgcatggtgtggcacgaaaacactgccagtattattatggtcaccaatctcgttgaggtcggcagggtgaagtgttgcaaatattggccagatgatacagagatctacaaggatatcaaggtcaccttaatcgaaaccgagttactggctgagtatgtaattaggacttttgctgtcgagaaacgcggagtgcacgagatccgtgagatccgacaattccactttacaggatggcctgaccacggggtcccctaccacgcaaccgggctgctgggattcgtcagacaagtcaagtctaaatctccacctagcgcaggccctttggtggtacattgcagcgccggtgcgggtagaaccggatgctttattgtcattgatattatgctagatatggcagagagggagggggttgtcgatatttataactgtgtacgcgagttgagaagcagacgagtcaacatggtacagactgaggaacagtacgtgtttatccatgatgctatcctggaagcatgtctatgtggtgacacatcggtgcccgctagccaggttagatcactgtattacgacatgaacaaactggacccccagaccaatagctcacagatcaaggaggaatttagaaccttgaatatggtcacacccacactgcgagtcgaggattgtagcatagcgctcctccccagaaatcatgaaaagaaccgctgtatggatattctgcctccagatcggtgtctgcctttcctgatcacaatagatggcgaatctagcaattatattaatgccgctctgatggattcatacaaacagccctcagcctttatcgttacccaacaccctctgccaaatactgtgaaagacttttggcggttagtgctcgactaccactgtacttccgtcgtaatgcttaacgacgtcgatccggctcagctgtgcccccagtactggcccgagaacggcgtacatcgtcacgggcctatccaggtggaattcgtctctgccgatttagaggaggacatcataagtcggatctttcgaatttataatgctgcccgtccccaagacggctataggatggtccagcagttccaattcctaggatggcctatgtatcgggacacccccgttagtaagaggtcattcttgaagctcatcagacaggtagacaagtggcaagaggagtacaacgggggtgagggacgcaccgtggtccattgcctcaatggtgggggtcggtcagggaccttttgcgccatctcaattgtgtgtgaaatgctgcgccatcagaggacagtggacgtgtttcacgctgtgaagactttacgcaataataagcccaacatggttgacctcttggatcagtataagttttgttacgaggtggctcttgaatacctaaattctgggtag

SEQ ID NO: 237041 - DNA, 4323 bp, Artificial Sequence
  Description of Artificial Sequence: Synthetic coding sequence
atggcccgagctcaagcccttgtgctcgccctgacatttcagctctgcgctcccgagacagaaacgcctgctgcgggatgtacatttgaggaggcctctgaccccgctgtgccatgcgaatattcgcaagcacaatacgatgacttccagtgggagcaggtgagaattcaccccggaacacgcgctcctgcagatctccctcacggtagctatttgatggtaaacacaagccagcacgcccctgggcaacgcgcacatgtgatcttccagagtttgtccgagaatgacacacattgcgtccagttctcttattttctttacagccgagacgggcatagtcctggaaccctcggcgtgtatgtcagagtgaacgggggtccactcgggtcagcagtgtggaatatgacggggagtcacggacgtcagtggcaccaggctgagttggcagtgagcaccttttggcccaacgaatatcaggtcctgttcgaagctctgattagtccagaccgtaggggatacatgggactggatgatatacttttgttgagttacccttgtgctaaagctcctcatttcagtagactaggggacgtggaagttaatgctggacagaatgcatcatttcaatgcatggcagcaggtcgggcagcggaggccgagcgttttctcctacaaagacagtccggcgctcttgtcccagccgcaggagttaggcacatctcccatcgacggttcctggctaccttccctcttgccgcagtctcacgcgcagaacaagatctctatcgatgtgtgtctcaagcacctaggggagctggagtgagcaactttgctgagctgattgtcaaggaacctccaactccaatcgctcctcctcaattactcagagctgggccaacatatttaattatccaactgaacaccaatagtatcataggcgacggtccgatcgtacgcaaagagatcgagtatagaatggcgcgtggcccttgggctgaggttcacgccgtgtccctgcagacctacaagctgtggcacttggaccctgatacagagtatgagatttctgtacttctgacccggccaggcgatgggggaaccggccgaccgggtcctccccttatttccaggactaaatgcgccgaacctatgagggcccctaagggtcttgcctttgcagaaattcaggctcggcaactaacgctgcagtgggaacctcttgggtataacgtcacgagatgtcatacttatacggtaagcctgtgctaccactacacattggggagctcccacaaccagactatccgggagtgcgtcaaaaccgagcagggcgtatccaggtacacgattaaaaacctgcttccatatcgcaacgtccatgtccggctagtgctgaccaatcctgagggtcgaaaggagggtaaagaagtgacctttcagaccgatgaggatgtgccctcgggcattgcagccgaatctctcactttcacgccacttgaagacatgatatttctcaaatgggaggagccacaggaaccaaacggcctgattactcagtacgagatttcttaccagagtattgagtcttccgatcctgcggttaacgtgccgggtccaaggaggaccatcagcaagcttcgtaatgaaacttaccacgtattcagcaacttgcaccctgggacgacctacctgttctctgtgagggcaagaaccggcaaggggttcggccaggcagcccttaccgagataacaactaatatttcagcaccaagcttcgattacgccgatatgccaagccccttaggagagtccgaaaataccatcaccgtcttactgcgccctgcacagggcagaggggctcctataagcgtctaccaggtgattgtcgaagaagagcgcgctcgccgacttcgcagagagccaggcggtcaggattgtttccctgttcctctcacctttgaggcggcactggcgaggggcctggtacactactttggcgcagagcttgctgccagttctctgcctgaagcaatgcccttcaccgttggagataaccaaacatataggggcttttggaacccacctctggaaccaaggaaagcctacttgatatatttccaggccgctagccatcttaaaggagagacccgccttaactgcatcagaattgcaagaaaggccgcttgcaaagaaagcaagcgaccactcgaagtgtcacagcggtcagaagagatgggactgatattagggatatgcgcaggcggactcgcggtgctgattctgttgctcggcgcaatcattgttataatcagaaaggggaaacccgtgaacatgacaaaggctaccgtgaattatcgccaggagaaaacacacatgatgagtgcagtggatcggagttttactgaccagtccacactccaggaggacgagcgcctcgggctcagcttcatggatactcacggctattccacaaggggtgatcagaggtcagggggagtaacggaagcttcttccctgctgggcggaagtccacgacggccatgcggcaggaaaggaagcccctaccacactggccaacttcatccggcagttagagttgccgacctgctacagcacataaaccagatgaaaaccgctgagggttacggatttaaacaggagtacgagagcttttttgaaggctgggatgccaccaagaagaaggataaggtgaaaggctcacggcaggaaccaatgccagcctacgacaggcacagagtcaaactgcaccctatgctcggtgatcctaatgccgattatattaatgccaactatatcgatattcggatcaatagagaaggctaccaccgtagcaatcattttatcgctacccagggccctaagccagagatggtatacgacttctggcgcatggtgtggcaggagcattgttccagcatcgtcatgataacaaaactggtcgaggtgggaagggtaaagtgttctcgctattggcccgaggactccgacacatatggagacatcaagataatgttggtcaagacagagacattggccgaatatgtagttcgtaccttcgctttagaacggagagggtactccgctagacatgaggttaggcagttccatttcacggcttggcccgaacacggagtcccttatcacgccactgggctgcttgccttcatcagaagggtgaaggcctcaactcctcctgacgcaggccctatcgttatacactgctctgccggtaccgggaggaccggatgctatatcgtcctggatgtgatgttagatatggcggaatgtgaaggagttgttgatatttacaactgtgtcaaaaccctgtgtagtaggcgtgtgaacatgattcagactgaagagcaatacatctttatccacgacgctattctggaagcctgtctctgtggcgagaccaccatccccgtgtcagaattcaaagccacttacaaggagatgatccgaatcgaccctcagagcaattctagccagctgagggaggaattccagacacttaattctgtcaccccccctctggacgttgaagaatgtagcattgctttactgccccgaaacagagataaaaacaggtccatggacgttctcccccctgacagatgccttcccttcctgatcagtaccgatggtgattccaataactatatcaacgctgccttaactgatagctatacccggtcggccgcatttattgtgacgctccaccccctccaatccaccacccccgatttttggaggctggtgtacgactacgggtgtacgagtattgtgatgctcaaccagctaaaccagtccaattctgcctggccttgcttacagtactggccggagccagggaggcagcaatacggtctcatggaagtcgagtttatgagcgggaccgcagacgaggacttagtagctcgtgtgttccgcgtgcaaaacatctctagagagggtcacctcctcgtgcgtcactttcagtttctacgatggtccgcttatcgtgacacgccagacagtaaaaaggctttcctgcacctgttagccgaagttgataagtggcaagccgagagcggggatggtcgcactatcgtgcactgcctcaatgggggaggccgatccggcaccttctgtgcctgcgcgaccgttctagaaatgattcgctgtcacaatctggtagacgtcttctttgcagccaagaccctgcgcaattacaaaccgaatatggtggagacaatggaccaatatcatttctgctatgacgtggcacttgaatatctggaaggactggagagtcgatag

SEQ ID NO: 237042 - DNA, 4347 bp, Artificial Sequence
  Description of Artificial Sequence: Synthetic coding sequence
atgagaatcctgaagcggttcctggcatgtatccagctgttgtgcgtctgtcggctggactgggccaacgggtactacagacagcaaaggaagctggtcgaggagatcggctggtcttacacaggagcccttaaccagaagaattgggggaagaagtatccaacatgtaattctccaaaacagtcacctattaacatcgacgaggatttgacacaggttaacgtaaacctgaagaaactgaaatttcagggatgggataaaacatccctggagaatacttttatacataataccggaaaaactgtggagatcaacctgaccaatgattatagagtcagtggcggagttagcgaaatggtcttcaaagcctccaaaatcaccttccactggggaaagtgcaacatgtccagcgatggctcagaacactccctggaagggcagaagtttccactggagatgcaaatttattgtttcgatgccgatagattttctagcttcgaagaagcggtgaaaggcaaaggcaaattgcgcgcactgagcatcctgttcgaggtagggaccgaagaaaatctggattttaaggcaatcattgacggcgtagaatcagtctcacggttcggcaagcaggccgcacttgaccccttcattttactcaatttgctcccaaacagcactgacaagtactacatttacaacggcagtctgacctctcccccatgtacggatacggtcgattggatcgtcttcaaagataccgtgagtatctccgaaagccaactggccgttttctgtgaagttcttaccatgcaacagagcgggtatgtgatgcttatggattatctgcaaaacaatttccgtgaacagcagtataagttcagccgccaagttttctcgagttacacagggaaggaggaaattcacgaagccgtgtgtagttctgagcctgaaaacgtgcaagccgatcctgagaattatacttcactgctggtgacatgggagcggcctagggtggtgtatgacacgatgatcgagaagttcgcggtgttgtaccagcagttggatggagaggatcaaactaaacacgagttcttaaccgacggataccaggacctgggcgcaattctgaataatttactgcctaatatgagttacgtgctgcagatcgtcgctatctgtacgaatggcctgtacgggaagtattccgaccagttgatcgtcgatatgcctacagataatcctgaactcgacctctttcccgaactcattggaaccgaagagatcattaaggaggaagaagaaggcaaggacatcgaagagggggcaatcgtcaacccagggcgtgattctgctactaaccagatcagaaaaaaagagccccagatatctacaactactcattacaacaggatcgggaccaaatataatgaagccaagacgaatcgctctcctacccgcggatctgagttttctggtaagggcgacgtgcctaatactagtttaaactcaacttcacagcctgtgacgaagctcgccaccgaaaaagacatctccctcacctcccaaaccgtcactgagctcccccctcatacagttgaggggaccagtgccagtcttaacgatggttcaaaaaccgtgttacggagcccacatatgaacctatccggaactgctgagagcctcaacacggtgtctattacagaatatgaagaggagtcccttctgacgtcctttaaactggatacaggggcagaggactcaagtggaagttctcccgctactagcgccataccattcattagcgaaaatattagccaggggtacatcttcagcagcgagaatccagaaactattacctacgatgtcctgatcccggagagcgctagaaacgctagtgaagattccacaagctccgggtctgaggaatctcttaaagatccatccatggagggaaacgtctggtttcccagttctaccgacataacagcccagccggatgtgggtagcgggagggaatccttcttgcaaaccaactatactgagatcagggtggacgaaagtgagaagactacaaagtcattctcggcgggtcccgtaatgagtcagggaccatctgtcacagatttggagatgcctcattactcaacctttgcctattttccaactgaagttaccccccatgctttcactccttctagtcgccagcaggatctggtcagcaccgtcaacgtcgtgtattcccaaactactcagcctgtgtacaacgaggcgtcaaactcttcccatgagagtagaataggcctggccgagggactggagtccgagaaaaaggctgtgatccccctagtgattgtctctgcactgacctttatctgtctggtcgtgctggtgggtatcctgatctattggagaaagtgtttccagactgcgcacttttacttagaagattccacgagcccaagggtgatttcaacacctccaactcccatctttcccataagtgatgatgtgggagccattccaattaagcacttccctaaacatgttgctgacctgcatgcgtcttcagggtttaccgaggaattcgaggaggtccagtcctgcacagttgaccttggtatcacggctgacagctctaatcacccagataacaagcacaaaaaccgttacattaatatcgtcgcctatgaccattcgcgcgtgaaactggcccagttagcagagaaggacggcaaactgaccgactacattaatgctaattacgtcgatggctacaaccgccctaaagcatatattgccgctcaaggcccacttaagtcaactgcagaggacttctggcgaatgatttgggagcacaacgtagaagtgatagtgatgattaccaacctcgtcgagaaaggaaggagaaaatgcgatcaatactggccggcagacggcagtgaagagtacggcaatttcctcgtcacccagaagtctgtacaagtgctcgcgtattataccgtacgtaatttcactctgcgcaacaccaagatcaagaagggtagtcagaaaggaagaccctccggacgggttgttacccaatatcactatacccagtggcccgacatgggcgtgcccgagtattcactccccgtcctgacatttgtccgcaaagcagcatatgccaaacggcatgccgtcggtccggtggtggtgcattgtagcgcaggcgtgggcagaaccggtacatacatagtcttggacagcatgctgcaacaaattcagcacgaggggaccgtgaatatcttcggctttttaaaacacatccggagccagaggaactatcttgtgcagactgaggagcagtacgtgtttatacatgacactctagtggaggccatccttagtaaggagacagaggtgctcgactcccatattcatgcctatgtgaatgcactactcatccctggcccagctggcaagactaagcttgaaaagcagttccaattgttgtcacaatctaacatccagcaaagcgattacagtgctgccctgaaacagtgcaaccgggagaagaatcgcacgtcatccatcattccagttgagcgatcccgggtcggcatcagctccctaagcggagaggggaccgattacataaatgcctcctacatcatggggtattaccagagtaacgagttcattattacccagcatccccttctgcatactataaaagatttctggaggatgatttgggatcataacgcgcagctcgtagtaatgatcccagatgggcaaaacatggcggaagatgagttcgtgtattggccaaacaaggatgagccaattaactgcgagtcctttaaggtgaccttgatggcagaagagcacaagtgcttaagtaacgaagagaaactgattattcaggattttatcttagaggcaacccaagacgactacgtgctggaggttcggcatttccaatgccccaaatggcctaacccagactcccctatcagcaagacatttgaactgataagcgttataaaagaagaggccgctaaccgagatggacctatgatagttcatgacgagcacgggggagtgaccgctggcacattctgtgcactgaccacactgatgcatcaacttgaaaaggagaacagtgtggatgtgtaccaagtggctaaaatgatcaatttaatgcgaccaggagtgttcgcggatattgaacagtatcaatttctctacaaggtgatcttaagccttgtttctacccggcaggaagagaatccctcaacatcgctcgactcaaatggagcggcactgccggatgggaacatcgccgaatccctcgaatccttggtgtag

SEQ ID NO: 237043 - DNA, 504 bp, Artificial Sequence
  Description of Artificial Sequence: Synthetic coding sequence
atgaacaggccagcaccagtggagatctcgtacgagaatatgaggttcttgatcacccacaaccctacaaatgctacgctgaataagttcaccgaggagctgaaaaaatacggagttaccactctcgtccgagtatgcgatgcgacctatgataaagcccctgtggagaaagagggcattcacgtactagactggccgttcgatgacggagcgcctccacctaaccagattgtggatgattggttgaacctgctgaagaccaagttcagggaggaaccaggatgctgcgtggcagtgcactgtgtagccggactgggtagggctcccgtcctggtcgccctcgccttgatcgagtgcggcatgaaatatgaggacgccgttcaattcatccgtcagaaacgtcgcggagccttcaacagcaagcagctgctctatttagagaagtaccggcctaagatgaggctcaggttcagggataccaacggccactgctgcgtacaatag

SEQ ID NO: 237044 - DNA, 249 bp, Artificial Sequence
  Description of Artificial Sequence: Synthetic coding sequence
atgaatcgcccagcccctgtggagattagctacgagaacatgcgcttcctgatcacccataatcccaccaacgcaacactcaataagttcacagaggaactgaaaaagtacggtgtcaccacacttgttagagtttgtgacgcaacttacgacaaagcacccgttgaaaaagaaggaattcacgtcctgaagaagaaaggcagcgtccagttccagacggccgctcttttcggggagatccctacatag

SEQ ID NO: 237045 - DNA, 411 bp, Artificial Sequence
  Description of Artificial Sequence: Synthetic coding sequence
atgaaccggcctgcccctgttgagatttcctatgagaatatgagatttcttatcactcacaaccctaccaacgccacacttaataaattcaccgaagattggcctttcgacgatggcgcacctcctcccaatcagattgtggacgattggctgaacctgctgaaaacgaagtttagagaggagcccggatgctgcgtagccgtacattgtgttgcgggactgggtcgggcacccgtgctcgttgctctcgcgctcatcgagtgcggaatgaaatacgaggatgcggtgcaatttatccgtcaaaagaggaggggcgcttttaacagcaagcaactgctgtacctggaaaaataccggccaaagatgcgactccgattccgcgacaccaacgggcattgttgcgtgcagtag

SEQ ID NO: 237046 - DNA, 192 bp, Artificial Sequence
  Description of Artificial Sequence: Synthetic coding sequence
atgaataggccagcccctgtggaaatttcatacgagaacatgaggttcctgattacgcacaatcccacgaacgctaccctgaacaagtttacggaagagctcaagaaatacggcgttaccacattggtccgagtgtgtgacgccacatatgataaggctccggtcgagaaggaaggtattcatgtcctgtag

SEQ ID NO: 237047 - DNA, 69 bp, Artificial Sequence
  Description of Artificial Sequence: Synthetic coding sequence
atgaacaggccagcccctgtcgagattagctatgagaacatgaggttccttattacccataacccttag

SEQ ID NO: 237048 - DNA, 522 bp, Artificial Sequence
  Description of Artificial Sequence: Synthetic coding sequence
atggccagaatgaaccggccagcacccgtggaagtttcatataaacacatgcggttcctgattacacacaaccccaccaatgcgactctgtcaacattcatcgaagacttgaaaaagtacggagccactaccgtagtgcgagtctgcgaggtgacctatgacaagacaccgctggagaaagatggtataaccgttgttgactggcctttcgacgacggcgcacctccacccggaaaagtggtggaggattggctgagcctggtcaaagcaaaattctgtgaggcccctggctcctgcgtggcagtacactgcgtcgcagggcttggtcgcgctcctgtacttgtcgccctggctctcatcgagtccgggatgaaatatgaggatgctatccaatttattagacagaaacgcagaggcgctataaactctaaacagctgacttacttagagaagtaccgacctaagcaaaggctacggttcaaggatccacatacacacaagacccggtgttgtgtgatgtag

SEQ ID NO: 237049 - DNA, 447 bp, Artificial Sequence
  Description of Artificial Sequence: Synthetic coding sequence
atggccaggatgaataggcccgctcctgtggaagtgagctataagcatatgaggttcctgatcactcacaaccccaccaacgcaactctgagcacctttatagaggaccttaaaaaatatggagccactactgtggtgagagtctgcgaagtaacctacgataagaccccattggagaaggatggcatcaccgtcgtggactggcccttcgacgatggcgctccgccacctgggaaggtcgtcgaggactggctgagccttgttaaggccaaattttgtgaggcaccaggttcatgtgttgccgtgcattgtgttgccggtctcggaaggaagaggcgcggtgccattaactccaaacaactaacctacctcgagaagtaccgtcctaagcagaggttgcggttcaaggacccccacacccacaaaacccgctgctgtgtcatgtag

SEQ ID NO: 237050 - DNA, 447 bp, Artificial Sequence
  Description of Artificial Sequence: Synthetic coding sequence
atggcacgcatgaataggcccgctccagtggaagttagctacaagcacatgcgctttctcataacacataaccccacaaacgctaccctgagtacttttatagaagacctgaagaaatatggagctactacggtggttcgcgtctgtgaagttacgtatgataaaacccctctggagaaagacggcattactgtggtcgactggcctttcgacgatggcgcacctcccccagggaaagtggtcgaggactggctctcgttagtgaaggctaaattctgtgaagcccctggatcttgcgtagccgtccattgcgtggccggtcttgggagaaagcgccgtggagctataaactcaaagcaattaacctatctggaaaagtacagaccaaagcagcgcctgcgtttcaaggatccccatactcataagacacggtgttgcgtcatgtag

SEQ ID NO: 237051 - DNA, 522 bp, Artificial Sequence
  Description of Artificial Sequence: Synthetic coding sequence
atggctagaatgaaccgccctgcccctgtggaagtaagctacaagcacatgcgtttcctgatcactcacaaccctacgaatgcaactctaagtaccttcatcgaagatctgaagaaatatggggctacaaccgtcgtaagagtctgcgaagtgacttacgataaaacccccttggaaaaggatggcattaccgtcgttgactggcctttcgacgacggggcaccaccccctggaaaggtcgtggaggactggttgtccctcgtgaaagcaaagttctgcgaggctcccggaagttgtgtagctgttcactgtgtggccggattgggtagggcccctgtcctcgtggccctcgcactcattgagagtgggatgaagtacgaagatgccattcagttcatacgccagaaaagacgtggcgctatcaattctaagcagttgacctacttggagaagtatagaccaaaacagcgtcttaggttcaaagatcctcacactcataaaactagatgctgcgtgatgtag

SEQ ID NO: 237052 - DNA, 213 bp, Artificial Sequence
  Description of Artificial Sequence: Synthetic coding sequence
atggccagaatgaacagacctgcacccgtggaggtgagctacaaacacatgcgctttcttattacccacaacccaaccaacgctaccttgtctacctttatcgaggacctgaagaaatatggggcaaccaccgtcgtccgcgtgtgcgaggtgacatatgacaaaacgccattggaaaaggacggcataaccgtggtagattggcccttttag

SEQ ID NO: 237053 - DNA, 2343 bp, Artificial Sequence
  Description of Artificial Sequence: Synthetic coding sequence
atggagcaagtggagattctacggaagttcattcaacgcgttcaggccatgaagtccccggaccataacggtgaggataattttgcacgggatttcatgaggctgcgacggcttagcactaaataccgtactgaaaagatctaccctactgcaactggagaaaaagaggagaatgttaagaagaaccgttataaggacattctcccctttgaccattcacgcgtgaaattaaccttgaagacaccctcgcaagactctgactatattaatgctaattttatcaagggtgtgtatggcccaaaggcttacgtggctacacagggcccacttgccaacacggtgattgatttttggcggatgatctgggaatataatgtagtcatcatcgtcatggcatgcagggagttcgagatggggcgaaaaaagtgtgaaaggtactggccactgtatggtgaggaccccattaccttcgccccatttaaaattagctgcgaggacgagcaggctaggaccgattattttattagaacgctgctcttagagtttcaaaatgagtcccggaggttgtaccaattccactacgtgaactggccagaccacgacgtcccatcaagcttcgattctattctcgatatgatatcgttgatgaggaaataccaggaacacgaggatgtcccgatatgtatccattgttctgcaggctgcgggaggaccggggcaatttgcgcaatagattacacttggaaccttctgaaagccggaaagattccagaggagtttaacgtgtttaaccttattcaggagatgcgcactcagcgacactctgcagtgcaaaccaaggagcagtatgagctggttcatagagcaattgcacagctgttcgagaaacagctgcagctatatgagatacatggcgcacagaagattgctgacggggttaacgagatcaacacagaaaatatggtttcctccatagaaccagagaagcaggatagccctcctcctaagcctccacggactcgatcttgcctggtggagggtgacgcaaaagaagagattctgcaacccccagaacctcatccagtgccccctatcctcaccccttccccgccttccgcctttccaactgtgactaccgtctggcaagataatgaccgttaccatcccaagcctgtgctgcatatggtctcatcagagcagcactctgctgacctcaacaggaactactccaaaagtactgaattgccaggtaagaacgagtccactatagaacagattgacaaaaaacttgagcggaacttatcatttgagataaagaaagtgcccttacaggagggtcctaaaagcttcgatgggaacactcttctcaaccggggtcatgcaattaagatcaaaagtgcatctccatgcatcgccgacaagatctcaaagcctcaggagctgtcttccgatctaaatgtgggagacacttcccagaattcatgtgtggattgttccgtgacccagagtaacaaggtgagcgtgacacctccggaagaatcacagaatagcgataccccaccccgtcccgaccgcttgccactggatgaaaaaggccacgtgacttggagtttccatgggccagaaaacgctatacccatcccagacctctccgagggcaattcctcggatatcaactaccaaacaagaaaaaccgtctcgctcacaccaagtcccactacacaggtggagaccccagatctggtggaccatgataatacgagccctttgtttcggactccattgtctttcacaaatccgctgcacagtgatgattccgacagtgatgagcgtaacagcgatggcgctgtcacacagaataagacaaatatcagtaccgccagcgctactgtcagcgcagccacgtccaccgaatctatctcgacacgtaaagtgctgcctatgagcattgcaaggcataatatcgctgggacaacccactccggagccgaaaaggacgtcgacgtgtctgaggacagcccgcctccccttccagaacggactcctgaaagtttcgtgctagcatcagagcacaacacacctgtgcgcagcgaatggtccgagctgcagagccaggagcgaagcgaacagaagaagagcgagggtttgatcacaagtgaaaatgagaagtgcgaccatcccgctggcggaatacattatgagatgtgtattgagtgtcctccgaccttttctgacaagagagaacaaattagcgagaaccctaccgaggctacagatatcggctttggtaatagatgcgggaagccgaagggccctcgggaccccccatcagagtggacttag

SEQ ID NO: 237054 - DNA, 1986 bp, Artificial Sequence
  Description of Artificial Sequence: Synthetic coding sequence
atgatttgggagtacaacgtcgtgatcattgtcatggcttgcagagaattcgagatgggcagaaaaaaatgcgagagatattggccgctctatggagaggaccctatcacattcgcccctttcaagatcagctgtgaagatgagcaggctcgtaccgactactttatccggaccctcctgctcgagttccagaatgaatctcgtcggctgtatcagttccactatgtcaactggccggaccatgatgtgcccagctcctttgattccatcctcgacatgatctcactgatgaggaaatatcaggagcatgaagacgtgcctatatgcatccattgctcagccggatgtgggaggacaggggcaatttgcgctatcgactatacttggaacctccttaaggccggtaagatccctgaagagttcaacgtgtttaacctgatccaggagatgagaacacaaaggcattctgcggtgcagaccaaggaacagtacgagcttgtgcaccgagcaatcgcacaactcttcgagaaacagctccagctgtatgaaatccacggtgcgcagaaaatcgcagacggcgtgaatgagattaacacagaaaacatggtgtcgtctatcgaacctgagaaacaggactctccccctccaaagccccctcgcacacggtcctgccttgtggagggagatgccaaagaggagattttgcaacctcctgagcctcatccggtgccccctatcctgacaccctccccgccaagtgcctttcccactgtcacaacagtctggcaagataacgacagataccatcctaagcccgtgctgcatatggtttcctctgagcagcatagtgctgatctgaatcggaactactccaagagtaccgagctccccggaaaaaacgagagcactattgagcaaatagacaaaaagctcgagagaaatctcagtttcgagatcaaaaaggtacccctgcaggaaggccctaagtccttcgacgggaacacgcttctgaatcgcggacacgcaatcaagatcaagagcgccagcccctgcatagccgataagatctccaagccccaggagctctcgtctgatttgaatgtcggcgacaccagccagaactcctgcgttgattgttctgttactcagtctaataaagttagtgtcactcccccagaggaatctcagaattcggatactccacctaggcccgatcgactaccgctggacgagaaaggacacgtgacctggagcttccatggtcccgaaaacgcaattcctattccagacttgagtgaggggaattcaagcgatataaactatcaaacccgcaagactgtgagcctgactccttcccccactactcaagtagagaccccagatttggtggaccacgataacacaagccctctgtttcgcactcctctgagctttacaaaccctctgcactccgacgatagcgatagcgatgaaaggaatagtgacggagcagtgacacagaacaagactaacatctctactgcatcagcaaccgttagtgccgcaacctctacagagtcaatttcaacacgcaaggtgttgccaatgagtattgctcgtcacaacatcgctggcacaactcacagcggggcagagaaagacgtggacgtctcggaggactctccccctccactgcctgagaggacacctgagtctttcgtcctggcaagcgagcataatacgccagtccggtccgagtggtctgagctgcagagccaggagagaagcgagcagaaaaagagcgaggggcttataacttcagaaaatgagaaatgcgatcacccagcgggagggatccattatgaaatgtgtatcgaatgcccccctactttctctgacaagagagagcagatttcagagaacccaaccgaggccacagatatcggatttgggaaccgctgtgggaagcctaaggggccaagggacccccctagcgagtggacctag

SEQ ID NO: 237055 - DNA, 1632 bp, Artificial Sequence
  Description of Artificial Sequence: Synthetic coding sequence
atgatttgggaatacaatgtggtgatcatagtgatggcatgccgcgaattcgagatgggcagaaaaaagtgcgagagatattggccattgtacggcgaggacccgattacttttgcacctttcaaaatctcctgcgaggacgaacaagcccgaactgattacttcatcagaactttgctgctcgagttccagaacgaatccagacggctgtaccaattccactacgtgaattggcctgaccacgacgtaccgtcatcatttgacagcatactggacatgattagcctgatgcgcaaatatcaagagcatgaagatgtgcccatctgtatccactgcagtgctggttgcgggcgtacgggggcaatatgcgctatcgactacacatggaatctcctgaaggctgggaagatcccagaagagttcaacgtattcaacctgatacaggagatgcgaacacagcgccacagtgcggttcagacaaaagaacaatacgagctggtccaccgcgcaatcgcacaactcttcgaaaaacagctccagctgtatgaaatacatggagcccagaaaattgcagacggggttaacgagatcaatacagaaaacatggtctcctcaattgagccagaaaaacaggattcccccccacccaagccacccaggaccagaagctgtctggtggagggcgacgcaaaggaagaaattctccagcctcctgaacctcaccctgtccctccaattcttacaccatctccaccaagtgcctttccaactgtcactaccgtgtggcaggacaatgaccggtaccaccctaagccagtccttcacatggtgtcatctgagcagcacagtgcagatctgaatcgcaattactccaaaagcacggaactcccgggtaagaacgagagcactatcgagcagatcgataaaaagttagagagaaacctgtcatttgaaatcaaaaaagtgcccttacaggaaggacccaagagtttcgatggcaataccttactgaataggggacacgctattaagataaaatctgcctcaccgtgtatcgctgataagattagcaagccgcaggagttaagctctgatctgaacgtcggggatacatcccaaaactcgtgcgtagattgcagcgtgactcaaagtaataaagtctcagtaacacctcccgaggagagccagaactcagatactcccccacgccctgaccgcctgcctctggatgagaaaggacacgtgacctggtcctttcacggccctgaaaacgctattccaattccagatctctctgaggggaattccagcgacataaattatcaaacccgtaagactgttagtctcacaccaagccctacaacacaggttgagacgcccgacctggttgatcatgacaacacttcccctctttttagaacccccctgagttttacgaaccccctgcacagcgatgacagcgacagtgacgagcggaatagcgacggggcagtgacgcagaacaagaccaatatatcaaccgcgagcgctaccgtgagcgcagctacatcgactgaatctataagcactcgcaaagttcttcctatgagcatcgcgagacataacagccgcaataacacttttaggtgttag

SEQ ID NO: 237056 - DNA, 6884 bp, Artificial Sequence
  Description of Artificial Sequence: Synthetic coding sequence
atgcacgtttctctggccgaggccctggaagtgcggggtggcccactgcaggaagaagagatctgggcagtccttaaccaatcagccgagagccttcaagagctgttcagaaaggtcagtttagctgaccccgctgctctgggtttcattatctccccttggtccctgctgctcctgccatcaggctccgtatctttcaccgacgagaatatttcaaatcaggatctgagagccttcacagctcccgaggtgctacagaaccagagcttaaccagcttatcggacgtggagaagattcatatctactcgctggggatgacactttattggggagcggactacgaagttcctcagtcccagcctataaaactgggcgaccaccttaattctatactcctcgggatgtgcgaggatgtcatctatgcaagggtgtccgtgcgtactgtgctggatgcatgtagtgcccacatccggaactctaactgtgctccctcattctcatacgtcaaacatcttgtgaagcttgtgctgggcaatttaagcggtacagaccagctgagttgcaattccgaacagaaaccggacagatcccaggccatccgcgaccgactgcggggtaagggcctcccaactgggagatctagtacctcagacgttctggacatccaaaagcctccactcagccatcagaccttcttaaataagggattgtctaagtcaatggggttcctctcaattaaggatacccaagacgagaactattttaaagacattttgtcggacaacagcggcagagaggattctgagaataccttttccccttaccaattcaagacttctgggcctgaaaaaaaacccatacccggaatagatgtgctgagcaagaagaaaatctgggctagttctatggacctgctttgcaccgctgacagagatttcagttccggagagaccgcaacttatcgcaggtgtcatcctgaggccgtcactgtgcgcacctctacaactccaagaaaaaaggaagcaagatattccgatggctccatcgcgcttgatatcttcgggcctcagaaaatggaccctatttaccacacacgagagctgccaacatcatctgctataagctctgccttggaccgcatcagagaaaggcagaagaaactgcaagtcctgagggaagccatgaatgttgaggagcctgttcgaagatataagacataccatggtgatgtcttttccaccagctctgaatccccttccataattagctctgagagtgattttcgacaagtgaggcgctccgaggcctctaagcgttttgaatcatcttctggccttcccggagtagacgagacgttgagtcagggtcagagtcagagaccctcacgccagtatgagacccccttcgaagggaacttgattaaccaggaaatcatgctcaagcggcaggaagaggagttgatgcagcttcaggcaaagatggcactacgtcaaagtcgactcagcctgtatccgggagataccatcaaagcctcaatgcttgacattacccgggaccctctgcgggagatcgctttagaaacagctatgacgcaacgcaaactgagaaatttcttcggcccagagttcgtgaagatgacaatcgaacctttcatttctctcgatctgccaaggagtatccttacgaagaagggcaagaatgaagataaccgtaggaaagtgaatatcatgctgctgaacggtcagcgacttgagctcacttgcgacacaaagactatctgcaaggacgtgttcgatatggtggtagctcacataggacttgtggagcaccacttgtttgccctggccacactgaaagacaacgaatatttttttgtcgatcccgacctgaagttgactaaggttgctcctgaaggatggaaagaggagcccaaaaaaaagaccaaagctacagtgaactttaccctatttttccgcatcaagttttttatggacgacgtctccctgatccagcatactctgacatgccaccaatattatctacagctgcgtaaagacattctggaagaacggatgcactgcgacgatgagacaagcctgctcctggcaagcctggccctgcaggctgaatacggagactatcagcccgaggttcacggtgtgagctacttcagaatggagcactatctgcccgcacgtgtcatggagaagctggacctctcctacataaaggaagagctgcctaaactgcacaatacatatgtaggggcatctgagaaagagaccgagctcgagtttctgaaggtttgtcaaagactgaccgaatatggcgtgcacttccatcgcgtgcaccctgaaaaaaagagccagaccggcatcctccttggcgtgtgttctaaaggcgttctggtgtttgaggtgcataatggtgtgagaacacttgtcctccggtttccttggcgggagacgaagaaaatatcattctccaagaagaaaataactttacagaacacaagtgacgggatcaagcatgggttccagacagataacagtaagatctgtcagtacttactgcacctgtgctcctaccagcacaagttccagctacagatgagagctcgtcagtcaaaccaggatgctcaggacatcgacgtcttacataagcggtggtccattgtgagctccccagaacgcgaaatcactcttgtgaatctgaaaaaggatgccaagtacggactcggctttcaaattattggcggtgagaagatgggcagactggacctgggaatctttatctcaagcgtggccccagggggacctgctgatttagatggctgtctgaaacctggagatagactcatttccgtgaactccgtgtcattggagggcgtcagtcatcatgccgcaatcgagatcctccagaatgcacccgaagacgtcactctggtgatctcccagcctaaggagaagatttctaaggtcccgtctactcccgtgcacctgaccaacgaaatgaagaattacatgaagaaaagttcctatatgcaggattctgcaatcgactcctcctccaaggaccatcactggtctcggggaacgctgaggcacatttcagagaatagctttggcccttcaggcggtcttcgagagggaagcctgtccagccaggactccaggacagaatccgcctcgctgtctcagagtcaggttaacgggttctttgcatctcacctgggggaccagacatggcaagagtcgcaacatgggtccccctcacctagcgtaatctccaaagcgacagagaaggagacctttacagatagtaatcagtccaagactaagaaaccaggcatttctgacgtaacggattattcagaccggggagactctgacatggatgaggccacctacagttcctcccaagaccaccagactcccaaacaagagtcatcctcctcagtgaacacctctaacaaaatgaacttcaagacattctcttcaagcccgccaaagccaggggacattttcgaagtggagctcgccaaaaacgataacagtttgggaatctctgttactggtggcgtcaataccagtgtgcgtcacgggggtatctatgttaaggctgttatcccacagggagcagccgaaagtgatggcagaatccacaagggtgatagggttctcgcagtgaatggagtttcgctggagggagcaacacacaagcaagctgtagagacactgaggaatactggtcaagttgtgcatttacttcttgagaagggacagagccccacaagcaaagagcatgtgcctgttacaccccagtgcaccttaagcgaccagaatgcccagggacagggccctgagaaagtgaaaaagactacccaagttaaggactactcatttgtgaccgaggagaacaccttcgaggttaagctcttcaagaattctagcggcttaggcttttcattttctagggaagacaacctgatcccagaacagatcaacgcgtcgatcgttagggtgaagaagctctttcctggtcaacccgcagcggaaagtgggaaaatagacgttggcgacgtgatcctcaaggttaacggagctagcctaaaaggcttgagccagcaggaggtgatcagcgccctcagagggaccgcgcctgaggtattcttgcttctatgcagaccgccaccaggcgttcttcccgagatcgacactgctctgttgacaccgctgcaaagcccagctcaggtgctccccaactcgtccaaggactcaagtcagccttcctgtgtggaacagtctactagtagtgatgagaatgaaatgtcggataaatctaagaagcagtgcaagagtccttcccgtcgggactcttattccgattcttcaggttccggggaggatgacttagttaccgcacctgcgaacatcagcaacagcacgtggagctcagccctgcatcagactctctccaacatggtttctcaagcccagtctcaccatgaagctcctaaatcacaggaggataccatctgcactatgttttactacccccaaaagattcctaacaagcccgaattcgaagattcaaaccccagccccctccccccagatatggcacccggtcagtcgtatcagccgcaatccgagtcagccagcagttcaagtatggataagtaccacatacatcacatttctgagccaacacgccaggaaaactggacccccctgaaaaacgatttggagaatcacctggaagactttgagcttgaagtggagttattgataaccttaataaagtcagagaaaggctccctcgggttcaccgtaactaagggcaatcagcggatcgggtgttatgtgcacgatgtgattcaggatcccgctaaatctgacggtcgcctcaagcctggagatcggctgatcaaggtcaacgataccgatgtcaccaacatgacccatactgacgctgtaaacctcctgcgtgccgctagtaagaccgttaggttagtaatcggccgagtcctagaactgccacggatcccgatgctccctcatcttctgcctgatataaccctgacgtgcaataaggaggaattgggcttctccctgtgtgggggtcacgactccctgtaccaggtggtttacatctctgacattaacccaaggtccgtcgccgctatcgagggcaatctgcagttgttagacgtcatacattacgttaacggcgtttccactcaaggcatgaccctcgaggaggtgaacagggcattagatatgagccttccaagtctggtcttgaaagccacaaggaatgacctgcctgttgtgccatcctctaagagaagcgcagtctccgcccctaaaagtacaaaggggaacggttcttattcagtgggatcttgctctcagcctgctcttacccctaatgactcgttttcaacagttgcaggggaggaaatcaacgagatctcttatccaaaaggcaaatgttcgacatatcagattaagggtagtccgaacctcactctccctaaggaatcatacatacaagaggacgacatttacgacgattctcaggaagcagaagtcatccagtccctgctggacgttgttgatgaagaggctcaaaatctgctcaacgagaataacgcggcaggttactcatgcgggccaggaacactgaagatgaatggcaagctgagtgaggagcgaactgaggatactgattgtgatgggtcaccgcttcctgagtatttcacggaagccaccaaaatgaacggatgtgaagaatattgtgaggaaaaagttaagtcagagtcacttatacagaagcctcaagaaaagaagacagatgacgacgagatcacatggggcaacgatgagctccccatagagaggaccaatcacgaggacagcgataaagatcactcctttctgactaacgacgaactcgccgtcctaccagtggtaaaagtgttgcccagtggaaaatacaccggcgcaaacttgaaaagtgtaatccgggttctgcggggacttctcgaccagggtattcccagtaaagaactggagaaccttcaggaactgaaacccttggatcagtgccttatcggacagacgaaggagaaccggagaaagaatcgttacaaaaatatcctgccttacgacgcgacccgcgttccactcggagatgagggcggatatattaacgcttcttttatcaaaattcctgttggaaaggaagagttcgtgtacatagcatgccaaggtcccctacccacgaccgtaggagatttctggcaaatgatctgggagcagaagtctacggtcatcgcaatgatgactcaggaagtggagggggaaaaaataaagtgtcagagatactggcccaacatcctggggaaaacgacgatggtcagcaacagattacgccttgcgttggtgagaatgcagcaattaaagggattcgttgtgcgtgccatgactttggaagacattcagacaagggaagttaggcatatcagccacctgaattttacggcttggccagaccatgataccccatcccagcccgatgaccttctgaccttcattagctacatgcggcatatccataggagtgggccaatcattacacattgctctgcgggaattggcaggtccggcactctaatatgcattgatgtggtgctcgggctcatctcacaggacctagactttgacattagcgatctggtccgctgcatgcggctccaacggcacggtatggtgcagactgaagatcagtacattttctgctaccaggtgattctttacgtgctgactagactgcaagccgaggaggaacaaaagcagcagccccagctgttgaagta

SEQ ID NO: 237057 - DNA, 7304 bp, Artificial Sequence
  Description of Artificial Sequence: Synthetic coding sequence
cagtttctattcacgaaggtgtctctggccgatcctgctgccctcggctttataatatctccgtggtcccttctgctcctgccgagcggatccgtcagttttacagacgagaacatttcaaaccaggacctgagggcttttaccgcaccagaggttctgcagaatcaatcactgacgtctctgagcgacgtcgagaagatccatatatactcgctgggcatgaccttgtactggggtgccgattacgaggtaccacagagccagccaatcaagcttggggaccatctgaactccatactgcttggcatgtgcgaagacgttatttatgcacgcgtctcagtgagaacggtgctagacgcctgctctgctcacatcaggaatagcaactgcgccccatcctttagctacgtgaaacatctcgtgaaattggtccttggtaatctgtctggaacagaccagctgtcttgcaattctgaacagaagcccgacagatctcaagccattcgcgacaggctgcgtgggaagggcctccctactggtcgctctagcactagtgacgttttagatatccaaaaacccccattgagccaccaaacttttctgaataagggtttaagcaaaagtatgggcttcttatcgattaaggacactcaggatgaaaattattttaaagatatcctgagcgacaacagcggacgtgaagattctgagaataccttcagtccatatcagtttaagacctccggaccggagaagaagccaatccctgggatcgacgtgctctctaaaaagaagatatgggcatcatccatggatctgttgtgtacggccgaccgggactttagctccggcgagacggctacatatagaagatgccacccagaggcagtgactgtgagaacctcaactacacccaggaagaaagaggcccgttattcggatggaagtatcgccctggacatattcggcccacaaaaaatggatccgatctatcacactcgggagctgccgacgagctctgctatctcatcagcccttgacagaattcgtgaaagacagaaaaaactccaggtcttgcgggaagccatgaacgtggaagagcccgtgagacggtacaaaacctaccacggcgatgtcttcagcacgtcttctgaaagcccttctattatcagctctgagagcgacttcaggcaggtgcgtcgatccgaggcctccaaacggttcgagtctagtagtgggcttccgggagtggatgagacgctgtctcagggccaaagccagcgaccttcaagacagtatgaaacccccttcgaaggaaaccttattaaccaggagattatgctgaagcggcaggaggaggagctgatgcagctgcaggccaagatggcactgagacagtcccgcctgagtttatacccaggtgatactattaaggcctcgatgctcgatatcactcgagacccactccgggaaattgctcttgagacagcaatgacccagaggaaacttaggaatttcttcggaccagagttcgtgaagatgaccatcgaaccttttatctccttggacctccccaggtccatcttgacaaaaaagggcaagaacgaagataaccgaaggaaagttaacataatgctcctcaatggacaaaggctcgaactaacctgcgacactaaaactatctgcaaagacgtgttcgacatggttgttgcccatattggcctcgtggagcaccaccttttcgcactggctactctcaaagacaacgagtatttcttcgtcgacccagacctcaaactcaccaaagtggcgcctgaaggttggaaggaggagcctaaaaagaagaccaaagcaacggtgaattttacactgttctttcgcatcaaattctttatggacgacgtgagcttaattcagcacacgctgacgtgccatcagtattacctgcagctacgcaaagacatcttggaggaaaggatgcactgcgatgacgagacctcccttttgctcgcaagcctggctctccaggcagagtatggtgattaccagcccgaagtgcatggggtttcttactttcgtatggagcattacctccctgcccgagtgatggaaaagcttgatctatcctacatcaaggaggagctccctaagctgcacaatacttatgttggcgcatcagagaaggaaactgaactcgagttcttaaaagtatgtcagagattaacggagtacggcgtacactttcaccgggtccatccggagaaaaaatcccagaccggcattctgctgggggtgtgcagcaagggggtactggtttttgaggttcacaacggtgttaggactctagtccttaggttcccttggagggagactaagaagatctctttcagtaaaaaaaaaatcacgttacagaacacctccgacggcatcaaacatggtttccagactgacaattcgaagatctgccaatatctgctgcacttgtgcagctatcagcacaaatttcagctacaaatgagagctcggcagagcaaccaggacgcccaggatatcgagcgtgccagctttcgatctttaaacctgcaggcggagtctgtacgcggtttcaatatgggcagagctatcagcaccggctctctagcaagctctacactgaacaaactcgcggtgaggcctctatcggttcaagccgaaatcctcaaaagactcagctgctctgaactgtctctgtaccagccattacagaattctagcaaggaaaaaaatgataaggcaagctgggaggagaagccacgggagatgtcaaaatcataccatgatttgtcacaagcctcactttaccctcatcggaaaaacgtgatagttaacatggagcctcctcctcagacagtggctgagctcgtggggaaaccgtctcatcagatgtcacgctcagacgccgagtccctggcgggagtgacaaagctgaacaactccaaatcagtggcctcccttaaccgcagcccagaacgtagaaaacacgagtccgattcgtcctcaatcgaggaccctggacaggcttacgttctagacgtactccataaacggtggtctatcgtgagctcccctgagcgcgagataacactcgtcaatttgaagaaggatgccaagtatggcctcgggttccaaattatcgggggtgagaagatggggcgtctggatttgggtatttttatttcttctgtcgccccaggaggacctgcagatctggatggttgcctgaaacccggagaccggctgataagcgttaacagtgtctcactcgagggtgtgtcccaccacgccgcaatagagatcctgcaaaatgctccggaggacgtgacactggtgattagccaaccaaaagagaaaattagcaaggtcccttccactcctgtgcatctgactaatgaaatgaaaaattatatgaaaaagtcatcttatatgcaggactccgccatcgactcatctagtaaagaccatcactggagtcggggtaccctcagacacatttctgagaactcattcggtccatctggcggtctgcgcgaaggctccctgtccagccaggatagcaggactgagtcagcctccttgtcccagtctcaagtgaacggcttctttgcgtcgcacctgggggatcagacttggcaggaaagccagcacgggtccccgtcgccctccgtcataagtaaggccacggaaaaggagacttttacagactctaaccagtctaagacgaaaaaacccggtattagcgatgttaccgattactcagatcgcggagatagcgacatggacgaggccacttactcttctagtcaagaccatcagacacctaagcaagagagttcctccagtgttaatacttctaacaaaatgaatttcaaaactttttcatcttcaccgccaaagccaggcgacattttcgaagtggaactggccaaaaacgacaactcactgggcatttccgtgaccggtggagtaaataccagcgtgaggcatgggggtatatatgttaaggcagtcatccctcagggcgcagcggagtccgacggacggatccataagggcgatagggtgctggccgtgaacggtgtgtcactcgagggggctacccacaaacaagccgtggagactctccgcaacacgggccaggtggtgcatctgcttctcgaaaagggacagagccccacttctaaggagcacgtgcccgttactccacaatgtactttgagcgaccagaatgcccaagggcaagggcctgaaaaagttaaaaagactacgcaagtaaaggactacagctttgtcacagaagagaatactttcgaggtgaagctgttcaagaactcaagcggattggggttttcattcagcagggaggacaatctgatcccggaacagataaatgcctcaatcgtgagagtgaagaaactcttccctggtcagcccgcagcagaatcaggcaagattgatgtcggtgatgtgattttaaaggtaaacggagccagtctcaaggggctttcccaacaggaggtgatttccgctctcaggggcaccgctcctgaagtgtttctgctgctttgtaggcctccaccgggtgtgttgcctgaaatagacactgcattgctcacccccttgcagagccccgctcaggtgctgccaaatagctctaaagacagcagtcaaccgtcatgtgtagaacagagcacctcgtctgatgaaaatgagatgagcgataaaagcaaaaaacagtgtaagtccccaagtcgcagggatagttacagtgactcaagcggaagcggagaggacgacctggtgaccgccccagcaaacattagcaattcgacttggtcttccgccctgcaccagactctctcgaatatggttagccaagctcagagccaccacgaggcgccaaaatcacaggaagatactatttgtactatgttctactacccgcaaaagattccaaacaaaccagagtttgaagattcaaacccctccccactgccacctgatatggcgcctggacaatcgtaccagccacagtctgagtccgcctcctcgtccagtatggacaaatatcacattcatcatatcagcgagcccaccaggcaggaaaactggactcccctcaaaaatgatctggagaaccacctggaagacttcgagttggaggttgaactgctgatcacactcattaagtcagagaaaggcagcctggggttcaccgtcactaaaggaaatcaacgaatcggctgttacgtccatgatgtcatccaggacccggcaaagagcgatgggagacttaagccaggtgatagactgattaaggtgaatgacactgacgtgaccaatatgacccacacagacgcggttaatcttctccgcgctgcgagtaagaccgttaggctcgtcatcggcagggttctggagctgcccaggataccaatgttgcctcatctattacctgatataacgctgacttgtaacaaagaggaactcggcttttctctgtgcggagggcacgattcattgtatcaggtggtctatattagcgacattaatcccaggagtgtggctgcaatcgaggggaatctccagttactggacgtgattcattatgtcaatggggtatccacccagggcatgacattggaggaggtgaacagagccctggacatgtccctccccagtttggtgctgaaagccaccaggaacgacctgccggtcgtgcctagttcaaagcgaagtgcggtatccgctcctaagtcgacaaagggtaatggcagctattctgtgggctcatgcagtcagcccgctctcaccccaaatgattcattttccaccgtagcaggtgaggagattaacgagattagctatccaaaagggaagtgctctacataccagattaagggaagcccaaacttgactctaccaaaggaatcatatatacaggaggatgatatctatgatgatagtcaggaagctgaagtgatccagtcgctcctggacgtggttgatgaggaagctcagaacctgctgaacgagaacaatgctgccggatacagctgtgggcctggcaccctgaagatgaacggcaagctgagtgaggaacgcacagaggacaccgactgcgacgggtcgccacttccagaatactttactgaggcaactaaaatgaatggctgcgaagaatattgcgaggagaaggtcaagagtgagagcctgatacagaaaccacaggagaaaaaaacagatgacgatgaaatcacctggggcaatgatgagctgcccattgagcgcaccaatcatgaagattccgacaaagatcatagcttcctcacgaatgacgaactcgcagttttacctgtagtgaaggtgttaccctctggtaaatacaccggtgcgaatctgaagtcagttatcagagtgttgcgaggtctcttagatcagggcattcccagtaaagagcttgaaaatctgcaggagctcaaaccactggatcagtgtcttatcggtcagaccaaagagaatagacgtaagaaccgttacaagaacattctgccctacgatgctacacgcgtccccttgggggatgaaggaggttatatcaacgctagctttatcaaaatccccgtcggcaaagaggaattcgtttacatcgcctgtcaggggccactgcctaccacggttggtgacttttggcagatgatctgggaacagaagtcgacagtcatcgccatgatgacccaggaggttgaaggcgagaagataaagtgccaacggtactggcctaatatcctgggcaaaacaacaatggtgtctaaccggctcaggttggccctggtccggatgcaacagctcaaaggcttcgtggttagggcgatgacccttgaggatatccagacaagagaggtacggcatatctcccacctgaatttcacagcatggccagatcatgatactccctcccagcctgacgatcttttaacttttattagttacatgcgccacatccatagatccgggcctattatcactcattgctccgctgggatcggaaggtctggaaccctgatttgcattgacgttgtgctcggcctgattagtcaagatctggacttcgacatctcggaccttgtaaggtgcatgaggctacagcgccacggaatggtgcagaccgaggatcagtacatattttgctaccaggtgatactgtatgttctaacaagactgcaggctgaggaagagcagaaacagcaacctcaactgctaaaata

SEQ ID NO: 237058 - DNA, 7457 bp, Artificial Sequence
  Description of Artificial Sequence: Synthetic coding sequence
atgcacgtctccttggcagaggccctggaagtaaggggtggcccactccaggaggaggaaatctgggccgtgctgaaccagagcgctgaaagcctccaggaactctttagaaaagtgtccctcgctgacccagcggctcttggatttatcatctcgccttggtcgttgttactgctgccaagtggatcagtgtcttttaccgatgagaatattagtaaccaggacttgcgggcattcacagcaccggaggtgctgcagaaccagtcactgacttcactctccgatgtggagaaaatccatatttacagcctcggcatgacgctctactggggagctgattatgaggtgccgcaaagccagccaataaagttgggtgatcacctgaattccatcctgctcgggatgtgtgaagatgtgatctatgctcgggtctcagtgcgaactgtactggacgcttgcagcgcgcacattaggaattctaattgtgcgccaagcttttcttatgtgaagcacctcgtgaagttggttctgggtaacctgtctggaacggaccaactctcttgtaacagtgagcaaaagccagaccgttcacaagccataagggatcgtctcaggggtaaagggctcccaacagggaggagctcaacgtccgacgtgctggacattcagaagcctccactctcgcaccaaaccttcctaaacaagggtttatccaagagcatgggcttccttagcattaaagacacacaagacgagaattattttaaggatattctgtctgacaattcaggccgagaggactcagagaatacattttctccttaccagtttaagaccagtggacctgagaaaaagcccatcccaggcatagatgtactttctaagaagaagatatgggcctcctccatggatctcctgtgtactgcggatagagacttttcttccggggaaaccgctacatacagaagatgccaccccgaggctgtaaccgtgcgaacttctaccaccccaaggaaaaaggaggcccgttactccgacggcagcattgccctggatattttcgggccacaaaaaatggatcctatctaccacaccagggaactgcctaccagtagcgccatctcttcagccttggatcggatcagagaaaggcagaaaaaactccaggtgctcagggaggctatgaacgtggaagagcctgttcgccgttataaaacgtatcacggagacgtattttcaacgagctccgaatctccatccattatatcatccgaatctgatttcagacaggtgagacgatccgaagcgtccaaaagattcgagtcctcatccggccttcccggagttgatgaaacgctttcccagggccagtcacagaggcccagccgacagtacgagaccccctttgaaggcaatctgattaaccaggagatcatgctcaagagacaggaggaagagcttatgcagttgcaggccaagatggcgctgaggcagtctaggctgtcactttatcccggagacactattaaggcatctatgctcgatattacccgggatccactgagagagattgccttggagacggccatgacacagcgaaagctgcgtaactttttcggaccagagtttgtaaagatgaccatcgaaccgtttatttccctggacctgccacgatcaatcctgacaaagaaaggcaaaaatgaagacaaccggaggaaggtcaatataatgctgctgaatggtcagaggctggagctcacgtgtgatacaaagaccatttgcaaggatgttttcgacatggtggtggcgcatataggcctggtggagcaccatctcttcgctctggctaccctcaaggataacgaatatttcttcgttgacccggatttaaagctcacgaaagtggcccctgaggggtggaaggaagaacccaaaaaaaagacgaaagccaccgtgaactttacccttttttttcgtatcaagttcttcatggacgatgtgagtttgatccagcacaccctgacgtgccatcagtattacctacaactgagaaaggacattctcgaagagagaatgcactgcgacgatgagacttctctactcctggcaagtcttgccctccaggcggaatacggcgactaccagccagaggtccatggagtatcttacttccggatggaacactacctgccagccagggttatggaaaaattggacctctcttacatcaaggaagagctacccaagctgcacaacacatacgtgggagccagtgagaaggagacagaactggagttcctgaaagtgtgccaacgactgaccgagtacggcgtccactttcaccgcgtccaccctgagaagaaatctcaaactgggatcttactgggcgtgtgctccaaaggagtgcttgtgttcgaagtgcacaacggcgtccgcactctggtgcttaggtttccatggagagaaaccaagaaaatctccttttccaagaagaaaattaccctgcagaatacctcagacgggatcaaacatgggtttcagacagataactctaagatttgccagtacctcttgcatctctgctcgtatcagcacaaattccaactgcagatgcgggctcggcagtcaaaccaggatgcacaggatattgagcgggctagcttccgaagcctcaacctacaggccgagagtgtccgcggttttaatatggggcgtgctataagcacagggtcccttgcctcctcaaccctaaataaactggcggtgcgcccactctccgtgcaggctgagatactgaaaaggctcagttgtagcgaactttctctgtaccaacccctgcagaactcctccaaagagaagaacgacaaagcaagttgggaggagaagcccagagaaatgtcaaagagctaccacgacctgagtcaggcgtctctttatcctcacagaaagaacgtgatcgtcaatatggagcctcctccacagacagtggcagagcttgttggcaagcctagccaccagatgtctcgttccgatgcggagtctctggccggtgtgacaaaactcaacaactcaaagtcagttgcttcacttaatcggtccccagagcgcaggaaacatgaatccgactcatcatcaatagaagaccccggacaagcttacgtgcttgggatgaccatgcattctagcggcaacagctcctcccaagtgccactcaaggagaacgacgtgcttcacaagcgttggtcaattgtcagttcaccggaacgagagattaccttggtgaatctgaaaaaagatgcgaagtatgggctaggctttcagatcattggcggagagaaaatgggaagacttgatctaggaatctttatttcaagtgtggcccctggtggacccgcagatctcgacggatgcctaaagccaggtgatcgacttatttcagtcaatagtgtgagtctggagggcgtgagtcaccatgccgcaatcgagatcctccagaatgcaccagaagacgtgactctggtcatatcccagcctaaagagaagatcagcaaagtcccctctaccccggttcacctaaccaatgaaatgaagaactacatgaagaagtcatcttacatgcaagactcagccatcgatagctctagcaaggaccaccactggtccaggggtacactgcggcacattagcgagaatagcttcgggccaagcggtggccttagggagggctccttgtcatctcaggacagccgaacagagtcagcctctctatcgcagtcacaggtcaatgggttttttgcctctcacttgggcgatcaaacttggcaggagtcccagcatggatcacccagcccatccgtcatttcaaaagccaccgagaaggaaaccttcactgattctaatcagagtaagactaagaaacctggtatcagtgatgtgaccgattattcggatagaggcgatagtgatatggacgaggccacatatagctccagccaggatcatcagacacctaaacaagagtcatcctcttccgtcaacacctcgaataaaatgaatttcaaaacgttttcctcatctcctcccaaaccaggcgacattttcgaggtggagctcgctaagaacgataatagcctcggcattagcgtaacaggtggggtgaacactagcgtacgtcatggcggaatatatgtcaaggcggttattccccagggagctgccgaaagcgacggacggatacacaagggagatcgggtcctcgctgtgaatggcgttagtctggagggggcaacacataaacaggctgtcgagacactgcgtaatactgggcaggttgtacacctcctgctcgagaaaggccaatcgccaaccagcaaagaacacgtaccagtgacacctcagtgtaccctctcagaccagaatgcccaggggcaggggccagagaaggtgaagaaaaccactcaagtgaaggattactcatttgtgaccgaggagaataccttcgaagtaaagctttttaagaattcctctggcttaggcttttcattcagccgtgaggataatctgattcccgaacagattaacgcctcaatagtgagagtgaagaaactcttccctggtcagccagccgcagagtccggaaagattgacgtgggtgatgtgatcctaaaagtgaatggggcatcgctgaagggactgagccagcaggaagtgatttcagccctccggggaactgccccagaggttttcttactgctgtgcaggccacctcccggtgtgctccccgaaatagacactgccctgctcaccccgctgcagtcccccgcacaggtactacccaactcgtccaaggactcctcccagccaagctgcgttgagcagtccacaagctcagatgagaatgaaatgagcgataagtccaagaaacagtgcaaaagcccgagccgacgggattcttactcagatagctccggcagtggggaggacgatctcgtgacagccccagccaatatatcaaattctacctggtcttccgctctgcatcaaacattatctaacatggtctcgcaggcacagtcccaccacgaagcacccaaaagtcaggaggacactatatgtactatgttttactacccccagaagattcctaacaagcccgaattcgaggactcaaatccttctccactccctcccgatatggcacctggacagagctatcagccacaatccgaatccgctagtagctctagcatggacaaataccatattcatcacatctccgaaccaacacgacaggagaactggacaccactgaagaacgatttggagaatcatcttgaagatttcgagctggaagtggagctgctgattactctgatcaagtctgagaaggggagcctcggcttcaccgtaactaagggaaatcagcgaattgggtgttacgtccatgacgtcatccaggatccggctaaatcagatggaaggctcaagcccggtgatcgccttattaaggttaatgacactgacgtcactaacatgacccatacggacgcagtgaacttgcttcgagcggcttctaagacagtacggcttgtcatcggtcgcgttttggagctgccgaggatccctatgttgcctcatttgctccccgatattacgctgacgtgcaacaaggaggagctggggttctctctctgtggtgggcatgacagtctgtaccaagtggtgtatatttctgatatcaacccaaggtcggtcgccgcaatcgaggggaatctccagctgctcgatgttatccattacgtgaacggagtgtctacacagggcatgacgctcgaagaggtgaatagagccctcgacatgtcattgccctccctggtcctcaaagcaacacggaacgaccttcctgtggtgccatcctcgaaaaggtcagccgtcagcgccccaaaaagtacaaaaggcaatggttcctatagcgttggatcgtgcagccagccagctttaacacctaacgactccttttcaactgttgccggtgaagagataaatgaaatctcataccctaaaggtaaatgctctacataccagatcaaaggctcccctaacctgaccctcccgaaagagtcttacattcaggaagacgatatttacgatgattcccaggaagccgaggtcatccagagtctactggatgttgtggacgaagaggcacagaacttgctaaacgaaaacaatgcagcaggttatagctgtggtcccggaacccttaagatgaatggcaagctgagtgaggaaaggacagaggacactgactgcgacggatcaccactgccagagtatttcacagaggcgacaaagatgaacgggtgtgaagagtactgtgaagagaaggtcaagtccgagagtcttatccaaaaaccccaggaaaaaaagacagatgatgacgagataacatggggcaatgacgaactacctattgagaggaccaaccatgaagattccgataaggaccacagcttcctgacaaacgacgaactagcagtgctgcccgtggtgaaggtactgccgagtggtaaatacacaggagcaaatttgaaaagtgtgatacgagtcctgagggggctattggaccagggcatccccagcaaagaactggagaacctgcaggaactcaaaccgctggaccaatgccttattggccaaactaaggaaaataggaggaaaaaccgctacaaaaacatcctgccatacgacgcaacaagggtgcctcttggtgacgaagggggatatattaatgcttctttcataaagataccagttggaaaggaggaattcgtttacatagcgtgtcaagggccattgccaacaacagttggtgatttctggcagatgatatgggagcagaaatccactgttatcgccatgatgactcaggaagttgaaggagagaagatcaaatgccaacgatattggcccaatatactcggtaaaactactatggtaagcaatcgcctgcgcctggcactagtgagaatgcagcagctgaagggatttgttgtgcgagccatgaccctggaggatatacagaccagggaagtccggcacatttcacatctgaattttacggcttggccggaccatgacacacctagccaacccgatgacctgctcactttcatttcatatatgcgacacatccacagatcaggcccaattataacacactgttctgctggaattggcagaagtggcacactgatttgtatcgacgtggtcctcggtctgatttcacaggacctggacttcgatatcagtgatctggtacgctgcatgaggttacaaaggcatgggatggtgcagacagaggaccagtatatcttctgttatcaggttatactgtatgtacttaccaggctgcaagccgaagaggagcaaaaacagcagccccagcttctgaagta

SEQ ID NO: 237059 - DNA, 7400 bp, Artificial Sequence
  Description of Artificial Sequence: Synthetic coding sequence
atgcacgtaagcctggctgaggcactggaagttcgcggaggcccattgcaagaggaggagatctgggcagtgcttaatcaatcggcagaaagcctacaagagttgttccgcaaagtgtcgttagctgatccagccgctttgggttttattatctctccatggagtctgcttctgctcccttcaggttccgtttcctttacagacgaaaatatatctaaccaggatctgcgagcgttcaccgcgccagaggtcttgcagaaccaatcactgacgagtctgagcgatgtggaaaaaatccatatatattcactgggaatgacgctttactggggggcagattacgaggtgcctcaatcccagcctattaagctcggcgaccatttgaacagcatactgttgggcatgtgtgaagacgtgatttacgcgagagtgtcagttcgcacagttctggatgcctgtagtgcccacatcaggaatagcaactgcgcaccatcttttagttacgtgaagcacctggtgaaacttgtcctgggtaatctatccggaacagaccaactgagttgcaattctgagcaaaagccagaccgcagtcaggccattcgcgatcggctccggggaaaagggctgccaactggcagatcttcaacaagtgacgttctggacatccagaaaccacctctgtcgcaccagactttcctgaataaaggcctcagtaagtctatgggattcctctccatcaaggacacacaggatgaaaactacttcaaggacattctctcagataactcgggcagggaggatagtgagaacacctttagtccatatcagttcaaaacatccggtcctgagaaaaagccgatccctggcatcgatgttctgtctaagaagaagatatgggctagctctatggatttactttgtactgctgatagagattttagttccggagaaactgccacttaccgccgatgccaccctgaagctgtcacagtgagaaccagcaccactcctcgcaagaaggaagccaggtacagtgatgggtccatagcactcgacatcttcgggccacagaaaatggatccaatataccacactcgcgagctacccacttccagtgcaatcagcagcgccctggaccgcattagagagcgacagaagaagttacaggtgctccgggaggccatgaacgtcgaggaaccagtgcgcagatacaagacataccatggagatgttttcagcaccagctcagagtctccaagcatcatttcctctgagagcgattttcgacaggtgaggaggagtgaagctagcaagagattcgagagctcctcagggctaccaggggtggatgaaacactctcacagggccaatcccagaggcctagccgccagtacgagacaccattcgaaggaaacctgatcaaccaggagataatgttaaaaaggcaggaggaagagctcatgcagcttcaggccaaaatggctttgaggcagagcagactaagtctttaccctggagacaccatcaaggcttctatgctggatataacccgcgatcctcttagggagatcgctttagagactgcaatgacccagcggaagttgcggaacttttttggccctgaattcgtgaagatgaccatcgaacctttcattagcctcgacctccctcgcagcatactgacaaagaaaggcaaaaatgaggacaaccggaggaaagttaacatcatgctcctgaatgggcagagactggagttaacctgtgataccaaaacgatctgcaaggacgtctttgacatggttgtggctcatatcggcctggtagagcatcatttgttcgctctggctaccctgaaagacaacgagtacttttttgtggatcctgacctgaaacttaccaaggtcgctcccgaggggtggaaggaggaaccaaagaagaaaacaaaggccaccgtgaatttcactctgttttttagaataaaattttttatggacgacgtgtccctgatacagcacaccctgacctgtcaccaatactacctccagttacgtaaggacattctggaggagcgaatgcactgcgacgatgagaccagcctactgctggcttccctggcattacaggccgaatacggtgactaccagcccgaagtccatggggtgtcgtattttaggatggagcactatttaccggcaagggtaatggaaaaactggacctctcctacattaaagaggaactccccaaactgcacaacacttatgtcggagcttctgagaaagaaacagagctagaattcctgaaggtgtgccagcggttaacggaatacggggtgcactttcatcgagtacatccagagaagaagagtcaaaccggcatcttgctaggcgtgtgtagtaaaggggtcttagtgtttgaagtacacaacggcgttagaactctggtgcttcgctttccctggcgggaaacgaaaaaaatttctttttctaagaaaaagattaccttacagaacacaagcgacggcattaagcacggcttccagacggacaattcaaaaatctgccagtatctgctgcacttgtgtagttatcaacataagttccaactgcagatgagagctcggcagtctaaccaggacgctcaggatatcgaaagggcgtctttcaggtccttgaacctacaagccgaatctgtgagaggctttaatatggggagagctatttctactggatctctggccagtagtacactaaacaagctggctgtccggcctctatccgtgcaagctgagatcctgaagagactttcctgtagcgagctgtcactctaccaaccattgcaaaattcatcaaaggagaagaatgacaaggcttcttgggaagagaaacccagagagatgtcaaagagctaccatgacctgtcccaggcctccctctacccccacagaaaaaatgtgattgtgaacatggaacctccccctcaaacagtggccgaactggtggggaaaccatcacaccaaatgtctagatccgatgccgagagcttagccggagtgacaaagctgaacaacagtaagtccgttgccagcctgaatcgcagtcctgaaaggcgaaagcatgaaagtgatagctcgtctatcgaggaccctggccaggcctacgtcttggacgtactccacaagcggtggtcaatcgtctcatctcctgagcgagagatcactctggtgaatctgaagaaagatgctaagtatggcctcggctttcaaatcataggaggcgagaaaatgggtcgcctcgatctaggcatcttcatttcctccgtggcacctgggggtcccgcagacctggatggctgcctgaagccaggggacaggctaatatccgtaaatagcgtaagtctggaaggggtctcacaccatgcagccatcgaaattctccagaacgcccctgaggacgtgacactcgtgatctctcagccaaaggagaaaataagcaaagtccccagcacgcccgttcatctgacaaacgaaatgaaaaattatatgaagaagtcaagctacatgcaggattctgcgatcgattcctcctccaaagaccatcattggtcacgtggcactctaagacatattagcgaaaattcatttggaccctcaggtggtttgcgggaaggcagcttgagctcccaggatagccgaaccgagagcgctagcctttcgcaaagccaggtaaacggctttttcgcttctcacctaggagaccagacctggcaggaatcgcagcatggcagtcctagcccaagtgtcatttctaaggcaaccgagaaggagacctttactgattctaatcaatctaaaacaaaaaagcctggcatcagcgatgtgacagactactccgatcgcggagatagtgatatggacgaggctacatacagttcctcacaggatcaccaaactcccaagcaagaatcctcaagcagcgtgaacacaagtaataagatgaacttcaaaacattctccagtagtccacctaagccaggagacatctttgaggttgagcttgccaaaaacgacaatagcttgggaatctcagtgaccggcggtgtgaacacgagtgttaggcatggcggaatatacgtaaaggcagttattccccagggggcagcagaatctgacggcaggatccacaaaggagaccgggtgctggctgttaacggggtcagcctggagggtgctacgcacaaacaggccgtcgagaccctaaggaatacgggccaagtggtgcatctgctgcttgagaaggggcagagtcctacatccaaggaacacgtgcccgttactccacaatgcacacttagcgaccagaacgcgcagggccagggcccagaaaaagtgaaaaagacgacacaggtgaaggattacagctttgtgacagaggagaatacttttgaagtcaagctcttcaagaactcctctggcctggggttttccttcagtcgggaggacaacttgatccctgaacagattaacgcgtccatagtgcgtgtgaaaaagctgttccccggtcagcctgcggcagaatccggaaagatcgatgtgggcgacgtcatccttaaggtgaacggagccagcttaaaggggctgtcccagcaggaggtgattagcgcccttagaggcacagctcccgaggtatttttgctcctctgtagacccccacccggtgtgctaccagaaatcgacaccgccttgctaacacccctgcaatccccggctcaggtcttacctaattccagcaaggactcatctcagcctagttgcgtagaacagagcacatctagcgacgagaatgagatgagtgataaaagcaaaaaacagtgcaagtctccttctagacgggactcttactcagatagctcaggaagtggcgaggacgacttggttacggctccagccaacatcagcaattcgacatggtcgtcagctctacaccaaaccctgtccaacatggttagtcaagcccagtctcatcacgaagcccctaaatcccaggaggataccatctgcacaatgttttattaccctcagaaaatacctaataagcctgagttcgaagacagtaacccatccccattacctcctgacatggcccctgggcagtcataccagccacaatccgagtccgcatcttcttcatccatggacaaataccacatccaccacatttctgagcctacccgccaggaaaactggactccgttgaagaacgatctggagaaccatctggaagacttcgaactggaagttgaactgctcattaccctcatcaagtctgaaaaagggagcctaggcttcacggtaaccaagggcaaccagcgcattggctgttatgtccacgatgtaattcaggaccccgctaagtctgacggcagactcaagcccggtgatcgccttatcaaggttaatgacacggacgtgacaaacatgactcatacggatgccgtgaacttgcttcgcgctgcttctaaaacggtgagactcgtaattggcagagtccttgagctgcccagaatccccatgcttccacacctcctgccagatataactctgacatgcaacaaagaagaactggggttctccttatgtgggggtcacgactctttataccaggtcgtttatatatccgacatcaatccaagatctgtggctgcgattgaaggaaacctgcagttattggacgtgatccattatgtcaatggcgtgtccacgcaaggtatgacgctcgaagaagtgaatcgcgctcttgacatgtcattgccgtctctggtgctaaaagcaaccaggaacgacctcccagttgtcccttcgtcgaagcggtcagccgtctccgcgcctaagtccactaaaggtaacggctcatactctgttggctcttgtagccagcccgctctcacccccaacgactccttcagtactgtcgccggagaggagatcaacgagatttcttaccctaagggtaagtgctcaacgtatcagattaaaggatcccccaatttgaccttgcctaaggagtcttacatccaagaggacgatatctacgacgacagtcaagaagcggaggtaatacagagcctgttagatgtcgtggacgaggaagcacaaaatctgcttaacgagaataatgccgcaggttacagttgtggccctgggacattgaagatgaatggcaaactgtcagaggagcgcacagaggacacagattgcgacggttctccattgcctgaatatttcaccgaagctacaaagatgaacgggtgcgaagaatactgcgaggagaaagttaaatcagaaagcttgatacaaaaaccccaagaaaagaaaaccgacgatgacgaaattacatggggcaatgacgagctgccgatcgagagaacaaatcatgaagactccgataaggatcattccttcctgacgaacgacgaacttgccgtgttgcccgtagtgaaggttctgccaagcggtaaatacacaggcgcaaacctgaagtctgtcatccgagtcctcagagggctgctcgaccaggggatcccgtctaaagaattagagaacctgcaagagctgaagcctcttgatcagtgtctcattggacagactaaggagaatcgaaggaagaacagatacaagaatatcctcccttacgacgccacaagagtacctcttggtgatgagggtgggtacattaacgcaagttttatcaagattccagtggggaaggaagaattcgtgtacatcgcctgtcaaggtcctctgcctactaccgtgggcgacttttggcagatgatatgggagcagaagtccacagtgattgcaatgatgacccaagaggtggagggcgaaaagatcaagtgtcaacggtattggcccaatattctggggaaaacaacgatggtgtccaacaggttgcgcttggccctggttcgcatgcagcaacttaaaggtttcgtggtgagggccatgacactcgaagatatccagactagggaggtgaggcatataagccatctcaatttcacagcctggcccgatcacgacacccctagtcagccagacgacttactgaccttcatctcatacatgcgccacatacaccggtctggacccatcattacacattgttccgccggaattggacgcagcggcacactcatttgtatagatgtcgtcctggggctcatctctcaagacctggactttgatattagtgacctcgtaagatgtatgaggctgcagcggcacgggatggtacaaactgaggaccagtatattttttgctatcaggtgatattgtacgtgctaacccggttacaagccgaggaagagcagaagcaacagccacaattattgaagta

SEQ ID NO: 237060 - DNA, 7472 bp, Artificial Sequence
  Description of Artificial Sequence: Synthetic coding sequence
atgcacgtttctctggcagaggccttagaagtgcggggaggtcccctccaggaggaagaaatctgggcggtgttaaatcagagcgcagagtccctgcaagagttattcaggaaggtatcactggccgatcccgctgccttaggtttcattattagcccctggagccttctgctcctccctagcgggagcgtctcgttcacggatgaaaacatcagtaatcaggatctgcgggctttcacagcacccgaggtcttgcagaatcagagtctgaccagtctgtccgacgttgaaaaaattcacatttactctctggggatgacattgtattggggtgccgattacgaagtcccacagagccagccgatcaagctgggagatcatctaaacagcatcctgctgggaatgtgcgaggacgtcatttatgctcgtgtttccgtaaggaccgttctcgacgcctgttctgctcacattcggaactcaaattgcgccccttctttttcttatgtcaagcaccttgtgaagctggtattgggtaacctgtccggtactgatcagctttcatgtaattctgagcaaaagccggaccgttcccaggccattcgggaccgactcagaggtaaggggctcccaaccggaagaagcagtaccagtgatgtgctggacatccaaaaaccccctctcagccaccaaaccttcctgaataaaggcttgagcaagagtatgggattcctttccattaaggacactcaagacgaaaattattttaaggacatcctgagtgacaactccggacgagaagactcggaaaacaccttctcaccttaccagtttaaaacatccggtccagaaaagaagccaattccaggcatcgacgttctttccaaaaagaagatatgggcaagttctatggacctgctgtgcactgctgaccgggacttctcgagcggtgagacagccacgtatcggcgatgccacccagaagccgtgactgtacgtacgagtactactccccgtaagaaggaagccagatatagcgacggttctatagccctggacattttcggccctcagaaaatggacccaatataccacacacgtgagttgcccacgtcttctgccatcagctctgccctggatcggatcagagagcgacaaaaaaagctacaggttctgcgagaagcgatgaacgtggaagagcccgtgcggcgatataaaacctatcatggtgatgttttctcaacaagctctgaatcacctagtatcatcagctcagagtcagactttcgtcaggttagaaggagtgaggcgtcaaaacggttcgaaagtagctcgggactgcccggagttgatgaaacactgtcccagggccagagtcagcgaccctccagacagtatgagactcccttcgaaggaaacctgataaatcaggagatcatgttgaaaagacaggaggaggagctgatgcagcttcaggccaagatggcgctaagacaaagccgcctttccctataccctggagacactattaaggcaagcatgttagacattacgcgggatcccctccgcgagatagctctggaaactgccatgactcagcggaaactgaggaacttttttggtccggagttcgttaaaatgactattgaaccttttataagtctcgatttgccgaggtcaattctcaccaaaaagggcaaaaacgaggacaaccggcgaaaggtaaatattatgcttctcaatgggcagaggttggaactcacgtgcgatacaaagactatctgcaaggacgtgttcgacatggtggtggcccatatcggattggtcgagcaccatctattcgccctggctacattgaaagacaacgaatattttttcgtggatcctgatctgaaactgacaaaggtggccccagaagggtggaaagaggaacctaaaaaaaaaactaaggcaactgtgaactttactctcttcttcaggataaagttcttcatggacgacgtctcactgatccagcacaccctgacctgccatcagtattacctacagctgcgtaaggatatcctggaggaaagaatgcactgcgatgatgagactagcctgctgctggcttctctggccctgcaggcggagtacggcgactatcagcctgaagtccacggcgtttcctacttcaggatggaacactatctgcccgctcgtgttatggaaaagctggatctctcgtacatcaaagaagagctgcctaaactgcataacacctacgtgggggcttccgagaaggagaccgaactcgagtttttgaaggtgtgccagcgactcaccgagtatggggtgcacttccaccgagttcaccccgaaaaaaagtcacagaccgggattcttctcggcgtttgctctaagggcgtcttggtgtttgaggtgcacaatggtgttcgcacactggtgttgcggttcccttggcgcgagacaaaaaaaatctccttctccaaaaaaaagattactctgcagaacacatctgatggcatcaagcacggtttccagacagacaattccaagatttgtcagtatctgctgcacctctgttcgtatcaacataaatttcagctccagatgcgggcacgtcaaagcaaccaggacgcacaggatattgagagggcaagcttccgatcactgaacttgcaggctgagtccgttcggggattcaacatggggagagccatatccacaggatcgctggcatcttctactctgaacaaacttgccgtgagaccgctttcagtacaagctgagatccttaaaaggttaagctgctcagaattgtcgctttatcagcctttgcaaaactccagtaaggaaaagaacgataaagcaagctgggaagagaagccacgggagatgagcaagagttaccatgacctttcccaagccagcctctatccccacagaaagaacgtcatcgtaaacatggaaccacccccacaaactgtcgctgaactggtcggcaagccctctcaccagatgtccaggagtgacgcggagtccctggcaggtgtgacgaagctcaataatagcaagtctgtggcctccctcaaccgtagccctgagcgccgtaagcacgagtccgattcttcaagtatcgaggaccccggacaggcttatgtgctgggcatgactatgcactcctctggcaacagcagttcccaggttcctctgaaagaaaacgatgtactgcacaaacgttggtctattgtgtcctctccagagagagaaatcacgctggtgaacctcaaaaaagacgcgaaatatggacttgggttccagattataggcggagaaaaaatggggaggctggatctcggcatttttattagcagcgtggcacccggaggacccgcagacctcgacggttgtctgaagccaggggatcgactaattagtgtgaattccgtcagcctggaaggcgtgagccatcatgccgcaatagaaatactccagaatgctcctgaagatgtgactctggtcatatcacagcccaaggaaaaaatatcaaaggtgcccagcactcctgtccatctgacaaatgaaatgaagaattatatgaagaaatcttcatatatgcaggactccgccattgatagcagctctaaggaccaccattggagtcggggtactttgaggcatatcagtgagaattccttcggtcccagtggcggactccgcgaggggtctctgagttcccaggattccaggactgagtcagcttcattgtctcagagccaggtgaacggattctttgcatcccaccttggggaccaaacttggcaggaatctcagcatggttctccctctccgtctgtcataagcaaggcgacagagaaggagactttcactgactcgaaccagtctaaaacaaaaaagccaggcatcagcgacgtcacagactattccgatagaggagattcagatatggatgaggctacatacagctcttcccaagatcaccagacccccaagcaggagagctcctcttccgtcaatacctcaaataagatgaactttaaaactttctcatcctctcctccaaagccaggcgatatattcgaggttgaattagcaaagaatgataatagccttggcattagcgtgacagtcttgtttgacaagggcggtgtgaataccagcgtgcgacatggcggaatttatgtgaaggctgtgattccacaaggggcagccgagtcagacgggaggatccacaagggcgaccgggtgttggctgtgaacggcgtgtccctggagggtgcgacccataagcaggcggtggagaccctaaggaacactggacaggtggtgcacctgctcctcgagaaggggcaatcacctaccagcaaggagcacgtgcccgtgaccccgcagtgcaccctgtccgatcagaatgctcaggggcagggtcccgagaaagttaaaaagaccacccaggtgaaagactattcatttgttacagaggaaaacacttttgaagtgaagctgttcaagaactccagtgggcttgggttttcttttagccgagaagataatttgatccctgagcagatcaacgccagcatcgtccgagttaagaaacttttccctggacagcccgctgccgaaagcggtaaaattgacgtgggcgatgtgatactcaaagtgaacggcgcttctctgaagggcctctcacagcaggaagtgatatcagcattacgcggaactgccccagaggtgttcctgctgctttgcagacccccaccaggcgtgcttcctgaaatcgacactgcactgctcactcccctccagagccctgcccaggtgctgcccaacagtagtaaagactcaagtcagccttcctgcgtggaacagtccacatctagcgacgagaacgagatgagtgataaatctaaaaagcagtgcaagagtccctcgcggagagacagctacagcgattctagcggctcaggagaggacgacctggtcactgccccagctaatatctctaactcaacatggtccagcgctttgcaccagaccctgtctaatatggtgagtcaggcacagtctcaccacgaggcccctaagtcacaagaagataccatctgtacaatgttctactatccacagaaaatccctaataaacctgaatttgaggattccaatcccagcccccttccgccagacatggccccaggccagtcgtaccagccacagagtgagtcggcttccagttcaagtatggataaatatcatatacaccacatctccgagcctacacgccaggaaaactggacacccctcaaaaacgacctggagaatcatctggaggacttcgagctggaggtggagctcctgatcaccctgatcaaatcagagaaggggtcattgggctttactgtcaccaaaggaaatcagcgtattggatgctacgtgcatgatgtcatccaggaccccgcaaaaagtgacggacgactgaagcccggagaccggttgatcaaggttaacgatactgacgtcacgaacatgactcacactgacgccgtgaatcttcttagagcagcctccaaaactgtgagactcgtgataggtagagttctggaactccctcgcattccgatgcttccacacctgcttccagatattaccctgacatgcaacaaagaggaacttggcttcagtctgtgcgggggacacgattcattgtaccaagtggtgtacatcagtgacattaatcccaggagtgtggccgcaattgaaggaaacctccagctattggatgtcatccactatgtcaatggagtcagcacccagggtatgacattggaagaggtaaaccgggcattagacatgagtctgccctctctcgtgcttaaagcaacaaggaatgacctgccagtagtcccatcctcaaagcgttcagccgtgtctgccccaaaatctacgaagggaaatggctcgtatagtgtcggctcatgcagtcagccggctcttactcccaacgactcttttagtaccgtcgcaggcgaggagatcaacgagatcagctaccccaaaggcaaatgctccacctatcagattaaaggaagtcctaacctcaccttacctaaagaaagttatatccaggaagacgacatttacgatgactcccaagaagctgaggtcatccaatccctcctggatgtagtcgacgaggaggcccagaatttgctgaatgagaataacgctgccggatattcctgcggccctggaactctaaaaatgaatggaaagttaagtgaggagcgcaccgaagacaccgattgtgacggctctccccttcccgaatattttacagaagcgacaaagatgaatggttgcgaggagtattgcgaggagaaggtaaagagcgaaagcttaattcagaagccccaggaaaaaaagacagacgacgatgagatcacctggggtaatgatgagctgcccattgaacgcacaaatcacgaggactctgataaggaccattccttcttgacgaacgacgagttggctgtgctgcccgtcgtgaaggtgctacccagcggcaaatatacaggagctaatctgaagtcggtgattcgcgtcctccgtgggctgctcgaccaggggatccctagtaaggagttagagaatctccaagagctgaagcctctggaccaatgcctcataggccagactaaggagaataggcgcaagaaccgatacaagaatatcttgccgtacgacgcaacgagggtacccctcggcgacgagggcggatacattaatgcaagctttatcaaaattcctgttgggaaggaggaattcgtgtacattgcctgtcagggcccacttcctacaaccgtaggcgatttctggcagatgatttgggagcaaaagtctactgtgattgctatgatgacccaggaggtggaaggcgagaagatcaaatgccagcgatattggcctaatattttgggcaaaacaacaatggtgagtaatcgcctgcggctggccctggtgcgcatgcagcagctgaaggggtttgtggtcagggccatgaccctggaggacatacagacgagggaagtgcgtcacatctcacatctgaacttcaccgcctggccggatcacgacacccctagtcagcccgacgatctgctaacatttattagctatatgagacacattcatcgatcaggaccaataatcacacactgcagcgcaggaatcggacgttccggaactctgatttgcattgacgtagttctgggactgatttcgcaggatttggacttcgatataagcgacttagtgcggtgcatgcgtttgcagcgccacggaatggtccagactgaggaccaatatatattctgttaccaggtcatcctctacgtcctcaccagactccaagccgaagaggaacagaaacagcaaccccagctgttaaaata

SEQ ID NO: 237061 - DNA, 420 bp, Artificial Sequence
  Description of Artificial Sequence: Synthetic coding sequence
atgcacgtctccctggccgaggcgttggaagtgcgaggcggacctcttcaggaagaagagatctgggcggtgcttaaccaaagtgcagagtcgctccaggaactctttcgcaaggtgtccctggccgatcccgcagctttgggattcatcatctctccgtggtcgctacttctcctgccaagtggttcggtctcattcactgacgagaatatatcgaatcaggacctgcgcgcatttacagcccctgaggtcctccaaaaccagtcactcaccagcttgagtgatgtggagaagatccacatatactcactaggcatgactttgtactggggagctgattatgaagtcccccaaagtcaacctattaagttgggagatcacttgaactcgattttgctaggaatgtgcgaagatgtctag

SEQ ID NO: 237062 - DNA, 7472 bp, Artificial Sequence
  Description of Artificial Sequence: Synthetic coding sequence
atgcatgtttctctggctgaggctttagaggtccgcggtggtcctctgcaggaggaggaaatctgggcagttctgaatcaatctgccgaatcactgcaggagctgtttcggaaggtgtcgctcgccgacccagctgctctaggcttcattatttccccgtggagtctcttgctgctacctagtggatccgtgtctttcaccgacgaaaatattagcaatcaggacttacgcgcatttactgctcctgaggtccttcagaaccagagcctgacatctctgtccgacgtcgaaaaaattcacatctattccttggggatgaccctctattggggcgcagactacgaggtcccccagtcccagccaattaagctgggcgatcatctgaacagtatcctgttaggaatgtgtgaggatgtgatttacgctcgtgtttcagtcagaaccgttctcgatgcatgctctgcgcatattcgcaactcaaactgcgccccatcgttctcctacgttaaacacctcgttaaacttgttctaggcaatttgtctgggacagaccagttgagttgcaacagcgagcaaaaaccagaccgcagtcaagccatcagggatcgacttaggggaaagggcctgcccacagggagatctagcacgtcagacgtgctcgatatccagaaaccacctctgtctcatcagactttcctgaacaagggcctttctaaatctatggggttcctgtccattaaggacacgcaagatgagaactacttcaaggacatcctctccgataattccggcagggaagattcggagaacacgttctcaccgtaccagtttaaaacctctggacctgaaaaaaagcctattcccggaattgacgtcctgtcaaagaaaaagatatgggccagctctatggacctactttgtaccgcggaccgggattttagcagcggagaaaccgcaacgtacagaagatgtcatcccgaggctgttacagttcggacatctacaactcctcggaagaaagaagcgaggtactctgatgggagtatcgcactggatatctttggccctcagaaaatggaccctatctatcacacgagggagttgcccacttcctcagccatttcttccgcactagatcgaattagagaacgccaaaaaaagctgcaggtgctgcgggaggcgatgaatgtggaggagcctgtcaggcgttacaagacataccatggggatgtgttttccacgagttccgagagcccatcaattatcagcagcgagagcgacttccggcaggtgcggaggagcgaggccagcaagagatttgaaagctcgagcggtttgccaggagtggacgagacgctctctcaaggtcagagtcaacgtccctcgaggcagtatgaaacaccatttgagggcaatcttatcaaccaggaaatcatgctcaagaggcaggaggaggagctcatgcagctgcaggcaaagatggccctgcgccagtccaggctttccctgtaccccggagatacaatcaaggcaagcatgttagatattactagggacccgctgcgggaaatcgctctggaaaccgccatgactcagcgcaagctgcgtaatttttttgggccagagttcgtgaagatgactatcgagccgtttatctccttggatctgccacggagcatcctgaccaaaaaaggcaagaacgaagataatcgccgaaaggtgaatatcatgcttctgaacggacagagactcgagctcacgtgcgatactaaaaccatctgtaaggacgtatttgatatggtagtggcccatatcggattagtggaacaccatttgtttgcgctggctactctgaaagataacgaatactttttcgtggatccagacctgaaactgacgaaagtggcccctgagggttggaaggaagaacctaagaaaaagacaaaggcgacagtgaatttcaccttattctttaggatcaagttcttcatggatgacgttagcctgatccagcacacactgacatgccaccagtactatctgcagttgcgcaaggacatattggaggaacggatgcactgtgacgatgagaccagccttctgttggcctcactggcactgcaagcagaatatggcgactatcaacctgaggtccacggagtttcatactttagaatggaacattatctgccagcacgggtcatggaaaagctcgacctcagctacatcaaggaagaactgccaaagctgcataatacatacgtaggggctagtgaaaaggaaacagagctcgagtttctgaaggtatgtcagcgattaaccgagtatggcgtccactttcacagggttcaccccgaaaaaaaatctcagactgggatccttcttggggtgtgttccaaaggcgtgctggtgttcgaagtgcataacggagttaggacgctcgtgctgcggttcccctggagggaaacaaagaagatttccttctctaagaagaaaattactctgcaaaacaccagtgacggaatcaaacacgggtttcagacagacaattcgaagatctgccaatatctgctgcatctctgctcatatcagcacaaattccagctgcaaatgcgggctagacaaagcaatcaggacgcccaggacatcgagagggccagtttcagaagcttgaatctccaggctgaaagtgtgaggggttttaacatggggagggccatatccaccggaagcctggcttcaagcactttaaataagctggccgtgcgccctctgtccgtgcaggcagaaatcctgaagagactctcttgttctgagttgagtctctaccaacccctgcagaacagtagcaaagaaaagaacgacaaggcaagctgggaggagaaaccgcgagagatgagcaaatcgtaccacgatctgagccaggctagtctgtaccctcaccggaaaaacgtgatagtgaatatggagccaccaccacaaacagtagccgaactggtcggtaaaccatctcaccaaatgtccagaagcgacgctgaaagcctggccggagtgaccaagctcaataactcaaaatcagtggcctcccttaacaggtcgcctgagcgaaggaagcatgaatcagactcttctagtattgaggaccctggacaggcctacgtgctggggatgacgatgcactcgagtggcaacagctcatcccaagtgcccctaaaagagaacgatgtcctgcataaacggtggagtatcgttagctccccggagagagagattacactggttaatttgaaaaaggatgctaaatacggtcttggcttccagatcatcgggggagagaaaatgggccgtctcgatctgggaatatttatctcttccgtggctccaggcggtcccgcagatcttgacgggtgtcttaagccaggagaccggctgattagcgtaaactccgtgagcctagagggagtcagtcaccatgccgcaatcgaaattctgcagaatgctcctgaagatgtgacacttgtaatcagccagccaaaggaaaagatcagcaaagtcccatctacgccggtccatctgacaaacgagatgaagaactacatgaaaaagagctcttatatgcaggattccgctattgatagttcatcaaaagatcatcattggtcccgcggaacactgcgtcacatttcagagaatagctttggaccgtctggcggattacgggagggttcgctcagttcacaggattcgcgaacagagtcagcctccctgtcacaaagccaagtgaatgggttctttgcatctcatctcggcgatcaaacttggcaggaaagccagcatggaagtccttccccgtctgtcatcagcaaggccactgaaaaggagaccttcaccgactccaatcaatctaagaccaagaaacctggaattagcgacgttacagattactcagaccggggagatagcgatatggacgaagctacctacagctcctcccaggaccatcagacacctaaacaggagagcagttcgtctgttaacacctcgaacaagatgaatttcaaaaccttctcttcctcgcctcccaagcccggtgatattttcgaggttgaactggccaaaaacgataattctttggggatttcagtaaccgtacttttcgataagggtggcgttaacacgagtgtaaggcacggtggaatctacgtgaaggccgttatcccgcagggcgctgccgagtccgatggccgaatccacaagggggacagagtgttagccgtcaacggtgtgagtctggagggggctacccataaacaggctgtcgaaaccctcagaaatactggccaggtggtacacttactccttgaaaagggacagtcgcccacttccaaggagcacgtgcccgtcacccctcagtgcactttatccgaccaaaacgcccagggccaaggtcccgaaaaagtgaagaaaaccactcaggttaaggactactcttttgtcactgaagagaacacctttgaggtgaagctctttaaaaattcatcaggcctggggttcagctttagtagggaggataaccttatccctgagcagatcaacgcgagcatcgtgcgcgtgaagaaacttttcccgggacaaccggctgccgagtctggaaaaatcgatgtgggcgacgtcatcttgaaagtaaacggagcctccttgaaggggttatcccaacaggaggtgatctccgccctccgtggaaccgctccggaggtgtttctgctgctttgccgacctcccccaggcgtactgccagagatagatacggccttgctgaccccactgcaatcccctgcccaggtcttgccaaattctagcaaggacagctcacaaccatcctgtgtggagcagtcgacctctagtgacgagaacgaaatgagtgataagagtaaaaagcagtgtaaaagcccaagccgcagggatagctacagcgatagtagcgggagtggggaggacgatctggtgaccgccccagcaaacatatccaatagcacttggagttctgctcttcaccagaccctgagcaacatggtgagccaagcccagagtcaccacgaggcccctaagtcccaggaagatactatttgtactatgttctactacccacaaaaaatcccaaacaaacctgagttcgaggactcaaacccatcaccgctgcctccggacatggcccctggccaatcataccagccccagtccgaatcagcctcgtcatcatccatggacaagtatcacatccaccacatcagcgagcccactcgacaagagaactggacgcccctcaaaaacgatctagagaaccacctggaggacttcgagctagaggtagagctccttattacactaatcaaatctgaaaaaggatcactcggctttacagtgacaaaagggaaccagagaatcggttgttatgtccacgacgtgatacaggaccccgctaaaagcgacggccgactcaaacctggtgatcgattgataaaggttaatgatactgatgtcacgaacatgacacatacggacgccgtaaacttgctgagagccgcatctaagaccgttagactcgtgatcggtagggtccttgagctgcctaggattcctatgctgcctcacctcctgccagacattaccctgacctgcaataaagaagagttggggttcagtctatgtggcggtcatgacagcctgtaccaagtggtgtatataagcgacatcaacccccgttcagtggctgccatcgaggggaatttgcagctcttagatgttatccactacgttaatggggtgagcactcagggaatgactcttgaagaagtgaacagggcactcgatatgtccctgccatctctggtgctcaaggccacaaggaatgatcttccagttgtgccgtcatctaaaagaagcgccgtcagtgccccaaaaagcactaagggcaacgggtcgtactccgtgggtagctgctcacagccagccctgacccctaacgattcattctctacggtggcaggcgaggagatcaatgagatctcctaccccaaaggaaaatgcagtacataccaaatcaaaggttcccctaatctgacactaccaaaggagtcatacattcaggaagacgatatttacgatgatagccaggaggccgaggttatacagtcattactggacgtggtcgacgaggaggcccagaatctgctcaatgaaaacaatgcggcaggctactcctgtgggccaggaaccctgaaaatgaatgggaagcttagcgaagagaggaccgaagataccgattgcgatgggagccctctccccgagtactttactgaggccactaagatgaatggttgcgaagagtactgtgaggagaaggtgaagtcagagagcctcattcagaagccacaagaaaaaaagacggatgatgatgaaatcacatggggtaacgatgagctcccgatcgagcgcacaaatcacgaggactccgataaagaccatagttttctgactaacgatgagctggcagtgctcccagtggttaaagttctgcctagtggaaaatacacaggggcaaacctgaagagcgtcatcagggtgctccgaggattgctggatcagggtatcccgtccaaagaactcgagaatctgcaggagctgaaacccctggatcaatgtctcattggacagacaaaagaaaaccgtcgcaagaatcgttataaaaatatcttaccatacgatgctacaagggtccctctgggtgatgagggaggatacattaacgcgtcctttattaagattcctgtgggcaaggaggaatttgtctacattgcctgccagggcccacttcccactactgttggggacttctggcagatgatttgggaacagaaatccaccgttatcgcaatgatgacccaggaagtcgagggtgaaaagatcaagtgtcaaagatattggccaaatattcttggcaaaacaacgatggtgtctaacagattacggctagctttagtccgcatgcaacagctcaaaggctttgtcgtgcgcgctatgactctcgaagacatccaaacgagagaggtccggcatatttcccatcttaacttcactgcctggcctgatcacgacactcccagccagccggatgatctactcacttttatctcctacatgaggcacattcacagatcgggtccgattatcacgcactgttccgccggaatcggaaggtccggtaccctgatttgtatagacgtggttttgggactgatatcacaagacctcgattttgacatttcagacttggttagatgtatgcggttgcagcggcacgggatggtgcaaacagaggaccaatacattttttgttaccaggttatcctctatgtgttaacacgactacaggcagaggaagaacaaaagcaacagccccaactgctcaagta

SEQ ID NO: 237063 - DNA, 3564 bp, Artificial Sequence
  Description of Artificial Sequence: Synthetic coding sequence
atgcctttcgggctgaagcttcgtagaacacgcaggtacaacgtgttgtctaagaactgcttcgtaacacggattcggctactagacagcaacgtcatcgaatgtactctgtcagtagagtccacaggacaagagtgccttgaggctgtggcacaacgcctagagcttagagaaacacactattttggactgtggttcctaagcaagtcacagcaggctaggtgggttgaactagagaaaccccttaagaagcacctcgataagttcgcaaatgagccgttgctgttctttggcgtgatgttttacgttcccaacgtttcatggctacagcaggaggcaacaaggtatcagtattacttgcaagtaaagaaagatgtgctggagggcaggcttagatgtacactagatcaggtgatccggctagcagggctggccgtacaggcagactttggtgactataatcaatttgattcacaagacttcctccgggagtatgtactgtttccaatggacttagctctggaagaagctgtgctagaagagctcacgcagaaggtcgctcaagagcataaggctcacagcggcattctgcccgcagaagcggaattaatgtacattaacgaggtggaacggctcgatgggtttggacaggagattttccctgtgaaagacaatcatggcaactgcgtgcacttggggatatttttcatgggcatttttgttagaaataggatcgggcgacaagcggttatttaccgttggaacgatatggggaacatcacccacaataaatcaactatcctggttgaactgattaataaagaggaaacagccctctttcatacggacgacatcgagaatgctaagtacattagtagactcttcgcaacacggcataaattctataaacagaacaaaatatgtaccgagcagagtaattctcctcctccaatacgacgacagcccacatggagtcggagttctctgcccaggcagcagccatatattctgcccccagtccatgtgcagtgcggagagcactacagtgagactcacacttcccaggacagtattttccacggcaacgaagaagcgttgtattgtaatagccacaatagcctcgaccttaattacctcaatggaaccgtcactaacgggagtgtgtgttccgtgcatagtgttaacagcttgaactgttcccaaagctttattcaggccagcccagtctcatccaaccttagcatccctgggagcgatattatgagggctgattatattccatctcatcgccatagtgcaatcatcgtcccctcttatcggcctacgcccgattatgaaactgtcatgcgtcagatgaaaagggggattctgcacactgattcacagtcacaatcgctgcgaaacctgaacattatcaacactcacgcatacaaccagcccgaggaccttgtgtactcccaacctgagatgcgggagcggcacccttacacagttccttatggccctcagggcgtttacagtaacaaactagtgagccctagtgaccagcgaaatccaaaaaataacgtcgtgccttcaaaacccggagcaagcgccataagccacacagtatccacacctgaactggctaacatgcagttacaaggatctcacaactactctaccgctcacatgctgaagaactacctgttccgtcccccaccaccatatccacgtccacgcccagccacctctacgcctgatctggcctcacaccgccataaatatgtgtcaggcagctctccagacttggtgacaagaaaggtccagctttcagtgaagacctttcaggaggatagctctcctgtggtgcaccagtcgctgcaggaggtatctgagccgctcactgccaccaagcatcacggcaccgtcaacaagcggcattccttggaagttatgaactccatggtgagggggatggaggcaatgacactgaagagcctgcatctccccatggcaaggagaaatacactaagggaacaagggcctcccgaagaaggatcaggctcccacgaggtgccacagctcccccagtaccatcataagaagaccttttcagacgctaccatgctgatacactctagcgagtctgaggaggaggaggaagaggcccctgagtccgtgccacagattccgatgttaagggagaaaatggagtatagcgcacaactacaggctgcccttgctcggataccaaacaagcctccacctgaatatccgggaccacggaaaagcgtgagcaatggcgctttacggcaggatcaagcttccctgccgcctgccatggcacgtgccagagtcctgaggcatggcccagctaaagccatatccatgagtcgcactgacccaccagcggtcaatggggcaagtctggggccaagtatctctgaacccgacctcacatcagtcaaggaacgcgttaaaaaggaacctgtcaaggaacgacctgtgtccgaaatgttcagcttagaagatagcataatcgagcgtgaaatgatgatccgaaatttggaaaaacagaagatggccggtctggaagctcagaaaagacctctgatgttggctgccctgaatggactgagtgtggccagggtgagtggccgtgaggagaaccgagtcgatgctactcgggtccctatggatgaacgattcaggactctcaaaaaaaagctggaagaagggatggtgttcactgagtacgagcagatcccgaagaaaaaagccaacgggatattttccacagccgctctgcctgagaacgctgagaggtcaaggattagggaggtggtgccctacgaagagaatagagtggaactgatccctacaaaggagaacaacaccggctacattaatgcctcacatatcaaggttgtcgttggcggagcggaatggcattatattgcgacccagggacccttgccccatacatgccatgatttttggcaaatggtgtgggagcagggcgtcaacgtgattgctatggtgacggcggaggaggaggggggacgcacgaagtcacatcggtactggccgaaacttggctccaaacactctagcgcaacctacggaaaattcaaagtcaccaccaaattccggactgactcggtgtgctacgccacgaccgggctgaaagttaaacacctactctctggtcaagaaagaacagtgtggcatttacagtataccgattggcctgatcatggctgccctgaggacgtccaaggatttctctcatacttggaggagatccaatcagtgcgacgtcataccaatagcatgctcgaagggacaaagaataggcacccccctatagttgtgcattgttcagccggagttggacgcaccggggtcttgattctaagcgagctgatgatttactgtctggagcataatgagaaagtcgaggtcccaatgatgttgcgcttgttgcgggagcagcggatgttcatgatccagacgattgcacagtataagtttgtttaccaggtcctcattcaatttctgcagaactctcgcctgatatag

SEQ ID NO: 237064 - DNA, 636 bp, Artificial Sequence
  Description of Artificial Sequence: Synthetic coding sequence
atgccatttggtctgaaactacgaaggacccgccgatacaatgtgctaagtaagaactgtttcgtgaccaggatcagactgctagatagtaacgtcattgagtgcacactgtctgttgaaagtaccggtcaggaatgcctcgaagcagtggcgcagcggctcgagctgagggaaacacactattttggattatggttcctgtcaaagtcccagcaggcaagatgggtcgagctggaaaagcctctcaagaaacacctggataaattcgccaacgagccgctgctcttcttcggagtcatgttttatgtgcctaacgtgtcatggctccagcaggaggcgacccgctaccagtactatcttcaggttaaaaaagatgtgcttgagggaagactgcggtgtacactggatcaggtgattcgtttggctgggttggcggtgcaggcagattttggagactataatcagtttgattcacaggactttctgcgagagtacgtcctgttcccaatggaccttgccctagaagaagcagtcttggaggagctgactcagaaggtggcgcaagagcacaaagcacacaggacaatcatggagacagtgtacaccctggcattctccctgtggggtttctcttag

SEQ ID NO: 237065 - DNA, 1383 bp, Artificial Sequence
  Description of Artificial Sequence: Synthetic coding sequence
atgtcccgctctttggattctgctaggagcttcttagagagactggaggcaagaggcggtcgagagggggctgttctggcaggggaatttagtgacatccaggcatgcagcgctgcgtggaaagctgacggagtgtgctcaacagtggctgggtccagacctgaaaacgtgaggaagaatcgttacaaggatgtgctcccatatgaccagactagggtgattctcagtctgcttcaggaagaagggcatagtgattacatcaacggcaacttcatcagaggcgtcgacggcagtctagcatatatcgctacgcagggccctctccctcacactctcctcgacttctggagactcgtgtgggagtttggtgtgaaggtcattctcatggcctgcagagaaattgaaaatggcagaaaaaggtgcgaaagatactgggcccaggaacaggaacccttgcaaaccgggctgttctgtattacccttattaaggagaaatggctcaatgaggatattatgctacggactctcaaagtcacatttcagaaggaatcacgttctgtttatcagctgcagtatatgtcatggcctgatcgcggagtgcctagctcaccagaccacatgttagcaatggtcgaagaagctagacgacttcagggctcaggcccagagcccctgtgtgtccattgtagcgccggatgcggtcggactggggtgctttgtacagtcgactatgtcagacaactccttctaacacagatgatcccacctgactttagtctattcgacgtggtgctgaaaatgaggaaacagcgcccagctgccgtccagaccgaggaacagtatagattcctgtaccatactgttgctcagatgttttgttcaaccctccagaacgcttcacctcactaccagaacatcaaagaaaattgcgcccctctgtatgatgatgctctgtttctgaggaccccacaagcactccttgccattcctcgtccgcctgggggtgtgctgagatcaattagcgtgcccggttctcccggacatgcaatggccgatacatatgcagtggtccagaagcgcggagcccctgcaggagctgggagtggtactcagactggcacgggcacgggcactggtgccaggagtgccgaagaagctcctctgtattccaaagtaactcccagggcccagaggccaggggcacacgcggaggatgcacgtggaaccctccctggaagagtcccagctgatcaatctcccgctgggagcggtgcctacgaggacgtggccggaggagcgcagactggaggcctgggctttaacctgcgtattggcaggcctaaaggccctcgcgaccctccggctgaatggactcgcgtttag

SEQ ID NO: 237066 - DNA, 1248 bp, Artificial Sequence
  Description of Artificial Sequence: Synthetic coding sequence
atgcccaccacaattgagagagagttcgaagaacttgatactcaaagacggtggcagcctctgtacttagagattcggaatgaatctcatgattacccccatagagtagctaagttccccgagaaccggaatcgaaaccggtatcgcgacgtatccccgtatgaccatagccgcgtaaaactccagaacgccgagaacgactacattaacgcgtcattggttgacatcgaagaggcccagcggtcttacatactcacacagggtccactgcccaatacctgctgccacttttggctgatggtgtggcaacagaagacaaaagctgtcgtcatgctgaaccgcattgttgagaaagaatctgtcaagtgtgcccagtattggccaaccgatgaccaagaaatgctgtttaaggagacagggtttagtgtgaagctgctgtccgaagatgtgaagtcctactataccgtccacctgctgcagttggagaatatcaatagtggggaaacaaggactatcagtcacttccactacactacctggcctgactttggcgtccctgaatcacctgcttcattcctgaacttcctgttcaaagtgagagaaagtggaagtctgaaccccgatcacggacctgcggtaattcattgtagtgcaggcattggtagatctggcaccttcagcctggtggatacatgcctggtcctgatggagaagggcgatgacatcaatatcaagcaggtcttactgaacatgaggaagtatcggatggggcttatccaaaccccagatcagcttagattctcttacatggctataattgagggtgcaaagtgcattaagggagatagctcaatccagaagcgttggaaagagctttccaaggaggatctgtcacctgcatttgaccacagtccaaataaaattatgactgagaagtacaacggtaacagaataggactggaagaagaaaaactgactggagatagatgtacggggttgtcttccaagatgcaggacacgatggaggaaaattccgagtccgcgcttcgcaagaggatcagggaagatagaaaagcaaccacagcccagaaggtccagcaaatgaaacagagactgaacgagaacgagcgaaagcggaagcggtggctctattggcagcccatactcactaaaatgggattcatgagcgtgatactcgttggggcttttgtgggctggacactcttctttcagcagaacgccctttag

SEQ ID NO: 237067 - DNA, 1164 bp, Artificial Sequence
  Description of Artificial Sequence: Synthetic coding sequence
atgccaacaaccatcgaaagggagtttgaagagttagacacccagagacgttggcaaccactgtatcttgaaatacggaacgaaagccatgactacccacatagggtcgctaagtttcctgaaaataggaatcggaataggtaccgggacgtgtctccttacgaccacagtcgggtgaaattgcagaatgccgagaacgactatattaatgcaagcctggtcgatattgaagaggcccagagatcttatattctgacccagggtcctctgcctaacacctgctgccacttttggctgatggtgtggcagcagaaaactaaagctgtagtgatgctgaatagaattgtggagaaagaaagcgtaaagtgcgctcagtattggcccacggatgaccaggaaatgctgtttaaggagaccgggttctcagttaagttgttgagtgaagacgtcaaatcctattatactgttcatctgctccagcttgagaatattaactctggtgagacccgtacaatctcccactttcattacactacatggccagattttggcgtgccagaaagccccgcatctttcttgaattttctcttcaaagtgagagagagcggttccctaaatcccgatcacggtcctgccgtgattcattgttcagccggaatcggcagaagcggcacatttagtctggttgacacctgcttggtgctcatggaaaagggagacgatatcaacattaagcaggtactgctgaacatgcggaagtatagaatggggttgattcagaccccagatcagctgaggtttagttacatggctattattgaaggagccaagtgcataaagggagacagttcgattcagaaaaggtggaaagaattaagcaaagaggacctatcgcctgctttcgaccattcccctaacaaaattatgaccgaaaaatacaatgggaatagaattggcttggaagaagaaaagttgaccggcgaccgctgcacaggcctgtcaagcaagatgcaggacacaatggaggagaacagtgagagcgccctccggaagcggattcgggaagaccggaaagcaactactgcccagaaggtgcagcagatgaagcagcgcttaaacgagaacgagcgcaaacgtaaacggccacgactcacagatacctag

SEQ ID NO: 237068 - DNA, 1179 bp, Artificial Sequence
  Description of Artificial Sequence: Synthetic coding sequence
tgccagcaggagttcagaatgtatggaaaggacggcaagggaaccaactggatggaccagggggatatggagtgcaggatgcaagagattgatgaccattcccgagtgaaattacagaacgcagagaacgattatatcaacgcctcccttgttgacattgaggaggcccagcgcagctacatccttacccaaggaccacttccaaacacatgctgtcacttctggctcatggtgtggcaacagaagacaaaggcagttgtgatgctcaacaggattgtggaaaaagagtctgtgaagtgtgcacaatactggccaaccgatgaccaggagatgctattcaaagaaactgggtttagtgtgaagctgctgagcgaagacgttaagtcttattacactgtgcatctacttcaactagaaaacatcaacagcggcgaaactcgcactatctcacatttccattatacgacctggccggatttcggcgttcctgagtcacccgcaagctttctgaacttcctctttaaagtgagggaaagcggttcccttaaccccgaccatgggcctgctgtaatccattgttcagcaggaattggtcgcagcggcaccttctctctcgtcgacacttgtcttgtactgatggagaaaggcgacgacataaacatcaagcaagtcctgttgaatatgcgcaaatacagaatggggctgatccagacgcccgaccagctgcgattctcatacatggctatcattgagggggcaaagtgtattaagggagactccagcatccagaagcggtggaaagagctctccaaggaagatctcagcccagcattcgatcattctccaaacaagataatgacagaaaagtataacggcaatcgtatcggcctggaggaggaaaaattaactggcgatagatgtacaggcctaagctctaagatgcaagataccatggaggaaaattccgaaagcgctcttcgcaaacgtattcgggaagataggaaagccactaccgcgcagaaagtgcagcaaatgaagcaacggttaaacgagaacgagagaaaacggaagcggtggctgtactggcaacccatacttacaaaaatggggttcatgagcgtgattttggtgggtgcctttgtgggctggacccttttttttcagcagaatgccctgtag

SEQ ID NO: 237069 - DNA, 1062 bp, Artificial Sequence
  Description of Artificial Sequence: Synthetic coding sequence
atgccaaccaccattgaacgcgagttcgaggagctggatactcagaggagatggcagcctctgtatttggagatcagaaatgaaagccatgattacccccaccgcgtcgccaagttccccgagaaccggaacaggaaccgataccgcgacgtgtctccatatgaccacagtcgggtgaaactccagaacgcagagaatgactacatcaacgctagcctggtggacattgaggaggcacaaagatcctacatcctcacgcaggggccactgccaaacacttgctgtcatttttggctgatggtgtggcagcagaagaccaaggccgtggtaatgctgaatagaatagttgagaaggaatccgtgaaatgcgcccaatactggcctacagacgaccaggagatgcttttcaaagaaacaggctttagtgtgaagttgctctccgaggacgtgaagtcttactatacggtacacctgctccagctcgagaacattaatagtggagagacacgcacaatctcacactttcattacaccacgtggcccgatttcggtgtgccagagtccccagctagttttcttaatttcctattcaaggtgcgcgagagtggttcattgaatccagatcacggacctgcagtgatccactgttcagcagggataggcaggtccggaactttctcgctggttgatacatgcttggtactaatggagaagggggatgacatcaacattaagcaagttcttcttaatatgaggaagtaccgtatgggcttgatccagactcccgaccaacttagattttcatacatggctattattgaaggcgcaaagtgcattaagggtgacagcagcattcagaaacggtggaaggagctgtctaaggaagacctgtctccagcttttgatcactctcccaataagatcatgaccgagaagtataatggcaaccgtatcgggcttgaggaggaaaagctcaccggggacaggtgtacaggtctgtcctcaaagatgcaggacaccatggaggaaaactcggagaggcccaggctgaccgacacctag

SEQ ID NO: 237070 - DNA, 2424 bp, Artificial Sequence
  Description of Artificial Sequence: Synthetic coding sequence
atggatcagagagagattctccaaaaattcctggatgaggcacagtccaaaaaaattacaaaggaggaattcgctaacgagttccttaagttgaaacggcagtccaccaagtacaaagccgataagacttacccaacaaccgtcgccgaaaagccaaaaaatatcaagaaaaacaggtacaaggatatactaccttacgactactctcgtgtcgagctttccctgataacctctgatgaagacagctcgtacataaatgctaacttcattaaaggagtctatgggccaaaggcgtatatcgctacccagggacccctctccaccacactgttagatttttggcgcatgatctgggagtatagcgtgctgattattgtgatggcctgcatggagtatgagatgggtaagaagaagtgcgagaggtactgggccgaaccaggtgagatgcaactggagtttggaccgttcagtgtttcctgcgaggctgaaaaaagaaagagcgactacattatccgtactctgaaggtgaagttcaattcggagacccgcaccatatatcagttccattacaagaattggccggaccacgacgtgccgtccagcatcgaccctattcttgaacttatctgggatgtgcgctgctaccaggaggacgacagcgtgccgatctgcatacactgtagtgcaggctgcgggaggacaggagtgatatgtgccattgattacacctggatgctgttaaaggacgggattatacctgaaaatttctccgtcttctctctgatcagagaaatgcgcacccagagaccttcgctggttcagacccaggagcaatacgagttggtgtacaacgcagtgctggagctgttcaaacgccagatggatgtgatccgagacaaacactcaggtacagagtcacaggccaagcattgcattcctgagaaaaatcacaccctccaggccgattcatattctcctaatcttccaaagtctactacaaaggcggctaaaatgatgaatcagcaaagaactaagatggaaattaaagagagctcttcatttgacttccgcacgtcggaaatatccgcgaaggaagaactcgtcctgcacccagccaaatcatccacaagcttcgatttcctggaacttaactacagcttcgataaaaacgctgatactactatgaaatggcaaactaaggccttccccatagttggagagcctcttcagaagcaccaaagcctagaccttgggagtctactctttgaggggtgttctaactccaagcccgtgaacgctgcagggagatacttcaatagtaaagtccccatcacccgcacaaagagcacgccttttgaactcatccagcagagagagaccaaagaggtggatagcaaggaaaacttttcctatctggaaagtcagcctcacgattcctgtttcgtagagatgcaggcccaaaaagtgatgcacgtgtctagtgccgaattaaattactccctcccatacgacagtaaacatcagatcagaaatgctagtaatgtaaagcatcatgactcctccgccttgggtgtttactcctacatacccctggtggaaaacccatattttagctcttggcctccgtcgggaacaagttcaaagatgtccctggacctcccagagaagcaggatggcaccgtcttccccagttcactgctgcccacttcatctacatctttattcagctactacaactcccacgacagcctgagcctcaatagcccaaccaacatttcttctttactgaatcaggagtccgccgtgttggccactgccccacggattgacgatgaaatccccccaccactgccagtgtggacaccggagagtttcatagtagtggaagaggctggagagttttcccctaacgtgccaaaatcgttaagtagtgctgtcaaagtcaaaattggcacctctctagaatggggtggcaccagtgaacctaagaagtttgacgattcagtcatcctcagaccatcaaagagtgtgaaactgaggtcaccaaaatccgagttacaccaagataggtcctcgccgccacctccacttcctgagcgaacccttgaatcattcttcctggccgacgaagattgtatgcaggcacagagcattgagacttactcaacgtcttacccagacacaatggagaactctactagctccaagcaaacactcaagacccccggaaagagttttactcgatctaagtctttgaagattttgcgaaacatgaaaaaaagtatttgcaacagctgtccccctaataagcccgcagaatccgtccagtcaaataacagctcaagctttttgaattttggatttgcaaaccgtttttcaaaaccaaaaggaccacggaatccccctcccacttggaatatctag

SEQ ID NO: 237071 - DNA, 1692 bp, Artificial Sequence
  Description of Artificial Sequence: Synthetic coding sequence
atgttgttaaaggacggcatcatacccgagaacttctctgtattcagtctgatccgcgagatgaggacccagcggcctagtctcgtgcagactcaagaacaatatgagctcgtgtataatgctgttcttgagctttttaaacgacagatggacgtgatcagagacaagcactcgggaacggaatcacaagcaaaacactgtatccccgagaaaaatcacactcttcaagcggactcctactcccctaatttgcccaaatccactacgaaggcagcaaagatgatgaatcagcagcggacaaagatggagataaaagaatcatcctcctttgacttcagaacatccgagatatctgcaaaagaggagctggtgctccatcctgccaagtccagcacaagcttcgatttcctggagcttaactattcttttgataagaacgcagacactaccatgaagtggcagacgaaagcgtttcctattgtgggcgagcctctccaaaagcatcagtcgttagatcttggatctctgctgttcgaaggatgtagcaattctaagccagttaacgccgctggcaggtacttcaattccaaggtgcccatcaccagaaccaaaagcacccccttcgaactaattcagcagagagagacgaaggaggtcgatagcaaggaaaacttttcatacctggaaagtcaacctcatgatagctgctttgtggagatgcaggctcagaaggtcatgcacgtgtcaagtgctgaactgaactactcccttccctacgatagtaagcatcagattcgcaacgcttcaaatgtaaagcaccacgacagcagcgcgcttggcgtgtactcttacatccctctggtggaaaatccctatttctccagctggcccccatcaggaaccagttccaaaatgagtctagacctacctgaaaaacaagatgggacagtctttccttcctcgctactgccaacaagcagtactagtttgttctcctattacaactcccatgattctctgtcgcttaacagcccaaccaatatcagcagcctacttaaccaggaaagtgccgtgttagcaacagccccaagaatcgatgacgaaataccacctcccctccctgtctggactcccgaaagcttcatcgtggtggaagaggcgggtgaattctccccaaatgtgcctaaatctctgtcttcagccgtcaaggtgaaaattggcacttctttggaatggggaggaacgtccgaacccaaaaaatttgacgactcagtcattttgaggccatccaagagcgtgaagctgcgatctcctaagtcagaactccaccaggatcgctcttcaccgcctccgccactccccgaacggacacttgaatctttctttctggctgatgaggattgcatgcaggcacagtcaattgaaacctatagcacgagctatccggacactatggagaactctacgtcatccaaacagacactaaaaaccccaggaaaatcattcacccgctctaagtctctaaagatcctgcggaacatgaagaaatccatctgtaactcgtgccccccaaacaagcccgctgagtcagtccagagcaacaattcctctagttttctgaacttcggctttgccaatcgtttcagtaagcccaagggcccaaggaatcccccacccacctggaatatttag

SEQ ID NO: 237072 - DNA, 4911 bp, Artificial Sequence
  Description of Artificial Sequence: Synthetic coding sequence
atggaggcagtgcctagaatgcctatgatttggctcgacctaaaggaagcaggagattttcactttcagccggcagtcaagaagttcgtcctcaaaaactacggtgagaaccccgaggcttacaatgaagaactgaaaaagttggagctcttacgtcagaatgccgtcagggtccccagggacttcgaaggatgtagtgtgttgagaaagtatctgggacagctgcactacctccagtctcgggtgcctatggggtcgggccaagaagcggcagtgccggtaacatggactgagatcttttctggtaaatcagtggctcacgaggacatcaaatatgagcaagcttgtatcctgtacaacctgggtgcgttgcactccatgctcggtgccatggacaaacgagtgtctgaagagggcatgaaggttagttgtacccacttccagtgtgctgccggagcattcgcataccttcgtgaacattttcctcaggcctactcagtggatatgagtaggcagatccttactctgaacgtgaatctgatgttgggacaggcacaggagtgcctgctggagaaatccatgctagataaccgaaagtcctttctcgtcgccagaatatcagctcaggtggtcgattattataaagaggcttgccgggcactcgagaatcccgacactgctagccttctgggacggatccaaaaagattggaaaaagttggtgcagatgaagatatattacttcgccgctgtcgcccatctacatatggggaaacaggccgaggaacagcagaaattcggtgagagggtggcttactttcaaagcgctctggataagctcaacgaggccatcaaattagcaaaggggcagcccgataccgtgcaggacgcactgagatttaccatggacgttatcggagggaagtataactctgcaaagaaagataacgactttatttatcatgaggctgttcctgcattggatacactgcagcctgtgaagggcgctcccctcgtcaagcccttgccagttaatcctactgatcccgctgtgactggacctgacatcttcgcgaagttagtgcccatggcagcccacgaagcttcgagcctgtattcagaagaaaaagccaagttgctgagggaaatgatggcaaagatcgaggacaaaaacgaagtcctggatcagttcatggactcaatgcaattagatcctgaaaccgttgacaatctggacgcttactcacacataccaccgcaattgatggaaaagtgcgcagcactatccgtgaggcctgacacagtcagaaatttggtgcagagcatgcaagtgctgagtggggttttcacagacgtcgaagccagtttaaaggatattagggacttgctggaggaggacgaactcctggaacagaagtttcaggaggccgtgggtcaagcaggggcaatatctattacatcaaaggcagaacttgctgaggtcaggcgtgaatgggccaagtacatggaggtccatgaaaaggcctctttcacaaactcagaacttcaccgggcaatgaacctgcacgtgggtaatcttaggctgctttctggaccactggaccaggtgagagctgctctcccaaccccagccctctccccggaggacaaggctgttctgcagaatctcaaacgaatcttagctaaagtgcaagaaatgagagaccagcgtgtcagtctagagcagcaactgcgggagctgatacaaaaggatgatattacagcatccctcgtgactaccgatcactcagagatgaagaagctgttcgaggagcagctcaagaagtacgaccagctaaaggtgtaccttgagcagaatcttgcagcccaagatcgcgttctctgcgctttgacagaagccaacgtgcagtatgccgctgtgcggcgtgtgttatctgaccttgaccagaagtggaactcaacactgcagactctagtggcaagctatgaggcctacgaggacctgatgaagaagagccaagagggccgagacttttacgccgatctggagtctaaggttgccgctctcctggaaaggacacagtccacatgtcaggcgagagaagcagccagacagcagcttctggacagggaactgaagaaaaagccccctccaagaccaactgccccaaaaccactgctccctaggcgggaggaatccgaagctgtggaagctggggaccctccagaggaactgcgttcccttccacctgacatggtcgcaggccctcgccttcccgacacatttctgggcagtgctacccccctgcactttccgcctagcccctttccgtcctcgaccgggccaggaccccattaccttagtgggcctctgcctcctggcacctacagtggccctactcagcttatccagcccagggccccaggaccacacgccatgcccgtcgccccaggtccagccctataccccgcaccagcgtatacacccgagcttggcctggtacctcggtccagccctcagcatggggtggtgagctctccttacgtgggggtgggacctgccccaccagtcgctgggctcccctctgcccctccgccacagttttctggacccgagctggctatggccgtcagacccgcaacaacgaccgtagactccattcaagccccaatcccaagtcatacagcacctagaccaaatcctacaccagctcctcctcccccatgctttccagtgccgcctccacagcctctacctacgccttacacgtacccagccggtgcaaagcagcctataccagcacagcatcacttcagttctggaattcccgctggatttcctgcccctagaattggacctcagccccagcctcacccgcagccccacccaagccaggcctttggcccacagcctccccagcagccgcttccactccagcaccctcatctgttcccccctcaggcgccaggactgttgccgccacagtctccttacccgtacgctccgcagccaggggtcctcgggcagccacctccaccactccatactcaactttaccccggtccggctcaggacccgctgcctgcccattccggagccctgcctttccccagccctgggccaccacagcccccacacccaccactggcctatggtccagcgccatccactcggccaatgggaccacaagccgctccactgacgattcgcggaccgtctagcgctggtcagagcacacctagcccccatttagtgccatctccggcaccgagcccgggtccgggtccagtaccaccacgaccccctgcggcagagccgccaccatgcctgagacgtggcgctgccgcagccgatctgctgagtagttctcccgaatcccagcacggagggacccagtctcccggtgggggacagcctctgctacagccaacaaaggtggacgcagctgaggggagaagacctcaggctttacgtctaattgagcgagacccttatgagcatcccgaaagactacgtcagctccagcaggagctagaggcttttcggggtcagctgggtgacgtaggtgccctcgacaccgtttggagagagctacaggacgcgcaggaacacgacgcaagaggcagaagcatagccatcgctcgatgttattcccttaagaataggcatcaggatgtcatgccctacgattccaatcgggtagtactaaggtccggcaaagatgattacataaacgccagttgcgtcgaagggctgagcccatactgtcctccactcgtggccacacaggccccactgccgggaacagcagctgatttctggctgatggtccacgagcagaaagtgagtgtcatcgtgatgttagtgagcgaagccgaaatggagaagcaaaaggtcgcacgttactttcctaccgagagaggccagcccatggtgcacggggctctttctttggctctgtcctctgtacggtccactgaaactcacgtcgagcgggtcctaagcttgcagttcagggatcagtccctcaagaggagtttggtccatctgcacttccccacctggcccgagttaggactgccagacagtccttctaacctgctgagatttatccaggaggtgcacgcacattacctgcatcaaaggcctcttcacacaccgataatagtccactgctcatcgggtgttggtcggactggagcatttgctctgctgtacgccgctgtccaagaggtcgaggccggtaatggaatcccagagctaccgcagcttgtgaggcggatgagacagcagcggaaacatatgctccaggagaagcttcacctgcgattctgctatgaagctgtggtgagacatgtagaacaggttctgcagcggcatggtgtccctcccccatgtaaacctctggcatcagcttcgataagtcagaagaatcatttgccccaggacagccaggacctcgtgctcggcggtgatgtgccaatcagctcgatccaggctactatagcaaagctgtccatccggcctccaggcggactggaaagccctgttgctagccttcctggacccgctgagccgcctggcctcccacccgcttccctgccagagagcactccgataccctccagctcgccacctcctttgagtagccccctccccgaggctccacagcccaaagaagaacccccagttcctgaagccccaagcagcgggcctccttctagctctctcgagctactggcttctctgacgcctgaagccttctcccttgattcgagccttaggggtaaacagcggatgagtaagcacaattttcttcaggctcacaacgggcagggacttagggctactcgccctagtgacgacccccttagtctgctcgatcctctctggacactgaataagacttag

SEQ ID NO: 237073 - DNA, 2739 bp, Artificial Sequence
  Description of Artificial Sequence: Synthetic coding sequence
atggaggccgtccccaggatgcctatgatatggcttgatctcaaggaggcgggagacttccactttcaaccagccgtcaagaaaaatgccgtgagggtacccagagactttgaaggctgtagcgttctcagaaagtatctggggcagcttcactaccttcagtctcgggtgccaatgggctcagggcaggaggccgcagtccctgtgacctggactgaaatttttagcgggaaaagcgttgctcatgaggacatcaagtatgagcaggcctgtatcttatacaaccttggggcactgcacagcatgctgggggcaatggacaagagggtgtcagaagagtgtgccgcaggggcttttgcatacctgagggagcactttccccaggcctactcagtcgacatgagccggcagatcttgactctcaacgtcaacctgatgttagggcaggcccaagaatgccttctggagaagagcatgctggacaatcgtaagagctttctggtggccagaatatctgcccaggtggtagattattataaggaggcctgccgggctctggagaaccctgacaccgcatccctgctcgggaggattcagaaagattggaaaaaattagtacagatgaagatttattatttcgcggcagtcgctcatctgcatatgggcaaacaggccgaagaacagcagaaatttggggagagggtcgcatactttcagtctgctctcgacaagctgaatgaggctatcaagctggcaaaggggcagcccgatacggttcaggacgctctgcgctttactatggatgtcatcggcggaaaatataattctgcaaaaaaagataatgactttatatatcatgaagctgtacctgccctggatacgctccagcctgtcaagggcgcaccccttgtgaagcccctgcctgttaaccccacagacccagccgtgaccggcccagacatctttgccaaactggtgcctatggcagctcacgaagcatcaagcctgtactctgaagaaaaggccaagcttcttagagaaatgatggccaagattgaagacaagaatgaagtgttggatcagtttatggactccatgcagcttgaccctgaaactgtcgataatttagatgcctactcacacatcccaccccaattaatggagaagtgcgccgcattgtccgtcaggcctgacacagttagaaatcttgtgcagagcatgcaagtgctgtctggagttttcacagatgtggaggccagtcttaaggatatcagggacttactggaagaagacgagctactggaacagaaatttcaggaggctgtaggacaggccggtgcaatcagcatcacgtccaaggctgagctagctgaagtccgcagagagtgggctaaatatatggaggtgcatgagaaagcgagctttactaacagcgaactgcacagagcaatgaatcttcatgtgggtaatctgaggctgctatccgggcctttggatcaggtgagggctgccctccctactcctgcgctgtctccagaagacaaagctgtactgcaaaatctcaaaaggattctggcgaaagtgcaggaaatgcgggatcaacgtgtctcactagaacaacagctgagggaactgattcagaaagacgacatcacagcctctttggtcaccactgaccacagcgagatgaagaagctgtttgaagagcagcttaaaaaatatgaccagctcaaagtataccttgagcagaacctggccgctcaagaccgcgtgctctgcgccctcactgaagctaatgttcagtacgctgcagtcagacgcgtactgagtgacttggatcagaagtggaacagcactcttcagacccttgtagcgagctacgaggcatatgaggatctcatgaagaaatctcaggaggggagggacttctacgcagacttggaaagtaaggtggcggctctcctggaacgcacccagagcacatgccaggcccgagaggctgccaggcagcagttactcgaccgagaactgaagaagaagccgcctccccgtccaacagcacccaaaccattgttgcctcggagagaggagagcgaggccgtggaagccggtgatcccccagaggagctgcggagtcttccgccagatatggtcgcgggaccaagactgcccgacacctttcttggtagcgcaactcccctgcatttcccacccagccccttcccaagctctacaggccctggaccccattacctctctggccctcttccgcctgggacttactctggcccaacacaattgattcagccacgcgctcccggtccacatgcaatgccggtcgccccaggccctgcgctttaccctgcacccagctctgcgccatccttcacctcagtttgggccagcgcacctaccgcagcgccaagtacccccgcttccaccagcttgcccactccagggcctagaaccccaactccaacaattccattaccactctgcccttctgcatggggcccaggcgctgccgctacacctccaacccatccagctctccccagatcaaggagcagaccttcagcctcccctctccgtggcagtgcttttcctcagccgtgggccccttccgcatccccctcacctacggggatttggagctgtcctttttaccaaacccatggacccccaggtagcccttcatatcactcccgagcattggtttgctggcctgttcatccttag

SEQ ID NO: 237074 - DNA, 1698 bp, Artificial Sequence
  Description of Artificial Sequence: Synthetic coding sequence
atgaattacgaaggcgcacggtctgagcgagagaaccacgctgctgatgacagcgaggggggtgcccttgacatgtgctgctctgagcgcttgccaggcctgccccagccaattgtcatggaagccctcgatgaggccgagggactccaggactcgcagcgggagatgcctcccccaccgccaccgtccccaccatccgatccagcacagaaaccacctcccaggggcgctggctcccattccctgaccgtcaggagctctttgtgtctattcgccgcttcccagtttctgctcgcatgtggcgttctgtggttctctgggtacgggcacatctggtcccagaacgcaactaacctggtgtcttccctgctcacactgttgaaacagctcgagccaacagcatggctggactcaggaacttggggagtacctagtttgttgttagtcttcttaagcgtcggtttagtcctggtgactaccctggtatggcacctcctgcggacccctccagagccacccactcccttgccccctgaagaccggcgacaaagcgttagccggcagccgtccttcacatactcagagtggatggaggagaagatcgaggatgatttcttagacttggatcctgtccctgaaacacccgtgttcgactgtgtaatggatatcaaacccgaggcagatcccactagtttaaccgttaagagcatgggtctgcaggaaaggcgtggatcaaatgtgtccctgacgctggacatgtgcacacccggatgcaacgaagagggctttggctacttgatgtccccaagagaagagagtgcacgagagtatctcctctctgcaagcagagtactgcaggcagaggagctacacgagaaagccctggatccatttctgttacaggctgagttcttcgaaatacctatgaactttgttgatcctaaagaatatgatataccgggactggtccggaaaaatagatataaaacaatcctgccgaacccgcacagcagagtgtgcctgacaagccctgacccagacgatccattgagctcttatataaatgcaaattatattagaggatatggcggagaggaaaaggtgtacattgcaactcaggggcctatcgtgagcactgtggcagatttttggcggatggtctggcaggagcacaccccaatcatcgttatgatcacgaacattgaggagatgaatgagaagtgtactgagtactggcctgaggaacaagtagcatacgacggagtcgagatcactgtccagaaagtgatccatactgaggactacaggctgagactaatcagccttaagtcaggtacggaggagcgcggtcttaaacattattggttcacatcctggccagatcagaagacgccagatagagcgcctccactgcttcatttggtgagggaggtggaagaggccgcacagcaagaaggccctcactgtgctccgattatcgtgcactgttccgcgggaattggtagaaccgggtgcttcattgctacgtcaatctgttgccaacagctgaggcaagaaggagttgtggacatattaaaaaccacttgccagctcaggcaggaccgtgggggaatgattcaaacctgcgaacaatatcaattcgtccatcatgtgatgtcattatatgagaaacagttaagccaccagtcccctgagtag

SEQ ID NO: 237075 - DNA, 1602 bp, Artificial Sequence
  Description of Artificial Sequence: Synthetic coding sequence
atgaactacgaaggcgctcgatcagagcgggagaatcatgccgcagacgacagcgaaggcggagccctagatatgtgttgtagtgagagactgcctggtctgcctcagcccatcgtgatggaggccctggacgaagctgagggattgcaggactcccagagagaaatgccgcctcctcccccacccagtccaccgagcgacccagcccagaaacctccgccaaggggcgctggcagccattctctcacggtccgcagttcactgtgcctgtttgcggcttcgcagtttctgctggaaccaacggcctggctggactcaggaacttggggcgtgccttccttattgcttgtgttcctgtcggtgggtttggttctggtaactactcttgtgtggcatctgctcaggactccgcctgagccccctactcctttgccgccagaagatcgacggcaatctgttagccgacaaccatcctttacatactccgaatggatggaagaaaaaattgaggacgattttctggacctggatcccgtacctgaaacacctgtgttcgattgcgtgatggatatcaaaccagaagccgaccccaccagcctaacagtcaaatccatgggactccaggagcgccgaggttccaacgtgtcactgactctggacatgtgcacccccggttgcaatgaggagggcttcggatacctcatgtccccaagggaggaatctgctcgggaatacctcctgtccgcctcgcgtgtcctgcaggcagaggagctccatgaaaaggcactggaccctttccttctacaggctgaattttttgagattcccatgaattttgtggaccctaaggagtatgatatccccggactcgtccgcaagaatcgatacaaaacaattctgcccaatccacactctcgggtgtgcttaaccagtcccgaccccgacgatccattatctagctacatcaacgctaattatatccgcggatacggcggagaggaaaaagtctatatcgctactcagggtcccatcgtcagtaccgttgcagatttctggaggatggtatggcaggagcatacacctattatcgtgatgatcacaaacatagaggagatgaatgagaaatgtaccgagtattggcccgaagagcaagtcgcctatgatggtgtggaaattaccgttcaaaaggtgattcacaccgaggactataggcttagactaatttccctcaagtcagggactgaagagcgtggactcaagcattattggtttacctcatggcccgaccagaagacaccggatagggcaccaccgttactacatctggtgcgagaggtggaggaggccgcacagcaggaaggccctcattgtgcacccatcatcgtgcactgctctgcaggtattgggagaaccggatgtttcattgccacctccatttgttgtcaacagctccggcaggaaggcgtggtggacattttgaaaacaacgtgccaacttaggcaagatcgtggcggaatgatccagacctgtgaacagtatcaatttgtgcatcatgtcatgagtctgtatgagaagcagctaagtcaccagtccccggaatag

SEQ ID NO: 237076 - DNA, 1698 bp, Artificial Sequence
  Description of Artificial Sequence: Synthetic coding sequence
atgaactacgaaggagctaggtctgagcgagagaaccacgctgccgacgatagtgagggcggtgctcttgacatgtgctgcagcgagagactaccaggcctgcctcagcctatcgtgatggaggccctggacgaggcagaaggactccaagatagtcagcgggagatgccccctccacctcccccatcccccccatctgaccccgcacagaagccccctcctaggggtgcaggcagccactcattgacggtgcggtctagcctgtgcctgttcgctgcctctcagtttctgctggcatgcggtgtgttgtggttctccggctacggacatatttggagtcagaatgctaccaatctcgtgtcgtccctcctgacgctgctgaaacagcttgaacctactgcctggcttgactcagggacgtggggggtgcctagtctgctgcttgtgtttctgagtgtgggcctcgttcttgtcactacactggtctggcacttactcaggactcctccagaacccccaaccccactacctccggaggaccgcagacagtccgtttctcgccagccaagtttcacgtacagcgagtggatggaggaaaagattgaggatgactttctcgacttggatcctgtaccagagactccagttttcgactgtgttatggacatcaaacccgaagccgaccctacgagtctgacagtgaagtcgatgggcttacaggaaagaagaggcagcaatgtcagtctgacgctcgatatgtgcaccccaggctgtaatgaggagggttttggatatcttatgtctccacgtgaagagagcgcgcgtgaatatttgctgtctgccagccgggtgctacaggccgaagaactgcatgagaaagccctggatccatttttactgcaagccgaattctttgaaattccgatgaacttcgttgaccccaaagaatacgatattcccggactcgtgcgcaagaacagatataagactatcttgccaaatcctcatagtagagtgtgtttgacttcccccgacccagacgaccctctctcgagttatatcaatgcaaactacatcaggggatatggcggagaggaaaaagtgtacatagcaacccagggcccaatcgtgtccaccgtggctgatttctggagaatggtctggcaagaacatacccctattatagtcatgattaccaacatcgaggaaatgaacgaaaaatgtaccgaatattggcccgaggagcaggttgcatatgatggcgtggagatcaccgtgcaaaaagtgatacataccgaagactacagactgaggctgatctctttgaagagcggcacagaagaaagagggcttaaacattactggttcactagttggcccgaccaaaaaacacccgatcgcgctccacccctcctgcacctagttcgagaagttgaagaagcagctcaacaggaagggcctcattgcgcccctattatcgtacactgtagtgcagggatcggacggaccggatgtttcatcgctacgagcatttgctgtcagcagctccgacaggaaggagttgtcgacatcctgaaaacgacgtgtcagctgcgtcaggaccgcggaggtatgatacagacatgtgagcaataccagttcgtccaccacgtgatgagcctctatgagaagcaactgtcccatcagtctccagagtag

SEQ ID NO: 237077 - DNA, 1788 bp, Artificial Sequence
  Description of Artificial Sequence: Synthetic coding sequence
atggtacggtggtttcatcgtgacctgtcgggcttagatgccgagaccttactgaaaggcagaggtgttcacggtagctttctggctaggccaagccggaaaaatcaaggggacttttccctctcagttcgcgtgggagatcaggtgacccacatcagaatccagaattcaggggacttctacgatttatacgggggagaaaagttcgcgactttaaccgaactcgtggagtattacactcagcagcagggcgtcctgcaggaccgcgacggaactatcatccaccttaagtatccactgaactgttctgaccctactagtgaacgatggtaccacggacacatgtctggaggacaggcagaaacactcctgcaagctaaaggagaaccctggacattccttgtccgtgagagcctgtcccagcccggagattttgttctttctgtcctatcggaccaacctaaggcagggccaggctctccgctgcgggttacccacatcaaggttatgtgtgagggcggtagatataccgtgggcggtcttgaaactttcgacagcctcaccgacttggtggagcactttaagaaaaccggcatagaagaggcctcaggcgctttcgtctacctgcgacaaccatactacgcgacacgtgttaatgccgcagacattgaaaaccgggtactcgaattgaacaagaagcaggagagtgaggatacagccaaggctggcttctgggaggaatttgaatcactccagaagcaggaagtaaaaaacctgcatcaacgactagaaggccagcgccctgagaataagggaaagaaccgctacaagaatatcctgccctttgaccattctcgggttatcctacaggggagggattcaaatatcccgggatctgactacatcaacgccaactacattaagaaccagttgctagggccagacgaaaatgcaaaaacgtatatcgcttcacaggggtgtctggaagctaccgtcaacgatttctggcaaatggcctggcaggagaattctcgcgttattgtgatgaccacccgggaagttgagaagggcagaaacaaatgtgtgccatactggcccgaggtcggaatgcagagggcttatgggccatatagcgtgaccaactgcggagagcacgacactactgagtacaaacttcgtacactccaagtgagtcccctggacaatggtgacctgattagggagatttggcattaccagtatttgtcctggccagaccacggggtcccctcagagcccggtggtgtgctgagcttcctcgatcagatcaaccaacggcaggagagtctgcctcacgcaggtcccattatagtccattgctccgctgggattgggaggacaggaaccattattgtgattgatatgttgatggagaatattagtaccaaaggacttgactgcgacatagatattcagaagacaatccagatggtccgcgcacaaaggagtggcatggtgcagaccgaagcccaatacaaatttatttacgtagctatagcccagtttatagagacaacgaagaaaaagctcgaagtgctacagagccagaaaggccaagagtccgaatacggaaatataacttatccgccagcaatgaaaaacgcccatgccaaagcttccagaacctctagcaaacacaaggaggatgtttacgagaatctgcacaccaaaaataagagagaggagaaggtgaagaagcaacggtccgctgataaggagaaatctaaggggagcctaaaacgaaagtag

SEQ ID NO: 237078 - DNA, 1794 bp, Artificial Sequence
  Description of Artificial Sequence: Synthetic coding sequence
atgctctcccgaggatggtttcacagggatctgagtggcctggacgccgagacgctcttgaagggccgaggggtgcacggatcattcctcgcacgaccatccagaaagaaccagggcgacttcagtttgtctgtgcgggtgggtgatcaggttacccacatccggattcagaattcaggcgatttttatgacctctacggcggagagaaattcgccaccttgaccgaactggtcgaatactatacccaacaacaaggagtcctgcaggaccgcgacgggaccatcattcatctaaagtatcccctgaattgctcagacccaacttctgagcgctggtatcacggtcacatgtcgggcggtcaggccgagacgttgctgcaggctaagggcgaaccatggacttttctcgtgcgggaaagcctgagtcagccaggcgacttcgtgctcagcgtgctttcagatcaacctaaagccggtccaggctctcccctgagggtgacccacatcaaggtcatgtgtgaaggcggtagatacacggtgggcggtttggagacgttcgacagcctcacggaccttgtggagcattttaagaaaaccggtatcgaggaggcctccggcgcttttgtgtatctgaggcagccctactacgccacacgggtgaatgccgcagatatcgagaatcgggtgttggaattgaacaaaaaacaggaatcagaagatacggccaaggccggtttttgggaagagttcgagagcctgcagaaacaagaggttaagaaccttcaccaacgccttgagggacagagacctgagaataaaggtaaaaacagatataagaacatccttccttttgaccactcgcgagtgatcctgcaggggcgagattctaacatcccaggttctgactatatcaatgcaaactacatcaaaaaccagctgctgggcccagatgagaatgccaaaacatacattgcctcccagggctgccttgaagctacagttaacgacttctggcagatggcctggcaggaaaactctagggtcatagtcatgaccactagggaagttgagaaggggcgaaataagtgcgtaccttactggccggaggtgggtatgcagagagcctacgggccttacagtgtgacgaattgtggcgaacacgacacgacagagtacaaactccggactctgcaagtgtccccacttgacaatggcgacctgatccgcgagatatggcattaccagtacttgtcctggccggatcacggcgtgccttcagaaccaggtggcgttctgtcattcttggaccagattaatcaacggcaagagagccttccacatgccggtccaattatcgtgcactgtagtgctgggattgggaggacaggcaccatcatcgtgatcgatatgttgatggagaacataagtacaaagggtctcgattgcgacatcgacatccaaaagaccattcagatggtaagggctcagcgatcaggcatggtgcagactgaggcgcaatacaaattcatctacgtggccatcgcccaattcattgaaactactaaaaagaagctagaagtcttgcagagccagaaaggacaggagtccgaatacggtaatataacgtatccaccagccatgaagaacgcgcatgctaaggcttcaagaacatcaagcaagcataaggaagacgtatacgaaaacctccacaccaagaacaagcgggaagaaaaagtcaagaaacagcgctcggccgataaggagaagtcaaaaggatccctgaaacgaaagtag

SEQ ID NO: 237079 - DNA, 1671 bp, Artificial Sequence
  Description of Artificial Sequence: Synthetic coding sequence
atgctctcccgcggtgtgggggatcaagtcacacatattagaatacagaatagtggcgatttttatgatctgtacgggggagagaagtttgccacgctcacagagctggtggaatactacacccaacagcaaggcgtcctgcaggatagggatgggaccataattcaccttaaatatcccctgaattgctctgaccccacatctgagaggtggtaccatgggcacatgtcaggtggtcaggccgagactttgctacaggcgaagggcgagccatggacctttctggtgagggagtctttatcacagccgggagactttgttctgtcagtgctcagcgatcagccaaaagccggacctggaagtccactgcgggtcacacatataaaggttatgtgcgagggcggtcgctacactgttggtggccttgagacatttgatagcctaacagatctcgtcgagcactttaagaaaactggcatcgaagaagccagcggagcgtttgtgtacttacggcaaccatattatgccactcgcgtgaacgccgctgatatcgaaaatcgcgtcctggagttaaataagaagcaggagtccgaggatactgccaaggcgggattctgggaagagttcgagtcccttcagaaacaagaggtcaaaaatctccaccagcgcctcgaaggtcagcgccctgagaacaagggcaagaataggtacaagaatatcttgcctttcgaccactctagggtgatcctgcagggtagagactctaatataccaggcagcgactatataaacgcaaactacattaaaaatcagctcctcggaccagatgaaaacgctaagacctacatagcctcccagggatgcctcgaggccactgtcaatgacttctggcagatggcttggcaggagaattcacgggtgatcgtaatgactaccagagaagtggagaagggaagaaacaagtgcgtgccctattggccagaagttggcatgcaaagggcctatggcccatatagcgttacaaattgtggtgagcacgacaccaccgagtacaagctgcgcactctgcaagtgagtccactcgacaacggcgatcttattcgtgagatctggcattatcagtacctctcttggcctgatcacggtgttcctagtgaacctggaggggtgctatcgtttctcgaccagattaatcagcgccaggagagtctaccccacgccggaccaataatagtccactgcagcgccggaatcggaaggacaggtaccataatagtcatcgacatgctgatggagaatattagtactaagggtctcgactgtgacatcgacatccaaaagacaatccagatggtgcgcgctcagaggtcaggaatggtccaaacagaggcccaatacaaattcatttatgtcgcaattgcccagttcatcgaaacaaccaaaaagaaactcgaagttctacaatctcaaaagggacaagagagtgaatacggcaacattacctaccccccagcgatgaagaacgcgcacgctaaggcctctagaacatctagcaagcacaaagaggacgtgtacgagaatctgcacacgaaaaacaaacgggaagaaaaggtgaaaaaacaacgttccgccgataaggagaagagcaaagggtctctgaagcggaaatag

SEQ ID NO: 237080 - DNA, 1875 bp, Artificial Sequence
  Description of Artificial Sequence: Synthetic coding sequence
atggtccgctggttccatcgagatctaagtgggttagacgcagagacactgctgaaagggaggggcgtgcatgggtcctttctcgctcggccatcaaggaaaaaccagggagacttttccctctcggttcgggtgggcgaccaagtgacacatatccggatccaaaattcaggcgatttctatgatctgtatggaggagagaagttcgctacgctcactgagcttgttgagtattatactcagcagcagggggtactccaggatagagatggtactatcatccacttgaaatatcctctcaactgcagcgatccaacatcagagagatggtaccacgggcacatgtcagggggtcaggctgagacccttctccaggcgaaaggggagccttggacattcctcgtgcgggaaagcctgagccagcctggagactttgttctgtccgttctgtccgatcagcccaaggccggaccaggcagccccttacgagtgacccacatcaaggtaatgtgtgagggcggacggtacaccgttggagggcttgagacattcgacagccttaccgacctggtggagcattttaagaagaccggcattgaagaagctagcggtgcttttgtttacctgcgacagccgtactacgccactcgggtcaacgctgcggacatcgaaaatagggtgctggagctgaacaagaagcaggaatcagaagacaccgctaaggcgggattctgggaagaattcgagagtctacagaaacaggaggtcaaaaatttgcatcagcggttggagggtcagaggcccgaaaataagggaaaaaatcgatataagaatatcctgccattcgatcattcacgcgtaattcttcaaggcagggatagcaacatccctggctcagactatatcaacgccaattacatcaaaaaccagctcctaggaccagacgaaaacgcgaagacttatattgcatctcaagggtgcctcgaggcaaccgtgaatgacttctggcaaatggcctggcaggagaattctcgcgtaatagtcatgacaaccagggaggtggagaaagggcgaaacaagtgcgtgccctactggcctgaggtgggcatgcagagagcctacggaccgtattccgtgaccaattgtggtgaacacgataccactgagtacaagctacggacgctgcaggtcagcccgctcgacaatggcgacctgattagggagatatggcactatcaatatctgtcctggccggaccacggcgtgcctagtgagcccggaggtgtccttagctttttggatcagatcaaccagagacaagaaagccttccccacgcaggccctattatcgtccactgtagtgcgggtattgggaggaccggaacaatcatcgtcatagatatgcttatggagaacatctcaaccaaaggacttgactgtgacatcgacatccagaagacaatccaaatggtacgcgctcagcggagcggaatggttcaaacagaggcccagtacaagtttatatatgtcgccatcgcgcagttcattgagaccactaaaaagaagttagaggtgctccaaagtcagaaggggcaggagagtgagtacggcaatatcacatatccacctgccatgaagaacgctcacgccaaagcttcccgaactagcagcaaatcgcttgagtcatcggccggtaccgtggccgctagtcctgtcaggcgcggtggacagagagggctgcctgtgccgggaccacccgtgctttccccagaccttcatcagctgcctgttctggcaccactgcaccctgccgctgatacccgtcgaatgtgcatgagaacttgtacattaagaactagagggagacgtaaatag

SEQ ID NO: 237081 - DNA, 1083 bp, Artificial Sequence
  Description of Artificial Sequence: Synthetic coding sequence
atggtgcaagcccacggtggacgaagccgagctcagccactcaccctaagtctaggagccgctatgacacaaccaccaccggagaaaacacccgcaaagaaacacgtgaggcttcaggaacggcgaggtagcaacgttgccctgatgctcgatgttcgttcattgggcgcagtcgagcctatctgttctgtgaatacgccacgggaagtaactctgcacttcctcagaacagccggtcatccactgactcggtgggccctgcaacggcagcccccatctcctaagcagttggaagaggagtttctgaaaatcccttctaatttcgtaagtcctgaagatttagatataccaggccacgcatcaaaggacaggtacaagacgatattgcctaacccacaaagcagagtgtgccttggaagagcccaaagtcaggaagacggcgattatatcaatgcgaactacatccggggttacgatgggaaagaaaaagtgtacatagccacccagggacctatgcctaacacagtgagtgacttctgggagatggtttggcaggaagaggtatctctgatcgtgatgttaacacaactgcgcgaagggaaagagaagtgcgttcactattggcccactgaggaggagacttacggaccatttcagatccgcattcaggacatgaaggagtgcccagaatacactgtcaggcagctcacgattcaatatcaggaggaaagaaggtccgtgaagcatattttgttctcagcatggccagaccaccagaccccagagagcgctggcccactgctccggctggttgctgaggtggaggagagtcctgaaacagctgcccatccaggcccaattgtcgtccattgcagcgctgggatcgggaggaccggctgctttatagccacccggattggatgtcagcagctgaaggcccgaggtgaagtggacatcctggggatagtttgtcagttgagattggacagggggggaatgatccagacggcggagcagtatcagttccttcaccacactcttgccctttacgcaggccaactgcctgaggaacctagtccctag

SEQ ID NO: 237082 - DNA, 1398 bp, Artificial Sequence
  Description of Artificial Sequence: Synthetic coding sequence
atggtcggaaaagcttggcctctgactcatagtcagggaacaggcccttgggccccagaaggtcatagaagggaagctgccgatccctggtggcagcggcagcaagcgcaggagggacggatgcaactgggctgtgcatgggtggcagcacggcgaggcggtgggcgaaagctggcttcttggtcccttctgagtccccagaggcagaccgatagacagactgatagttggcaagaggcagcatgggggcctcagctcctgcaacagacaagttggttatctgaaccaccacttgggccagctccgcatctgagtatggtgcaggcacatgggggaaggagtcgagcccagccactcacattgagcctcggggcagccatgacccagcctccccctgagaagacccctgcaaaaaagcacgtgcgactgcaggaacggaggggaagtaatgttgctctgatgttggacgtgaggagtttaggagccgtagagccaatttgctctgttaatacacctagagaggtcaccctccattttttgaggacagcaggccatcccttgacccggtgggccctccagaggcagcccccttcacccaaacagctggaagaagagttcctgaaaattccgagtaactttgtgagcccagaagatcttgatatacccggacacgccagcaaagacaggtacaagaccatcctgcccaacccacagtcgcgtgtttgccttggtagggctcaaagccaagaggatggggactacatcaatgcgaactacatacgcggatatgacggcaaggagaaagtatacatcgccacccagggtcctatgccgaacacagtgtctgatttttgggagatggtgtggcaagaggaggtctcattaatcgtgatgctgacccagctgcgcgaaggtaaggaaaagtgtgtgcactactggcctaccgaggaagagacctacggcccattccagataaggatccaggacatgaaagagtgcccagaatataccgtccgacagctgaccatccaataccaggaagagcgccgttccgttaaacatatactatttagcgcatggcccgatcaccagacacctgaatccgccggtccgttattgaggctggtggctgaggtagaggagtcccccgaaacagctgcgcacccgggaccaatcgtcgtgcactgcagcgccggaattggtcgcactggatgtttcattgctacaagaatcggttgccagcaactgaaggcccgtggcgaggtggacatcctgggcatcgtctgtcagctccggctcgaccgtggcggaatgatacagactgcagagcaatatcagtttctgcaccacacactagctctgtacgccggtcagttgcccgaggagcccagcccctag

SEQ ID NO: 237083 - DNA, 1200 bp, Artificial Sequence
  Description of Artificial Sequence: Synthetic coding sequence
atgggcgcttcgttctggccgatcagacaggctagagaacaacagcggcgagccctctcttttagacaaaccagctggctgtccgagccgccattgggtccagccccacacttgtccatggtgcaggcacacggaggcaggtcaagagcacagcctctgactctgtccctcggtgccgcaatgacccagccgcctcccgaaaaaacacctgcaaaaaaacatgtacgtctgcaggagagaaggggttcaaatgtcgctttgatgttggatgtgcgctctctgggcgcagttgaacctatctgcagtgtgaacacccctagggaagtgacactccatttcttacgcactgctggccaccctttgacaagatgggctttgcagcggcagccccctagcccaaagcagctggaggaagaatttctgaagatacccagtaatttcgtgtcgccggaggacctggacattcccggtcacgcctcaaaagaccggtacaagaccatcttacctaaccctcagtcaagggtctgcctgggcagggcccagagtcaggaagatggagactacattaacgccaactacatccgcggttatgacgggaaagagaaagtgtatattgcaacccaaggtcccatgccaaacacagtcagtgacttctgggagatggtgtggcaggaggaggtttcgttgatcgtgatgctgactcaactgcgcgaggggaaggaaaagtgcgtgcactattggccaacagaagaggagacctacgggccatttcagatccgaattcaggacatgaaagaatgtcctgagtacacagtgcgtcagttgaccattcagtaccaggaggaacggaggtctgtgaagcatattttgttttccgcgtggcctgatcatcaaacacccgaaagcgcaggccctctgctgaggctggtcgccgaggtcgaagagtcacccgaaaccgccgctcacccaggtccaatagtggtacattgttccgccggaatcggccgtactggctgcttcattgcaactaggattggttgtcagcagttgaaagccaggggtgaggtcgatatcctcggcatcgtttgccaacttcgactagaccgtgggggtatgattcagaccgcagagcaataccaattcctgcaccacacactggctctttacgcaggtcagctgcccgaggagccatccccatag

SEQ ID NO: 237084 - DNA, 465 bp, Artificial Sequence
  Description of Artificial Sequence: Synthetic coding sequence
atggtccaagcacatgggggaagaagccgagcccagcccttgactctgagcctaggcgctgctatgactcagccccctccagaaaagacccccgctaagaagcatgtgagactccaggaacgcagaggcagcaacgtcgccctgatgctcgacgtgagatcgctaggagccgtggaacctatatgctcagtgaatacgcctcgggaagtgactctgcatttcctgagaaccgcgggacaccctctgactcggtgggcactgcagcgccagcccccttcacccaaacagctggaggaagaattcctgaagatcccatctaattttgtatccccagaggatcttgacattcccggtcatgcctctaaggacagatataagacaatccttccaaaccctcagagtcgcgtctgtttagggcgtgctcagagccaagaggatggagattacattaacgctaactattag

SEQ ID NO: 237085 - DNA, 1326 bp, Artificial Sequence
  Description of Artificial Sequence: Synthetic coding sequence
aaaaggcgtagggctgcaagcatgaaccgcctggggtgttggcctgccagatctctcccaaggagtggcagagggtccggacagagatctctgggactgggcggacacccttctggccctagacaccccggtactccggctgcaaaaaggacttgggagagccccggagtgagggcccgtgactgtcctttgtctactagctggctgtccgaacctcctcttggaccagcaccacatctatctatggtacaagcacacggcggaaggagcagagctcaaccacttactctgagtctcggagctgctatgacccagcccccacctgagaaaacaccagcgaagaaacatgttaggcttcaggaacggagaggcagcaatgtcgctctgatgttggacgttcgatctctgggcgcagtcgagccaatatgctctgttaacacccccagggaagtgaccctgcacttcttaaggaccgccggtcacccactgactagatgggccctccaaagacagcccccatcacctaagcagctcgaagaggaatttctgaagatcccttccaattttgttagtccagaggatctggacatccctggacacgcttcaaaggaccgctataagacaatcctgcccaatcctcagagtcgggtatgcctgggtcgagctcaaagtcaggaggacggcgactatattaacgctaattatattcgcggttacgacggtaaggagaaagtttatattgccacgcagggcccaatgccaaataccgtctcggacttttgggagatggtgtggcaggaagaggtgtctctgatcgtgatgcttacacagcttagagaaggcaaagagaagtgcgtgcactactggcctacagaggaggagacctacggcccatttcaaattaggatccaagacatgaaggaatgtcctgagtatacagtccgacaactcacaattcagtaccaagaggagagaaggagcgtgaagcacattttgtttagcgcctggccagatcaccagacaccagagtctgcagggccactgctacgtctggtggcagaagtcgaggagagcccggagaccgcggctcatcccggaccgattgtggtgcactgcagcgccggaataggccgtacggggtgcttcatagccacccgcattggctgccagcagctgaaagctagaggcgaagttgacattctgggcatcgtgtgccaactgcggcttgacaggggagggatgatacagacggctgaacagtatcagtttctacatcacacgctggcgctgtatgcagggcaattgccggaagaaccatctccctag

SEQ ID NO: 237086 - DNA, 423 bp, Artificial Sequence
  Description of Artificial Sequence: Synthetic coding sequence
atggtacaggcccacggtgggagatcacgagctcagccccttactctctcactgggcgcagccatgacccagccaccccctgagaagacccccgcaaagaagcacgttcgcctgcaggagcggagaggaagtaatgtagcactgatgttagacgtgaggtccttgggggctgtcgaacccatctgttctgtgaacacgcctcgtgaggtaaccttacattttctgcgtactgccggacacccactcacccgctgggctttacagaggcaaccccctagtccaaaacaacttgaggaggagtttctgaagataccatctaacttcgtgagccccgaggatctcgacatccccggacatgcaagtaaggatcgttacaaaaccatcctgccaaatcctcagagtagagtctgcctcggacgatag

SEQ ID NO: 237087 - DNA, 1083 bp, Artificial Sequence
  Description of Artificial Sequence: Synthetic coding sequence
atggtgcaagcccatggaggcagatcgcgcgcacagcctcttacactgagtctgggtgctgccatgacgcagcctcctccagaaaaaactccggctaagaagcacgtcaggctgcaggagagacggggaagtaacgtggcattgatgctagacgtgcggtctctgggagccgtcgagcccatatgctcggtgaacactcctagggaggtgaccctccatttcctgcggacagccggacacccactcactcgctgggcactgcagcgacagcctcctagcccaaagcaactggaagaggagttcctcaaaattccatcaaattttgtttcccccgaggatttagacattcctggccatgcttccaaggaccgctacaaaacaatactgcctaatccacagtcccgcgtctgcctcggcagggcccagtcacaggaggatggggactacatcaatgctaactacatcaggggctatgacggtaaagagaaggtgtacatcgccacgcaaggccctatgcctaataccgtaagtgacttttgggagatggtctggcaggaagaggtttccctgatcgtcatgctgacacaactgagagagggcaaggaaaaatgtgtccattattggccaactgaagaggagacctatgggccttttcagatccgaatccaggacatgaaagagtgtccagagtacaccgtccgccagcttactattcagtatcaggaggaaaggaggtctgtgaagcacattctcttcagcgcctggcctgatcaccagacacccgaaagcgcagggcctctgctcaggctggtcgccgaagtggaggaaagccccgagactgccgcacacccagggccaatcgtcgtgcactgcagtgccggaataggcagaacaggctgcttcattgccaccaggataggttgccagcagcttaaagcgcgtggggaagtagatatcctaggcattgtgtgtcagctgaggctcgaccggggtggtatgatccagacggctgaacagtatcagtttctgcatcacacattagccctttatgcgggacagcttcctgaggaaccgtccccatag

SEQ ID NO: 237088 - DNA, 570 bp, Artificial Sequence
  Description of Artificial Sequence: Synthetic coding sequence
atgcccaatactgtgtctgacttttgggagatggtctggcaagaggaggtgtctctcatcgtgatgttaactcagctgagggaaggtaaagagaagtgtgtgcattactggcccaccgaggaggaaacatatggacccttccaaattcggattcaggacatgaaggagtgcccggaatacaccgtgagacagctgacaattcagtatcaagaggagcggaggagtgtaaagcacattttgttctctgcatggcccgaccatcagactccggaaagtgctgggccattattaaggttggtggccgaagtcgaggagagccctgaaaccgcagcacatccaggcccaatcgtagtgcactgcagcgcagggatagggagaactggctgctttatcgcgacccggattggctgccaacagctcaaggcacgtggggaagttgacattctgggtattgtatgccaacttcgattagatcggggtgggatgattcagactgctgagcagtatcaattcctgcaccatacccttgcactgtatgcaggacaattaccagaagagccctccccttag

SEQ ID NO: 237089 - DNA, 411 bp, Artificial Sequence
  Description of Artificial Sequence: Synthetic coding sequence
atgaaagagtgtccggaatacaccgtaagacagctgacaattcagtatcaggaggaacgcaggagtgtgaagcacatactgttctctgcatggccagaccaccagacccctgagtctgccggaccactcctgagattggtcgccgaagtggaagagtcgcccgagaccgccgctcaccctggccctatcgtcgtgcattgttcggcgggaattggacggacgggctgcttcattgcaacacggatcggatgccagcagctcaaggcacgcggagaagtggacatcctgggcatcgtctgtcaactcagactggacagggggggaatgatacagactgcagagcagtaccaatttttacaccataccctcgccctctacgccggtcagttaccggaagaacctagcccgtag

SEQ ID NO: 237090 - DNA, 1545 bp, Artificial Sequence
  Description of Artificial Sequence: Synthetic coding sequence
atgtcatctccgatttctaaatcccggtcactcgcggcattcttacagcaattgcgctctccaagacagccaccgcgtctggtcacctccaccgcatacacgagtccacaaccacgtgaggtcccggtttgccccctgacggccggtggcgagacacagaacgctgcagcactgcccggacccactagctggcctctgcttggttcacttttacaaatcctgtggaagggagggcttaaaaaacaacacgataccctagtggaataccacaagaagtatgggaagatattccggatgaagctgggaagttttgagagcgtgcacttaggaagcccttgcctcctggaagccttgtaccgcactgagagcgcctacccgcagcggctcgaaattaaaccgtggaaagcgtatcgtgattatcgcaaagagggatacgggttactgattctagaaggcgaggactggcaacgcgtccggtccgctttccagaagaagctcatgaagcccggtgaggttatgaagcttgataataaaatcaacgaggtcctagcagatttcatgggtcgaatcgacgagctgtgtgacgagagaggccatgtggaggatctgtatagcgagctcaataaatggtcattcgaatccatttgtctggtactttacgaaaaaaggttcggtctattgcagaaaaatgccggagacgaagctgttaacttcattatggccatcaagacaatgatgagcacattcggcagaatgatggtaacacctgtggagctccacaaatccctgaatacaaaggtatggcaggaccatacgctggcgtgggacaccatatttaagtccgtcaaggcttgcattgataaccggctcgagaagtattcccagcagcctagtgctgacttcctttgcgatatttaccaccagaataggctttcgaaaaaagagctttatgccgctgtcacggaactacaactggcggctgtggaaaccaccgctaacagcctcatgtggatcctctataacttgtctagaaatccccaggtccaacaaaaactcctgaaggaaatccagagcgtgctgcctgagaaccaggtgccacgagcggaggatctgcgcaacatgccctacctcaaggcttgcttaaaggagtctatgcgtttaacacccagcgttcccttcaccacccgaaccctcgataaggccactgtgctgggagaatacgctcttcctaaagggactgtgctcatgctaaacacccaggtcctcgggagcagtgaagataatttcgaggactcttctcagttcagaccagaacggtggctgcaggagaaggaaaagatcaacccttttgctcacttacctttcggagtgggcaagaggatgtgcatcggccgaaggttggccgaactccagctccacttggctctatgctggatcgtgagaaagtatgatatccaggccacagacaatgaacccgtggagatgctgcacagtgggacgctcgtgcccagccgggagcttcccatcgcgttttgccagaggtag

SEQ ID NO: 237091 - DNA, 2382 bp, Artificial Sequence
  Description of Artificial Sequence: Synthetic coding sequence
atggactcatggttcattctggtgcttctcggaagcggcctgatctgcgtgtccgccaataatgctaccactgtggccccttctgttggaatcactaggctcattaatagctcaaccgccgaaccagtgaaggaggaggctaagaccagcaaccccacctctagtctgacctcattgtctgtcgctcctacgttctctcccaacatcacacttggaccaacctatctcactacagtgaacagttctgattctgataacggaacaacgaggactgcaagtacaaacagtattggcatcacgatcagccccaatggcacgtggctgccagacaatcagttcactgatgcgcgtactgagccgtgggaaggtaactcctctacagccgcaacaaccccagaaacttttcctccaagcgacgaaactccaataattgccgtgatggtggccctgagctcgctgttagtcatcgtattcataatcatcgtcttatacatgcttcgctttaagaaatacaagcaggccggttcccactccaattcttttcgtctttctaacggcagaaccgaggacgtggagccacaaagcgtgcctctgttagccaggtcaccctcaactaacagaaaataccctcccctgccagtggacaagctggaagaggagataaaccggagaatggccgacgacaacaagctattcagagaggaattcaatgccctgccagcatgccctatccaggccacttgcgaggccgcttccaaggaagaaaacaaagagaaaaaccgctacgtaaatatcctgccgtatgaccattctcgggtgcacttgacccctgttgaaggtgtgcctgatagcgactatataaacgctagctttattaacgggtatcaggaaaagaataagtttattgctgcccagggtcctaaggaagaaactgtgaacgacttttggagaatgatttgggaacaaaacacagctacgattgtaatggtcactaacctcaaggaaaggaaagaatgtaagtgtgctcagtattggcctgaccagggctgctggacgtacgggaacatcagggtgagcgtggaagatgtgacagtcttagtcgattacaccgttcgtaagttttgcatccagcaagtcggtgatatgactaaccgaaagccccagagactgataacccagttccacttcactagctggcctgacttcggtgtgcccttcacaccaataggtatgttgaaatttttgaagaaagtgaaagcctgcaatccgcaatatgcgggagctattgttgttcactgttccgcaggggtgggtcgcacaggaaccttcgtagtgattgatgcaatgcttgacatgatgcataccgagaggaaagttgatgtttacgggttcgtgagccggattcgcgctcagcgctgccagatggttcagacggacatgcaatatgtgttcatataccaagctctacttgagcactatctgtatggagacaccgaactcgaagtgacttcgcttgagactcatctccagaagatctacaacaagatacccggaacaagtaataatgggctggaagaagaattcaagaaactcacatctattaagatacaaaacgataagatgcgaactggtaacttgcccgctaacatgaaaaaaaaccgcgtgctgcagattatcccttatgagtttaaccgggtgattatccctgtgaaaagaggtgaggaaaacactgactatgtcaatgcatcattcatcgacggttatagacagaaggactcatacatcgcctctcagggtcccctactccatacgattgaagacttctggcggatgatctgggaatggaagtcttgtagcattgttatgctcaccgaactggaagagaggggccaggaaaagtgcgctcagtactggccatcagatggtctggtctcttatggggacatcaccgtagaactcaagaaggaggaagagtgtgagagctataccgtgcgcgacctgctagtgaccaacactcgtgaaaataaatcccggcagatcaggcagttccacttccacggatggcctgaagtgggaattccctccgacggcaaagggatgatttccattatcgcagctgtgcagaaacagcaacagcaatcggggaatcacccgatcacagtgcactgttccgctggcgctggtcgaaccggcaccttttgtgcgctgagtacagtgttggagagggtgaaagcggagggaatactggacgtgtttcagacggtaaaatcactaaggttgcagcgcccacacatggtgcagaccctagaacagtacgaattttgttacaaagtggtgcaggagtatatcgacgccttctccgactatgcaaactttaagtag

SEQ ID NO: 237092 - DNA, 2382 bp, Artificial Sequence
  Description of Artificial Sequence: Synthetic coding sequence
atggacagttggttcatcctggtgctcctggggagcgggctgatctgtgtctccgcaaataacgcaaccactgtcgccccatctgtcggaatcacgagactgatcaactctagcacggcagagccagtcaaagaagaggcaaagacatctaatcccacatcttcccttacctctctgtccgtggctccaacgttctcacctaacatcacgctgggacccacatacctcacaacagtgaattcttctgattcagacaacgggacgacacgcaccgcaagcactaactcaatagggatcaccatttcaccgaacgggacctggctgcccgacaatcagttcaccgatgctaggaccgagccttgggaaggtaactcttccactgccgctactactcccgagacctttcctccaagcgatgaaacgcctataattgctgtgatggtggctcttagctccttgctggtcatcgtctttattattattgtactatacatgcttcggttcaagaaatacaaacaggctggctcacatagcaattccttcagactgtccaacggcaggacagaagacgtcgagcctcagtccgtccccttgctggcccgatccccctccaccaatagaaagtatcccccactgccagtcgataaacttgaagaggaaataaaccgtcgtatggctgacgataacaagctttttagagaagagttcaatgctctacctgcctgccccatccaggcgacctgtgaagccgctagcaaggaggaaaacaaggaaaagaatcgttatgtcaacatactgccatatgatcactcaagagtgcacttaacgcctgtggaaggcgtgcctgatagcgattatattaatgcctctttcattaatggataccaggaaaagaacaagtttatagccgctcagggccctaaagaggagacggtgaacgatttttggcggatgatctgggaacaaaacacagcgactatagtcatggtgacaaacctcaaggaaaggaaggaatgcaagtgcgcacagtactggccggatcagggatgttggacatatggtaatattcgggtgagcgttgaagacgttaccgtccttgtggactataccgtgcggaagttctgtatccaacaggtgggcgatatgaccaaccgtaagcctcagcggcttatcacgcaattccacttcacctcttggccagactttggcgtcccattcacacctataggtatgttaaaattccttaaaaaagttaaggcctgcaaccctcagtacgcgggagctattgttgtgcactgttctgctggggtgggacgtactggcacctttgtggtcattgatgcaatgctggacatgatgcacaccgagcgcaaagtggacgtgtatggtttcgtgtctcgaatccgtgcacagaggtgccaaatggtacagactgatatgcagtacgtgtttatttaccaggccctcctggaacattacctgtatggagacacggaacttgaagttacttccctcgaaacacacctccaaaaaatttataataagattcccggaacctccaacaatggcttggaagaggaatttaagaagctgacttctatcaaaatccaaaatgacaagatgcggaccggaaatctgccagctaatatgaaaaaaaatcgggtgttgcaaatcatcccatatgaattcaaccgcgtcatcatccctgtgaagcggggtgaagaaaataccgattacgtgaatgcctctttcatcgacggctaccgacagaaggattcctatatagcctctcaggggcctctgctgcataccattgaggacttctggagaatgatttgggaatggaagagctgctccatcgtaatgctcaccgagctggaagagaggggacaagagaaatgtgcgcagtattggccatccgacggcctggtctcctacggcgatataactgtggaactgaagaaagaagaagagtgtgagtcctacactgtgcgggatcttctggttacaaataccagagagaacaaatcacgccagatcagacagttccacttccacggttggccagaggtggggatcccatctgatggcaaggggatgattagcatcatcgctgctgtgcagaagcagcagcagcaatccgggaatcatcctataactgttcattgcagcgccggagcaggtcgaactggcactttttgcgcattgtccacggttcttgagagagtgaaagcagaaggcatactggacgtgtttcagactgtcaaatcattacggctccagcgtccccacatggtgcagactcttgaacagtacgagttctgctacaaggtcgttcaggagtacatcgatgctttttctgattatgccaattttaagtag

SEQ ID NO: 237093 - DNA, 1977 bp, Artificial Sequence
  Description of Artificial Sequence: Synthetic coding sequence
atggtggcgctctcttccctcttggtgattgtcttcataatcatagttctctatatgctgagaagatttcgaaaagcagaacttatgagccgcaatactgagaagtacaagcaggccggatcccactctaactctttccgcctgagtaatggcaggacagaggatgtggagccccaaagtgtccccctgttagccaggtcaccctcgaccaaccgaaagtatccaccgctgccggttgataaactcgaggaagaaatcaatagaagaatggccgatgataataaattgttccgagaggagttcaacgccctgcccgcatgccccattcaggccacatgcgaggccgcttccaaggaggaaaataaagaaaagaatcgatatgttaacattctgccttatgaccactcgagggtccacttgacaccagttgagggagttcccgacagcgattatattaacgcaagttttattaatggttatcaggagaaaaataagttcatcgcagcgcagggacctaaggaagaaacagtcaacgacttttggagaatgatctgggagcaaaatacagctaccatcgtaatggttacgaacctgaaagaaaggaaagagtgtaagtgtgcccagtattggcccgatcagggttgctggacgtacggtaacatcagggtgtcggtcgaggacgttaccgtcttagtggactataccgtgcgcaaattttgcattcagcaggtgggcgacatgacaaacaggaagccgcagcggctgatcacgcaattccatttcacatcctggcctgactttggcgtcccattcacacccattggcatgctgaaattccttaaaaaggtaaaggcgtgtaacccacagtacgctggagctatcgtggtccactgctcagctggcgtggggagaactggcacctttgtagtaatagatgcaatgctggacatgatgcacacggaacggaaggtggatgtttacgggtttgtgtctaggatacgagcccaaagatgccagatggtgcagaccgacatgcagtatgtgtttatctaccaagcactgctggaacattatctgtacggggacactgaactggaggtcacctccttggagactcatctacagaagatctacaataagatcccaggcacctcgaataacggcctggaagaagagttcaagaagctgacctcaattaagatccaaaacgacaagatgcgcactggcaacctgcctgccaatatgaagaagaatagggtgctccagattatcccttatgagtttaaccgtgttattataccagttaaacgtggcgaagagaatactgactacgtcaacgctagcttcatagatggctatcgccagaaggattcttacattgcatcacagggtccacttctgcacaccatcgaagatttttggaggatgatttgggaatggaagtcatgctccattgtcatgctgaccgagctggaggaaagaggccaggagaaatgcgcccagtactggccctcggacggactggtgtcctacggcgacatcaccgttgagctcaaaaaagaggaggagtgtgagtcctacacagttcgcgacctgcttgtgacaaacactcgggaaaacaagtctcgtcaaatccggcagttccacttccatggctggcccgaggtgggaatccccagtgacggaaaaggcatgatctccattatcgctgctgtgcagaagcaacagcagcagtccggaaaccatccaatcaccgtacactgttctgccggagccggtagaaccgggacgttttgcgccctaagcactgtgctcgagcgggtgaaagctgaaggtatactggacgtcttccaaacggtgaagagtttgcgattgcagcggccacatatggtgcagaccctggaacaatatgaattttgctataaggtggtgcaggaatacattgatgcattttctgattatgccaattttaagtag

SEQ ID NO: 237094 - DNA, 2409 bp, Artificial Sequence
  Description of Artificial Sequence: Synthetic coding sequence
atggactcttggtttatccttgtgctcctggggagcggcctgatttgcgtgtctgcaaataacgccactacagttgccccaagtgtcggaatcactaggttgataaatagctccacagcagagcctgtaaaagaagaggctaagacctcaaatcctacgagctccctaacatcgctgtctgtagcaccaactttctctcctaacattacgctgggcccaacctatcttaccacggtcaacagctcggattccgataacggcacaacacggacggcctcgaccaactccatcgggatcactataagccccaatggtacctggctaccagataatcagttcaccgacgccaggacagagccttgggaggggaatagcagtacagcagcgacaactccagaaactttccctccttctggcaatagtgactccaaggaccgcagagatgaaacgccaataatcgcggtgatggtggccctgtcatcacttctggtaatagtctttatcattatcgtactctatatgcttcggtttaaaaaatataagcaggctgggtcccacagtaatagttttagactcagcaatggcagaacagaggatgtcgaaccccaatccgtgccactcctcgctaggagcccaagcaccaatcgaaagtatccacccctcccagtagataagcttgaagaagagattaatcgcagaatggccgatgataataagctctttagggaagagttcaacgcactgcctgcctgcccaattcaggcgacatgtgaagcagcatcaaaggaggagaataaagaaaaaaacaggtacgtgaatattctgccttacgatcactctcgggtacatctaaccccggtggagggtgtgccggacagcgattatatcaacgcaagcttcatcaacggctaccaggaaaaaaacaagtttattgctgcccaggggccaaaggaagaaaccgttaacgatttttggcgtatgatatgggaacagaatacagcaactattgtgatggtgacaaacctcaaagaaagaaaagaatgcaaatgcgcacagtactggcctgatcagggatgctggacgtacggtaacattcgggtaagtgtcgaggacgtgacggtattggtggactacaccgtgcgtaagttctgcattcagcaggtcggcgatatgaccaacaggaagcctcagaggttgataacacagttccacttcaccagttggcccgacttcggcgtgccctttacaccgatcggcatgcttaagtttctcaagaaggttaaggcctgcaatccccagtacgctggagctatcgtggtgcactgcagtgccggtgtcggccgtacaggtaccttcgtggtgattgatgccatgctagatatgatgcatacagaaaggaaggtggatgtctacgggtttgtgtcacgcataagagcacagaggtgccagatggtgcaaactgatatgcagtatgtcttcatttatcaggcgctgctggaacattatctctatggtgacaccgaactcgaagtcactagcctggagacccatttgcagaagatatataacaagatcccaggtaccagcaataacggccttgaagaagagtttaagaaattgacgtccattaaaatccagaacgataaaatgcgaacaggtaatctgcccgctaatatgaaaaaaaatagggtgctacagataatcccttatgaattcaaccgagtgatcatacccgttaagcgaggcgaagagaacaccgactatgttaacgcaagcttcatcgatggataccggcaaaaagatagttatatcgcgtcacaggggcctctcttgcatactattgaggacttctggcgcatgatatgggaatggaagtcatgctctatcgtgatgctaacagagttagaggaacgaggccaggagaaatgcgcccaatattggccctccgacggtttggtctcatacggagacatcactgtggaactaaagaaggaggaggagtgtgagtcctacacagttcgcgatttgctcgtgaccaatacccgtgagaacaaatctcgccaaatccgccaatttcacttccacggttggccggaggttggcatcccctctgacgggaagggcatgatctccataatcgccgcagtccagaagcaacagcagcagagtggaaatcaccctatcaccgtacactgtagtgctggggcaggtcgcacaggaaccttttgtgccctctctactgtgctcgaacgggtcaaggcagaggggattttggacgtctttcagactgtgaagagcctgagactccaaagacctcacatggtgcagacccttgagcaatacgagttctgctacaaggtggtccaggagtacatcgacgcattttcagactatgctaattttaaatag

SEQ ID NO: 237095 - DNA, 2409 bp, Artificial Sequence
  Description of Artificial Sequence: Synthetic coding sequence
atggactcctggtttattcttgtgctgctgggaagcgggctgatttgcgtgtctgctaacaacgcaaccaccgtggcgccttctgtggggatcacacgtctgattaattcctccaccgccgaacctgtgaaagaggaagctaagacctcaaaccccacctcttccctgacctccctgagcgtggccccaacttttagtcccaacatcactctgggaccaacttatctcaccaccgtgaactcttccgactccgacaatggcaccacgagaactgcttccaccaatagtataggaataaccatatcccccaacggcacttggcttcctgacaaccaattcactgacgctagaacagagccttgggaaggaaactctagcacagccgcaactacacctgagacattcccgccttcaggaaattcagattccaaagatcgcagggatgagacaccaattatcgctgttatggtggctcttagcagcctcctcgtgattgtgtttatcatcatcgtgctgtacatgctgcgatttaagaagtataaacaggccggtagccactccaatagctttcgcctgtccaacggcagaaccgaagacgttgagccccagtccgttcctttgttagcacgatcaccctctacgaaccggaagtatccacccctgcctgtggacaagctagaggaggaaatcaatagaagaatggcagatgataacaagctgttccgggaggagtttaacgccctccctgcttgtccaattcaggcaacctgcgaggcggcttccaaagaggaaaacaaagagaagaacagatatgtcaacatccttccttacgatcatagtcgcgtgcaccttactccggtggaaggcgtgcccgattccgactatatcaatgccagctttattaacggctatcaggagaaaaataaatttatcgccgctcaaggccctaaagaggagaccgtgaatgatttctggaggatgatatgggagcaaaacaccgcgactatagtgatggtcaccaatctcaaggagagaaaagagtgcaagtgtgctcagtactggcccgatcagggatgctggacatacgggaacattcgagttagcgtggaggacgtgaccgtgctcgttgactacactgtgcggaagttctgtatccagcaggtgggcgacatgaccaatcgtaagccccagcgcttaataacgcagtttcactttaccagctggcccgactttggagtacccttcacccccattggcatgcttaaatttctgaaaaaggtgaaggcgtgtaatcctcagtatgcaggtgcgatcgtcgttcattgctccgccggagtcggcaggaccggaacattcgtagtgatcgatgcaatgctggacatgatgcacaccgaacggaaggttgacgtttatggatttgtgtcccgcattcgggcacagcgatgccagatggtacagactgatatgcagtatgtctttatctaccaagctttgctggaacactacctgtacggcgacacggaactcgaggtcacctccctggagacacacctccagaagatatataacaagatcccagggacctcgaataacggtcttgaggaggagtttaaaaaattaactagcattaagattcaaaatgacaaaatgcgtaccgggaatcttcccgcaaatatgaagaagaaccgtgtgctccagatcatcccatatgaattcaatagagtgatcatcccagtgaaaaggggcgaggagaatactgattatgtcaatgccagctttattgacggttatagacagaaagattcctatatcgcctcacaaggacccctattgcacacgatagaggacttctggcgcatgatttgggagtggaagtcttgctctattgtgatgctcaccgagttggaagagaggggccaagaaaaatgcgctcagtattggccctctgatggcttggtctcctacggggatataacagtagagctgaaaaaagaggaggaatgcgaaagctacacagtgcgcgatctcttggtcactaatactcgcgagaacaaaagcagacagattaggcagtttcatttccatggctggcccgaggttgggattcctagcgatggcaaggggatgatctccatcatcgccgcagtgcagaaacaacagcagcagagcggtaaccatcccattacagttcactgctcggcaggagctgggcgaacaggaacattctgtgccctgagcaccgtgctggagcgggtcaaagccgagggaatactggacgtcttccaaactgtgaagagcctgaggctgcaacgaccacacatggtccagacgctggagcagtacgagttctgctacaaggtggtccaagaatacattgacgctttcagcgattatgctaacttcaagtag

SEQ ID NO: 237096 - DNA, 603 bp, Artificial Sequence
  Description of Artificial Sequence: Synthetic coding sequence
atggatagctggtttatcctagtgctactggggagtggattgatatgtgtgtccgccaataacgccacaaccgtagctccgtcagttgggattacccggctgataaattcctcgacggctgagcccgtgaaagaagaagcgaagactagcaaccctactagcagcctaacgtcactcagcgtggcccctactttcagtccgaacataacacttggaccaacatacttgactactgtgaattccagcgactcagataatggcacaaccagaactgcctcgaccaactccatcgggattacaatcagccccaatggcacctggcttcctgataaccagtttacagatgccagaactgaaccctgggaggggaattcttcaactgctgccaccacccctgaaactttccccccaagcggcaattcggactccaaggatagacgggatgagaccccaatcattgctgtgatggtcgcactgagtagtcttttggttattgtgtttattattatcgtcctgtacatgttgaggttcaaaaagtataagcaagcaggatctcactccaactcatttaggctgtctaacggcaggacggaagacgtttag

SEQ ID NO: 237097 - DNA, 2442 bp, Artificial Sequence
  Description of Artificial Sequence: Synthetic coding sequence
atggatgatgcagtgcaaataactaagatttcaatggattcgtggttcattctggtgctgcttggcagtgggcttatttgcgtttcagccaacaacgccaccaccgtggccccatctgtgggaatcactcggctaattaatagctccacagcagaacccgtgaaagaggaggccaagacctccaatcctacatcttcactcacctctctgtcagtggcaccgaccttttcacccaacattaccctgggtcctacgtacttaaccactgttaatagtagcgacagtgacaatggcaccacccgaacagctagcaccaactccatcggtattacaatctcacctaatggaacctggttaccagataatcagtttaccgacgcaaggacggagccctgggaaggaaacagctcaacggccgctactacccccgagacttttcctccttctgggaactcagactctaaagatcgtcgggacgagacccctattattgccgtcatggtggcactcagctcattgctggtaatagtgttcatcattatagtgttatacatgctgagattcaaaaagtacaagcaggccggaagccactcaaactcattccggcttagtaatggccgaactgaagacgtggaaccacaatcagtgcctctgctcgcccgaagtcctagcaccaaccggaaatacccgcctttgccagttgacaagttggaagaggaaatcaatcgcagaatggctgatgacaacaagctgttcagagaagagttcaacgcactgcccgcttgtccaatccaggccacctgtgaagcggctagtaaggaggaaaacaaggagaaaaataggtacgtcaacatcctgccatacgaccattccagagttcacctgactcccgtggagggggtgcctgacagcgactatatcaatgcctcctttattaacgggtatcaggagaagaataaatttatcgcggcacagggacccaaagaggaaactgtaaatgatttttggcgcatgatctgggagcagaatacagccaccattgtaatggtaaccaaccttaaggagcggaaggagtgcaagtgtgctcaatactggcctgaccagggttgttggacttacggtaatattagggtgtccgtcgaggacgtgactgtcctggtcgactacaccgtgagaaagttttgcatccagcaggtaggcgacatgacaaacaggaaaccacagcgtctgatcactcagtttcacttcacatcatggcctgatttcggcgtaccctttacccctatcggcatgctgaaattcctgaaaaaagtaaaggcatgtaatccccagtatgcgggtgcaatcgtggtgcattgtagcgctggagtgggtagaacgggcactttcgtggtcatagacgcaatgttggacatgatgcacactgaacgcaaggttgacgtgtacggcttcgtgtctagaattagggcccagaggtgccagatggttcagacggatatgcagtacgtctttatttatcaagccctcttagagcattacctttatggggatacggagctggaagtgaccagcctggagactcacctccagaaaatctataataagattcccggaacatcaaacaacggcctggaggaggagttcaagaagctaacttctattaaaatccagaacgataaaatgaggacggggaatcttccagcaaatatgaaaaaaaaccgcgtcctccagattataccctatgagtttaatagagttatcatacccgtaaagcggggtgaggagaacacagattatgtgaacgccagtttcatcgatggttaccgccagaaggactcctacatcgcttcccaaggacctctcttgcataccatcgaggacttctggcgcatgatctgggagtggaaaagctgttcgatcgttatgcttacggaacttgaggaacggggacaagaaaagtgtgctcaatactggcccagcgatggattagtgagctatggagacattaccgtggaactaaaaaaagaggaagagtgtgagagttacaccgtgagggatctcctggtgaccaacaccagggagaataaatctaggcagatccgtcagttccactttcatggatggcctgaggtgggcatcccatctgatggcaaggggatgataagcattatagcagctgtgcaaaaacagcagcaacagtccggcaatcaccccattacggtgcactgctccgcaggcgctggcagaactggcaccttctgcgctctaagcactgtgttagaacgggttaaggccgaggggattctggacgtttttcagaccgttaaaagcttgcgactccagagacctcatatggtccaaacactggagcagtacgagttctgttacaaggtggtacaggagtatatcgacgccttctcagattacgctaacttcaaatag

SEQ ID NO: 237098 - DNA, 528 bp, Artificial Sequence
  Description of Artificial Sequence: Synthetic coding sequence
atggacagttggttcatcttggtgcttctcggctccgggctcatctgcgtgtcggctaacaatgccacaaccgtcgccccatccgttgggatcacccgcctcattaactcatcaacggccgaacccgtgaaagaagaagccaaaactagcaaccccacaagttctttaacctctctttctgtggccccaactttttctcctaacattactctcggccctacttacctaacgactgtgaattccagcgacagtgataacggcactacacgtacagcctctactaactccatcgggatcaccatctcaccaaacgggacgtggctcccggataaccaatttactgacgcaagaaccgaaccctgggaaggcaactcttccaccgctgcgaccactcccgaaactttccccccatccggaaatagcgactccaaagaccgtagagacgagacaccaattatcgccgtcatggtggcactttcctccctcttagtgatagtttttattattatcgtcctttatatgctttag

SEQ ID NO: 237099 - DNA, 417 bp, Artificial Sequence
  Description of Artificial Sequence: Synthetic coding sequence
atggacagttggttcatattagtccttttaggtagcggactgatctgcgtatctgccaataacgctactacagtagccccttctgtagggatcactaggctgattaactcctctacagccgaacctgtaaaagaagaggcaaagaccagcaaccccacctcaagcttgacaagcctctcagtggccccaacgttctcccccaatattactctcggccctacttacctgactacagtgaattcctcagactccgataatgggaccactcggacagcatctaccaattcaatagggatcactatttcacccaacggtacctggctccccgataatcagttcacagacgcaagaacagaaccctgggaaggcaacagctccactgcagctaccacacctgagacatttccaccctcttag

SEQ ID NO: 237100 - DNA, 762 bp, Artificial Sequence
  Description of Artificial Sequence: Synthetic coding sequence
atggactcatggtttatccttgtgctgttgggcagtggacttatctgtgtgagtgcaaataacgctacaacagtggcaccatcagtcgggatcactagattgattaactcaagtacagccgaacctgtaaaagaggaagcgaagactagtaatccaaccagttctttaaccagcttgtccgtggccccaacttttagcccaaatatcacactggggccaacctatctcacaacagtcaattcctccgatagcgataacggtaccacacgtactgccagcactaatagtattggaattaccatatctcccaatggcacctggcttccagataaccagtttacggatgccagaaccgagccatgggaagggaatagtagcactgcagctaccacccccgaaaccttccccccttccgacgagacccctattattgcagttatggtcgccctgtcatccttgcttgtcattgtctttattatcatagtgctgtatatgttacgttttaaaaaatacaagcaggccggatcgcacagtaatagcttcaggttaagcaatgggaggactgaggatgttgagccccaatccgtcccactgctcgcacgatcacccagtaccaacagaaagtatccccctctgcctgtggacaagcttgaagaggagatcaatcgacgaatggcagatgacaacaaactgtttcgcgaagagttcaacgccctgcccgcttgccctattcaagctacatgcgaggccgctagtaaatag

SEQ ID NO: 237101 - DNA, 1239 bp, Artificial Sequence
  Description of Artificial Sequence: Synthetic coding sequence
atgactaacagaaaaccccagaggctaataacacagtttcatttcacgtcctggcctgactttggagtccctttcaccccaatcgggatgctgaaatttctcaagaaggtcaaagcctgcaatccccagtatgcgggagccattgtcgtgcactgttctgccggagtgggcagaaccggaacatttgtggtgatagatgccatgctcgacatgatgcatacagagaggaaagtggacgtctacggattcgtctccagaattcgcgctcagcgctgccagatggtgcaaacggatatgcagtatgtttttatttatcaggcgctcttggaacattatctgtatggggatactgaacttgaagtaacctccctggaaactcatctccagaaaatctacaacaagatcccaggaacctccaataacggtctggaggaggagtttaaaaaactgacttcgatcaagatacagaatgacaagatgagaacgggcaacctgcctgctaacatgaagaagaatagagtcctgcaaatcatcccctatgagttcaatagggtgatcattccagtgaagagaggagaagagaatacagactatgtcaacgcttcgttcatagacggctatcgacagaaggatagctacatcgcctctcaagggcctttgctgcatacgatagaagatttctggcgcatgatttgggaatggaaaagttgctccatcgtaatgttgaccgagctagaagagcgcggacaagagaagtgcgctcaatactggcccagtgacgggctggttagctacggcgatatcacagtggagctgaaaaaagaggaggagtgcgaatcatacaccgtgagagaccttctggtcaccaacacgcgagaaaataaatctcgccagattcgccagtttcacttccatggttggcctgaggtcgggatcccgagcgatggcaaaggaatgatcagtattattgcagcagtccagaaacagcagcagcagtccgggaaccaccccattactgtgcattgtagtgccggagcaggcagaaccggtacattttgcgccctctcaacagtgctggaaagggtgaaggctgagggcattctggacgtatttcagactgtgaagtctctcagactgcagcgcccacatatggttcagacgctggaacagtatgaattctgttataaggtggtccaggaatatattgacgctttctcagattacgctaattttaagtag

SEQ ID NO: 237102 - DNA, 5993 bp, Artificial Sequence
  Description of Artificial Sequence: Synthetic coding sequence
atgttgagtcatggagccggactggccttgtggattacactatcgctcctacagacggggcttgctgaacctgagcggtgtaactttaccctggcagagtcaaaggctagttctcattcggtctccattcaatggcggatcctaggcagtccctgcaattttagtctcatctactcttccgatactctaggagcggcactctgtccgactttccgaatcgataacacaacctatgggtgtaatctacaggacctgcaggctgggacaatttacaacttccgcatcatcagtctggatgaagaaagaaccgtggtcttgcagaccgaccctctacccccagcacgctttggggtgtcaaaggaaaaaacgacttctacaagtttacacgtgtggtggaccccttcatctggtaaagtaacaagctacgaggtccagctcttcgacgaaaataaccagaaaatccagggggtgcagatccaggagtccacgtcttggaatgagtacacttttttcaacttgacagctggatcaaaatataatatcgcgattactgcagtgtccggtggcaaaagatccttcagcgtgtacacaaacggaagtaccgtccctagccccgtgaaagatatcggtatcagtactaaggctaatagtctcctcataagttggtcacacgggtcaggaaacgtcgagcgctacagacttatgctgatggacaagggcattttagtgcatggaggtgtcgtggacaagcacgctactagctatgctttccacggcctgacacccggatacctgtacaacctaactgttatgaccgaggctgccggactgcagaactacaggtggaagctggtccgcaccgccccaatggaagttagcaacttgaaggtcacgaacgacggctctttgactagcctgaaagtgaagtggcaaaggccccctggtaacgtcgattcttacaatataaccttatctcataaaggaacaatcaaagaatcaagagtgttagccccatggattaccgagactcactttaaggagctcgtccctgggaggctctaccaagtgacagtgtcatgcgtgtcaggagaactttcagctcagaagatggccgtagggagaacctttccagacaaggtagccaacctggaggctaataacaatggccgtatgcgaagcctcgtggtcagttggagcccgccagcgggtgactgggagcaataccgcattctcctcttcaatgattctgtggtccttttgaatattactgtgggcaaagaagagacacagtacgttatggacgacaccggactggttccagggagacagtatgaagtcgaagttatcgttgaaagcggtaacctgaaaaattcagagaggtgtcagggcagaacggtccctctcgctgttctacagctgagagtcaaacatgccaatgagacaagcctgtctattatgtggcagacacctgttgccgaatgggagaaatatataatcagtctcgccgacagggaccttttgttgatccacaaatcactgagtaaagacgccaaagaatttacctttacggatttggtacctggacgaaagtacatggctaccgtgacttccatcagcggcgatctcaagaattcatcctcggttaaagggagaaccgtccctgcccaggttactgatcttcatgtggcaaatcaggggatgacatcatccctcttcacaaattggacacaggcgcaaggagatgtggagttttaccaggtactcctgatccatgaaaatgtagtgatcaaaaacgaatctatcagctccgagacttcaaggtatagttttcacagcttgaagtcgggctcactgtattctgttgttgtgaccacagtgtccgggggtatttcctcccgccaggtggtggtggaggggaggaccgtgccttcttccgtgtctggagtaaccgtcaataatagtggcaggaatgattacctctccgtttcgtggctcctggcgcctggggacgtggacaactacgaggtaaccctgtcccatgatggcaaagttgtccagtcattggtgatagcgaaaagcgtgcgggagtgttcgttttcaagtttaacgcccggtaggttgtacactgtaacaattactacgcggtctggaaaatatgagaaccattcctttagccaggagcggacagttcctgacaaagttcagggcgtgtccgtgtccaatagcgccagaagtgactacctccgtgtgtcctgggtgcacgccacaggcgatttcgaccactatgaagtgacgatcaagaataagaataacttcattcagaccaaatccatccctaaatcagagaacgaatgcgtgttcgtgcagctggtaccagggaggctgtatagcgtgacagttacaactaagtcaggacaatatgaggcaaacgagcagggcaatggaaggacgattccagaaccagttaaggacctgacgttgaggaacagatcaaccgaggatctccatgtgacttggagtggggctaacggggacgtggaccagtatgaaatccagttacttttcaacgacatgaaagtgtttccaccctttcacctcgtcaacacggccacagaatatagatttacaagcctcacgccaggacgacagtataagatcctcgtactgactataagcggcgacgtacagcagagcgcgtttatcgagggattcacagtgccctctgctgtaaaaaatatccatatcagccctaacggcgcaactgattcacttacggtgaattggacaccagggggtggagacgtcgactcttacacggtctccgcttttaggcattctcagaaggtagactctcagacaatcccaaaacatgtgtttgaacatacgtttcaccggcttgaggccggagaacagtaccagatcatgattgcatcggttagcggctccctgaaaaatcagatcaacgtagtgggccgtaccgttcctgcttccgtgcagggagtgatagccgataacgcatactcttcatactcactgattgtgagctggcagaaagccgcaggagtggctgaacgatacgacatcttgctgctaactgaaaacggaattttgctgcggaacacctccgaacccgctacaactaaacagcataaattcgaggatcttacacccggaaagaaatataaaatccagattctgacagtgagtgggggactcttttccaaggaggctcaaacggaaggacgcacagtgccagccgctgtgacagatctgcgaatcactgaaaattccacccgccacctgtcattccggtggacagcaagcgagggtgaactgtcttggtacaacatattcttgtataatccagacggtaatcttcaggaacgggctcaggtcgaccccctcgtccagtcgttttcttttcagaatttactgcagggcaggatgtataaaatggtcatcgttactcactcaggcgagttgtcgaacgagtctttcatatttggccgtactgttcccgcttctgtgagccaccttagggggtccaacaggaacaccaccgattctctttggttcaattggtcaccagcatcgggagacttcgacttttacgaactgattttgtacaaccctaatggcactaaaaaagaaaattggaaagataaagatctcacagagtggcggtttcagggtcttgtgcctggcaggaaatacgtcctctgggttgtcacccatagtggggatttgtcaaataaagtgacggccgagagtaggactgccccttcccccccaagtctcatgtccttcgccgacattgcaaatacgtcacttgccatcacctggaaaggccctcccgactggaccgattacaacgactttgagctgcagtggctgcctcgggacgctctcaccgtttttaatccctataacaatagaaagagcgaggggaggatcgtttacgggttgcgcccaggacgctcgtatcagttcaatgtcaagactgtatcaggagacagctggaagacctattccaagccgatctttggcagtgtgcggacaaaacctgacaagatccaaaacctgcactgtcggccacaaaatagtactgcaatcgcttgttcttggatcccaccagattctgatttcgacgggtattcaatcgagtgtcgaaagatggacactcaagaggtcgagtttagtcggaaattagagaaagaaaagtccctcctcaacattatgatgttagtcccacataagaggtatcttgtctctatcaaggtgcagtctgccggaatgacatccgaagtcgtggaggacagcaccattactatgatcgacaggccccctccgcctccccctcacatccgggtcaacgagaaagatgtgcttatcagtaaatcatcaatcaatttcaccgtgaactgcagttggttttccgacaccaacggggctgttaagtactttaccgtggtcgtgagagaggcggacggaagtgatgagctgaagcctgagcagcaacaccccttaccctcttacctggagtatcgtcacaatgcatcgattcgtgtgtatcagactaactacttcgccagtaagtgcgccgagaaccccaacagtaatagcaagagctttaacattaagctaggcgctgagatggaatcactgggtgggaagtgtgatccaactcagcagaaattctgcgatggcccattgaagccacatacagcctacagaatctcaattcgagcattcacccaactgtttgacgaggaccttaaggagttcaccaagccactatatagcgatacgttcttctctctccccattacaaccgagagtgagccactctttggggcaatcgagggtgtgtctgctgggctctttttaattggtatgcttgttgccgtggtggccctcctcatctgcaggcagaaggtgagtcacggcagggagaggcctagtgccaggctgtccattaggagagacagacctctatccgtgcacttaaatctcggtcagaagggtaaccgaaaaacgtcttgccctataaaaatcaaccagtttgaggggcactttatgaagttgcaggctgattctaattacctgctgagtaaagaatacgaggaattgaaggacgttggacgtaatcagtcctgtgacattgccttgctgcccgaaaatagagggaagaaccggtacaataacattctcccatacgacgccaccagggtgaagctgagcaacgtagacgatgacccctgttctgattatatcaatgccagctacattcctgggaacaatttccgccgtgagtatatcgtcacccaggggccattgccaggaactaaagatgatttctggaaaatggtgtgggagcaaaacgtgcacaacatcgtgatggtgacgcaatgcgtcgagaaagggagagtgaagtgcgaccactactggcccgctgaccaggattccctgtattacggtgacctcatcttacagatgctcagtgagagtgtgttaccagaatggactattcgcgagttcaaaatctgtggagaagagcaattggacgctcaccggttaattcggcacttccattacactgtgtggccagatcacggggtgccagaaaccacccagtccctcatccagtttgtgaggacagtgcgcgactatataaaccggtctccaggtgccggacctaccgtggttcactgtagcgcgggagtcggaaggactggcacatttatcgccctcgaccgcattttacagcagctcgactccaaagatagcgtcgatatctacggggcagttcacgaccttcgtcttcaccgagtgcatatggtgcagaccgaatgccagtatgtgtacttacaccaatgcgtcagggacgtactgcgagccagaaagttacgttctgagcaggaaaatccgctgtttcccatttatgagaatgtaaatcctgagtatcatcgggaccccgtgtacagtcgccatta

SEQ ID NO: 237103 - DNA, 6647 bp, Artificial Sequence
  Description of Artificial Sequence: Synthetic coding sequence
atggaagctgagttttacatggtaatactgacctgcctgattttcaggaactcagagggatttcagattgtccatgtgcaaaaacagcagtgcctcttcaaaaacgagaaggttgttgtgggatcctgcaatagaaccatccaaaatcagcaatggatgtggaccgaggatgagaagcttcttcacgtaaaatcagccctgtgtctcgccatcagtaattcttctaggggacctagtcgcagcgctatcctcgatcgatgcagtcaggcgcctcgatggacctgctacgaccaggagggctttcttgaggtggagaatgcttctttatttctgcaaaagcaggggagtcgggtcgtggtgaagaaggcacgcaaatacttgcactcttggatgaaaatagatgttaacaaggaaggcaaattagtgaatgagtccctgtgtctccagaaagcaggactcggagcggaagtttctgtcaggagtacccgtaacacggccccaccccagatactgaccacattcaacgccgtgcccgacggtttggtgttccttattcggaatacaaccgaggccttcattcgcaatgccgctgagaattactcgcaaaactcatcagagaggcagcatccaaatttgcacatgaccggtatcaccgatacatcctgggtgctcagtacgacacaacccttttcaagcaccaccgaagaaaccggacttgctgagcccgaacgatgtaactttaccctggccgaaagcaaggctagtagtcatagcgtatctattcagtggaggattctagggagcccttgtaatttctcactcatatatagcagcgacactctaggcgctgccctgtgccctacatttagaattgataacacaacctatgggtgtaacttgcaggatttgcaggccggtactatttacaactttagaataatctcacttgacgaagagcggactgtggtgctgcagaccgaccccctgcctcctgcccgttttggcgttagcaaggagaaaacaaccagtacttccctgcacgtgtggtggaccccctcgtccggcaaggtcacgtcatatgaggtgcaattatttgacgagaataaccagaaaattcagggagtgcagatccaagaaagcacatcttggaacgagtatacattcttcaacctgacagctggcagtaagtataatattgccatcaccgcagtctctggtgggaaacggtcattctctgtgtacactaatggcagcacagtgccttctccagtgaaagacattggaatcagcaccaaagcgaactctctcctgataagttggtcccatggcagcggcaacgtggaaagatacaggctcatgttaatggataagggcattcttgtccatgggggagtagtggacaagcatgcaacctcatacgcctttcatggcctcacccctggttacctgtacaacctcacagttatgaccgaggccgctggtctgcaaaactatcgctggaaactggtgaggacagcgcctatggaggttagtaacctcaaggttacaaacgatggcagccttaccagtttgaaggtcaagtggcagaggcctcccggaaatgtggacagctacaatattaccctgtcccacaaaggtacaatcaaagagtcacgcgtgctcgcaccgtggattacggaaacccactttaaggagctggtgccgggtcgcctgtaccaagtgacagtaagctgcgtgtccggcgagctgagtgctcagaagatggccgttgggaggacgttccctgataaagttgctaatctagaagccaacaataatggtagaatgagatccttagtagtgtcatggtcccctccagcgggagactgggaacaatatcgaattctgctgtttaacgactcagttgtccttttaaacatcactgtgggcaaagaggagacacagtacgtaatggacgacaccggtttggtgccaggaagacagtatgaagtagaggtgatagtcgagtccggcaacctgaagaatagcgaaaggtgccagggccgaacagtacctcttgcagttctccaactgcgagtgaaacatgctaacgaaacaagcttgagcattatgtggcagaccccagtggccgaatgggaaaagtatattatcagcctcgccgaccgagatcttctgttaatacacaagagtctgtcgaaggatgccaaggagttcaccttcacagacctggtcccgggacggaagtatatggccaccgtgacgtcaattagcggggacttgaaaaattcaagcagtgtgaagggcaggacagtccctgcgcaggtgaccgacctgcatgttgcgaaccagggaatgactagttccctgttcaccaattggactcaagcccagggcgatgtcgagttctatcaggtactgctgattcatgagaatgtggttataaagaatgagtcgatttctagcgagacatcccggtatagctttcattctctcaagtcaggatcactgtatagtgtcgtggtgaccacagtgtctggtggaatctctagccggcaagtagtggtcgaggggagaacagtgccctctagtgtgtctggagtcaccgttaacaactccgggaggaacgattacctctccgtctcctggctgctggcacccggagatgtcgataattatgaggtcacactgtcccacgatgggaaagtggtgcaaagcctcgtgattgcaaagtcggttcgagagtgctccttctctagtctgacacctggtagactgtatactgtcaccataacaacacgaagcggtaaatacgaaaaccactctttctcccaggaacgtaccgtccctgacaaagtgcagggagtcagcgtaagcaattccgccagaagtgactacctccgggtctcctgggtgcatgcaacaggagatttcgatcactatgaggttaccattaaaaacaagaataactttatccagacaaagagcattccaaagagcgagaatgagtgtgtctttgtgcagctggtcccagggcgtctctatagtgtcacagtgaccaccaagagtggtcaatatgaagccaatgaacaggggaatggcaggacaatccctgaaccagtaaaggatctcacactccgcaaccggtctaccgaggatctgcacgtgacgtggagtggcgcaaacggagatgttgaccagtatgagatacaactgctgtttaacgacatgaaggtattccctccctttcatctggttaacacagccactgaatatcgttttacatctctcacccccggaaggcagtacaaaatcctggtgctgacaatcagcggcgatgtacagcagagcgcatttattgaggggttcaccgtaccatcagctgtgaagaatattcatatatctcccaacggcgctaccgactcgctgacggtgaattggaccccagggggaggtgacgtagattcctacaccgtgtccgcattccgccactcccagaaagtggattcgcagacgattcccaagcacgtcttcgagcatacctttcaccgcctagaggctggcgaacagtaccagatcatgattgcaagcgtgagtggatctctgaagaaccagattaatgttgtcgggcgtacagtgcctgcatccgttcagggagtgatagccgacaatgcctactcttcatactcattaatcgtgagttggcagaaagctgccggtgtagccgagcgctatgacattctgctcctgaccgagaacggtatcctgctgcgcaacacctccgagcccgctaccacgaagcagcataagtttgaagacttaactccgggtaagaaatacaagatccaaattctcactgtgtccggtggactgttttctaaagaagctcagaccgaaggtaggactgtgcctgccgcagttactgacctgcggataaccgaaaattccacgcggcacctgtcgttccgatggacagcatctgagggagaactgtcctggtacaatatcttcctatacaacccagatggcaatcttcaagagagagcacaggtcgaccctctggtccagagcttcagctttcagaacctacttcagggcagaatgtacaagatggtgattgtcacacacagcggagagctgagcaacgagtcctttatatttgggaggactgtgcctgcatcggttagccatttgcgcggttccaacagaaataccaccgactctttgtggtttaattggagcccagctagcggcgattttgatttctacgagctgattctctataaccccaatggcaccaaaaaagagaattggaaagacaaggacctcaccgagtggagattccagggcttggtaccaggccgaaagtacgttttgtgggttgtcactcattctggggatttgagtaataaagtaaccgcagaatcaaggaccgcaccaagccctccaagtctaatgtcgtttgccgatattgccaacacatcactcgccattacatggaagggccctcctgactggacagactataacgattttgaacttcagtggttaccgagagatgcactcacagtctttaacccttacaataacagaaaaagcgaggggaggattgtgtacggattgcggcctggcagatcgtatcagttcaacgtgaagacagtcagcggagacagttggaaaacttatagcaagccaatttttgggtctgtgcggactaagcctgacaagattcagaaccttcactgcaggccccagaattcaactgctattgcttgttcctggattcctccggatagcgactttgacggctacagtattgaatgccgcaaaatggacactcaggaggtggagttttctagaaagctggaaaaagaaaagagcctactgaacatcatgatgcttgttccacataagaggtacctggtctccattaaggtccaaagcgcaggcatgacaagcgaagtcgtggaggactctaccataaccatgatcgatcgcccaccacctcctcctccccacatcagggtcaatgagaaggacgtcttgatttcgaaatcctctataaactttaccgtgaattgcagctggttctcagacacgaatggggcagtaaagtacttcaccgttgtcgtccgcgaggccgacggaagtgatgaattgaaacccgaacagcagcaccccttaccgtcctatctggaatatcggcacaatgctagcataagagtttatcaaacaaactacttcgcctctaaatgtgccgagaatcccaattcaaactctaaaagctttaatattaaacttggcgcagaaatggaaagcttgggcggtaaatgtgatcctacacagcagaaattctgtgatggcccactcaaaccacatactgcataccgcatcagcataagagcatttacccagttgtttgacgaagaccttaaggaatttaccaaaccactgtattccgacacgttcttttccctgcccataaccactgaatcagagcccctgttcggcgcaattgagggggtgagcgcaggcttgttcctgattggaatgctcgtggccgtcgttgcactcctgatctgcagacagaaggtctctcacgggagggaacgaccttctgccagactgtctattcgccgagataggcccctgagcgtacacctgaaccttggacagaaagggaaccggaagacaagctgtccgattaagatcaaccaatttgagggccattttatgaaactccaggccgacagtaattatctgctgtctaaggaatacgaagagttaaaagacgtgggcaggaatcagtcatgtgatatcgcgctcctaccagaaaatcggggaaagaacaggtataacaatattttaccctacgatgctaccagagtgaagctcagcaatgtggacgacgatccatgctccgattacattaatgcctcttacatcccgggtaacaacttcagacgcgaatatattgtcactcagggacctctgcccggaaccaaagatgacttttggaaaatggtgtgggaacagaacgtccataatatcgtgatggtgactcagtgcgtagagaaaggccgtgtaaagtgcgatcattactggcccgctgaccaagattctctgtactatggggatttgattctgcagatgctatccgagagcgttctgcctgaatggaccataagagagttcaaaatttgcggagaggagcagctggacgcgcacaggttgattcgccatttccattacactgtttggcccgatcatggggtcccagagacaacacagagcttgattcagtttgttaggactgtgcgcgactacattaatcggtcccccggtgctggaccaaccgtagtgcattgcagtgcgggagtgggtagaacagggacatttattgccctggaccgaatcctccagcagttagacagtaaagatagtgtcgacatatacggcgcagtacatgacctgcgcttgcatcgggtacacatggtgcagactgagtgtcagtacgtgtacctgcaccagtgtgtgagggacgttttaagagcgaggaaactgcggtctgagcaggaaaaccccctgttccctatttatgagaacgtgaatcccgagtaccaccgggatcccgtttattctagacatta

SEQ ID NO: 237104 - DNA, 5723 bp, Artificial Sequence
  Description of Artificial Sequence: Synthetic coding sequence
atgctaagccacggtgctgggcttgctctatggattaccctgtctctgctgcagacgggcctggcagaaccagagaggtgcaatttcaccctggcagaatccaaggcaagttctcactcagtatccattcaatggagaattctcggatcaccctgtaatttttcacttatatattcatccgacacacttggggcagcactctgccccactttcaggatcgataatactacatacgggtgcaacttacaagacctgcaagcaggcacaatctacaattttaggataatcagtctcgatgaggagcgtacagtcgtgctccagactgacccactgcctccggctaggtttggggtgagcaaggagaagaccacttccactagcctacatgtgtggtggactccatccagcggaaaagttaccagttatgaggtacagttgttcgacgagaataatcagaagatccagggcgtccagatacaggagagtacatcgtggaacgaatatacgttttttaatcttaccgcgggatcaaaatacaacattgccattacggccgtcagcggaggtaagcggagcttcagcgtttacacaaatggaagcacggtcccttcacctgtgaaagatattggtatctctaccaaggcaaatagcctgctaatatcatggtctcacgggtccgggaacgtggagaggtacaggctgatgcttatggataagggcatactcgtgcacggcggagtcgtcgataagcacgcgacaagctatgcttttcacgggttgacaccaggttacctgtataacctcactgttatgacggaagcagccggattgcagaactaccgatggaaactcgtcaggacggctcccatggaggtgtcaaacctcaaggtgacaaatgatgggtcattaacttccctcaaagtgaagtggcagagaccacctgggaatgtggattcttacaacattacgctgtcccacaaaggaactataaaagagagtcgggtcctagcaccttggataactgaaactcattttaaggagcttgttcctggaaggctctatcaggtaacggtaagttgcgtctcgggcgagttgtctgcgcaaaaaatggctgttggaaggacgtttcctctcgcggtcctgcagctccgcgtgaagcacgcgaatgagacctcgctgagcattatgtggcagacacccgtggctgaatgggagaagtacatcatctccctggccgacagagacttgctgttaatccataaaagcctgagcaaggatgccaaggagttcacattcactgatctcgtacctggcagaaaatacatggctactgttacttccatctccggggatttgaaaaatagttcatcggtcaaaggtcggaccgtgcccgcacaggttactgatctgcacgtcgcaaaccagggtatgacatcaagcttattcactaactggactcaggcccagggcgatgtagagttttaccaggtgctgctgatccacgagaacgtcgtcatcaaaaatgagtccatcagttcggaaacctcccgatactcattccactcgttaaagtccgggtctttgtactccgttgtcgtaaccacagtttctggcggtatttcctcgagacaagtcgtagtcgaggggcgaacggtgccttctagcgtatccggtgtgaccgtgaacaattcaggccgaaatgattacttgtcagtgagttggctcttggctcctggggacgtggacaattacgaagtgaccctcagccatgatgggaaagtggtgcaaagtctcgtgatagcaaagtcagttcgagaatgttctttctcttcccttactcccggtaggttgtacactgttacaatcactacaaggtctggcaaatacgaaaaccattcatttagtcaagaaagaaccgtgcccgacaaagtccagggcgtctcagtgtccaattcagcacgctccgactacctccgcgtcagttgggtgcacgccacgggggattttgaccattatgaggtcactatcaaaaataaaaacaactttattcagaccaaaagtattcccaagagcgaaaatgagtgtgtgttcgtgcagttggtaccgggtagactttatagcgtgactgtcacaacaaaatcaggccaatatgaagctaacgagcaagggaacggccgaacaatcccagagccagtcaaggatctaacactgaggaaccgttccacggaagacctccacgtgacatggtccggcgcaaacggtgatgtggaccagtatgagattcagttgctctttaacgacatgaaagtgtttcccccattccacttggtcaatactgccacggagtatcgtttcacctccctgacaccaggcaggcagtacaaaatcctggtgctcaccatatcgggtgacgtgcagcagtcagcttttatcgagggcttcaccgtgccgagtgccgtgaaaaatattcacatctcaccaaacggagcaacggactcattaaccgtaaattggacccctggcggaggcgacgttgactcgtataccgtgtcagccttccgccattcgcaaaaggtagacagtcagaccattccaaaacacgtttttgagcatactttccatagactggaggccggagagcagtaccaaataatgatcgcgtcagtgtccggctcgctgaagaatcagatcaacgtcgtgggcaggacggtgccagcctctgtgcaaggtgtgattgcggataatgcctattcctcctactccctgattgtgtcctggcagaaggctgcaggtgtggcagagaggtatgatatactcctgctgacagaaaacggcatactgctgaggaacacttccgaacctgctactaccaaacagcataagttcgaggatctcacccctggcaagaaatataagatacagatccttaccgtcagcggcggtctgttctccaaggaggcgcagacagagggaagaactgtgccagctgctgttactgacctgaggatcaccgaaaatagtacgaggcacctgtcctttcggtggacagccagcgagggtgagttaagctggtataatatctttctctataatcccgacggaaacctgcaagagagggcccaggtcgaccccttggtccagtctttcagctttcagaatctgctgcaaggtcggatgtacaaaatggtgattgtcacccattcaggcgagttgtcaaacgaaagcttcattttcggtcggacagtgccggcttccgtaagtcatctccggggaagtaacagaaacaccaccgactcattatggtttaactggtctcctgcttccggcgacttcgatttctatgagctgatcttatataaccctaacggtacaaaaaaggaaaattggaaggacaaggacctcactgagtggcggtttcaaggactggtgccaggtcgaaagtacgtgctatgggtggtcacccactccggggatctgtccaataaagttaccgctgagtccagaactgcacccagtccgcctagtctgatgtctttcgcagacatcgccaacacatccctcgctataacatggaagggcccaccagactggacagattataacgacttcgaactacaatggctgcccagggatgccctcactgtgttcaacccatataacaaccgcaagagcgaaggcaggatagtttacggactcaggccgggaagaagctaccagtttaacgttaagaccgtcagtggcgactcctggaagacatattccaaacccatctttggaagcgtgcgcactaaaccagataaaattcaaaacttgcactgtagaccccagaactctactgctatcgcttgcagctggattccccctgatagtgattttgacggttacagtatcgaatgcagaaaaatggatacacaggaagtcgaattctcgaggaagctggagaaagagaaaagcctgctgaatatcatgatgctagttccacacaaacggtatcttgtctcaataaaagtccagtccgcgggaatgacttcagaggtggtagaagattcaacgatcactatgatagaccgccctcctcctccacccccacacatacgggtgaacgaaaaagacgtcctcataagcaaatcctctatcaattttaccgtgaattgtagctggttcagcgacaccaatggagccgtgaagtactttacagtggtcgtccgggaggccgacggaaatgacgaactgaagcctgagcagcaacaccccctcccctcttatttggaataccgacacaacgcctcgatccgggtgtaccagactaattacttcgcatccaaatgcgctgagaatcccaactctaattcaaaatccttcaatattaaactgggggcagagatggagtctctcggaggtaagtgtgaccctactcagcagaaattctgcgacgggcctctcaagcctcacacagcatacagaatctctattcgtgctttcactcaacttttcgatgaagaccttaaagagttcacaaagcccttgtactcggataccttcttctccttgccaatcaccaccgagtcagagcctctcttcggagcaattgaaggagtgagtgccggtttgtttctgattggcatgctagtcgccgtggtggcgctcctgatttgtagacagaaggtctcccatggacgggagagacccagtgcgcgactgtctattaggagagaccggccactgagcgtccatctcaacctaggccagaaggggaaccgcaaaacgtcatgccctattaagattaaccagtttgaagggcacttcatgaaactgcaggctgacagcaactatcttttgagtaaggagtacgaggagctcaaggacgtcggccgaaaccagtcctgcgatatcgccctgcttcccgaaaacagggggaaaaacaggtacaacaacatactcccctatgacgccacccgggtgaaactgtctaatgttgatgatgacccctgctcggattacatcaatgcatcctacattcccggtaacaatttcaggcgagagtatattgtaacacagggtccactgcccggtactaaggacgatttctggaaaatggtgtgggaacagaacgtccacaacattgtgatggttacacagtgcgtagaaaaaggtcgcgtcaaatgcgaccattactggccagccgaccaggattcactctattatggggatctgatcttgcaaatgctctctgagagcgttctgcccgagtggacaatacgcgagttcaaaatttgcggagaagagcagctagatgcacaccgactgatcagacatttccactacacagtgtggccagatcatggcgtccccgagactacccagagtttaatccagtttgtgaggacggttagagactatattaacagatcacctggcgcaggcccaacggtggtgcattgctcagccggtgtgggaaggacagggactttcattgctctggatcgaattctgcagcaattggactctaaggactcagtcgacatttatggggcagtgcacgacttgagactgcacagagtccacatggtgcagaccgaatgtcagtatgtgtacctccatcagtgcgttcgggatgtcctgcgggcaaggaaactccggagcgaacaggagaatcctctattccctatatacgagaatgtaaaccctgagtaccacagagacccagtgtacagccggcacta

SEQ ID NO: 237105 - DNA, 2760 bp, Artificial Sequence
  Description of Artificial Sequence: Synthetic coding sequence
atggaggccgaattttacatggtgattctgacctgcctgatttttcgaaattctgaggggttccagatcgtgcacgtccagaaacagcagtgcctgtttaagaacgagaaggtggttgtgggatcttgcaaccgcactatccagaatcagcagtggatgtggacggaagacgaaaaactgctgcacgtcaagtccgccctctgcctggccatctccaacagctcacggggaccttcgcgctctgccattcttgacaggtgttcccaagctcctagatggacctgctacgaccaggagggatttttagaagttgagaacgcatcgttgttcctgcagaaacagggatcccgcgttgtggtgaagaaagccagaaaatacttgcatagctggatgaaaatcgacgtgaacaaggagggcaaactggtgaacgaaagcttgtgtctccaaaaggctggacttggagcagaggtgagtgtgcggtcaacgagaaatactgccccacctcagattttgacaacctttaatgcagtacctgatgggctggtcttcctgattcgcaacactaccgaagcttttataaggaacgcagcagagaattacagccagaacagcagcgagcgccaacacccgaatttgcacatgactgggattactgacacaagctgggtactgagtaccactcagccattctcttcgacaacagaagagactgggctggctgagccagagcgttgtaactttacactcgctgagtctaaggcgtcttcccatagcgtctctatccaatggagaatattggggtcaccctgtaacttttcactgatatactcgagcgacactttgggagctgcgctgtgtcccactttccgcatcgataatactacctacggatgcaacctgcaggatctccaggctggaaccatctacaatttccggatcatatccttagatgaggagcggacagtggtgttacaaacagacccgctgccccctgcccgattcggcgtctctaaagagaagacaacatctacatcgttacatgtgtggtggactccatctagtggcaaagtcacatcatacgaagtccagctatttgacgagaataaccagaagattcagggcgtgcaaattcaggagtctacaagctggaatgaatacaccttttttaacctcactgccggaagtaaatataatatagcaatcacagccgtctccggaggcaagaggagttttagtgtatacacaaatggctcaaccgtgcccagcccagtgaaagacatcgggataagcaccaaagcaaactctttgttgatatcttggtcacatgggagtggtaatgtggagcggtacagactgatgcttatggataagggaatcctggtccatggcggtgtggtcgataagcacgcaacttcttacgcctttcatgggcttaccccagggtacctttacaatctgactgtgatgacagaagcagcgggattgcagaactaccggtggaagctggtgagaacagctccaatggaagtatcgaacctaaaggtgaccaatgatggaagcctgacctctctcaaagtgaagtggcagcgacccccaggcaacgtagattcttacaacatcaccttatctcataagggcaccataaaggagtcccgcgtcctcgccccttggattaccgagactcactttaaagagctagtcccaggtcggctctatcaggtcacagttagctgcgtaagcggtgaactctctgctcagaagatggccgttggacgaacattccctgataaggtggcaaatttagaggcgaacaacaacggtcgaatgcgttctttggtggtatcatggtctccccctgccggtgactgggaacagtataggattcttctcttcaacgattccgtcgttttgctgaatattaccgtgggcaaagaagaaacacaatacgtcatggatgatacgggactcgtgcctgggaggcaatacgaagttgaggtgattgttgaatccggcaatctgaagaattccgagcgttgccagggaagaacggtgcccctggctgtcttacaattacgggtcaagcatgctaacgaaacctctctgtcgatcatgtggcagacacctgtggctgagtgggagaagtacattatcagcctggcagatagagacctccttttaattcataaatcactaagtaaggacgccaaggaatttaccttcacagatcttgttcctggaaggaagtacatggcgaccgttaccagcattagtggagacctcaaaaatagtagctccgttaagggcaggactgtgccggctcaggtaaccgatttacacgtggcaaaccaggggatgacatcttcgctgtttactaactggacccaggcccagggcgatgtggagttttatcaggtgttgctgatccacgaaaacgttgtaataaagaacgaaagtatcagttctgagactagcaggtactcgttccactctctcaagtccggaagcctgtacagcgtagtggtgactacagtgagtggcggtataagtagccgacaggtcgtggtggagggcagaactgtgccggacaaagttcagggtgtgagtgtctctaattccgcaagaagtgattacctgagggtctcttgggtgcacgctacaggggacttcgaccattacgaagttaccattaaaaacaagaacaactttattcagacaaaagcatttccttcccaaaagaccaacgtttacttatttagttag

SEQ ID NO: 237106 - DNA, 5723 bp, Artificial Sequence
  Description of Artificial Sequence: Synthetic coding sequence
atgctgagccacggcgcaggcctggccctctggattacacttagcctgcttcagaccggcctggcagagcctgagagatgtaactttactttagccgaatccaaggcgtcaagccactcagtctctatccaatggcgcattctcggatccccttgcaatttttctcttatttattcttcagacacactaggggctgccctatgcccgacattccgtattgacaacactacatacggatgtaacctgcaggacctgcaggccggaacaatctataattttcgaatcatcagcctggatgaggagcggaccgtggtgctccaaactgatcccctgccaccagctcgcttcggtgtttctaaagaaaaaacgactagtacctcactccatgtgtggtggacaccttcgtctgggaaagtgacttcttacgaggtacaattattcgacgagaacaatcaaaaaatccagggggtccaaattcaggaaagcacgtcgtggaacgagtatactttcttcaatctgactgccggttctaaatacaacatcgccatcactgccgtgtctggaggtaaacggtccttttcagtatacacaaacggcagcacagtcccttctcccgtaaaggacatcggcatcagcaccaaggccaacagcctacttatatcctggtctcacgggtccggtaacgtggagcgctatcggcttatgctcatggataaaggcatcctcgtgcacggaggcgttgtggacaaacacgctacctcctacgctttccatggacttactcccggttatctgtataatcttaccgttatgaccgaagccgcagggctacagaactacagatggaaattggttagaaccgcaccaatggaggtctctaacctgaaagtcacaaacgacgggtccctgactagtctgaaagtgaagtggcaacggcctcctggcaacgtcgacagttacaacatcacccttagccataaaggcacgataaaagaatccagagtcctagctccatggattaccgagacccactttaaggaactggtgcccggaaggctctaccaggtgactgtttcctgcgtatccggagaactttctgctcaaaagatggctgtgggacggacttttccccttgctgtgctgcagcttcgagtgaagcacgccaacgaaacgtcattgtcaattatgtggcaaacacccgtggccgagtgggagaagtacatcatttctctggctgatcgggacttgctgctgatccataaaagcctctccaaagacgctaaagagttcaccttcactgatcttgtgccgggaagaaaatacatggcaaccgtgacttccatctccggagaccttaaaaattcaagttccgtcaagggccgtacagtgcccgctcaggtgacagacctgcacgtagcgaaccagggaatgacatcatctttgtttaccaactggacacaggcgcagggtgatgtggaattttatcaggttcttctgatccatgaaaatgtcgtgatcaagaacgaatcaatctccagcgagacatccaggtattctttccatagcctcaagagcggctccctttattcagttgttgtcacgaccgtctcaggagggatctcgtctagacaggttgtggtggaagggaggaccgttccttcatctgtctccggggtgacagtgaacaactctggacggaacgattatttgtccgtttcttggctgctagccccaggagacgtggacaattacgaggtgacgttatctcatgacggcaaggttgtgcagagcctcgtgatcgccaaaagcgttcgtgaatgttccttcagctcactcacgcctggcagactgtacacagtgactatcactacacggagtggcaagtatgaaaaccactcctttagtcaagaaaggacagtgccagataaggtgcaaggcgtctctgtcagtaatagcgctaggagcgattatctgagggtgagctgggtgcacgccacaggtgatttcgaccactatgaagtcacaatcaaaaataagaataactttattcagaccaagtctattcctaaatcagaaaacgaatgtgtgtttgtgcagctggttccgggaaggctgtacagtgtaacagtcaccaccaagagcggccagtatgaagcaaatgaacagggcaatgggcgtacaatccctgaaccagtgaaggatctgactctgaggaacaggagtaccgaggacctacacgttacctggtccggcgctaatggcgatgtcgaccagtatgaaatccaacttctgtttaacgatatgaaagtattcccacccttccatctagttaacacagcgaccgagtaccgtttcacctcacttaccccaggaaggcagtacaaaattcttgtgttgacaattagcggagacgttcagcagtcagcgttcatagaaggcttcaccgttccctccgcagtcaagaacattcacatatctccaaacggcgcaaccgatagcctgactgtgaactggaccccgggaggaggggacgtggactcatataccgtgtcagcctttcgtcattcgcagaaagtcgactcccagactatccccaagcacgtttttgagcacacatttcatcggttggaggcgggtgaacagtaccagatcatgatcgcgagtgttagcggcagccttaaaaaccaaataaacgtggttggaagaacagtaccagctagcgtgcagggagttatagctgataacgcctacagttcttacagtctcatagtctcttggcaaaaggccgctggcgtagccgaacgatacgacattctgctgttaactgaaaacgggatactgctccgaaacacctctgagcctgctacgaccaagcagcacaagtttgaggatctaacgccaggcaaaaaatacaagatacagatcctgaccgtttctggaggattgttttcaaaggaggcacagacggaaggaagaacagtgccggctgccgtcactgatttgaggattaccgaaaatagcacgaggcatctgagcttccgttggacagcgagcgagggcgaattgtcctggtacaacattttcctctataatcccgacggcaacctgcaggaacgtgctcaggtggatcccctcgtgcagtccttcagtttccagaatctgcttcaggggaggatgtataagatggttattgtgacacactctggtgagttaagcaacgagagcttcatcttcgggagaacagtcccagccagtgttagtcatctgagaggcagcaatcgcaataccaccgactctctctggttcaattggagccctgcgtccggcgattttgatttttatgagctaattctgtataacccaaacgggaccaagaaagaaaattggaaagataaagaccttaccgagtggagattccagggcctggtaccaggccgtaaatacgtcctgtgggtggtgacccactcgggggacctgagcaacaaagttacagctgaaagccggaccgccccatcccccccttcactcatgagcttcgctgacatcgccaacaccagtctcgccataacatggaagggtccacctgattggacagattacaacgactttgaactgcaatggttgccaagagacgcccttaccgtttttaacccatataacaatcgaaagagtgaggggcgtatagtctacggacttagacccggaagaagttatcagttcaatgttaaaaccgtcagtggtgacagttggaagacctattcaaagcctatctttgggtcagtgcgcaccaaacctgataaaattcagaacctgcactgccgcccacagaatagtaccgccatcgcatgcagctggataccccctgacagtgacttcgacgggtatagcatagagtgcagaaaaatggatactcaggaggtggagttctcacgtaagctggagaaagagaagagcctgctgaatatcatgatgctcgtgcctcacaaacgatacttagtgtctatcaaagtccagagcgcagggatgaccagtgaagtagtagaggatagtaccattaccatgattgataggccaccgccaccaccccctcatatcagggtgaatgaaaaagatgttctaatcagcaagtcttccataaattttactgtgaattgctcatggttcagtgataccaacggagctgtcaagtactttacagttgtggtgagagaggccgatgggtcagacgagcttaaacctgagcagcaacaccctctgccaagctatctcgaatatcgtcacaatgcctccattcgtgtctaccagacaaattactttgccagcaaatgtgctgagaacccaaacagcaattctaagagttttaatattaaactcggagctgaaatggagagtctcggaggaaagtgcgacccaacacagcagaagttttgtgacggcccactgaagccacatacagcgtaccgtatcagtatccgggcttttacacaactctttgatgaggacctaaaagaattcaccaaaccactctattctgacacattcttttcactcccaatcaccacagaatcagaacccctgttcggtgcaatagaaggcgtgtccgctgggttgtttctgattgggatgctggttgcggtggtggctctgctgatctgcaggcaaaaagtgtctcatggccgagaaagaccttctgctcgtctctccataagaagggaccgacccctgtccgtgcatctcaacctggggcagaaggggaaccgcaagacctcgtgtccaatcaagatcaatcagtttgaaggccacttcatgaaactgcaggccgattccaactatctcctcagcaaggagtatgaggagttgaaggacgtggggagaaatcagtcatgtgatatcgctctgctacccgagaacagaggaaaaaaccgctataacaacatcttgccctatgacgcaacacgggttaagctatcaaatgtcgatgatgacccctgcagtgactacattaatgccagctacattccaggaaataattttaggcgggagtacatagtaacacagggacccttacctgggactaaagatgacttttggaagatggtttgggaacagaatgtccataatattgttatggttacacagtgcgttgagaaaggtcgcgtcaagtgcgatcactactggccagctgaccaagacagtctgtactatggcgatcttatactgcagatgctgagcgaatcagtccttcccgagtggactatccgagagttcaagatctgtggggaggagcagcttgacgcgcatcgactaatacgccacttccattataccgtgtggcctgaccacggcgttcctgaaacaacacaatcgctaattcagtttgtccggactgtacgggactatattaatcgctcccccggagcaggaccaacagtcgtccattgttctgctggggtaggcaggaccggcacattcatagccctggacagaatcctgcagcagctggattctaaggactctgttgatatttacggtgccgtgcacgacctgcgcctgcacagggtgcacatggtccagaccgagtgccagtatgtctacctgcatcaatgtgtgcgagacgtcctccgcgctcgcaagctgcgttccgaacaagaaaaccccctgttcccgatttatgagaatgttaatcccgagtaccatagagacccggtttattctaggcatta

SEQ ID NO: 237107 - DNA, 621 bp, Artificial Sequence
  Description of Artificial Sequence: Synthetic coding sequence
atggccttaccttgtacacttgggctcggtatgcttctagccctgcccggtgccttgggtagcggcggatctgctgaggattctgttggaagtagctctgttacagtcgtgctgctcttgctgctcctcctgctgctggccaccggtttagcgcttgcatggagacgcctctcccgggattctggtgggtactaccatccagcgcgactgggggctgctctgtgggggaggacccggaggttattatgggcctctccacctgggagatggctacaggctcgtgccgagctgggctccactgataatgacctcgagcggcaggaggacgagcaggacacagactatgatcacgttgccgatggcggtcttcaggctgatcctggtgagggggagcagcaatgtggggaagcctcctcgcctgaacaggtgccagtgcgtgccgaagaggccagagactccgacaccgaaggggacttagtcctcgggtcgcctgggcctgcaagcgccggaggctcagcggaggccttactgtctgatctgcacgcctttgccggaagcgccgcatgggatgatagcgctagggcagctggcggtcaaggcctgcacgtgaccgcgctatag

SEQ ID NO: 237108 - DNA, 4152 bp, Artificial Sequence
  Description of Artificial Sequence: Synthetic coding sequence
atggtccacgtggctaggctacttctgcttctgctgaccttttttttgcggaccgatgcggaaaccccaccgcgtttcacacgaacccccgttgaccaaacgggagtgagtggcggagtggcatctttcatctgtcaggcaacaggagatcctaggccgaagattgtgtggaacaaaaagggaaaaaaagtctcgaaccagcggtttgaggttatcgagttcgatgatggatccggctcagtgcttcggatccagcccttacgcactccaagagacgaggccatatacgagtgtgtggcgtctaacaatgtaggagaaatttcagtctcaacgagactgaccgttcttagagaggaccagattcctcgcggattcccaacaatagacatgggaccccaactaaaggtggtggaaagaacaagaaccgctaccatgttgtgtgcggcatccggcaacccagatcctgaaataacttggttcaaagacttcctgcctgtggacaccagcaacaataacggaaggatcaaacaacttcgatcggtgagcgtgtgcgccacgtatcacactggggcactgcagatcgaacagtccgaggagtctgatcaagggaaatatgagtgcgtagctaccaacagtgccggtacaaggtacagtgccccagcaaacttgtacgtccgcgtgaacagaaaggtgcggagggttcctccacggttcagcattccacccactaaccacgagattatgcccggtggtagtgtgaacattacatgcgttgccgtgggttctcccatgccgtatgtcaagtggatgcttggggctgaggacttaaccccagaggatgacatgcccatcggtagaaacgtgctggagctgaatgacgtgcggcagtctgcgaactatacttgcgtcgccatgagcaccctcggggtgatcgaggctatagcccagattacagtgaaggccctaccaaagcctcctggtactccagtcgtgacggagtcgaccgctacttcaattacccttacgtgggacagtggtaaccccgagcctgtaagttactatatcatccagcacaagcccaaaaacagtgaggagctgtataaagagattgacggagtagctactacccggtacagcgtagccggactgtccccatattccgattacgagttcagggttgtagccgtaaacaatatcggccgaggacctccttccgagcctgtacttacccagacctcagaacaggccccaagctccgccccacgggacgtccaagctcgcatgctcagcagcactactatactggtacagtggaaggagcctgaagaacccaacgggcaaatccaaggttacagagtgtactacaccatggaccccacccagcacgtgaacaactggatgaaacataatgtcgccgatagtcagatcacaaccattggaaacttagtgccacaaaagacatactcagtgaaagtcctggcattcaccagcatcggcgatggaccgctctcatctgatatccaggtgatcacgcaaaccggcgtgccgggtcaacccctgaatttcaaagctgaacctgaatccgagacatctatcctgctcagttggactcccccacgatccgacactatcgcaaattatgaactcgtatataaggacggcgagcacggcgaagaacagcgaattacaatcgagccaggcacctcatatcgattacagggattaaaacccaactcactgtattacttcagattagctgctaggagcccccaaggactcggggcttccactgctgagataagcgctcgaacaatgcagagctctaaagggtattatattattatcgtccctctgaagaagagtcgcggaaagttcatcaagccttgggaatctcctgatgaaatggaattggatgaactactcaaggagattagccggaaacggagatccatccgatatgggagggaggtcgagctgaaaccctatatcgcagcccactttgatgtactcccaacagagttcaccctgggggatgacaagcattatgggggattcactaataaacaactgcagagtggtcaggaatatgtgttcttcgtgctcgccgtaatggagcacgccgaaagcaagatgtacgccacgtccccatactccgatccagtagtgtccatggatcttgatcctcagccaatcactgatgaagaagagggtttaatctgggttgtcgggccagtgcttgccgtggtcttcatcatctgcattgtcattgctattcttctgtacaagagaaagcgcgcagagtccgattcaagaaaaagttcgatacctaataacaaggagatccccagccatcatcccactgacccagttgagcttcgcaggctcaacttccaaactcccggaatggcctcccaccctccaatcccgatcctggagctcgccgatcatattgaacgcttgaaggctaacgacaatctgaaattctcccaggagtatgaatctatcgacccagggcagcagtttacatgggaacattcgaatcttgaggttaataagcctaaaaaccggtatgctaacgtcattgcgtacgaccattcccgagttcttttgtcagcaatcgaagggatcccaggatccgattatgtcaatgccaactatatcgacggataccgcaagcaaaacgcatatatcgctacccaaggttccttacctgagacatttggggatttttggcgtatgatttgggaacagagaagtgcaaccgtggttatgatgacaaagctggaggagcgatcccgggtgaaatgtgatcaatattggccatctcggggtactgagacgcacggcctcgtgcaggtgactctacttgacaccgtggaacttgcaacctactgtgtgcgcacatttgccctatataaaaatggttcctctgaaaagagagaggttcgacagttccaattcacagcctggcccgaccacggcgtgccggaacatcctacaccatttttagccttcctcaggcgcgtgaagacctgtaatccaccagacgctggaccaatggtggtccactgctccgcaggggtggggcgaacgggatgttttatagtgatcgatgccatgctggagaggatcaaacacgagaagacagtcgacatttacggacacgttacactgatgcgagcccagaggaactatatggtgcagactgaagatcagtacatctttatccacgacgccttgctcgaggccgtaacgtgcggaaacacagaagttcctgcacgaaatttatatgcctatattcagaagctgacacagatcgagactggggagaatgttacaggcatggaattggagttcaagcgcctggcaagcagcaaggcacatacttcaaggtttattagcgctaatctcccttgcaacaaatttaagaataggctggtcaatatcatgccctatgaatctacgagggtgtgcctgcagcccatccggggagtggaagggtccgattacattaacgccagctttatcgatgggtataggcaacagaaagcctacatagccacacaaggccctctcgccgagacaactgaggacttttggcgaatgctttgggaacacaactctaccattgttgtcatgctcacaaaactgcgagagatgggacgcgaaaagtgccatcagtactggccagctgagaggtcagccagataccaatactttgtggttgatcccatggcagagtacaacatgccgcagtacatcttgcgcgaattcaaggtgactgatgcaagggatggccaatctaggaccgttcggcagtttcagtttacagactggccggagcagggggttcccaagtcaggggagggctttattgatttcatagggcaagttcataaaacaaaggagcagtttggtcaggatggtcctatttcagtgcactgcagcgccggagtcggaagaacaggtgtgtttattacactgtctatcgtcttagagaggatgcgctacgaaggcgttgtcgatatattccagactgtgaagatgttgcgtacgcagcgccctgccatggtccagaccgaggatcaatatcagttttcgtatagagccgctctggaatacctgggctcatttgaccattacgctacatag

SEQ ID NO: 237109 - DNA, 4521 bp, Artificial Sequence
  Description of Artificial Sequence: Synthetic coding sequence
atggtgcacgtcgccaggttactgcttctgctactcacgtttttcctcaggacagacgccgagactcccccaaggtttacacggacccctgttgaccagacaggcgtgtccggaggcgtggcctcattcatttgtcaggcaactggcgatccgcgacccaagatcgtatggaataagaagggaaagaaggtgtctaaccagagattcgaggtgattgagtttgatgatggatcaggatccgtcctacggatacagcccctacggactccaagagatgaggccatctatgagtgcgttgccagcaataacgtcggggagatctctgtgagcactcggttgacagtactccgtgaggatcagatcccacggggtttccctactatagacatgggtcctcagctaaaggtggtcgagagaacccgtactgccactatgctctgcgccgcttccggcaaccccgatcccgaaatcacatggttcaaggacttcctccccgtagatacatcaaacaacaacggaaggataaaacagctaagatccgagtctattggcggtacccccatacggggagcactgcaaatcgagcagagcgaggaatctgatcaggggaaatatgagtgtgtggctactaactctgccggtactagatacagcgcacccgctaacctctacgtgcgcgaattgagggaggtgagaagagtgcctccacggttctccatcccccctactaaccacgagatcatgccaggcggatctgtgaatattacttgtgttgccgtcggaagtcctatgccttatgtgaaatggatgctgggcgcagaagacttgaccccagaggacgatatgccgattggtcggaacgtgctagaattgaatgacgtcagacagagtgccaattacacctgtgtcgcaatgtccaccctgggcgtaattgaggccattgcccagataacagttaaggccctgcccaaacctccgggaacacctgttgtaaccgagtcgacggccacttctatcaccctgacgtgggacagcggcaatccggagcctgtgtcctactacatcatccagcacaaacccaaaaatagtgaagagttatataaagagatcgatggcgtggccaccactagatattctgttgcgggactgagcccctacagtgactacgagttccgcgtcgtcgctgtgaataatatcggcagaggcccaccctccgaacccgtgctcacacaaacatcagagcaggcgccaagtagtgccccacgggatgtgcaagcgagaatgctaagctcaactacaatactggtgcagtggaaggagcccgaagagcctaacgggcaaattcaaggctaccgagtctattataccatggatcctacacaacacgtgaacaactggatgaagcacaacgtcgccgactcacagatcaccactataggcaatctggttccacagaagacgtattctgtgaaagtcctggcctttactagtatcggggacggcccattgagcagcgatattcaagtgatcacccaaaccggagtgccgggacagccactgaattttaaagctgagccagagtctgagacatccattcttctgtcctggaccccccctcgaagtgataccatagccaactacgagctcgtgtacaaggacggcgaacatggggaagaacaacggataacaatcgagccaggcacctcctacagactgcagggcctgaagcccaacagcctgtactactttaggttggccgctagaagtcctcagggattaggcgcaagcaccgccgaaatttctgctcgcaccatgcagtctatgttcgctaaaaacttccatgtgaaggctgtgatgaagacatccgtcctcttgtcttgggagatcccggagaattataattctgctatgccattcaaaattctttatgatgacggaaagatggtggaagaagtcgatggacgcgcaacccagaagttaatagtgaatttaaagccagagaaatcttacagcttcgtgctgaccaatagagggaactccgccggaggcctgcaacaccgcgtgacggcaaaaaccgcccctgacgtgctgcgcactaaaccagccttcataggaaaaacaaacctggatggcatgattaccgtgcaattaccagaggtgcctgcaaacgaaaatatcaaaggctattacataattatcgtgccattgaaaaagagccgcggaaaattcatcaagccttgggagtccccagatgaaatggagctcgacgagttattgaaggagatatccaggaaacgtcgatctatccgttacggcagagaggtggaactaaagccttatatcgcagctcactttgatgttctgccaaccgagttcactttgggagatgataagcattatggagggttcaccaacaagcaacttcagtcggggcaggagtatgtgttttttgtacttgccgtcatggagcatgctgaaagtaagatgtatgcaacaagcccatattctgatcctgtggtatccatggacttagaccctcagcccataaccgatgaagaagaaggcctcatttgggttgtgggcccagtgctggccgtggtctttattatatgcatcgttatagcgatattgctttacaagagctcgaaaccagaccggaagagagccgaatcagacagtcgcaagtcctcgatacccaataataaggagatcccgagccatcatccgacagaccctgtagaactgcggcgtctgaattttcagactccaggaatggcctcccaccccccaattccgattctcgaattagccgaccacattgagaggctgaaagccaacgacaatctgaaattcagtcaggaatacgagtccatcgaccccggtcagcagtttacctgggagcatagtaacctggaggttaacaagccaaagaaccggtacgctaacgtcatcgcttatgaccactctagagtcctcctgtcggccatcgaagggatccctgggagtgattacgtcaacgctaattacatcgatggctaccgtaagcagaacgcctacatcgctacacaaggcagcctgcccgagacatttggggatttttggcgaatgatctgggaacagagatccgcaaccgtcgtgatgatgaccaaactggaggagaggagccgggtcaagtgtgatcaatactggccttctagaggcacagagacacacggacttgtccaggtgaccctccttgacacagtggagttggccacatattgcgtgaggactttcgctctgtacaagaatggcagcagtgagaaacgggaggttcgtcagtttcaatttacagcctggccagaccacggtgtgccggagcaccccacaccctttctcgcctttctgcgcagggtgaaaacctgcaatcctcccgacgccggtcctatggtggtccactgttccgccggagtgggaagaaccggctgctttatcgtgattgacgcgatgttggagaggatcaagcacgagaagacagttgacatctatgggcacgtgacgcttatgagggcccaaagaaactatatggtgcagacagaagatcagtacatcttcatacatgacgcactactcgaagcggtgacctgcgggaacacagaggtgccagctcgaaacctttacgcttacatccagaaactcacacaaattgagactggcgaaaatgtgactggtatggagctggaatttaaacgactggccagcagtaaagcccatacgtctagattcatctctgccaatttaccgtgcaacaagttcaagaaccggctagtaaacattatgccctatgagagtaccagagtatgccttcaacccattcggggagtggagggtagtgactacattaatgcgtcgtttatagacggctacaggcaacagaaggcctacattgctacccagggccctctggcagagactacagaagacttctggcgcatgttgtgggaacataacagcaccatcgttgttatgctgactaaattgcgggagatggggcgagaaaagtgtcaccagtactggcccgcagagcggtcagctcgctaccagtattttgtagtggacccaatggctgaatataatatgccacaatacatactgcgtgagttcaaagtgacagacgcgagagacgggcaaagtcggacagtgcgtcagttccaattcactgactggccggaacagggagtgcctaagagcggcgagggctttatcgattttatcggtcaggtgcataaaactaaagagcagttcggacaggacgggcctatctcggtgcactgctctgcgggtgtcggcaggactggcgtcttcattaccctttcgatcgtgttggaacggatgcgttacgaaggggtggtagacattttccagaccgtcaaaatgctgcgtacacaaagaccggctatggttcagacagaggaccagtaccagtttagctaccgggcagcactggagtatctgggcagctttgatcactatgccacttag

SEQ ID NO: 237110 - DNA, 5738 bp, Artificial Sequence
  Description of Artificial Sequence: Synthetic coding sequence
atggtgcatgtcgcgcgacttttactgctactcctcacattcttcctgcggactgacgctgaaactcctccgcgatttacacggacaccagtggatcagaccggagtgtcaggaggcgtggcaagctttatctgccaggctaccggcgaccctcggccaaaaatagtgtggaacaagaaggggaagaaagtttccaatcagagattcgaagtcattgaattcgacgacggaagcggctctgtactccgcatccagccgttgagaactcccagagatgaagccatctatgaatgcgtggcctcaaacaatgttggggagataagcgtgtcaactcggcttacggtgctgagagaggaccaaatacctcgcggttttccaaccatcgacatgggccctcaattgaaggttgtcgagaggacgagaactgccaccatgttgtgcgctgcgtctggtaatcctgatccagagatcacttggtttaaggactttttgccagtggatacatccaacaacaatggtagaatcaaacagcttagatccgagagtatcggcggaaccccaatccggggtgccctccaaatagaacagagtgaagaatccgaccaggggaaatacgagtgtgtggccactaactcagccggaactcggtatagcgcgccagccaatctgtacgtgcgggaattgcgggaggtaagaagagtgccccctaggtttagcattccacctactaatcatgaaattatgcccggagggagcgttaatatcacatgtgttgcagtaggcagccccatgccctacgtgaaatggatgcttggagctgaggatctgaccccagaggacgatatgcctattgggagaaacgtacttgagcttaatgacgtgaggcagagcgctaattatacctgtgttgcgatgtcgactctgggggtgatagaggcaattgctcagataacagtgaaggctctgcctaagcctcctggcacaccggttgtgacggagagcactgcaacatcgataacattaacttgggatagcgggaatccagagcccgtatcctattatattatccagcacaaacctaaaaacagtgaggagctctacaaagagatcgacggcgtggctactacgagatactcagtggccggtttgtccccctactcagattatgaattccgtgtggtggcggtgaacaacattggtagaggaccaccatcagagccagtacttactcagactagcgagcaggcccctagcagcgcaccacgggacgtgcaggccagaatgctgagctccacaacgatcctcgtgcaatggaaggagcctgaagaacccaatgggcagatccagggctacagagtctattataccatggacccgactcagcatgtgaataactggatgaagcataatgttgccgacagtcagataaccaccatagggaatctggtacctcagaagacatatagcgtcaaagtgctcgcctttacctcaatcggcgacgggccactgtcctcagacatacaggttatcactcagaccggcgtgcccggtcagcccttaaacttcaaggccgaaccagagagcgaaacaagtatcttactgagttggacccctccccgatccgataccatcgcaaattatgaacttgtgtacaaagacggggagcatggcgaggaacaacgcattacgattgaacctggcacgtcttaccggcttcaaggtctgaagcccaactccttatattatttcaggctggctgctcggagccctcagggacttggcgctagcactgccgaaattagtgcgcgaaccatgcaaagcaagcccagcgcccctcctcaggacattagctgcaccagcccgagctctacttcaatccttgtgtcatggcagccccctccagtggaaaagcagaacggaataatcacggagtactcaattaagtacaccgcagtggatggcgaagacgataagccccacgagattttgggcataccaagcgataccactaaatacttgttggaacagttggaaaaatggaccgaatatagaatcaccgtgacagcccacactgatgtcgggcctgggccagaatctctctccgttctgattcggacaaatgaagacgtgccttctggcccacctcggaaggtggaagtcgaggccgtgaacagcacctctgtaaaagtgtcatggcggagccctgtgccgaataagcagcatgggcaaattcggggatatcaggtgcattatgtgcgcatggaaaacggcgaaccaaaaggacagccgatgttgaaggacgtgatgctagccgacgcacagtgggagttcgacgataccactgagcatgacatgatcatctccggactccaaccagaaacgtcttatagcctgacggtgaccgcctacaccactaagggagacggggcaagatcgaagcccaagttggtgtctacaacaggagcggtcccaggcaaacctcgcctcgtgatcaaccatacacagatgaataccgctttgatccagtggcacccacccgtggacacctttggacccctgcagggctataggctgaaatttggacgcaaggatatggagccactgacgacactggagttcagcgaaaaagaagatcatttcaccgccacggacatacacaaaggcgcatcctacgtgttcaggctgagcgcacgtaacaaggtgggtttcggcgaagaaatggtgaaggagatttccatcccggaggaagtgcctactggttttccccagaatctacactccgaaggcactactagcacctcagttcagttaagctggcagcctcctgtactcgctgaacgcaacgggatcatcactaagtatacgctcttgtatcgagacataaacatcccactccttcctatggagcagttgatagtaccagcagacacaacaatgacacttacgggattaaagccagacactacgtatgacgtgaaggtgcgcgctcacacgagcaaagggccaggtccatattctccctctgtgcaatttaggacattgccggtcgaccaggtgttcgctaagaatttccacgtgaaggccgtaatgaaaacatctgtgttgctgtcatgggagatccctgaaaattataactctgccatgccgttcaaaattctttacgatgatgggaagatggtggaggaggttgatggcagggccacccagaaactgattgttaacttgaagccagagaaatcatactcatttgtactgaccaatcgcggaaactccgccggaggtctgcagcatagagtcaccgctaaaaccgctcccgacgttctgcggaccaagccagcgtttatagggaagaccaatctagatggcatgatcaccgtccaacttcccgaagtgccagctaacgagaacatcaagggttactacataatcatcgtgcctctgaaaaaatctcggggtaaatttatcaagccctgggaatccccagatgagatggagctggacgagctgttaaaggagatctccagaaaacggaggagcatccggtacggtcgggaggttgagttgaagccatacatagcagcacatttcgatgtgctgccaactgagttcaccctgggggacgacaaacattatggaggatttacgaacaagcagctgcagtcggggcaggaatacgtgttttttgtcctggctgtcatggaacacgctgagagcaaaatgtacgccacaagcccttactcagaccctgtggttagcatggatctcgaccctcagcccatcaccgacgaggaagaaggcctcatttgggtcgtggggcctgtcctggcagtggtgtttataatctgtatcgtgattgccattctgctttacaagagaaagcgcgctgaatctgactctcgcaagtcctcaattcccaacaataaagagatcccatcacaccatcccacagatcctgttgagttaagaagattgaacttccagactcctggaatggcaagccacccccctattcccattctggagttagcagatcacatcgagcgtttgaaggcaaacgacaacctcaagttcagccaggagtatgagtccatagatcccggtcagcagtttacctgggagcattcaaacctcgaggtgaataagcctaagaaccgttacgccaatgtcattgcgtatgatcatagccgggtgctcctgagcgccattgaagggattcccggatcggactatgtgaatgccaactacattgatgggtacagaaagcaaaacgcctatatcgcaacacaggggtctcttcccgagacatttggcgacttctggcggatgatatgggaacagaggagcgccactgttgtgatgatgacaaaattggaagagcggagtagagtgaagtgcgaccagtattggccctcccgagggacggagacccatgggctcgtgcaggtgaccctgcttgacactgttgaactagcaacctactgtgttaggactttcgccctgtacaaaaacggcagcagcgagaagcgggaggtgcgccagtttcagttcaccgcttggccggaccatggcgttccagagcacccaactccctttctggcattcctcaggagagtgaaaacatgtaatcctcctgacgccggtcccatggtggtccactgctccgccggagtcggcaggaccggttgttttatcgtgatcgatgccatgttggagagaattaaacatgaaaagaccgtggacatttacggacatgtcaccctgatgagagcacagcgtaactacatggtgcaaacagaggaccagtatatctttatccatgacgctctattggaggcagttacctgtggcaatacagaggtaccagccaggaatttgtacgcctacatccaaaagctgactcaaatcgaaacaggggaaaacgtgacaggaatggagttggaatttaaacgattagcgagttccaaggcacataccagccgttttatcagtgctaatctgccctgcaataaattcaagaataggctggttaacataatgccctatgaatccacccgggtgtgcctgcagccaatacgcggagttgaaggctccgattacatcaacgcaagttttatcgacgggtatcggcagcagaaggcctacatcgcaacccagggccctctggctgagacaactgaggacttctggcggatgctatgggagcacaatagcacaatcgtcgtgatgctgactaaattgcgagaaatgggcagggaaaagtgtcatcagtattggcctgctgagcgatcggcacggtatcagtactttgtggtggacccaatggcagagtacaatatgccccagtatattctgagggaattcaaagtaactgatgcacgggatggccagtcccgcacagtgcgacagtttcaatttacagactggccagaacaaggcgtgcctaagtccggagagggtttcattgattttatcggtcaggtgcacaagaccaaagagcagttcggtcaagacggcccaatctctgtccattgctccgcaggcgtagggcgaactggagtctttattactcttagcatcgtactggaacgaatgcggtacgaaggcgtggtagacatttttcagactgtcaaaatgctgagaacccagaggcccgcaatggtgcagacagaggaccagtaccagttttcatacagggccgcattggaatacttaggcagttttgatcactatgccactta

SEQ ID NO: 237111 - DNA, 5672 bp, Artificial Sequence
  Description of Artificial Sequence: Synthetic coding sequence
atggtgcacgtagcacggctgttactgctgctccttaccttctttctgagaacagatgccgagacccctccacgttttactcgaacccccgtggaccagaccggggtttcaggaggtgtggctagctttatttgccaagccactggagatccgaggccaaagattgtatggaacaaaaagggcaaaaaggtgtccaatcagagattcgaggttatcgagttcgacgatggttcaggtagcgttcttcggatccagcccttaagaactccacgggacgaggccatttatgagtgcgtcgcctcaaataacgttggggaaattagcgtctccacccgactcacggtgctcagagaagatcaaattccccgaggcttccccacgatcgacatgggcccacagctgaaggtcgtggagagaacccgcaccgccactatgctgtgtgctgcctcggggaatcccgaccccgaaattacctggtttaaggacttcctgcccgtcgatacctcaaacaataatggacgcattaagcagctaagatccggcgcacttcagatcgaacagagcgaagagagcgatcagggaaaatatgagtgtgttgctactaacagcgccggtactcgctattccgccccagcaaatctgtatgtgagggtgcggcgtgtgccacctagattctccattccacccactaaccacgagataatgcctggaggttcagtcaatattacttgtgttgcggtggggtccccaatgccatacgtgaagtggatgctcggagctgaagatcttacaccagaagacgatatgccaatcggcagaaacgtactggaactgaacgatgtacggcagagcgccaattatacatgtgtcgcgatgtctactttaggtgtaattgaggcaatcgcccaaattactgtaaaggcccttcccaagcctccgggtactcccgtcgtgaccgagtcaacagctacctccatcacacttacatgggattctgggaaccccgaacccgtctcatattacataatccaacacaagcccaagaacagtgaggagctctacaaggagatcgacggcgtcgcgacgacacggtacagtgtagcgggtctgtccccctactccgactatgagttccgtgttgtcgccgttaacaatatcggcaggggccctccgtccgagcccgtgcttacccaaacaagtgagcaagccccttcttcagcgcctcgagatgtacaggctcggatgctgtcatcaaccacgattctcgtgcagtggaaagaacctgaagaacccaacggccagatacaggggtaccgggtgtactacaccatggatcctacccagcatgtgaacaactggatgaaacacaatgtggccgacagccagattaccaccatcggcaatttagttcctcagaagacttacagcgtcaaggtgctggccttcacttcgattggagacggccctctgtcttccgacatacaggtcattacacagaccggcgtgccagggcagccgttgaactttaaagctgagcccgaatctgaaacctcgatacttctgagctggactcctccacgaagtgacaccatcgccaattacgaactagtctataaggacggcgagcacggcgaagagcagcggatcactattgaaccaggcaccagctataggttgcagggtttgaagccaaattctctgtattacttccgccttgcagccaggtctccccagggactcggggcatcaacagcagagatatcagctaggacgatgcagagcaagccaagcgccccaccccaggacatcagttgtacatctccatcgagcaccagcatcctggtttcctggcagcccccacccgtggagaaacagaacgggatcatcaccgagtactctatcaaatatacggccgtggacggagaggacgataagccgcatgaaattctaggcattccttctgacactacgaaatacttacttgagcagctggaaaaatggactgagtatcgtatcactgtcaccgcccatacagatgtgggcccagggccagagagcctatctgttcttatcaggacgaatgaagacgtcccctctggaccccctcggaaggtcgaagtcgaggccgtaaattccacaagcgttaaagtgtcctggcggagtccagtgcctaataagcaacatggacagattcgcggttatcaggtgcattacgttaggatggagaatggcgagccaaaaggccaacccatgctgaaggacgtgatgctggcggacgcccaagacatgattatatctggcctgcagccagaaacatcctactctctgacagttaccgcctacaccacgaaaggggatggggcaagatctaaacctaaactggtctcgaccaccggcgcagtgccgggtaagcccaggcttgtgatcaatcacacacagatgaatactgccctgattcagtggcacccaccggtcgataccttcggcccactgcagggctatcgcctgaaatttggcagaaaagacatggagcctctcacaacactggagttctccgagaaggaagaccacttcacggccaccgatatccataagggcgcatcttacgttttcagactctcggccagaaataaggttggttttggcgaagaaatggtgaaggagatctcgatccctgaggaagtccccaccggtttcccacagaatttgcacagtgagggaacaaccagcaccagcgtgcaactgagctggcagccacctgtgctggccgagcgtaacggcattataacaaaatatacccttctgtatagagacatcaatattccactgcttcccatggagcaactcattgtgccagccgacaccaccatgaccctgaccgggctgaaacctgacacaacctacgatgtcaaggtgagggctcacacgtccaaggggccaggcccatactctccctctgtgcagtttaggacactgcctgtcgaccaggtcttcgccaaaaacttccatgtcaaggccgtcatgaagacctcggtgttgctctcatgggagatccctgaaaactataatagcgctatgccattcaagatcttgtatgacgacggcaagatggttgaggaagtggatggcagagccacccagaaattgatcgttaatctgaagcctgagaaaagctactcgtttgtcttaaccaatcgaggcaactccgccggtggcctgcaacaccgggtgactgctaaaactgcacctgacgtgcttcgcactaaacccgctttcatcggcaaaacgaacttagacggcatgattaccgtccaactgccagaagtgccagccaacgaaaacatcaaaggatattacattatcattgtccccctaaaaaaatcccgcggaaagttcatcaaaccttgggagagtccggatgaaatggagcttgacgagctactgaaagagatcagccgaaagcgcaggtccatcagatacggcagagaagtcgaattaaaaccctacatcgctgcccattttgacgtactcccaactgagtttacccttggcgacgataagcattacgggggattcaccaacaaacaactgcaatcaggacaggagtatgtgttcttcgtcttggctgtgatggagcatgcagagagcaaaatgtatgcaacctcgccctattccgaccctgtggtgagcatggatctagacccacagcccattaccgatgaagaggaggggctaatctgggttgttggacctgtcctcgccgtggtcttcataatctgcatcgtcatcgctatcttattgtacaagaggaaaagagcagagagtgattctcgtaagagcagcatacccaataacaaggaaataccgagccaccaccctactgatccagtggagctaaggcggcttaattttcaaaccccgggtatggccagccacccacctatccctatcctggaattagccgatcacatcgaacgtctgaaagccaacgataatctcaaatttagccaagaatatgagtctattgaccctggtcaacagttcacttgggagcatagcaatctcgaggtcaacaaacccaaaaacagatacgctaatgtgatcgcctatgaccatagcagggtgctgttgtcggccattgagggcatcccgggatctgactacgtcaacgccaactacattgacggttatcggaagcagaatgcttacattgctacacaggggagcctgcctgagacatttggggacttttggcgcatgatatgggagcagcgatcggctacagttgtcatgatgaccaagctggaagagcggagcagggtgaaatgcgaccagtactggccaagtagagggaccgaaactcacgggctggtacaggtcactcttctggacactgtagaactggccacatactgtgtgcgcaccttcgctctctataagaacggcagcagtgagaaacgggaggtgcgccagttccaattcactgcctggcctgatcatggtgtccccgagcatccgactcccttcctggcatttcttcgccgagtgaaaacttgtaaccctccggatgcgggaccaatggttgtacactgctcagccggtgttggcagaaccgggtgtttcattgtcattgacgccatgttggaaagaattaagcacgagaagaccgtggacatttacggccacgtgacacttatgagggctcagcgcaattacatggtacagacagaggatcagtatatttttattcacgatgccctcctcgaagcagtcacctgtggtaatactgaagttccagcccgtaacctctacgcctatatccagaagctgacccagatagaaaccggagaaaatgtaacaggcatggagctggagttcaagagactagcaagctctaaggctcatacttctcggttcatatcagccaatttaccttgcaataagttcaaaaatagactcgtgaatattatgccatacgaatccacacgtgtatgtctgcaacctatacgcggagttgaggggtccgattacattaatgccagtttcatcgatggatatcggcagcagaaagcatacatcgccacccagggccctctggccgagacaacagaagacttttggcgcatgctttgggagcataacagtacaatagttgtgatgctcacaaaacttagggaaatggggagggaaaagtgtcaccaatattggcctgccgagaggtcagccaggtatcagtattttgttgttgatccaatggcagagtacaacatgccgcaatacattcttagggagtttaaagttacagatgccagggacggccagagccggactgtccgccagtttcagttcacagattggcccgagcagggggtgccaaagtctggagaggggtttattgatttcatcggtcaggtccacaaaactaaggaacagttcggacaggatggccctataagcgtccattgttcagccggagtagggagaactggtgtgtttattacattgagcatcgtgcttgagcgcatgcggtacgaaggggtagtggatatcttccaaacagtgaagatgttaaggactcagcgacctgccatggttcagaccgaggatcagtaccagttttcatatcgagccgctctcgaatatttaggctctttcgaccactacgcaaccta

SEQ ID NO: 237112 - DNA, 5699 bp, Artificial Sequence
  Description of Artificial Sequence: Synthetic coding sequence
atggtgcatgtggcacggctcctgctccttctgttgaccttctttctgcgcaccgacgccgagaccccgccaaggttcacaagaacccccgtggaccagaccggcgtgagcggaggagtcgcaagctttatttgtcaggctacaggcgacccgaggcccaaaattgtgtggaataagaaaggcaaaaaggtgtcaaaccaacgtttcgaggtgattgaattcgacgatggcagcggaagtgtgctgcgcatccagcccctgaggacgccacgagacgaggctatttacgagtgcgtcgcctcaaacaacgttggcgaaatctccgtctctaccagattgaccgtgctcagggaagaccagatccctagaggttttccgactatagatatgggtccacagctaaaggtggtggaaaggactcgaacagccactatgctgtgcgctgccagtggaaacccggacccggagatcacatggttcaaggactttctgccagtcgatacctccaataataacggtaggattaaacagctgcgcagcggcgcactccagattgagcagtctgaagagtctgaccagggcaagtatgaatgcgtggccacaaattccgcgggtacacggtatagcgcacctgctaatctttacgtcagagtgcggagggtcccaccccgattctctattcctccgaccaaccatgagattatgcccggaggaagcgttaatatcacatgtgtagccgttggctccccaatgccttacgtaaagtggatgttgggagctgaagatctgacccctgaggatgacatgcctatcggaagaaatgtgctcgaactcaatgacgttaggcaatctgcaaactatacctgtgtggccatgagcacactgggcgtcatcgaagcgattgctcagatcacagtcaaagctctccctaagccgcctgggacccctgtcgtgactgaatccacagccactagcatcacactgacatgggatagtggcaatccagaaccagtcagttactacatcatccaacacaaacccaagaactctgaggagctgtataaggagattgacggcgtggcgactacgagatatagcgtggctggcctcagtccttatagcgactatgaatttagggtcgtggccgtgaacaatattggacggggaccgccaagcgagccagtactcacacagacatccgaacaagccccttcttctgcccctcgggacgttcaggcaagaatgctcagctcaactacgatcctagttcagtggaaggagcccgaagaaccaaatggacagatacaaggatacagagtgtactataccatggatcctacgcagcacgtgaataactggatgaaacataacgtggcggactctcagatcactactattggcaatctcgtgccacagaaaacatattccgtgaaggtactggcatttaccagtatcggagacggacctctgtccagtgacattcaggttattacccagaccggagtgccgggacagcctctaaacttcaaagcggaacccgaaagcgagacctctatactgttaagctggaccccccctcgatctgacactatcgccaattacgagttggtttataaagacggagagcacggtgaggaacagcgcatcacaattgagcccggaactagttacagactccaggggttaaagccaaatagcctttactacttcagactcgccgctaggagtccccaagggttgggggcatccactgcggagatatccgccaggactatgcagagtaaaccttcagccccaccccaggacatctcttgcacttctccaagcagtacaagcatactcgtttcctggcaaccacctccagttgaaaaacagaatggcattattacggagtattccatcaagtataccgccgttgacggggaagatgacaaacctcacgagattttaggaatccctagtgatacgactaagtatctgctggaacaactggaaaaatggactgaatatcgcatcacggttacagcacatactgacgtgggacccggacccgagagcctgtccgttctcatccggaccaacgaagatgtgccctccggtcctccacgcaaagtggaggtggaggctgtcaattccacgtccgtgaaggtatcctggagatctccagtgcctaacaagcaacatggccagattcgcggataccaggtgcattatgttagaatggaaaatggagagccgaagggtcagcctatgctgaaggacgtgatgcttgcagacgcacagtgggaatttgatgatacaactgaacacgacatgataatttcaggactgcaacccgaaacatcttatagccttaccgtgactgcctacacaaccaaaggtgatggtgcccgttccaagcccaaacttgtgagtacaaccggggctgtcccaggcaaaccaagactggttattaatcacactcagatgaatacagctcttattcaatggcaccccccagtggacacttttggacctctgcaggggtacagactaaagtttggtcgaaaagacatggaacctcttacaactttagaattcagtgagaaggaggatcacttcaccgcaaccgacatacacaaaggagcttcgtatgtattcaggttgagcgctagaaacaaagtgggtttcggggaagaaatggtcaaggaaataagcattccggaggaggtccctaccgggtttcctcagaatctgcactccgaaggcacaaccagtaccagtgtccagctgagctggcagcccccagttcttgcagagaggaacggcataattacaaaatatacgttgttgtatagggacatcaacatcccactgctacccatggaacagttgatcgtgcctgcagacaccactatgaccctaactggattaaaacccgacaccacctatgacgtgaaggtccgggctcacacctctaagggacctggcccatattcaccaagcgtgcagttcaggacactgccagtagatcaagtgtttgccaagaattttcacgtgaaagcagtgatgaaaacctccgtgttactgtcttgggaaattccagaaaattataattctgcaatgccctttaagatcctgtatgatgatggcaagatggttgaagaagtagatggccgagccacccagaaactaattgtcaacctgaagccagagaaatcttactcctttgtgcttacgaataggggcaattcagcgggagggcttcagcatagggtgaccgctaagaccgcaccggacgtcttgcggactaaacccgcattcataggcaagacaaacctggacggcatgattaccgtccagctccccgaggtgcctgcaaatgagaatattaaggggtactacataataatcgtgcccctgaaaaagtcccgaggaaaatttataaagccttgggaaagtcctgatgaaatggaactcgatgaactgcttaaggaaatctcccgtaagagaaggagcattcggtatggtcgagaagtggagttgaagccttacattgcagctcacttcgatgttctgcctacagagttcactctcggcgatgataaacattatggtggttttacgaacaaacagctccaatctgggcaggagtacgtcttcttcgtgctggcagtcatggaacatgccgagagcaaaatgtatgcgactagcccttacagcgacccggtggtgagcatggacctcgaccctcagccaattaccgacgaggaggagggcctaatctgggtcgttggccctgtgctggctgtcgtgttcattatttgcatcgttatagccattttactgtacaagagaaagagggctgagtccgattctcggaagtcgagtatcccaaataacaaagaaatcccaagtcaccatcctaccgatcctgtcgaactcaggcggttaaactttcagacacctggtatggcctcgcatcccccaatcccaatcctcgagttagcagatcatatagagcgcctgaaggccaacgataatttaaagttcagtcaagagtacgagtccattgaccctggtcagcagtttacttgggagcactctaatctggaggttaacaagccgaaaaaccggtatgcgaatgtgatagcatatgaccacagccgagtgctccttagcgcaatcgaagggattcccggatccgactatgtgaacgctaactatatcgacggctatcggaaacaaaatgcgtatatcgctacacagggctcgttaccagagactttcggggatttctggagaatgatttgggaacagaggtcagctactgtggtgatgatgacaaaactcgaagaaagaagccgggtgaagtgcgaccaatactggccatcgcggggtaccgagacacacggccttgtgcaagtgacgctcctcgacaccgtggagctggctacctattgcgtgcgaacttttgccctatacaagaatgggtcatctgagaagagggaggtccgacagtttcagttcaccgcctggcccgaccacggggtgccggagcaccccactccatttctggcgtttctgcgcagggtcaagacctgtaatccccctgacgctggacccatggttgtgcattgttcggctggtgtggggagaactggctgcttcattgtgatcgatgccatgcttgaaaggatcaagcatgaaaagactgtagacatctacggccacgttaccctgatgagagcccagcgcaattacatggtgcagactgaggaccaatatatatttatccacgacgccttactcgaggcggtaacatgcggcaacacggaggtgcctgctagaaatttgtatgcctacattcagaaattaactcagatcgaaacaggagagaatgtaacaggcatggagctggagtttaagcgccttgcctcctcaaaggcccacaccagccggttcatcagtgccaatctgccatgcaataagttcaagaaccggctggtcaacatcatgccctatgaatcgactagagtttgtctgcagcctatacggggtgtcgaggggagcgactacattaacgccagttttatagatggataccgccaacagaaggcatacatagcaacccagggcccacttgccgagacgactgaggatttttggcgaatgttatgggagcacaattccacgatcgtggtgatgctaaccaagctacgtgaaatggggcgagagaaatgccaccagtattggcctgctgagaggtcagcccgataccagtacttcgttgtcgaccccatggccgagtacaatatgccccagtacattcttcgcgagtttaaggttacagatgcccgagatgggcaatccagaactgtgagacagttccagttcaccgattggcccgagcagggcgtgccaaagagcggcgaagggttcattgattttatcgggcaagtgcacaagactaaggaacagtttggccaggacggcccaattagtgttcattgtagcgctggggtgggcaggacaggagtgttcattacccttagcatagtgctggagaggatgcggtatgagggagtcgtggatatttttcagacggtcaagatgctccgaactcaaaggccagcgatggttcaaaccgaggatcagtatcaattcagctatagggcagccttagagtacttggggagtttcgatcattatgctacata

SEQ ID NO: 237113 - DNA, 5738 bp, Artificial Sequence
  Description of Artificial Sequence: Synthetic coding sequence
atggtccacgtagcgagacttctgctgctgcttcttaccttctttctacggactgatgccgagactcctcccagattcacacgaacaccggttgaccaaaccggcgtatccggaggtgtcgccagtttcatctgccaggcaactggcgatcctagacccaagatcgtgtggaacaaaaagggtaagaaagtctcgaaccagcgattcgaagtgatcgagttcgatgacggttcagggtccgttctgcgcatccagcccctccgtacacccagggatgaggctatatacgaatgtgttgccagcaacaacgtcggggagatcagcgtctccacgagattgactgtactgagggaggatcagattccacggggtttcccaacaatagacatggggcctcagcttaaggttgttgagagaacaaggaccgccaccatgttatgcgctgccagcggaaatcctgaccccgagattacatggtttaaagactttcttcccgtggatacttcgaataataatgggcgtataaagcagctgagatctgagagcattgggggtactccaatccggggtgctctgcagattgagcagtcagaagaaagtgatcaaggtaaatatgaatgtgtggcgacaaattctgcaggcacgcggtactccgcccctgcaaatttatatgtgagggagttgcgggaggtacggagagtccccccacgcttctctattcctccaacaaaccacgagatcatgcctggagggtccgtaaacatcacctgcgttgcagtgggatctccaatgccatacgttaagtggatgcttggagctgaagatctgacacccgaggatgatatgccaataggccgtaatgtgttggagctcaatgatgtccggcagtctgccaattacacatgcgtggcaatgagcacactgggagtcatcgaagccattgctcagattaccgtgaaggctctgccaaagccccctggtacacctgtggtgaccgaatcaaccgcgacgagcattacgctcacatgggactctgggaatccagagcccgtctcttattatatcattcagcacaagcctaaaaattccgaggaactttacaaagagatcgatggcgtcgctactactagatacagcgtagcgggactctcaccttacagcgactacgaattccgggtggtcgcagtgaacaacatcggcagaggaccaccttcagagccagtgcttacacaaacttcagaacaggctccgagctccgcaccacgtgatgtacaagcgaggatgctgagcagcaccacaatcctcgtacagtggaaggagccagaagaacctaatggtcaaattcaagggtacagagtgtactacactatggatccaactcagcatgtgaacaattggatgaaacataatgtggccgattctcaaatcactactatagggaacttggtgccccagaagacctattccgtgaaagtcctcgcattcaccagtatcggggatgggcctctgtcatctgacattcaggtcatcacccaaacaggggtgcccggacagcctttaaattttaaggccgagcccgaaagcgaaaccagcatccttctgagctggactcctccacggtccgatactatagctaactacgagctcgtctataaggacggtgagcatggcgaagagcagagaatcacaattgaaccaggtactagttacaggctgcaaggcctgaagcccaattctctgtactactttcgcttggctgcccgaagcccgcagggcctgggcgctagtactgctgaaattagtgcgcgaacaatgcagtcaaaaccgtctgctcccccacaggacatcagttgtacctcgcccagctcaacgagtattctcgtcagttggcagccccctccagtcgaaaaacagaatggtattatcacagagtactctataaaatacacggctgtcgacggagaagatgacaaacctcatgagatattgggcattccatctgatactactaagtacctgttggaacaacttgagaaatggactgaatacaggattaccgtaaccgcccacaccgatgtgggcccagggcctgaatcactgagcgttttgatccggacaaacgaggatgtgcctagcggccctcccagaaaggtggaggtggaagcagtaaacagtacgtctgtgaaggtgtcctggcgctccccggtgcccaataagcagcacggccagatccggggatatcaggtgcactacgtgagaatggagaatggcgagccaaagggtcaaccaatgctgaaagacgtaatgctggcagacgcacaatgggaatttgacgacacgacagaacacgatatgattatatcggggctgcagcccgagactagttatagtcttacagttactgcctacacaacaaaaggggatggagcaagaagtaagccgaagcttgtatctacgacgggagcggtaccaggcaaacctaggctcgtcattaaccatacccagatgaacacggcactcatacagtggcacccacctgtggacacatttggcccattgcaagggtatcgcctgaaattcggaagaaaggatatggaaccacttacaactttagaattttctgaaaaggaagatcactttactgccacagatattcacaaaggagctagctacgtgttccgcctcagcgcaaggaacaaagtgggattcggggaagaaatggtaaaggaaatctccattcctgaagaggtcccaaccggctttccacagaatctgcatagcgagggtaccaccagcacatcagtgcaactgtcttggcaaccgcctgtcctggccgaacgaaacgggatcatcaccaagtacacactcctataccgagatatcaatatccctctcctgccaatggagcagctgatcgtgccagcggacaccacaatgactctgaccggactgaaacctgacaccacttacgatgtgaaagtacgagctcacacttctaaaggccctggtccatatagtccctccgtgcagttcagaaccctccccgtcgatcaggtgttcgcgaaaaactttcacgtgaaggccgtgatgaaaacctcagtgctgctaagttgggaaatccccgagaactacaattccgccatgccctttaaaatcctgtacgacgatggaaagatggtcgaagaagtggacgggagggcaacacagaaactcattgtcaatctcaaacctgagaaaagctattctttcgtgcttacaaatcggggaaacagcgccggagggctccagcaccgagtcaccgccaaaacagcgccagatgtcctgcgtactaaaccagccttcatcggtaaaactaatttggacggcatgattactgtgcaactgcctgaggttcccgctaatgaaaatatcaaaggctattacatcatcatcgtgcctcttaagaagtctaggggcaagttcattaagccttgggagtcccccgatgagatggagttagacgagctgcttaaagaaatcagccggaagcgaaggtccatccgctacgggcgagaagtagagctcaagccttacattgcagcccactttgacgtcctccccaccgaattcactctgggcgacgataagcactatgggggattcacaaataaacagctgcaatccggccaggagtatgtcttcttcgtgctggccgtgatggaacatgctgagtccaaaatgtatgccacatccccttattccgacccagtagtgtccatggacctggatccccagcctattaccgacgaagaagagggacttatctgggttgtggggccagtgctcgcggtggtatttattatatgcatcgtgattgctatcctgctgtacaagagaaagagggccgagagtgattcacgcaaaagttctatcccaaacaacaaagagattcctagtcaccatcccacagacccggtagagctcaggcgactgaatttccaaactcctgggatggcctcccatccaccaatcccgattctggagctagcagatcatatagagcgactcaaagcgaacgacaacctaaaattttcacaggagtacgagtctatagacccaggccagcagttcacttgggagcatagcaaccttgaggttaacaaaccaaagaataggtacgccaacgtgattgcgtacgatcatagcagggtgctactcagcgccattgaaggaattccagggtccgactatgtgaatgcaaattatattgatgggtacagaaagcagaatgcttatatagccacccagggatctctgccggagacatttggagacttctggaggatgatatgggagcagcggtccgccacagttgtcatgatgaccaaactcgaagaacgctcgagggtgaaatgtgaccaatattggccatccagggggaccgaaactcatggcctcgtacaggtcaccttactggacaccgttgagctggctacttactgcgttaggacttttgcactgtacaaaaatggctcctccgaaaaaagagaggttcgtcaatttcagtttactgcttggcccgaccacggcgttcctgaacaccctacgccctttttagccttccttcgtagggtgaaaacctgtaatccccctgacgccggacccatggtggtgcactgctccgccggagttggcaggaccggctgcttcatcgttatcgacgcaatgctcgagcgtataaaacacgagaaaacggtcgatatctatggtcacgtcactctgatgagggcacagagaaactatatggttcagaccgaagatcagtacatatttatccatgacgctctgctggaggccgtcacttgtggcaacacggaggtgcctgctagaaatttgtatgcatacattcaaaaattgacacagattgagacaggagagaatgttacaggcatggagttggagtttaagcggctggccagttccaaagcgcacacgtctagatttataagtgccaatttaccttgcaacaaattcaagaatagactggtgaatattatgccttacgagagcacgcgagtgtgtctgcagcctatcaggggcgtggaaggttcagattacattaacgcaagcttcatcgacgggtatcggcagcagaaggcatacattgccacccaaggtcccctggctgagaccaccgaggatttctggcggatgctgtgggagcacaatagcacaatagtcgtcatgctgactaagctgagggaaatggggagggagaaatgtcatcagtactggcctgccgagcggagcgccagataccaatatttcgtcgtagatcctatggccgagtacaatatgcctcagtatatcctgcgggagttcaaagtaactgacgccagagacggtcagagtcgcactgttcggcagttccagtttactgactggccagagcagggcgtgcctaagagcggcgaaggctttatcgatttcataggccaggtacataaaaccaaagagcagttcggccaagatgggccaatttcggtacattgctcggccggagtaggccgtacaggggtatttatcactttgtccatcgtgcttgagcgcatgaggtacgagggagtcgtcgacatctttcaaaccgtgaagatgctgcgtacccagcgtcccgctatggtgcaaacagaggatcaatatcaattttcctatcgggctgccctggagtacttgggctcgttcgaccactatgcgactta

SEQ ID NO: 237114 - DNA, 4509 bp, Artificial Sequence
  Description of Artificial Sequence: Synthetic coding sequence
atggtgcacgtcgctagactgctgctcttgcttctgactttttttctgagaactgatgcggagacaccgcctagattcacacgtactccggtggatcaaaccggcgtctccggtggcgtggcctcttttatctgtcaggcaacaggtgaccccagaccgaaaatagtgtggaacaaaaaaggcaaaaaggtgagcaatcaaaggttcgaggtgatcgagtttgatgatgggtccggctcagtgctcagaatccagccactacggaccccacgcgacgaggctatctatgagtgcgtggcctccaacaatgttggagagatcagcgtgagcacacggctgaccgtcctccgagaggatcagataccaagaggctttccaacaatcgacatgggaccacaactcaaagtggtggagcggactagaaccgcaaccatgctctgcgctgcgagtggaaatccggaccccgaaataacctggtttaaagactttctccccgtcgacacctccaacaacaacggccgaatcaagcaattaagaagcgggggaactcctattagaggagcgcttcaaatcgagcagtccgaagagagcgatcagggaaaatatgagtgcgtggccaccaactccgccggtacccgttactcagcacccgcaaacctctatgtgcgggagctacgagaggtgagaagggtgcctccgaggttctccattcccccaaccaaccacgagatcatgcctggcggttctgttaacattacatgtgtggcagtaggctctccaatgccctatgtgaaatggatgctgggcgctgaagacctcacgccagaagatgacatgccaattggccgaaacgtccttgaactgaacgacgtgagacagtccgcaaactatacatgtgttgccatgagcacacttggagtgatcgaagccattgcacagatcacagtcaaagccctacccaaacctccagggaccccagtcgtcacagagtcaaccgccaccagcataaccctcacatgggactctggaaaccccgagcctgtatcctactatatcatccagcacaaacccaagaatagtgaggaactttataaagagattgacggagtggctactactcgctatagcgtggctggtttgtcgccctatagcgactatgaattccgcgtcgtggcggtgaacaatattggacgcggacctccgtccgagcctgtgttgacacaaacttctgaacaggctcctagctctgcccctcgagatgtgcaggcacgcatgctgtcatcgacgaccatactggttcaatggaaggaacctgaagagcctaacgggcagatccaaggatatcgcgtgtactacaccatggatccgacacaacacgtcaataactggatgaagcacaacgtggctgactcgcagatcaccactatcggcaatctggtgccccagaaaacttactctgttaaggtgctcgcctttactagcatcggggacggtcctctttccagcgacatacaggtcattacacagacgggtgtgcccggtcagcccttgaatttcaaagcggaacctgagagcgagacttctattcttctgagctggacaccaccccgatccgacacgatcgccaactatgagctcgtgtataaagacggcgagcacggtgaggagcaacggattactatcgaacccggtacctcttatcgtcttcaaggcctcaagcctaactctctttactactttagactcgccgcaaggagccctcagggactcggtgcaagtaccgctgagatctccgcacgtactatgcaaagcatgttcgctaagaatttccatgtaaaagcagtgatgaagacgtctgttctgttgtcttgggaaatcccggagaactataactctgcaatgccctttaagatcctctacgatgatggaaaaatggtagaagaggtggatgggagggcgacccagaaactgattgtcaacctgaaacccgaaaagtcctactccttcgtcctgaccaaccgaggtaacagcgccggagggctgcaacaccgtgtgacggctaaaactgcgcctgatgtgctgcgcactaagccagccttcatcgggaaaaccaatctggatggtatgattaccgttcagctgcccgaggtgcccgcaaatgaaaacatcaaaggttactatataattattgttcctctgaagaagagccggggaaagttcattaagccatgggaatcccccgacgaaatggagctggatgagctgctcaaggagatcagcagaaagagaaggtccattcgctacggacgggaagtcgaacttaagccctacatcgccgcacacttcgacgtgttacccactgagtttactctgggtgatgataagcactatgggggtttcactaacaagcagctgcaatctggccaggagtatgtattcttcgtcctggcggtcatggagcacgctgaaagcaagatgtatgcaacgtccccctatagcgacccagtcgtatccatggacctggatcctcagcccatcaccgatgaggaggaaggcttgatttgggtggttggcccagtgctggccgtggtgttcatcatctgtattgtcatagctatccttttgtataaaagtaaacccgaccgtaagcgtgctgagagcgactctagaaaatcaagcatccctaataataaggaaattccctcacatcatccaactgatcccgtcgagttgaggcgcctgaatttccaaacaccgggaatggcttcacatcctcctatccctatcctcgaactcgccgaccatattgagcgccttaaagccaacgataatttgaagttcagtcaggagtacgaaagtatcgaccctgggcagcaattcacctgggagcactcaaacctggaggttaacaaacccaagaatcgatacgccaacgtaatcgcatacgatcactccagggtgttactgagtgctatcgaaggcatccctgggtctgactacgtgaatgctaattatatagatggttatcgcaagcagaacgcctacatcgcgacccagggctcccttcctgaaacctttggagacttttggcgcatgatctgggagcagcgtagcgccactgtggttatgatgaccaagctggaagaaaggagtcgtgtaaagtgtgatcagtactggccgtcacgcggaactgaaacacacggactcgtgcaggtgaccctgctggatactgttgaactggctacgtattgcgtgagaacattcgctttgtataaaaatggcagtagcgagaaacgggaggtgcggcagttccagttcaccgcttggccagatcacggagtgcccgagcatccgacgcctttcctcgcttttctgaggagagtcaagacatgtaatcctcccgacgctggtcccatggtggtgcactgctccgctggagttggacggactggatgttttattgtcatcgatgccatgctcgagcgaataaaacacgagaaaactgtggacatctatggtcacgtgactctcatgcgcgctcagcgtaattacatggtgcagacggaagaccaatacatttttatccacgacgcactgctggaggcagtaacgtgcggtaataccgaggtgccagctaggaacctctacgcgtatattcagaagcttacccagatcgagacaggggagaacgttaccggtatggagttagagttcaaacgcttggcatccagcaaggcccacacgagccgcttcatcagtgcaaacctgccgtgtaataagttcaagaaccggcttgtgaacatcatgccttacgaatccacacgggtgtgcctccagcctataagaggagtggaagggtccgattacattaatgcctcttttatagatggatatcgacagcagaaagcttacattgcgactcagggacccctcgcagagacaactgaggatttttggcgtatgctgtgggagcataattctactattgttgttatgttgacaaaacttcgcgagatgggacgggagaaatgccatcaatactggcccgcagagagatcggctaggtaccaatacttcgttgtggaccccatggccgaatacaacatgccccagtacatcctccgggagtttaaagtaactgatgccagggatggacagtcccgaactgtgcgccagttccaatttaccgattggcccgagcaaggtgtccccaaatctggagagggctttattgatttcatcggacaagttcacaaaacaaaggaacagtttggtcaggacgggccaatcagcgtccattgtagcgcaggagtggggagaacaggtgtctttatcactttaagcattgtgctggaacgcatgcgctacgaaggcgtcgtggacatcttccaaactgtaaaaatgctgaggactcagagacctgcgatggtgcagaccgaggaccagtaccaattttcatatcgagccgcactggaatatctcggctccttcgaccactatgcgacatag

SEQ ID NO: 237115 - DNA, 4518 bp, Artificial Sequence
  Description of Artificial Sequence: Synthetic coding sequence
atggtgcatgtcgccagacttctgctgctcctccttacattctttttaagaaccgatgcggaaaccccaccgaggtttactcgtacgccagtggatcagactggcgtgtccggcggtgttgcatcattcatctgtcaggctacgggcgatccccgtcccaagattgtgtggaataagaaaggcaagaaggtatccaaccagcgatttgaagtgatcgaattcgacgatggatctggaagcgttctccgaatacagcccctacgcacacctagggacgaggctatctacgaatgcgtagctagcaataatgtgggtgagatctcggtgagtacgcggctgaccgtgctgcgggaggaccagatacccaggggtttccctacgattgatatgggtccacagctgaaggtggtcgagcgaacaaggaccgcgactatgctctgcgctgcaagcggtaacccagaccccgaaatcacttggttcaaggatttcctgccggttgatacgtccaataataatggaaggattaagcaactgcgaagtgtgagtatcggggctctgcagatcgagcaatctgaggaatcggatcaggggaagtatgagtgcgtcgcgaccaacagtgccggaaccaggtactctgctcccgcaaacctgtatgtcagagttagaagagtgcctcccagattcagtattcctcctacgaaccatgagattatgccaggcggatccgtcaatatcacttgcgtagccgtgggcagccccatgccctatgtaaaatggatgctgggcgctgaagacctcacccccgaagatgacatgcctatcggacgcaatgtgctggagctgaatgacgtgcggcagagcgccaattatacgtgcgtagctatgtcaactcttggcgtgatagaggcaatcgcccagataactgtcaaagcactgcctaagccgcctggaaccccggtggttacagagagcaccgcgacaagcatcacattaacatgggactctggaaatcctgagcccgtgtcttactacattatccaacataaacctaagaactctgaagagctctacaaggagatcgacggagttgccactacaaggtactctgtggccggtctcagcccctacagcgattacgaattcagagtggtagcagtgaataatattggtcgaggcccaccaagtgagcccgttctgacccagacgtctgagcaagctccaagctcagctccaagagacgttcaggctagaatgctaagtagtacgaccatactggtgcagtggaaagagcccgaggagcctaatggtcaaatccaggggtacagggtgtactacactatggatcctacacaacatgtcaacaattggatgaaacacaatgtggcagattctcaaatcaccacgatcgggaatttggtcccccaaaagacgtattctgtcaaagtgctggcgttcacaagtattggcgacggacccctgagtagcgatattcaggttattactcagacaggggtgcccggacagcccctgaatttcaaagccgaacctgagagcgagacttctatcctgttatcatggacaccaccccgtagcgacaccattgctaactatgagctcgtatacaaggacggggagcatggcgaggaacagcgaatcaccattgaaccagggactagctatagattgcaggggctgaaacccaatagcctgtattactttcggctcgcagccaggtctccacaggggttaggcgcatcaactgccgaaatatcagccaggacaatgcagtctatgtttgcgaaaaattttcacgtgaaggctgtgatgaaaacttctgtcctcttaagctgggaaattccagagaattataatagtgccatgccattcaaaatcctatatgacgacggcaaaatggtcgaagaggtcgatggaagagcaactcagaaattgatcgtcaatttgaagcccgaaaagtcttattccttcgtactgacgaataggggcaattcagctgggggactacaacacagagtcaccgctaagactgctccggatgtcctgcggacaaagcccgcatttattggcaaaaccaacctggatggcatgattaccgtccagttaccagaggtgccagccaatgaaaatattaagggatactatatcatcatcgttcccctgaaaaagtctagagggaagttcatcaagccatgggaaagccccgatgaaatggagttggatgagttgctgaaagagatttcgcgcaaaagacgatccatcaggtacggcagagaagtcgaactgaagccttacatcgccgcacacttcgatgtgctgcctacagagtttacattgggtgatgataagcactatgggggtttcacaaataaacaactacagagcggccaggaatacgtgttctttgtgttggcggtgatggagcatgccgaaagcaaaatgtacgctacgtccccttattccgatcccgtagttagtatggacttagacccacaacctattacagatgaggaagaggggctcatctgggtggttggaccagtgctagccgtcgtgttcatcatatgtatcgtcatcgcgatattgttgtataaaagaaaacgcgctgagtccgactcacggaaatctagcatacccaacaacaaggagatccctagccaccacccaactgatccggtggaattgcggagattgaacttccagacccccggttctgatgatagtggataccccggaaatcttcactcttcatctatggcctctcaccctcctattccaattctcgaactggctgaccacattgagaggctcaaggccaatgataatttgaagttcagtcaagagtacgagtctatcgaccccggacagcagtttacttgggaacattcaaacctcgaagtaaataagcccaagaatcgctatgccaacgtcatcgcgtacgatcattctagagtgctcctcagcgccatagaggggatcccaggatccgactacgtaaacgcaaactatatagatgggtataggaaacagaacgcatacatcgccacccaggggtccctgcctgagaccttcggcgatttctggcgcatgatttgggagcagaggtccgctaccgtcgtcatgatgaccaagctcgaggaaagaagccgtgtaaagtgtgatcaatactggcctagtagaggcacagaaacacacggcctggtacaggtcactctcctcgacaccgtggaactcgccacctactgcgttcgaactttcgccctgtacaagaacggaagttccgaaaagcgcgaagtgcgccagttccaatttacggcgtggcccgaccacggcgtccccgagcacccgactccctttctggcgtttctccgcagagtgaagacctgcaacccacccgatgctggtcctatggtggttcattgttctgccggagtgggccgaaccggatgctttatagttattgacgccatgcttgagcgtatcaagcatgaaaaaactgtggatatttatggtcacgtgaccctcatgagagcacaaagaaattatatggttcaaacggaagatcagtacatcttcatccatgacgccctgttagaggccgttacctgcggcaatactgaggtccccgcaagaaatctttacgcatatatccaaaagttgactcaaatcgaaaccggagagaatgtcacaggtatggaattggagttcaagagattggcctccagtaaagcccacaccagccgatttatatcggcaaatctgccctgcaacaaatttaaaaacaggctggtgaatattatgccctatgaatccacccgggtctgtctacaacctattagaggcgtggaaggttccgattacatcaatgcttccttcatagatggttatagacagcagaaagcatacattgcgacgcagggccctctggccgagacaacagaagacttctggcggatgctctgggaacacaacagcacaattgtcgtcatgttaaccaaattacgcgagatgggacgcgagaagtgccaccagtattggcctgctgaacgcagtgcccgataccagtattttgtagttgatccaatggctgagtacaatatgcctcagtacatccttcgggagttcaaggtcactgatgcaagggacggccagtcacgcacagttcggcagtttcagtttaccgattggcctgaacagggggtgccaaagtcaggggagggttttatcgacttcattgggcaggtgcacaagactaaggagcagttcggccaagatggtcccatctccgtgcattgctctgctggggtcgggagaaccggggtgttcattactctcagtatcgtcctggagcggatgcgatacgagggcgtcgtggatattttccagacagttaagatgctgcgtactcaaaggccagcaatggtgcaaactgaggatcagtaccaattctcttatagagctgctcttgaatatctgggaagctttgatcactatgctacttag

SEQ ID NO: 237116 - DNA, 282 bp, Artificial Sequence
  Description of Artificial Sequence: Synthetic coding sequence
atggtccacgtggcacgtctcctcctgctgctgctgacctttttccttcgaaccgacgccgaaaccccgcctagattcaccagaaccccggttgatcagaccggtgtgtcagggggagttgccagtttcatttgtcaggccacgggcgatccacgcccaaaaattgtatggaataagaagggcaagaaggtaagtaaccaacggtttgaagtcatcgagtttgacgacggcagtggctccgtgcttagaattcagcccctgaggaccccccgtgatgaatag

SEQ ID NO: 237117 - DNA, 4518 bp, Artificial Sequence
  Description of Artificial Sequence: Synthetic coding sequence
atggtccatgttgcaagacttctcctgttgcttctcactttcttcttaagaactgatgcagaaacgccgccacgattcacaaggacccccgtagaccagactggcgtttccgggggagtagcctcctttatctgccaagccacaggcgatccacgccctaaaatcgtgtggaacaagaagggcaaaaaggtctccaaccaacgatttgaagtaattgaatttgatgacgggtctggaagcgttctgagaatccaaccactccgaacccctagagacgaggccatttacgaatgcgttgcctctaataatgttggagaaatctctgtcagcacaaggctaacagtgcttcgcgaggaccaaattccgcgagggtttccaaccatagacatggggcctcagctgaaagtggtggaaagaacccgcaccgctaccatgctatgcgctgcaagcggtaaccccgatcctgaaatcacgtggttcaaagattttctaccagttgacacttccaataacaatgggagaatcaagcagttgcgcagcgaaagcattggaggaacacccatacgcggtgcgctgcagatagagcagtccgaggagtcagatcaaggcaagtatgagtgtgtcgccacaaactccgccggtactcggtactcagcaccagccaatctttacgtaagagaactcagagaagtcagacgggtgcctccgaggtttagtattccgccaactaaccacgagataatgccaggcggttccgtcaacattacgtgcgtcgccgttggaagcccgatgccatacgtaaaatggatgctgggggctgaagatctcacgcccgaagacgatatgccaatcggacggaatgtcttggagctgaacgacgtaagacagtcagctaactacacctgcgtagcaatgtctaccctgggagtgattgaagctatcgcccaaattacagtgaaagccctgcccaaaccccctggaacccctgttgtgaccgaatctacggcgacttccatcactttgacgtgggacagcggaaatcccgaaccagtctcctactatattatacagcacaagcccaaaaattccgaagagttgtacaaggagattgacggggtcgccacaactcggtatagcgtggccggtctctccccttactcagattacgagttccgcgtcgtggccgtgaataacattggcagagggcctccttccgagccagttctgacccagacctccgagcaggctccctcctcagccccaagggacgtacaagcgcgtatgctgagttctacgaccattctagtgcaatggaaagagcccgaggaaccgaacggccagattcaaggatatcgggtctattacactatggatcctacgcagcatgtgaataactggatgaagcacaacgttgccgacagccagataaccactattggcaatctcgtcccgcagaaaacctactcagttaaggtcctcgcatttacctcgataggtgacggacctttatcctcggacattcaggtcattacccagacgggcgtccctggacagccccttaactttaaggccgaaccagagtctgaaactagcattctgctgtcatggacaccacccagatctgataccatcgctaattatgaactggtctataaggatggcgaacacggggaggaacagcgcataacaatcgaacctggcacctcataccgtttacaggggctgaaaccgaatagtctctactactttcggctggcagccaggagtcctcagggactgggcgcaagcaccgccgaaattagcgccagaaccatgcagtcaatgtttgctaaaaacttccacgtaaaagcagtgatgaagacctcggtgctgctcagttgggagatcccagagaattataattcggcaatgccatttaaaattctgtatgacgacgggaagatggtcgaggaagtagacggacgagccacccagaagttgattgtgaacctgaagccagagaagtcatactcatttgtcctcactaacaggggtaactctgccggtggactgcaacaccgggtgaccgccaagactgcacccgacgtcttgcgtaccaagcctgcgttcatcggtaagaccaaccttgatggtatgatcaccgtgcaactgccagaagtacctgccaatgagaacataaagggttactacatcataatcgtccctctcaagaaaagcagggggaagttcataaagccatgggagtcccctgatgagatggaactcgatgaactcctcaaagaaattagccggaaacggcgttcgatccggtacgggagggaagtggagctgaaaccatacattgccgcacatttcgacgtgcttccaactgaatttacgctgggtgacgataaacattacggtggtttcaccaacaaacaactccagtcaggtcaggaatacgtgttcttcgttctggcggtcatggaacacgcggaatcaaaaatgtatgccacatctccatactctgatcctgtagtcagtatggatcttgatccccagccgatcaccgatgaagaggaggggttgatttgggtggtcgggccagtactggcggtggtattcataatttgtatcgtgatcgcaatcctcctgtacaagagcaagccagatcggaagcgggctgagtctgattcaagaaaatcgagcatcccaaacaacaaagagattccttctcaccacccaactgacccggtggaattgcgaagactgaacttccagactcctgggatggcctcccaccctcctattccgatccttgagctggcagaccacatcgagcgcctgaaggccaacgataatctgaaattttcccaagagtacgagagtatagacccaggacagcaattcacatgggagcattcaaacctcgaggtgaacaaacccaagaataggtacgccaacgtcattgcctacgatcattcacgggtccttctctccgctattgagggtattcccggatccgattatgtcaacgcaaactacatcgatggctatcggaagcagaatgcatatatagcaacccagggaagcctgccagaaactttcggtgacttctggcgcatgatttgggagcagaggtctgcaactgtggtgatgatgaccaaacttgaggaacgtagccgagtgaaatgtgaccaatattggccttcgcggggaactgaaacgcatggcctagttcaggtgaccctcttggatactgtggaattagcaacgtactgtgtccgtacatttgctctgtacaagaatgggagcagtgaaaagcgagaggtaaggcagtttcagttcacagcctggcccgatcacggtgttcccgagcatccaacaccattcctagccttcctccgcagggttaagacatgtaaccctcccgacgccggacctatggtcgtgcattgcagtgctggcgttgggaggactggttgtttcatcgtaatcgacgcaatgctggaacgcatcaagcatgagaagacagtcgacatctatggccatgttaccctgatgagagcccagcgtaattacatggttcagaccgaagatcagtacatttttatccacgatgccctgcttgaagcagtgacctgtggaaacacagaggtgccggcaaggaacttatacgcctacatccagaagttgacacaaattgagacaggcgagaatgtgaccgggatggagttggaattcaagaggctggcctcctccaaagctcatacttccagatttatcagcgccaacctgccctgcaacaaattcaagaatagattagtgaatatcatgccatacgagtccactagagtctgtcttcagcctatccggggagttgaaggctccgactacatcaatgccagcttcatcgatggttatagacagcagaaagcctatattgcgacccaggggccacttgctgaaacaaccgaggatttttggagaatgttatgggagcacaatagcacaatcgtggtaatgctgaccaaactgcgggaaatgggtagggagaaatgccaccagtactggcccgcagaaagaagtgcacgataccagtactttgtggtggaccccatggccgagtataacatgccccagtacatcctgcgcgaattcaaagttaccgatgcgagggacggacagagtaggactgtgagacagttccagttcaccgattggcctgagcaaggggtcccaaagagcggcgagggatttatcgattttatcggacaggtccataagaccaaggagcagttcggacaggatggccctatctcagtccattgtagcgccggagtgggcaggacaggcgtttttattaccctgagcattgtacttgagagaatgagatacgagggagtggtggatatctttcagacagtcaagatgcttcgaacccagaggcctgctatggtacagacagaagaccaatatcagttctcatatcgcgctgctctggaatacctgggaagctttgaccattacgcaacttag

SEQ ID NO: 237118 - DNA, 4509 bp, Artificial Sequence
  Description of Artificial Sequence: Synthetic coding sequence
atggtgcatgtggcaaggttgctgctgcttctcctgaccttctttctccgtacggatgccgagactccaccaaggttcactcgcaccccagtagatcagacaggggtatctggaggcgtcgcctctttcatctgtcaggctacaggtgaccctcgcccaaagatcgtctggaacaagaaaggcaaaaaggtgtcaaatcaacgcttcgaggtcatcgaattcgacgacgggtccgggtctgtgctgcgcatccagccgcttagaacacccagggacgaagccatctacgagtgcgtggcctccaacaatgtgggggagatcagcgtcagtaccaggctcacagtgttgcgggaggaccagattcctcgaggattccccactatagatatgggaccccagctaaaagtggtcgagcgtactcggaccgccactatgctttgtgctgccagcggcaacccagacccggaaatcacctggttcaaagactttcttcctgttgatacgagcaacaataatggccgaatcaaacaacttcggagtggaagggtcttccatacaggggcactacaaattgaacagtctgaggaatccgaccaggggaaatatgagtgtgtggcgaccaatagtgcagggacacggtactccgctccagctaatctgtacgtaagagtcaatcggaaggttaggagggtgccacccaggttctctatacccccaacgaaccacgagattatgccgggaggcagcgttaacatcacctgtgtggcggtcggctcccccatgccatacgtgaaatggatgctgggggctgaagatttgacacccgaagacgacatgccaattggcagaaatgtactggagcttaatgacgtgcggcagagtgctaactacacatgtgtagcaatgtctaccctgggcgtgatcgaagccatcgctcagatcactgtcaaggcattgcctaagccgcctgggacacccgtggtcactgagtccacggctacttctatcaccctcacttgggactcaggtaaccccgagccagttagttactatatcatacagcataagcccaaaaatagtgaggagctgtataaggagatcgacggggttgccaccaccagatactccgtcgctggcttgtctccatacagcgactacgaattccgtgtcgtagccgttaataatattggtcgtgggcctccctccgagccggttttaacccagacctccgagcaggccccatctagtgcgcctagagacgttcaggcacggatgctttccagcaccaccattctggtccaatggaaagaaccagaagagccaaacggccagatccaaggatacagagtgtactacactatggatccgacacagcatgttaataactggatgaaacataacgtagcagattctcagattacaaccattggaaatctcgttccccagaaaacttactcggtaaaagttctggcttttacatccatcggggacggccctctgagctccgatatccaggttatcacccaaaccggtgtgccgggacagcctttgaactttaaggctgagcccgagtctgagacctcaattctgttgtcttggacgcctccgaggtcagacacgatcgcaaattacgagcttgtttataaggacggcgagcacggcgaggagcagcggattaccattgagccaggcaccagttacagactgcaagggctgaagcctaactccctgtactacttccggttagcagcaagaagtccccagggattgggcgcttcaacggctgagattagcgcccgtaccatgcagagcatgtttgctaaaaattttcatgtgaaagccgtcatgaaaacttccgtgctgctgtcttgggagatacctgaaaattataacagtgctatgcccttcaaaattctttatgacgatggcaagatggtggaagaggtggacgggagagccacccagaagttaatcgttaatctcaagcccgagaagtcttacagttttgtcctcacaaatagaggcaactccgccggaggcctacagcaccgcgtcacagcaaagaccgcccctgacgttctgcgtacgaaaccggctttcattgggaaaactaatctcgatggcatgatcacagttcagttgcccgaggtccccgcaaacgagaacatcaaaggatattatatcataattgtacccctcaaaaaaagcagaggcaagttcattaagccgtgggaatctcctgacgaaatggagctggatgagctattgaaggagatttctagaaagcgacgttccattagatacggcagagaggtcgagctgaagccctacattgctgcccattttgacgttcttccgacagaattcaccctgggtgacgataaacattatgggggattcacaaacaaacagctccaaagtggacaggaatatgtattcttcgtgctggctgtaatggaacacgccgagtccaaaatgtatgctacaagtccctactcagatccagtcgtatctatggacctggatccgcaacctattaccgatgaagaggaggggctcatctgggttgtcggcccagtcctggcagtggtgttcatcatatgtatcgtaatcgccattttactgtacaagcggaaaccatatcggaagcgggctgagagcgatagtcggaagagctccattcccaacaataaagagatccctagtcatcacccaacagatccagtcgaactgcgcaggctgaactttcaaacacccggtatggctagccatcctccgatccccatcttggaactggcagatcatattgaacggctgaaggccaatgacaacctgaagttttcgcaagaatacgagagcatcgatcctggccaacagttcacgtgggagcacagcaacctggaagtaaataaacccaaaaatcggtacgccaacgtgattgcgtacgaccattcgcgggtcctcctgagcgctattgaagggatcccaggctcagattatgtgaacgcaaattacatcgatggttatcggaaacaaaacgcctacatcgccactcagggatccctgcctgagacttttggagacttttggcggatgatttgggagcagaggtcggccaccgtcgtcatgatgacaaagttggaagagcggagtagagtgaagtgtgatcagtactggccaagtcgtggtaccgaaacccacgggctggtccaggttactcttctcgatacagtggagctggctacctactgcgtgcgcactttcgccctgtacaaaaatgggtcgagcgaaaaacgagaggtgcggcagttccagtttactgcatggcccgaccatggcgtacctgagcatcccaccccatttctcgcatttcttcggcgtgtcaagacttgcaacccacctgatgcgggaccaatggtggtccattgctctgctggtgtaggaaggaccggatgcttcatcgtaatcgacgctatgctggaacgcatcaaacatgagaaaaccgtggacatttacgggcacgtcacactcatgcgtgcccagagaaattacatggtgcagacggaggaccagtacattttcatccacgatgcgcttctggaagcagtcacatgcgggaataccgaagtaccagctcggaatctgtatgcatacatccaaaagttgacccaaatcgaaacaggcgaaaatgtcaccgggatggaactggagttcaagagactggcaagtagcaaggcccatacaagtcgctttatctctgccaatttgccgtgtaacaagtttaaaaaccgcttagttaatattatgccttatgagagtacaagagtgtgtttacagcctattcgcggagtagagggaagcgattacattaacgccagcttcatcgacggataccggcagcagaaagcatatatagccacccaggggcctctggccgaaacgactgaagacttctggaggatgctgtgggagcacaactccacaattgtggtgatgcttactaaactgagggaaatgggcagggaaaaatgtcatcagtattggcctgctgagcgttctgccagatatcagtattttgtggtcgacccaatggctgagtacaacatgccacagtatatcctccgagagtttaaagtcacagatgctcgggacggccaatcccgcaccgtgagacagttccaattcaccgattggcctgagcagggagtccctaaatccggcgaaggttttatcgacttcataggccaagtgcataagacaaaggaacagttcggccaagatggaccaatctccgtgcactgctcagccggagtggggagaaccggtgtttttatcactctcagtatagttttggaaaggatgagatacgagggtgtggtagacatcttccaaaccgtgaagatgttgagaacacaacggcctgctatggttcagaccgaggatcagtaccagtttagttatcgggcagccctggagtacctcggatcatttgaccactatgcgacttag

SEQ ID NO: 237119 - DNA, 5738 bp, Artificial Sequence
  Description of Artificial Sequence: Synthetic coding sequence
atggttcatgttgctcgcctgctattattgctgctcacgttctttttgcgaactgatgctgagacaccacctcggttcacccggaccccagtggaccaaaccggtgtctcaggcggagtggcgtcctttatttgccaagctaccggggatcccagacctaagattgtatggaacaaaaaaggaaagaaggtgagtaaccaaaggttcgaagtaatagagtttgatgatggctccggaagcgtattgagaatccagccgctgcgcactccaagggacgaagccatttacgagtgcgtggcgtccaacaatgtgggtgagatctcagtgagcaccagattgaccgtgttgcgagaagaccagatccctcgcggatttcctacaattgatatggggccacaacttaaagtggtcgagcgcacacggactgccaccatgttgtgcgctgcctctggtaaccccgatcctgagatcacctggttcaaggacttccttccagtcgacacctcaaataacaacggacgcataaagcaattaagatctgagtcaattggtggcaccccaattcgcggagccctgcagatagaacagtcagaggagtccgaccaggggaaatatgagtgtgtggcgactaacagcgccggaactagatactccgcccctgcaaatttatacgttcgggagctgcgtgaggtaaggagggtacctccgaggtttagcattccaccaaccaatcacgaaattatgcctggaggttccgttaatataacctgtgtggcagtcggttcgccaatgccatacgtgaaatggatgctcggagccgaagacctgactccagaggacgatatgccgatcggccgtaacgttctggagctgaatgacgttcgccagtccgctaattacacatgtgtagctatgtcaaccctgggagtgatcgaggccattgcacagatcactgtgaaggctttgcctaaaccaccgggaacaccagtagtgacggagagcaccgcaacgagcatcactctgacctgggactccggcaatcccgagccagtgtcctattatatcatccagcataagcctaagaacagcgaagagttgtacaaggagatcgatggtgttgcaactacccgctactccgtcgcaggactctccccttatagtgactacgagttccgagtcgtggccgtgaacaacattgggcgaggccctcccagcgagccagtccttactcagaccagcgagcaggccccttctagtgccccacgtgacgtccaggcacggatgctttcatccactaccatcctggtgcaatggaaggagcccgaagagcctaacgggcagatacaagggtatagggtgtattatacaatggatcccacccagcatgtcaataactggatgaagcataacgtggccgactcccagatcacgactattgggaacttggtgccacagaaaacatactccgttaaggtcttagccttcacatccattggtgacggccctctatcgagtgacattcaggtcattacccaaacaggagtgcccggacagcccctgaacttcaaggctgagcccgagtccgagactagcatcctgctgtcttggacacctcccaggtctgacactattgctaactacgagctcgtgtataaggatggagagcacggggaagaacaaagaatcactatagaaccagggacaagctaccggctgcagggactgaaacctaactctctgtattattttaggctcgctgccaggagtcctcagggtttgggagccagcactgccgaaatctccgcccgaaccatgcaatcgaaacccagtgcccctccacaggacatttcctgcacctcaccctcttccacctccatcctggtcagctggcagcctccaccagtggaaaaacagaatggaataattactgagtactccataaagtacacagctgtagacggcgaagatgataaacctcacgagatccttggaataccctccgataccaccaaatatcttctagaacaactggaaaagtggactgagtacaggataaccgtgactgctcacacagatgtggggcctggtccagagagtttgagtgtactcatcagaacgaacgaggacgtgcccagtggcccaccacggaaagtcgaggtcgaggccgtcaacagcacatctgtgaaggtgtcttggcggtccccagtccccaacaagcagcatggccagattcgagggtaccaggtccactacgttcgcatggagaacggggaacctaaaggtcagcctatgctgaaagatgtgatgctcgcagatgcccagtgggagttcgacgataccaccgaacacgacatgatcatctccgggctgcagcccgagacaagttactcactcacagtgacagcctacacgacaaagggggatggcgcaaggtcaaagcctaagctggtgagcacaaccggcgctgttccagggaagcccagactcgtcattaatcatactcagatgaataccgcccttatacagtggcacccacctgttgatacctttggcccactccaaggatatcgcttgaaattcggacggaaagacatggagcccttaacaaccctggaattttccgagaaggaggatcatttcacggccaccgatatacacaagggggcaagttacgttttcaggttgagtgccagaaacaaggtgggttttggtgaagagatggtgaaagaaatcagtatacctgaggaagtgcctaccgggtttcctcagaacctgcattccgaagggacgacatcaaccagcgtacaattatcatggcagccacccgtgttggccgaaaggaatggtatcattaccaagtacaccctcctgtaccgggacataaacatacccctcctgcccatggaacaactgatcgtcccagctgacaccacaatgaccctcactggactgaaacccgacactacctacgacgtcaaggttagagctcacacctctaagggccctggcccatatagcccttctgtgcagttccgtacactgccagtcgaccaggtatttgcgaaaaattttcatgtgaaagccgtgatgaaaacctcagtcctgctctcctgggaaattccagagaattataattcagctatgccatttaagatactatatgacgacggaaagatggtggaggaggtggacggccgagccacccagaagttgatcgttaacctgaagcccgagaagtcttattcctttgtcctcaccaataggggcaactccgcgggagggcttcagcaccgcgttaccgcgaagactgcgcctgacgttctgcggacgaagcccgcatttatcggaaaaactaatctggacgggatgattactgtgcagctgcctgaggtcccagccaacgagaatattaaaggttattacatcatcatcgtgccccttaaaaaaagccgcggaaaattcattaagccttgggagagccctgatgaaatggaactggatgaactccttaaggagatcagccgcaaaagacgatctattaggtatggcagggaggtggaactcaagccatacatcgctgcacacttcgatgtgctgcccaccgagttcacattaggggacgacaaacattacgggggttttacaaacaaacagttgcagagcgggcaggagtatgtgttctttgtgcttgccgtcatggagcatgcagaaagtaaaatgtatgcaacatctccatactctgatcccgtggtcagcatggatctggatcctcagccaatcacagatgaagaagaggggttaatctgggtcgtggggccagttctggccgtcgtattcattatctgtattgtgattgcaatacttctctacaaacggaagcgagccgaatctgacagccggaagagctcaataccgaataacaaggaaatcccctcccaccaccctaccgatcctgtggaactgcggaggctgaattttcagactcctggcatggccagccacccccctatccctatcctggaactggcagaccatattgagcgactgaaggctaatgataacctgaagttttcgcaagagtatgaaagtattgaccctggacagcagtttacctgggaacattccaacctcgaagttaacaagccgaaaaaccgatacgccaatgtcattgcctatgatcatagccgagtactgctttctgcaatcgaaggaataccgggaagtgattatgttaatgcaaactatatagatggttaccgaaagcagaatgcctatattgcgacgcagggctctcttcctgaaacctttggagacttttggaggatgatctgggaacagcgatccgcgacagtcgttatgatgacaaagctggaagaacgatctagagtgaagtgtgaccagtactggccctcgcgcggtacagagacacatggcttggtgcaggtgacactcctggacactgtcgagctggcgacctactgcgtgcggacgtttgccttatataaaaacggcagcagtgagaagagggaggtccgccaattccagtttacagcatggcctgaccatggtgttccagagcacccaacaccttttcttgctttcctccggcgagtcaagacatgtaaccctccagacgctggccctatggttgtacactgctctgccggagtggggagaacggggtgctttattgttattgacgcgatgttggaacgtataaaacacgaaaagaccgttgatatttatggtcacgtgaccctgatgcgcgctcagcgcaactatatggttcagactgaggatcaatacattttcattcacgatgcccttctggaggccgtcacctgcggcaatactgaagtgccagccagaaacctgtacgcttacattcaaaagctgacccagatcgagaccggagagaatgtcaccggtatggaactcgaattcaagaggctggctagttctaaagctcatacctctcgctttatttcggccaatctgccttgcaacaaatttaagaacagacttgtgaatattatgccctatgagtcgacccgcgtgtgtctccagccaatacgcggagttgaggggtcagattatatcaacgccagcttcatcgacggctaccggcaacagaaggcctacatcgcaacacaaggtcctctggccgaaaccacagaagatttttggagaatgctgtgggaacataatagtacgatcgtcgtgatgctaaccaaactgcgggaaatgggcagggagaaatgccaccaatactggcctgccgaaaggtctgcacgttaccaatacttcgtggtcgatcccatggccgagtacaacatgccccaatatattctgcgagagttcaaagtaaccgacgccagagacgggcagagcagaaccgtacgacagtttcagttcacagactggccagaacagggtgttcctaagagcggagaaggatttatagactttattggccaggtgcataagacgaaggagcagtttgggcaggacggaccaatttccgtccattgttccgccggagtcgggcgaacgggcgtgttcataacgctttctatagtgttagaacggatgaggtatgagggcgtggtggacatttttcagacggtgaaaatgctgagaacccagcggcctgcaatggtgcagacagaagaccagtaccagtttagctatcgagcagcccttgaatacctcggttccttcgatcattacgctaccta

SEQ ID NO: 237120 - DNA, 2103 bp, Artificial Sequence
  Description of Artificial Sequence: Synthetic coding sequence
atggaacctctgtgtcccttgttgctggtcggcttctcgctcccattagccagggccctccgtgggaatgagacaaccgccgactcaaacgagactaccaccacgagcggccctccagatcccggtgcaagccaacccctgttggcctggctgctgctgcccctgctgctgctcttactcgttcttcttctggcagcctacttctttcggttccgaaaacaacgcaaggctgttgtatcaaccagcgacaagaaaatgcctaatggaatcctggaggagcaggaacagcagcgggttatgctgctgagccggtcaccttcagggccaaagaagtatttccctattccggtcgaacatctcgaggaggaaattaggatccgctcagctgacgactgcaagcaattcagggaagagttcaacagcctgccctccggacacatccaaggcacgttcgaattggcaaataaagaagagaacagggaaaagaatagatatcccaatattctgccaaacgaccattctcgtgtaattcttagtcagctggacggcatcccatgttccgattatatcaacgcatcatacatcgacggctataaggaaaagaataagttcatcgccgcacaggggcctaagcaggaaactgtcaacgatttttggagaatggtatgggaacaaaagtccgcaacaattgtgatgcttaccaatctgaaagaacgaaaggaggagaagtgccaccagtattggcctgaccagggatgttggacctacggtaatatccgggtttgtgtggaagactgcgtggtgcttgtggactacactatacggaagttctgtatccaaccccagctccctgatggctgcaaggctccgaggcttgtatctcagctgcatttcacgtcctggccagacttcggtgtcccttttaccccaatcggtatgctgaaattcctgaagaaagtgaagacactgaaccctgtacacgccggaccaatagtggtgcactgttcagcaggggtggggaggacggggacctttattgtcattgacgcaatgatggcaatgatgcacgcggaacagaaggtggacgtttttgaattcgttagtcgaatcagaaatcagcgtccccagatggtgcaaactgatatgcagtatacgttcatctaccaagctctgttggagtattacctctacggggacacggagctcgatgtgtcaagcctagagaagcacctgcagaccatgcatggaacaactacacatttcgacaagattgggctagaggaagagttcaggaaattgaccaatgtgagaatcatgaaagagaatatgcgaacaggaaacctccctgcaaacatgaaaaaggctcgcgtcattcagatcataccttacgatttcaatcgggtgatcctgtctatgaagcgtggtcaagaatatacagactacatcaatgcttcttttattgacggctatcgccagaaggattacttcattgccactcagggaccactggcccacacagtggaagatttttggcggatgatctgggagtggaagagtcatactatcgtgatgttgacggaggtccaggaacgggaacaggataagtgttatcagtactggcccacagagggatccgttacccacggggaaataacgattgagataaagaacgacaccctgagcgaggcaatcagtattcgggactttttagtaacccttaaccaaccgcaagcacgacaggaagaacaagtgcgcgtggtaaggcagtttcactttcacggatggcctgaaatcgggatccccgcagagggaaaaggtatgatcgatttgatcgcagctgttcaaaaacaacaacagcagactggcaaccatccaattaccgtgcattgcagcgccggtgccggacgtacaggcactttcatcgctctgagtaatatcctggagcgggtgaaagccgaaggcttgctggacgtgtttcaggcagttaagtcactcagactgcagaggccgcacatggtccagactctggagcagtatgagttttgttacaaagtcgtgcaggactttatcgacatcttcagtgactatgcgaactttaaatag

SEQ ID NO: 237121 - DNA, 1929 bp, Artificial Sequence
  Description of Artificial Sequence: Synthetic coding sequence
atgtcaaacagaagctccttctccagactgacgtggttccgaaaacagcgcaaggccgttgtgtccacttcagacaagaaaatgccaaatggcatcctcgaggaacaggaacaacaaagggttatgctgttgtctaggagcccgagcggtcccaagaagtacttccccatcccagtggagcatctggaagaagaaattcgcatacgcagtgccgacgactgcaagcagtttcgtgaagagttcaacagcctcccttccggacatattcagggaacattcgagctagctaataaagaggaaaatcgggaaaaaaacagatatccaaatatcctcccaaacgaccactcccgcgttatcctcagccaattggacggcatcccatgtagtgattatatcaatgcgtcttatatcgatgggtataaagaaaaaaacaaatttattgctgcccaagggcctaagcaggaaactgtgaacgacttttggaggatggtctgggaacaaaagagcgcaacaatcgtaatgctcaccaacctcaaggaaagaaaggaggaaaagtgccaccagtactggccagatcagggttgctggacatacggcaatattagggtgtgcgtcgaagattgtgtcgtgcttgtggactatacaatccgtaagttctgcatccaaccacagctgcctgatggatgcaaggctcctcggcttgtctctcaactacactttacttcatggcccgatttcggggtgccattcacaccaataggcatgttgaaatttctgaagaaggtcaagactctcaacccagtccatgccggacccatcgttgtccattgctctgctggggtcggtcgcacaggcaccttcatcgtgatcgacgctatgatggcgatgatgcatgccgaacagaaggtggacgtcttcgagtttgtgtcccgaattaggaatcagcgacctcagatggtgcagaccgacatgcagtatacattcatataccaggctctgttagagtattacctgtacggtgacacagagctggacgtctcttcattggaaaagcacctccagaccatgcacgggacaactactcacttcgataaaattgggttagaagaggaattcaggaagctgaccaatgtgaggataatgaaagaaaacatgcgcaccgggaacctccctgccaacatgaaaaaagcgcgtgtgattcaaatcataccatacgatttcaaccgggtgatcctgtcaatgaagcgcggacaggagtatactgactacataaatgcctcgtttatcgatggataccgccagaaagactatttcatagcgacgcaaggccctttagcccataccgttgaagatttttggaggatgatatgggaatggaaatcccacactatcgtcatgcttacagaagtgcaggagcgagagcaggacaagtgctaccaatactggcctaccgagggatcggtgacacacggcgagatcaccatcgagatcaaaaacgatactttatccgaggctatctcaattagggacttcttagtgactctgaaccagccccaagcccgacaggaagagcaggtacgcgttgtcaggcagttccacttccatgggtggcctgagatagggatccctgcagaggggaagggaatgatcgaccttattgccgctgtacaaaagcagcagcaacagaccggcaaccaccccatcacagtgcactgttcggccggtgctggtcgtactggtaccttcattgccctctccaacatactcgagagggtcaaagcagaaggcctgctcgacgtgttccaggcagtcaagagtctacgtttacaacgtccgcacatggtgcagacccttgagcagtatgagttttgttacaaagttgtgcaggacttcattgacattttctcagattacgcaaacttcaaatag

SEQ ID NO: 237122 - DNA, 2103 bp, Artificial Sequence
  Description of Artificial Sequence: Synthetic coding sequence
atggaacccctttgtccactactcttggtaggcttttctctaccgctggcccgagccctgcggggtaatgagaccacagccgattccaatgagacaacaacaacctctggcccacccgaccctggcgcttctcaacccctcctggcctggctgcttttgcctctgttgctattgctgctcgtcctgctgcttgcggcttacttctttcgctttaggaaacaacgaaaagctgtggtctctactagtgacaaaaagatgccaaacggcatcctggaagaacaggaacaacagcgcgttatgctgctgagccgaagtccaagcgggcctaagaaatatttcccaattcctgtggaacatctggaagaggagattcggatacgtagcgccgatgactgcaaacaattccgagaggaatttaatagcctgccttccggccatattcaggggaccttcgagctcgccaacaaggaagagaacagagagaagaaccgatacccaaacattctgcccaacgaccacagtagggtcattctttcccaacttgatgggatcccctgcagcgattacataaacgcatcatacattgatggctataaggagaaaaacaagttcatcgcagcccaaggacctaagcaggaaaccgttaacgatttctggagaatggtttgggaacaaaagtccgccactatcgtgatgctgaccaatctcaaggaacggaaagaggagaaatgccaccaatattggcccgatcaggggtgctggacttatggcaacattagagtgtgtgttgaagattgcgtggtgctggtggactatacaatccgaaagttttgcatccagccccaattgccagacgggtgtaaggctcccagattggtgtcacagcttcattttacatcatggcctgattttggcgtgcccttcacacccattggcatgctgaagtttctaaaaaaggtcaagaccctgaatcctgtccatgccggtccaatcgtcgtccattgttctgcgggagtggggcgtaccggcactttcatcgtcatcgacgctatgatggccatgatgcatgctgagcaaaaggtcgatgtgtttgagttcgtgagccgaatcaggaatcaaagaccgcagatggtacagacggatatgcagtataccttcatttatcaggctctccttgagtactacttgtatggcgacacggaactggatgtctcatccctggaaaagcacctgcagactatgcatgggaccacaacacatttcgacaaaatcggcttggaggaggagttcaggaaactgaccaatgtacgtatcatgaaggagaacatgagaacagggaacttgccagcaaacatgaaaaaagccagggttatccagataatcccctacgacttcaatcgagtcatcctcagcatgaaacgagggcaggagtataccgattacattaacgcaagtttcatcgacggttatcgccagaaagattactttatagccactcagggccctctggcccacaccgttgaggatttttggagaatgatctgggagtggaaatctcacaccatcgtgatgctgacagaggtacaggagcgggaacaagacaaatgttaccaatactggccgaccgaagggtcagtcacccacggggagattactatcgaaatcaaaaacgacacattgtcggaggcgatctctatccgtgattttctcgtgaccttgaatcaaccacaggctagacaggaagaacaggtgagagtggtaagacagtttcacttccatggttggccagaaataggcatccccgctgagggcaagggcatgattgaccttatcgcagctgtccagaaacaacagcagcagacaggcaatcaccctatcaccgtccactgcagcgctggcgctggcaggaccggaacctttatcgccctttccaacattctggagcgcgtcaaagccgaaggacttctggatgtgtttcaggccgtgaaaagcctgcgtctgcaaagaccacacatggtacagactctcgagcagtacgaattctgttataaagttgtccaggattttatcgacatctttagcgattatgctaactttaagtag

SEQ ID NO: 237123 - DNA, 438 bp, Artificial Sequence
  Description of Artificial Sequence: Synthetic coding sequence
atggagccactctgcccgctgctgttggtgggcttctcactcccactcgcccgagccctgaggggtaacgagacaactgccgactctaatgaaaccactacgacctctggaccacctgatcccggtgcctctcagcctttgttggcttggctgctcctacccctgctgcttttgctcctcgtactcctactcgctgcctacttctttagatttcgcaagcagaggaaggccgtggtcagcacgagtgataaaaagatgcctaacggtatactggaggagcaagagcagcagagagttatgctactcagccgaagcccaagtggacccaagaaatatttccccattccggtggaacaccttgaagaagagataagaataagatctgcagacgactgtaagcagtttcgcgaggagtttaacatgacaatattgggctag

SEQ ID NO: 237124 - DNA, 2010 bp, Artificial Sequence
  Description of Artificial Sequence: Synthetic coding sequence
atggtatctcagcgacttcccagaaaaactaggggaccaccttggagcccgtgtgtgcattcttgttggtgggtgttggcctgtcggagccccggattaagcggagctacacgcccactgcctaccgcaacaagacaaccgagaccacaggccctgcgaactcgggcacccccaagcaggtgctggcctggatgctattgtcgatgttgctcatcatcgtcatgctcattctccccccctacatcatctgggagtggaccaaagaagtattttccaattccagtggaacatctggaagaagaaatccgaatcagatccgcggacgattgtaagcaatttcgggaagagttcaattcacttccttcagggcacattcagggcacattcgagctggcaaataaagaggagaatagggagaaaaaccgttacccaaacatcttgcccaacgaccacagtcgggttatcttatctcagctggacgggatcccatgctccgactatataaatgcatcatacatagacggctataaggagaagaataaattcatcgctgcccaaggcccaaagcaggagaccgtaaacgacttttggagaatggtgtgggagcagaaatctgcaactattgtgatgttaacaaacctgaaggaacgcaaggaggaaaaatgccaccagtactggccggaccaagggtgttggacttacggcaacatccgggtatgcgtagaggactgcgtcgtgctcgtggattacaccatccgcaagttctgtattcagccgcagctccctgatgggtgtaaggcaccacgcttagtttctcagcttcacttcacgtcatggccagactttggagttccattcacccccataggaatgctcaaatttcttaaaaaggtcaaaactttaaatcccgtgcacgctggcccaatcgtggtacattgctcagctggggtcgggagaaccggaacatttattgtgattgatgccatgatggccatgatgcacgcagagcagaaggtggacgttttcgaatttgtctccagaatcaggaaccagcgccctcagatggtccagaccgacatgcagtacaccttcatctatcaggctctgttagagtattacctatacggggatacggagctcgacgttagtagcttggagaagcatctccaaacaatgcatgggaccaccacccacttcgataaaattgggctggaagaggaattccgcaagctgaccaacgtccgtatcatgaaagagaatatgagaaccggcaatcttccagcgaacatgaagaaagcccgagtcattcagattatcccgtacgattttaatagggtgattctgagcatgaaacgtggccaggaatacacagattatatcaatgcttccttcattgatggttacagacagaaggactacttcatcgccacacagggtcccctggcgcacacggtggaagacttttggaggatgatctgggagtggaaaagccataccatcgtgatgctgacagaggttcaggagcgagaacaggataagtgttatcagtactggcctactgaaggttccgtgactcacggggaaattaccattgagattaaaaacgatactctcagcgaggctatttccattcgtgatttcctggtgactctgaaccagccccaggcacgtcaggaggaacaggtgcgcgtggtccgacaattccatttccacgggtggcctgaaattggcatcccagcggagggcaaaggcatgattgacctgatcgctgcagtccagaaacaacaacagcaaaccggaaaccacccaattacagttcactgccgcaactctatgaactccgccacaaaatggtataagattctgctgatctactttctgataatgctgataagcaatgaggactcttgtttaaagattttctttaatttaatggagcagagacgcagtcactttcctcaggacgctcgtctctctcctccactctcagggaccgcatttgcactgtag

SEQ ID NO: 237125 - DNA, 423 bp, Artificial Sequence
  Description of Artificial Sequence: Synthetic coding sequence
atggagcctctttgcccactcctgctcgtcggcttcagtctgcccctagctcgagctcttcggggtaacgagaccacagccgatagtaacgagacaaccacaacatcaggtcctcctgatcccggagctagccagcctttgctcgcatggttgcttctgcccctgctgctgctcctgctggtgcttttactggctgcctacttttttaggttccgcaagcaacggaaggccgtagtctccaccagcgataagaagatgccaaacggaatattggaggagcaggagcaacagcgcgtaatgttactgagtcgatctcccagtggccctaaaaagtatttccccattcctgttgagcacctggaggaggaaatcagaatccggtctgctgacgattgcaaacagttccgggaggagttcaactag

SEQ ID NO: 237126 - DNA, 465 bp, Artificial Sequence
  Description of Artificial Sequence: Synthetic coding sequence
atggagccactttgtcctctcctgcttgtgggcttctccctccccctggctagggcactgcggggtaacgaaaccaccgctgactccaatgagaccactactacctcaggcccacccgaccccggagccagtcaacctcttctggcatggctcttattacctttgcttctgctgttactggttttgctcctggccgcatatttctttcggttcaggaagcagaggaaagccgtggtgtcgaccagtgacaagaaaatgccaaacgggatactcgaagaacaggaacagcaacgcgtgatgctattgagtagaagtccttccggccctaaaaagtattttcccattcctgttgagcatttggaagaagaaattcgtatccgctccgctgatgattgtaagcagtttagagaagagttcaattctttgccctcaggtcacatacaagggacgtttgaactcgcatag

SEQ ID NO: 237127 - DNA, 5723 bp, Artificial Sequence
  Description of Artificial Sequence: Synthetic coding sequence
atggccccagagcctgcccctggcagaaccatggtaccacttgtacccgcattagttatgctgggcctggtggccggagctcatggcgattccaaacccgtgttcattaaagttcctgaggaccaaactgggctctcgggtggcgtggcctcctttgtctgccaagccactggggagccaaaacctaggattacttggatgaaaaaggggaagaaagtcagcagccagaggtttgaggtcattgagtttgacgatggtgcagggagcgttctccggattcagcctttaagggtgcaacgcgatgaggccatatatgagtgcaccgcgactaatagcctaggagaaataaatacttccgctaaattgtccgtgttggaggaggagcagttgcccccaggcttccccagcatcgacatgggcccacaactcaaggtggtagaaaaggctaggaccgctacgatgctgtgcgccgctgggggaaacccggacccagagattagctggttcaaggactttctccccgtggatcctgccacctccaatggcagaataaaacagttgaggtccggtgctttgcagatcgagtccagtgaggagtctgatcagggcaagtacgaatgtgtggccacaaatagcgccggtaccaggtattcagcccctgccaatctctatgtcagggtccgcagagttgcacctcgctttagcatcccgccttcctcacaggaggtgatgcccggagggtcagtcaacctgacatgtgtggcagtgggggcacctatgccatacgtgaagtggatgatgggagccgaagagcttacaaaggaggatgaaatgcccgttggaaggaatgtgctggaactatctaacgtggtccgttcagctaactacacgtgtgttgctatttcctcgcttggaatgatcgaggctaccgcacaagttaccgttaaagccctgcctaagccaccaattgacttagtggttactgaaacaaccgctacatcagttactctcacttgggattctggaaacagcgaaccggtcacctactatgggattcagtatagggctgctggaaccgagggacccttccaagaagttgacggcgtggcaactactcgttattctatcggtggactcagcccattctccgagtatgcattcagggttttggcagtaaactcaattggccgagggccaccatcagaggccgttcgcgcacgaaccggggaacaagccccttcatcccccccaagacgcgtacaggccaggatgctgtcagctagcactatgctagtgcagtgggaacccccagaagagccaaacggactggtccggggataccgcgtgtattatacccctgactcacggaggcctcccaatgcctggcacaagcacaacacagacgctggcctgctcaccactgtaggctcactgttacccggtatcacttactccttaagagtgcttgccttcacagcggtcggcgatggcccaccatccccgacgattcaggtgaagacacagcagggggtgcctgcccagcccgctgattttcaggctgaggttgaatccgatacccgcatacagttgtcctggttattgcctccacaggagaggattattatgtacgagctagtctactgggcggctgaagatgaagatcagcagcataaggtgacatttgatccaactagcagctacaccctggaggatttaaaacccgacacactatatcgcttccagctggctgctagatctgacatgggggtgggcgtcttcacccctaccatagaggctcgaactgcacaaagcacgccatccgcccctccccaaaaggtgatgtgcgtctctatgggctccacaacagtcagagtctcttgggtacctcctcccgcagatagccgcaacggggtgatcacccagtattctgttgcatacgaggcagtggatggggaggaccgagggaggcacgttgtggatggaatatctcgtgagcactccagctgggacctcgttggattggaaaaatggacggagtaccgggtctgggttcgtgcccacacagatgtggggccaggccctgagagctcacccgtactggtgagaacagatgaagacgtaccaagcggacccccacgtaaggtggaagtggagcctctgaactctaccgccgtccatgtttactggaaactgccagtcccctccaaacagcacggacaaatacggggataccaggtcacctacgtgcggctagagaacggtgaacctaggggcctcccaattattcaggacgtaatgctagcagaggcacagtggcggccagaagagagcgaggattacgaaacgacgattagtgggttgactcctgagacaacctactcggttaccgtggcagcatataccacaaaaggggatggtgcgagatcaaagcccaagatagtgaccacgaccggcgctgtgccaggacggccaactatgatgatatcaactactgccatgaataccgccctcctgcagtggcacccccctaaggagctgcctggcgagttactaggctacaggcttcaatactgcagggctgacgaagcaagacctaatactatagactttgggaaagacgaccagcatttcactgttaccggactgcacaaaggaactacttatatattccgactggcagcaaaaaaccgggctgggcttggcgaggagttcgagaaagaaattaggacccctgaggatttgccctccggattccctcagaatctccacgtgacagggttgacgacctccaccaccgaactggcttgggacccgcctgtgctggcagagcggaatggaagaataataagctataccgttgtttttcgtgatattaatagccagcaggaattacagaatattactacggatacgagattcactctcactggactgaaacctgacaccacttatgatatcaaagtccgcgcttggacttcaaaggggagcggcccactctcccctagcatccagtccagaacaatgcccgtcgagcaggtgttcgccaagaacttcagagtggccgctgcaatgaagacctcagtgttactttcttgggaggttcccgatagctacaaatccgctgtgcccttcaagatcttatataatggccagagcgtcgaggtcgacggccattcgatgcgcaaattgatagccgaccttcagccaaacacggagtactcatttgtgttgatgaacaggggcagttccgcgggaggtttacagcacctggtgtccatcagaaccgcaccagatctcctgccacataagcccctgccagcttctgcatatattgaggatggccgattcgacctctcaatgcctcatgtccaggacccatccttggtgagatggttctacatagtagttgtcccgatcgatcgggttggcggttcgatgcttactccacgatggagcacaccagaagaactcgagttggacgagctcctcgaggcaatagaacaggggggtgaggagcagagacgcagacgaaggcaggctgagcgactgaaaccgtacgtagcggcacagttggacgtactgcccgaaacattcactttgggtgacaagaagaactatcgcggtttttacaatcgaccgctgtcccctgaccttagctaccagtgcttcgttctggcgagcctgaaagagcccatggatcagaaacgatatgcctctagcccatacagcgatgaaatcgtcgtgcaggttactccagcccaacagcaggaagaaccagagatgttatgggtcaccgggcctgtgctagcagtgatcctaattatactgatcgttatcgcaatcctgctgtttaagagaaagaggacacattcccccagcagcaaggacgagcagtccatcggactgaaggattcccttcttgcccactccagcgatcctgtggagatgagacgccttaattaccaaaccccaggcatgcgggatcatccgccaattcctatcacagacctcgccgacaatattgagaggctcaaggccaacgacggactgaagttttcccaggagtatgagtctatcgatcccggacaacagttcacttgggagaattcaaatctggaagttaacaagcctaaaaaccgctatgccaatgtaatcgcttatgatcatagtcgagttattcttacctcaattgatggcgtgccgggaagcgactacattaatgcaaactatattgatggttacagaaaacagaacgcgtatatcgctacccaagggccactgcctgaaacaatgggcgacttctggagaatggtctgggaacagcggacagccactgtggtaatgatgacacgactggaagaaaaatcaagggtgaagtgtgatcagtattggcccgctagaggtactgagacctgtgggctgatacaagtcacccttctggacaccgtcgagttggccacctacactgtgagaacattcgctcttcataaatccgggtcctctgagaaacgggagctgcgacagttccagttcatggcctggcctgaccatggtgtaccagaataccctaccccaatcctggctttcctgcggcgagtgaaggcctgtaatcccctggatgcgggtcccatggtggtacactgttctgccggtgtgggtaggaccgggtgctttatcgtgatcgacgccatgcttgagcgcatgaagcatgagaagacagtggacatatatggccacgtaacttgtatgcggtctcagcgtaactatatggtgcagacggaagaccagtacgtcttcatacacgaggccctgctcgaagcagctacatgcggccacaccgaggttcctgcccgaaacctgtatgcccacatccagaagctcggacaggtgcctcctggggagtcagtaacagctatggagctggaatttaagctcttagctagtagtaaagctcatactagcagatttatttctgccaacctgccctgcaataaatttaaaaacagattagtgaacattatgccatatgagcttactcgagtctgcctccaaccgatacgtggagtggaagggtccgattatatcaatgcaagtttccttgacggctatagacagcaaaaggcctacattgcaactcagggtcccctggcggagtccacggaggacttctggcgaatgctgtgggagcataatagcacaattattgtgatgctgactaagcttcgcgaaatgggacgcgagaaatgtcaccaatactggcccgctgagaggagtgctagataccagtacttcgtggtcgatcctatggccgaatacaacatgccccagtacattctgcgagaattcaaggtgacagatgccagggacggacaatctagaactattaggcagtttcagtttaccgactggcccgagcagggtgtccctaagaccggcgaggggttcatcgacttcatcggccaggtgcataagaccaaagagcaattcggacaggacggacctatcaccgttcactgcagtgctggcgtagggcgtacaggcgtattcatcaccctgtcaatcgttctcgaacggatgcgatacgaaggcgtggtggacatgtttcagaccgttaaaacgctcagaacgcagcgccctgctatggttcagacggaagaccagtatcagctctgttatcgtgcagcgttagagtacctgggctccttcgatcactacgccaccta

SEQ ID NO: 237128 - DNA, 5696 bp, Artificial Sequence
  Description of Artificial Sequence: Synthetic coding sequence
atggcccctgagcctgcgcctgggcgtaccatggtcccccttgtaccagccctggtgatgctgggcttagtcgcaggcgctcatggggattcaaaacccgtgtttattaaagtgcccgaagatcagactgggttatctggcggtgttgccagctttgtatgtcaggcaaccggggaacccaagcctaggattacctggatgaagaaaggcaaaaaagtcagcagccaacgtttcgaggtgatcgagtttgacgatggagcaggatcagtgctgcgcatccaaccactgagggtccagagagatgaagcgatatatgaatgcaccgccaccaattcccttggagagatcaacacgagcgccaaactttccgtgttagaggaagaacagttgccaccagggttcccaagtattgatatgggaccacaactgaaagtagtcgaaaaggccaggacagcaacgatgctctgcgctgccggaggcaatccagaccctgaaatctcttggtttaaagattttctgcccgtggacccggcaacgagtaatggccgtatcaaacagcttagatcgggggctctgcagatcgagtcgagcgaggaatcagaccaggggaaatacgagtgtgtagctacaaattcggcgggaacccgctacagcgccccagcgaacctctatgtgcgagttcgtagagttgcaccgagattctccattccaccctcttcgcaggaagttatgcctgggggatctgtaaatctcacctgcgtcgccgtaggggctccaatgccttacgtcaaatggatgatgggcgctgaagagttaacgaaggaagacgaaatgcccgtcggcaggaacgtcctcgagttaagcaatgtcgtgcgatcagcaaattatacttgcgtggccatcagtagcctcggcatgatcgaggccacagcccaagtgacagtgaaggccctgcccaaaccccctatcgatttggtggtgaccgaaactaccgccacctcagtgaccctcacatgggactccggaaattcggagcccgtgacgtattacgggatccagtacagggccgcaggtacagaaggcccatttcaagaggtcgacggcgtcgctactacacgctattctatcgggggactctcccccttcagcgagtacgcgtttagggtcctggcggtgaactcaatcggtagaggcccaccaagtgaagcagtacgggctcgcaccggtgagcaggccccatcttctccacctcggcgagtgcaggcccgtatgttgtccgctagcacgatgttagtccagtgggagcctccagaggaaccgaatggccttgttcggggataccgggtgtattatacacccgattcacgcaggccgccaaacgcatggcacaagcacaacaccgacgcaggcctcctgaccactgtgggatcactgctcccaggcattacttacagcctgagggtcttggccttcacggccgtgggcgatggtccgcctagccccacaattcaagtgaaaacacagcagggggtcccagcccagcccgctgacttccaggccgaagtggaatctgacacacgcatccagctgtcgtggttactgccccctcaggagcgaattattatgtacgagctggtgtattgggccgcagaggatgaagatcagcagcataaagttacttttgatcccacatcatcttacacattggaggatttaaaacccgataccctgtaccgttttcagttggccgctagatctgatatgggcgttggtgtcttcactcccaccattgaagctagaaccgcccaatccacacccagcgcacctcctcagaaggtgatgtgcgtgagcatgggaagcaccacggtgcgggtgagctgggtcccacctcccgctgattctcgtaacggtgtcatcacgcagtactccgtggcctacgaggcggtagacggagaggataggggacgccacgtggtggacggtatttcaagggagcattcaagctgggacctggtggggctcgaaaagtggaccgagtacagggtgtgggttagagcccacactgatgtggggcctggccctgagtcttcgcccgtcctggtgcgaacagacgaggacgtgccgtctggaccgcctcgaaaggttgaagtcgagccgctgaactccacggctgtgcacgtttactggaagctgccagtacctagcaaacagcacggccagattcgcggataccaggttacatatgttaggctggaaaacggagagccacgagggctgccaataatacaggatgtcatgctcgctgaggctcaagaaactactatttcaggattaacacccgaaaccacgtactctgtcaccgtcgccgcatacactaccaaaggcgacggagcccgtagcaagccaaaaatcgtgacaaccaccggcgctgttcccggacggcctacaatgatgatttccactacagctatgaataccgcacttttgcagtggcacccacctaaggagctccctggtgagttacttgggtataggcttcagtactgccgggcagacgaggctcgacccaatacaattgattttggaaaagacgatcagcacttcactgtgaccggtctccacaaaggcaccacttacatctttcggctggccgcaaaaaaccgggcaggattgggcgaagaatttgaaaaggagataagaacgccggaagacctcccaagcggcttccctcagaacctgcacgtaaccggactgactactagcacgactgaactggcctgggatcccccagtcctggccgagcgtaacggcagaatcataagttataccgtggtctttagagatatcaatagccaacaagagcttcagaatatcacgacggatacaaggtttaccttgactggcctgaagccggataccacctatgatattaaagtgcgtgcttggaccagcaaaggctcaggccctctttctccctccatccaaagcaggaccatgcctgttgagcaagtatttgcaaagaatttcagagtcgctgctgccatgaagacgtctgtgctgttaagctgggaggtgcccgattcctacaagtcagctgtgcccttcaagatcctctacaatggacagtccgtcgaagttgatggccacagcatgaggaagctgattgccgatctgcagccaaataccgagtactccttcgtgctaatgaaccgaggtagctctgcgggtgggttgcagcaccttgtgtccatccggactgccccagatctgcttccccacaagccattacctgccagcgcgtatatcgaggacgggcgatttgacttgtccatgcctcacgttcaggaccctagtctggtccggtggttctacattgtagtggttcccatagaccgcgttggaggtagtatgctgacaccacggtggtctactccagaggagcttgaattggacgagctgttggaagccatagaacagggcggtgaagaacagcgtcgccgaaggagacaagctgaaagactgaagccttacgtggcagcccagttagatgtgctgcccgaaacatttactctgggggacaaaaaaaattaccgtgggttttacaaccggccactctccccagacttgtcttatcagtgtttcgtgctcgcgtcactcaaggagcctatggaccaaaagcgatacgcaagttcgccatatagtgatgagatcgtcgtgcaagtcactcccgcacagcaacaggaggaacctgagatgctttgggtcacaggtcccgtcctggccgttatcctgattattctaatagttattgctatcctgctgttcaagaggaaacggacgcactctccctccagcaaggatgagcaaagcattggtttaaaagattccctgttggctcactccagcgatcctgtggaaatgaggagactcaattaccagacccctgggatgcgagaccatcccccaattcccatcacagacttagctgacaacattgaacggctgaaagctaatgacggcctgaaattttcccaggagtacgagagtattgaccctggccagcaattcacctgggaaaattccaatttagaagttaacaagccaaaaaatagatatgcgaacgttattgcttatgatcactctagagtgatcctgacctccattgatggcgtccctgggtcagactatatcaacgctaattacatcgatgggtaccgcaagcagaatgcatacatcgctacccagggccctcttcctgaaactatgggcgacttttggcgtatggtctgggaacaacgcactgcaaccgtggtgatgatgactcgcctcgaagagaaatcccgtgttaaatgcgaccaatattggccagccagaggaacggagacatgcggccttatacaggtgaccttgctggacaccgtggaattggccacatataccgtaagaaccttcgccctgcataaatcgggcagctctgagaaaagggaactgcggcagtttcaatttatggcctggcctgaccacggtgttccagagtaccccacgcctattctggcctttctgcgacgagtgaaggcgtgtaatccactggatgccggacccatggtcgttcattgttctgccggagtgggtagaacagggtgttttatcgtaatcgacgctatgcttgaaaggatgaaacatgagaagacggtggacatatacgggcatgtgacctgtatgcgcagccagaggaactacatggtccagacagaggaccaatatgtgtttattcatgaggctttgctcgaagcggcaacttgcggacacacggaggtgcctgcgagaaatctgtacgcccacatccagaaactggggcaagtcccaccaggggaatctgtaaccgccatggagctcgagttcaaactgcttgcatcttctaaagcccatactagcaggtttattagcgcaaaccttccatgcaataaatttaagaacagactggtcaacataatgccatatgaactgacccgtgtttgcctgcagcctatccgcggtgtagaaggtagcgactacattaacgcatctttcctcgatggttacagacaacagaaggcttatatagcaacacaaggaccattggcagagtccaccgaggacttttggagaatgctttgggagcataatagcaccatcatcgtgatgctgactaagttacgggaaatgggcagagagaagtgccaccagtattggcccgctgaacgctccgccagataccagtacttcgttgtggaccctatggccgaatataatatgccccagtatatcctccgagaatttaaagtcacggacgcacgcgacggtcagtcccggaccatcagacaatttcagttcacagactggcctgagcagggtgtccccaagaccggggagggattcatcgactttatcggccaggtgcataaaactaaggagcagttcggccaagatgggcctattaccgtgcattgttccgccggagtgggccgaacaggggtattcattacattgagcatagtcctggagagaatgcggtatgagggcgtggtggatatgtttcaaactgttaaaacgttaagaacacagcggcctgcaatggttcagacagaagaccagtatcagctatgttatcgcgctgcgctggaatacctgggttcatttgatcactatgcgacata

SEQ ID NO: 237129 - DNA, 5723 bp, Artificial Sequence
  Description of Artificial Sequence: Synthetic coding sequence
atggctcccgagcctgccccagggaggaccatggtgccactcgtccccgcacttgtcatgctgggcctcgttgcgggtgcccacggggactctaaacctgtgtttataaaagtgccggaagatcagacaggccttagtgggggagtggcttcctttgtgtgccaggctacaggcgaacccaaacccaggattacatggatgaagaaggggaaaaaagtgtcctcccaaagattcgaggtcatcgagttcgacgacggggcaggctccgtgctcaggatacaaccgctcagggttcagagggacgaagctatctatgagtgtaccgctaccaattcactgggtgaaatcaatacttctgccaaactgagtgtattggaagaagagcagctgcccccaggattccccagcattgacatggggccacagctaaaagtggtcgaaaaagcaagaacagctacaatgctctgcgccgctggtggcaatccagatcctgagatctcctggtttaaggatttcctgccagtggacccagccaccagcaatggtcgaattaaacaattacgatcaggtgcccttcagatcgagtctagcgaagagtccgaccagggcaagtatgaatgcgtggccaccaacagcgcaggcactagatactccgccccagcgaacctgtatgtgagagttcggcgtgtggccccaaggttttccatccccccttcttcacaagaggtcatgccagggggtagtgtcaatcttacatgcgtggcagttggggcacctatgccttacgtcaaatggatgatgggggcagaggagctgacaaaggaggacgagatgcctgtgggtcgcaatgtcttagaactcagtaatgtagtccgcagcgcgaactatacctgcgtcgcaatttctagtttgggcatgattgaggccaccgctcaggtgaccgtgaaggccctgccgaagcctcctatcgatttagtcgtgactgagactaccgcaaccagcgtgaccctcacctgggattccggaaattcagagccggtgacttactatgggattcaatatcgcgcagccggaaccgaaggaccttttcaggaggtcgatggggtggccacgacacgatacagtatcggtggattgtcacctttcagtgagtatgcgtttcgcgtgttagcagtaaattctatcggcagaggcccaccctctgaagcggtgagggcccgaaccggcgagcaagctccatccagcccacccaggagagtgcaagcaaggatgctgagcgcttcgaccatgctcgtgcagtgggagcccccagaagaaccaaacgggttagtccggggttaccgtgtgtactataccccagactcaagacggcctccaaatgcctggcacaagcataatacagatgccggattgctaacgactgtcggcagcctgctgccaggaattacatattcacttcgggttctcgccttcactgcagtgggagatggacccccatcacccactattcaggtcaaaacccagcagggagtgccggcacagcctgcagacttccaagccgaggtcgaatcagacactagaatccaactgtcctggctcctgccgcctcaggagaggattattatgtacgagctggtgtactgggccgcagaggatgaagaccaacagcataaggtcacattcgaccctacatcatcctacaccttagaggacctgaagcccgacaccttataccgatttcagctggcagctcggtctgatatgggcgtaggggtgttcactccaacaattgaagccagaaccgcccagagcacccccagcgcgccacctcagaaggttatgtgtgtgagcatgggctctaccaccgtccgggtcagctgggtcccccctcccgctgacagccgaaacggggtcattacacagtattccgtggcctacgaagccgttgatggtgaagacaggggaaggcacgtagtggatgggattagtcgagagcactccagttgggacctggtgggcctggaaaaatggacggaatatagagtctgggttcgcgcacacacggacgtcggccctggaccggagtcttcacctgtcttggtgcgcaccgacgaagacgtgcccagtggcccaccaagaaaggtggaagtggagcccctgaactccactgctgtgcacgtgtactggaagttaccagtgccatcaaagcagcacggacagatccggggttatcaagtgacctatgtccgcctggagaacggagagccgcgaggactgcctatcattcaggacgtaatgctggcggaagctcagtggcggccagaggagagcgaagattacgaaactacaatatccgggcttacgcctgagaccacctatagtgtcaccgtggccgcatacacaacaaagggcgatggggctaggagtaaaccaaaaatcgttacgacaactggtgcagtgcctggcaggcctaccatgatgattagcactactgcgatgaatacggccttgttgcagtggcatccacccaaagaattacccggagaactactgggttacagattgcaatactgtagagccgacgaagccaggccaaataccatcgacttcggcaaagatgatcagcactttacagtcaccggcctccataaaggcaccacatacatctttagactggctgctaagaaccgggctgggttgggcgaagagttcgagaaagaaatccgtacaccagaggacctcccttctgggttcccacagaatctgcacgtaactgggttgaccacatctaccaccgaacttgcctgggatcccccagtgctggctgagcggaacgggaggattatttcgtatacggtggtgttccgggatatcaactcccagcaggagctccagaacataaccaccgatacaaggttcacgctgacaggactcaagccggatacaacgtacgatattaaagtcagggcatggacttctaaaggctccggaccgctgagccccagtatccaatcacgaacaatgcccgtggaacaggtgtttgcaaaaaatttcagagttgccgcagctatgaaaacaagcgtcttactctcctgggaagtcccagactcctacaaaagcgcggttcctttcaagatcctatacaatggtcaatcagtggaggtggacggccattctatgagaaagctcattgccgatctgcaacccaatactgagtactcttttgtccttatgaatcggggatcaagtgctggaggcctgcaacacttggtatccattcgcactgctcctgatcttttgccccacaagcctctacccgctagcgcatatattgaggacggaaggttcgacctgtctatgccacatgtgcaggaccctagcttagtacgatggttttacattgtggtggttccaatcgatagggtaggcggttctatgttgaccccaaggtggtccactcctgaagagctggaactcgatgagctgctggaagcgattgaacaaggcggagaggagcagcggagacgccgacggcaggctgaaagactgaaaccttatgtcgcggctcagcttgatgtcttgcccgagacctttactctgggcgacaaaaagaactaccgaggcttttacaaccgtcccctttctcccgatctgagctatcagtgctttgtgctcgcttctttaaaggagccgatggatcagaaacgttatgcgtctagcccgtactctgacgaaattgtcgtgcaggttacacccgctcagcaacaggaggagcccgaaatgctgtgggtgactggacctgttttagccgtaattctaattattctaattgtgatagccatacttctgttcaaaaggaagcggactcacagccccagtagtaaggatgagcaaagtatcggcctgaaagattccctgctggcccactcttccgatcccgttgaaatgcgtcgcttaaactatcaaacccccggtatgcgcgaccatcctccgatcccaataacggatcttgctgacaatattgagcggctgaaggccaatgacggcttaaagttctcccaagagtacgagtctattgacccgggtcagcagtttacatgggagaattctaacctggaggtcaacaaaccgaaaaatagatatgccaacgtgatcgcttacgatcactcccgtgtcattcttacttccatcgatggggttccaggtagcgattatattaacgctaactatattgacggatatcgcaagcagaatgcatatattgcgacccaggggccattacctgagaccatgggcgatttctggcgaatggtgtgggaacagcgtactgcaactgtggtgatgatgacaagactggaagaaaagtctagagttaaatgcgaccagtattggccagctcggggtacggagacctgtgggttgatccaggtgacattgctggataccgttgaattggccacctacaccgtcagaacgttcgctttacataaatccggcagtagcgagaagagagaactgcggcaatttcagtttatggcctggcccgaccatggggtgcccgagtaccctactccaattctcgcctttctcagacgcgtgaaggcttgtaaccctttggatgccggtcctatggtggtacactgttcagcgggtgtcgggcgtacgggatgctttattgttatcgatgctatgctcgagcgaatgaagcacgagaagaccgtcgacatctacggccacgtcacatgcatgagatcacaaagaaactacatggtccagaccgaggaccaatatgtcttcattcacgaggccctcctggaggcagctacctgcggccatactgaggtgcctgcacggaatctttacgcacatatccagaagctcggacaggtccctccaggggaatccgtcaccgccatggagctcgagtttaaactcctggcaagctccaaggcccatacatctaggttcattagtgcaaacctgccatgtaacaaatttaaaaatagattagtgaacataatgccatacgaactgactagggtgtgcctgcaacctatccgcggagtagaaggctctgattatatcaatgctagctttctggatggatataggcaacagaaggcttacatcgctacccagggcccattagccgaaagtacagaagatttctggcggatgctatgggaacataactctaccattattgtaatgcttaccaaactcagagagatgggaagggagaagtgtcaccaatactggcccgctgaaagatcagcgaggtaccagtattttgtggttgaccctatggccgagtacaacatgccccagtatatactcagggaatttaaggttactgacgctcgtgatggtcagtcgagaaccattcggcagtttcagttcaccgactggcccgagcagggggtccccaagaccggagaagggtttatagactttatcggtcaagtgcataaaacaaaggagcagtttggtcaggatgggccaataacagtccactgttcagctggagtggggcgaacaggagtctttattaccttaagtatcgtgctggaacgcatgagatatgagggggtggtagacatgttccagactgtcaagactcttcgcactcagcgccctgcaatggtacaaactgaggaccagtatcagctctgctaccgagcggcactagagtatctgggttcattcgatcattacgccaccta

SEQ ID NO: 237130 - DNA, 3801 bp, Artificial Sequence
  Description of Artificial Sequence: Synthetic coding sequence
atgtatgagctggtttactgggccgctgaggatgaggatcagcaacataaggtgacctttgatccaacttccagctatacccttgaggatctgaagcctgacacattatatcggtttcaactagctgcccgaagcgacatgggggtgggggtgttcaccccaacaatcgaagccaggacagctcaatctatgccaagtggaccaccacggaaggtcgaggtcgagccgctgaacagtaccgctgttcacgtgtattggaaactgcctgtgccatccaagcagcatgggcagattagaggctaccaagtgacatacgtgagactcgagaatggagaacctaggggcctgcccattatacaagacgtgatgttggccgaagctcaggagacaactatcagcggactcacacccgagacaacatactccgttaccgtggctgcatacaccactaagggagacggcgctcgctctaagcccaagatcgttaccacaaccggcgctgtccctgggagaccaacgatgatgatctctaccacagcaatgaacacagctcttctgcagtggcatccacccaaggagctgccgggtgaactcctggggtaccgcctccagtactgccgggctgatgaggctcggccaaataccatcgacttcggcaaagatgaccagcacttcactgtcactggcctccacaagggcactacatatatcttccgactggctgctaaaaaccgcgctggcctgggcgaggagttcgaaaaagagattcgcacccccgaagacctgcctagcggatttcctcagaatctgcatgtaactggtctgacaacgtcaacaacagaactggcttgggacccaccagtgctggcagaaagaaacggacggattattagttacacagtggtgtttcgcgacatcaattcccaacaagagcttcagaacattacaactgacacgaggtttactctgaccgggctaaagccggacaccacttatgacatcaaggtgcgggcatggacctcaaaagggtccggcccattgtcccctagcattcagtctaggacaatgcctgtggaacaggtatttgctaaaaacttccgggtggcagcggctatgaaaacctcagtgcttctctcttgggaagtccctgatagctataaatctgccgttcctttcaagatcttgtataacgggcagtccgtagaggtcgatgggcactccatgcgaaagctgattgctgatttacaaccaaacacggagtattcctttgtcttaatgaacagaggctcctctgctgggggtctgcagcacttagtgagtatccgaacggccccagacctcctgccacataaaccactgcctgcctctgcatatatcgaggatggtagattcgacctctctatgccccatgtgcaggacccctctctggttcgatggttttatatcgtggtagtgcctattgaccgggtagggggtagcatgctgaccccgagatggtcaacccccgaggaactggaactcgatgaactgttagaggccatagaacagggcggagaggagcagcggaggcgcaggcgccaagcagaaaggcttaagccatatgtggcagcacaactggacgtgctgccggagacctttacgctgggcgataaaaaaaattatagagggttctataaccggcctttgagtcctgatctgtcataccagtgctttgtgctcgccagccttaaggagccaatggaccagaagcgttacgcctcctcaccttatagtgatgagatagttgtgcaggtgacgcctgcccagcaacaggaagaacctgagatgctgtgggtgaccgggccagtgctcgccgttatcttaattatcttgatcgtgatcgccatcttactgttcaaacggaaaagaactcatagcccaagctccaaggatgagcagtcgatcggactgaaagactccctgttagcccactcctcagatccagtagagatgagaagactgaactaccagacaccgggatcctctgtgcccagctgcccaaacacttctagcatgcgagatcacccgcctatacccattactgacttggcagataatatcgagaggttgaaggccaacgatggactgaagttcagccaggagtacgagtccatagaccccggacaacaattcacgtgggaaaacagcaaccttgaggtaaataaacctaagaatagatacgctaacgttatcgcctacgaccatagccgagtcatcttgacctccatcgatggggtgcctggatccgattacataaatgccaattatatcgacggctaccggaaacagaatgcgtatatcgccacacaggggccattgccggagacaatgggtgatttctggcggatggtttgggaacaacgcacggctactgtggttatgatgacacggcttgaggagaagagtagggtgaaatgcgaccaatactggccagctcggggaacagagacatgcggcttaattcaagtgaccctgctcgataccgtggaactggccacttacactgttcggacgttcgccttacacaaatccgggtcatcagagaagcgcgagttgcggcaattccagttcatggcttggcccgatcatggagttcccgaatatccaacccctatactggctttcctccggagggtgaaagcatgcaaccctttagatgccggtccgatggtggtgcattgcagcgcaggtgtggggaggacagggtgttttatcgtcattgacgctatgctggaacgtatgaaacacgagaaaacagtggacatttacggtcatgtcacctgtatgaggtcccaacgaaactacatggttcagactgaggatcaatatgtcttcatccacgaagccctcctggaggccgcaacctgcggccatacggaagtccccgctcggaacctgtacgcgcacatccagaaacttggccaggttccccctggcgaatctgtgacagcaatggagcttgagtttaaactgctggccagctcaaaggcacacacatctcgtttcatttcagccaatctgccatgtaacaagtttaaaaatcgcttggttaatatcatgccatacgagcttacacgggtgtgcctccaaccaattcgtggcgtagaaggctcagattacatcaatgcctcttttctggacggttatagacaacaaaaagcctacattgccacccagggtccacttgccgaatccacagaggacttttggcggatgctgtgggagcacaattccactatcatcgtcatgctgactaagctgcgcgagatgggtagggagaagtgccatcagtattggcctgctgaacgctcagcacgttatcagtatttcgtggtggaccccatggccgaatataacatgccccagtatattttgcgtgaattcaaggtaaccgacgccagggacggccagtcaagaactatacggcagtttcaattcacggattggcccgagcagggagtgccaaaaaccggagaggggttcatagactttattgggcaggtacataaaaccaaagaacagttcggacaagatggtcccatcacagtccattgcagcgccggagtgggacgaactggtgtgttcattaccctttctatagtgttggagcggatgcgatatgaaggagtcgtggacatgtttcaaaccgttaaaactttgaggactcagagacctgcaatggtgcaaaccgaagaccagtatcagctgtgctatagggcagctctggagtacctggggagtttcgaccactacgctacatag

SEQ ID NO: 237131 - DNA, 5696 bp, Artificial Sequence
  Description of Artificial Sequence: Synthetic coding sequence
atggctcccgagcctgcccctggcaggacaatggtgcctctagttccagccctagttatgctggggctggtagccggagcccatggcgactctaagcctgtttttattaaggtccccgaagatcagaccggccttagcggtggcgtcgccagctttgtctgccaggctaccggagaaccaaaaccaaggattacatggatgaaaaagggcaagaaggtatcttcccaacggtttgaggtgattgagtttgatgatggcgcaggaagcgtgttgaggatccagcccctgagagtacagcgggacgaagccatatacgagtgcaccgctaccaatagtctgggcgaaattaacacgagtgcaaagctctccgtacttgaggaggagcagctccctcctgggtttccttctattgatatggggccacagctgaaggttgttgagaaggcaaggacagctacaatgctctgcgctgctggcggtaatcccgatccagaaatcagctggttcaaagattttcttcccgtggacccagccacgagcaacggtcgcatcaagcagctacgcagcggcgcactgcaaattgagtccagtgaagagtccgatcagggcaaatacgagtgcgtggcaaccaacagtgccggaaccaggtacagcgctcccgcaaacctttatgtgcgggttcggagagtggcgcctcgcttctcgataccaccgtccagccaagaggtcatgccaggcggatcggtgaacctcacctgtgtagcggtcggcgcaccgatgccctatgtgaaatggatgatgggcgcagaagagttaactaaggaggatgagatgccggtgggtcggaatgtactcgagttaagcaatgttgtaaggtccgctaactacacctgcgtcgccatttcaagtctaggaatgatcgaggcaacagctcaggttactgtgaaggctttacctaagcctcctattgacctggtcgtcacagaaaccaccgcaaccagtgtgactctgacctgggattccgggaactccgaaccagtgacctactatggtatccaataccgcgcagcgggtacagagggaccctttcaggaagtagacggcgttgccaccacacgctattcaatcggtgggctctctccattttccgagtatgcctttcgcgtcctggccgtaaatagcatagggaggggacctccctccgaggccgtgcgagcccgaactggagaacaagccccttcctcaccgccaaggcgtgtccaggcaagaatgctttccgcatcaaccatgctcgtccagtgggaacccccagaagaaccaaacggcctcgtgcggggttatagagtctattatacacccgactctagacgaccccctaatgcctggcacaagcataacacagacgctggtctccttacaaccgtgggcagcctgctgccaggaatcacctatagcctcagagttctggcatttaccgcagtaggggatggcccacccagtccaaccattcaggtcaaaacacagcagggcgtccctgctcagcccgcagacttccaagcagaggtggagagtgatacgcggatccaactcagttggctcctcccaccccaggagcggattataatgtatgaactggtctattgggccgcagaagatgaggatcagcagcacaaggtcacgttcgatccaacaagcagctacacactcgaggatctgaagccagatactctttatcgctttcagctggctgctcgttctgatatgggagtcggcgtgttcaccccgactattgaggccaggaccgcccaaagcactccatcagcccctcctcaaaaagtgatgtgcgtgagtatgggctccacaacagtacgcgtgagttgggtcccacctcccgctgacagccggaacggtgtgattacacagtattccgtcgcgtatgaagccgtggacggggaggacaggggacgccatgtggtcgatggcatcagccgcgaacactcttcctgggacctggtaggattggaaaaatggacggagtacagggtgtgggtaagagcccacacagacgtagggccaggccctgagagctcccctgttctggtgcggactgacgaagatgttccatccgggccaccacggaaggtggaagtggagcctcttaacagcacagccgtccacgtgtactggaagctgcccgtgcccagtaaacaacatggacagatccgaggataccaggtcacctacgtgagactcgagaacggcgaacctcgcggtctgcccatcattcaagatgtgatgctcgcagaggcccaggagaccacaatcagcggcctgactcccgagaccacatactccgtgactgtcgccgcttatacgaccaaaggagatggcgcacgcagtaagcctaaaattgttacaaccactggcgctgtgccaggtcgtcccacaatgatgatctcaacaactgcgatgaacacagcactgctgcagtggcatcccccaaaagagcttcctggagagctcctggggtaccgcctacagtactgccgggctgacgaggctcggcctaataccatcgatttcggcaaagacgatcagcacttcactgttaccggactccacaagggtaccacgtatatctttagacttgccgctaagaaccgtgcaggcctcggcgaagaatttgagaaagagattaggacacccgaggacctgccctcaggttttcctcagaatctccacgtcaccggactcacgaccagtacgaccgaactggcttgggatccgcctgtactggccgagcgcaatggaaggatcatctcatacaccgtcgtgtttagggacatcaattctcaacaggagctgcagaatataacaacggacacacgcttcacactcaccggcctgaagccagacacaacctatgatattaaagtaagggcttggactagcaagggtagcgggccattgtccccatcgatccagtcacgaaccatgcctgtggagcaggtgttcgcaaagaactttagggtggcagctgctatgaagacttcagtattgctctcttgggaggtcccagatagttacaagtcagcggtgccttttaaaatactttacaacgggcagtcagtggaagtcgacggacatagcatgaggaagttaattgctgatctccagccaaatacagagtactcatttgtactgatgaaccgaggatcatccgccggaggcctgcagcacctagtctcaatacggacagccccagatctgctgcctcacaagccacttcctgccagtgcatatattgaggacgggaggttcgacctgtctatgccacatgtgcaggatcctagcctagttaggtggttttacatcgtggttgtccctattgatcgagtgggtggatctatgctaacgccaaggtggagcacaccggaggaattggagttagatgagctgctcgaggcaatcgaacagggaggagaagagcagaggaggcgcagacgccaggccgagcggctgaaaccctatgtagctgctcagttggatgttctccctgagacattcacgctgggcgacaagaagaattaccgaggcttctacaataggccactttctcccgacctgagctatcagtgtttcgtgctggctagcctgaaagagcctatggatcaaaagagatacgctagcagcccttattccgatgagatcgtggtgcaggttacacctgcccaacaacaggaagagcccgaaatgctttgggtgactggacccgtgcttgccgtgatcctgattatcctaatcgtgatagccatactcctcttcaaaagaaaaaggacacatagtccttcctccaaggacgagcagtcaatcgggctcaaagacagcctgttggctcattcatctgaccctgtggagatgcggaggctgaactaccaaacacctggaatgcgagaccaccctccaatccctattacagatttggccgacaatatagaaaggctgaaggccaatgacggtcttaagttctctcaggagtatgagtccatcgatccaggccagcagttcacttgggagaacagcaaccttgaggtgaataaacccaaaaacagatacgccaacgttatagcttatgaccactcgcgcgttatcttgacctcaattgacggcgttcccggatctgactacattaatgcaaactatatagatggctaccgcaagcaaaatgcctacatcgctacacaggggcctctgcccgaaactatgggcgacttttggaggatggtgtgggagcagcggaccgccaccgtcgttatgatgacacggttagaggaaaaatcaagagtgaaatgtgatcaatattggcctgctagaggcacggagacctgtggcttgatccaggtcacactgttggataccgtggaacttgccacatatactgtccggacgtttgctctccataaatctggcagcagtgaaaagcgagagctgagacaattccagttcatggcctggcccgaccacggagtgcccgagtaccctacaccaattctggcgttccttcgtcgcgtgaaggcttgcaacccgttggatgctgggcctatggtggtgcactgttcagccggagtgggaaggaccggatgcttcattgtcatcgacgccatgcttgagcggatgaaacatgagaaaacagtggacatttatggacacgtcacctgtatgcgctcccaaagaaactacatggttcagactgaagatcagtacgtgtttatccatgaggctcttctcgaggcagctacgtgcggacacacagaagttccggcacggaatctgtatgcccacattcagaagctcggccaggtgccacctggtgagtctgtgactgcaatggagctggaatttaaacttctggcctcttccaaggcccatacttcccgattcatctccgctaaccttccttgtaataaattcaaaaatcgcctcgttaatatcatgccatatgagttaacaagggtttgtttgcagcccattcgtggggttgaggggtccgattatataaacgctagcttcctcgatgggtatagacagcagaaagcttacattgctacccagggacctttggcggagtcaacggaggatttttggaggatgctttgggaacataacagcacaattatcgttatgttgactaagctgcgcgagatgggcagggagaaatgccaccaatactggcctgccgagagatcagctagataccaatatttcgtggtggaccctatggcggagtacaatatgcctcaatacatcctgagagaattcaaagtcactgacgcgagggatggacagagtaggacgatacgccagttccagttcacagactggcctgagcagggcgtgcctaaaaccggcgagggttttattgacttcattggccaggttcacaaaacaaaagagcagttcggccaggacggccctataactgtgcattgcagtgctggcgtcggacggacgggggtattcatcaccctctccatagtgctggagaggatgagatatgagggagttgtggacatgtttcaaactgttaagaccctccgtacccagcgccctgcaatggttcagactgaagatcaataccagctgtgttatagagccgctctggagtacttgggcagcttcgaccactatgctacata

SEQ ID NO: 237132 - DNA, 3609 bp, Artificial Sequence
  Description of Artificial Sequence: Synthetic coding sequence
atgatgtgtgaggtgatgcccaccattagcgaagctgaaggaccccctggaggtggaggcggacacggttccggcagtccatcccagccagatgcagattcccactttgagcagttaatggttagcatgctggaagaacgggatcgcctgcttgacacacttcgggagacccaggagacccttgcactaacccaagggaaactgcacgaggtgggccacgaacgggacagcttgcaacgccaacttaacaccgcattaccccaggagttcgccgcactcacaaaagaattgaacgtatgtcgcgagcaactgctcgaaagggaggaggagattgcggaactcaaggcagaaagaaataacactcgtttactactggagcacctggagtgcctcgtgtcccggcacgagcgatcactgcgaatgacagttgtcaagaggcaggcccagtcgcccgcaggagtctcctcggaggtggaagttctcaaggctctgaaaagcctttttgagcatcataaggcgctggacgaaaaggtaagagagagacttcgggtggcgctggaacggtgctccttgctggaggaggaactgggtgcaacacataaggagttgatgattttaaaggagcagaataatcagaaaaagaccctcaccgacggagtgctcgatataaatcacgaacaggagaatacaccctccaccagtggcaagaggagctcagacggatcactctcccatgaggaggatttagcgaaggtaattgagcttcaggagattattagcaagcagagtcgggagcaatcccagatgaaagagcgccttgcctccctctcaagccacgtcaccgaactggaagaagacctggacacagctagaaaagaccttatcaagtccgaagaaatgaataccaaactgcagagggatgtgcgggaagctatggctcagaaggaagacatggaggagcgtattaccacactagaaaagaggtacctagccgctcagcgcgaggctactagtgttcacgacctgaacgacaagctggaaaacgagatcgccaacaaggactcaatgcacagacagacagaggacaagaatagacagcttcaggaacgtctggaacttgcagagcagaaactgcaacagacattgagaaaggccgaaactctgccagaggtcgaggcagagttggcccagcgagtcgccgcactgtccaaggccgaagaacggcacggaaatatagaggaaagactcagacaaatggaggcacagctggaggagaaaaatcaagagcttcagcgcgctcgccagcgtgagaagatgaatgaggagcataataagcggctgtctgatacggtggacaagctgctttctgagtctaacgagcggttgcagctccacctaaaggaacggatggcagctttggaagataaaaactccctactcagggaggtggaatccgccaagaagcagctcgaagagactcagcatgataaagatcagctcgtgctgaacatcgaggcgctgagggccgagctggaccacatgcggctacggggtgctagtctgcaccatgggcgaccgcatctgggatctgtacccgattttcgtttccccatggcggatggacacacagactcatatagcacgagcgcagtactccgcagaccacagaagggcagactggcagccctcagggacgagccttcaaaagtacaaaccctgaacgagcaggattgggaacgagcacaacaggcaagcgtgcttgctaatgtggcccaggcgttcgagtctgatgctgatgttagtgatggcgaggatgaccgggataccttgctgtcaagtgtggacctactctccccttcaggccaagctgatgcgcataccctagcaatgatgttgcaagagcagcttgacgcgatcaataaggaaattcgcttgatacaggaagagaaggagaacaccgagcagcgagcagaagaaatcgagtccagggttgggtccggctccctggacaacctcggacggtttagatccatgagctctatacctccatacccagccagctcgctcgcatcatcctcgccccctgggtcaggaagatccacgcccaggcgtattccccactctcctgccagagaggtcgatcggctgggggtgatgaccctgcttcccccatcacgagaagaggtccgggatgacaaaactacaatcaagtgtgaaacctctccgcctagtagccccagagctctgcggctagaccgtctccataagggggcactccatacggtctcccatgaggatatccgtgatattcgcaacagtactggaagccaggacggccctgtgagcaatccaagctcctctaactcaagtcaggattccctgcataaggcaccaaagaagaaaggtatcaaatcaagtatcggaagactgttcgggaagaaggagaagggtcgtcctggacagacagggaaagaggccctcggacaggccggtgtgagcgaaacagacaacagttctcaggacgcattgggcctgtctaaactcgggggacaggctgagaagaacaggaaattacaaaaaaagcatgagttactggaagaggcgcgtaggcaaggactaccatttgcccagtgggatgggccaaccgtcgtcgtgtggctggaactgtgggtaggaatgccggcttggtatgtggcggcttgcagagccaacgtgaagtcgggcgctattatgagtgctcttagcgatacagaaatacagcgggagattgggatctcgaatcccttgcatcgtctaaaactcaggctggcaatccaagagattatgagcctcaccagcccttcagcccctcctacctctaggaccacattggcctacggcgacatgaatcacgaatggataggcaacgagtggctgccatctttgggactcccgcagtatagatcttacttcatggagtgcctcgtcgacgcccgaatgctcgatcatctgacaaaaaaggatctccgtggccagcttaaaatggtcgacagctttcatagaaacagcttccaatgcggcataatgtgtctgcgtaggttaaattacgaccgcaaggagctggagagaaagcgcgaagagtctcaatcagagattaaggatgtcctggtgtggtcaaatgacagggttattcgctggattctctcgattggactgaaagagtacgcaaataacttgattgagagcggggtgcatggagccctgctggccctggatgagactttcgacttctctgctctcgctctccttctgcagatcccgactcaaaacactcaagccagagcagtcctggagcgggagtttaataaccttttggtgatggggaccgaccggaggtttgatgaggatgacgataagagtttccgtagggcaccgagctggaggaagaaattccgtccgaaggatatccgcggattagccgctgggtcagctgaaacactgcccgcaaatttccgcgtaacaagctccatgagcagtccatccatgcaaccaaagaaaatgcagatggatgggaacgttagcgggacccagagactggatagtgcgaccgttagaacttacagctgttag

SEQ ID NO: 237133 - DNA, 3558 bp, Artificial Sequence
  Description of Artificial Sequence: Synthetic coding sequence
atgatgtgcgaggtgatgccaactatcagcgaggcggaagggcctcccggaggcggtggaggccacggatctggcagccccagtcagccggacgcagactctcacttcgagcaactgatggttagcatgctggaggagcgtgataggttgctggatacactcagagagacccaggaaacccttgccctgactcagggaaagctgcacgaggtcggacatgagcgagacagtctccaaaggcaactgaacactgcccttcctcaggagttcgccgcactgaccaaggagctgaacgtatgtcgtgaacaactgctcgagcgggaagaggagattgccgagctgaaagccgagagaaacaacacccgactattactcgagcacctggaatgtcttgtctcccgtcacgagcgaagtcttagaatgaccgttgtcaagaggcaggcccagagtcccgcaggtgtgtcaagcgaggtggaggtgctaaaggctctaaagagcctatttgaacatcacaaggccctagatgaaaaagtccgagaaagacttagggtggctctggaacggtgttccctgctagaagaagaactcggggctactcataaggaactgatgatcttgaaggaacagaacaaccaaaaaaagaccctgaccgacggcgttctcgacattaaccatgagcaggagaataccccctctacctccggcaagcgcagctccgatggttcacttagccatgaagaggatttggcaaaggttatcgagttgcaagagattatatccaaacagagccgggagcagagccagatgaaagagagactggcttcattgtctagtcacgtcacagagttggaggaggacctggatactgctcgcaaggatcttattaagtccgaagagatgaatacaaagctccagagggatgtacgcgaggcaatggcccagaaagaagacatggaggagcgcattaccacccttgagaaacgctacttagccgctcaacgggaagccacatccgtccatgatctcaatgacaaactcgagaacgagatcgccaacaaggactcaatgcataggcagaccgaagataagaaccggcaactgcaagagcgtcttgagctggcagaacaaaagcttcagcagacgctgagaaaggcggagactctccctgaagtcgaagccgagttggcacaacgggttgccgcactctccaaagctgaagaacgacacggaaacatagaggaacgcctcagacaaatggaggctcagctggaggagaagaatcaggagctccagcgggctcgccaacgcgaaaaaatgaacgaagaacacaacaaaaggctgtctgataccgtcgataaactcctatctgagagtaacgagagactacagttacatctgaaagagagaatggccgctctagaagacaaaaactccttgctacgcgaggtggagtcggccaagaagcagctggaagagacgcagcatgacaaggatcaactggtgctgaatatagaggctctgagagcggaactggaccacatgaggctgcgtggtgcttctttgcaccatgggcgaccacatctcggttctgtgccggactttaggtttccaatggcagacggccatacagactcgtacagcacatctgccgtcctcagaagacctcagaaaggacgcctggctgccctgcgcgacgagccgagcaaggttcagacccttaacgagcaggactgggagagagctcagcaggcttccgtactcgccaatgtagcccaggccttcgagagtgatgccgatgtgagcgacggcgaggatgatcgtgataccctcctaagctctgtcgacctgctttcccctagtggccaggcggacgcccacacactggccatgatgctgcaggagcagcttgatgcaatcaataaagaaatcagattgatccaggaggagaaagaaaacaccgagcagcgcgcagaagaaatcgagtcaagagtgggctctggatcgcttgataacctcgggagattcagaagcatgtcctctatcccaccttatccagccagctcacttgcctcttctagtcccccagggtccggacgcagcacccctagacgcatcccccattcaccagcccgtgaagtggatcggcttggcgtaatgacccttctgccgcctagtcgtgaggaagtacgggatgacaagactactatcaaatgcgaaacctcccccccatcctctcctagggcactgagactcgacaggctgcataagggcgctctgcatacagtgagccatgaggacatcagagatattcgtaactctacagggtcccaagatggtccagtatcaaacccttcttcttccaatagttctcaggatagcctgcacaaggcccctaaaaaaaagggtattaaatcttctattgggaggcttttcggtaagaaagaaaaggggagacctgggcagacaggtaaggaagctctgggccaagcaggggtgtccgagacggataacagcagccaggatgcacttggcttgtcaaaattgggagggcaggcagagaagaatcggaagctccagaagaagcacgagttgttagaagaggctaggagacagggactcccattcgctcaatgggatggaccaacagttgttgtctggttggaactgtgggtgggcatgcctgcttggtacgtcgccgcttgccgggcaaatgtcaaatctggagctataatgtccgctctgtccgacactgagatccagagagagataggtatatcgaacccgctgcaccgactgaagttaaggttggctatccaagaaattatgtccctgacctcccccagcgcgccacccacgagtcgaacaacgttggcctacggcgatatgaaccacgagtggattggaaacgaatggctgccttctctcggtctgccgcaatacaggagttacttcatggagtgtcttgtagacgcacggatgctggaccacctgacgaaaaaggatctgcgcggtcaattgaagatggtggactccttccataggaactcgtttcagtgtggcattatgtgtctgcgcaggctgaattacgaccgcaaagagctggagagaaagagggaagagagccagtcggagatcaaagatgtcctagtctggagcaacgatcgcgtcatacggtggatcctgagcatcggcctcaaagagtatgccaacaacttaatcgaatcaggggtgcatggtgctcttctggccctggatgagaccttcgacttttctgctctagctctcctactgcagatccctacccagaatacacaggctagagcagttctcgaaagagaattcaacaatctcctggttatgggcaccgacagaagattcgacgaagacgatgacaaaagctttcggcgagccccatcctggcggaagaagtttagacctaaagacatacgaggccttgccgctgggagcgctgaaactctcccagccaacttccgcgtaacctctagtatgagttccccttctatgcagcccaaaaaaatgcaaatggacgggatgtag

SEQ ID NO: 237134 - DNA, 477 bp, Artificial Sequence
  Description of Artificial Sequence: Synthetic coding sequence
atgatgtgtgaagtgatgcccaccatctccgaagccgagggccctccaggaggcggaggcggacatggttcaggcagtccctctcagccagacgcagattctcatttcgagcagttgatggtgtctatgctagaggagcgtgacagattgttggacactctacgtgagacacaggagaccctggccttaacacagggcaaattacatgaagtcggtcacgaacgagactccctccagcgccagttgaataccgcccttccgcaagagtttgcagctttgacgaaggaacttaacgtgtgtagagagcagctattggagagggaagaagaaattgctgagctgaaggcagagcgcaacaatacccgattgctgctggaacatctggagtgtctggtcagccgacatgaacggagcctgagaatgacagtagttaagaggcaggcgcaatcaccagccggtgtttcttctgaagtgtag

SEQ ID NO: 237135 - DNA, 300 bp, Artificial Sequence
  Description of Artificial Sequence: Synthetic coding sequence
atgatgtgcgaagtaatgcccacaattagcgaagctgagggtccacccggtgggggtggcggtcatggtagcggcagtccctcacagcccgacgcggactctcatttcgagcagctcatggtgagcatgctggaagaacgcgacaggctgctggacactctccgggagacgcaggagaccctggctctgacacagggtaagcttcacgaagtgggacacgagcgagatagtcttcagagacagttgaacaccgccctgcctcaggagtttgctgctctgaccaaggaactcaatgtgtag

SEQ ID NO: 237136 - DNA, 2100 bp, Artificial Sequence
  Description of Artificial Sequence: Synthetic coding sequence
atgcgactacggggagcctccctccaccacgggcgaccccatttaggctccgtgcccgacttccgttttccaatggcagacggacatactgatagctatagcacaagtgccgttctccggcgacctcaaaagggtaggctggccgctcttcgagacgagcctagtaaggtacagacacttaacgaacaggactgggagcgagctcagcaggcttctgtgttagccaatgtggcccaggcttttgagtccgacgcggacgtgagcgatggggaggatgatagggatacactattatcttctgttgatttgctgtcacccagtgggcaggccgatgcccacacgctggcaatgatgctgcaggagcagttggatgcgattaataaggagattcgcctcatccaggaggagaaggaaaatacggagcagcgggcagaggagatcgagagtcgggtggggagcgggtctctggacaatcttgggaggtttcggagcatgtctagtattcccccatatcctgcttctagtctggccagtagctctcctcctggctctgggagaagcactccacgtagaataccacacagtccagccagggaggttgatcggttaggcgtgatgacccttccatccgatctgcggaaacataggagaaaactgcccccaagtcgggaggaagtgagggatgataagacaactataaaatgtgagacttcccccccatcctcgccgcgtgccctgagactggaccgcttgcacaaaggcgcactgcataccgtttctcacgaggacatccgtgacatacgtaactctaccggaagccaagacggccctgtgtccaacccttcgtcatctaattcctcgcaggatagtcttcacaaagcccctaagaaaaaaggcataaagtctagcatcggacgactatttggtaaaaaggagaagggaagacctggacaaacggggaaggaggccctgggccaagccggagtatccgagactgataatagttctcaggacgccctcggactgtccaaacttggtggacaggccgagaagaacagaaaattgcagaaaaagcacgaactgcttgaagaggcccgacgacaggggctcccatttgcgcagtgggacggaccaacagtggtggtgtggctggagctatgggtcggcatgcccgcttggtatgttgctgcatgtagggcaaatgtcaagagtggcgctataatgagtgctctctctgacaccgagattcagagggagattggaataagcaaccccttacaccgcttgaagttaagactagctatccaggagattatgtccctgacatccccgagcgctccccctactagccgcaccacccttgcgtatggagacatgaaccacgagtggataggcaatgaatggctgccttcactcggacttccacagtacaggtcctactttatggaatgtctcgtagatgccaggatgttggaccacttgaccaaaaaggaccttagaggccagttaaagatggtcgattcttttcaccgaaactcctttcagtgtggcatcatgtgcctacggaggctgaattacgatcgcaaggagctggagagaaagagagaagaatcccaaagtgaaataaaggacgtgctagtatggagtaacgacagggtcatccgctggattctatctatcggcttgaaggaatacgcgaataacctgatcgaatctggagtgcatggagctctcttagccctcgacgaaaccttcgatttctctgccctggccctgcttctgcagatccctactcaaaatacacaggctagggccgttttagaaagggagttcaacaatctattagtgatggggaccgaccgtaggttcgacgaggatgatgataagagttttcggagagcccctagctggagaaaaaaatttcgacctaaggacatcagaggtctcgcagcaggatccgccgaaactctaccagctaattttagggtcacaagcagcatgagctccccaagtatgcagcccaaaaaaatgcagatggacggcaacgtgtctggcacccagagactagatagtgccaccgtgaggacctactcctgttag

SEQ ID NO: 237137 - DNA, 3585 bp, Artificial Sequence
  Description of Artificial Sequence: Synthetic coding sequence
atgatgtgcgaggtgatgccaaccatatccgaggacgggcgtcgaggtagcgctctgggccctgatgaagccggtggagagctcgagaggctgatggttacgatgttaactgagcgcgagcgactcctagaaactctgagggaagcccaggacggactcgccacagcccagttgcggctgcgagagctggggcacgaaaaggactcgctgcaaaggcagctgtcgatcgcactgcctcaagagtttgctgctcttacaaaagagctgaatctatgtagagagcaacttctggaacgggaggaagagatcgctgagctgaaggctgaaaggaacaataccagactgcttctggagcaccttgagtgcctggtctcacgacacgagcggtctctgcgaatgacagtggtgaaacggcaggcgcagtctcccggaggggtctccagcgaagtagaggtgctgaaggccctcaaatccctcttcgagcaccataaggccttggatgagaaggtgcgtgaaagactccgaatggccctggaaagggtggctgtgctggaggaggagctggagctgtcaaaccaggagacacttaatcttcgggagcaactgagcaggcggaggtctgggctggaggaaccaggtaaagatggagacggtcagaccctggcgaacggtctggggccagggggtgattcaaatcgcagaaccgccgaattggaagaggccttggaacggcagcgcgctgaagtttgccaacttcgagaaaggctggccgttttgtgtagacaaatgtcgcagctggaggaggaactgggcactgcccacagggaattgggaaaggcggaagaggccaactctaaactccagagagatctgaaggaggccctggcacagcgggaagacatggaggagaggattaccacattggagaagcggtatttgtcagcacaacgggaagcaacctctctacatgacgctaatgataagttggaaaatgaactagcatccaaagagtctttatatagacagtccgaagagaaaagccggcaactcgctgaatggctcgacgatgctaagcagaagctccaacaaacccttcagaaggcagagactctcccggagattgaggctcagctggctcagagagtggctgccctgaataaagccgaggagagacatggcaatttcgaggaaagactgcgtcaactcgaagcccagcttgaagagaaaaaccaggaactgcaaagagcacggcagagagagaaaatgaacgatgaccataataagaggctatcagagaccgttgacaaactgctcagcgagagcaatgagcgcctgcagctgcatctgaaggagcggatgggagccctagaggagaagaattctctgtcggaagaaatcgcgaatatgaaaaaattacaggacgaattactgttaaataaggagcaattactcgccgagatggaacggatgcaaatggaaatagaccagcttcgcggaagaccgcctagcagctactctcgttccctgccaggcagcgccctggagttacgctacagccaggctccaacattaccttctggagcacacctggacccatacgtcgccggaagcggaagagcaggcaagaggggaaggtggagcggtgttaaagaggaaccgtcgaaggactgggaaagaagcgctcccgctggatcaattccacccccatttccaggcgaactcgatggatccgacgaagaagaggctgagggcatgtttggcgctgagctgctctcgccaagcggccaagctgacgtacagactctcgctatcatgctgcaggaacaactggaagctatcaataaagagatcaaactgattcaggaggaaaaagagaccaccgaacaacgtgcggaggaactggaaagcagagtgtcaagctcgggactcgactcgctgggcagataccgtagcagttgctctttaccaccctctctgacaacgtcaactctggcatccccatctcccccatcatccggacactcaacgcccagactcgccccaccctctcctgcgagggagggaactgataaagcgaatcatgtaccaaaagaagaggctggggctccaaggggcgagggccctgcaatcccgggagatacacctccgccaacccctagatctgcgaggctcgaacgcatgacccaagcccttgcactgcaggccggttcactcgaggacggcggacctccacgagggtccgaagggaccccggacagcctgcacaaggcacctaagaaaaaaagcataaagagttccatcggaagactgtttggtaagaaggaaaaaggacgcatgggcccacctggacgtgactcctccagtctcgctggaacaccctctgacgagaccctcgccaccgacccactcggactggctaagcttacagggcctggcgacaaggaccgcagaaacaagagaaagcacgagttactggaggaagcttgtcgccaggggttaccctttgccgcttgggacggtcccaccgtggtgagttggctagaactatgggtcggcatgccagcatggtacgtggccgcttgcagagctaacgtgaaatcaggagcaattatggctaacctgtctgacacagagatccagcgcgagattgggattagcaatcccctgcataggttgaaactccggctagccattcaggagatggtcagccttacctctccatccgctcccgctagtagccggacgagcacaggtaacgtctggatgactcatgaggaaatggagagcctgactgcaacgactaagccggaaacgaaggaaattagctgggagcagattctagcctacggcgacatgaaccatgagtgggtgggtaacgattggttgccttcccttggtctcccacagtacaggtcctactttatggagtccctggtcgatgctcggatgctggaccacttgaacaaaaaagaactccggggacagctcaagatggtggatagctttcaccgagttagccttcactatggaataatgtgtctgaagcgcctcaactatgatcgcaaagatctggaacggagaagagaggaatctcagacacaaattagagatgtgatggtgtggagcaatgaacgggtgatggggtgggtcagcgggttagggctgaaagaatttgccacaaaccttactgagagtggggtccacggcgctctgttggccctagatgaaacattcgactactctgacttggctctactgctacagatccctactcagaatgcccaagctcgccaactcctggagaaggaattcagcaacttaataagcctgggcactgaccgccgtctcgatgaagactccgcaaagagtttttccagatcaccaagctggagaaaaatgtttcgagaaaaggacctgcgcggtgtcacgccggattcagctgagatgttgccccctaatttccgaagtgcagctgctggagcactgggctctccagggctgccattgcgtaagctccaacctgaagggcagacgtctggctcaagccgcgctgatggggtgtcagtgcggacatactcgtgttag

SEQ ID NO: 237138 - DNA, 1731 bp, Artificial Sequence
  Description of Artificial Sequence: Synthetic coding sequence
atgtctggccaggagttcgcagctctcacaaaggaactcaatttgtgtagagagcagttgctggagcgagaagaggaaatcgctgaactgaaggcagagcgaaacaatacacggctactgctggagcacctggagtgtttggtgagcaggcacgagaggagtttgcggatgaccgtggtgaagcgccaggcccaaagcccgggaggtgtttccagtgaagttgaggtgctgaaggccctgaaaagcctcttcgaacatcataaagctttagacgaaaaagtcagggaaaggctgcgaatggccctggagagggtagctgtcctggaggaggagctggagctgtccaatcaggagacacttaatctcagagagcagctgtcccggcgtcggtccggactcgaagagcccggaaaagacggggacggtcagactctcgccaacgggctggggccagggggagactctaatcgccgtaccgcagagctggaagaggccctagaacgccagagggccgaagtgtgtcagctgagagaacgtctggccgtactgtgcagacaaatgtcacagctcgaggaggagttaggcacagcacaccgggaactcggcaaagccgaggaggccaattccaaactgcaaagagacctcaaagaagcgcttgctcagcgggaagatatggaagaacggattacaacgctggaaaaaagatacctcagtgcgcagcgtgaagcgacatcattgcacgatgctaacgataaactggagaacgagttggcctctaaggaaagtctgtatcgccaaagcgaggaaaagtctcgtcagctggctgagtggctagatgatgcaaaacaaaagctccagcagacactccagaaggccgagactctccctgaaatcgaagcccagctggcacagagggtcgcagcgctgaacaaggccgaggagcgacatggcaattttgaggagcgtttgcggcagctggaggcacagctggaagaaaagaaccaggaacttcagagggcaagacagcgcgagaaaatgaatgacgaccacaataagcgcctatcagaaaccgtcgataagctgctcagcgaaagcaacgagcggctgcagcttcacttgaaggaaagaatgggtgcactggaggaaaagaactccctgagcgaggaaatagctaacatgaagaaactccaggatgaactgctgctcaataaggagcagctgctcgccgagatggaacggatgcagatggagattgaccagctgcgaggacggccaccgtcaagttactcccgctctctgcctgggtccgctctggaacttcggtactcccaggcccctacactacccagtggggcacatctggatccttatgtcgcagggtccggaagagccggaaagagaggtagatggtctggagtgaaggaggagccctccaaagactgggagcggtcagcacccgctgggagcataccccctcccttccctggcgaattggacgggagcgacgaagaagaagcagaggggatgttcggcgctgaactgctgtcaccgagtgggcaagcagacgtccagactctggcaattatgctgcaggagcagctggaagcgatcaataaggagatcaagatcatgagccttcgccgaaagctggaactccacgaagggcgtggcaggccctctcaggaaaccccacaccacccgcttcccgcactgccagttctgagggaatag

SEQ ID NO: 237139 - DNA, 4338 bp, Artificial Sequence
  Description of Artificial Sequence: Synthetic coding sequence
atgcggcgattactggaaccttgctggtggattctgtttctgaaaattacctcttccgtactgcattacgtggtctgctttcccgctctgactgagggctacgtcggggctttgcatgaaaaccgccacggttccgccgtgcagatcagaagacgcaaagcaagtggggatccctactgggcgtactccggggcatacggcccagagcactgggtgacctccagtgtgtcctgcggcggtcgccatcaatcgccaattgatatcctggaccagtacgccagagtgggggaagaatatcaggagctgcagttggacggcttcgacaatgaaagcagcaataaaacatggatgaagaataccgggaagacagtggctattctcttgaaggatgactattttgtctccggggcaggtcttcccggacgcttcaaagccgaaaaagtggaattccactggggccatagtaatggctcagccggtagcgagcacagcataaatgggagacggtttccggtagaaatgcagatctttttttacaaccctgatgattttgactcatttcagactgctataagcgaaaatcgcattatcggggctatggcaatttttttccaggtttctccgcgagataattctgccctcgatccgattatccacgggctcaagggggttgtgcaccacgagaaagagacatttctggatccttttgtgctccgggatctattgcctgcaagcctgggcagctactacaggtacaccggcagtctgactacacccccatgcagtgaaattgtggagtggatcgtgttcaggagacccgtgcccatctcctatcatcagcttgaagcattctactctatattcaccacggaacagcaagatcacgtgaagtccgtcgagtatctcagaaataacttcaggccccaacagaggctccacgatagggtcgtatccaaatcagcagtccgggactcctggaaccacgacatgacagactttctggagaaccctctgggtaccgaggcatcaaaggtctgcagctcccctcctattcacatgaaggtacagcccctcaatcaaaccgccctgcaagtttcatggtcacagcccgagactatctaccaccctccaattatgaactatatgatcagctactcctggaccaagaacgaggatgagaaagagaagacattcacaaaagacagcgataaggacctcaaagccacaattagtcatgtctctcccgatagtctgtacctgtttcgcgtgcaggctgtctgtagaaatgatatgagatccgacttctctcagactatgctgtttcaggcgaacacaacccgcatcttccagggaacccgtattgtcaagaccggtgttcccaccgcatcaccggcttccagcgcagacatggctccgatcagcagtgggtccagcacatggacctcctctggtatccccttcagcttcgtatcaatggccacagggatgggtcccagcagttcaggctcacaggctacagtggccagcgtggtcacctccacactattggcgggtctcgggttcggtggcggtgggatatcttcattccctagtaccgtttggcctaccaggcttcctacagcagccagcgcatccaagcaggctgctcggcctgtgctggccactacggaggccctcgcctcacccggtcccgacggcgactctagtcctaccaaggatggagaaggtaccgaggagggggaaaaggatgaaaaatccgaatctgaggacggggaaagagaacacgaagaggatggagagaaagattcggagaaaaaggagaagagtggagtcacacacgcggcagaagagaggaaccaaaccgagccttcaccaacacccagcagtcctaacaggacggccgagggcggacaccagaccatacccggtcacgagcaggaccataccgccgtcccaacagatcagactggcggacgtcgcgacgcaggtccgggattggaccccgacatggttaccagtacccaggttccaccaacagcaacggaggagcagtacgcaggttccgacccgaagcggcctgaaatgccctctaaaaagcccatgtcaagaggagacaggttttcagaagatagccggtttatcacagtgaaccccgctgaaaaaaacacctcggggatgatctctcgaccagcgccaggacgcatggagtggattatccccctcatcgtcgttagcgcgcttacgtttgtgtgtctgattctcctgatagccgtcctcgtgtactggaggggttgcaataagatcaagagtaagggtttccccagaagattcagggaagtccccagtagtggagaaaggggcgagaaaggtagtaggaagtgtttccagaccgcacatttttatgtggaggactcatccagtccaagggtggtgcctaacgagagtatacccatcatccccatccctgacgatatggaggccattcccgtgaaacagttcgtaaagcacatcggagaattgtattcaaataaccagcacggcttcagcgaagattttgaggaagttcagcgatgcacagcagacatgaacatcacagccgaacattccaatcatccagagaataagcataaaaatagatacatcaatatcctcgcctacgatcactccagagtgaaactgcgtcctttgccagggaaagattcaaaacactcggattatatcaacgccaattatgttgacggatataacaaagccaaagcatatattgccacacaagggccactgaagtccactttcgaggatttctggaggatgatctgggagcaaaatactgggatcatcgtcatgattacaaacttggtggaaaagggacgaaggaagtgtgatcagtactggcccacagagaattctgaggagtacggtaacatcattgtaaccctcaagtctaccaaaatccatgcgtgctataccgtgcgcaggttctccattagaaacaccaaggtgaagaaggggcagaaagggaatcccaaggggcgtcagaatgagcgcgtagtgatccaatatcattacacccagtggccggatatgggtgtgcctgaatacgcgcttcctgtgcttacgtttgtccgacgctcatctgctgcgagaatgcctgaaaccggaccagttctcgtgcattgttcggcaggagtgggcaggacaggtacctacatcgtcatagactcaatgctgcagcaaattaaagacaaaagcactgtcaacgtcttaggctttctcaaacatatccgcactcagaggaattatctcgtgcaaaccgaggagcagtacatttttatccacgatgcactgctcgaagcgatcctggggaaagaaactgaagtatccagcaatcagctgcattcttatgtcaattcaatactcattccaggcgttgggggaaagacgcgcctggaaaaacaattcaagctcgtgacccagtgcaacgctaaatatgtcgagtgtttctccgctcagaaggagtgtaataaagagaagaaccgtaacagctcagtggtaccgtcagaacgcgctagagtgggtctggcgcctctgcccggtatgaagggtacggactacataaacgcctcatacatcatgggttactatcggtccaatgagttcataattacccaacaccctctgccgcatactactaaagacttttggcgtatgatctgggaccacaatgcccagatcattgtgatgctgcctgacaaccaatccctggccgaggacgagttcgtctattggccaagtcgcgaagagagcatgaactgtgaggcctttacagttacactgatctcaaaagatagactctgtctgtctaacgaagaacagatcatcatccatgattttattctggaggccacacaggacgattacgtcttagaggtgagacatttccaatgcccgaaatggcccaatcccgacgcccctatcagttccacatttgagctgataaatgtcatcaaggaagaggcgctcactcgcgacgggccaacaattgttcacgacgaatacggcgctgtctctgcaggaatgctatgcgctcttacaacactcagtcagcagcttgagaacgaaaatgccgtggacgtctttcaagtagcaaaaatgatcaatctcatgagacccggtgtctttaccgatattgagcagtaccagttcatctacaaggctatgctgagtctcgtgtccactaaagaaaatggcaatggacccatgacagtggataaaaacggagccgtgctgattgcagatgagagcgaccctgccgaatctatggagagtttagtctag

SEQ ID NO: 237140 - DNA, 309 bp, Artificial Sequence
  Description of Artificial Sequence: Synthetic coding sequence
atgcggcgactcttggaaccctgctggtggatcttatttttgaagattacctcttccgtactacactacgtggtgtgctttccagcgttgaccgagggttatgtgggggctctccatgaaaaccgccacggctctgcagtccagatccgccgtagaaaagcaagtggtgatccctactgggcttacagtggcaagtcttcatgcagcaacggggaccacaccgggcagctgactagccactctacacatctgaaagcccactttgaatctctgctctgtctatccagtgtgtgcagcaacttgtcttag

SEQ ID NO: 237141 - DNA, 2814 bp, Artificial Sequence
  Description of Artificial Sequence: Synthetic coding sequence
atggccggtgctggcggtgggctgggggtttggggcaacctggttctactggggctttgttcctggactggggcaagggcacccgcaccgaaccccggaaggaacctcaccgtcgaaacacaaaccaccagtagcattagcctatcatgggaggtccccgacgggctcgactcccagaatagtaattattgggtccaatgcacaggtgatggaggcacaacggaaacaagaaatacaacagcgactaacgtcaccgtcgatgggctgggcccaggatcactgtacacctgttctgtctgggtggaaaaggatggagttaactctagtgtgggtacagtcactactgcaactgctccgaatcctgttcgcaaccttaccgtcgaggcacagacaaactcgtctatagcgcttacctgggaggtgcccgacggaccagacccacaaaatagcacatatggcgtggagtatacaggcgacggcggtcgggctggcacgcgctcgacagcacacacaaacattaccgtggaccggcttgagcccggatgcctttacgtgttctcggtctgggttggtaaaaacggaatcaattcctctcgggagactagaaacgccacgactgcccctaaccctgtacgaaatctccatatggagacccagaccaacagtagtatcgccttatgctgggaggtcccggatggcccatatccacaggactacacatactgggtcgaatacacaggggacggcggaggaacagagacccgcaacaccacaaatacgagtgtgaccgccgaacgactggagcctgggacgttgtacaccttctccgtttgggcagaaaaaaacggcgcaaggggctctcgacaaaatgtttcaatttcaactgtacccaatgcagttacctcactctccaaacaggattggacgaacagtactatcgccttaagatggacagccccacaagggccaggacaatcaagttactcctactgggtgtcatgggtgcgggagggcatgaccgaccctcgcactcagtctaccagtggcactgacattacactgaaggagctcgaggccggtagcctctatcatctgacggtgtgggccgaacgaaacgaagtccgtggttataatagcactctgactgccgcaactgctcctaatgaggtgactgatctgcagaacgagacccaaaccaaaaactccgtcatgctgtggtggaaagcgcctggggaccctcattcccagctctatgtgtactgggtgcagtgggctagcaagggccacccgaggaggggtcaagatccccaggccaattgggtgaaccaaaccagtaggaccaacgagacctggtacaaggtagaggcgctggagcccggaacactgtataacttcaccgtttgggcggagaggaacgatgtggcttcctccacacaatccctctgtgccagcacgtatccagacacagtgaccattacgagctgtgtatctacctccgctggctacggcgtaaatctaatttggagctgcccgcagggcggatatgaggctttcgagctggaggttggtggccagcggggaagtcaggatagatccagttgtggagaggccgtgagtgtcctcggcttgggacccgcacggagttaccccgcaacgatcacaactatttgggacggaatgaaagttgtatctcactcagtggtgtgtcacaccgaaagtgcaggggtcatcgcaggagcttttgtgggcatcctgctgtttttgatcctggtgggacttctcattttttttctgaaacggagaaataagaaaaagcagcagaagccggagttgagggatctcgtgttttcatctcccggtgacatcccagctgaagactttgcggaccatgtgcgcaagaatgagagagattccaattgcggatttgccgacaaataccagcaactcagtctggttgggcactcccaaagccagatggtagcctcagccagcgagaataatgccaaaaaccggtacagaaacgttctcccgtatgattggtcccgcgtaccactgaagccaattcatgaagagccgggttcagattacattaacgccagttttatgcctggattgtggtcgccgcaggagttcattgctacccaaggacctcttccgcagacagtaggcgacttttggcggctcgtttgggagcaacagtcacacacactggttatgctcacaaactgtatggaggccggacgggtgaagtgcgaacactactggcctcttgacagccagccctgtacacatggccacctgcgcgtaactttagtcggggaggaggtcatggagaactggaccgtgcgcgaactgcttctgctgcaagtggaggaacaaaagaccctcagcgtaaggcaatttcactatcaagcatggccagatcatggtgtgccttcctctcctgatactctgttggccttttggaggatgctaagacagtggctggaccagacaatggaagggggtccacccatcgtccactgctcagccggtgtagggagaaccggcaccctgatagcccttgacgtccttctcagacagctgcagagcgaaggcctcctgggcccattctctttcgtgagaaaaatgcgcgagtctcggccactcatggtgcagactgaggcccagtacgtatttcttcatcagtgtattctccgtttcctgcagcagagcgcgcaggcccctgcggagaaagaagtaccatatgaagacgtcgagaatttaatctatgagaatgtagctgctattcaggcccacaaacttgaggtgtag

SEQ ID NO: 237142 - DNA, 3348 bp, Artificial Sequence
  Description of Artificial Sequence: Synthetic coding sequence
atggccggtgccggtggagggctgggtgtatggggaaatctcgtgttactagggctgtgcagctggacgggtgcgcgagcacccgctccaaatccagggagaaatttgaccgtggagactcagacaactagctctatttctctctcctgggaagtgccggatggacttgatagtcagaattcaaactattgggtgcagtgcaccggtgatggtggtactaccgagacgagaaataccaccgctactaatgtgactgtcgacggtcttgggccaggaagtctgtatacatgcagcgtgtgggtagagaaagacggtgtgaactctagcgtgggaacagtgacgacagcaacggccccaaaccccgtcaggaatctgcgggttgaagcccaaaccaactcaagtatcgccctgacctgggaggtgccagacgggcctgaccctcagaattccacatatggcgtagagtatacaggcgatgggggaagggcaggaacccgctcaactgctcacactaacataacagtagatggactcgagcccggatgtctctacgctttctctatgtgggtgggcaagaatggaatcaattcctccagggaaacccgtaatgcaactaccgcacacaatcctgtgaggaatctgagggttgaggcacaaactacatcttccatcagcctgtcgtgggaagtcccagacggtacagatccccagaattctacctactgtgtgcagtgcactggggacggagggaggactgagacccgcaacaccactgacacaagggttacggtcgacggattaggcccaggatctttgtacacatgtagcgtatgggtcgaaaaagacggagtgaattcctctgtagagatcgtgacgtccgcaacagctcccaatccagtccgcaatttgactgtggaggcccaaacaaattcttctatcgccctgacttgggaggtgcccgatgggcctgatccacaaaactccacctacggggttgagtacactggcgatggcggtcgcgcaggcaccagatccactgcacacaccaatatcaccgtcgaccgcttggaaccaggctgcctttacgtcttttccgtctgggtggggaagaacggtattaactcgagccgggaaacccggaacgccaccacggcccctaaccccgtcagaaatcttcacatggaaacacagacaaactccagtatcgcactgtgctgggaggtgcccgacgggccttacccccaagattatacctactgggtagaatataccggtgatggagggggtaccgaaacacgcaataccacgaatacatcggttaccgcggaaaggctggagccaggcactctgtacacattcagcgtctgggccgaaaagaacggcgctcgcggttcccgccagaacgtgagtatttctacagtgcctaacgcagtgacctccttgtccaaacaggattggaccaatagtaccatcgccctcaggtggaccgctccccagggacccggtcagagcagctactcttactgggtgagttgggtgcgggagggaatgaccgaccccaggactcagagcacaagtggcaccgacatcactctgaaagagctagaagccggatctctgtatcacctgactgtctgggcagagcggaacgaggtccgtggctataatagtacactgacggcagcaactgccccaaatgaggtcaccgatctgcagaatgagacccagacaaagaattcagtaatgctatggtggaaagcaccgggtgacccgcactctcagctgtacgtctattgggtgcagtgggccagcaaagggcatcccagaaggggtcaagaccctcaggctaattgggtgaatcagacctcaagaacaaacgagacttggtacaaagttgaagcactcgagccaggaacactgtacaactttaccgtgtgggccgagagaaacgacgtggcctcctcaacgcagtccctgtgtgcctcaacgtatcccgataccgtgacaattacctcatgcgtttctacttcagccggttacggggtgaacctgatttggagttgtccccagggcggatatgaagccttcgaacttgaggtggggggtcagcgaggcagccaggaccgttccagctgcggggaagcagtatctgttctcgggcttggcccagcacggtcctatccggctactataacaaccatttgggacgggatgaaggtcgtgagccacagcgtcgtgtgtcacactgagtccgctggcgttattgccggagcattcgtgggcattcttctttttctgatcttggttggtctgttaatttttttccttaaacgcaggaataaaaagaagcaacaaaagcccgaactgagggacctggtcttcagcagcccaggggacatccccgctgaggatttcgctgatcatgtgcggaaaaacgagagagatagcaactgcggcttcgccgacaaataccagcagctcagtctggtcggtcattctcagtcacaaatggtggcaagtgcctctgagaacaacgccaagaacaggtatcgaaatgttcttccatacgattggtctagggtcccactgaaaccgattcatgaggagccaggaagcgactatataaatgcatcttttatgccaggcctttggagccctcaggagtttatcgccactcagggacccctcccccaaaccgtcggggacttctggaggctggtatgggaacagcaatcacacaccctcgtgatgttaacgaactgtatggaagctgggagagtcaaatgcgagcactattggcccctggacagccaaccctgtactcatgggcacttgagggtgactctggtgggcgaagaagttatggagaattggacagtccgggagttactgctgctccaagtcgaagagcagaagacactgtctgtaaggcaattccactatcaggcctggcccgaccatggagtgccaagctctcccgacaccctgctcgccttttggagaatgttacgtcagtggctggaccaaacaatggagggaggcccacctatcgttcattgctccgcgggtgtgggtcgtaccggtaccctaatcgctctggatgtcctgctgagacagcttcagagcgagggtctcctgggcccatttagcttcgtgaggaagatgcgcgagagtcgacctctgatggtgcagaccgaagctcaatatgtgttcctgcaccaatgcattttacggttccttcagcagtctgcccaggcacccgcagagaaagaagtcccctacgaggacgtcgagaacctaatatatgagaatgtcgcggcaatccaggcacataaattagaagtttag

SEQ ID NO: 237143 - DNA, 1278 bp, Artificial Sequence
  Description of Artificial Sequence: Synthetic coding sequence
atgaaacccgctgcccgtgaagcgaggttgcccccaagaagccccggattgagatgggctctccccctcctgctgcttcttctgcgcttaggtcagattctttgtgccggaggaacaccctccccaataccggatcccagcgtagctaccgtcgccaccggggaaaacggtatcacacagatttccagcaccgcggaatccttccataagcaaaacggtacagggaccccccaggtggaaactaacaccagtgaggatggagaatccagcggggcaaacgactctctgcgcacaccagagcaagggtctaatggcacagacggggctagtcagaagacccctagctccaccgggccatctccggtcttcgatatcaaggctgtgtccatctcgcccaccaatgtaatcctcacttggaaatccaacgacaccgctgcctctgagtacaaatatgtcgtaaagcataagatggaaaacgaaaagaccataaccgtcgtgcatcaaccctggtgcaatattacgggcctgagacccgctacgtcatatgtgttctcaatcacgccgggtattggaaacgagacttggggcgatccccgagtaattaaggtcattaccgagcctatccctgtaagcgacctccgcgtcgccttgaccggggtgcggaaggcggctctgtcatggtccaacggtaacggaactgcaagctgcagggtcctcctagagagtatcggaagtcacgaggagttaacacaagattcacgcttacaggtgaacattagtggtctgaagcccggagtccagtacaatatcaatccatacctactgcagagcaacaaaacgaagggagaccccttgggaacagaaggtggcctggatgctagcaacacagagaggagtcgcgctggatcacccacagccccagtgcacgatgaaagcttggttggccctgtggaccccagtagcggacagcagtcacgagacacagaggtattactagttggcctcgagccaggcacccggtacaacgctacagtgtattcccaggccgctaatggcaccgagggtcagccccaggccatcgagttcagaacaaacgctattcaagtcttcgacgtgaccgccgttaacatcagcgcaacttctctgactctgatctggaaagtttctgataatgaatctagctcaaactacacttacaagatacatgtagccggtgaaactgactcgtccaaccttaatgtgtccgagccaagagccgtcatacctggcttgagatag

SEQ ID NO: 237144 - DNA, 4014 bp, Artificial Sequence
  Description of Artificial Sequence: Synthetic coding sequence
atgaagccggctgcgagggaggctcgtctgccccctcgtagccccggtctgagatgggccctacctttactgctcctgcttctgaggctgggacagatactctgcgccggtgggacaccatctccaattccggacccctccgtcgccacagtggcgacaggcgagaatggaattactcaaattagctctactgctgagtccttccataaacagaacgggaccgggactccgcaggtcgaaaccaacactagtgaagatggcgaatcctcgggcgcaaacgatagcctgcggactccggaacagggctctaatggtaccgatggggcaagtcaaaagacaccctcaagcactgggccaagccccgtgttcgacattaaggccgtcagcatatcccccaccaatgtgatcctgacatggaaaagtaacgacacggctgccagcgaatataagtacgtcgttaagcataagatggagaacgagaagaccataacagtcgtccatcaaccctggtgcaatatcacaggattacgcccagctacgagctacgtcttctctattacccccggtattggaaatgaaacatggggcgacccccgtgttattaaagtaattaccgagcctatccccgtgtccgatcttagagtggccctcaccggcgtacgcaaggcagcgctgagctggagcaacggcaacgggactgccagctgcagagtcctactggagagtataggcagccacgaggaactcacccaggactcaagacttcaggtgaacatttctggcctaaagccaggcgtgcagtacaatataaacccctacctcctgcagagcaataagacgaaaggagacccactgggcactgagggtggactggatgcaagcaacaccgagaggtctcgggcaggcagtccaacagcccctgtgcacgacgagtccctggtcggaccagtggacccttcgtcaggacagcaaagtcgggacacggaggtgttgctagtaggcttagagcccggaaccaggtataatgccacagtgtactcacaggccgctaatggtactgaaggacagccacaggcaatagagtttaggacaaatgctatccaggtatttgacgtgacggctgtcaacatcagcgcaacctcactgactctaatttggaaggtgtctgataatgagagctcatcaaattacacttacaaaattcacgtcgccggtgagaccgattcttccaacctgaacgtgtcagaaccaagggctgtcatacctggacttagatccagcacattttacaacatcactgtctgccccgtgctgggcgacattgaagggacacctggtttcttgcaggttcacactcctcctgtgcccgtgtctgattttagggtcactgtggtcagcacaacggagataggcctggcgtggagcagccacgacgcagaaagctttcaaatgcacatcactcaggagggtgctggaaattcccgagtggagatcaccaccaatcaaagcatcataatcggcggtctgttcccgggtacaaagtactgcttcgaaattgtcccaaagggtcctaacggcacggagggcgctagccgcacagtatgtaatagaaccgtgccttctgcagtgttcgatatccacgtggtgtacgtcaccactaccgaaatgtggttggactggaaatcccccgacggtgccagtgagtacgtgtaccacttggtgattgagtctaagcatgggagcaatcatacttctacctacgacaaagccattactttgcaaggattgatccctggcacactctataacatcaccatcagtcccgaggtcgatcacgtgtggggggacccaaacagtacagcgcagtacacacgcccttccaatgtatccaacatagatgtcagcaccaacaccacagccgcaactttatcctggcagaacttcgatgacgccagcccaacctactcttactgtctcctcatcgagaaagcaggtaatagtagtaacgccactcaagtggtcacggacattggcataacagacgcgaccgtgaccgaactgatacctggttcttcatacaccgtcgagatatttgcacaggtgggagatggtattaaaagcctggagccaggcagaaaatctttttgtaccgacccagcctctatggccagcttcgattgcgaggtcgtgcccaaggagcctgcgctcgtgttgaagtggacttgcccaccaggagccaatgctggattcgagctggaagtctcctccggggcatggaacaacgccacccacctggagtcatgctctagcgaaaacggaacagagtacagaactgaggtcacctacctcaacttctcaacaagctataacatttcgataacaactgtctcctgcgggaagatggccgcacccaccagaaacacttgcacaactggtatcacagatccgccacctcccgatggctcgccaaacattacctctgtttcccacaactctgtgaaagtgaagtttagcggcttcgaagccagccatgggcctatcaaggcttatgccgtgattcttaccactggggaggcaggacacccctctgctgacgtgcttaagtacacgtatgaggatttcaaaaagggggcttccgacacttatgtcacgtacctgattcgtacggaggaaaaagggcgatctcagtcccttagtgaggtgttaaagtatgaaattgatgttggaaacgagagtactacactgggctactataatggcaaactggaacccctgggaagttatcgcgcttgcgtcgccggattcactaacattacgtttcacccccagaataaagggctgatcgatggggcagaaagttatgtcagcttttcccgttatagtgacgccgtctccttaccccaggatcctggagtgatttgtggcgcagtatttggctgtatcttcggcgctctggtgattgtcacggttggaggctttatcttctggcggaaaaagagaaaggacgcaaagaataatgaagtttccttctcgcagattaagcccaagaaatctaagctgatccgggtggaaaatttcgaggcgtattttaagaaacaacaggccgacagcaactgtggctttgccgaagaatatgaagatctgaagctggtgggcatctctcagcctaagtatgccgcagaactggccgagaatagaggaaagaaccggtataacaacgtccttccctatgacatctcgagagtcaaactgtccgttcagacccacagcaccgacgattacataaacgctaactacatgcctggttaccactccaagaaagattttatcgctactcagggccctttaccaaataccctgaaagacttctggcgaatggtctgggagaagaacgtgtatgccatcatcatgttgactaagtgtgttgagcaaggccgaactaagtgtgaggaatattggccttcaaaacaagcacaggactacggagatattaccgtggctatgacatctgagatagtactgccagaatggactatccgggactttactgtaaagaacatacagacgagcgaaagccatcctctgaggcagttccacttcacatcttggccagaccacggcgtgcctgatactaccgacctcctcatcaacttcaggtacctggtgcgggattatatgaaacagagcccccctgaaagcccgattctggtgcattgctcagccggagtgggacggacgggaaccttcattgcaatcgacagattgatttaccagatagaaaatgagaatacggtagacgtatacggcatcgtttacgaccttcgcatgcatcgacccctcatggtgcaaacagaggaccagtacgttttcttaaatcagtgtgtcctggacatcgtgaggtcccaaaaagatagcaaggtggaccttatttatcagaataccaccgctatgactatttatgagaatttagcgcctgtcacaacgttcggcaaaaccaatggctatattgcatag

SEQ ID NO: 237145 - DNA, 1620 bp, Artificial Sequence
  Description of Artificial Sequence: Synthetic coding sequence
atgaagcctgctgcaagagaagcacgcctgcctccaagatcaccgggtttgagatgggccctgccattgttattactcctgcttcggctgggccagatactgtgtgccggtggcactccatcccccattcccgatccatccgtggcgacggtcgctactggcgagaatgggatcacacagatttcctccacggccgaaagctttcataagcagaacgggactgggactcctcaagtcgagacaaacacctctgaagatggcgagagctccggagctaatgactccctgcgtacacccgagcaagggtcgaatggaacagatggtgccagccagaagacacccagctcaacaggcccaagccccgtgtttgacattaaggcagtaagcatctcaccaactaacgttatcttaacttggaaatcaaatgacacagctgcctccgagtacaaatatgtggtgaagcacaaaatggagaatgaaaaaaccatcacagtggtgcaccagccatggtgcaatataaccggcctgaggccagcgacgtcatacgtgttcagtatcacgcccggaatcggcaatgagacgtggggggacccgagggtcatcaaggtcattaccgaaccgatccccgtctccgatctcagggtggcgctcaccggggtgcgtaaggccgctttgtcttggagtaacggaaatggcacagcctcctgtagagtgctgctggaatcgattggctctcacgaggagctcacccaggacagcagactgcaagtgaatatctcaggactgaaaccaggggtacagtacaacataaatccgtacctcctacagagcaataaaactaaaggcgatcccctcggcaccgagggaggactggacgcttccaatacagaaaggtcaagggccggtagcccgactgctccagtccacgatgaatccttggttggccctgtggacccaagctccggacagcagtctagagataccgaggtgctgctcgtaggcctggaacccggaacccgatataatgccaccgtgtatagtcaagcagccaatgggactgaaggacaaccacaggccatcgaatttcggactaacgccattcaggtgtttgacgtgaccgccgttaatatatccgcaactagcctcacactcatttggaaagtgagcgacaatgagagcagttctaattatacttacaaaattcatgtggctggcgaaacagattccagtaatctgaacgtgtcagagccacgggcagtcattcctgggttgaggtctagtacattctacaacatcaccgtgtgtccagtgctgggcgatatcgagggcacaccaggtttcctgcaggtgcacacacctccggtgccagtttctgacttcagagtgacagtagtaagtactacagagattggccttgcatggtcttctcatgacgctgaaagcttccagatgcatattacacaggagggcgctggaaactcccgtgtggagatcacaactaatcaatccatcatcatagggggtctgttcccaggtaccaaatactgtttcgagatcgtccctaaggggcctaacggaaccgaaggagctagcaggactgtctgcaataggactggctag

SEQ ID NO: 237146 - DNA, 4419 bp, Artificial Sequence
  Description of Artificial Sequence: Synthetic coding sequence
atggacacgaccgcggcagccgcactgcccgctttcgttgcacttttactcctgtcaccttggccactgctcggttccgcccaggggcaattctctgcagggggatgtactttcgacgacgggcctggcgcatgtgactatcaccaggatctgtacgacgattttgaatgggtgcacgtcagcgcccaggagccccactatctgcccccagagatgccacaggggagctacatgattgtggacagcagcgatcacgatcctggagagaaggcccgtctgcaattgccaacaatgaaggagaatgacacacattgtatagacttcagctacctactgtacagtcaaaaggggctaaatccaggtaccttaaatattctagtaagagtgaacaagggtcccctggcgaaccccatctggaatgttacaggcttcacgggtcgcgactggcttcgcgcagaactggccgtgtccaccttctggcccaacgaataccaagttatttttgaagcagaggtctcaggaggacgctcgggctacatcgctatcgatgacattcaagtgctcagctacccctgtgataagtccccccactttttgaggctgggcgacgttgaggtgaacgcagggcagaatgccacttttcagtgcatcgccacgggtcgcgacgctgtacataataaactctggctccagcggagaaacggcgaggatattcccgtggcccagactaagaatatcaatcaccgaagattcgctgccagctttcggctgcaggaggttacaaaaaccgatcaagacctgtaccggtgtgttacacaaagcgagcgcggtagcggtgtgagtaacttcgcccagctcattgtgcgggaacccccacggcctattgcccctccccaactattgggggtgggacctacctacttgctgatccaattaaatgccaactctatcatcggagatggaccaataatcctgaaggaggtagagtatagaatgacatctgggagttggacggaaactcacgctgtcaatgcccctacgtataaactgtggcacttggatcccgacaccgagtacgagattcgcgtcctgctgactcggcctggtgagggtggcacgggacttcccggacctcctttgataaccaggacaaagtgtgctgagccaatgaggacgccgaagaccctgaaaattgctgaaatccaggcgaggcgcattgcagtcgattgggaatccctaggatacaatataacaagatgccatacattcaacgttactatctgctaccactatttccgcggtcataacgagtctaaggctgactgcttagatatggatcccaaggcccctcagcacgtagtgaatcacttgcctccctatacaaatgttagcctgaaaatgatcctcacaaatcctgaggggaggaaggagtccgaagagacaatcattcaaactgacgaagacgtgccgggacccgtgcctgtcaagtccctgcaggggacatcattcgagaacaagattttcttaaattggaaagaacccctagacccaaacggtataataactcagtacgaaatatcttactcctccatcagaagttttgatcccgctgttccagtggcaggtccccctcagactgtgtcaaatctgtggaactcaacacatcatgtgtttatgcaccttcatccaggaaccacctaccaatttttcatccgcgcatccactgtaaaggggttcggacccgctaccgcaatcaatgtcactaccaatattagcgctcccactctgcccgactacgagggcgttgacgctagcctgaacgaaaccgccacaaccataactgtgctcctgagaccagcccaggcgaagggggcacccatcagtgcatatcagatcgtcgtggaggaactgcatccacatcgcactaagcgagaggctggagcaatggagtgttaccaagtacctgtgacctatcaaaacgccatgtctgggggagctccttactactttgccgctgagctcccacccggtaatcttccagaacctgccccatttaccgtcggcgataacagaacttaccaaggcttttggaatccgcctctcgctcccagaaagggatacaatatctacttccaagccatgtcatctgtggaaaaagagacaaaaacccagtgcgtacgcattgccaccaaagccgctgctacggaagaaccagaggtgattcccgacccagccaagcagaccgacagagtggtcaagattgcgggtatttccgcgggaatcttggtttttattctgctgctacttgtggttatcctaatagtgaaaaagagacggagttactactcttattcgtattatctaaagcttgcaaagaagaggaaggatgcaatggggaatactagacaagagatgacacatatggttaacgcgatggaccgatcttatgcggaccaaagcacactgcatgccgaggatcctctgtccattacctttatggatcagcataacttctccccaaggctgcctaatgaccctctggtacctacggccgttctcgtccctatcaccgacgagaaccactcagccacggctgagtctagtagacttctggacgtgccgcgatatttgtgtgaaggcacagagagtccttaccagaccggccagcttcatcccgcaatcagagtggccgacttactgcaacatatcaacttaatgaaaacctctgactcctacgggtttaaagaggagtacgagtctttcttcgaaggacagtcagcctcttgggatgtggcgaaaaaggaccagaatcgcgcaaaaaatcgttatggcaacatcatcgcctacgaccacagccgcgtgatccttcagcccgtggaagatgaccccagctccgactatattaacgctaactatatcgatatatggctgtaccgggatgggtatcagcgcccaagccactacatcgccacccaaggccctgttcatgagactgtgtatgatttctggagaatgatttggcaggaacagtccgcctgtattgtgatggtgaccaatctcgtggaggtgggcagggtcaagtgctacaagtattggcccgatgacaccgaagtgtatggcgatttcaaggttacatgtgttgagatggaaccattagccgagtacgtcgtgcggacatttaccttggagcgcagaggctataacgagatccgggaggtcaagcagtttcattttaccgggtggcctgatcatggagttccataccacgccaccggtctgttgagcttcattaggagagtgaagctttcaaaccctccatccgctggccctattgtggtccattgctcagccggtgccggacggacaggatgctacattgtcatcgacattatgctggatatggcagagagggaaggtgtggtggacatttacaattgcgtgaaggccctgcgaagtaggagaataaacatggtgcagacagaagagcagtacattttcatccatgatgcaatcttagaagcatgcctgtgtggggagacagcaatccctgtgtgcgagtttaaggctgcatattttgacatgatacgcatcgactctcagactaacagctcccacctgaaagatgaatttcagaccttgaattcagtgaccccgcgactgcaggctgaggattgttctatcgcctgcctgccaagaaatcacgataagaaccgatttatggacatgttgccccctgataggtgcttaccttttttgatcaccatagacggggaatcttcaaattacattaacgcagccctgatggattcctatagacagcccgcagctttcattgttactcagtaccctctgcccaacacagtgaaggacttttggcgactggtttatgattatggttgcaccagcatcgtcatgctcaacgaagtggacctgtcccaaggatgtccccaatattggcccgaggagggtatgttgcgctatgggccaatccaggtcgaatgcatgagctgtagtatggactgcgatgtgattaatagaatttttcgaatctgtaacctgaccaggccccaagaaggatacctgatggtgcaacagttccagtacctcggctgggcctcgcaccgtgaggtccctggaagcaaaagaagcttcctgaagctaattttgcaagtggagaagtggcaagaagagtgtgaggagggggagggtaggacaatcatccattgcctgaatggcggagggagatccggaatgttttgcgccatcggaatcgtggtggagatggtgaagaggcagaacgttgtcgacgtatttcacgctgtgaagacactgcgcaactcgaagcctaatatggttgaggctccagaacagtacagattctgctatgatgtcgccctcgaatacctagaatcctcctag

SEQ ID NO: 237147 - DNA, 4377 bp, Artificial Sequence
  Description of Artificial Sequence: Synthetic coding sequence
atggataccacagcagccgcagccctacctgcatttgttgcactcctcctcctgtctccctggcccctgcttggtagtgcccagggacaattctcagccggaggatgtacatttgatgacgggccaggtgcatgtgattatcatcaggacctctatgacgattttgaatgggtccacgtatccgcacaggaaccacattacttgcctcccgagatgcctcagggctcctacatgatagtcgattctagcgatcatgacccaggggaaaaagcgcgtcttcagctgcccacgatgaaagagaacgacacccactgtatcgacttttcatatcttctgtattcacagaaaggccttaaccctggaactcttaacatactggtgcgggtgaacaagggcccattggctaatccaatctggaacgtaactggattcaccggccgtgactggctgagagccgagctagcggtctctactttttggccaaatgagtatcaggtcatctttgaggcagaagtcagcggcggtcgcagcggttatattgccatcgacgacattcaggtgctgtcatacccctgcgacaagagtccccacttcctacggctcggcgatgtagaagtcaacgctggccagaatgccacgtttcaatgtattgctacaggacgcgatgccgtgcacaacaagctttggctgcagaggcggaatggcgaggacatccccgtggcccaaacaaagaatatcaatcacaggcggtttgcagcctcgtttcggttgcaagaagttaccaaaacagaccaggatctgtaccggtgcgtgacccagagtgagcggggttcaggtgtgtccaacttcgcccaattaatcgtcagagagcccccaagaccgatagcccctccccagctgcttggcgtgggccctacgtacctgctgattcagcttaacgcgaatagtatcataggggatggacctataatactgaaggaagtggagtatagaatgacaagcggtagttggaccgagacgcacgctgtgaacgcccctacctataaactgtggcacttggaccccgacaccgagtatgagatccgagtattattgacacggcctggcgagggcggaacaggcctgcccggtccacctctgattacgcgaaccaaatgtgcggaaccaatgcgaacaccaaagaccctcaagattgccgagatccaggcaagacgtatcgcggtagattgggagtcactaggttataatattaccagatgtcatacatttaatgttacaatatgctatcattatttcaggggacacaatgaatccaaggctgactgccttgatatggacccaaaggcccctcagcatgttgttaatcacctgcccccttacaccaacgtgtcacttaaaatgattctgaccaacccagaagggaggaaggaatctgaagaaacaataatccagaccgatgaggatgtgccaggcccagttccggtgaagtcgttgcagggaacttccttcgagaataagatcttcctgaactggaaagagccgctggatccaaacggcataatcacccagtatgagataagttattcctcaattagatctttcgaccctgctgtgccagtggcaggccctccacagacggtcagtaacttatggaattccacccatcacgtcttcatgcacctccatccgggaacaacatatcagttttttattcgtgcatccaccgtaaaggggttcggacctgccactgccattaatgtgacgaccaacatatccgctccgacactgccggattatgagggagtggacgcttcactgaacgagaccgcaaccaccatcaccgtcctcctgagacccgcacaagcaaaaggggctccgatctcagcctaccagattgtggtggaagagttgcacccccatcgaacgaaacgcgaggctggagctatggaatgctaccaggtgcccgtcacataccagaacgccatgagtggcggagccccttactatttcgccgctgagctgcctcccggtaacctcccagagcctgctcctttcactgtaggggataataggacctaccagggcttctggaaccccccattagctccccgaaagggatataacatttattttcaagccatgtcctccgtagaaaaagagacgaaaacccagtgtgtaaggatcgccactaaagcagccgcaacggaagagccggaggtgatcccggaccccgcaaaacaaaccgacagggtggttaagattgctggtatctcagccggaatcctcgtttttattctgctgctccttgtcgtgatcttaatcgtgaaaaaaagtaaactggcgaagaagcggaaggatgccatgggaaatacgagacaagagatgacccacatggttaacgccatggataggagctacgcagatcaaagcacactgcatgcggaggatcctttgtccataacttttatggaccagcacaacttttcacctcgcctgccaaatgatcctctggtacctaccgctgtcctggacgaaaaccattccgccaccgcagaatcttcaagacttctggacgtaccaaggtatctttgcgagggaactgagagtccttaccagaccgggcagctccaccccgctatccgagtggccgacctcctgcagcacattaaccttatgaagaccagcgactcttatggatttaaggaggaatacgagtccttctttgaaggacagtccgcatcctgggacgtcgccaaaaaggatcagaaccgtgccaagaacaggtatggaaacattatcgcttacgatcattcgcgggtgatcttgcagcccgtcgaggatgacccttctagcgattacattaatgccaattatatcgacatctggttgtaccgggatggatatcagagaccttcacattatatcgccactcagggaccagttcacgagactgtttatgatttttggcgaatgatctggcaggaacagagcgcatgtattgtgatggtgaccaatctggtagaggtcggaagggtgaaatgttacaaatattggcccgacgacactgaagtgtacggggattttaaagtgacttgcgttgaaatggagcccctggctgaatatgtggtgagaactttcaccctcgagcggagagggtacaacgagatcagagaggtcaaacaattccactttacaggttggcccgaccacggcgtgccttatcacgccactggcttactgagttttattcgccgtgttaaactctctaatccccctagcgccggtcccatcgtggtacactgctccgccggagctgggaggactggatgttatatcgtgatcgacattatgctggatatggcggagagagagggagtcgtggacatctataactgcgtcaaggcattacgctctagaaggataaatatggtccagacagaggagcagtacattttcatccacgatgcgattctcgaggcatgtttgtgcggcgagaccgcgattcctgtgtgtgagtttaaggccgcatattttgatatgattaggatagactctcagactaattcatcccatctgaaagacgaatttcaaaccttaaactccgtcactccacggctgcaggcagaggactgttccattgcatgtctccctcggaaccacgacaaaaatcgcttcatggatatgctcccccctgaccgctgcctgccctttcttatcacaatagacggagaaagctcaaattacatcaatgccgctctcatggattcctacaggcagccggcagctttcattgtaacccagtatcccttgccaaacacagtgaaagacttttggaggctggtgtacgattatgggtgcacaagtatcgtcatgctgaatgaggttgatctatcccagggttgcccacagtattggcccgaagaggggatgctcagatacggccctatccaggtagagtgcatgtcatgtagcatggactgcgatgtcattaatcggatctttagaatctgtaaccttactaggccacaggaggggtatctcatggtgcagcagttccagtacctgggctgggcaagccaccgggaagtgccaggcagcaaaaggagcttcttgaagctgatcctgcaggtggagaaatggcaagaggagtgcgaggagggcgaaggccgaactattattcactgtttgaacggtggcggacggtctggtatgttctgtgcaatagggattgttgtcgagatggtgaaacgccaaaatgttgtcgacgtctttcacgccgtcaaaaccttaagaaatagcaaacccaacatggtcgaagctcccgaacagtatcgattttgctatgacgtggctcttgaatacttggagagtagctag

SEQ ID NO: 237148 - DNA, 4341 bp, Artificial Sequence
  Description of Artificial Sequence: Synthetic coding sequence
atggataccactgccgctgcagcactaccagcattcgtggccctgttgttgctgagcccatggccacttctcgggtcggcccagggccagttcagcgcgggtgggtgcacatttgacgacggacccggagcctgtgactatcaccaggatctgtacgatgacttcgaatgggtccatgtaagcgcccaggaacctcactacttgccaccagagatgccccaaggtagctacatgattgtggattcttccgaccatgatcccggtgaaaaagctcggctccagctccctacaatgaaggaaaatgacacgcactgtattgatttttcttacttgctttacagtcagaaaggcctgaacccgggaacactaaatatcctggtgcgggtcaataagggacctctcgctaatcctatttggaatgtgaccggatttaccggccgtgattggctccgggcagaattagccgtaagtacattctggccaaacgaatatcaggttatctttgaggcagaggtgtccggagggaggtccggttatattgccattgacgacatccaggtgctgagctacccatgtgacaaaagtcctcattttctgcggctgggcgacgtggaagttaatgccggtcagaacgcgactttccagtgcattgcgacgggcagagatgccgtgcataataaattgtggctgcaaagacgtaatggggaggatattcctgtcgcacagacgaagaacattaatcacagacgcttcgctgcgtcattcagactccaggaggtcacgaagacagaccaggacctttatagatgtgtgacccaatctgaacgcggaagcggggtgtcaaacttcgcccagctgatagtgcgggagccacctcgccctattgccccacctcaactgcttggcgtaggaccaacttacctcttaatccagttgaatgcaaattccatcattggcgacggccctatcattctgaaagaggttgaataccgcatgaccagtggcagttggactgagactcatgctgtcaatgcaccaacgtacaagttgtggcatttagatcctgatacagaatacgagatcagagttctgctgacacgacctggcgaaggaggaacgggcttgccaggacctcccctgataacgagaactaagtgtgcggagcccatgcgcactcccaagacacttaagattgccgagattcaggcaagacgaatcgcagtggattgggaatccttgggatataatatcacacgttgtcatacctttaacgttactatatgctatcattacttccggggacacaacgagtctaaggctgattgcctagacatggatccaaaggcccctcaacacgttgtgaatcatctgccaccttataccaatgtgagtttgaaaatgatactgacaaatcccgaagggcgaaaagaatctgaagagacaatcatacagacagacgaagacgttcccggacctgtgcctgtaaagagcctgcaggggacttcgtttgagaacaagattttcctgaattggaaggagccactcgatccaaatggcatcatcactcagtatgagatcagctattcgagtatacgctcgtttgacccagctgtaccagtcgcagggccaccacagacggtcagcaatctttggaactccacccatcatgtcttcatgcacctacaccctgggacgacgtatcagtttttcattcgtgccagcacagtcaaaggtttcgggccagccacagctatcaacgtgaccaccaatatttctgctcccacgttgcccgattatgagggagttgatgccagcctgaatgagaccgctactaccatcactgtcttattaaggcccgcacaggctaagggggcaccaatctcagcataccagattgttgtggaagaactgcacccccacaggacaaaaagagaagcaggcgcaatggaatgctaccaggtgcccgtcacataccagaatgcaatgtctggcggagccccatactatttcgccgcagagctcccaccaggcaatctgcccgagccagctcccttcactgttggggacaatagaacctatcagggcttttggaatccaccactggctccgaggaagggctataatatttacttccaagcgatgtcttctgtcgagaaggagaccaagacccagtgtgtgcggattgccaccaaagccgctgcgaccgaggaacccgaggtcattccagatcctgctaaacaaacagaccgcgtagtaaagatcgccggtatcagtgcaggcattctcgtatttatactgctactgctggtggtcatacttatcgtaaaaaaaagcaagctggctaaaaagaggaaggatgccatgggaaacacacgacaggaaatgactcacatggtcaatgccatggatcgaagctatgccgatcagtcaaccttgcatgctgaggatcccctgtccataacctttatggatcagcacaacttctcaccaagatacgagaaccatagcgcaacagcagagtcatcaagactcctggatgtgccgagatacctctgcgaaggcaccgaaagcccctatcagacgggacagctgcatcccgctatacgggtggctgacctgctccagcatataaacctgatgaagacatccgactcatacggcttcaaggaggaatacgaatcattctttgaggggcagtcagcatcctgggatgtggcaaaaaaagaccaaaacagggctaagaaccgatatggtaacatcatcgcctacgatcacagtagagtgattctgcagccagtggaagacgacccgtcatccgattacataaatgctaactatattgatatctggttgtaccgtgatggctaccagagaccatcacattacatcgctacgcaagggcctgtgcacgagactgtgtatgatttctggcgaatgatatggcaagagcagagcgcttgcatagtcatggtgaccaacctggtggaggtagggagggtgaagtgctacaagtactggccagacgataccgaggtctacggggactttaaagtaacctgtgtggagatggagccattagctgaatacgtggtgcgcaccttcactctggagaggaggggttataatgagattagggaagtgaaacagtttcactttacgggatggcctgatcatggggtaccctatcacgcgaccggcctcctgagcttcatccgccgagtgaagttaagtaaccctccatcagctgggccaattgttgtgcactgcagcgctggcgctggccgtaccgggtgttacatcgtgattgacatcatgctcgatatggccgagcgggagggagtggtggacatttacaattgcgtgaaggctctgcggagccgcagaataaatatggtacagaccgaagagcagtatattttcatccacgacgcaatcctggaagcgtgtctgtgcggagagaccgccatccccgtctgtgagtttaaggctgcatattttgatatgatccgaatcgatagccagactaattccagccatttaaaagatgagttccagacactgaatagtgtcacaccgagactgcaagcggaggattgctctattgcgtgtctgccccgtaatcacgataaaaatagattcatggatatgttacctccggaccgctgtctcccctttctgattaccatcgacggggagtcatcaaattatatcaatgcagcactgatggacagttaccgccaaccagccgcttttattgtgacgcagtatccattgccgaatactgttaaagacttttggcggttggtctacgactacggctgcacctctatcgtgatgctgaacgaagtggatctgagccagggatgtccacaatactggccagaagagggaatgttgcgttacgggccaatccaggtcgaatgcatgagctgttcaatggattgcgacgtgatcaaccggatcttcagaatttgtaatctgacacgcccacaggaaggctacctcatggtacagcaatttcagtacctgggttgggcgtctcaccgcgaggtgccaggaagtaaaagaagcttcctgaagctgatacttcaggtggagaaatggcaggaggagtgcgaagagggtgaaggacggacaatcatacactgtttaaacggcggaggacggagcgggatgttttgcgcgattggcattgtggtggaaatggtcaaaagacagaatgtcgtggacgttttccacgccgtgaagacactacgaaactctaagcctaacatggtggaggcccctgaacagtatcggttctgttatgacgtggctcttgaatacctcgaaagtagctag

SEQ ID NO: 237149 - DNA, 4320 bp, Artificial Sequence
  Description of Artificial Sequence: Synthetic coding sequence
atggatacgacagcggctgctgcgctgcccgcttttgtagctttgctcctcctctcaccctggcccctactgggtagcgcccagggccaattttccgccggaggttgcaccttcgacgatgggcctggagcctgcgattaccatcaagacctgtacgatgacttcgagtgggtccacgtcagtgcccaggagccacactatcttccaccagagatgccccagggaagctacatgatagtggatagtagcgatcacgatcccggagagaaggccagacttcagttgccgaccatgaaggagaacgatactcattgtattgattttagctacctgctgtactcacagaaaggcctgaacccaggcacactcaacatactggtcagagtgaataagggccctctggcaaacccaatctggaatgtcacagggtttaccggacgcgattggttgcgggctgagctggctgtaagcactttttggcctaatgagtatcaggtgatttttgaggccgaggtctctggaggcaggtcaggatatatcgccattgatgacatccaggttctgtcttatccttgtgacaagtcaccccacttcctgcgtttgggcgatgttgaagtaaatgccggtcagaatgccacatttcagtgcatcgccactggccgtgatgcagtacacaataagctgtggctacagagacgtaatggggaggacatcccggtcgcccagaccaaaaatatcaatcacagacgctttgctgcaagctttcgactccaagaggtcactaagactgaccaggacttgtaccgctgtgttacgcagagtgagcgaggcagcggcgtgtccaatttcgctcagctgatagttcgcgagccacccaggcctatcgcaccccctcagctactcggcgtaggcccaacctacctcctgatccagctgaacgcaaactccatcataggggatgggcctataatcttgaaggaggtcgagtatagaatgacatcggggagctggacagaaactcacgccgtgaacgctccgacatataagttgtggcatctcgatccagataccgaatatgagatcagagtgttgctgaccaggcctggggaaggaggcactgggttgcccggacctccattgataacccgtacaaagtgcgctgagcccatgcggaccccgaagacacttaaaatcgcggagatacaggccaggagaattgccgtcgactgggaaagcttgggatataacataactcgctgtcatacgttcaacgtcacaatctgctaccattacttccggggtcataatgaaagcaaggccgattgcctggacatggatcctaaggcccctcagcacgtggtgaatcatctgcctccatacaccaacgtgagcctaaaaatgattctgactaatccagaaggcagaaaggaaagcgaggaaaccatcattcagacagatgaggacgtgccaggacctgtcccagtgaaaagtctgcaaggaacctctttcgaaaataagattttcttgaactggaaagaaccacttgaccctaatggtataatcactcagtatgagatatcctattcatctattaggtcattcgacccagccgtacccgtggccggaccgcctcagacagttagcaatttatggaactctacacaccatgtcttcatgcaccttcatcccggaacaacttaccaattctttattcgggcaagcactgtgaagggctttgggccagccacagctattaatgttaccactaatatttcagcccctacgctgcctgattacgagggcgttgacgctagcctgaatgagacagccactaccatcacagtcctactgcgaccagctcaggccaaaggcgcacccatcagcgcttatcagattgttgtggaagaactgcaccctcataggaccaaaagagaggccggagccatggaatgttaccaggttccggtaacatatcaaaatgcaatgtctggcggagccccatactattttgcagctgaacttcctccaggcaatctgcctgagccagcgccattcacagtcggagacaacagaacgtaccaggggttttggaatcccccattagcgccaaggaaaggttataatatctacttccaagcgatgagctcagtggagaaggaaacaaagactcagtgcgtgagaatcgcaaccaaagctgccacagaagagcctgaggtgatcccggatcctgcgaagcagacagacagagtagttaagattgcaggcatctcggcgggaatcctcgtgtttatcctccttctgctagttgtaattctgatagttaagaagagcaagctggctaagaaacggaaagatgcgatgggaaatacgagacaggagatgacccatatggtaaacgcaatggaccgctcttatgccgaccagtccactctgcacgccgaagatcccctgagtatcaccttcatggaccagcataatttctctccacggtacgagaaccactccgccacagcggaatcctcccgcctgctggatgttccgcgatacctctgcgaaggcacggaaagtccttaccagacaggacaactccatcccgctatcagagtcgcggatttgttacagcatattaatctcatgaagacatcagacagctatggattcaaggaagagtatgagtcattctttgagggccagagtgccagctgggacgtagctaagaaagatcaaaatcgagccaagaaccgttacggtaatattattgcctatgaccatagtcgcgtcatcttgcagcccgtggaggacgatccctcgtctgactatatcaatgccaattacatagatggatatcagcgtccaagtcactatatcgccacacaagggcctgtgcacgaaacagtatacgacttctggaggatgatctggcaagagcagtccgcttgcatcgtgatggttacaaacctggttgaagtcggcagggttaagtgttataagtactggcctgatgatactgaagtttacggagactttaaggtgacctgcgtggagatggaaccattggctgagtacgtcgtccgaacgtttaccttagaacggagaggatataatgaaataagagaggtgaagcagttccactttacggggtggccagaccacggggtaccatatcacgccacgggccttctttcgtttatcagacgggtgaagctctcgaatcctccgtctgcgggacctatcgtagtccactgcagcgccggagccggaagaacagggtgttacattgtcatcgacattatgctggacatggccgaaagggaaggagtggtagacatctacaactgtgtgaaagctttgcggtctcggaggatcaatatggtgcaaacggaggagcagtacatttttatccatgacgctattctcgaggcctgtctctgcggggagaccgcaattcctgtctgtgaatttaaggctgcctacttcgatatgattcgtatcgacagtcagaccaacagttcgcacctaaaggacgagtttcagaccctgaatagcgttacccccagactgcaggccgaggactgctctatcgcgtgcctgccacggaatcatgacaagaatagatttatggatatgctgcccccagacagatgtctgccctttcttatcactatcgacggggagtcttcaaactacatcaatgctgccttaatggacagttataggcagcctgctgcctttattgtcacccaatatcccttaccgaacacagtgaaggacttctggcgcctggtctacgactatggttgcaccagtattgtgatgctcaatgaggttgacttgtcacaggggtgcccacaatactggcctgaagaaggtatgcttaggtatgggccaatccaggttgaatgcatgagctgcagcatggattgtgacgtgattaacaggatctttcggatctgtaacctgactcgcccacaggaaggatatctgatggttcaacagttccagtacttaggttgggcgtctcatagggaggtgccgggttcaaagagaagctttttgaagttaattctgcaggtggaaaagtggcaggaagaatgcgaagagggcgagggcaggactattattcactgtctaaatggcggaggacggtcgggtatgttttgcgctatcggcatcgtggtggagatggttaagcgccagaacgtcgttgacgtcttccacgcagtgaagacattgcggaattccaagccaaacatggtcgaggctcccgagcaataccgattttgttacgatgtggcgctcgagtatctcgagtcctcatag

SEQ ID NO: 237150 - DNA, 4323 bp, Artificial Sequence
  Description of Artificial Sequence: Synthetic coding sequence
atggacactacagccgctgcagcacttcctgcatttgtggctctccttttgctcagcccctggcctttgctcggatctgcacagggacaattctctgcaggcggatgcacctttgacgatggacctggcgcttgcgactaccatcaggacctctacgatgactttgagtgggtgcatgttagcgcccaggaaccacactatctgccgcctgaaatgccccaggggagctatatgatcgtcgacagcagcgatcacgacccaggagaaaaagccagactccagcttccaaccatgaaagagaacgatacacactgcatagattttagttatctcttgtacagccagaagggactcaatcctggaactttaaacattctcgtgcgggttaataaaggccctcttgcaaaccccatctggaacgtgacggggtttaccggtcgcgattggctgcgggctgagctggcagtttcaaccttctggcccaacgagtaccaagtgattttcgaggctgaagtatctggtggccgttctggatacattgccattgacgatatacaagtcctgtcttacccttgtgataagtcaccacactttttgagactcggagacgtagaagttaatgctggccagaacgccacctttcaatgcatcgctaccggcagggacgctgtgcacaataagctctggctgcagagaaggaacggcgaagacatacccgtggcccagacaaaaaacatcaaccataggaggtttgcagccagtttccgtttgcaagaagttactaaaaccgaccaggacctttaccgctgtgtgactcaaagcgaaagggggtcaggtgtatcgaatttcgcacagttgatcgtgcgagagccaccccgtcccattgcacctccccagttactgggcgtcggccctacctatctattgattcaactgaacgccaacagtataataggggacggacccattattctgaaagaggtagaataccgtatgaccagcggcagctggacagagactcacgcagtgaatgctccaacgtacaaactatggcacctcgacccagatactgaatatgaaatccgtgtcttactgactagaccgggagaggggggaacgggactgcccggtcccccattgatcacccggacaaaatgcgcagagcctatgcgtacccctaagaccttgaaaattgccgaaatccaggcacgaaggattgccgtggactgggagtccttgggatataatatcaccaggtgccatactttcaatgtgactatctgctaccactactttagaggccataatgaatctaaagccgattgtctcgatatggaccctaaagccccacagcatgtggtaaaccatctgcctccctatacaaacgtgtcactgaaaatgatcttaactaatccagagggtaggaaggagagtgaagagactatcattcaaacagatgaagatgtccctgggcctgtgcctgtcaagagtctccaaggaactagcttcgagaataaaatattcctgaattggaaagaacctcttgaccccaacggaattatcacccagtatgaaatttcgtactctagtatccgttcatttgatccagccgtgccagtcgctggacctccacagactgtgtctaatctttggaacagtacacatcatgtattcatgcaccttcacccaggtaccacatatcagtttttcatcagggcctctaccgttaagggcttcggtcccgcaaccgccattaatgtgacaaccaatatctcagcacccaccctgcccgactatgaaggagtggatgcctcactgaatgaaacagccactaccatcaccgtgttgctacggccagcccaagctaaaggggctcctatcagcgcatatcagatcgtcgtggaagagttgcacccccacagaaccaagcgggaagccggagcaatggagtgttaccaggtgccggttacataccagaacgcaatgtccggaggtgccccatactattttgctgccgagttgcctccaggcaacctgccagagccggctcctttcaccgtcggagacaaccggacgtaccaggggttctggaatccccctctggcaccaagaaagggctacaacatctatttccaggccatgtctagcgtggagaaggagaccaagacccagtgtgtccgtatcgccactaaggcagccgcaactgaggagccagaagtcatccccgacccagccaagcagacggaccgagttgtcaagatcgcagggataagcgcaggcattctagtcttcatccttttgctcctcgttgtgatcctcattgtcaaaaagtctaaattagccaagaagcgcaaggatgcaatgggaaataccagacaagagatgactcatatggtgaacgcgatggaccgcagctatgccgatcagtccacattacatgccgaggacccactgagcataaccttcatggaccaacataacttctcccctaggtatgaaaaccacagcgctacagccgaatctagccgcctgctcgatgttccccgatacctgtgcgaaggcaccgagagcccgtaccaaaccggccagctgcatccggctatccgagtcgctgatctgcttcagcacattaacttaatgaaaacatcggactcatacggatttaaagaggagtatgaaagtttcttcgagggacagagcgcttcttgggacgtggcaaaaaaggatcagaaccgagctaagaacagatacggtaacattatcgcctatgaccattcgagagtgatcctgcagcccgtagaggatgatccttctagcgattacatcaatgcaaactacatagacggctatcaaagaccatctcattatatagctacacaaggtcccgtccacgagacagtctacgatttttggcgcatgatctggcaggagcagtccgcatgcatcgtgatggtcacaaacttggtggaggttgggagagtaaagtgttataagtactggccagacgataccgaagtttacggcgattttaaggtcacgtgcgtggagatggagcccctcgctgagtatgtcgtgcggacctttaccttggagagacgtggctataatgagattagggaagtcaaacagtttcacttcacggggtggccagaccatggtgtcccgtatcatgctaccggcctgctctctttcattcgcagggtcaagttgagtaatcctccgagtgccggacccatcgtggtgcattgtagcgcaggggctggccgaaccgggtgttacatagtgatagacataatgctggacatggcggagcgagagggcgtagttgacatttataactgtgtaaaagctctccgatctagaaggatcaacatggtgcagaccgaggagcagtacatcttcattcacgacgccatcttggaagcatgcctctgtggagaaactgccattcccgtgtgtgagttcaaggcggcatattttgacatgatccgaatcgactcacagacaaactcttcgcaccttaaagacgagtttcagactctaaatagtgtcactcctcgacttcaggctgaagactgttcgattgcttgcctccctcgaaatcacgacaaaaacagatttatggacatgctgcctcctgatcgctgtctccccttcttgatcaccatcgacggcgagagtagtaattatatcaatgccgctctcatggatagttatagacagccagctgctttcattgtgacccagtacccccttcccaatactgtcaaggatttttggcgcttggtgtatgattacggctgcacctctattgtaatgctcaacgaggtcgacctttcacaaggttgcccccagtattggcctgaggagggcatgctgagatacggcccaatccaagtggagtgcatgtcttgctccatggactgcgatgtcatcaacagaatctttagaatttgtaacctgaccagaccacaggagggttacctgatggtccagcaattccaatacttgggttgggctagccatcgagaagtacccggatctaagagatcttttcttaaactgatactgcaggtagagaagtggcaggaggaatgcgaagagggggaaggaagaactataatccattgcctcaatgggggaggcagaagtggtatgttctgcgcgatcggtatcgtggtggaaatggtcaaacggcagaacgttgtggacgtctttcacgctgtgaaaaccctcaggaattctaagcccaacatggtggaggctcccgagcagtaccgcttttgttatgacgtagcactggagtacctcgaaagtagttag

SEQ ID NO: 237151 - DNA, 4374 bp, Artificial Sequence
  Description of Artificial Sequence: Synthetic coding sequence
atggacacaaccgccgctgccgcactaccagcattcgtagccctgctgttgctgagtccctggccactcttgggtagcgctcagggccagtttagtgcgggaggctgcactttcgacgacgggccaggggcatgcgactaccaccaggatttgtacgatgacttcgaatgggtccacgtgagcgcccaggaaccacactatctgcccccagagatgcctcagggtagctacatgatcgttgattctagtgaccatgaccctggagagaaggcccgactgcaactgccaacgatgaaagaaaacgatacccactgtatcgatttcagctatctgctgtacagccagaaaggcctgaatcctgggacactcaacatcctggtcagggtaaacaaagggcctctggctaatcccatatggaacgtgacgggattcacaggcagagattggttacgagccgaactcgcggtttctactttctggcccaacgagtatcaggttattttcgaggccgaggtgagcggcggtcgcagcggctacatcgccatcgacgacatccaagttctgagttatccttgcgataagagcccgcatttcctccgcctgggagacgtcgaagtgaacgccggacaaaacgcgacatttcaatgtatcgcaacgggacgagatgccgtgcataataaactgtggttgcagcggaggaacggggaggacattcccgtcgctcagaccaagaacataaaccacaggaggtttgccgctagtttcaggttacaggaagttaccaagacagatcaagatctatacaggtgtgtgactcagagtgagagggggagcggcgtttcaaactttgcacagctgatcgtgcgggaaccacctcgtcccatcgcgccaccccagcttctgggcgtcggaccaacctacctactgatccagctgaatgccaacagtattatcggggatgggccaataatactcaaggaggttgaataccgcatgactagcggctcatggaccgagacccatgcggtcaatgctcccacttacaagctgtggcacctcgatccagatactgagtacgagatcagggtgctgttgacaagaccaggcgagggcggaaccggtcttccgggaccaccgttaatcacacggacgaagtgtgcggagccgatgagaactcctaagacccttaaaattgccgaaattcaagcaaggcgcattgccgtggattgggaatccctgggctacaacattactcgctgccatacattcaatgtgaccatctgttatcactacttcagaggccacaacgagtcaaaggctgattgtctcgacatggaccctaaggcaccacaacatgtagttaaccatctgccaccatacactaacgtgtccctgaagatgattctaactaaccctgagggacgcaaggaaagtgaggaaaccataatccaaacagacgaagacgtgccaggtccagtccctgtgaagtccctgcaggggacttcatttgagaacaaaatcttcctgaactggaaagagccactggaccccaacgggattataacacagtacgaaatttcttactcttctattcggagcttcgacccagctgtgccagtggcagggccacctcagactgtgtccaacctgtggaacagtacccaccacgtattcatgcatcttcaccccggtaccacgtatcagttcttcatccgggcaagcaccgtgaagggatttgggccagctactgcgattaatgtaactaccaatataagcgctcctacgctacctgactacgaaggtgtggatgcttctctgaacgagactgcaacaacgattaccgtcctgcttagaccggctcaagccaaaggagcacccatctcagcctatcagatagtcgtagaggaattgcatccccatcgcacgaagcgagaagccggtgcaatggaatgctatcaggtgcccgtgacttatcaaaatgccatgagcggaggcgctccttattactttgcagccgagctgcccccaggcaaccttcccgagccggctccgttcaccgtgggagataatcgcacgtaccagggcttctggaatccaccgctcgcgccacgcaaaggttataatatctatttccaggctatgagctccgtggagaaggaaactaaaacgcagtgtgtgcgaatcgcaactaaggctgcagctaccgaagagccagaagttatccccgatcccgctaagcaaaccgatagggtcgtaaagatcgcaggaatctcggcagggatcttggtattcattctgctcctcttagtggtgatactgatcgttaagaagagcaagctggcgaagaagaggaaagacgccatgggcaacacacggcaggagatgacccatatggtgaatgcaatggatcgctcatatgctgaccaaagtacgttgcacgcagaggaccctttaagcatcacattcatggatcagcacaacttctcaccccgactgccaaatgaccccctggtgccgacagcagtgctggacgaaaaccactccgccactgcagaaagcagcaggctcctcgacgtgcctagatacctttgtgaaggaaccgaatccccctaccaaactggacagctgcacccagccattcgagtagccgaccttctccagcacattaatctgatgaagacctctgacagctacgggtttaaggaagaatatgagagtttttttgaagggcaatctgcaagttgggatgtggcaaagaaagaccaaaatcgcgctaaaaataggtacggcaatataattgcatacgatcacagcagggtgatactccagccagtagaggatgacccatctagcgactatataaacgctaactacatcgatgtcagcattttcatcggttaccagcggcctagccactacattgcaacacagggacccgtgcacgagaccgtttatgatttttggcgcatgatatggcaagagcagtccgcgtgtatcgtgatggtgaccaatctggtggaggtcggtcgtgtgaagtgttataaatactggcccgacgacaccgaagtctatggagacttcaaggtgacatgcgttgagatggaacctctggctgagtatgttgtgcgcacattcaccttggagcgcaggggatataacgagatccgcgaggttaaacagttccactttaccggttggcccgaccatggggtgccataccatgctactggcttactgtcatttatccggcgtgtgaaattgtccaaccctcccagcgcaggccctatcgtggttcactgcagtgcaggggctggcaggacaggatgttatattgtcatcgacatcatgctggatatggccgaacgggaaggggtggttgatatttataactgtgttaaggcgttgaggagtaggcggatcaatatggtgcagaccgaagagcagtatatatttattcatgacgctatactcgaagcctgcctctgtggcgagaccgcgatcccggtgtgcgagttcaaggccgcatattttgatatgatcagaattgattcacagaccaattcgtcccatctgaaagacgaattccaaaccttgaacagcgtgacacccaggcttcaagcagaggactgctctattgcatgcctgcccaggaatcacgataaaaataggttcatggacatgcttccacctgatcggtgcctgccttttctgataacgatcgacggtgagtccagtaactatattaacgcagcactcatggatagctaccgtcagcccgctgcattcatcgttactcaatatcctttgccgaacacagtcaaagacttctggagactcgtgtacgactatggatgtacatctatagttatgctcaatgaagtggatctgagtcagggctgccctcagtactggcccgaagagggcatgctccggtacgggcctattcaggtggagtgcatgtcctgcagtatggactgtgacgtgatcaacaggatttttcgaatttgcaatctcacccgacctcaagaagggtacctcatggtgcagcagtttcagtatctgggctgggcgtcccacagggaggtcccagggagcaagaggtcgtttctgaagttgattctgcaggtcgaaaagtggcaggaggagtgcgaagaaggagaggggagaacgattatacattgtctcaacgggggtggcagatccggaatgttctgtgcaataggtatcgtcgtggagatggttaagcggcagaacgttgtcgacgtattccacgccgtgaaaaccctgcgcaatagcaaacccaatatggtcgaagctcctgagcagtacagattttgctatgacgtggcattggaataccttgaaagctcctag

SEQ ID NO: 237152 - DNA, 2244 bp, Artificial Sequence
  Description of Artificial Sequence: Synthetic coding sequence
atgactctgaacggttgcatgctggtgctgaagtccctgattatctatcatcctagatgccccaaagtgatcttcgaggcagaagtgtctggcggaaggagcggctacatcgctatcgatgatatccaggttcttagttacccatgtgacaagtccccacacttcttaagacttggagacgtcgaagttaatgctgggcagaacgctacattccagtgcattgctacaggccgagacgctgtgcataataagctgtggctgcagcggagaaatggcgaggatatacccgtcgctcaaactaagaacatcaatcatcgcaggtttgctgcctcattccgcctgcaggaagtgactaagacagaccaggatctgtaccggtgtgttactcagtccgaacgcggttccggagtatccaatttcgcacagctcattgtgcgcgaaccccctcgcccaatagcgccaccccagctcctgggagtaggcccaacataccttcttattcagttgaacgcaaactcaattatcggagatggtcctataatcctcaaagaagtcgaatatcgaatgacttctgggtcctggactgaaacccatgccgtgaacgcccctacatataagttgtggcatctcgaccccgacaccgagtacgaaattcgagtgctgctaactaggcccggagagggagggaccggtctgccaggtcccccactcattacaaggactaagtgtgcagagcctatgcggacccctaagaccctgaaaatcgcagagatccaagcacgcaggatcgctgtggactgggagtctctgggctataacattacgcggtgccatacctttaatgtcaccatctgctatcactacttccgaggacacaacgaatccaaggcagattgccttgatatggaccctaaagcccctcagcacgtggtgaaccatctgcccccatacacaaatgtgagtctgaaaatgatccttacaaacccagagggtcgcaaggagtcggaggaaaccatcattcagactgatgaggacgttcccggtccagtgccagtcaagagcctccagggcaccagctttgagaataagatattccttaactggaaggaaccccttgatcccaacggcattattacccagtacgagatctcctatagctctatcagatcttttgatcccgctgtgccggtggccggtccccctcagacagtgtccaatctttggaattctactcatcatgtttttatgcaccttcaccctggcacaacctatcagttctttatcagggcttcaactgtgaaaggcttcggtcctgcgaccgctatcaatgtcaccactaatatctcagcgcctactctccccgactatgagggtgtggacgctagcctcaatgaaaccgctacgactatcactgtcttgttacggccagcacaggctaaaggtgctcctattagcgcttaccagatcgttgtggaggaattgcaccctcaccgaacaaaaagggaagcaggggcaatggaatgttatcaggtgcctgtgacctaccagaatgcgatgtctggcggagcgccttactacttcgctgccgagctccctccagggaaccttccagagcccgctccttttactgtgggtgacaaccgtacataccagggcttctggaacccacctcttgcgcctcgaaagggctacaacatttattttcaggccatgtcctctgttgaaaaggagacaaaaactcagtgcgtcaggattgctacaaaagcggctgctactgaagaacccgaggtgattccagacccggcaaaacagacagacagggtggtgaagattgccggaattagcgcagggatcctcgtctttatcctcctgcttctcgttgttatactgattgtcaagaaacgctatatctgctggcggcgtcatatttgtatccggaatatcaggcggagctattatagttactcatactatttgaagctggccaaaaagagaaaagacgcaatgggcaatacaaggcaagaaatgacgcacatggtaaacgccatggacagatcatacgctgatcaatcgaccttacacgcggaggatccactttcaatcacctttatggatcagcacaacttttctccgcgactgcctaatgatcccctggtcccgacggccgtgttagttccatcaccaggacgcaagaacgtatatcacggggataacaacagctttttcgccataagttacctgtag

SEQ ID NO: 237153 - DNA, 4389 bp, Artificial Sequence
  Description of Artificial Sequence: Synthetic coding sequence
atggatacaacagccgcagccgctctgccagcatttgttgctctgctgctcctgagcccttggcctctactcggttccgctcagggtcagttctcagcagggggatgcacctttgatgacggaccaggcgcatgcgattatcaccaggacttgtacgacgacttcgagtgggtccacgtgtcagcacaggaaccccattatttaccccctgaaatgccccagggttcctacatgattgttgacagttctgatcacgaccccggagaaaaggccagactgcagttaccgacgatgaaagaaaacgatactcactgtatcgactttagttaccttctttactcacagaaaggtcttaaccccggtacactcaacatcttagtacgtgttaataagggacccctagcaaatcctatctggaatgtcaccgggtttactggtagggattggttacgcgctgagctggccgtctccactttctggcccaacgagtaccaggtcatcttcgaggccgaggtcagcggtggacgctccggctatatagccatcgacgacatacaagtgctctcctatccatgtgacaagtccccacacttcctcaggcttggggacgttgaagtaaacgcaggccagaacgccactttccagtgcatcgccactggacgggatgctgtgcataataaactctggttacaaaggagaaacggagaggacatccctgttgcacagacgaaaaacatcaaccatcggcgtttcgcagcatcattccgcctgcaggaggtcactaaaactgatcaggatctttatcggtgtgttactcagagtgagcgcggatccggggtatctaacttcgcacagctcatcgtacgtgaaccccctaggcccatcgctcctccacagctgcttggggtaggccctacctacctgctgatacagctaaatgccaatagcatcattggagatggtccgattattttgaaggaagtggaatataggatgaccagtggttcgtggactgagactcacgccgtgaatgcacccacatataagctctggcacctggatcccgacactgaatacgaaattagggtgcttctgacccgaccgggagaggggggaacagggctgccgggacccccacttataacaaggacgaaatgcgctgagccgatgcggaccccgaagacgctgaaaatagccgagatacaagcccgtcgaattgcagttgactgggaaagtttaggatataatatcacgcggtgccatacattcaatgttacgatttgctatcactatttccgaggccataacgagtctaaagccgattgtcttgatatggatccaaaagcccctcagcatgtcgtgaaccatttgcccccatacactaatgtgagtcttaaaatgatcctgacaaaccccgaaggacgtaaggagagcgaggaaaccattatccagacagatgaggatgtaccgggacctgtgccagtgaagagtctccagggtactagtttcgagaacaagatctttctcaactggaaggagccactggaccccaatggcattatcacacagtacgagatctcttattcaagcatcaggtcttttgaccccgcagtgccagtagcaggtcccccacagaccgtgagcaacctctggaactcaacccaccacgtgttcatgcacttacacccgggaactacgtatcagttcttcataagggcgagtacagtgaagggtttcggccctgccactgccatcaacgtgaccactaatatttcagcaccgacactgcctgattatgagggcgtggatgcatctctcaatgaaaccgcaaccactatcacagtgctgttgcggcctgctcaggctaaaggtgcaccaattagcgcctatcagatcgtcgtggaggagctccacccccacagaacgaaaagggaggccggagccatggaatgctaccaggttccagtaacataccaaaacgccatgagtggcggagctccctactattttgcagccgagcttccacctggcaatctgcctgagcctgctcctttcaccgttggcgacaatcgaacatatcagggcttctggaatcctcccctggcacccaggaaggggtacaacatctactttcaagccatgagctccgtggaaaaggagactaaaacccagtgcgtgaggatcgccaccaaagccgcagcaaccgaggagcctgaagtgatcccagatccagctaaacagaccgatcgggtggttaagatagctgggatcagcgcgggaattttagttttcatcctgttgctattagttgtcatcctaatcgtgaagaaatctaagctggcgaagaagagaaaggatgcaatgggaaacaccagacaggagatgacccacatggttaacgcaatggataggagttacgccgatcagagcaccctgcacgctgaagatccactctccattacgttcatggaccagcataatttcagtccgagactgccaaatgacccacttgtgcctacagccgtgctggttcccatcacagatgagaaccatagtgctacggctgagagctccaggctgctggatgtaccaagatatctgtgtgagggaaccgagagcccttatcagaccgggcaactccacccagccattagggttgcagacctattgcaacacatcaacctcatgaagacctcggacagttacggttttaaagaagagtacgaatctttttttgaaggccagagtgcctcatgggatgtagcaaaaaaagaccagaatcgggcaaaaaacagatacggcaatatcatcgcctacgatcattctcgggtcatcctccagccagttgaggacgatcccagcagtgactacattaacgccaactacattgacatttggctctatagggacggttaccagagaccaagccactatatcgctacgcagggccctgtgcatgaaacagtgtatgatttctggcggatgatttggcaagaacagagcgcctgcattgtgatggtgactaaccttgtcgaggttggcagagttaaatgttataaatactggcccgatgataccgaggtgtacggcgatttcaaggtaacgtgcgtggagatggaaccgctggccgagtacgtcgttcgtacctttaccttggagcggcgtgggtacaatgagatccgggaggttaagcagtttcacttcacaggatggcccgatcacggcgtgccatatcacgcaacaggtctgctctccttcatacgcagggtgaagttaagcaatcccccttccgccggacctatcgttgtacactgttctgcaggcgctggacgcaccggatgttacatcgtcatagatattatgctggatatggcagaaagggagggcgttgtcgacatttacaattgtgtcaaggccctaaggagtaggaggataaatatggtgcagacagaagagcaatacattttcattcacgacgcaatcctggaggcctgtttgtgcggtgagaccgctatacccgtctgtgaattcaaggccgcttatttcgacatgatacgaatcgacagccagaccaacagcagccacctcaaggacgaatttcaaaccctgaacagtgtcacacctcggctgcaggccgaagactgcagcatagcctgcctacctaggaatcacgataagaaccggttcatggacatgctgcccccagacaggtgtttacccttccttataacgattgacggtgagagctccaactacattaatgccgctttgatggattcttatagacagcctgcagcattcatcgtgacacagtaccctctgccaaatacagtcaaggatttttggcggctggtctatgactatggttgtaccagtatagttatgctaaacgaagtagatttgtctcaggggtgcccacaatattggccggaggagggcatgctgcgctacgggcctatccaggtcgaatgcatgagctgtagcatggattgtgatgtgatcaatagaattttccggatttgtaatctcacacgccctcaggagggctaccttatggttcaacagttccagtacttgggctgggcatcccacagggaagtccctggctccaagcgcagtttcctgaaattgatactgcaagtcgaaaaatggcaagaagagtgcgaagaaggcgaggggaggacaataatacactgcttgaacgggggaggaagatccgggatgttctgcgcaatcggaattgttgtggagatggtgaagaggcagaacgtggtggatgtgtttcacgcagtcaagactctcagaaatagtaagcccaatatggtcgaggcccctgagcagtaccggttttgttacgatgttgcgctggaatatctggagtcgagctag

SEQ ID NO: 237154 - DNA, 4359 bp, Artificial Sequence
  Description of Artificial Sequence: Synthetic coding sequence
atgaggggtctgggcacatgtcttgcaacactggccggtctactgctcacagctgctggcgagactttttccggcggttgcctgtttgacgagccttacagcacctgcggttacagccagtcggagggtgacgactttaattgggagcaggtaaacacactcacaaaaccaacttcagatccatggatgccctcgggctcttttatgctagtcaacgcatcaggacggccagaaggtcagcgggcacatctgctcctgcctcagctgaaagaaaatgatactcactgcatcgatttccactatttcgtgtccagcaaatccaatagcccaccgggacttctcaatgtgtacgtgaaggtcaataacggtcctcttggcaacccaatttggaatattagcggtgatccaactcgcacttggaaccgcgctgagctagcaatctcaaccttctggcctaacttttaccaggtgatctttgaggtgattacgtctgggcaccagggctatctcgccattgacgaggtcaaggtgctgggccatccatgcacgagaaccccgcacttcctccgcattcagaatgtcgaagtgaatgccggacagtttgcgacattccagtgttccgcaattgggagaaccgtcgctggtgatcgactgtggctgcaggggattgacgtcagggacgcacccctcaaggagatcaaagtgacttctagccgacggtttatcgcttccttcaacgtcgttaatactactaaaagggacgcaggtaagtacagatgtatgatacggacagaaggaggggtaggtatctctaactacgctgaactcgtggtcaaggagccgcctgtccccatagctcctccccagctagcttccgttggtgccacttatctgtggatccagcttaacgcaaacagtattaatggggatggcccaattgttgcacgcgaggtggaatattgcaccgctagcggatcatggaacgaccggcaacctgtcgactctacctcatacaaaataggacatttggatcccgataccgagtatgaaatctcagtgcttttgaccaggcctggggaaggaggaaccgggtcccccggacccgcactcagaactcgtactaaatgcgcggatcccatgcgagggccacgtaagctggaggtggtcgaagttaaatccagacagatcactatcagatgggaaccttttggatacaacgttactaggtgccattcctataacctcactgtgcactattgctaccaagtcggtggacaggagcaggtccgcgaagaagtgtcctgggatactgagaacagccacccccagcacaccattaccaacctaagcccttacacaaacgtgtcagtgaaactcattctcatgaaccctgagggcaggaaagaaagccaggagttaatagttcaaactgacgaggaccttcccggtgctgttcctaccgagagcattcagggcagtaccttcgaggaaaagatattcctgcagtggcgggagccaacgcaaacatacggtgtcattaccctgtatgagattacttataaggccgttagttcttttgacccagaaatcgacctttcgaatcagtcaggacgcgtgtctaaactcgggaatgagacccatttcctgttcttcggcctctatccagggactacatattccttcaccatacgcgcaagtaccgccaagggcttcggtccccctgccactaatcagttcaccacaaagatcagcgcaccatccatgccagcttacgaactggaaaccccactgaaccaaacagacaacactgtcaccgtcatgctgaagcccgctcacagccgcggtgctcccgtgtcagtctaccaaattgtcgtagaagaagaaagaccacgcagaactaagaagactacagagatcttgaaatgctaccctgtccctatccattttcaaaacgcatccctgctgaattcccagtattacttcgcagctgagtttccagccgatagtttgcaggctgctcagccttttacgattggtgacaataagacttataatggatactggaacactccacttctgccctacaaaagctaccggatttactttcaagctgcaagccgcgcaaatggggagactaaaattgactgcgtacaggtcgccacaaaaggagctgcaacacctaaacctgtgccagaacctgagaaacagacagaccacacagtcaagatagccggagtgatcgccggtattctcctgttcgtgattatcttcctgggagtggtgttggtcatgaaaaagcgcaaactggctaagaaaaggaaagagaccatgtccagtacaagacaggagatgacggtgatggtgaactcgatggataagagctacgccgagcaggggacaaattgcgacgaggccttctcgttcatggatacacataatctaaatggacgttcagtctccagtccatcatcattcactatgaaaaccaatacactgagcaccagcgtgccgaattcttactacccagatgaaacccacactatggcctccgatacctcttcgctggtgcagagccacacctataagaagcgagaaccagccgatgttccttaccagactggccaactacaccccgctattcgcgtggctgacttactccagcacataactcagatgaagtgcgcagaaggctacggattcaaggaagagtacgaaagtttctttgaaggtcaatccgctccatgggacagcgcaaaaaaggatgaaaaccggatgaagaaccgatacggaaatatcattgcctacgatcattcccgcgtcaggttgcagaccatcgagggtgacactaactccgactacatcaacggaaactacatcgatggttatcataggcctaatcactatatcgcaacgcaaggccctatgcaagagaccatctacgacttttggcgaatggtgtggcatgaaaacactgcgtcaattataatggtgacaaacctagttgaagtcggcagagtgaaatgttgtaagtactggcctgacgacactgagatctacaaggatattaaggtgactctcattgagactgaactgctagcagaatacgtgattagaacatttgccgtggagaagagaggcgtgcatgagattcgggagatcagacagtttcattttacaggttggccagaccatggggtgccctaccacgccactggactcctgggttttgttcgtcaggtcaagtccaaaagccctccctctgctggtcccttggtggtgcattgcagtgccggagccggtcggaccggttgtttcatagtgatcgatatcatgctggacatggctgaaagggaaggcgtggtggacatctataattgtgtccgtgaactgaggagcagaagagtgaatatggtccagacagaggaacagtacgtgtttattcatgatgctatccttgaggcatgcctgtgcggcgatacatcggtgcctgcttcccaggttcgcagtttgtattacgatatgaataagctggacccccagacaaactcctcacaaataaaggaagagtttagaaccttaaacatggtgacgccaaccttgagagtggaagattgttccatagccctgctgcccagaaatcacgaaaagaacagatgtatggatattctgccccctgatcgctgtctgccttttctgattaccatcgatggtgaatccagtaactacatcaacgccgcactcatggatagctataagcagccctcggcctttatcgtgacccagcatccactgcctaataccgtaaaagacttctggagactagttctggattaccactgtaccagtgttgtaatgctgaatgatgtggatcctgctcagctctgtccgcagtattggcctgagaacggcgtccatagacacggacccatccaagtcgagttcgtgagtgccgacctggaggaggatattatcagcagaatcttccggatatacaacgccgcaaggcctcaggatggctacagaatggtgcaacaatttcaattcctaggttggccaatgtaccgggacacaccagtctcaaaacggtcgtttctgaaacttatccgacaggtggacaaatggcaagaggagtacaacgggggagaaggcagaactgtagttcactgcctgaacggtgggggtaggtccggtactttttgtgccatcagcatcgtatgtgaaatgctgaggcatcagaggaccgtggatgtttttcacgccgtcaaaacactaaggaacaataagcccaatatggtggatctgttagatcagtataagttttgctatgaagtggctctggaatacttaaattccggctag

SEQ ID NO: 237155 - DNA, 4173 bp, Artificial Sequence
  Description of Artificial Sequence: Synthetic coding sequence
atgcccagtggctctttcatgttggtgaacgcctctggcaggccagaggggcagcgtgcacacctcctgcttccacaactcaaggagaatgatacacattgtattgactttcactatttcgttagctccaagagcaattcccccccagggctccttaatgtgtatgttaaggtcaataacggcccactcggcaaccctatttggaatatcagtggtgatcccacgcgaacatggaacagagcggaactggcgatctctacattttggcctaatttctatcaggtgatcttcgaagtgatcacctctgggcaccaagggtatctggctatagacgaggttaaagtgctcggtcatccgtgcacgcgcacaccccactttttgcggattcagaacgtggaagttaacgcgggtcagttcgcaaccttccagtgttccgccatcggacggaccgtcgctggcgatagactctggcttcagggcattgatgtgagagatgcaccactcaaagaaatcaaggttacaagttcaaggaggtttattgcttcgtttaacgtcgtcaatactacgaagcgcgatgccggaaaatatagatgtatgatcagaacagagggcggtgttggaatttctaattatgcagaacttgttgtgaaggagccccctgtccccatcgcaccacctcagctggcatcagtgggggcaacctacctatggattcaactaaacgctaattccatcaatggagacggtccaattgtggcacgcgaagtggaatactgcactgcatcaggtagctggaatgatcgtcagcctgtggattccacatcatacaagatcggccatctggatcccgacaccgagtacgagatttccgttttgttaacaaggcctggagaagggggaactggcagcccagggccagcacttcgcacacgaactaagtgcgccgaccctatgagggggcctcgcaaactggaggttgtggaggtgaagtccaggcagattaccatacgatgggaaccgtttggctacaacgtgaccaggtgtcactcatacaacctgaccgtgcactactgctatcaagtaggcggacaggagcaggtaagagaggaggtgagttgggacaccgagaactcccatccgcagcatacaatcacaaacctgtccccatacaccaacgtatccgtgaaactcatcctcatgaaccccgagggtcgaaaagaatcacaggaactcattgtacagaccgatgaagacctgcccggagctgttcccacagaatcgattcaaggctctacttttgaggagaagattttcttgcagtggagggaacccacgcagacatatggtgtcatcacactttatgagatcacgtacaaggctgtgtcatcctttgacccagaaatcgacctatcaaaccagagtggcagggtgagtaaactcgggaatgaaacccacttcctgttcttcggtctctaccccggtactacctattccttcacaatccgcgcatccaccgccaagggtttcggaccacctgcgacaaaccaattcaccactaaaataagcgcgccttcaatgcctgcctatgagctggagactcccctgaatcagaccgacaacaccgtcaccgtgatgctgaagccagctcatagtcggggagctccagtgtcggtctatcagattgtggtagaggaggaacggccacggaggaccaagaagactacggagatcttaaagtgttatccagtacccatacacttccagaacgcaagccttctcaactcacagtactactttgcagccgaattccccgcagacagtcttcaggctgcccagccctttactattggcgacaataaaacctataacggctactggaatactcccttgctgccgtacaaatcttataggatctactttcaggccgcaagccgcgctaacggagagactaagatcgattgtgtccaggtagccacgaaaggcgcagccacccccaagcccgtgcccgaaccagagaagcagaccgatcataccgtgaaaatcgcaggcgtaattgccggaattctcctgtttgttatcatcttcctcggcgtcgtgctggtgatgaaaaagcgtaagctcgctaaaaagagaaaggaaaccatgtcatccactcgtcaggagatgacagtgatggtgaatagtatggacaagtcatacgccgagcaaggaactaattgtgacgaagctttcagttttatggatacacacaacctcaatgggagatccgtcagttccccctcgtcctttaccatgaagactaatactctctcaacatctgttccaaatagctattatcctgatgagacgcacacaatggcatccgatacctcttctctggtacagagtcatacgtacaaaaagcgagagcctgcagatgtgccataccagacaggccaactccacccagccatccgtgtcgctgacttgctgcagcacattacccagatgaagtgtgccgagggctatggcttcaaggaggagtacgagtcattcttcgagggacagtcagctccgtgggactccgccaaaaaagatgagaacagaatgaagaaccgttatggcaatatcattgcttacgatcattcacgagtgcgactgcaaaccatcgagggagataccaactcagactacatcaatggaaactacattgacggttaccacagaccgaatcattacatcgctacgcagggaccaatgcaggaaactatttatgatttttggaggatggtgtggcacgagaatacggctagtataattatggtgacaaacttggttgaggtgggcagggtgaaatgttgcaagtactggccagatgacacagagatctacaaggatattaaggtaaccctcattgagactgagttactggctgaatacgtgatacgtacctttgccgtcgagaaacgcggtgtgcatgagatacgcgaaattaggcaatttcatttcacaggctggcccgaccacggagtcccctaccatgcaactggtttgctcgggtttgttcggcaggtgaaaagcaaaagcccccctagtgcgggtcccttagtggtacactgttcagccggagcgggtcggacaggctgttttattgtcattgacatcatgttggatatggccgagcgggagggagttgtcgacatctataattgcgtgcgcgagctgaggtcccggagagttaatatggtgcagacagaggaacaatatgtgtttatccatgacgctattctggaggcctgcctgtgcggggatacctctgtccctgcctcccaggtgcgatcgctatactacgatatgaacaaactagacccacagacaaattctagccagattaaggaagaatttagaaccctaaacatggtgacaccgacactgagagtggaggactgctccatcgccctgctgccacggaaccacgaaaagaaccggtgtatggacattttgccccctgatcggtgcttgcctttcctgatcactattgacggcgaatccagcaactatatcaatgccgctttgatggattcatataagcagcctagcgctttcattgtgacccagcaccctctgccgaatacggttaaggatttctggagattggtgcttgactaccactgcactagcgtggtcatgctaaacgacgtcgatcccgctcagctgtgcccccagtattggcccgagaacggtgttcaccgtcatggaccgattcaagtcgaattcgtatccgctgatcttgaagaggatattatcagtcgtattttcaggatatataatgctgcccgaccacaggatggctacagaatggttcagcaatttcagtttctggggtggccaatgtatcgggatacccctgtatcaaagcggtcttttctaaaactaattaggcaggttgacaagtggcaggaggagtacaacgggggagagggacgcacagtggttcactgcttgaatggagggggacggagcggaactttttgcgctatctccattgtctgcgaaatgctgagacaccaacgtaccgtggacgtgtttcatgccgtgaaaacgctccggaacaataagcccaatatggtagacctgctggatcagtacaaattttgctatgaggtggcactcgaatacctgaattcagggtag

SEQ ID NO: 237156 - DNA, 4401 bp, Artificial Sequence
  Description of Artificial Sequence: Synthetic coding sequence
atgcgcggactcgggacgtgtttagcgactctggccggtcttctcctgactgcagctggcgaaactttcagcggcggttgtttattcgatgagccgtactccacgtgcggctattcccagagcgagggcgatgatttcaattgggaacaggtcaatacactgacaaagcctacttctgatccctggatgcctagcggaagctttatgcttgtgaacgcctctgggcgtcccgaggggcaaagggcccacttgctcctgcctcaacttaaggaaaacgacacccactgtattgatttccattatttcgtaagctcgaagtcaaactccccaccagggctgcttaatgtatatgtgaaagtcaacaacggccctctggggaaccccatatggaatatctccggcgatccaacacgaacctggaatcgcgctgagctagcaattagtactttctggcctaacttctatcaggttatctttgaggtgattaccagcggccatcaaggatacttggcgattgacgaagttaaagtgcttgggcacccatgcacaaggaccccccacttcctgagaatccaaaatgtagaagttaatgcgggacagtttgccacctttcagtgttccgctataggtaggacagttgccggagacaggctgtggctgcagggcatcgatgtgcgggacgcccctttaaaggagatcaaagtgacctccagtagacgcttcattgcgtcttttaacgtcgtcaacacgactaagagagacgcaggtaagtacaggtgtatgataaggacggaaggcggagtgggcatctctaattacgctgaattggtcgtaaaggagcctccagtgcctatcgcaccacctcaattggcatccgtgggtgctacttatctctggattcaactgaatgccaacagcataaacggagacggccctattgtcgctagagaagtggagtattgcacagcctcaggatcctggaatgatagacagcccgtcgactcaacatcttacaagatcggccacctggaccccgacactgaatatgaaatctcagtcctgttgacaaggcccggtgagggcggaacagggagtccgggacctgcactgagaactaggactaagtgtgctgaccccatgaggggccctcggaaactcgaagtcgtagaggtgaaatccaggcaaatcaccatcagatgggagccattcggttataacgtcacgcgctgccacagctataatctgaccgtgcactactgctaccaggtgggtggtcaggaacaggttagagaggaagtttcatgggacacagaaaatagtcacccccagcacacaataaccaacctgagcccctatacgaatgtgtctgtgaaattaatcctgatgaaccccgaagggaggaaagaaagtcaagaactgatcgtgcagacagacgaagatctgccgggagccgttccaaccgagtctattcagggaagtaccttcgaggagaagatcttccttcagtggagagaacccacccagacgtacggggtgattaccctctatgaaataacctataaagccgtttccagttttgaccctgagattgacctgtcaaaccaatctggcagagttagcaaactaggcaacgagacacatttcttgttctttggtttatatccgggaactacctacagtttcaccattcgcgcatctaccgcgaagggcttcgggcctcccgctacaaatcagttcacgaccaagatttcagcaccgagcatgcccgcttatgaactggaaaccccactcaatcagacggataacaccgtgactgttatgctgaagccagcacatagtagaggcgcacccgtatccgtctatcaaatcgtcgtggaggaggaacgaccgagaagaactaaaaaaactaccgaaattctgaagtgctatccggtacctattcactttcaaaatgcatcacttttgaactctcagtactattttgcagcagagttcccagcagactcgttgcaggcggctcagcctttcacaatcggtgataacaaaacctacaatgggtactggaacaccccactactgccctataaaagttatagaatctacttccaagctgccagtcgggcaaatggagagaccaaaatcgactgcgtgcaggtggctacgaaaggcgcagcaacccctaaacctgtgcccgagccagagaagcagacagaccataccgtaaaaatagccggtgtgatcgctggcatacttttatttgtgattatctttctcggtgtcgtactagtaatgaagaaaagaaaactggcaaagaagcggaaagaaacgatgtccagcacaagacaggagatgactgtaatggtgaatagcatggacaaatcctacgccgaacagggaacgaactgcgacgaagccttttctttcatggatacccacaatctgaacggccgatcagtgagctcaccctcctctttcactatgaaaaccaataccctgagtacctcagtgcctaacagctactatcccgatcccttcgttcctacagccatcctagattttagtctgaacaacgagacccatactatggcctccgacaccagttccctggttcaatctcacacgtacaaaaaaagagaaccagcagacgttccatatcagactggccagctacatcccgctatccgggtggccgatcttttacagcatattacccagatgaagtgcgcagaagggtacgggttcaaggaggagtatgagagtttctttgaaggacagagcgccccttgggactcggcaaagaaggacgaaaacagaatgaaaaatcgatacggaaatattatcgcgtacgaccatagccgcgtgcgcctgcagacaatcgagggcgacactaactccgattacattaacgggaactacattgacggctaccaccgccctaaccattatattgctacgcaaggacccatgcaagagacaatctacgatttttggcgcatggtttggcatgagaatacagcatcaatcataatggttactaatcttgtggaggtgggtagagtgaaatgttgtaagtattggcctgatgacactgagatatataaagatattaaggtgacattgatagagacagagctgctggccgaatacgtcattagaacatttgcagtggaaaagcgaggtgtgcacgagatccgggaaatccggcagttccattttacaggctggccggaccatggcgtgccctaccacgccacgggactgctgggctttgtgagacaggttaaatccaaatctcctcctagtgctgggcctctcgtcgtccactgcagcgcaggggcaggcagaaccgggtgtttcattgtcattgacattatgttagacatggcagaaagggaaggcgtcgttgatatatacaattgtgtgcgggaactcaggagccggagagttaacatggtacagacggaggagcagtatgtcttcattcacgatgccatcctggaggcttgcctgtgtggagacacatcagtcccggcaagccaggtgcggagcctgtactacgacatgaataagctggacccccagacaaattcctcccagatcaaggaggaatttagaaccctgaatatggttacacctacccttagagtggaagactgttcaattgcgctactcccgaggaaccacgaaaagaaccggtgtatggatatccttccgccagacagatgcttgccctttctcatcaccattgacggagagtcgtccaattatattaatgccgctttgatggactcttacaagcaaccctccgccttcatcgtgactcagcacccactgcctaacaccgtgaaggacttctggagattggtgcttgattaccattgtacttccgtcgtcatgctcaacgatgtggaccctgctcagctgtgtcctcagtactggccagaaaatggtgtccacaggcatgggccaatccaagtagaatttgtctccgccgatctcgaagaggatattataagcagaattttcagaatttacaacgccgcaagaccgcaggacggctacagaatggttcaacaatttcagttcctggggtggcccatgtatagggacacccccgtgtcaaaacgatcattcctgaagctgatcagacaggtggacaaatggcaagaggaatacaacggcggtgaaggaaggacagtcgtccactgtctcaatggagggggacgctccggcaccttctgcgctatcagcattgtatgtgagatgcttcgacaccagcggaccgtggacgtctttcacgctgtgaaaaccctgcgcaataacaaaccgaatatggtcgatctcttggaccagtataaattctgttatgaggttgcactggaatatctcaactccgggtag

SEQ ID NO: 237157 - DNA, 3720 bp, Artificial Sequence
  Description of Artificial Sequence: Synthetic coding sequence
atgggcactctcagcttgcaccccggtatcgacgtgcgcgacgcccctctaaaggagatcaaagtgacatcctctcggagattcattgctagtttcaatgtagttaatactacaaagcgggatgcaggtaaataccggtgtatgatccggaccgagggcggagttggaatctccaactatgccgagctcgtcgttaaagagccgccagtcccaatcgcaccaccacaattggcctcagtgggggctacatacctttggatccagctaaacgcaaactcaattaacggcgacggtccaattgtagccagggaggtggagtactgcaccgcatcaggatcctggaatgataggcaaccagtggactctacctcttacaagattggtcatttagaccccgacaccgagtacgaaatctccgtcctactgactcgaccaggagaggggggaaccgggtcacccggtcccgcattgcggactaggaccaagtgcgcagatcccatgcgtgggcctagaaaacttgaggttgtcgaagtcaagtctcggcagattaccatccgctgggagccattcggatataacgtcacacgctgccacagctataacctgaccgtgcactactgctaccaggtgggaggccaggagcaagtgcgcgaagaagtaagttgggatacagagaactcccacccccagcacacaatcacaaatctgagtccatacacgaatgtgagcgtcaaactgatattgatgaaccccgaaggccgtaaagagtcacaggaacttatcgtgcagacagatgaagacttaccgggagcagttcccaccgaaagcattcagggatcgaccttcgaggagaagattttcctccaatggcgggagcccacacagacttacggcgtcatcactctgtacgaaattacctataaagctgttagtagcttcgatccagagattgacctgagcaatcagtccggacgggttagcaagttagggaacgagacccacttcctcttcttcggattgtatccaggaacaacgtattcttttaccatccgggcatcaaccgctaagggcttcggtcctcctgccaccaatcaatttaccactaaaatatctgccccatctatgcctgcatatgagctggagacacctctgaatcagaccgacaacacagttactgtcatgttaaaaccagcacactcccgcggagcccctgttagtgtgtatcagatcgtggttgaagaggagaggccacgccgtacaaaaaaaaccacagagatcttaaaatgttacccagttcccatccactttcaaaacgcttccttgctaaactcgcagtactatttcgccgctgaattccccgcagatagtcttcaggctgctcagcctttcacaataggtgataataagacctacaatggctattggaacacgcctctccttccttataagagttaccgtatttattttcaagctgcctcgagggccaatggtgaaacaaagatcgactgcgttcaggtggccactaagggcgcagcgacccctaagccagtgcccgaacccgagaagcagaccgatcatacagtgaagatcgccggagtgatagcaggcattctgttgttcgtaatcatctttctgggagttgtcctcgtgatgaagaaacggaagctcgcgaagaagcgcaaggagaccatgagcagtacccggcaggaaatgaccgtcatggtcaactcaatggacaaaagctacgccgaacaggggactaactgcgacgaggcattcagctttatggacacgcacaatctcaatggtcggagcgtttcttcaccaagctcattcaccatgaagactaacacactcagcacttccgtccccaatagttactacccagacgagacccacactatggcctctgacacttcatcactcgtacagtctcacacttataaaaagcgggagcctgccgatgtgccctaccaaacaggccagctgcatcctgcgatccgggtcgcggacttgctgcaacatatcacccagatgaaatgtgctgagggctatggatttaaagaagagtacgagtcatttttcgaagggcagagcgccccatgggactctgcaaagaaggatgagaaccgtatgaagaaccggtacgggaacataattgcatatgaccactccagagtccgcttgcagacaatagagggcgacaccaattccgactacattaatgggaactatatcgacggatatcaccgcccaaaccattatatcgcaactcagggacccatgcaagaaacaatttacgacttttggagaatggtatggcatgagaatactgcctccattattatggttacgaacctcgtagaggtgggtagggtcaagtgctgcaaatactggcccgacgatacggaaatttacaaagatattaaggtgaccctgatcgaaaccgagttactggccgaatacgtgattagaacattcgccgtggagaagagaggcgtgcacgagattagagaaatcaggcagttccattttaccggctggcccgatcatggagtgccctatcatgcgacagggcttttgggttttgtgcggcaagtaaaatcaaagtcccccccaagcgctggtcctctcgtggtgcattgcagcgctggcgcaggcaggacaggatgtttcatcgtcatcgacatcatgctggatatggctgagagagagggcgtcgtggacatctataattgcgtgcgggaacttcggtcccgaagggtgaacatggtccagacagaggaacagtatgtctttatccacgatgccattctcgaagcctgtctgtgcggtgacaccagtgttcctgcatcccaggtgaggtctctttactacgatatgaacaaactagatccacagacgaatagcagccagataaaggaagaattccgaaccctgaatatggtgaccccaactcttcgggtagaggactgtagtattgccctcctgcctaggaaccacgaaaaaaatagatgcatggatattttgcctccagaccggtgcctcccctttttaattacaatcgacggggagagttcgaactatatcaatgctgcgttaatggatagctacaaacagccgtccgctttcattgtcactcaacaccccctgcccaatactgtgaaagacttctggcgcttggtgctggattaccattgtacatctgtggtcatgttgaacgacgtggaccctgctcaactttgtcctcaatattggcctgagaacggcgtacacagacatgggccaattcaagttgagtttgtcagcgcggatctggaagaggacatcatctccagaatattcaggatttacaacgctgcacggcctcaggacggttacagaatggtgcagcaatttcagtttttgggctggcccatgtatcgagacacaccggttagtaaaagaagtttccttaaacttattagacaagttgacaaatggcaggaggagtacaacggcggtgagggtaggacggtcgtgcattgtctgaatggcggaggtcgatctggaactttctgtgctatctccatcgtatgcgagatgcttagacaccagcgcactgtcgacgtttttcacgccgtgaagacactgagaaacaacaaacctaatatggtcgacctcctcgatcaatacaagttctgttatgaggtagctctggagtatctgaactccgggtag

SEQ ID NO: 237158 - DNA, 2940 bp, Artificial Sequence
  Description of Artificial Sequence: Synthetic coding sequence
atgcgcaggcccaggcgcccagggggacttggcggatctggaggtctccgcttgctgttgtgtttgctgttactctcatccaggcccggaggctgcagcgctgtctcagctcatggttgtctgttcgataggagactttgcagccaccttgaggtgtgcatccaagatggactcttcggccagtgccaggtgggcgtgggccaggctagaccgctcttgcaggttacctcaccagttttgcagcgtctccagggagtactgcgacagttaatgagccagggactctcttggcatgacgatctgacgcagtatgtcatctcacaggaaatggaacggatccccaggctccgtccacccgaacctagaccaagagaccgatctggactggctccgaagagaccgggacctgcaggcgaactgctgctgcaggatatcccaacagggtccgctcccgcagctcaacataggctgccgcagcctccagttgggaagggcggagctggagcttctagtagcctttccccgctacaggcagagctgctgcctccactgcttgagcaccttttgcttcccccacagcctcctcacccttcactatcctatgagcctgctctgcttcagccatatttgttccaccagttcggcagcagggacggctcgagagtgtcagaagggagccccggaatggtgagcgtaggcccactccctaaagccgaagctcccgcactgttctctagaactgccagcaaaggaattttcggcgaccaccccggtcattcatatggggatttgcctgggccaagtcccgcacaacttttccaggattccgggttgctgtatctggctcaagaactgccagccccttccagagctagggtacctaggctgcccgagcaggggagctcgagccgcgcagaggattctcccgagggatacgaaaaggagggcctcggtgacaggggtgagaagccagcatctcctgcagtccagcctgacgctgctcttcagaggctcgcagcagtcctggcaggctatggtgtcgagctgagacagctgacccctgaacagctgagcacactgcttaccctccttcaactgctgcccaaaggagccggacgaaatcccggaggagtggtgaatgtaggagcagacattaagaagaccatggagggccctgtcgaaggtagggacactgctgagctccccgctcggacttcaccgatgcctgggcatccgactgctagccccacttccagcgaggtacagcaggtgccatccccagtgagcagcgagccccctaaggcagctagacctcctgtgacccccgtcctgctggagaagaaaagcccgctgggccagtcacagccgacagtcgccggacaacctagtgcccgacctgcggcagaagaatacgggtatattgtgacggatcagaaacccctttccttagcggctggcgtgaaacttttggaaatcttggctgagcacgtgcacatgtcttcgggctcctttattaacatctctgtggtgggcccagcacttacatttcgcatacgccataatgagcagaacctgtctctggctgatgtgacacaacaggccggacttgttaagtccgagctcgaggcacagaccggcctacagattttgcagaccggcgtgggacagagggaggaagccgctgcggttctgccacagaccgctcactcaacaagcccaatgcgaagcgtgctcttgaccctcgttgccctcgcaggggtcgccggattacttgtggctctggccgtggccctgtgtgtacgacagcacgcacggcagcaagataaggaacgcctcgccgctctagggcctgagggggcacatggagacactacctttgagtaccaggatctgtgccgccagcatatggcaactaaatccctgttcaatagagccgaaggaccaccagaaccttctcgagtgagcagtgtcagttcacagttctcagacgccgctcaggcatctccgtcctcgcactctagcaccccgagttggtgtgaggagcctgctcaggctaatatggatatatcaacagggcacatgatcctggcttatatggaagaccatctcaggaatcgagatcgtctggctaaagagtggcaggccctgtgcgcctatcaggccgagccgaatacgtgtgctacggctcagggggagggcaatattaagaagaatcggcaccccgactttctcccatatgatcatgctaggataaagctgaaggtagaaagctccccaagtcgtagcgattatatcaacgctagcccaatcatcgagcacgaccctagaatgcccgcttacatagccacccagggcccattatcgcacaccattgcggacttctggcagatggtgtgggagagcggttgtaccgtcatcgtgatgcttactccactggttgaggacggcgtgaagcagtgcgacaggtactggccagacgaaggagccagtctgtaccacgtttacgaagtgaacctggtgtcggaacatatttggtgcgaagattttctggtccgctccttctatctcaaaaacgtccagacccaggagactaggacacttacccagttccacttcctgagctggcctgcggagggaaccccagctagcacgcgtcctctactggatttccggaggaaggttaacaagtgctaccgaggacgttcttgccccataatcgtccattgttctgatggagcaggacggactggcacttacattcttatagatatggtcctaaacaggatggccaaaggcgtgaaggaaatcgatatcgcagctacgctcgagcacgtacgcgatcagagacccggattggtcaggtcaaaagatcaattcgagtttgccttgaccgcagtggccgaggaggtgaacgcaatactgaaggccctgccccagtag

SEQ ID NO: 237159 - DNA, 2853 bp, Artificial Sequence
  Description of Artificial Sequence: Synthetic coding sequence
atgcgaaggccccgtaggcctggcggtctcggtggatctgggggtctgagactcctgttatgtctgctcctcctgtccagccgtcctggcggttgttctgctgtgagcgcacatggatgcttgttcgacaggcgtttatgtagccacttggaagtgtgcatacaggatggcctgttcggtcagtgccaagtcggggtgggccaagcacggcctcttcttcaggtgacctcgcccgtgcttcaacgtctccaaggcgtgctacggcagttaatgtcacaggggctctcatggcatgacgatctgacacagtatgtcatcagccaggagatggaacgtattccaagactgcggccacctgaaccacgaccgagagacaggtcaggcctcgccccaaagagacccggaccagcaggagagctgctacttcaggacattccgactggctccgcccctgccgctcagcataggctgccgcaaccccctgtcggcaagggtggcgctggggcatcctcttctctgtcaccactgcaggctgaactactcccgccactactggaacacctgctgttaccaccacaacccccacaccccagtctctcatacgagcccgctctgctgcagccctacctatttcaccagttcggtagtagagatggcagccgtgtgtccgagggaagcccaggaatggtgagcgtcggacccctgccaaaagccgaggcccctgcactgttctcacggaccgcatccaagggtatcttcggggaccatcccggtcatagctacggcgatctcccgggacctagtccggctcagctatttcaagatagtggcctgctataccttgcccaggagctgcccgctccctcacgcgcacgggttccaaggctccccgagcagggctccagcagtcgcgctgaagacagccctgagggctacgaaaaggagggcttgggcgataggggtgagaaacctgccagtcccgctgttcagcctgacgcagcactgcagaggttagccgcagttctggcaggatacggcgtcgaattacggcagctcaccccagagcagttgtctaccctcctgaccctcctgcagttgctacctaaaggggctggcaggaatcccggtggcgtagttaacgttggcgcagacataaaaaagacgatggaagggcctgtggaaggccgtgacactgccgaattgccagcccgtacttcaccaatgccgggtcatccaacagcctcgcccacaagctctgaggtccagcaggtgccttcacccgtgtcctctgagccacctaaggccgctcgcccaccagtcactcctgtgctgctggaaaagaaaagtccactcggacagtctcagccgaccgtggccggacagccatcagctagaccagccgcagaagaatacggctacatcgtaaccgatcagaacgtggtgggtcccgctctgaccttcaggattcgacacaatgagcaaaacctgtccttggcggacgtcacccaacaggccggattagtcaagtcagagttggaagcccaaacagggctgcaaatcctgcagaccggcgtcgggcagcgggaagaagcggctgcagttctaccacagaccgctcactcgacgtcacctatgcggagcgtgcttttgaccctcgtcgctctcgccggtgtggccggattgctggtggccctggctgtggccctatgcgtccggcaacacgccagacagcaggacaaagagagactcgccgcacttggccctgagggtgctcacggggatacaacctttgaataccaagacctgtgccgccagcacatggcaaccaagtccctattcaacagagcagaagggcctcccgagccatctagagtatcctctgtgtcttcccagttctccgacgcagctcaggccagcccatcatctcactcttcaactccctcttggtgtgaagaacctgcccaagcaaacatggacatctctaccggacacatgattttagcttacatggaagaccacctacgcaaccgtgaccggctcgctaaagagtggcaggcactctgcgcgtatcaggcagagccgaatacctgtgccactgcacagggagaggggaacatcaaaaaaaatcgccacccagattttctcccttatgaccacgcacgaataaaactgaaggtagagagcagcccttctcggtcggattatatcaacgcatccccaatcatagagcatgaccccagaatgcctgcctatattgcaacgcagggtccgctgagccacaccatcgctgatttttggcagatggtctgggagagtgggtgcacggtgattgtgatgctgacccccctggtggaggatggcgtcaagcagtgcgatcggtattggcccgacgaaggcgcatctctgtaccacgtttacgaggtgaatctggtgtcggagcacatttggtgcgaagacttcctcgtacgcagcttttacctgaagaatgtgcaaactcaggaaacaaggaccctgacacaatttcacttccttagctggcctgcagagggtaccccggctagcactaggccactgcttgatttccgacgtaaagtcaacaagtgttatcgaggtagatcttgccccataatcgtccactgcagtgatggagctggaaggactgggacatacatccttatcgatatggtcctcaataggatggctaagggggtgaaggagattgatatcgcagccaccctggaacatgtgagggaccaacgacctggactcgtcaggtccaaggatcagttcgagttcgcgttgaccgccgtcgctgaggaggttaacgctatattgaaggctctgcctcagtag

SEQ ID NO: 237160 - DNA, 489 bp, Artificial Sequence
  Description of Artificial Sequence: Synthetic coding sequence
atgcggcgtcctcgcaggcccggagggttaggagggtctggcggacttaggttgctgctctgcctgctgctcttgagctctagaccaggtggctgtagtgcagtaagcgcacacgggtgcctgttcgaccgccgtctttgcagccacttagaggtctgcatacaggacggactcttcggacaatgccaagttggggtaggccaggcacgtccattactgcaggtcacatccccagttctgcaacgcctgcagggcgtactacgacagctgatgagtcagggactgagttggcacgacgacctgacccagtacgtgatttcccaggagatggaaagaatccctagactgaggcctcccgagcccagaccaagggataggtctggtctcgcacctaaacggcctggcccagccggtgaactgctgctccaggacatccccaccgggtcagcaccagctgcacaacttttgagcgtgccaagtgccggatag

SEQ ID NO: 237161 - DNA, 2670 bp, Artificial Sequence
  Description of Artificial Sequence: Synthetic coding sequence
atgagccaagggctctcctggcatgacgacctcactcaatatgttatcagccaggagatggagagaatccctaggctgcgcccacctgagccacggccacgcgaccgaagcgggttggccccaaagcggcctggacctgccggagaacttctcctccaggacattcccactggtagcgcacctgcggctcagcatcggctgccgcagccccctgttggcaaagggggtgcaggagcatcctccagtctctctccgctgcaggcagaactgctcccgccactccttgaacatctcctgctgccacctcagccaccccatcccagtctgtcatatgagcccgctctcctgcagccatatctgttccaccagttcggcagccgtgatggctcacgtgtaagcgagggcagtcctggaatggtgtccgtgggacctctgcctaaggccgaggccccagcactgttttccagaactgcatcgaaaggcatatttggcgatcatccaggccatagctacggggatctgccaggcccttccccagcccagttatttcaggacagcgggcttttatatcttgcgcaggagttgccagcaccctcacgagctagagtgccacggctgccagaacagggctctagtagccgggcagaggactccccagaggggtacgagaaagagggattaggagatcgaggggagaaaccggcttctcctgctgtccaaccagacgctgccttgcagcggctcgcagccgttttggctgggtatggggttgaactgaggcagcttacacctgaacagctgtctacgctgctgacactactgcaattgctgccaaaaggggcaggcaggaatcctggcggagtcgtcaacgtgggcgcagatattaaaaagacaatggaagggccagtggaaggaagggacacagcagagctccccgcacgcacgagtcctatgccgggacaccccactgccagtcctaccagcagcgaggtacagcaggtgccttcccctgtgagttctgagcccccaaaagcggcacgccctcctgtgacaccggttcttctggaaaagaaaagtcctctaggtcaaagccaacccacagttgccggtcaacctagcgcacgacccgcagccgaagaatacggctacatcgtaaccgatcagaagccgttaagcttagcggctggcgtcaaattgctggagattttggcagaacacgttcacatgagttccgggtcttttattaacataagcgtggtgggccctgcccttacatttcgaatcaggcacaacgagcagaacctaagcctcgctgacgtgacacagcaggcgggactggtgaaaagtgagctcgaggctcaaacgggattgcagatcctgcaaaccggcgtaggccagcgggaggaggccgctgctgtcctgccccaaacggcacactctacaagtccaatgcgctccgtgcttctcactctggtcgcactggcgggtgtggccggactcctggtggctttggccgtggccttgtgcgtccgtcagcacgctcgacaacaggataaggagaggttggctgccctgggacctgagggcgctcatggagataccacttttgaataccaagatctatgccggcagcatatggccactaagtcactctttaatagggccgaggggcctccagagccttcaagagtgtcaagcgttagctcacaatttagtgatgcagcccaggcatccccatcaagccattcctctactccatcttggtgtgaggagcccgctcaggcaaacatggatattagcactggacatatgatattggcatatatggaagatcatttacgcaatagggacagactagctaaggagtggcaggcgctgtgcgcttaccaggcagaacctaacacctgcgccacagcccagggtgagggcaatattaagaagaacaggcatcctgatttcctgccctatgatcatgcgagaatcaagctcaaggttgaaagtagccctagcagatctgactatatcaatgcttccccaattattgagcatgacccacggatgccagcatatattgccacccagggcccacttagccatactattgccgatttctggcagatggtctgggaatcaggctgcaccgtaatagtgatgttgacacccttggtggaagacggtgtaaagcaatgcgaccggtactggcctgatgagggggcttcactctaccacgtttacgaggtgaacctggttagcgaacatatctggtgtgaagactttctcgtgaggtctttctacctcaagaacgttcagactcaggagacccgaactttgactcagttccacttcctgtcctggccagccgagggtacccccgcatccaccaggccgttacttgatttccggcgaaaggtcaacaagtgttaccggggaaggtcttgtccgattattgtccactgcagtgacggggctggcagaaccgggacctacattctgatcgacatggtgctcaatcggatggctaagggggtcaaagaaatcgatattgccgcaacccttgagcatgtcagagatcaacgcccaggactggtgcgctcgaaagaccagtttgagttcgccttgaccgctgtcgccgaagaggtcaatgctatactgaaggccctccctcaatag

SEQ ID NO: 237162 - DNA, 2853 bp, Artificial Sequence
  Description of Artificial Sequence: Synthetic coding sequence
atgagaaggccacgtcgccctggtggcctgggtggttctggaggactgagactactgctgtgtctattgctgctgagctccaggccaggaggctgttctgctgtttccgctcacggttgtctttttgacaggcgtctgtgtagccatctagaggtttgcattcaagacggcctcttcggacagtgtcaggtgggcgtgggccaggccagaccactgctacaagttacaagccctgtgctgcagaggctgcaaggcgtgctccgtcagctcatgagtcagggcctgagctggcacgatgatcttacccagtacgtgatttctcaggagatggagaggatcccgaggctgaggcctcccgagcctagacccagagacaggtctggattagcccctaagagaccaggcccagcaggtgaactgctgctgcaggacatccccaccggatctgccccagccgcacagcaccggttgccacaacctccggtcgggaaaggcggagctggtgcctcgagctccctctcccccctgcaggccgaactgctgccacccctgctggagcacctactgttgcctccccagcctccccacccgagcctttcttatgaacccgctcttcttcaaccctatcttttccatcagtttggcagccgggatggaagtagagtgtccgaaggcagccccggaatggtaagcgtgggacctctgccgaaagctgaagcacccgcactgttctcgagaacggcttccaaagggattttcggagaccacccaggccactcctatggggatctgccaggcccttccccagctcagttatttcaggacagcgggctgctgtacctggcccaggaattgcctgccccatcccgcgcacgggtccctagactaccagagcagggcagttctagcagggcagaggactctccggaaggctatgagaaggaagggctaggggaccgcggagaaaagccggctagcccggcagtccagccagacgcggctctgcagaggttagccgcagttttggcagggtatggcgtggaactccgacagctgacaccagagcagcttagcacgctactcacactcctgcagctgttgccaaaaggcgcaggtcgaaatcctggtggggtggttaacgtgggagcagatatcaaaaagacaatggaaggacccgtggaggggagagacaccgcagaacttccagctagaactagtccgatgccaggccatccaactgctagccccacgtcatccgaggtacagcaagtcccttctccagtgagctccgagccaccgaaagccgcacggcctccagtgactccagttctgctcgagaagaaatctccgctgggacagtcacagcctaccgtggccggacagccgtctgcacgccctgccgctgaggaatatggctacatcgtgaccgatcagaatgtggttgggcctgccctgacttttcgtatccgtcataatgaacagaatctatctctggctgatgtcacccagcaggcgggactggtgaaatccgagttagaggcacagacaggactgcagatactgcaaaccggtgttgggcaacgcgaagaggccgcagccgtgctgcctcagaccgcccatagtacttcccctatgagatccgtgttgctgacccttgtcgcccttgccggtgttgcagggctgttagtggcattagccgtcgccttgtgcgtaagacagcacgccaggcaacaagataaggagcgtctggccgctctgggtccagaaggagctcatggcgataccacattcgagtaccaagacctttgccgccagcacatggccaccaaatccctgttcaatagggctgagggcccacctgagccttctcgggttagctctgtctcatcccaattctcagacgccgcacaagctagtccctcttcacatagctccaccccgtcctggtgtgaggagcccgcacaagctaacatggatatatccacgggccacatgatactagcctacatggaggaccacttgcggaatcgagaccggttggcgaaggaatggcaagccctttgtgcttatcaagccgaacctaacacttgtgcaactgcacagggcgagggaaacattaagaaaaacaggcaccccgacttcctgccttacgaccacgcccgaattaaacttaaggtcgaaagtagtccctcccgcagcgactatatcaacgcatcccctataatcgagcatgacccaaggatgcctgcctatattgcaacccagggcccactcagccatacaattgccgatttttggcagatggtctgggaaagtggttgcacagtcatagtgatgttgactccacttgtagaggatggcgtgaagcagtgcgaccggtattggcccgatgagggcgcttctttataccatgtgtatgaagtgaacctcgtctctgagcacatctggtgcgaagactttctcgtacgctcattctatctgaaaaacgtccagactcaagaaacccgcaccctcactcagttccacttcttgtcgtggccagccgaaggcacaccagcatctactaggccactgctcgacttcagacgcaaggtcaacaaatgctataggggccgttcctgtcctattatcgttcactgttctgacggggcagggagaactggcacctacattcttatcgatatggtgctgaaccggatggctaagggggttaaagagatcgacatcgcagctacactggaacacgttcgagatcagcggcctgggctcgtgaggtcaaaggaccaattcgaatttgcgcttacagcagtggcagaggaagtgaatgccattctgaaggccctccctcaatag

SEQ ID NO: 237163 - DNA, 2961 bp, Artificial Sequence
  Description of Artificial Sequence: Synthetic coding sequence
atgggcccacccctgcccctgttgctgctgctgctgctgctcctgcctccaagagtcctgccggctgctcccagctcagtgcccagggggaggcaactccccggaaggttgggatgtctgcttgaagaagggctgtgtggagcttcagaggcctgcgtgaacgacggcgtgtttggcagatgccagaaggtgccagctatggacttttacaggtacgaagtatctcctgtcgcgctacagaggctccgagtggctcttcagaaactatcaggcacaggatttacatggcaggatgattacactcaatatgtgatggatcaggaactcgcagacctgccgaaaacctatcttagaagacctgaagcctcctccccggctagacctagtaaacactcagttggaagtgaacgacgctatagcagggaaggaggggctgcgctcgctaatgccttgcggcgacatctgccctttctggaagccctgagtcaagcaccagcctcggatgtgcttgcccgaacccatactgcccaggatcgaccaccagctgagggtgacgatcggttcagtgagagcatcttaacctacgtagcccacacctcagccctgacctacccgccaggcagtcgcacacagcttagggaagacctgcttccacgaaccctcgggcagttacagccggacgagctgtctccaaaagtggactcaggggtggaccgccaccatctaatggctgctctgtcggcatatgctgctcagagaccgccagcccctccgggtgaaggatccctagagcctcagtacctcctgagagccccttcccgcatgcccaggcccctattggcgccagcggcaccccagaagtggccttctcccctgggggattcagaggaccccagtagcacaggggacggtgctagaattcacaccctgctgaaagatcttcagaggcagcctgctgaagttagagggctctctggactcgagctggacgggatggcagagttgatggcaggattgatgcagggtgtggaccacggcgtggcaagagggagtccgggacgagcagccctcggggaatcaggggagcaggccgatggccctaaagctactctccggggtgattctttccccgatgacggggttcaggatgatgacgaccgactttaccaggaagtgcataggctctcagcaacactgggcggactactacaggaccatggttctcggctactccctggggctctacctttcgcacgccctctggacatggaacgaaagaagagtgagcaccctgaatctagcctgtcatcagaggaagagaccgctggggtcgagaacgtgaagagccaaacatactcaaaggaccttttgggccagcaaccgcattcagagccgggtgcggctgccttcggtgagcttcagaatcagatgcctgggccaagcaaggaagagcaatctttgcctgcaggagcccaggaagccctgagcgatggtttgcagttggaggtgcagccgtcagaggaagaagcccgagggtacatcgtcaccgatcgtgaggtcctaggccctgccgtgacattcaaagtctctgcaaatgtccagaatgtcaccaccgaggacgtcgaaaaagccactgtggataataaagataagctggaagagacctccgggctgaaaattctgcaaacaggggtaggttctaaatccaaactcaagtttctgcccccacaggcagagcaagaagattctaccaagttcatagcactgaccctggtgtccctggcttgcattttaggcgtgctcctggcatccggtctgatttattgtctaaggcattcttcacaacaccggttgaaggagaaactgtcaggtttggggggtgatcccggtgctgacgcaacggccgcttaccaggagctatgcagacagagaatggcgaccaggccaccagaccgtccagagggccctcatacctcccgaatcagctccgtgtcctcgcaattctccgacgggccaatcccaagcccctccgcacgaagcagtgccagtagctggtctgaagagcccgttcaaagcaatatggacattagcaccggacacatgatcctctcctacatggaagaccacctcaagaacaaaaacagactggagaaggagtgggaggctctgtgtgcatatcaggctgagccgaactccagcttcgtggctcagcgcgaagagaacgtaccaaaaaatcggtcacttgcagttctgacctatgaccacagtcgcgttctcctcaaggccgagaattcacattcacattcagattacatcaacgcctcccctatcatggaccatgaccctcgtaatcccgcttacatcgctactcagggcccactcccagcaacagtcgctgatttttggcagatggtttgggagagcggctgcgtggtgatcgtgatgctcacccccctcgcagaaaacggggttcgccagtgctatcattactggcccgatgaaggtagtaatctgtaccacatttacgaagtgaacttagtgagtgaacacatctggtgcgaggacttcctggtgcgcagcttctacctgaagaatctacagacaaacgagactcggaccgtgacccaatttcacttcctttcctggtacgacaggggggttccttcctccagtaggtctctgctagattttcggagaaaggtgaacaaatgttacagagggcgatcatgccccataatcgtgcattgtagtgatggtgccggaagaagtgggacttatgtactgatagacatggtgctgaataaaatggctaaaggggctaaagaaatcgatatcgccgcaactctcgagcatctcagggatcagcgcccaggaatggtgcagacgaaagagcagttcgaattcgcccttactgctgtggctgaggaggttaatgctatcttaaaagcactgccacagtag

SEQ ID NO: 237164 - DNA, 2997 bp, Artificial Sequence
  Description of Artificial Sequence: Synthetic coding sequence
atgggtcctcctctccccctactcctgctgctcctgcttctgctaccaccgagagtgttgcctgccgcacccagcagcgttcctcgcggtaggcagctgccaggtagactggacggggttttcggcaggtgccagaaggtcccagctatggacttttatagatacgaggtgtccccagtcgccctgcagagattgcgggtggctctccagaaactgagcggcaccggcttcacttggcaggatgattacactcaatacgtcatggaccaggaactggccgacttgcctaaaacgtacctgagacgccctgaggcctcttccccggctaggccatcaaagcactcggtggggtctgaaaggcgatatagccgtgagggaggagctgccctggcaaatgctctcagacggcatcttcccttcctagaggccctttctcaggccccagccagtgatgttctcgcaagaacgcacacggcacaagatcggcctcctgcggaaggagacgatcggttctctgagtccattttaacctatgtggctcacaccagtgccttgacctatcctccagggtcccggacccagttacgagaggacctactaccgaggaccctgggccagctacagccagatgaactgagcccgaaggttgattccggcgtcgataggcaccacctgatggccgcactcagcgcctatgcggctcaaagaccacctgcgcctcccggagaaggcagtcttgagccccagtatctgctcagagcccctagcaggatgcctcggcctctcctggccccagccgcaccccaaaaatggccttcacctctaggtgacagcgaggatcccagttccacgggggatggggctcgtatccatacacttctaaaagatcttcagcgacaacctgcagaagtgagaggcctgagcggtctcgaactagatggaatggcagagctcatggctggattaatgcagggagttgatcacggcgtggccagaggttctccaggccgagctgccctaggggagagcggggaacaagcagatggccctaaagcaactctgagaggcgatagcttccctgatgacggagtgcaggacgatgatgatagactgtatcaggaggtgcataggctgagcgcgaccctgggtggtttgctccaggaccacggatccaggctactcccgggtgcgctcccgtttgccaggcctctcgatatggagaggaaaaagagtgagcacccagagtcaagtctaagcagcgaggaagaaactgccggtgtagaaaacgtaaaatcccagacttactcaaaggacctgctcggtcagcagccacactcagagccaggggctgccgcattcggtgagctacaaaatcagatgccgggaccctcaaaggaagagcaaagcctccctgctggagcgcaggaggctttatctgacggattgcagcttgaagtgcagccttccgaagaagaggcacgcggttatattgtcacggaccgagaccccctccggcctgaggagggacgtaggcttgtcgaagacgtggcgagactcctgcaagtcccgtctagcgcatttgcagatgtagaggtcttaggccctgccgtgacctttaaagtatccgctaatgtccagaatgtgacaacagaggacgttgagaaggccaccgtcgataacaaagacaaactggaagaaaccagcgggttgaaaatcttgcagacaggcgtggggagcaagagtaaattgaagttcctccctccccaagctgagcaagaggacagcaccaagttcattgcgcttaccctggtcagtctggcatgtatcttgggcgtcctgttagcctccggactgatctactgcctccgtcacagctcccagcataggctgaaagaaaaactttccggacttggaggggaccctggcgcagacgcgaccgcagcttaccaggaactgtgtcgtcagaggatggcaacgagacctcctgacaggcctgaagggccacatacatccaggatttcctcagtttcgtcgcagttctctgacggcccaatccccagcccctccgctcggagttcagcctcttcctggtccgaggagcccgtacagagcaacatggacatttccactggtcacatgattctatcttacatggaggatcacctcaaaaataagaacagactggaaaaggaatgggaggccttgtgcgcctatcaggctgagccgaacagttcctttgtggcccagcgggaagagaatgtacccaaaaatagaagcctggcagtgttgacttacgatcacagcagggtgttactgaaggccgagaacagccacagtcattctgactatattaatgcatcacccatcatggaccacgatccaaggaacccagcctatatagcaactcaggggcctctgcccgcaactgtggcggacttttggcagatggtatgggagtcaggttgcgtggtcattgtgatgcttaccccgctagcagaaaatggtgtccgccagtgctaccactactggcctgacgagggcagcaacctgtatcatatttatgaggtgaacctggtctccgagcacatttggtgcgaggattttctggtgcgctctttctatctcaagaacctccagaccaacgagacgcgaaccgtgactcagtttcattttctcagctggtatgatagaggagtgcccagcagtagcagaagcctgctcgatttcaggcgcaaggtgaacaagtgttatagaggtcgcagttgccctatcatagtccactgttcggatggcgcaggccgatccggcacctacgtgctcatagatatggtcctgaacaaaatggccaagggggctaaagaaatcgatatcgccgcaacactcgagcatctcagggaccagcgcccaggcatggtccagaccaaggaacagtttgagttcgcccttaccgccgttgcagaggaggtgaacgcaatcctgaaagctctgccacagtag

SEQ ID NO: 237165 - DNA, 3048 bp, Artificial Sequence
  Description of Artificial Sequence: Synthetic coding sequence
atgggcccacccctacctctcttgttactcctgctgcttcttctgccaccccgagtcctgcccgcagctccttcttctgtgcccagggggcgacagttacctggacgcctcgggtgcctcctggaggagggtctttgtggagcctctgaggcctgcgtcaatgatggcgtgtttgggaggtgccagaaagtacccgcaatggatttctatagatatgaggtctcccccgtggcgctgcagaggcttagagtggcattgcagaagctttctggcaccggcttcacctggcaggacgattacacacagtacgtcatggaccaagagctggccgacctacccaagacatacttaaggaggccagaggcatccagtccagctagaccgtctaagcattccgtcggttcagaacgccgatatagccgggagggaggtgccgctttggccaacgcccttcgacgccatttgccctttctggaagctctgagccaggcaccagcttcagatgtgttggccagaactcataccgcacaggataggcctccagcagaaggggacgaccgtttcagtgaaagcatccttacatacgttgcacacacctccgccctgacttatcctccaggcagccgcacacaattgcgcgaagatctgctaccccgtacattgggccagttgcagcccgacgagttgagccccaaagtcgactcaggcgtcgacaggcatcaccttatggccgcactttccgcctacgcagcgcagcgcccacccgcaccgcctggggagggatccctagaaccccaataccttttgcgggcacctagtcggatgccccgaccacttctggctcctgctgcacctcagaaatggccctcacctcttggcgactctgaggatcccagctcgactggtgatggggctagaattcacactctactgaaggacctacagagacagccagccgaagttcgcggtttaagcgggctggaacttgatgggatggcagagctgatggccggactcatgcaaggagtagatcacggtgtggctcggggatcccctgggagggccgctctcggggagtccggcgagcaggccgacggacccaaagctaccctgcgcggagactccttccccgatgacggagttcaagacgatgacgaccgcctgtatcaggaagtgcaccggctttcagcaaccctgggagggcttctccaggaccacggttcaagactgttacccggagctctgcctttcgcacggcctcttgatatggaaaggaagaaatcagaacaccctgaaagctccctgtctagtgaggaagagaccgctggagtggaaaacgtcaaaagccagacttactcaaaggacctgttgggtcagcagcctcacagcgaaccaggagcagccgcttttggcgagcttcagaaccagatgcctggaccttctaaggaagaacagagccttcccgctggggcacaagaggctctgtccgacggcttacaattggaggtgcagccgagcgaggaggaggcccgaggatacatcgtgaccgatagggacccactcaggcccgaggaggggcgaaggcttgtggaggatgtggcacggctattgcaggtgccctcttcagccttcgccgacgttgaggtcctgggcccagcagtaacattcaaggtgtccgcgaacgtgcagaacgtcacgaccgaagatgtggagaaggccactgtggacaataaagacaagctggaggaaacatcaggtcttaaaatcctgcagacaggggtgggcagtaagtctaaacttaaatttctgcctcctcaagcggaacaagaggactccacaaaatttattgctctgactttggtatcactcgcgtgcatcctgggcgtccttctggcatctggtttgatttactgtcttcgtcatagctcgcagcatcggctcaaagagaaacttagtgggctggggggtgatcccggagcggacgccacggcggcttaccaagagttgtgtaggcagcggatggcaacccgcccacctgaccgtcccgagggccctcatacctctcgtatatccagtgttagcagtcagttctctgatggaccaataccttcaccatcagcgagatcatcggcttcaagctggtctgaggaacctgtgcagtcaaacatggatatcagtacaggacatatgatcctgagctacatggaggaccacttaaaaaataaaaatagactggagaaggagtgggaagccctctgcgcctaccaggctgagcctaacagctcctttgtggctcagcgtgaggaaaacgtccccaagaataggtctctcgcagtcctcacctacgatcactcacgtgtactcctgaaggccgagaactctcacagccatagtgattacatcaacgctagccctatcatggaccatgatccaaggaatcctgcctacattgccacccaaggtcctcttcccgctaccgtcgcggacttctggcaaatggtatgggagagcggatgcgtcgtaatcgtaatgctgactcctttggccgaaaatggggttagacagtgctatcattactggcccgatgaaggttctaacctctaccacatctatgaagtgaatctggtgtctgagcacatttggtgcgaggattttttagtgcggtctttttacctgaagaacctgcaaaccaatgaaactcgtacagtgacacagttccatttcctgtcatggtatgatcgtggcgtccctagcagcagtcgatccttgttggactttcggcgaaaggtaaacaaatgctaccgtgggagatcttgtcccattattgttcattgttctgacggcgcagggaggtccggcacctatgtactgatcgacatggtgcttaataagatggctaagggggctaaagaaattgatatcgcagcaacccttgaacatttgagggatcagcggcctggcatggttcagacgaaggaacagttcgaatttgctctgacggcagtggcagaagaggtaaatgctatcctcaaggccctgcctcaatag

SEQ ID NO: 237166 - DNA, 3117 bp, Artificial Sequence
  Description of Artificial Sequence: Synthetic coding sequence
atggctgtcgagtccgagtactcccttctgaggaccgaagcctcctttccgaccatgaaaatgttctgtgtgtcccacacactgccacgagttgaagtaatgtttgtgagcggaccacagacccgcgaacggaccgaacctgttgatccacgttggcagtgtttagtccagatgtgggcaggctgcctattggaggagggcctctgcggagcctcagaagcatgtgttaatgatggagttttcggcaggtgtcaaaaagtgcctgccatggatttctaccggtatgaggtatcacctgttgctctgcagcgtctgcgggtcgccctccagaaactgtcaggcactggattcacctggcaagatgattacacccagtatgtgatggaccaggagctggccgacctcccaaaaacgtatctccgcagaccagaagccagtagcccagcacgcccatccaaacactctgtcggctcagaaaggaggtacagtcgagagggcggagccgctctcgccaatgcacttcggcgacacctgccatttctggaagctctaagtcaagctcctgcctctgatgtgctggccagaacgcataccgcacaggaccggcctccagccgagggtgacgacaggttttccgagagtatccttacttacgtcgcccacacgtctgctcttacatatccacccggaagccggacacagctgcgggaagatctgctaccaagaacactgggtcaactccaacctgatgagctgtcgcctaaagtcgactccggagtggatcgtcaccacctgatggctgcactgtctgcatatgctgctcaacgcccaccagccccacctggcgaggggagcctggaaccgcagtacttgcttagagccccatcaaggatgccacgccctctgttggcaccagccgcaccacagaagtggccatcgccacttggagacagcgaagacccctcttctacaggagatggcgcacgaatacatacgctcctgaaggacctacagaggcaaccagctgaggtgagaggtttatcagggctggagcttgatggcatggcggagttgatggcagggctgatgcagggcgtggatcatggcgttgccagaggttcaccgggaagagccgcactgggggaaagtggggagcaggccgatggccctaaagctacccttcgcggtgactcatttccagatgatggggtgcaggatgacgacgaccgactctaccaggaagtccatcgcctgagtgctaccctcggtgggttgctgcaggatcatgggtcaaggttgctacccggtgccctaccttttgctaggcctctggacatggagcgcaaaaagtctgagcatcctgagtcctcattgagtagcgaggaggagacagcaggtgtcgaaaacgttaagagccagacgtatagcaaagacctgctgggtcagcaaccccatagtgagcctggtgctgccgcttttggagaacttcagaatcagatgccaggcccatcaaaggaggagcaaagcctgcccgctggagcgcaggaagcactaagtgacgggttgcagctggaagtgcagccgtcagaggaggaagccagagggtatatcgtgactgaccgggatccattgcgtcccgaagaaggtcggaggctggtggaagatgtggcaaggttgctccaagtgccctcatcagctttcgccgacgtggaagtgcttggaccggcagtaacatttaaggtgagcgctaacgtgcaaaacgtaacaaccgaggacgtggaaaaggcgacggtggacaacaaagacaaacttgaggaaacatctggcttgaagatacttcagactggcgtgggttctaaatcaaagctgaagtttctcccacctcaggcggagcaggaagactctaccaaatttatcgcgttaaccctggtgtccttggcatgcattctgggggtgctgctggccagtgggttaatatactgcttgcggcactcatctcagcaccgcctcaaggagaaactgtccggactaggcggagatcctggcgcagacgccactgccgcttaccaggaactgtgtcggcaaagaatggctacccgccctcccgatcgacccgagggtccacacacttccaggatttcttccgtgtcgtctcagttctcagacggccctatcccatccccaagcgccaggagctccgcctcctcctggagtgaggagcctgtccaaagcaatatggatataagcactggtcacatgatcctctcctacatggaggatcaccttaaaaataaaaacagacttgaaaaagaatgggaagcattgtgcgcataccaggctgagcctaactctagcttcgtggcccagagggaagagaacgtgccaaagaatcgctctctcgcagtactgacctacgatcatagcagagttttactgaaggctgaaaacagccattcgcactccgactacatcaacgcctcacccattatggatcatgaccctcgtaaccccgcatacattgctacccagggacccctgcccgcaactgtggcagatttctggcagatggtgtgggagagcggatgtgtggtcatcgtgatgttaacaccccttgccgaaaatggtgtgcgccaatgctaccattactggcctgatgagggatcgaacctgtaccacatttatgaggtgaacctcgtgtctgaacacatctggtgcgaggacttcctggtgcggtccttttatttgaaaaatctccagactaatgagacacggactgtgacgcaattccattttctgtcctggtatgatagaggcgtgccaagcagcagtaggagtttgttggatttcaggcgcaaggtaaacaagtgctacaggggcaggtcctgtcccattatcgtacattgttcagatggggcaggcaggagcggaacatacgtgttaatagacatggtccttaataagatggcaaaaggggctaaagaaatcgatatcgctgcaaccctcgaacacctgcgagaccagaggcctggtatggtgcagaccaaggaacagttcgagttcgccctcacggccgtcgccgaggaagtgaacgctattctgaaggctctgcctcaatag

SEQ ID NO: 237167 - DNA, 2934 bp, Artificial Sequence
  Description of Artificial Sequence: Synthetic coding sequence
atgggacctccgctgccgctgctgttgctactgctcctgctgttgccgcctagagtccttcctgctgctccaagctccgtaccgaggggcagacagttgcccggaagactcggatgcctccttgaggagggactgtgtggtgccagtgaagcctgcgtcaatggattcacctggcaggacgactacacccagtatgttatggatcaggagctggccgatctacctaaaacctatctccgcaggcccgaagcaagctcaccggctaggccttcgaagcactccgtcggctctgagcggagatattcgcgagaaggcggtgcggcattggctaatgctcttaggagacatttgccattccttgaggccctttcccaagcccctgcctccgatgttctagctcggacccatacagcccaagaccgtccacccgctgagggtgacgataggttttctgagtcgatcctgacgtacgtcgcgcataccagcgctttgacatatcctcccggaagccgcacacaactccgggaggatttgctcccgaggaccctcgggcagctccagcctgatgaactgtctcctaaggtagactccggtgtcgatcgtcaccatctcatggcggctctgagcgcatacgcggctcagcgtcctcccgcaccacctggggaggggtctctggagccacaatacctactgagggcgccttcacgtatgcctagaccacttctggcacccgcagctccacagaagtggccgtctcctctgggcgatagtgaggatccctcctcgacaggcgacggagcacgaatccacaccctgctcaaggatttgcagaggcagccagccgaggtacggggtctcagcggcctggagctggacggcatggccgagctgatggctggccttatgcaaggcgtggatcatggtgtggctcggggtagcccaggtcgcgctgccctgggcgagtccggagaacaggccgatggtccaaaggccacactgcggggagattcgtttccagacgacggtgttcaggatgacgacgataggctataccaagaggttcataggctaagtgccactctcggaggcctgttacaggaccatgggagcaggctgctacccggagccctgccattcgccagaccactcgatatggaaagaaaaaagtccgagcatccagaatcttccctatcttcggaggaggaaacggcaggtgtggagaatgtgaagtcacagacctactccaaggatttgctgggacagcagccacactctgaacctggtgcagccgcttttggcgagctgcagaaccaaatgccgggaccctcaaaggaagaacaaagtctaccagccggagcgcaggaggccctgagtgacggacttcaactggaggtgcagccctccgaggaagaggcaaggggctacatcgtcacggatcgggatccattgcgacctgaggaagggcgaaggctagtagaggacgtcgcacgcctgcttcaagttccttcctctgcgtttgccgatgtggaggtcttggggcctgcagtgacgtttaaggtgagtgctaatgtgcagaacgtcaccacagaggatgtggagaaggccaccgtagacaacaaagataagctcgaagaaaccagcgggctgaagattctgcagaccggagtgggcagtaaaagtaaactcaagttcttaccacctcaggctgagcaggaggacagcaccaagttcattgcccttacattagtgtcgttggcttgcatacttggagttcttcttgccagcggactgatttactgtctgaggcatagtagccagcatcgactgaaggaaaaactctctggcttaggaggagatcccggagctgatgcaaccgctgcctaccaggagctttgtcgacagcgcatggcaactaggccaccggatcgccctgaaggcccacatacttcaaggatttcttccgtgtctagtcagttctctgacggacccatcccctccccgtccgccagaagcagcgccagttcatggtccgaggaacctgttcagtcaaatatggacatctcgaccggacacatgattctgtcttacatggaagatcacctgaaaaataaaaaccggctggagaaggaatgggaggctctgtgtgcatatcaagcagagccaaattccagctttgtagcccaacgcgaagaaaatgtgcccaagaacaggtccctggctgtgctgacctacgatcacagcagggtccttctgaaggcagaaaactcccatagtcatagcgactatattaatgcttcaccaatcatggaccatgatcccagaaacccagcttacatagcaacacagggcccactacccgcaacagtggctgatttctggcagatggtttgggaatcagggtgcgtcgttattgtcatgctaacaccgctagccgagaatggtgtgcgtcagtgctaccattattggcccgatgagggaagtaacctatatcacatatacgaggtgaaccttgtctcagagcatatctggtgtgaggattttctggtgagatccttctatctgaaaaacttacaaactaacgaaacccgcactgtgactcagtttcattttcttagttggtatgatcgaggcgtcccttcttcctcccggagtctgctggacttcagacgaaaggtcaacaaatgttatcgcggtcggagctgtcctatcatcgtccactgtagtgatggggctggccgttccggcacctatgtgttgattgacatggtcctgaataaaatggccaagggtgcgaaggagatcgacatcgctgctaccctggagcacctgcgagatcagcgtcctggaatggtccaaactaaagagcagtttgaatttgctctgactgctgtggccgaggaggttaatgccatactgaaagcgctgccccagtag

SEQ ID NO: 237168 - DNA, 3651 bp, Artificial Sequence
  Description of Artificial Sequence: Synthetic coding sequence
atggggcatctcccaaccggcattcacggagcccgaagactgctgcctctcctgtggctcttcgtgttgtttaagaacgcaaccgcatttcacgtgacagtgcaggatgacaacaacattgttgtctccctcgaagcttcagacgttatttcacctgccagtgtctacgtggtgaagatcactggcgagtctaaaaactacttctttgaatttgaggagttcaattcaacattaccaccaccagtgatcttcaaggcgtcgtatcatgggctgtattatatcattacactggtggtggttaatggcaatgtggtcacaaagccttcccgctctataacagtgttgactaagccccttcccgtgacgtccgtgagcatctatgactacaagccctcaccagaaaccggcgtcctgttcgaaatccactaccccgagaaatacaatgtgtttactcgtgtaaacattagttattgggaaggtaaggatttccggactatgctgtacaaggacttttttaaaggtaagaccgtctttaaccactggcttcctgggatgtgctactcgaacataacctttcaacttgtctctgaagccacattcaataagtcaactctcgttgagtactcaggggtgagccacgaacccaagcaacatcgaacagcaccctatcctccccagaacattagcgtgagaattgtcaacctaaataagaacaactgggaggagcagagcggcaattttcccgaggagtctttcatgcggtcccaggatactattggaaaggaaaagctgttccacttcaccgaggaaactcccgaaattccctctggaaatatctccagcgggtggcctgactttaatagtagcgattacgaaaccacgagtcagccctattggtgggactccgcttcggccgctccagagtcggaagatgaatttgtgagcgttttgccaatggagtacgagaacaactctacactgtcggagaccgagaaatctaccagcggcagcttcagcttctttcccgttcagatgatcctcacatggctgccgcctaagcctcctaccgccttcgatggcttccacatccacatcgagagggaggaaaacttcaccgaatatctaatggtggacgaggaggcacatgagtttgtggcagagctgaaggagcccggtaaatacaagctcagcgtgacaacttttagttccagtggcagttgcgagaccaggaaatctcaatccgctaaaagcttgtccttttatataagtccttccggggaatggatcgaggagttaaccgaaaaacctcagcacgtatcagtccacgttctgagttccaccactgccctcatgtcgtggacaagctcccaggagaactataactctaccatcgtgtccgtagtgtccctcacctgccaaaaacagaaggaatctcagcgcctggagaaacagtactgcactcaggtcaatagcagcaagccaattatcgaaaatctcgtccctggcgctcaatatcaggtggtcatctaccttagaaaaggaccactgattggaccaccatccgatcccgtgacattcgcaatagtgcctacaggaattaaagatctgatgctctaccctctgggcccaactgcggtcgtgctcagttggacacgaccttaccttggagtctttcgcaaatatgtcgtcgagatgttttattttaatccagccaccatgactagtgagtggaccacttattacgagatcgccgctaccgtgagtcttacagcaagcgtccgcatcgccaatctgctgcctgcttggtactataatttccgcgtaaccatggtgacatggggagatcccgaactctcctgctgcgattcctccactataagtttcataacggccccagttgctccggagataacgagcgtggagtacttcaatagcttgctatatatctcttggacctacggtgacgacacgacggacctctctcatagcaggatgctgcactggatggtggtggcggagggaaagaagaaaattaaaaaatctgtcactaggaatgtgatgacagccatcctctcactgcccccaggggatatttacaacttatcggtgaccgcctgcacagagcgcggatcgaatacttctatgctgaggctagtcaagctcgagcctgcaccccctaaaagtctgtttgcagtaaacaaaacccaaacttcggtcacgctactctgggtagaagaaggagtagcagactttttcgaagtattctgtcagcaggtggggagttcccaaaagactaaacttcaggaacccgtggcagtctcctcgcatgttgtcacgatcagcagtctgctcccggcaacagcttacaactgtagcgtaacatctttctcccatgattccccctccgtgcctaccttcatcgccgtatccactatggttacagaaatgaaccctaacgtggtggtaatctccgtgttagccattctgagcaccctgctaattggtctcctgctggttacattaattattctaaggaagaaacatctccagatggcccgagaatgtggggcaggtacttttgtgaattttgcatctttagagagggacggcaagttaccctacaattggcgtagaagtatcttcgcctttctgacactgctgccatcttgtctgtggacggactacctgctggccttctacattaacccatggagcaaaaatggattaaagaaaaggaaactgacgaaccccgtgcagctggatgattttgacgcatatataaaggacatggcgaaagacagcgactacaagttcagcttgcagttcgaggagctaaagcttattgggctcgatattccacactttgctgcagatttgccgctgaatcggtgtaaaaacaggtacacaaatatccttccttatgatttttctcgtgttagacttgtgagtatgaacgaggaagagggtgccgactacattaacgctaactacatccctggctacaattctcctcaggaatacatagccacccagggacccctccctgaaactcgcaacgatttctggaagatggtgctacaacagaaatcccagattatcgtgatgctgacgcaatgtaacgagaaacggcgagtgaaatgcgaccattattggcccttcacagaggagcctatagcttacggcgacattacggtggagatgatctccgaagaggagcaggacgactgggcttgccggcactttcggattaattacgctgacgagatgcaggacgtgatgcattttaattatacagcatggcctgaccacggcgtcccaacggctaacgctgccgaaagcattctgcagttcgtgcatatggtcagacagcaggccaccaaaagtaaggggcctatgattattcattgcagcgctggtgtggggagaacaggaacatttattgcacttgatcgcctcctccagcatatcagggaccacgagtttgtggatatcctcggcctggtgagcgagatgcggagctaccgaatgagtatggtgcagaccgaggagcagtatatattcatccaccaatgtgtgcagctcatgtggatgaagaaaaagcaacagttctgtatatccgatgtcatctacgagaacgtctcgaagtcatag

SEQ ID NO: 237169 - DNA, 3567 bp, Artificial Sequence
  Description of Artificial Sequence: Synthetic coding sequence
atgggccatttacctacaggcattcatggcgctaggcgcctgttgcccctgttgtggcttttcgtgctttttaagaacgctacagcctttcacgtcactgtgcaagacgacaataacatagtcgtttccctcgaagcctctgacgtgataagccccgcttcagtatatgtggtcaagatcaccggcgagagtaagaactatttttttgaatttgaggaatttaactctactcttcctccacccgtgatctttaaggcttcgtatcacggcctttactacattatcaccttggtcgtagtgaatggcaatgtggtgaccaaaccttcccgatcaatcacggtactgaccaagccactgccggttacatctgtgtctatttatgactacaaaccatcacctgagaccggtgtcctctttgagatccattaccccgaaaaatataacgtcttcacccgggtgaacatctcttactgggaaggcaaagacttccggacaatgctctacaaggacttttttaaggggaagacagtttttaatcattggcttcccggaatgtgctactcaaacattacttttcagctggtctccgaggctacgttcaacaagtccaccttggtcgagtactccggggtgagccacgaacctaagcaacacaggacagcaccatatcctcctcagaacatcagtgtgagaattgttaacttgaataagaataactgggaagagcagtcagggaactttccggaggaaagtttcatgaggagtcaggatacaatcggtaaggagaaacttttccacttcacagaggaaaccccagagatcccatcgggcaatattagttctggatggcccgatttcaattcttctgattacgagaccacgtctcagccctactggtgggactccgccagcgctgccccagagtccgaggatgagttcgtgtccgtactgcctatggagtatgaaaacaactccacgttgtccgaaaccgagaagagcacgtccggttcctttagtttctttcctgtgcagatgatcctgacgtggctcccgcctaaaccacctaccgccttcgatggctttcatatccacatcgagagggaggaaaacttcaccgagtatctaatggttgatgaagaagcccatgagttcgtggctgagctcaaggagccgggaaagtataagctatccgtgaccacattctcgtcctcgggttcatgtgagacccggaagagtcagagtgcaaagtctctcagtttctatatctctccttccggggagtggattgaggagctgactgagaaaccacagcacgtgagtgtccacgtgctctcatccacaacggctctgatgtcctggacttcttcgcaagaaaactacaattccacgattgtctccgtagtctccctgacatgccagaaacaaaaagaaagtcagcgcctcgagaagcagtactgtacacaggtcaattccagtaagcccatcatagaaaatctcgtgccgggagcccagtatcaggtagtgatttatctccggaaagggccattgataggacccccatccgatccagtgaccttcgccatcgtacccacgggcattaaggacctgatgttatatccactgggacccacggcggtcgtgctgtcctggacccgaccctacttgggagttttcagaaagtatgtggtggaaatgttctatttcaaccctgctacgatgacctcggagtggacaacatactacgaaatcgctgctacagtatctctgacagcttcagtcaggatcgccaatctacttcccgcttggtactataattttcgcgtcactatggtgacctggggagacccagagctgagctgttgtgatagtagcaccattagcttcatcacagctcctgtggcacccgagataacatctgtggagtacttcaattctttactctatatttcctggacgtacggcgatgatacgacagatctgagtcactctagaatgttgcactggatggtcgtggccgaggggaaaaaaaaaattaagaaatctgttacaagaaacgtgatgaccgccatcctctctctgccacccggtgatatttacaacctatctgtgactgcttgcacagaaagaggctctaatacctctatgctgagattagtcaagctcgaacccgctccccctaagtcactattcgctgtgaataagactcagacttctgtgacactcctctgggtggaagagggggtggccgatttttttgaagtgttttgtcagcaggtaggctcttctcaaaaaaccaaattgcaagaacccgtggctgtttcctctcacgtggttaccatatcctctctactacctgctacagcttataattgttccgtgacatccttttcgcacgattccccgtcagttcctacctttatagccgtgagtaccatggtgaccgagatgaatccaaatgtggtagttatctccgtactcgctattttatctactctcctcattggcttgctcctcgtgactctcatcatcctgcggaaaaagcatctccagatggccagggagtgcggtgctggaacattcgtaaacttcgcatcactagagcgcgacgggaagctgccctataactggtctaagaacggactgaaaaagcgtaagttgaccaacccagtgcagctggatgacttcgacgcctacattaaagacatggcgaaggacagtgattacaagttcagtctccagtttgaggaattgaagttgattgggttagatatcccacacttcgccgctgacctccctctgaaccgctgcaagaataggtacaccaatattctgccgtatgatttcagtcgcgtgcgcttggtttccatgaacgaagaggaaggagctgactatatcaacgcaaattatatacctggctataattcaccacaggaatatatcgccactcagggcccactgcctgagactagaaatgatttctggaaaatggttctgcagcaaaaatcacagattatcgtcatgctgactcagtgcaacgaaaagcgccgagtgaagtgcgaccactattggccatttacggaggagccaatagcctacggagacattaccgtggagatgatcagcgaagaagaacaggacgactgggcgtgcagacattttagaataaactacgctgatgaaatgcaggacgtcatgcatttcaattatacagcctggccagaccatggagttcccacagcaaacgcggctgaaagtatcctgcagttcgtgcatatggttaggcaacaggctactaagagcaagggtccaatgataattcattgttccgcaggcgtcggtcgcaccggtacctttatcgccctcgatcgcctgttgcaacacatacgggatcatgagttcgtggatattcttggactcgtcagcgagatgaggtcttatcgaatgagcatggttcagaccgaggaacaatacattttcattcatcaatgcgtgcagcttatgtggatgaaaaagaaacaacaattttgtatttccgatgtgatctacgaaaacgtgtccaaaagttag

SEQ ID NO: 237170 - DNA, 1218 bp, Artificial Sequence
  Description of Artificial Sequence: Synthetic coding sequence
atggtgactgagatgaaccccaacgtggtcgtgatttccgtgctggccattctcagcacactgcttataggcctcttgctggtgaccctgatcatcttgcgaaaaaaacacctgcagatggctagagagtgtggagccggaacgttcgtcaacttcgctagtctcgagcgtgacggaaagcttccgtacaattggcgcagatctattttcgcatttctgactctgctgccttcctgcctgtggacagactacctgctcgctttctacatcaatccttggagcaagaacggtttaaagaagaggaaactaaccaaccccgtccagctcgacgatttcgacgcttatataaaagatatggcaaaggacagcgattacaagttctctctgcagtttgaggaactcaaattgatcggactcgacatccctcattttgcagcggatttgcctcttaaccgttgcaagaatcgctatactaatattctgccgtacgatttcagccgtgttagactggtgtcaatgaatgaggaggagggagccgattatatcaatgccaattacatcccgggttataatagcccacaggagtacatcgccacccagggccctctgccggagacccgtaatgacttctggaagatggtcttgcagcagaaatctcagatcatagttatgctaacacagtgtaacgaaaagaggcgggtgaaatgtgatcactactggccatttacagaggaacctatcgcctatggcgatatcacagtggaaatgatttctgaagaggaacaggacgattgggcttgccgccattttaggataaactacgccgacgaaatgcaggatgtcatgcactttaactacaccgcctggcctgatcacggggtgcctacggcaaacgcggcagagtccatacttcagtttgtgcacatggtaaggcagcaggcaaccaagagcaaaggccctatgattatacattgctccgctggggtgggcaggacaggtacgttcatagcgttggatcggctcctacaacacatccgcgatcacgaattcgtggacattctggggcttgtttcagagatgcgaagttatcgaatgtctatggtccaaaccgaagagcagtacatattcatccaccagtgcgtgcagttgatgtggatgaagaagaaacaacagttctgcatcagtgatgtcatatatgaaaacgtgagtaaatcttag

SEQ ID NO: 237171 - DNA, 1218 bp, Artificial Sequence
  Description of Artificial Sequence: Synthetic coding sequence
atggtgacggagatgaatccgaacgtggtggtcatctccgtgcttgcgatattgtcaacactcttgattgggctgttactggtgacactgattatactacgtaaaaaacatctgcagatggccagagagtgtggggctggaacgtttgtgaacttcgcttccctagaaagggatggcaaactcccttacaactggaggaggtctattttcgcatttctgacgctcctaccgtcctgcctgtggactgactaccttctagctttttatataaacccttggagcaaaaatgggttgaagaaaaggaaattgactaaccctgtgcaactggacgattttgacgcctacatcaaagatatggccaaggacagtgattataagttctctctgcagtttgaggagctgaagctgatcggtctggatattcctcattttgctgccgacctccccctgaacaggtgcaagaatcggtacaccaacattctgccttacgactttagccgagtgagactcgtcagcatgaatgaggaggaaggagccgactatatcaacgctaattatattcccggttacaactctccgcaggagtatatagcgacacagggacctctccctgaaacacggaacgacttctggaagatggtgctgcagcaaaagtcccagatcatcgtcatgttgacccaatgtaacgaaaagcggagggtgaaatgcgatcactactggcctttcaccgaggagcctatcgcgtacggggacattactgttgagatgatcagtgaagaggagcaagacgattgggcgtgcagacatttccggataaattatgcggacgagatgcaagacgtgatgcacttcaactacacagcctggccagaccacggagtgcccacagccaatgcagctgaaagtatcctgcaattcgttcatatggtgcggcaacaggcaacgaaatcaaaaggcccaatgattatccactgttccgccggagtggggaggacggggacattcattgcgctggacaggctccttcagcacatcagagatcacgagttcgtggacattctcggactagtgagcgagatgcgatcttacagaatgtcgatggtccagaccgaagagcagtacatcttcatccaccagtgcgtgcagctcatgtggatgaaaaagaaacagcaattttgcatttcagacgtgatatatgagaatgtgtcaaaaagctag

SEQ ID NO: 237172 - DNA, 1134 bp, Artificial Sequence
  Description of Artificial Sequence: Synthetic coding sequence
atggtgacggaaatgaaccccaacgttgtggtcatatctgtgttggcaatcttgagcactttgctgattgggctcttactggtaaccctgattatacttcgaaagaaacatctccagatggctagggagtgcggggctggtacttttgtgaattttgcgtccctggagagggatggtaagctaccatacaattggtcgaagaacggtctgaagaaaagaaaactgactaatccagttcagctcgatgactttgacgcctacatcaaagacatggcaaaagacagcgattataaattctcactccagtttgaggagcttaaattaatagggctcgacattccacatttcgccgcagacttacccttgaacaggtgtaaaaaccgctacaccaacatcctgccttacgatttcagtcgagtgagactggtgtctatgaatgaggaagagggtgccgactacatcaacgccaattacataccaggatacaattctcctcaagagtacatagcaacccagggacctttacctgaaactaggaacgatttctggaaaatggtgttgcagcaaaagtctcagattattgtgatgctgacgcagtgtaacgagaagagaagagttaagtgtgaccactattggcctttcaccgaggagccaattgcatatggggacataacagttgaaatgatcagcgaggaggagcaggacgactgggcttgtcggcattttagaatcaattacgctgatgaaatgcaggacgtcatgcacttcaactatacagcctggcctgaccacggggtgccaacggcaaacgccgctgaaagcatcttgcagtttgttcacatggttcggcagcaggccactaagtccaaaggcccaatgatcatacattgctcagccggtgtcggaaggaccggcacttttattgccctggacagattgctgcagcatatacgcgatcacgaatttgtggatattcttggcctcgtgagtgaaatgcggtcttaccggatgagcatggtgcagacagaggaacagtacatcttcattcaccagtgcgtgcaattgatgtggatgaaaaaaaagcagcagttttgcatttcagacgtgatctatgaaaacgtgtctaaaagctag

SEQ ID NO: 237173 - DNA, 1134 bp, Artificial Sequence
  Description of Artificial Sequence: Synthetic coding sequence
atggtcacagaaatgaacccgaatgtggtggtgatcagcgtcttagccattctgtccacattgctgatcggtctgctgctcgtgaccctcatcatcctgagaaaaaagcacttacagatggcacgggagtgcggagccggaactttcgtgaattttgcttctctggaacgggacggtaaacttccctataactggagtaagaacggactgaaaaagaggaagctgacaaatcccgttcaattggacgacttcgacgcgtacatcaaggacatggctaaggactccgactacaaattttccctgcagtttgaagagttaaagctaattgggcttgacatcccccatttcgcagctgacctgcctctgaaccgctgtaagaatcggtatacaaacattttgccatacgacttcagcagagtgagactcgtttctatgaatgaagaggagggcgctgattacataaacgccaattatataccaggctacaattcacctcaggagtacattgcaacacaaggaccactacccgagacgcgtaatgatttctggaaaatggttctgcagcagaaaagtcagatcatagtcatgctgacccagtgtaatgagaaaaggcgggttaagtgcgaccattattggccctttacagaagaaccaatagcttacggagacattacagtcgagatgatctctgaagaggagcaggacgattgggcttgcaggcattttagaataaattatgccgacgaaatgcaggacgtcatgcatttcaactataccgcgtggccagatcatggggtgccgacggctaacgccgctgagagcatcctgcaattcgtccacatggtccgccagcaggccaccaaatctaagggacccatgattatccactgttcagccggtgtgggacggacaggcacctttatcgctctggatcggctgttacagcacattcgtgaccatgagtttgtggatatcctcggactggtctctgaaatgcgtagttatcgcatgtctatggtccaaactgaggaacagtacatttttattcatcagtgcgtgcaacttatgtggatgaagaagaagcagcagttctgtataagtgatgtgatatatgagaacgtgtcaaagtcgtag

SEQ ID NO: 237174 - DNA, 6888 bp, Artificial Sequence
  Description of Artificial Sequence: Synthetic coding sequence
atggactttctgataatttttctgttactcttcatcgggaccagcgaaacccaagtcgacgtgtctaatgtcgtccctgggacccggtatgacatcacaatcagctccatctctactacctatacatcccctgtgacccgcattgtgaccactaatgtgactaagcctggcccacctgttttcctggccggagaacgcgtgggctcagccggaattttgctctcttggaatacccctccaaatccaaacggcagaatcatttcttatatcgtgaagtacaaggaggtgtgtccctggatgcaaacagtgtacactcaggtaagaagcaagcccgactcattggaagtgttgctgacaaatctcaacccgggtacaacctacgagatcaaggttataatccttaatgcaactaaagtgggctgcctgctctctcccattctgttgaacacagtcctcgaaggactggcgcgtgccataaatctcactagagaatgccagaccgtagatgcgggacagtgcgtgcagtgcgccgtgcgagaacccaaacaaggtagcacttccgggggacgggctcaaacaaataagaaaactgcagttacatcagcagacctcaaccacaccgccggagacttaaggacgggtaggctgcctccacagccattgactgcggagcagccgaactgggaagctccaccatcgcgtggaaggctgaccccccacaaagccggttactcttctgcgacagcagcaggaacacaggctaatcgggtgtggtccagacctttagctaagatccaaactactatccgggaatattataaacacctgtacgctaagaaggagggaattcttcccaactccttttacgaggcctctattattctgatccccaagccagttcccgaagggccacctcagaattgtgttacagggaacataaccggtaaatcgttctctatcctttgggacccgccaactattgtgacaggcaaattctcctacagagtcgagctctatggaccttcagggcgtatattggataacagtactaaggacttaaagtttgccttcaccaatcttactcccttcactatgtacgatgtttacattgccgcagagacttcagcagggaccggcccaaagtccaatatttccgtctttacgcccccagatgtccctggagccgtgttcgatctgcaactggctgaggtcgaatctacccaggtccggatcacctggaaaaaacccagacagcccaacggcatcatcaaccagtacagggtcaaggtactggtgcccgagaccggcatcatcctcgagaacaccctcttgaccggtaataatgaatacatcaacgaccctatggcccctgagatagtgaatatcgttgaaccgatggtcgggctctacgagggatccgctgaaatgtccagtgatctgcactcactcgctactttcatttacaatagtcaccccgataaaaacttccctgctcgcaatcgtgccgaggaccagacaagccctgtagtcacaacacggaaccagtacatcaccgacatcgccgcagagcagctcagctatgtaattcgtcgactggtgccattcactgagcacatgatctcagtctccgcctttacaattatgggagaaggccctcccaccgttttgagtgtgagaacacgccaacaggtgccttccagcattaaaattataaattacaaaaatatctcttcctcttccatcctgctgtattgggatcctcctgaataccctaatggcaaaattactcattacacaatctacgcgatggagctggacacaaatcgggcatttcaaatcacaaccatagataacagcttccttatcacagggcttaaaaagtacactaaatacaaaatgcgcgtggccgctagtacccatgtgggcgagtcaagcctgtccgaggagaatgatatattcgtaaggacatcagaggacgaaccagagtctagtccgcaggatgttgaagtgatcgacgtgacggccgacgaaattcgcctcaagtggagccctccagagaagccaaacggcataataattgcctatgaagtgctctacaagaatatcgacaccctatatatgaagaacacaagcaccaccgacatcatcctgagaaacctcagaccacataccctctataacattagtgtgcgctcctacaccagatttggtcacggaaaccaagtgagctccctcctgtcagtgcgcaccagcgagacggtaccagactccgctccagaaaacatcacatacaagaatatctcatcgggcgagatcgaactgagcttcctacccccatcaagccctaatggaattattcagaagtacacgatctaccttaaacgatcaaatggcaacgaggagcgaacaattaacaccacatcgcttactcaaaatattaaggttctgaagaaatatacacagtacatcatcgaagtgtcagcatcaactcttaagggtgaaggagtgaggtccgccccaatcagcatcctgaccgaagaggacgcccctgacagccccccacaggacttttctgttaaacagctgagcggggtgacagtcaagctaagttggcagccacccctggagcccaacgggattattctctattacactgtttatgtctggaatagatctagcctcaaaacaattaacgtgactgaaacatctttagagctgtctgacttggactacaatgtggagtattcagcctacgtgaccgctagcacgcgattcggtgacgggaagacgcggagtaacataatctcgttccaaacacctgagggagcaccgtctgacccacccaaagacgtgtattatgcaaacttgagctcaagctctattatcctgttttggactcctccttccaaacccaacggaattattcagtactactccgtatactaccgaaataccagcgggacatttatgcagaattttaccttgcatgaagtgactaatgatttcgataacatgaccgtctccactattattgataagttaaccatatttagctattataccttttggttgacagcaagcacctcggtcggtaacgggaataagtcaagcgacatcattgaagtatacacggaccaagacattcccgagggttttgtcggaaacctcacatacgagtcaatcagtagcacggccattaatgtgtcctgggtccctcctgcgcagcctaacgggctggtcttttattatgtcagcctcattctccagcagacgcccaggcatgtacggcctccacttgttacctacgagagatctatctacttcgacaatctggaaaaatacactgattacatcctgaaaatcacaccgtccacagagaagggtttcagtgacacttatacagcccagttatatatcaaaactgaggaagatgtgcccgagactagcccaatcatcaatacttttaagaatctaagctccacctccgtgctccttagttgggatccccctgttaaacccaacggcgcaatcatctcctatgacctcacactccaaggacctaatgaaaactactcatttatcacttctgataattatatcattctcgaagagctaagtcccttcaccctttactcattctttgccgcagcgcgaacacgcaaaggcttaggcccttcctccatcctgttcttttacaccgacgagtccgtaccactggctccaccccaaaacttgactctgatcaattgcacgtctgatttcgtctggctcaagtggtcaccaagccctctcccaggtggtatcgtgaaggtatatagctttaagatccacgaacatgaaacagacactatttactacaaaaacatttcaggcttcaaaacagaggctaagctggtcggcctggagcctgtttctacctatagcatcagggtcagtgcctttactaaggttgggaacggcaaccagttttctaacgttgtgaagttcaccacgcaggagtctgtgccagatgttgtgcaaaacatgcagtgcatggccacttcctggcagtcagtgctggtgaaatgggacccccctaaaaaagctaacggtattattactcagtacatggtgacagtcgagagaaatagcacaaaggtgagcccacaggaccatatgtatacctttattaaactgcttgccaacacaagttatgtcttcaaagttagagctagcacaagcgctggcgagggcgacgagtcaacatgccacgtgtccactctgcccgagacagtgccttcagtgcccaccaacatagcattctctgacgtccaatctactagtgctactttgacttggatacggcctgatactattttaggatacttccagaactataagattactacccagctgcgggcacagaagtgcaaagaatgggagtccgaagagtgcgtggaatatcagaagattcagtacctctacgaggcccatctgacggaggagacggtatacggtcttaaaaagttccgctggtaccggtttcaagtagctgcatctacgaatgccggatatggtaatgcttccaattggatatcaactaagacgttgccaggcccaccggacgggccacctgaaaatgtgcacgttgtggcaaccagccctttcagtataagcatttcctggagcgagcctgccgtgattaccggaccaacctgttatctgattgacgtaaagagcgtggataacgacgaatttaatataagcttcattaaatcaaacgaggaaaacaaaacaatcgagatcaaggatttggagatatttacccgttactctgtcgtaatcactgccttcactggcaacatatctgccgcttacgtggaaggcaagagtagcgccgaaatgattgtcaccacacttgaatctgctcctaaagacccaccgaataacatgaccttccagaagattcctgacgaagtcacaaaattccagctgacctttttgcctcccagccagcccaacggcaatattcaagtctaccaggccttggtgtaccgggaggacgatcccaccgcggtgcagatccataatctctccattatccaaaagacgaataccttcgtgatagccatgctggagggactgaaaggcggtcacacatacaatattagcgtgtacgctgtaaattctgcaggcgcaggacctaaagtgcctatgcgcatcactatggacattaaagccccagcgaggccaaaaacaaagcccactcccatttatgacgccacaggaaaacttctggtgacctccaccactattacgattaggatgccgatttgctactactcagacgaccatggcccaataaagaatgttcaagtgttagtgaccgagacaggagctcagcacgacggaaacgtaacaaaatggtatgatgcctatttcaacaaggccagaccctacttcaccaacgaggggtttccaaatcccccatgcaccgagggcaagaccaagttctcagggaatgaagaaatttatattatcggagccgataatgcttgcatgatccccggtaacgaggacaaaatctgcaatggtcctttaaagccaaaaaagcagtacctctttaagttcagagccaccaatataatgggacagttcacagactctgattactcggatccagtgaagacattgggggaaggtttatcagaaaggactgtggaaatcatactcagtgtgaccctgtgcattctgagcatcatactgttgggcacggcaatctttgcgtttgcccgaatcaggcagaaacagaaagagggaggcacatattctccccaagatgcagagattatagatactaaactgaagctggatcagctgatcactgtagccgatctcgagttgaaggatgaacgcctgactcgactgctgtcatatagaaaaagcattaaaccaatcagtaagaagtccttccttcagcatgtggaagagctatgtacgaacaacaacctgaaattccaggaagaattctccgagctccccaagttcttacaggatctctcctcaacagacgccgatctcccttggaaccgcgctaaaaacaggttccctaacatcaaaccttacaacaataaccgagtaaagctcatcgctgatgcctctgttccaggctctgattacatcaatgcctcttacatttctggctatttgtgccctaatgagtttatcgctacccaggggccattaccgggtaccgtcggagatttttggcgtatggtgtgggaaaccagagctaagaccctggtgatgctgacacagtgttttgagaagggcaggattaggtgccaccagtattggcccgaagacaataagcctgtaaccgtcttcggcgatattgtcattacaaagctaatggaggacgttcaaatcgattggactattcgggatctgaaaatagaacgacatggcgattgcatgacggttcgtcaatgtaactttaccgcatggccggagcatggggtccccgagaattctgcccctctaatccactttgtcaaactggtcagggcctctcgcgctcatgatacaactcctatgatcgtccactgcagcgctggagtgggtaggaccggcgtgttcattgcacttgaccacttgacacagcatatcaacgatcatgacttcgttgacatttatgggctcgtagcggagctccgcagtgagcgaatgtgtatggttcagaatttggctcagtatatcttcctgcatcagtgcattctcgacttattatcgaacaaaggaagtaaccagcctatttgtttcgtgaattactcagctctccaaaagatggattcccttgatgccatggagggcgacgtggagctcgagtgggaggagaccactatgtat

SEQ ID NO: 237175 - DNA, 5786 bp, Artificial Sequence
  Description of Artificial Sequence: Synthetic coding sequence
atggcacccacctgggggccaggaatggttagtgtagtgggaccaatggggctgctcgtggttctcctggtagggggatgtgccgctgaggagccacccaggtttattaaagaacccaaagatcagattggcgtgagcgggggagtcgcatccttcgtttgccaggctactggggacccaaagcctcgagtcacctggaacaaaaagggaaagaaggtgaatagtcaacggttcgagaccatagaatttgacgaatcagctggggcagtcctgcgtatacaaccactccgaacccctagggatgaaaacgtgtatgaatgcgtagctcaaaatagtgttggtgaaataacagtgcatgccaaacttacagtcctccgagaagaccagttaccctctgggttccctaacattgacatgggcccacagctgaaggtggtagagagaacccgcactgccaccatgctgtgtgctgcttccggtaatccggatcccgagattacctggttcaaggactttcttcccgtcgatcctagtgcatcaaatggcaggattaaacagctcaggtccgaccaggctttctctcacctgcccacaggcgctcttcagattgaatcttcagaggaaactgatcaaggcaaatatgaatgtgtcgccaccaactccgctggggtgcggtattcctcgcctgcaaatttgtacgtgagagtgcggagagtggcaccgcgattttctatcctccccatgagccacgagattatgccaggcggtaacgtcaatattacatgtgtcgctgtgggcagcccaatgccttatgtcaaatggatgcagggagccgaagacctgacacctgaggatgatatgcccgtggggaggaacgttctcgaattgactgacgttaaggattctgctaactacacatgtgtcgcaatgtcttcacttggcgtgatcgaagcggtggcacagattaccgtcaagagcctcccaaaggcgccaggaacacccatggttaccgaaaatactgccacatccatcacgatcacttgggacagcggaaatcccgatccagtgtcttactatgtcattgagtacaaatcgaagtctcaggacggtccatatcagatcaaagaggatattacgacgacccggtacagcatcggtggcttgagccccaattctgaatatgagatctgggtgtcagctgtgaatagtatagggcagggccctccaagcgaaagcgtagtaacgcgtaccggcgagcaggctcccgctagcgccccacgcaacgtgcaggccagaatgctaagcgcaactactatgatcgtccaatgggaagagcccgtggagccgaacggcctgatcaggggctatcgagtgtactacacgatggagccagagcatccggtgggcaactggcagaagcacaatgttgacgatagcttgctgacgaccgttggaagtctgcttgaggatgagacatacaccgtgcgcgtgctcgccttcacatccgtgggcgacggccctctgtccgacccaattcaggtgaagacacagcaaggagttccgggtcagccaatgaatcttcgcgctgaggcaaggtccgagacttcaattacactgtcctggtccccccctcggcaggagagcattatcaaatatgagctgctgttccgggagggcgaccacggcagggaagtgggcagaaccttcgaccctactaccagttacgtagtagaagatttaaagccgaacaccgaatatgcctttcgactggcagcaaggtccccccaggggctgggggctttcactcctgtggtgaggcagcgaactctgcaatctaagccgagtgctcctcctcaagatgtcaagtgtgtgtcggtgagaagtactgcgatcctcgtaagctggcgccctcctccacctgagacacacaacggcgctctggtcggatacagtgtgcgataccggcctctggggtctgaagatcccgagcccaaggaagtcaatggcatacctcctacgactacgcagatcctgctcgaggctctcgaaaagtggacgcagtacagaatcacaacagtggcccacaccgaagtcggccctgggcctgaaagctcacctgttgtcgtgaggactgatgaggatgtgccctcagctccaccccgtaaagtcgaggctgaggccctgaacgccacagccattcgggtactttggagaagccctgcaccaggcaggcagcatgggcaaatcagaggctatcaagtccactacgtaagaatggaaggcgcagaagccagggggccaccgagaatcaaggatgtgatgctggccgatgcccagtgggagacagacgatactgcggaatacgaaatggttattacgaacctgcagcccgagaccgcgtactctatcactgtggcggcttatactatgaagggcgacggagccaggtcaaagcctaaggtggtcgtgaccaagggcgcagtgttagggagacctaccctcagcgtacagcagactcccgaaggcagtctcctggcccgatgggaaccgcctgctggaaccgccgaggatcaggtcctgggataccggctgcagtttggacgtgaggactccactccgttggcaactctggaattccctccaagcgaggatcgctataccgcctctggcgtgcacaaaggcgcaacttacgtctttaggttagccgcaaggtctcggggaggccttggcgaagaggctgccgaggtcctgtctatcccagaggacacccctcgcggacacccacaaatcctggaggccgcagggaatgcgtcggctggtacagttttgttgcgatggttgccaccggtgccagccgaacgcaatggcgcaatcgtgaagtacacagtggccgtacgggaggcaggcgctctcggtcctgcacgtgaaacagagttacccgcagccgcagagcctggggctgagaacgcgctgacactgcagggactgaagccagacactgcctacgacctccaggtgagagcacacacacggcgtggaccgggtcccttttctcccccagttaggtaccggactttcctgagggatcaggtgtctcccaaaaacttcaaagtgaagatgataatgaaaacatcggtactgttatcttgggaattccctgacaattacaattctcctacaccatacaagatccaatataacggtctcaccctggacgtcgacggcaggacaaccaagaaactgatcacccatctcaaaccacacacattttacaacttcgttctgacaaacagggggagctccctaggaggcttacagcaaacggtgacggcgtggacggcctttaatttgctaaacgggaaaccaagcgtggcaccaaaaccagacgctgacggcttcataatggtctatctgcccgacggccagtcaccggtgcctgtgcaatcatatttcatcgtgatggtgccgcttagaaagtcaaggggtgggcagttcctcaccccccttggatcccctgaagatatggatctggaagagctgattcaggacataagcaggctgcaaaggcggagtctgcgacacagcaggcagctcgaggtacctcggccatatatcgcggcaaggttctcggttctgcctcctacatttcatcctggggatcagaaacagtacggaggcttcgataaccgcggactggaacctggccatcgctatgtcctcttcgttctagctgtgctgcaaaagtctgaacctacatttgccgcttccccatttagtgatccttttcagctcgacaatccagatcctcagcccatagtggatggcgaagaggggctcatttgggtgatcggccctgtactggcggtggtgttcattatttgtattgtgatagccattctcctgtataagaataaacccgattcgaaaagaaaagactccgagccaagaacgaaatgtctccttaataatgccgaccttgctccccaccacccaaaagacccagtggagatgcggcgaattaatttccaaactccaggcatgctttcacaccccccaatccctattgcagatatggccgaacatacagagcgtttgaaagctaacgactctctcaaactttctcaagagtatgagagcatcgaccccggacagcaatttacatgggagcacagtaaccttgaagttaacaaaccgaagaatagatacgctaatgtgatagcttatgatcactctcgagtgatcctgcagcccatcgaaggaattatgggaagcgactatatcaacgccaattacgtcgatggctaccgttgtcaaaacgcctacatcgccactcaagggccacttcccgagacgttcggggacttttggcgtatggtgtgggaacagcggtccgccacgattgtgatgatgactagactcgaagagaaatcacgaattaagtgcgatcagtactggcccaatagagggacagagacttatggttttattcaagtgaccctacttgacaccattgagctcgccactttttgtgttcggacattctctcttcataaaaacggctcgtccgagaaaagagaggttaggcagttccaattcactgcttggccggaccacggggtgcccgagtacccaaccccattcctggccttcctgcggcgagtgaaaacttgtaaccccccagacgccggacctatcgttgtccactgctcagcaggcgtgggacgaaccggatgttttatagtcatagatgcaatgctcgagagaatcaaaccagagaagacagtcgacgtttatgggcacgtcaccctgatgagatcgcagcggaactacatggtgcagactgaagatcaatattccttcattcatgaggccctgttggaggctgtaggctgcgggaatacagaagtgccggcacgttccctgtacgcgtatatccagaagttggcccaagttgagcccggagaacatgttacagggatggaacttgagtttaagaggttagccaactcaaaagctcacacctctagatttatcagcgcgaacctgccatgtaataaatttaaaaatagattggtcaacatcatgccctatgagtctacacgggtttgcttgcaacccattcggggagtggagggcagcgactacatcaacgctagttttatagacggctatagacagcagaaggcctatatcgcaactcagggacctttggccgagactacggaagacttttggcgaatgctctgggaaaataatagcactatcgtggtcatgctcacaaagctgagggaaatggggcgtgaaaaatgccaccaatactggcccgcagaacgctcagccaggtaccagtacttcgtcgtggacccaatggctgaatacaatatgccccagtacatcctgagagaattcaaagtaaccgacgccagggacgggcagtcaagaacagtcaggcagttccaattcacagattggcctgaacagggtgttccgaagtctggagagggcttcatcgatttcatcggtcaggttcataaaaccaaggagcagttcggacaggacggtcccatctccgtgcattgtagcgcaggcgtcgggagaacaggcgtcttcatcaccctgagcatagtgcttgaaagaatgcgctacgaaggcgtagtggacatttttcaaaccgtaaaaatgctgcgtacccagcgcccagccatggtccagacagaagatgaatatcaattctgctaccaggccgcactggaatatttgggatcttttgatcactacgcgacata

SEQ ID NO: 237176 - DNA, 5732 bp, Artificial Sequence
  Description of Artificial Sequence: Synthetic coding sequence
atggccccaacctggggaccaggcatggtaagcgtcgtagggccaatgggactacttgtagtgttgctggtgggaggatgtgccgcagaggagccgcctaggtttataaaagagccgaaggatcaaataggagtgtctggaggcgtcgcctcatttgtgtgccaggctacaggtgatcccaagccgagggtcacctggaacaagaaagggaaaaaagtgaatagccagcggttcgaaacgatagaatttgacgaaagcgccggagctgtcctgcgcatccagccactgcggactcctcgggacgagaacgtgtacgaatgtgtggcccagaatagtgtcggggagattacagtgcacgcgaaactaaccgtcctacgcgaggatcagctgccaagtgggttcccaaacattgatatgggaccccagttgaaagtcgtcgaacgaactcgaacagccacgatgctgtgcgccgcaagcggaaaccctgatccggagatcacctggtttaaggattttctcccagtggacccatctgcctcaaatgggcgaatcaagcagctacggtcgggcgcattgcaaatcgaatcaagcgaggagactgaccagggcaaatatgagtgcgttgccacgaatagtgcaggagtgcgctactcttcacctgccaacctctacgtaagagttaggcgggtggcaccccgtttcagcatcctcccaatgagccacgaaatcatgcccggaggaaatgtgaacataacatgcgtggctgtcggctccccaatgccctatgtcaagtggatgcagggagcagaggatcttaccccagaagacgacatgccagtagggcgtaatgtgctcgagctgacagatgttaaggattccgccaattatacctgcgtggctatgagttctctaggggttatcgaggctgtggcccagattaccgtcaaaagcctccccaaggctcctggaacgccaatggttactgaaaatacggctacctccatcacgatcacttgggacagtggaaatccggatcctgtgagctactatgttattgagtataagtccaaatcacaggatgggccttaccaaatcaaggaggatattaccactactagatattcgataggcggtctgagccctaacagtgagtacgagatttgggttagcgcagtcaatagcattggacaggggccacctagtgaaagcgtggttactcggaccggtgaacaagccccagcatctgccccacggaacgtgcaggctaggatgttgagcgcaacgacaatgattgtgcaatgggaagaaccagtcgaacccaacggtctgatccgtggatatcgggtctactatactatggaaccggagcaccctgtcggaaattggcagaaacataacgttgacgatagcctgctgacaactgttgggtctttactggaggatgaaacttacactgttcgcgtgctggcctttacaagcgtgggagatggaccgctgagtgatcccatccaggttaagacgcagcagggcgttccaggccagcctatgaaccttagagccgaggctagaagcgagacatctatcacactttcatggagcccccctaggcaagagtccatcattaaatatgagctcttgttccgcgagggcgaccatggccgtgaagtcgggagaacattcgatcccacaacatcctatgtcgtagaagacctaaaacccaataccgagtacgctttcagactggccgctcgcagccctcaaggcctaggcgcattcacaccagttgttcgacagcggaccttacagtctaagccatcagccccaccacaagacgtgaaatgcgtgagtgtacggtccactgctattttggtaagttggagacccccaccgcctgagactcacaacggtgctctcgttggctactccgtgcggtacaggccgctgggcagcgaggatccagaaccaaaagaggtcaatggaatccctcctacaacaacccagatcctgctggaggccctggaaaagtggacccagtacagaatcaccactgtcgcccatacagaggtagggcctggcccagaatcctcacccgtggtcgtgcggaccgatgaagacgtgcccagcgctccacccaggaaagtcgaggcagaagctttgaacgccacagcaatcagagtcctctggcgcagtcccgctccagggagacagcatggccaaatccgaggataccaggtccactatgtaagaatggagggcgctgaggcgagaggaccccctagaattaaagacgtcatgttggctgacgcgcaggaaatggtaatcacgaatttacagcccgaaacagcctattctattactgtggcagcctacactatgaagggcgacggggctaggagcaagccgaaagtagtagttaccaaaggggcagtgctggggaggcccacactgtccgtccagcaaacacctgagggaagtctgctcgcacggtgggagcccccagcgggaaccgcagaggatcaggttctcggttatagattgcagttcggacgagaagacagtacccctctcgcgaccttggagttccccccttccgaagacaggtacacagcgagtggcgtgcataaaggagcgacctatgttttccgcttagccgctagatcccgcggaggcttgggagaggaggctgctgaggtcctctcaattccagaggacactccacgagggcacccccagattctagaggctgccggaaatgcaagtgccggtacagtgctgttgcggtggctcccccctgtccccgctgagcgcaacggcgctatagtcaaatatacggtagctgtgcgggaagcaggcgctctgggcccagcccgagaaactgagctccccgcagctgccgaaccaggggcagagaatgcactgactcttcagggcctgaagcccgatactgcgtatgacttacaggttcgtgcgcacactaggcgtgggcctggcccttttagtccccctgtgagatatagaacctttttgcgcgaccaggtttcaccaaaaaatttcaaagttaaaatgattatgaaaacctctgtgctgctcagctgggagttccccgataactataactcacctacgccatacaaaatccagtacaacggcctcacacttgacgtggacggcagaactactaaaaaactgattacgcatttgaagccccatacattctacaattttgtattaacaaataggggcagctcattggggggactgcagcagaccgttacggcttggacagcttttaatctcttgaacgggaaacccagcgtggcccctaagccggatgcggatgggttcatcatggtttaccttccggacgggcaaagtccagtgccagtacagtcctatttcatagttatggtgccacttagaaagtcacgaggcggacagtttctcaccccactagggagccctgaggatatggacctggaggaactgatacaggatatttcccggcttcagagaagatccctgcgtcactcacgccaattagaagttccccgtccttatatcgcagcccgtttcagtgtgctgccccctaccttccaccctggcgaccagaaacagtatgggggtttcgacaatagaggcctagaacctgggcacaggtatgtgctgtttgtgctggccgttctgcagaaaagtgaaccaaccttcgcagcttcccctttcagtgacccattccagctggacaacccagatccacagccgatcgtagatggcgaagaagggctgatctgggtgatcggccctgtactcgcagtggtttttattatctgcatagtcatcgcaattctactttacaagaataaaccagatagcaagaggaaagatagcgaacctcgcacaaagtgtctgctgaacaatgccgatctggcccctcatcatccaaaagaccctgtggaaatgcggaggattaacttccagacaccaggaatgctgtcccaccctcccatcccaatcgccgacatggccgaacacaccgagagactgaaggccaatgactcactgaagctgagtcaggaatacgagtcgatagatcctggtcagcagtttacttgggaacattctaatttagaagtcaataaacctaagaaccggtatgccaacgtcatcgcttatgatcattcccgcgtaatcctgcagccgatcgaaggcatcatgggctctgattatatcaacgcaaactacgtggatggctatcggtgccaaaacgcttatattgccacacaaggccctctgccagagacctttggggacttctggagaatggtgtgggagcaacgctctgcaacaatcgtaatgatgacaagacttgaggagaaaagccggatcaagtgtgatcagtattggccaaatcggggaactgagacttacgggttcatccaagtaactctacttgacaccatcgaattggctaccttttgcgttcgaacatttagtttacacaagaatggctcaagcgaaaaacgggaggtgcgccaatttcagtttactgcatggcctgaccacggagtgcccgagtaccctaccccctttctggccttcttgcgcagggtcaagacctgtaatccccctgacgctggcccaatcgttgttcactgttccgccggagtagggaggaccggttgcttcattgtgatcgatgccatgctagaaagaatcaaacctgagaagactgtggacgtgtacgggcatgtaacattaatgcgcagtcaacgtaattatatggtgcagaccgaggaccagtactcttttattcacgaagccttgctcgaagccgtgggctgcggcaatacagaggtgcctgctagatctctatacgcttacattcaaaagctggcccaggtggagcccggtgaacatgttaccgggatggagctggagttcaaacggctggctaatagcaaggcacatactagtaggttcatctccgctaatctgccttgcaataaatttaaaaacagactggtcaacatcatgccttatgagtctactcgggtgtgtctgcagcccatacgcggagtcgaggggtctgattacataaacgcatcatttattgacgggtaccggcagcagaaggcctacattgcaacacagggcccattagccgagacaaccgaggacttttggcggatgctgtgggagaataacagcactattgtggtcatgttaacaaagcttcgtgaaatggggagagaaaagtgccaccagtattggccggctgagcgtagcgccaggtaccaatatttcgtggtcgatcccatggctgagtacaacatgcctcagtatatattgcgggagttcaaggttactgacgcccgtgatgggcagagtagaactgtgcgtcagttccagttcactgattggcccgagcagggggtcccgaaatcaggggaaggcttcatagattttatcggccaagttcacaaaacaaaagagcagttcggccaagatggacccatctccgttcactgtagcgcaggggtcggcagaacgggggtatttataactctgtcaatcgtgctagagcgaatgcggtatgagggagtggtagatatttttcagacagtgaaaatgttgaggactcagcgacctgccatggttcagactgaagacgagtaccagttttgttaccaggcggcattagaatacctgggcagctttgaccattatgctacata

SEQ ID NO: 237177 - DNA, 4506 bp, Artificial Sequence
  Description of Artificial Sequence: Synthetic coding sequence
atggcaccaacctggggtcctggtatggtctctgtcgtaggaccaatgggactcttagtcgtgctcctggtggggggatgcgccgcagaggagccccctcgatttattaaggaacccaaggaccaaataggcgtatctgggggagtggcttcgttcgtgtgtcaagcaactggtgaccccaagcctcgggtcacctggaataagaaaggcaaaaaggtgaactcccagagattcgagactatcgaattcgacgagtccgctggcgcagttttacggattcaaccactgcggactccacgggacgagaatgtgtacgagtgcgtcgcccagaacagtgtgggtgaaatcacagtgcacgctaaactgaccgtccttagggaggatcagctcccgtctgggtttccaaatatagatatgggacctcagctcaaggtggttgagcgcactcgaactgcaacaatgttgtgtgctgcgtccggcaaccctgatcccgaaatcacctggttcaaagattttctgccagtggatccctctgcatctaatggcagaattaaacagctgcgctcgggtgctttacaaatcgaatcaagcgaagagacagatcaaggaaagtatgaatgtgtggcgacgaattcagccggagttaggtattctagccccgctaatctttatgtgcgggttaggcgtgtggctcccaggttctccatcctaccaatgagtcatgaaattatgccgggtgggaacgttaacataacgtgcgtggccgtaggttcaccgatgccctacgttaaatggatgcagggcgcagaagatctgactcccgaggacgatatgcctgtgggtcggaacgtgctggaactgaccgatgtgaaagattcagcaaactacacctgcgtggccatgagcagtctgggggttatcgaagccgtcgcacagatcaccgttaaaagtttgccgaaggctcctggaaccccaatggttaccgaaaatacggcaacctccatcaccattacttgggatagcggaaacccagacccagtctcctactacgtcattgagtacaagagcaaaagccaggatggtccataccagatcaaagaagacatcacgacgactcgctactcaataggcggactgagccctaatagtgagtacgagatctgggtgagtgccgtgaactctattggccaaggtccgccttctgagagcgtggtgacccgaactggcgagcaggcaccagcttcggcacccagaaacgttcaggcccgaatgctgtccgccaccaccatgattgtgcagtgggaggagcccgttgaacccaatggtctgattcggggatacagggtttactacactatggagccggagcacccggtcggtaactggcagaaacacaatgtagacgattccttgttaactactgtgggctccctcctcgaggacgagacctatacggtaagggtcctggcatttacaagtgtaggagacggacccctgtcagatcccattcaggtaaagactcaacaaggtgtcccaggtcagcccatgaatctaagggcagaagctcgttctgaaaccagcatcacactgagttggtcaccaccccgacaggagtccataatcaagtacgaactattatttcgggagggtgaccatggacgagaagtgggcagaacatttgatcccaccacatcatacgtggtagaagatttaaaacctaatactgagtacgcctttaggctagccgcacggagcccacaggggctcggtgcattcacccctgtggtgcgtcagcgcaccttgcagagcatttcgcccaagaattttaaggtaaaaatgattatgaagacttccgtactactgtcatgggagttcccagacaactataacagcccaactccatacaaaatccagtataatgggctcacactcgatgtggacggccgaactaccaaaaaactaattacacatctgaaacctcatactttctataatttcgtgttgacgaatcgcggatccagcttgggcggacttcagcaaactgttacggcttggactgcgtttaatctcctgaacggaaagccctccgtcgcaccgaaacccgatgctgacgggttcattatggtttacctgccagatgggcagtccccggtgcctgtgcaatcttacttcatcgtgatggtaccactgcgaaaatctagaggcggtcagtttctcactcccttgggcagcccagaagacatggacctggaggagcttattcaggatattagccgacttcagaggcgcagtctgaggcacagtcgacagctagaagttcccaggccctatatcgcggctcgattctctgttctgccgcctacgtttcaccccggtgatcaaaagcagtacggtgggttcgacaatcggggattggagcctggccacagatacgtcctcttcgtcctcgcagtgctacaaaaaagcgaacctacttttgctgcatctcctttttcggatcctttccagctggacaatccagatccccagcccatagtagacggtgaagaggggcttatctgggtgataggtcctgttttagctgttgtcttcattatatgcattgtcatcgccattctgttatataagaataagcccgattccaaaaggaaggactcagaacccaggacaaaatgcctcctcaacaatgccgatttagcccctcatcatcccaaggacccagttgagatgagaaggataaactttcagactcctggcatgctgagtcatcccccaatccctatcgcagacatggccgaacacacggagcggctgaaggcaaacgattcactgaaattgtcccaggaatatgaatccatcgatccgggacagcagttcacctgggaacacagcaacctagaagtgaacaagcccaaaaatcgttatgcgaacgtcatcgcttacgaccatagtagggtcattctccagcccatcgaagggatcatgggatctgattacataaatgccaattacgtggacggctaccgttgccaaaacgcctacattgccacgcaggggccactcccagaaacattcggagacttctggcgcatggtctgggaacagagatcagccaccatagtaatgatgactcgacttgaggaaaaaagtagaatcaaatgtgatcaatactggccaaatcgtggaaccgagacttatggcttcatccaggtcaccttgctcgacaccatcgaacttgcgacattctgcgtgcgcacattctcactccataagaacggctcttccgagaaaagagaagtgcgtcaatttcaattcactgcatggccagaccacggcgtgcccgagtaccccaccccattcctcgcgttcctcaggcgcgtgaaaacttgcaatccgccagatgccggtcctatcgtagtacactgtagtgccggtgttggtcgcacaggttgtttcatagttatcgatgctatgttggaaaggattaagcccgagaagacagttgatgtgtatgggcatgtgacactgatgaggtcacagcggaactatatggtccagaccgaagaccagtacagcttcatccacgaggctctactcgaagccgtcggatgcggtaatactgaggtgcctgccaggtctctgtatgcttatatccagaagttggcacaggtagagccaggggagcacgtcacaggtatggaattagagttcaagcgcttggcaaacagtaaggctcacacgtcacgctttatcagtgctaatctgccttgcaacaagttcaaaaatagactcgttaacatcatgccctacgagtccacccgggtttgcttgcagccaatcagaggggtggaggggagcgactatatcaatgcgagcttcatcgatgggtacaggcagcagaaggcctacatcgccacacaagggcctctcgctgagactacagaagatttttggaggatgctgtgggagaacaactcaacaatcgtcgtgatgcttaccaagctgcgagagatgggcagggaaaagtgccaccaatactggccagctgaaaggtcagcaaggtaccagtacttcgtcgtggatccaatggcggagtataacatgccgcagtacattttgcgcgagtttaaggtgacagatgccagagatgggcaatctcggaccgttaggcaattccagtttaccgactggcccgaacagggcgtcccgaaatcaggtgaggggttcattgactttatcgggcaggtgcacaaaacaaaggagcagtttgggcaggatggccctattagcgttcactgttcagcaggggtgggccgaactggggtgtttataactctctccattgtcctggaacgtatgcgctacgagggtgtcgtagatatcttccagaccgtcaagatgctcagaacacagagacccgcaatggtccaaaccgaggatgagtatcagttttgctaccaggcagctttagagtacctgggaagtttcgaccactacgccacctag

SEQ ID NO: 237178 - DNA, 5846 bp, Artificial Sequence
  Description of Artificial Sequence: Synthetic coding sequence
atggcccctacgtggggtcctggaatggtatcagtagtaggacctatggggttgcttgttgtccttttggtagggggatgtgccgcagaggaacccccaaggtttatcaaggaacccaaggaccagatcggcgtgagtggcggagtggctagttttgtgtgccaggctacaggagatcctaagcctcgtgtgacctggaacaaaaaaggaaaaaaggttaacagtcagaggttcgaaaccattgagtttgacgaaagcgctggggctgtcctgagaattcagcccctccggacacctcgtgacgagaatgtctatgagtgcgtcgctcagaactcggtgggggagataacagtgcacgcaaaactgaccgtccttcgcgaggaccagttgccgtctggcttccctaacattgatatgggaccccagttaaaggtggttgagcgtacaaggacagccacaatgctttgcgcggcatcaggcaatcctgacccggaaatcacctggttcaaggacttcctgccagtcgacccgtctgctagcaacggcagaataaagcagcttcggagcgatcaggcctttagccacttgccaaccggggctctccagatcgagtcatccgaggaaactgatcaaggaaagtacgagtgcgtggctaccaactccgcaggggtgaggtattcctcccctgcaaatctatatgtccgcgtgtggcgtacggtgaggagagtggccccaaggttcagtatcctccctatgagtcacgagatcatgcctgggggaaatgtcaacattacctgcgttgccgtgggcagtcctatgccatatgtgaagtggatgcaaggagccgaagatctaacccccgaagacgacatgcccgtcggacgtaatgtgctcgaattaactgacgtcaaagactcagccaactacacctgtgtggccatgtcctcactgggggtgattgaagccgtggcacagattaccgtcaagtccctcccaaaagccccagggactcccatggtgactgaaaacaccgccaccagtattaccatcacttgggattctggcaaccccgacccagtctcctactatgttatcgaatataagtccaaaagccaagatgggccataccagattaaagaagatataaccacgacaaggtactcaatagggggactctcaccaaacagtgaatacgagatttgggttagtgcagtcaactcgatcgggcagggccctccttcagaaagtgttgtcacacggacaggggaacaggcgcctgcctccgcccctagaaatgtgcaagctcgcatgctgagcgctaccactatgatagtgcagtgggaggagcccgtggaaccaaacggactgattcgcggttatagggtgtattacacaatggagcccgaacaccccgtcgggaactggcaaaagcataacgttgatgatagcctccttacaaccgtaggatcacttctggaagacgagacttatactgtgagagtgctggcctttacatctgtgggcgacggcccactgtcggatcccatccaggtcaagacacaacagggtgtgcccggacagcctatgaacctgagggcggaggcacgcagtgaaacttctataaccttgtcttggagcccccctcgtcaggagagtataattaagtacgagcttctgtttagagaaggggaccacgggagggaggtggggcgaaccttcgaccctacaaccagttacgtggtcgaggacctgaagccaaacaccgagtacgccttccggcttgcagcacgctcaccacaaggtctaggagctttcacaccagtcgtcagacagagaacactgcaaagtaaaccaagcgcccctcctcaggatgtgaaatgtgtgagcgtgaggagcaccgccatcctggtgagctggcgcccaccgcctccagagacacataacggggctctggtcggatactctgtcaggtacaggcctctgggaagcgaggacccagagcccaaagaagtgaacggtatcccacccacgactacacagatactactggaagcactggaaaagtggacccagtaccgaattaccaccgtggctcatacagaagtgggaccagggcctgagtcatcgcctgtggtggtccgcactgacgaggacgtgccaagtgctcctcctaggaaggtggaggcagaggccctgaacgccactgccatacgggtgctgtggcgctctcccgcaccaggcagacaacacggccagattcggggatatcaagtgcactacgtgagaatggagggggctgaagccagaggccctcccaggataaaggatgtgatgttggccgatgcccagtgggagactgatgataccgccgaatacgagatggtgattactaatcttcagccagaaactgcatactcaatcacggtcgctgcctacaccatgaaaggcgatggagctcggtctaagcccaaggttgtggtgacgaagggagcggtgctgggcagacctactttgtcagtccagcagaccccagagggatctctgttagctaggtgggagccacctgctggcaccgctgaggaccaagttctggggtatcggctgcagttcggtagggaagactctaccccgttggcaaccctggaattccctccttccgaagatcgttatactgcaagtggagtccataagggcgctacctacgtgtttagacttgcagcccgatctagggggggtttgggtgaggaagcggcagaggttcttagtatcccagaggacacccccaggggtcatccccaaatcctagaggccgcaggaaacgcctctgcagggacagtcctgctgcgctggctcccacccgtccctgccgaaaggaacggcgctatagtgaaatatactgtggccgtgcgtgaggccggtgcacttggtcccgctagggaaaccgaattaccagcagccgctgaacctggagctgaaaatgcattgacactccaaggtctgaaaccggacacagcatatgatctgcaggttcgggcacacacaagaagaggcccaggtccttttagcccacccgtgagatatcgcacattcttgcgcgatcaggtcagtccaaaaaacttcaaggtgaaaatgataatgaagactagtgtgttactgagctgggaatttcccgacaactataattcaccaaccccttacaaaatccagtataacggcctcacgctggacgtggatggtcggacgactaagaagttgattacccatttaaaaccacacacgttttataactttgtactcacaaatcggggaagttccctgggcggattgcagcagactgtaaccgcatggaccgcgtttaatctgctcaacggtaaaccaagcgtggcaccaaaacccgacgccgacggctttattatggtctaccttccggatggacaaagccccgtcccagtacagagctatttcatcgtaatggtccccttgcggaagtcaagaggcggacagtttttaacccccctgggttcccccgaagacatggatctggaggagttgatccaggacatttcccgcctgcaacgcagatccctgcgtcacagtaggcagctggaggtcccaaggccttatatcgcagctcgctttagcgtgcttcctcccacctttcaccccggagaccagaagcagtacggaggctttgacaatagagggctcgagccaggccataggtatgtcttatttgtgctggctgtgctccaaaaaagtgaaccaacgttcgccgcaagtcctttttcagacccatttcaactggataaccccgacccccagccgatagtggatggagaagaagggctcatctgggttattgggcctgtcctggcagtggtatttattatctgtatcgtgatcgccattttactttacaagaataagccagatagcaagagaaaggatagcgagccgagaactaagtgcctactgaacaacgcagatctggccccacaccatcccaaagatccggtggaaatgaggcgtatcaacttccagacccctgactcaggcttgagatctcctctgcgggaaccagggtttcacttcgagtctatgctgtcccaccctcctatccctatcgccgacatggcggaacacaccgagagactcaaggcaaatgacagcctaaaattgtctcaggagtacgaaagtattgatccaggccagcagtttacctgggagcattcaaaccttgaagtgaacaaaccaaagaaccggtatgccaacgtgattgcatatgaccacagtcgtgtgatactgcaacctatcgaagggattatgggtagtgattacatcaatgccaactacgttgatggctatagatgccagaacgcgtacatcgcaacacaagggccactgccagagacgtttggagacttctggcgcatggtgtgggaacaaaggtcagcgactatcgtcatgatgacacggctggaagagaaatcccggattaaatgcgatcagtattggccaaaccgaggaactgagacctacggttttatacaggtgacactgctggatactatcgaactggccacattttgcgtgcgtacgttttccctgcacaaaaatggctcaagcgagaaacgtgaggtcaggcaattccagtttacggcttggcctgatcacggagtgccggaataccctacccctttcttggcctttctccggagggtcaagacatgcaaccccccagacgctggcccaatcgtcgtgcactgttctgcgggtgttgggaggacaggctgcttcatcgtgattgacgccatgcttgagcggattaagcccgaaaagacagtcgacgtgtatggtcacgtcacattaatgcggtcacagaggaactatatggtgcaaacagaggaccagtactcttttatacatgaggccctcctggaagctgtgggttgcggtaacaccgaggtacctgcacgctcgctgtacgcctatatacagaaattggcacaagtggaaccaggcgagcacgtcacaggcatggagctggagttcaagaggttggctaattctaaagcccacacatcacgctttatctccgccaaccttccctgtaataaattcaagaataggctggtcaacattatgccttatgaaagcactcgagtttgtttgcagccgatccgaggtgtggagggttcagactatattaacgccagcttcattgatgggtacagacaacagaaggcgtatatagccacgcaaggcccactcgcagagacaactgaagacttctggcgaatgttatgggagaataactccactatcgttgtgatgctaaccaaactgcgggagatggggagagagaagtgtcatcagtactggccggctgagcggtccgctagatatcagtactttgtggtggaccccatggctgaatacaatatgccacaatatatcctgcgcgaatttaaggtcacagacgccagagatggccaatcccgcaccgtccgacagtttcagtttacagactggcccgaacagggggtgcccaaatcaggtgaaggtttcattgactttatcggacaggtgcataaaacaaaagaacagttcgggcaagacggacccattagcgtgcactgcagcgccggagtcggcagaacaggtgtcttcatcactctttccatcgtactggagcgcatgcgctacgaaggagtggtggacattttccagacggtcaagatgttgagaacacaaagaccagccatggtccaaaccgaggatgagtaccagttctgttatcaagccgcactggagtaccttgggtcatttgaccactacgccaccta

SEQ ID NO: 237179 - DNA, 4593 bp, Artificial Sequence
  Description of Artificial Sequence: Synthetic coding sequence
atggcaccaacatggggtcccggaatggtaagcgttgtggggcctatgggcctgctggtagttttgctggtcggtgggtgcgcagccgaagaacctccgagattcataaaggagcccaaggaccaaatcggcgtcagcgggggagtagcctcatttgtgtgtcaggcaaccggcgatccgaagcctcgcgtgacatggaacaaaaagggcaaaaaggttaatagccagagattcgagaccatagaattcgatgagagtgcaggtgctgtcctgaggattcagcccctgagaaccccccgagatgaaaatgtgtacgagtgcgtcgctcagaatagtgttggcgagattacagtccacgccaaactaaccgtgctgcgagaggaccagctcccgagcggatttcctaatatcgacatgggccctcaactcaaagtggtggaaaggacccggacagccacaatgctttgtgcagcttccggcaaccctgacccagaaattacctggttcaaagattttcttcctgtcgatccaagcgcatcgaacggcagaatcaaacaactgagaagcgatcaggccttcagccacctcccaacaggagccctgcagattgagagctctgaggagaccgaccaagggaaatacgagtgtgttgccacaaacagcgctggcgtcagatatagctctccagccaatctgtacgtgcgcgtgtggcgcacagtgcggcgagtcgcaccgagattttcaatcctgcccatgtctcacgagatcatgccaggcggaaacgtgaatattacctgcgtggccgtaggctcaccaatgccatacgtcaaatggatgcagggggcagaggacttgacaccagaggatgacatgcctgtgggcaggaacgtcctcgaacttacagatgtaaaggatagcgccaactatacgtgcgtggccatgtcttccctcggggtaatcgaggccgttgcccagataacagttaagagcctcccgaaggctcccggaaccccaatggttaccgagaacactgcaactagtataaccatcacatgggattccggcaaccctgaccctgtctcttactatgttatcgagtataaatccaagtcacaggacggcccttatcagattaaggaggacatcacaacaacaaggtactccatcggcggactgagtcctaatagtgagtatgagatctgggtgagcgccgtcaatagtatcggacagggcccaccatcggagtctgtggtaacacggacaggcgagcaggctcctgccagcgcccctagaaacgtgcaggcaaggatgctgtctgccacaacaatgattgtgcagtgggaagaacctgtggagcctaatggcctgattagggggtaccgcgtgtattacacgatggaacctgagcatcctgtcggcaattggcagaagcacaacgtagatgatagtcttcttacaactgtgggctcacttctggaggatgaaacgtatacagtcagggtccttgcctttacatcggtgggtgacgggccactcagtgatcccatccaagtcaagacacagcagggagttcctggtcagcctatgaacctgcgtgctgaagccagatctgagacttcaatcacactctcctggtcgcctccacggcaagagagcatcattaagtacgagcttctgttccgcgaaggagaccacggacgcgaagtggggagaaccttcgatcccaccacatcttatgtagttgaggacctgaagccaaacaccgagtatgcctttagactcgccgcacggagcccccaaggactgggcgcttttacgccagtggtccggcaacgtacccttcagagtatcagcccaaagaacttcaaggtgaaaatgatcatgaagacatccgtgcttctgtcctgggaattccccgacaactataattctccaacaccttacaaaattcaatacaacgggttgacactggacgtagacggaaggacaactaagaaacttatcactcacctcaaaccccacaccttttataattttgtgctgacaaaccggggtagctccttaggcggattgcaacagacagtgaccgcctggacagcctttaacctgctgaacggcaaacccagtgtagcgcctaagcctgacgcagacggattcatcatggtttacctccctgatggacagtcccccgtgcctgtccagagctatttcatcgtgatggtgccgctgagaaaatctagaggcggacagttcctcaccccactgggatccccagaagacatggaccttgaagagctgatccaggatatttcgagactgcagcgcagatccctcaggcattctcgccagttggaagtgccacggccatatatagccgcacgcttctcagtactgcctcctacattccaccccggtgaccagaagcagtacggaggcttcgacaataggggcctggagccaggtcatagatacgtgctgttcgtattggccgtcctgcagaagagtgaaccaactttcgccgcatccccgttctccgatccctttcagctggacaaccccgacccccagccaattgtggacggcgaggaaggcctgatctgggtcatcggaccagtgctcgccgtcgttttcatcatatgtattgtcattgcgattcttctgtacaaaaacaagcccgattcaaagagaaaggacagcgaaccgaggaccaagtgtctcttgaacaatgcagatttggctccgcaccaccccaaggatcctgtcgagatgcgcaggattaatttccagacacctgactctggactccgcagtcctctgagggagccgggatttcattttgaaagcatgctgagtcacccgccaattcctattgccgacatggccgagcatacagagcgactgaaggcgaatgactcccttaagttgagtcaagaatacgaatctatagatccgggacagcaattcacatgggagcacagcaatcttgaggtgaataaacctaagaaccgctatgcgaatgtcatcgcttacgaccattcgcgcgttattctgcagcccatcgaaggaatcatgggcagcgattacattaacgctaattacgtcgacgggtatcgatgtcaaaacgcttacatagcgacacagggaccactgcctgaaacctttggggatttctggcgaatggtatgggagcagcggtcagcaacaatcgttatgatgacccgcttggaggagaagtccagaatcaagtgcgaccagtattggccgaacaggggcacagagacctacggcttcattcaggtgacactacttgacactattgaactggctaccttttgtgtccgaaccttctctctacacaagaacggatcaagtgaaaagcgagaggtacgccaattccagttcaccgcttggccagaccacggagtgcccgaatatcccacacctttccttgcttttcttaggcgcgtcaagacctgtaatccacccgatgccggacccattgtggtgcactgttccgctggggtgggccgtactggatgcttcatcgtgattgatgccatgctggaaagaataaaacccgagaagaccgtggacgtgtatggacatgtgacactaatgcgttctcagcgcaactatatggttcagaccgaggaccagtatagcttcattcacgaagcgctgctggaggccgtgggttgtggcaacacagaggtacctgctcgcagcctgtatgcatatattcaaaagctggctcaggtcgagccaggggaacatgtcaccggaatggagctggagttcaagagacttgccaattccaaagcccatacctcgagattcatatcagccaaccttccatgcaataaatttaagaataggcttgtgaatataatgccctacgagagcactcgggtatgtcttcagcccatccgtggagtagaggggtccgattatattaacgcctcctttattgacggctaccgtcagcagaaggcctacattgctacacaggggccactggccgaaaccaccgaggacttttggaggatgttatgggaaaataactcaacaatcgtggtgatgctgacgaagttaagggagatgggccgtgagaagtgtcaccagtactggccagccgagcgatccgctagatatcagtatttcgtcgttgaccctatggccgagtacaacatgccccagtatattctgagagagtttaaggtcactgatgcacgcgacggccagtcccgaacagtgcggcagtttcagttcacagattggcccgagcagggggtgcctaagagtggggagggatttatcgatttcatcggacaggtgcataagacgaaagagcagtttgggcaggacggcccaatcagcgtacattgttcagctggggtgggcaggacgggggtatttatcacgttaagcatcgttctagaaagaatgaggtacgagggagtggtggatatctttcaaacggtaaagatgctccgaactcagagacccgctatggtgcagacggaggatgagtaccagttctgctaccaggccgcattggagtatctgggttcctttgatcactacgctacctag

SEQ ID NO: 237180 - DNA, 5819 bp, Artificial Sequence
  Description of Artificial Sequence: Synthetic coding sequence
atggctcccacctgggggcctggtatggtttcagtggttggaccgatgggcctcctggtagttctcctggtgggcggttgtgccgctgaagaaccacccaggttcattaaagaaccgaaagatcagataggggtgtcgggaggagtagcgtcattcgtatgtcaggccactggagaccctaaacccagggtgacgtggaacaagaagggaaaaaaggtgaacagccaaaggttcgagacgatagagttcgacgaatctgctggggcagtgctcaggattcagccgttgagaaccccacgagacgagaacgtctacgagtgtgtagcacaaaacagcgtaggtgagatcaccgtgcacgcaaaacttactgtcctcagggaggaccaactgccatcaggcttccccaatatcgacatgggtcctcaattaaaggtggttgagcgaaccagaacagctacaatgttgtgcgccgcttccggcaaccctgacccagaaattacgtggtttaaagatttcctgccagtggatccctcagcctctaatggccgaatcaagcagctcagatccgatcaggccttttcacaccttcctaccggcgcattgcagattgaatcgtcggaagagacagatcagggtaagtatgagtgtgttgctacaaactctgccggagtgcggtactcctctcccgcaaacctgtatgttagagtctggcggacagtaagacgggtggccccaaggttttccattctgcctatgtctcatgaaataatgcctgggggaaacgtgaatattacatgcgtggcagttggatctccaatgccctacgtgaagtggatgcagggcgcagaggatctcacgcccgaagacgatatgccagtgggacgaaacgtgcttgaactgaccgacgtgaaggattctgcaaattacacgtgtgtagccatgagctcgctgggggttattgaagccgtggcccagattaccgtgaaaagtctcccaaaggcgcctggtacgcccatggtcaccgaaaataccgccacatccataaccataacttgggacagtggtaaccccgaccccgtgagttactatgtcatcgagtacaaatcaaagtctcaggatgggccttatcagattaaggaggacattacaaccacccgctactctatcggtggtctcagtcctaatagcgagtacgaaatctgggtatcagccgtgaacagtattgggcagggtcccccaagtgaaagcgtcgtcaccagaaccggagagcaggcccctgctagtgcccctagaaatgtgcaggctcgcatgctaagtgcgactaccatgatcgttcagtgggaagaacctgtagagcccaacggacttatccgcggttatcgcgtgtactataccatggaaccagagcaccctgtgggcaactggcagaagcataatgtggacgatagcctgctgacaaccgtgggctccctgcttgaggacgagacatacactgtgagagtgcttgcctttacctctgtgggtgacggtcccctgtccgatcccattcaagtgaaaacccagcagggcgtgccgggtcagccaatgaatctccgggctgaggcacggtccgagacctcaatcaccctgtcctggtccccacccagacaagagagcatcatcaagtatgagttgctgttccgagaaggtgaccatgggcgtgaggtcgggagaacgttcgaccccacgacctcctatgtggtcgaggacttaaagcccaataccgagtacgcctttagactggcggctaggtcaccacaaggtcttggcgcttttacacccgtggtacgccaaaggacactgcagagtaagccctcagcacctccccaggatgtcaagtgtgttagcgtgcggtctacagcaatcttagtgtcatggcgcccacctcccccagagacacacaacggcgctctggtgggatactctgttcggtaccgacctttaggctctgaggatcccgagccaaaagaagtgaacggcattcctccaaccacaactcagattctgcttgaggcactagaaaagtggacacagtacaggataactaccgttgcccacaccgaggttgggccaggtcctgaaagtagccctgtggtggtacgcaccgatgaggatgtgcccagtgcccctcccaggaaggtcgaagccgaagccctcaacgctactgctatacgggtcctgtggaggtcgcccgctcctggtagacaacacggccaaataaggggttaccaggtgcactatgtgcgaatggagggagccgaagcccgaggcccaccgcgaatcaaggatgtcatgctcgcggatgcccaggaaatggtgatcacgaatctccagccagaaactgcttatagcattacggtggctgcatataccatgaaaggcgatggagccagatccaagcctaaggtggtcgtcacaaaaggcgcagtgctaggtagacctactctgagcgtgcagcagacaccggagggctccttactcgctcgatgggagcctcctgcagggacagctgaagaccaggttctggggtataggctgcagtttggcagggaagattccactcccctagcaactctggaatttcctccgagcgaggatcggtatactgcttcaggcgtgcacaaaggagcgacttatgtatttcgcttggccgctcgttccagaggcggactgggggaggaagcagctgaggttctctctatacccgaggataccccgcgaggccatccccagatcctggaggccgcaggaaacgcaagtgcaggcactgtgctgctgcgctggctgcctccagttcctgctgaaagaaacggggctatagtgaaatacactgtggcagtccgcgaggctggcgcactagggccagctcgcgagactgaactgccagccgcagctgagcccggtgctgaaaacgctctcacactgcagggtcttaagcctgatactgcctacgatctgcaggtgcgagcacacaccagacgcggtcccggaccattcagtccacctgtgcgttaccgaaccttcctgagagaccaagtctctccaaagaacttcaaggttaagatgatcatgaagacgagcgtgctgctaagttgggagttcccggataattacaattctccaaccccttacaaaatccaatacaatggtttgacgctggatgtggatggcagaacaaccaagaaattgataacccatctcaagccccacaccttttacaatttcgtgctgaccaaccgaggctcatccctgggcggattgcagcagactgtgactgcatggacagcttttaacttactaaacggcaagccttcggtggctcccaagcccgatgcggacggttttattatggtatatctacctgacgggcagtccccagtgcctgtacagagctatttcatcgtaatggtccctcttaggaagtcacgagggggacagttcctcactccactcggttctcctgaggatatggacttggaagagctcatccaagacatcagtagactgcagaggcggtccctacggcactccagacagctcgaagtgccacggccatacatagccgcaaggttcagcgttctgccaccgaccttccaccctggagatcagaaacagtatgggggattcgacaaccgaggactcgagccagggcatagatatgtactttttgtcctggccgtgctgcagaagagcgaacctacgttcgcagccagtcccttcagtgacccctttcagctcgataaccctgatccccagccgatcgtcgatggtgaggaggggctaatatgggtgatcggtcctgtgctcgccgtggttttcataatatgtatcgttatagccatcctcctatataagaacaagccagatagtaaacggaaggattctgagcctcggactaaatgtctgctgaacaatgctgatctcgcacctcaccaccctaaggacccagtagagatgagaagaattaactttcagacacccgatagcggcctcagatccccgctgcgcgaaccgggatttcacttcgagtccatgcttagccatcctcctattcctatcgccgacatggccgaacacacagaacgacttaaagccaacgacagtctgaaactgagtcaggagtacgaatctattgaccctgggcagcagtttacctgggagcactccaatctggaggtaaataagccaaagaatagatatgctaacgtgatcgcatacgaccactccagagtaatcctgcaaccgatcgagggcatcatggggtcagactatataaacgcaaattatgtagacggttacagatgccagaacgcttacatcgccacccaggggcctctaccagagacattcggcgatttttggaggatggtatgggaacagagatctgcgactatcgttatgatgacccggctggaggaaaaaagccgaataaagtgcgaccagtattggccaaaccgaggcactgaaacttacgggtttatacaggttacgctacttgacactattgaactcgcgactttctgcgtccgtactttctccttacacaaaaatggcagcagcgagaagagggaagtcaggcaattccagttcacagcttggcccgatcacggagttcctgagtaccccacaccttttctggccttcctgcgacgtgtgaaaacatgtaacccccctgatgcagggcctatcgtcgttcactgcagtgccggagtggggagaacaggctgcttcatagtgatcgacgcaatgctggagcggattaaacctgagaagaccgtagacgtatacggtcatgtcacgcttatgagatcccagagaaattacatggtgcagaccgaagaccagtactcgtttatccatgaggcgctactggaagccgtgggatgtggtaatactgaggtaccagcccgatctctctacgcctacatccagaaactggcgcaggtggaaccaggggagcacgtcacgggtatggaactagaatttaaacggctggcaaactctaaagctcatacatccaggttcatctcagccaatcttccctgtaataagtttaagaatcggctggtcaatattatgccctacgaaagcacacgcgtatgtctccagccaattcgcggagtagaaggctctgattatatcaatgccagcttcatcgacggatatcgccaacagaaggcttacatcgccacccaagggccattggctgaaactaccgaagatttttggcggatgctttgggagaacaacagtaccatcgttgttatgctcacgaagttgagggagatgggcagggaaaagtgtcaccagtattggcccgctgagaggagtgccagataccagtatttcgtagtggaccctatggccgaatacaatatgcctcaatacatcttgcgcgagttcaaagttactgatgcaagagacggtcaatcccgcacagtccgacagtttcaattcaccgactggcctgagcagggtgtaccaaaaagcggtgaaggttttatcgattttatcggccaggttcacaagacgaaggaacagttcggtcaggacggtccaatctctgtgcactgttccgcgggtgtgggcagaaccggagtgttcatcaccctatcgattgtgcttgaaagaatgaggtacgagggagtcgttgacatattccagaccgtcaagatgctgagaacccagcgcccagctatggtgcagacggaagatgagtatcagttctgctaccaggccgctttagaatatctgggttcattcgaccactatgcaaccta

SEQ ID NO: 237181 - DNA, 5846 bp, Artificial Sequence
  Description of Artificial Sequence: Synthetic coding sequence
atggctcctacttgggggccagggatggtcagtgtagttgggccaatgggcctgctagtagtcctcctggtcggtggatgcgccgcagaggagccaccaaggtttatcaaagagcccaaagatcagataggcgtgtccggaggcgtggccagctttgtgtgccaggctactggcgatccgaagccacgcgtaacctggaataagaaaggcaagaaagtgaactcccaacggtttgaaacaatagagtttgacgagagtgcaggggctgtcctccggattcagccactgcgcactcctcgggatgagaacgtttacgagtgtgtcgcccagaatagtgtcggggaaatcaccgttcatgccaagctaacagtgctgcgggaagaccagcttccttcaggctttccaaatattgatatgggaccccagttaaaagttgttgagcgcacacgaactgcaactatgctgtgtgcagcctctggcaatcctgatccagagattacatggtttaaagattttctgcccgtggacccctctgcgtctaatggcaggattaagcaactgaggagtgagactttcgaatccacccctatccgcggagctctgcagatagaatctagcgaagagacagaccagggaaaatacgaatgcgttgccaccaattccgctggcgttagatattcaagccctgctaatctttacgtccgcgagctcagagaggtacggagggtagctccaagattttcaatcttacctatgtcgcacgagattatgccaggtggaaacgtgaacatcacctgcgtggctgtgggctcacctatgccttatgtgaagtggatgcagggagctgaggacttaacacccgaagacgacatgcccgtcggtaggaatgttctggagctgactgatgtgaaggactccgccaactacacttgtgttgctatgagctctttgggggttatcgaagctgtggctcaaatcacagtgaagagcttgcctaaggccccaggtaccccgatggtgaccgaaaacaccgctacctccattacaattacgtgggacagcggtaatccagacccggtcagctattatgtgattgagtacaaatccaagtctcaggacggaccttatcagataaaggaggatattaccactacacggtactccatcggtggactgtctcccaacagtgagtacgaaatttgggtctcagctgtcaactctatcgggcaaggtcccccatctgagagcgtagtcaccaggacaggggagcaagcgccagcaagtgcgccacgcaatgtccaagctcgcatgctcagcgccacaactatgattgtgcagtgggaagagcccgttgaacccaacgggctgatccgcggatatagggtctactatacaatggaacccgaacaccctgttggcaactggcagaaacacaacgtcgacgatagcctcttgaccacagttggttctttgctggaggacgaaacttatacagtgcgggtactggcgtttacatctgtcggtgatgggccactgagtgatccaattcaagtcaagacacagcagggcgtcccaggacagcccatgaacctccgcgctgaggcacggtcggaaacctcaattacgctgtcttggtccccgccacgccaagagtccataattaaatatgagctcttatttagggaaggagatcatgggagagaagtaggcagaacattcgatcctaccacttcatatgtcgtggaggatttaaaaccgaatactgaatacgcctttcggctggcagcgagatcgccacagggcctgggcgctttcacaccagttgttagacagcgaactctgcagtctaagccatcagcccctcctcaggatgtgaaatgcgtttccgtgcgcagcactgctatactggtttcttggagaccccctccacctgagacgcacaacggagctctggttggctattcagttagatatagacctctggggtcagaggaccccgagccaaaggaggtgaatggaattccacctacaacaacgcagattctcttagaagccctggagaagtggacccaataccgtattacaaccgtagctcatactgaagtgggtcctggaccagagtctagtcctgtggttgttaggactgatgaagacgtgccttctgcccctccacgcaaggtcgaagccgaggctctgaatgcaacagctattagagtgctgtggcggagcccagctccgggacgtcagcacggccagatccgcggatatcaggtccattatgtgcgtatggagggggctgaggcaaggggacctccacgcatcaaggatgtcatgcttgcggacgcacagtgggagaccgacgatactgccgagtacgagatggttattactaacctgcagcccgagactgcatactccattactgttgccgcttatacaatgaaaggggacggtgccaggagtaaaccaaaagtagtcgtgaccaagggcgcagttcttggccgtcctacccttagtgtccagcagacgcccgaaggctcactcctggccaggtgggagccccctgccggaaccgcagaagaccaagtactcggatacaggctccagttcggcagggaagactcaacacctcttgccacgcttgagttcccacccagcgaagaccggtacaccgccagtggagtacacaagggagctacttacgtcttccgactggccgcaagaagccggggaggcctcggtgaggaggccgcagaggtgctctctattcccgaagacaccccgcgtggccacccacagattcttgaggccgctggcaacgctagtgccggaaccgtgcttttacgttggctgccccctgtgcccgctgagagaaatggagcgatcgtgaaatatacggttgctgtaagagaggcaggggcactgggccctgcaagggagacggaactccccgctgccgctgagcccggagccgaaaatgcactaactctgcagggactgaagccagatacagcctacgatctgcaagtcagagcccacacgagaagaggccctggcccttttagtcctccggtccgatacagaacttttctgcgagaccaggttagtcctaaaaatttcaaagtgaagatgatcatgaaaacctccgtgctgctcagctgggaatttccagataactacaattcccccacaccttacaaaatccagtataatggcttgacactggacgttgatggacgaaccactaagaagcttatcactcatttaaaacctcacaccttctacaatttcgtcctgacaaaccggggaagctcgctcggaggcctccagcaaactgttacggcttggaccgccttcaatttgctcaacggaaaaccaagcgttgcacccaagccagatgcagacgggttcatcatggtgtatctgcccgacggtcagagcccagtgcccgttcagtcctactttattgtgatggtgccactaagaaaaagccgcggtgggcagtttttaacccctctgggaagtcctgaagatatggaccttgaggaattgatccaggatatctcccggctgcagaggcgatccctcaggcactcacgccagcttgaggtgccaaggccctatattgcagccagatttagtgtgctgccccctacgtttcatcctggtgatcagaagcaatacggagggtttgacaatagaggcctggagccgggacaccggtatgtcctttttgtgcttgctgtcctgcagaaatctgagcccacattcgcagcatctcccttcagtgatccattccaactggacaatcctgaccctcagcctatcgtcgacggtgaggagggccttatttgggttataggtcctgtgctggcagtagtgttcataatttgtatcgttatcgcaatactcctgtacaagaacaaaccagattctaagcgtaaggactccgaaccgagaactaagtgcctgctgaacaacgcagatctcgctccacaccacccaaaagacccagttgaaatgcgccgtatcaattttcagacaccagactctggtttgcgctcccctctaagggaaccaggtttccactttgagtcaatgcttagccacccacccattcccatcgctgacatggccgagcacactgagcgcctcaaggcaaacgatagcctgaagcttagtcaggaatacgaatccattgaccccggtcagcagtttacttgggagcattccaaccttgaggtcaataagcccaagaatcgctacgcgaacgttatcgcgtatgatcattcccgagtcattctgcaacctattgagggtatcatggggagcgattatattaacgcaaattatgttgacggatacaggtgccagaatgcctatatcgccacccaaggccctctgcctgagacctttggtgatttttggcggatggtttgggagcagaggtcggctaccatcgtgatgatgacaaggctcgaggaaaagagtcgcatcaaatgtgatcaatattggccaaaccggggtactgaaacttatgggtttattcaggtgaccctcttggacacaattgaactagccacgttttgtgtaaggacattctctctgcacaagaatggcagttcagaaaagagggaagtccggcagttccagttcactgcctggcccgaccacggggtaccagaataccctactccctttctcgctttcctaagaagagtgaagacatgtaaccctcctgatgcaggtccaatagtggttcactgcagcgctggcgttggacgaacaggttgctttattgtcatagacgcgatgctggaacgcatcaaacccgagaagacagtagatgtgtacggccatgtgaccttaatgcgtagtcaacggaactacatggtccagaccgaggaccaatatagttttatccacgaagccttgctagaagcggtaggctgcggcaatacagaggtacccgctcgttccctttatgcttatattcaaaagttggcccaggtcgaaccaggcgaacatgtcactggtatggagctggagttcaaaaggttagctaacagtaaggcacatacctcacgtttcatttctgcgaacttaccctgcaataagttcaaaaaccggcttgtaaatatcatgccttatgaatccactagagtttgcttgcagccgatccgtggtgttgaaggctccgattacatcaacgcttctttcatcgacggttaccgccaacagaaagcatacattgcaactcagggacccctggccgaaacaaccgaagacttctggcgcatgttatgggaaaacaatagtacaatcgtcgtgatgctcaccaagctcagagaaatgggtcgcgaaaaatgtcaccagtattggccggctgagaggagcgccagatatcagtatttcgtcgtggaccccatggcagagtacaacatgccacaatatatcctgcgcgaatttaaggtgactgacgccagagacggccagagcagaacagtccgccagttccaattcaccgactggcccgaacaaggtgtgccgaagagcggggaggggtttattgatttcatcggacaagtgcacaaaacaaaggagcagttcggacaggacgggcctatttcagtccactgctccgccggagtgggcaggaccggtgtatttattaccctgagcattgtcttggagcgtatgcgctacgagggagtggtagacatctttcagaccgtcaaaatgctgcgcacacaacgcccagcaatggtgcagactgaggatgaatatcagttttgttaccaagccgcactggagtacctaggaagcttcgaccactacgcaacata

SEQ ID NO: 237182 - DNA, 5849 bp, Artificial Sequence
  Description of Artificial Sequence: Synthetic coding sequence
atggccccaacctggggcccaggcatggtgtccgtggtaggcccaatgggtttactggtggtgctgctcgtcggtggatgcgcagcggaagagcctcctcgctttattaaagaacccaaagaccagatcggcgtctctggtggcgtggccagcttcgtttgccaggcaaccggagaccccaagccccgagtgacatggaacaaaaaggggaaaaaggtgaactctcaaagattcgagaccatcgagttcgacgaatccgccggagccgttctgcggattcagcctctgaggacaccaagagatgagaacgtgtatgagtgcgtggcccagaacagtgtgggagaaatcaccgtgcacgctaaactgaccgtgctaagggaagaccagcttccatctggttttccgaatattgatatgggaccccagcttaaagtcgtggagcggaccaggaccgccactatgctgtgcgccgctagtgggaaccccgatccagaaatcacatggttcaaggattttctacctgttgacccaagcgcctctaacggcaggattaagcagttgcgcagatccgaaacctttgagtctaccccgatacgcggagcactgcagatcgagagctccgaggagactgaccagggcaaatacgaatgtgtggcaacaaatagcgctggcgtgcggtattcaagtcctgcaaacctatacgttcgggagctgcgggaggtgagacgcgtcgccccaagattcagtatcttgcccatgagtcatgaaatcatgcctgggggtaacgttaacatcacgtgtgttgcagtgggatcacccatgccatacgtgaagtggatgcagggtgccgaggatctgacccctgaggacgatatgcctgtgggaaggaatgttttagagctgacagatgtgaaggacagtgccaattatacgtgcgtggcaatgagcagccttggagtgattgaagccgttgcccagatcactgtcaagagcctgccaaaggctcctgggacaccgatggtgactgaaaacacggccaccagcatcacaataacttgggatagtgggaacccagatcccgtatcctattatgtgatcgaatacaagtccaaatctcaggacggcccttaccagataaaagaagatatcacgactaccaggtactcgataggcggtctgagccccaatagcgaatacgagatttgggtttctgcagttaacagtataggtcaggggcctccctcggagtccgttgtcacccgcactggagaacaggcccctgctagcgcacccaggaatgtacaggccagaatgctctcagcaacgaccatgatcgttcaatgggaggagcccgtggagccaaacggcctgatcagagggtacagagtgtattatacgatggaaccagaacaccctgtgggtaactggcagaagcacaatgtcgatgactctcttttaactaccgtggggtcacttctggaggatgaaacctataccgtacgggtgcttgcatttacaagtgtgggggatgggcctttaagcgatccaatccaggtgaaaacgcaacagggcgtgcccggtcaaccaatgaaccttagggccgaagccaggtccgagacctccatcacactcagctggtccccacccagacaagagtcaattataaagtatgaactgctgtttcgggagggggaccacgggagggaggtcggaagaactttcgacccaaccacaagttatgtcgtggaggatctcaagccgaatacagagtacgcattcaggttagccgctagaagccctcagggactgggcgctttcacccctgtggtaagacagcgaaccctacagtccaagccaagtgctcccccacaggatgttaaatgtgtgtccgttaggtcaacagcaatactggtcagttggaggcctccccctcccgagacgcacaacggcgcactggtgggttattccgttcggtacagacccctgggatcagaggatccagagcccaaagaggtgaacggaatccctcccactaccacacagatcctcctcgaggctcttgagaagtggacccagtatagaataactacagtggcccatacagaggttggacctggcccagaatcctcccccgtcgtggtgcgaacagacgaagatgtgccttctgcacctcctcgaaaggtggaagcggaagctctgaacgccacagctattagggtcctctggcggagcccagcgcctggcagacagcacggccaaataaggggctatcaggtccattacgtacgtatggagggtgccgaagctagagggccaccgcgtattaaagatgtaatgttggcagacgcacagtgggagactgatgatacagctgagtacgagatggtgataaccaatcttcaacctgagaccgcttacagcatcaccgtggcagcgtacaccatgaaaggggacggcgcacggagtaagccaaaggtggttgtgacaaagggggctgttcttggtcgaccgaccctttccgtgcagcaaactccggagggatccctgcttgccagatgggagccaccagctggcaccgctgaggaccaggtgttgggctataggctgcagtttgggagagaagattccactcctctcgccacgctggagttcccaccatccgaagacagatataccgctagcggggtgcacaaaggcgcaacttacgtgtttcgcttggccgctcgctccagaggcggtctgggcgaggaggctgctgaggtgctctcaatacctgaagatacgcctcggggtcatccacagatcctggaagccgcaggaaacgcatctgccggtactgttctgcttcggtggctacccccagttcccgctgagcggaacggcgctattgtcaagtataccgtggcagtgagagaagcgggagccctcgggccagccagagagactgagctccctgccgcagcagagccgggagccgagaatgcgctgaccttacagggcctgaaaccagacacagcatacgatctgcaggtgagggcgcacacaaggcgaggacccggacctttttccccccctgtgcgatatcgcacctttctgcgtgaccaagtttcacccaagaactttaaagtgaaaatgattatgaaaacctccgtgctgttgagttgggagttcccagataactacaacagtccaactccctacaagatacaatataacgggctgacacttgacgtagacggcaggaccacgaagaaacttatcacacatcttaagcctcacacattttataatttcgtgctcactaatcggggtagtagtctggggggactgcagcagactgtgaccgcctggacagctttcaacctgcttaacgggaaaccttctgtggctccaaaaccagatgcagatggttttatcatggtgtatctgcccgatggccaatctccggtcccagtccagtcgtacttcatagttatggtgccattaagaaagtcaagaggcggacagttcctgacgcccctgggatcccccgaggatatggatttagaagagctgatccaggatatttcaagactgcagaggcgatcactgagacatagcaggcaactggaagtgcccaggccgtacatcgctgcacgattcagcgtgcttccaccaacatttcaccccggagaccaaaaacagtacggaggttttgataacaggggtctcgagccaggacaccgatacgtgctgttcgtgctggccgtgttacagaaatctgagcccacctttgcggcatcaccgttcagcgatcctttccagctggacaaccctgatccacaacccattgtcgacggggaggaagggctgatctgggttatcggcccagtgctggcagtggtgtttatcatttgtatagtgatcgccatcctcctgtataagaaaaaaccccacagcaagcggaaagattccgaacccaggactaagtgtttgctcaataacgcagatctcgccccacaccatcccaaagatcctgttgaaatgaggcgaattaatttccagaccccagactccggactgagaagcccccttagggaacccggattccactttgagagcatgcttagtcacccacccatccctatcgccgacatggccgagcacactgaacggctcaaggcaaatgacagcctgaagctcagccaggaatatgaatccatcgaccccggtcagcagttcacatgggaacactcaaatctggaggttaacaagcctaaaaaccgatatgcaaatgtaattgcctacgatcactctcgcgtgatcttacagccaatcgagggcatcatgggttcagactacataaatgccaactacgtcgatggctatcgctgtcagaatgcatacatagcaacccaaggaccgctccctgaaactttcggggatttttggaggatggtttgggagcagcgatcggctacaatcgttatgatgacaagactggaggagaagtcccgaataaagtgtgatcaatactggcctaatcgcggtactgagacatacgggttcatccaggttacactgctggatactatcgaactggccactttctgcgttagaacattcagtctgcataaaaatggttcctccgagaaacgtgaggtacggcaatttcagtttactgcctggccggaccatggggtgcctgagtacccaactcccttccttgcatttcttaggcgagtgaaaacatgtaacccacccgacgcaggtcccatcgtcgtccattgtagcgcaggggtggggcgtaccggctgtttcattgtgatcgacgccatgctggaaagaatcaaacctgagaagacggtagatgtgtatggtcatgtaacgcttatgcgatcacaacgcaattatatggtgcaaacagaagaccagtactcttttatccacgaagcccttctagaggctgtgggatgtggcaatactgaggtccccgctcgctcactgtacgcctatatccagaaacttgcacaggtggagcctggcgaacatgtgacaggaatggagctggagtttaagaggttggcgaactccaaggctcatacgtccaggtttatttccgccaacctcccttgtaataagtttaaaaaccgccttgtgaacatcatgccctacgaatcgaccagagtgtgtctccagccaatccgaggagtggagggatctgattacatcaatgcctccttcatcgatgggtaccgacagcagaaagcgtatatcgcgactcagggccctttggccgagaccaccgaagacttttggcgaatgttgtgggaaaacaactctacaatcgtcgttatgttgactaagttgcgagaaatgggtcgagaaaaatgccaccagtattggcccgcagaacggtccgcacgctaccagtacttcgtagtcgacccaatggccgaatacaatatgccgcaatacatcctgcgtgaatttaaggtgaccgatgccagggacggtcagagcaggaccgttaggcagttccagttcactgattggcccgagcagggtgtccctaagagcggagaaggatttattgattttattggccaagtgcataaaacaaaagaacagttcggccaggacggcccaatttccgtccactgtagtgccggagtgggccgtactggcgtgtttataacgctcagtatcgtgcttgagcgcatgaggtacgaaggagtggtggacatcttccagaccgttaagatgctccgaacacagaggcccgctatggtgcagacagaggacgaataccaattctgctaccaggctgccctggagtacttggggtcatttgatcactacgcgacata

SEQ ID NO: 237183 - DNA, 4683 bp, Artificial Sequence
  Description of Artificial Sequence: Synthetic coding sequence
cgcagcgcgagaggcctgagtgtcagagaccgaggtgccatcccacttcaaggaggggacaggaggtccttaccttccatggctccaacatgggggcctggcatggtgtctgtggtgggaccaatgggcctgcttgttgttctccttgtgggtggttgtgcggcagaagagcctccacgctttattaaggagcccaaagatcagatcggcgtctcagggggtgtggcctcatttgtgtgtcaggctactggcgaccccaaaccaagggtaacctggaacaagaagggcaagaaggtgaattctcagcgttttgagaccatcgaatttgacgagtctgcaggggctgtgttgcgtatccagccacttagaaccccccgagatgaaaatgtttatgagtgtgtggcccagaattctgttggcgagataacagtgcacgctaaacttacggtactgagagaggatcagctccccagtgggttcccaaacattgacatgggtccccaactcaaagtggttgagcgcacgaggaccgcgacgatgttgtgtgctgccagtggaaatccggatccagaaattacctggttcaaagattttcttcctgtcgatccttctgcaagtaacggcagaattaagcagctccgctcaggggctctgcagattgagtcatccgaggagacagaccagggaaagtatgagtgcgtcgccacgaattccgccggtgtgaggtactccagccctgcaaatctgtatgtgagggtacgcagagtggccccaaggttctctattctccccatgtcacacgagatcatgcctggaggaaatgtcaatattacttgcgtagccgtagggagtccaatgccctatgtgaagtggatgcaaggtgcagaggatctcactccagaggatgatatgcctgtgggcagaaatgtgcttgagttgacggacgtgaaggatagcgccaattatacatgcgtggccatgagtagtctcggggtgatcgaggccgtggctcagatcactgtgaagtctttacctaaagccccaggaaccccaatggtgacagagaatacagccacatctattaccattacatgggactccggtaatcctgaccccgtctcttattacgttatagagtacaagagtaagtcgcaagacggaccttatcagataaaggaggatatcaccactacacggtactcgattgggggactcagccccaatagcgagtatgagatctgggtatcagccgtcaattccataggtcagggccctccgtcggaatccgtggtgacccgtactggggagcaagcccctgcttccgccccaagaaacgttcaggccaggatgctcagcgccacgacaatgatagtacagtgggaagaacccgttgaacccaatggcctgattagaggatatagggtgtactataccatggagcctgagcaccctgttgggaactggcaaaagcacaatgtcgacgactctctcctgacaacagtaggttcattactcgaggacgagacgtacacggttcgagtgctcgcctttaccagcgtgggcgatggcccattgagtgaccctatacaggtcaagacccagcagggtgttccaggccagccgatgaacctgagagctgaagctagaagtgagacgagtatcactttgtcctggtctccgcctcgccaagagtccatcattaaatacgagcttttgtttcgtgagggcgatcatggcagagaagtggggaggacttttgaccccactacaagctatgtggttgaggatctaaagccgaatactgagtatgcattccgtttggccgctcgtagccctcagggcctgggagcattcactccagtcgtgaggcagagaactctccaaagcatttccccaaagaatttcaaagtcaagatgatcatgaaaaccagcgtcctactgagctgggagttccctgacaactataactctcctacaccctacaagattcagtataacggcctcacactcgatgtagacgggagaactactaagaagttgattacccacttgaaacctcacaccttctataactttgtcctaactaataggggcagttcgctcggcggactgcagcagacagtgacagcatggaccgcctttaatctgctcaatggcaagccgtccgttgcacctaagccagatgctgacggctttatcatggtgtatttgccggacgggcagagccccgttccggtgcagagttacttcatcgtgatggttccactcaggaagagcaggggtggccagtttctgacgcccctcggaagcccagaagatatggatctggaggagctaatacaggacatctccaggctgcagaggcgctctttgcggcatagtcggcagttggaggtgccacgcccatacattgctgctaggttttcggtgctgccacccacatttcacccgggagatcaaaagcagtacgggggtttcgataaccgcggtctcgagcctgggcataggtacgtgctatttgtgctggctgtgttgcagaaaagcgagcccacgtttgctgccagccctttcagtgatccttttcaattggataaccctgatccacagcccatcgtagatggcgaggagggactaatctgggttatcggtccagtactggccgtcgttttcatcatctgtatcgtcatcgccattttactctataaaaacaaaccagactcaaagcggaaggacagcgagcctcggactaaatgcctgcttaataatgctgacctcgctcctcatcaccccaaggatccagtggagatgcgaaggatcaattttcaaacccctgacagcggattaaggagcccactaagagagcctggttttcactttgaaagtatgctcagccaccctccaattcccatcgccgatatggcagaacacacagagaggttgaaagcgaacgatagcctgaagctgagccaagagtacgaaagcattgacccaggccagcagttcacttgggagcactcaaatcttgaagtgaacaagcccaagaaccggtacgccaacgtgatcgcttacgaccacagcagagtaatcctccagcccattgagggaatcatgggcagtgactatattaacgctaattacgttgacggttaccgctgtcaaaatgcgtacattgccacacaaggacccctgccggagacctttggagacttttggaggatggtctgggagcagcgtagcgctaccatagttatgatgacgcggctggaagagaaaagtcggattaaatgcgatcagtattggccgaaccgtggtaccgaaacatatggttttattcaagtgactcttctggacacaattgagctagcaacattctgtgtgaggacgttttccttacacaagaatggctcatccgagaagcgcgaggtacgtcaatttcaatttaccgcatggccagatcatggagtccccgaatatcccacgcccttcctggcctttcttaggagagtgaagacctgcaatccgccagacgcaggtcccattgtggtacattgcagtgcaggtgtagggagaactggttgttttatagtcatcgacgctatgcttgaacgcattaaacccgagaaaaccgtagacgtgtatgggcatgttacactgatgcggagccaaaggaattatatggtacagactgaggatcaatactccttcatccacgaagcacttttggaggccgtgggatgtggaaatacagaggtgccagctcgatcactttacgcctacatccagaagttggcccaggtggagccgggtgagcacgtgaccgggatggaattagagtttaagaggttagccaatagtaaggcgcacacctctcgctttatcagcgctaatctgccatgcaataagtttaagaacaggctagtgaatatcatgccctatgagtcaaccagggtttgcctgcaacctattaggggcgtggagggtagtgactatattaatgcttcgttcatagatggctatcgccaacagaaggcttacattgcgactcaggggcctctggctgagacgactgaggatttctggagaatgctgtgggaaaataattcaacaatcgtggtgatgctcactaaactgagagaaatgggcagggagaagtgccaccagtactggcccgcagaaaggtctgccaggtaccagtactttgtcgtcgaccccatggccgagtacaacatgcctcaatacatcttaagggagtttaaagtcactgacgccagggacgggcagtcccgaaccgtgaggcaatttcagtttacagactggcctgagcagggtgtgccaaaatccggcgagggtttcatcgactttattggtcaggtgcataagactaaggagcagtttggccaggatggccctattagcgtacattgctcagccggagtgggcagaaccggcgtgttcatcaccctgtccattgtcctggagagaatgaggtacgagggggtcgtggatatttttcagacagtcaagatgctgaggacccagcgcccagccatggttcagaccgagaccgagtctaggccagggtggagtgcagtcgcccaaagccggctgaccgcctcgtctgcgtcctggatccatgctattctgctcccccagccccctgaatggttgggtcttcaggtgtag

SEQ ID NO: 237184 - DNA, 4518 bp, Artificial Sequence
  Description of Artificial Sequence: Synthetic coding sequence
atggctcccacttggggccctggcatggtaagcgtggtaggtcccatggggttacttgtggttctgctcgtcggcggttgcgctgctgaagagcctcctcgctttatcaaggagcccaaggaccagattggcgtatccggtggagtagcttcctttgtgtgccaggctacaggcgaccccaagcctagagtcacttggaataagaagggaaagaaggttaattcacaacgctttgagactatcgagtttgatgagtctgccggtgccgtcttgaggattcagccattgagaactccaagggatgagaacgtgtacgagtgcgtagctcagaactcagtgggagagatcaccgtgcacgccaagctcactgttcttcgagaggaccagctccccagtggtttccccaacattgacatgggcccacagttgaaggtcgtggagcgtactagaacggcgactatgctctgcgccgcttccggtaatccggatcccgaaatcacttggtttaaggatttcctacctgtcgatccctccgccagtaacggccgaataaagcagctgaggtcaggcgcattgcagatcgaaagttcagaggagacagaccagggaaagtacgagtgtgtggctactaactcagctggtgtcaggtatagcagtccagcgaacttatacgtgcgcgcactgagggaagtccgccgtgtggcaccgagattctctattttgcccatgagtcacgagatcatgcctgggggtaacgtgaacatcacctgcgtagccgtgggctctcccatgccctacgtgaaatggatgcagggggctgaggatctgactccagaggatgacatgccggttggcagaaatgtgctcgaactaactgatgtgaaggactctgcaaattacacctgcgttgccatgtccagcctgggtgtcatcgaggccgtggcccaaatcactgtgaagagtttgcccaaggcacctggaacgcctatggttacggagaacacagcaacaagtatcacaattacctgggatagcggcaaccccgaccccgtttcatattatgttatcgagtacaaaagtaaatcccaggatggcccataccaaataaaggaagacattacgactacccgctactccattggaggtctcagcccaaactcagaatacgagatctgggtgagcgccgtcaactcaatcgggcaggggcctccctcggaatccgtggtaacccggacaggtgagcaggcaccggcatccgctccaagaaacgtgcaggctcgaatgttaagtgccaccaccatgatcgtgcagtgggaggaacccgtggaaccaaatgggctcatccggggatatagggtctattataccatggagccagagcatcctgtaggcaactggcagaagcacaacgtggacgacagtctgctaacaaccgtggggagtctccttgaggatgagacatatacagttcgggttctcgcgttcacgtccgtgggagatggccctctcagcgacccaatccaggtgaaaacccagcagggagtcccagggcagccaatgaacttaagggccgaagcgagaagtgaaacctccatcactctaagctggagtcctccccgacaggagtctattatcaagtacgaattgctgtttagagagggggaccatgggcgagaagtcggtcggaccttcgatcccactacgtcttacgttgtggaagacctcaaacctaacaccgaatacgcgtttagattagccgctaggtctccccagggtctgggggctttcactcccgtagttagacagaggacgttacagagtataagcccaaaaaacttcaaggtcaagatgattatgaaaacctcagtcttgctgtcctgggaatttcccgataactataattcgccgacaccttacaagatacaatacaacggcttgactcttgacgtggacgggcgaacgaccaaaaagctcattacgcacctgaaaccccacacattttataacttcgtcttgactaataggggcagttctctgggcggactccagcagaccgtgactgcttggacagcctttaatctcctgaacggcaagccaagcgtcgcccctaaacctgatgctgatggctttatcatggtgtacctgcccgacggacagagtcccgtccccgtacagtcctattttattgtcatggtccctctgcggaagagcaggggcggacaattcctcacacctctcgggagtcctgaggacatggatctggaggaactgatacaggacatctcgaggcttcagcgcagaagcctgcgccactcccgtcagctggaagtgcctcggccatatatcgcagccaggtttagtgtgctgccacccacttttcaccctggcgatcagaagcaatatggtgggttcgacaataggggcctggagcccggacacaggtacgtgctctttgtgctggccgtattgcagaagagcgaacctacctttgccgcatcccctttcagtgatccttttcagctcgacaaccctgatcctcaacccatcgtcgatggagaagaaggccttatatgggtcatcgggccagtgctcgcagttgtgttcattatctgcattgtaatcgccatccttctctacaaaaacaagccagatagcaagaggaaggatagcgaacctagaacgaaatgcttgctgaataacgccgatctggcaccccatcaccctaaggaccccgttgaaatgagacgtattaattttcagacacccggaatgcttagtcatcctcctataccaatcgcggacatggccgagcatactgagcgactaaaggctaacgactccctcaagctgtcccaggagtatgaatctatcgatcccggtcagcagttcacatgggagcatagcaatctggaggtaaataagcccaagaatagatatgctaacgtgatcgcgtatgatcacagcagagtaattctgcagcctattgaggggatcatggggtctgactacataaatgccaactatgtcgacggctacaggtgtcaaaatgcctacatcgccacccagggccctcttccagaaaccttcggagacttctggagaatggtctgggaacagcgatccgccacaatagtgatgatgaccaggctagaagaaaaaagtcggattaagtgcgatcagtattggccaaaccgcggtaccgaaacctatggcttcattcaggtgacccttctggacaccatagaactggctaccttttgcgttcggacattttccctgcacaaaaacgggtcgtctgaaaagcgtgaagtcagacagttccagttcactgcctggcccgaccacggcgtgcctgaatatccaacgcccttcttggcctttctgcgtagggtgaagacttgcaatccccctgacgccggaccgattgtcgtccactgtagcgctggggttggcagaaccggctgtttcatcgttatcgacgctatgctggaaagaatcaagccagaaaagaccgtggacgtttatgggcacgttacgctaatgcgctcacaacgcaattacatggtacagaccgaggaccagtactcttttatccatgaggccctgcttgaagctgtggggtgcggtaacacagaagtgccagctcggtctctttatgcatatattcaaaagttagcacaagtggaaccaggcgaacatgtcacagggatggagctggaattcaagcgactcgccaattccaaggcccacacttcccgttttatcagtgcaaacctcccgtgcaacaaattcaaaaacagacttgttaatatcatgccttatgaatccacaagggtttgcctgcagcctataaggggggtcgagggctctgactatattaacgctagtttcatcgatggataccggcagcaaaaggcctatattgccactcagggtcctcttgcagagaccacagaggacttctggcggatgctatgggagaacaactccacaatcgtggtgatgctgacaaagctccgggagatgggccgtgagaaatgtcatcaatactggcctgcagaacgctcagctcggtaccagtactttgtcgttgaccccatggcggagtataacatgcctcagtacattctccgcgagttcaaagtgaccgacgctcgagacggccagtctaggaccgtgcgccagttccaattcacggattggcctgagcagggagtgccaaaaagcggtgagggattcatcgactttattggtcaagtccacaaaacgaaagaacagtttgggcaggacggacctatttccgtgcactgttcagcgggagtgggacgcacaggggtcttcattacactgtccatcgttctggagagaatgcggtatgagggcgtggtagatatcttccagaccgtgaaaatgctgcgcacacagaggcccgcaatggtgcagaccgaggacgaatatcagttctgctaccaggctgctctcgaatacttgggctcatttgatcattacgccacctag

SEQ ID NO: 237185 - DNA, 4329 bp, Artificial Sequence
  Description of Artificial Sequence: Synthetic coding sequence
atggctcgggctcaagcgctggtcctcgctctgacatttcagttgtgcgccccagagacagagacccctgcagctgggtgcaccttcgaggaggccagcgatccagcagtgccatgcgagtactcccaggcccagtacgacgactttcagtgggagcaggtcaggatccacccaggtacacgtgccccagcagacctcccccacggttcctacctgatggtcaacactagccagcatgcgccagggcagagagcccacgtcatatttcagagcctgagtgaaaatgacactcactgtgtgcagttttcgtactttctctactctagagacgggcactcacccggtacattgggggtgtatgtgagagtgaacggaggacccttggggagtgccgtgtggaatatgaccgggtcccacggtagacagtggcaccaggcagagctggctgttagcaccttttggccgaacgaatatcaggttctgttcgaggccctgatcagccctgatcgacgcggatatatggggctggatgatatccttctcctgtcttatccctgtgctaaagcgccacatttttcacgactcggagacgttgaagtcaacgcaggtcaaaacgcctccttccagtgtatggccgctggacgagccgcagaggctgaaagatttctgcttcaacggcagagtggggcactggtgccggctgccggagtccgccatatatcacatagacggtttctcgcaacatttcccctggcagcggtgtcccgggctgagcaggacctctacagatgcgtctcccaggcgccacgaggcgctggtgttagcaattttgcagagctgatcgtgaaagagccaccaacccccattgctccaccacaactactgagagccggtcccacctatcttatcattcaattaaacacgaacagcattatcggggatggcccaatcgtgaggaaagaaatcgagtacagaatggctagaggaccttgggctgaagtgcacgcggtgtctctccagacttataagctgtggcatctcgatcccgacacagagtatgaaatatcggtgctgcttacgcgtccaggagatgggggaaccggtcggcctggacctccactgatctctcgcacaaagtgcgccgagcccatgcgtgcccctaaggggctcgcctttgccgagattcaggcccgacagctcaccctgcagtgggagccccttggatataacgtcacaagatgtcacacttatactgttagtctgtgctatcattatactttgggatctagccataatcagaccattcgagaatgtgtgaagaccgagcagggcgtgtccagatataccatcaaaaatctgctcccgtacaggaacgtccatgtaaggcttgtgttaaccaatccggaggggcgaaaagaggggaaggaggttacgttccaaaccgacgaggatgtaccctcaggtatagcagctgagtccctgacgttcactcctctggaagacatgatcttcctaaagtgggaggaaccccaggaaccaaacggactcatcacacagtatgagatttcttatcaaagcattgaaagttccgatccggctgtgaacgtgccaggtcctagacggactatcagcaagctaaggaacgagacctaccacgtgttcagtaatctccaccctggcacaacctacctcttcagcgtccgagctcgcaccggtaaggggttcggccaggccgctcttacagagataacaacaaacatttccgctccttcatttgactatgctgacatgcccagccctctgggcgaatccgaaaataccattacagtgctgctacgcccagcccagggacgcggagcacctattagtgtataccaggtcattgtcgaggaagaaagagctcgtagattgcgcagagaaccaggtggccaggactgctttcctgtgcctctgaccttcgaggccgcacttgctagggggcttgtgcactacttcggggcagaattggctgcgtcatctttgccagaggccatgccctttaccgtgggcgacaaccagacttacagaggtttctggaatcctccactcgagcctcggaaagcctacctgatatattttcaggctgcatcacacctaaagggtgagacacggctcaactgcatacgaattgctaggaaggccgcttgcaaagagtctaaaaggccgttggaggtgtcacagcggagtgaagaaatgggccttattctcgggatctgcgcaggcggactcgccgttctgatcttacttctgggtgctatcatagtgataatccgcaagggcaaaccagtgaatatgacaaaggccactgtaaattataggcaagaaaagacgcacatgatgtcagctgtagatcgaagctttaccgatcaatctactctacaggaagacgaacgcttggggctatcattcatggacactcatggatactcaaccagaggagatcaaagatctgggggagttacggaggcaagctctctgctcggaggatctcctcggcgaccatgcggaaggaaaggatctccatatcacacagggcagctccacccagcagtcagagtcgctgacctcctgcagcatatcaaccagatgaagactgcagagggctatggttttaagcaggaatacgagtcgtttttcgaggggtgggacgcgactaaaaaaaaggacaaggttaaaggcagccgacaggagccaatgccggcatacgatcgccacagggtgaagctgcatcctatgctcggtgaccctaacgcagactacatcaacgcaaactacatcgacctgcgaggtggcaggactggataccaccgttcgaatcattttatcgcaactcaagggcctaagcccgaaatggtctacgacttctggagaatggtgtggcaggagcattgctcttctatcgtcatgattactaaactcgtcgaagtgggccgtgtaaaatgtagtcggtactggcccgaagactctgatacctacggtgatattaagattatgcttgtcaaaacggagacactcgcggagtatgttgtgaggacctttgcacttgaaaggcgcggttacagcgcacgtcacgaagttcgccagttccatttcacggcctggcctgaacatggtgttccctatcacgctactggacttctggcattcattagacgggtgaaggcaagcactccgccagacgctggacccattgtaatccactgttccgcgggaaccggcaggacgggttgttacatcgttctagacgtgatgttggatatggccgaatgcgagggcgtcgttgatatctacaactgtgtcaagaccctgtgctcacgtcgcgtcaacatgatacagactgaagaacagtacattttcatccacgacgcaatcttagaggcttgcctctgtggtgaaacgaccattcctgtgagtgagttcaaggctacctataaagaaatgatccggatagacccacagtccaactcctctcagctaagagaggagtttcaaacgctcaactccgtcacaccgcctttagacgtggaagagtgtagtattgcgctgttacctcggaatagagacaagaatagatccatggatgttctgccacccgatcgttgcctccccttccttataagcaccgatggcgactccaataactatattaatgccgcactgacagacagttacacccgcagcgccgcatttatcgttaccctgcaccccctccagagtaccacaccggacttctggcgtctagtgtacgattacggctgtacgagcatcgtgatgctcaaccagctgaaccagtccaactcagcatggccctgcctccagtactggcctgagcccggacgccagcaatacggtctgatggaagtggaatttatgtccgggactgcggacgaagatctagtcgcccgagtcttcagagtccagaatatctctaggctccaagaaggacacctgctggtgcgccacttccagttccttaggtggtcagcttatagagatactcctgatagcaagaaagcgttcctgcatctgctcgccgaagtagataaatggcaggccgaaagtggcgatggacgcacaatcgtacattgcctgaatggcggaggaagatcaggcactttctgcgcctgcgccacggtgctagagatgattagatgtcacaacctggtggatgtgtttttcgccgctaaaaccttgagaaactataagccgaacatggttgagacaatggatcagtatcacttttgttacgatgtcgccctcgagtacttagaaggactagaatcccgatag

SEQ ID NO: 237186 - DNA, 4341 bp, Artificial Sequence
  Description of Artificial Sequence: Synthetic coding sequence
atggcaagggcacaggctctagtgctcgcactaacttttcagctgtgtgccccagaaacggaaacccctgcggctggttgcaccttcgaggaggcttcagacccggctgtaccctgtgaatactctcaggctcagtacgatgacttccagtgggagcaggttcgaattcaccctgggacaagggctcccgctgaccttccacacggatcctatctgatggtcaataccagccagcatgcccctggacagcgagcccacgtgatattccagtctctgagcgaaaatgacacccactgtgtacaattcagctattttctatattccagagacgggcacagccccggtacgttgggagtttacgtgcgggtcaatggtgggccactgggttctgctgtgtggaacatgactggatctcacggcagacagtggcatcaggcagagctggcggtgtctactttctggccgaatgagtaccaggtcctgttcgaagctctcatcagtcccgatcggagaggctatatgggcctggatgatatcctgctgctttcctatccctgtgctaaagcaccccatttctcccgccttggtgatgttgaggttaacgcaggccagaacgctagcttccagtgtatggcagccggtagggctgccgaggccgaaaggttcctacttcagaggcagtccggtgccctagtaccagccgcaggagtgagacacatttctcatcgtcggtttctcgccaccttccctctcgccgcagtgagccgagccgagcaggatttatatagatgtgtgtcacaagctcctagaggtgctggagtgagcaacttcgccgagttgatcgtgaaggagccacctacacccatcgcacccccacagctcctgcgggcaggccctacttatctgatcatacagctcaatactaattctataattggggatggtccaatagtgcgtaaggaaattgaatacaggatggccagaggtccgtgggcagaggttcacgcggtttctctgcaaacatataagctttggcatctcgacccagataccgaatacgaaatctcagttttgctgactcggcctggagatgggggaactggccgtcctggccctcctcttatcagtcgtaccaaatgtgccgaacctatgcgtgcgccaaaggggctggcattcgcagagattcaagctcggcaacttacgttacagtgggagccgctagggtataacgtgacacgctgtcacacttacaccgtgtcgctgtgttaccattacacgctgggttctagtcataaccagaccatacgggagtgcgtgaagactgagcaaggtgtctctaggtataccattaaaaaccttctaccttaccgcaacgtgcatgtgcgccttgttttgacaaatcccgaaggacggaaggaaggaaaagaggtaaccttccagaccgatgaagatgtcccatccggcatcgcagcagagtctctcacttttaccccactggaagatatgattttcctgaaatgggaggaaccgcaggagcctaacggattgatcacccagtatgagatcagctatcagagcatcgagagcagcgaccctgctgttaacgtgccaggtcccagacgcacgattagtaagctgagaaatgagacataccacgtgttttctaacctgcaccctggcactacatacctcttttcagtgcgggctaggacaggaaaggggtttggacaggccgctctgacggagattaccactaatatctccgcaccctccttcgactatgcagatatgccttcccctctcggagagagcgagaataccatcaccgtgttgctgaggccggctcagggcagaggtgccccaatctctgtctaccaggtgattgtggaggaggaacgggctcgtagactgcgacgggaacctggcggacaagattgtttccctgtccctctgacattcgaggccgcattagccagaggcctggtccattatttcggagcggagctggccgcttccagtctgccagaagccatgccattcactgtcggcgacaatcagacgtataggggcttttggaacccccctctggaacccagaaaggcatatctaatttacttccaggctgccagtcatctcaagggcgagactcgattgaactgtattagaattgctcgtaaggctgcttgcaaggagtcaaagaggccgttggaagtctcacagcgcagtgaggagatgggcctcatcctcggtatctgcgcgggtggccttgcagtgttgatcctgctgttgggcgctattatcgtgattatccgaaaaggcagagaccactatgcatatagctactatccgaagccggttaacatgaccaaagctaccgtcaactatcgccaggagaaaacacacatgatgtcagccgttgaccggagtttcacggatcaaagcactcttcaagaggacgaaaggctcggtctttccttcatggacacacacggctattcaacgcggggagaccaaagatccggcggagtgacagaagccagttctctattaggcggttctccccgtaggccctgtgggagaaaaggcagcccttatcatacgggccagctgcatcctgcagtgagggtcgctgatctcctgcaacacattaaccagatgaagaccgccgaaggatacgggttcaagcaggaatatgaatccttctttgaagggtgggatgcgacaaaaaagaaggataaagttaagggatcacgacaggaacccatgcccgcttatgatcggcacagagtgaaattgcacccaatgctgggcgacccaaatgctgactacatcaacgcaaactatattgatgggtaccacaggtctaaccacttcatcgccacccaaggtcccaaaccagagatggtatatgacttctggaggatggtgtggcaagaacattgtagcagcatcgtgatgattaccaagctggtggaggttggtcgggtgaaatgctcgagatattggccggaggattcagacacctacggagatataaaaattatgctcgtgaagaccgaaacactagcagaatatgtggtgaggacattcgctctggaaagacggggatattccgcacggcacgaggtgaggcagttccacttcactgcttggcccgaacacggtgtgccttaccacgccactggcttgctggccttcattagaagggtgaaagcgtctactccgccagacgcaggaccgatcgtgattcactgtagcgccggaacaggaaggaccggatgttatatcgtgcttgacgtgatgctggacatggctgaatgtgaaggagtagtggatatatataattgcgtgaagactttatgctccagaagagtcaacatgatccaaactgaggagcagtatatttttatccatgatgccattctcgaagcatgtctttgcggagaaacgaccattcctgtgagtgagttcaaggcgacttataaggagatgattaggattgaccctcagtctaactcttctcaactacgcgaggagtttcagaccctgaatagcgtcacaccccctctagatgtcgaggagtgttctatagccctcttacccagaaatagggataagaaccggagtatggacgtgctgccacccgatcgatgccttccattcctcatctctaccgatggggattccaacaactatattaatgcagctctaacagactcatatacacggtccgccgcattcatcgtgacgttgcatcctctgcaatctactactcccgacttttggaggctggtttacgattacggctgcacttcaatcgtcatgctcaaccagctgaaccaaagcaacagcgcctggccatgtctgcagtactggccggagcctggcagacaacagtatgggttgatggaagtcgagtttatgtctggaaccgctgacgaggatctggtggcgcgtgtgtttcgggttcagaacataagccgccttcaagaagggcacctgctcgtaagacatttccagtttttgaggtggagcgcttaccgcgacactccagactccaaaaaagcattcttgcatctactggccgaagtagacaagtggcaggctgagagtggcgatgggagaaccattgtgcactgccttaacggcggaggcaggtccggcaccttctgtgcttgcgcaaccgtgcttgagatgattcgctgtcataatttggtagacgttttttttgcagccaagaccctgagaaattataaacccaatatggttgaaactatggaccagtatcatttttgttatgatgttgctctggaatacttggagggattagagtctcggtag

SEQ ID NO: 237187 - DNA, 4329 bp, Artificial Sequence
  Description of Artificial Sequence: Synthetic coding sequence
atggcgagggctcaggccctggtgcttgctctcacttttcaactgtgtgccccagagactgaaaccccggcagcaggatgtactttcgaggaggcgagtgatcccgctgtgccctgcgagtattcgcaggctcagtatgatgactttcagtgggaacaggtcaggatacaccctggcacccgggcacctgccgacctcccccacggttcttatcttatggtcaatactagccagcacgctcctggtcagcgggcacacgtgatttttcaatccttatcagaaaacgacactcactgcgtccagtttagttattttctgtactctagagacggtcacagccctggcacactgggtgtctacgtccgggtgaacgggggaccattggggagcgcagtctggaatatgacgggctcccacggacgacagtggcaccaggctgagctggctgtatcaaccttctggcctaacgagtatcaggtgctctttgaggcactaatttctcccgatcgaagagggtacatggggttagacgacatcctactattaagctatccatgcgccaaagccccacattttagccgcctcggagatgtggaagtgaacgccggacagaatgcttcctttcagtgcatggccgcaggacgtgccgcagaagctgagagatttttgctccagagacagagcggggcactcgtgccagccgctggtgtgcgacatatctcgcaccgtcggtttctggcaacctttcctcttgctgcagtgagtcgggcagagcaagatctgtaccgctgcgtttcgcaggcgccacggggtgccggagtgagtaactttgcagaattaattgtcaaggagcctccgaccccaatcgctccaccccagctcctgagagccggtccgacctacctgatcatccagcttaataccaactccattatcggggatggtcccattgtgcggaaggagattgaatatagaatggctcgcggaccttgggccgaagtgcacgcagtcagccttcagacttacaagctctggcatcttgatcccgacaccgagtatgaaattagtgtgttgttaactaggcctggcgacggagggacagggaggcccggacctccattaatcagcagaaccaagtgcgctgagcctatgagggcccctaagggactggcttttgctgaaattcaggccagacaactgaccctgcagtgggaaccgttgggatataacgtaacaagatgtcatacctacactgtctcactgtgttatcattacacccttggtagcagccataaccagactataagggaatgcgtgaagacggagcaaggcgtgagcaggtatactatcaagaatttgctgccttaccgcaatgtgcacgtgagattggttctgaccaatcccgaggggagaaaagagggcaaagaagtgacttttcagaccgatgaggatgtccccagcggcatcgccgcagagagtcttacttttactcccttagaggacatgatcttccttaagtgggaagagccccaagagcctaatggacttataacccagtacgagatctcgtaccagagtatcgagagttcagacccagctgtgaacgtgcctgggccacgcaggacaatttccaaactccgcaatgagacctaccatgtcttttccaatttacaccctggcactacgtatctattctccgtcagggctaggaccggaaagggattcggacaagctgccctgactgaaatcacaacaaatatctcggcaccgagttttgattacgctgatatgccgagcccgctgggggagtccgagaacaccatcacagtcctactacggccagcccagggccgaggcgcacccattagcgtctatcaagtcattgtggaggaagagcgggctcgcaggctgagacgggagccgggaggccaagactgcttcccagtgccactgacctttgaggcagccttggctcgaggactggtgcattacttcggggcagagctcgcagcctcctcgctacctgaggccatgccatttacggttggtgataatcagacatacaggggtttttggaacccaccactggagcccagaaaagcatatctcatctatttccaggctgcatcacacctgaagggtgagacgaggctgaactgcattaggatcgcaaggaaagctgcctgtaaagagtcaaagagacccctggaagtgagccagcgatctgaggagatgggcctaattcttggtatttgtgccggtggcttagccgtgctgatcctgctgctgggcgcaatcatcgttatcataagaaaagggaagccggtaaacatgactaaagcgactgtgaactaccggcaagagaagactcacatgatgagcgcagtagaccgttcttttaccgaccaaagtacgctgcaggaggatgagcggttgggtttaagtttcatggacacccatggatattccacaagaggtgatcaacgcagcgggggagtcactgaggcgtcatcgctgcttggcggttcaccaaggcgaccttgcggcagaaaggggtcgccttaccacacggggcagctacaccccgcagtacgggtagccgacttgttgcagcacattaatcagatgaagacagcagaaggctatggattcaagcaggagtatgaatcgttttttgagggctgggacgccactaagaaaaaggacaaagtgaaaggcagtcgccaggaaccgatgcctgcatacgacaggcatcgagtgaagctgcacccaatgctcggagacccgaacgccgattacatcaatgccaactacatcgacatccgcattaacagggaaggttaccacagaagcaaccactttatagcaacccaggggcctaaacccgagatggtttacgacttttggaggatggtctggcaggaacactgctctagtatcgtcatgatcacgaagcttgtggaagtgggacgggtgaagtgcagcagatattggccagaggacagcgatacctatggggacattaaaattatgctcgtgaagaccgagacattggctgagtatgtggtgcgaacctttgctctggagcggcgaggctacagtgccagacatgaggtgcggcagttccactttaccgcctggccagaacatggcgtgccataccacgcaacagggcttttggcatttataaggagagtgaaagcctcgacgccccctgacgcagggcctattgtgattcactgcagcgcgggtactggacgcactggatgttatattgttcttgacgtcatgctggacatggccgaatgtgagggcgtagtggatatatataattgcgtcaagacactgtgtagccgcagagttaatatgatccagacagaggagcagtatatctttattcatgacgctatcctagaagcctgcctatgcggggagactaccattccagtcagtgagtttaaggctacatataaagaaatgatccgaatcgatccacagagcaactcctctcagctcagagaagagttccagacactgaactccgtgacgccccctctcgatgttgaggaatgtagtattgccctgttaccccgtaatcgcgataaaaaccgatctatggatgttttacctcccgataggtgtctgccattcctgatttctaccgacggagattcgaataactacatcaatgctgcactgactgactcatatacacgtagcgccgcatttatagtgacactgcatcctctgcagtctaccacccctgatttctggagattagtgtacgactacggatgtacgtcgatcgtgatgcttaatcaacttaatcagagtaacagcgcttggccatgcctccagtactggcccgaaccgggtcggcagcagtacggcctcatggaggttgagtttatgtccgggacagccgatgaggacctcgttgcacgagtttttcgcgttcaaaacatctctcggctccaagaaggacacctgctcgtgcgccactttcagtttctgaggtggagcgcctaccgggacactccggattctaagaaggcattcctgcacctgcttgctgaggtcgacaaatggcaagccgagtctggagacggtcgtacgattgtccactgtctgaatgggggtgggagaagtggcactttttgcgcctgcgctactgtgttggagatgattcggtgccataacctggtggacgtttttttcgccgcaaagactttgcggaattataagcctaatatggtagagacaatggaccagtatcacttctgttacgacgtggctcttgagtacctggaagggctcgaatcgagatag

SEQ ID NO: 237188 - DNA, 4311 bp, Artificial Sequence
  Description of Artificial Sequence: Synthetic coding sequence
atggcacgcgcacaggcactggtgctggccctcaccttccagctctgcgccccagaaacagagacacctgcagcgggatgcacctttgaggaggcctcggaccctgctgttccatgcgagtacagccaggcacaatatgacgactttcaatgggaacaagtgcggatccacccaggcacccgagcaccagcagatctcccacatggttcctatctcatggtcaatacaagccaacacgccccagggcagcgggcacacgtgattttccagtctttaagtgagaatgacactcattgcgtgcaattcagctattttctgtatagcagggacggacactcacctgggacgctcggcgtttatgtgcgcgtgaacggcggacctttgggttccgctgtctggaatatgaccgggagtcacgggcgacaatggcaccaggctgagcttgcggtcagtactttttggccaaatgaataccaggttttgttcgaggccctgatcagccccgaccggcgaggttacatggggctggatgacatcctactcttatcttacccttgtgccaaagccccacacttcagtaggctgggagatgtagaagtaaatgcagggcagaacgctagcttccaatgtatggccgcaggaagagccgctgaagcggagcgcttcttactccagaggcagagcggtgctttggtgcctgccgctggcgtcaggcacatttctcacaggcgtttcctcgcaacgttccccttagctgcggtatctcgggctgaacaggatctttaccgttgcgtgtctcaggctcctagaggagctggggtgagtaatttcgcggagcttatcgtcaaggagcctcccactcccattgcccctccacaactgctgagagccggtcccacctatctgataatacagttgaacaccaattctatcattggagacggcccaatcgtgagaaaagaaattgaatacaggatggcgagaggtccgtgggctgaggtacatgcggtgtccttgcagacatataagctttggcatctggatcctgacacagagtacgagattagcgtgttgcttacaagacctggggatggagggaccgggagacccggtccccctttgatctcccgtacaaaatgcgccgagccaatgagagccccaaaggggctcgctttcgccgagattcaggccaggcagctgacccttcagtgggagccgttgggatacaacgtgacacgctgccacacctataccgtctccctatgctaccactacacactgggatcttcccacaaccagacaatcagagaatgcgttaaaactgaacagggtgtatccagatataccattaagaatttgctcccgtacaggaacgtacacgtgcggctggtactgactaatcctgaagggaggaaggagggcaaggaagttacatttcaaactgacgaggacgtgccctctggcatagctgcagagagcctgaccttcacaccactcgaagacatgattttccttaagtgggaagagcctcaggagccgaacggcctcattacccagtatgagatcagttaccaaagcattgagtccagtgatccagctgtgaacgttcctggacctaggcggactatttccaagcttcggaatgaaacttaccatgtgttctccaatctccatcccggtaccacctatctgttttccgttcgagcaagaacagggaaaggtttcggacaggccgctctcacagagataacaaccaacatttctgccccttcgttcgattatgctgacatgcccagccccctgggtgagagcgagaacacaatcactgtgttattgcgaccggcacagggccgtggagccccaatctctgtataccaggtgatcgtggaggaggaacgggctagaaggctgcgcagggagcctggagggcaggactgctttcccgttccgctgactttcgaggctgcactagctcgtggactggtgcactatttcggagcagagctggctgcctcttctcttcccgaagccatgccttttactgtcggcgataatcagacttaccgcggtttttggaaccccccattggaacccagaaaggcgtatctaatctactttcaagcagcatctcacctaaaaggcgaaacacgtttgaactgcattcggatcgcacgcaaggcagcctgtaaagaaagtaagaggcctttagaagtcagccagagatccgaggagatgggtttaatacttgggatctgtgcgggaggcctggcagtgctcatcttactcttgggggctattatcgtgattatccggaaaggcaaacccgtaaacatgactaaggcgaccgtgaactaccgccaagagaagacgcacatgatgtccgccgtagatcggtcattcacagaccagtcaacacttcaagaagatgagcggctgggtttgtcatttatggacacccacggttattcgacacgcggagatcaaaggtctggaggcgtgactgaggctagctctctcttaggtggttcacctcggaggccttgtggaagaaagggatcaccttaccatactggccagctgcacccagcggttagagtggcagacctcctccagcatataaaccagatgaagaccgctgaggggtacggctttaagcaggaatacgagtccttcttcgagggatgggacgctactaagaagaaagataaagtcaagggtagccggcaggagccaatgcccgcttatgataggcatcgtgtgaaactgcatcctatgttaggtgaccctaacgccgattacatcaacgctaactacattgatggatatcaccgcagtaaccacttcatagctacacagggacccaaaccagaaatggtatacgatttctggcgtatggtgtggcaagaacattgcagcagcatcgtcatgataactaaacttgtcgaagtaggacgcgttaagtgttcacggtactggcccgaggatagcgacacctacggcgacataaaaattatgctcgttaagactgagacgttggccgagtatgtggtgcgtacatttgcgctggagcgcagggggtactccgctcgacacgaagtgcggcagttccactttactgcatggccagaacacggggtgccatatcacgccacgggcctgctcgcttttatcaggcgggtaaaagcatccacccccccagacgcaggccctatcgtgattcactgttctgctgggacaggaaggacaggctgttacattgtccttgatgtgatgctggatatggccgaatgcgagggagtggtggatatttacaattgtgtgaaaaccctgtgctcccgtagggtcaacatgattcagacagaagaacagtatatattcattcacgacgccattctggaggcttgcctctgcggggaaacgaccatccccgtctctgagtttaaggcaacctataaggagatgattcgcatagacccacagagcaacagctcgcagttaagagaggaattccagacattaaactcagtgacgccacctctagacgtggaggagtgctccatcgctctcctgcctaggaacagagataagaaccgctctatggatgtgctgccgccagataggtgtcttccttttctaattagcacggacggcgattctaacaactatatcaatgctgccttaaccgattcatatacaagatctgccgcattcatcgttacactccaccctttacagtctaccactcccgacttctggaggctggtctatgactacggttgcacgagtattgtcatgcttaatcagctgaatcaaagtaatagcgcctggccctgtctgcagtactggcccgagcccggtaggcaacagtacggactgatggaagttgagttcatgagcggcactgcagacgaagacctggtggcccgagtctttcgcgtccagaatattagcagactccaggaaggccacctgctggttagacactttcaattcctgagatggtccgcctatagggacactcccgactctaaaaaagcctttctgcacttgttggcagaggttgataaatggcaggctgagtccggggatggcaggacgattgtccattgcctgaatggcggaggtagatccggaactttctgtgcatgtgcgactgtcctcgaaatgatcaggtgtcacaaccttgtggatgtgtttttcgcggctaagactttgaggaactataaacccaacatggttgagaccatggaccaatatcacttttgctatgacgtcgcgctggaataccttgaagggcttgagagcaggtag

SEQ ID NO: 237189 - DNA, 4302 bp, Artificial Sequence
  Description of Artificial Sequence: Synthetic coding sequence
atggccagagcacaggctctggttttggctctcacatttcagctgtgcgctccagagactgaaactccagcagctggatgtacgttcgaagaagcctctgacccagccgtgccttgcgagtacagtcaagcacagtacgatgattttcaatgggagcaagtgcgaattcatcctgggacacgggctccggcagacttacctcatggaagttacctgatggtgaatacctctcagcacgccccaggccaacgtgctcacgttatctttcagagcctcagcgaaaacgacactcactgcgtccaattcagctacttcttatacagccgggatggccattctccaggcaccctgggcgtgtacgttagagtcaatggaggaccgttgggctcagctgtttggaacatgactgggtcccatggccgacaatggcatcaggctgagctggccgtgagcaccttttggcctaacgagtatcaggtgctcttcgaggcgttgatcagccccgatagaaggggctacatgggactcgacgacatattactactttcctatccctgcgctaaagcaccacacttctcccggctgggggatgtcgaagtaaacgcgggacagaacgcctcctttcaatgcatggccgcaggacgggcagccgaggctgagcggttccttctgcagcgccagagcggagccctggtgcccgctgcaggggttagacacatctctcaccggcgatttctggctacattcccgcttgcagccgtcagccgagccgagcaggatctctataggtgtgtgagtcaggcgccacgcggagcaggcgtctccaatttcgcggagttgatagttaaagagcctcctacccccatagccccacctcaactgttgcgggctggaccaacttatttgatcattcagctcaacacgaactctatcattggcgacgggcctattgttcgcaaggaaattgagtacaggatggctcggggaccctgggctgaggtgcacgctgtgtccttgcagacatacaagttgtggcatctcgatcccgacactgaatatgagatctcagtgcttctgaccagacccggtgatggtgggacaggacgccctggtccccctctcatttcccgtactaaatgcgccgagcccatgagggctcccaagggacttgcctttgcagagattcaggcaagacaattaaccttgcaatgggagcccctgggttataatgttacaaggtgccatacatataccgtctccctgtgctatcactataccctaggatcttcacacaaccagacaattagagagtgtgtgaagactgagcaaggcgtgagtaggtacacaatcaagaaccttctcccctaccgaaatgtccatgtgcgtttagttctcacgaatcccgagggacgcaaggagggcaaagaagttacctttcagacagacgaagacgtcccttcgggaatcgcagcagaatcactcacctttaccccattggaagatatgattttcctaaaatgggaagaaccccaggagccgaatggactgattacccaatatgagatctcttaccagagtatcgaaagtagcgatccggcagtgaatgttccgggacctcggcgaactatctccaagctgagaaatgaaacttatcacgtcttctcgaacttacaccccggtaccacatatctgttttctgttcgcgcaagaacgggcaaaggctttgggcaggctgcgctcaccgagatcaccacaaatatttctgctccttcctttgattatgcagacatgccttcccccctgggggaaagcgaaaacacaatcaccgtgctcctgcgccctgcccaagggagaggtgcacctatttcagtgtatcaggttatcgtggaggaagagcgcgctagaaggctccgaagggagcccggaggccaggactgcttccccgtgccgctgaccttcgaagctgccttagctagaggtctcgtgcactacttcggcgctgagctcgccgcaagctctctgcctgaggccatgcccttcacagttggcgataaccagacctacaggggcttctggaacccaccgcttgaaccacgcaaggcctacctgatctacttccaggcagccagccacttgaagggcgagacacgtcttaactgtatccgcattgccagaaaagcggcatgtaaggaatcaaaacgccctttggaagtgagccaaaggagcgaagagatgggcctaatcttagggatctgcgccggtggtctcgctgtgttaatccttcttctaggcgctatcattgtgatcattagaaaggggaaacctgtcaacatgaccaaagcaaccgttaactacagacaggaaaagactcacatgatgagtgcagtggaccgtagcttcaccgaccaatccactctccaggaagatgaacgtctcgggctgtctttcatggacacccacggctacagcactcgaggcgatcaacgatctggaggcgttactgaggccagttctctcctcgggggttcgccaaggcggccatgcggcagaaagggcagcccctatcacaccggccagctgcaccccgctgtgagagttgctgacctactccaacatatcaatcagatgaagacagctgaaggctatgggttcaaacaggagtacgagagctttttcgaggggtgggacgctacaaaaaagaaagacaaggtgaaagggagtcggcaggagccaatgccagcttacgacaggcaccgcgtcaaactgcatcccatgctgggcgatccgaatgctgattacattaacgcaaactatatcgatgggtaccatagatccaaccatttcatcgctactcaaggccctaaacccgagatggtgtacgacttctggagaatggtgtggcaggaacattgctccagtattgtgatgatcaccaagctggttgaagtgaagtgcagcagatattggcctgaggactccgacacctacggagatattaaaatcatgttggttaaaacagagactcttgctgagtatgttgtgagaacctttgccctggaacgcaggggctactcggctcgacatgaagtgagacagttccattttaccgcatggcctgagcacggtgttccctatcatgccaccgggctcctggcattcattagacgggtgaaagcaagcacacctcccgatgctgggccaattgtgatccactgctctgccggtacagggcgtaccgggtgttatatcgtactcgacgttatgctcgacatggctgagtgcgagggcgtagtggatatctataactgtgtcaaaacgctgtgtagccggagggtgaatatgattcaaaccgaagagcagtatatcttcattcacgatgctatactcgaggcgtgcctgtgcggggagaccacaatccccgtaagtgagttcaaggctacttataaggagatgatacggatagacccgcagagcaatagcagtcagctgcgcgaggagtttcagaccctgaattcagtcactccccctctcgatgtagaggaatgctccatcgccctgctgccccgaaaccgggacaagaacagatctatggatgtcctgccacctgatcgctgcctgcccttcctgatctcgaccgatggggattctaataactacattaatgccgcactcacagactcctacacccggtccgctgctttcattgtcaccctgcaccccctacagtcaacaacgccggacttttggcgactggtttacgactatggatgtacaagcattgtgatgctcaaccagctgaatcagtctaacagcgcttggccgtgtctgcagtattggccagaacctggcagacagcaatacggcctaatggaagtcgagttcatgagtggaacagccgacgaggatcttgtggcccgtgtgttccgagtgcagaatatatctcgactgcaggaaggccacctgctggttcgccacttccagttccttaggtggtctgcataccgagatactcccgacagcaagaaagcattcttacacctgcttgcggaagttgacaagtggcaggcagagagtggagatggtcgaacgatcgtccactgtctaaatggcggaggcagatcaggcacgttctgcgcatgtgctactgtgctggagatgatcagatgtcacaacctggttgacgtctttttcgccgctaaaacgttaagaaactataaacccaatatggttgaaactatggatcagtaccacttttgctatgatgtcgctttagagtacttagaggggctggaaagtagatag

SEQ ID NO: 237190 - DNA, 6947 bp, Artificial Sequence
  Description of Artificial Sequence: Synthetic coding sequence
atgcgcattctgaaaagattcctcgcctgcattcagctgctatgcgtctgccgtctcgattgggccaatgggtactaccgacagcagcgcaaacttgttgaggagatcgggtggagttacactggggcattgaaccagaagaactggggcaagaagtacccaacctgtaatagtcccaaacagtctccaattaacatcgatgaagacctgacacaggtcaacgtgaatttgaagaagctgaagttccaaggctgggataaaacttcccttgaaaatacatttatacataatactggaaagacagtagagataaaccttaccaatgactatagggtgtcaggtggtgtgagtgagatggtctttaaagcttcgaaaattactttccattggggcaagtgcaatatgtctagcgacgggtccgaacacagtctggagggacagaaattccctctggagatgcagatctattgctttgatgccgatcgcttttcaagctttgaagaggccgttaagggcaagggcaaactgagggctctgagcattctattcgaggtcggaaccgaagagaatctggacttcaaagctataattgatggtgtggaaagcgtgtccagatttggcaagcaggcagccctggatcccttcatactgttaaacctgctgcctaacagcaccgataagtactacatctataacggcagtctgacctctccaccgtgtaccgatacggtggattggatcgtcttcaaggatactgtgagtattagtgaaagtcaattagcggttttctgtgaagtgcttaccatgcagcagagtggatatgtgatgttaatggattatcttcagaacaactttcgtgagcagcaatacaagtttagccgccaagttttttcttcctacaccgggaaggaagaaatccatgaagccgtgtgttcatccgagcccgaaaacgtgcaggcagatccagaaaattacacgtccctactggtgacgtgggagcggccacgtgtggtttacgacaccatgattgaaaagttcgctgtcctgtaccagcagctggatggagaagaccagacaaaacacgagttcctgaccgatgggtaccaggacctgggcgctatcctgaacaacctgctgcctaatatgagctatgtcttgcaaattgtggccatatgcacaaacggcctttacggtaagtacagcgatcagctcattgtggacatgcctactgataatccagagctggatctctttcccgaactcatcggtacagaggagattataaaagaagaagaagagggtaaagatattgaggagggagcgattgtcaaccctgggagagatagcgcgacgaaccaaataaggaagaaagaaccacagatctccacaactacccactacaatagaattggaaccaagtataacgaagctaaaacgaacaggtccccgacccggggatcggagttcagcggcaaaggggatgtgcccaacaccagcctaaacagcacatcgcagccggtaacaaaattagcaacagaaaaagatattagccttacgtctcagaccgtgacggagctgccccctcacaccgttgagggtacatccgctagtttgaacgacggcagtaaaacagtattgcgctcaccacacatgaatctgagcggcaccgcagagagccttaatactgtgtctattaccgaatatgaagaggagtcattactgactagctttaagctcgacactggggctgaggattcaagtgggagcagccccgcaacaagcgcgattccctttatcagcgaaaatatctcacagggatacatcttcagttctgagaatcccgaaacaattacctacgacgtgttaattcccgaatctgcgagaaacgccagcgaagacagtacctccagtggatcagaggaaagcctcaaagacccatctatggaggggaacgtgtggtttcccagctctaccgatataaccgctcagcctgatgtcgggtcgggtagagaatctttcctccagaccaactacaccgagatacgggtggacgagagtgaaaagactaccaagagcttctctgccggaccagttatgtctcagggaccatctgtcacagatctggagatgcctcattatagcactttcgcttactttccaaccgaggtgactccccacgctttcacacccagttcccgccagcaggacctggtgagcacagtcaacgttgtgtattcgcaaaccacacaaccagtgtacaatggagagaccccactgcagccaagctactcctcagaggtgttccccctcgtcactccgctgctgctggataaccagatcctgaacacgactccggcagcctcttcttctgactccgccctgcatgctacaccagtttttccctctgtggatgtatcttttgagagcatcctgagctcgtacgacggagcccctctgctccctttttcatcagcatcgttctcaagtgagttatttcggcacctgcacacagtgtctcagattttaccgcaggtcactagtgccacagagagcgataaggttccactgcacgcatccctccccgtggcaggcggagacctgctgctcgaacccagcctggcacagtattcagatgtgctgagcaccacccatgctgccagcgagaccttagaatttggctctgagagcggagtcctctataaaactctgatgttttctcaagtggagccacccagcagtgacgctatgatgcatgccagatcttccggacctgaaccgagctacgctctgtctgataatgagggtagtcagcacatttttacggtgtcctacagttctgcaatccctgtgcacgattctgtcggggtgacataccagggaagtcttttcagcggtccctcccacatccctatccctaagtccagcttgattacgcctaccgcctccctgctccagccaacacacgccttgagcggggatggggaatggtctggggctagctcagattcagaattcctcctaccagacaccgatgggctcaccgcgctgaatatctcttcacccgtgtccgttgcagagttcacctacaccaccagcgtgtttggcgacgacaacaaggccctgtcaaaaagcgagatcatttacgggaacgaaaccgagttgcagattccctcgttcaacgaaatggtctatccttctgaaagcacagtcatgccgaatatgtacgacaatgtgaataaacttaatgcctcccttcaggaaactagtgtctcaatctccagcaccaagggcatgttcccaggatccctcgcccacaccaccacgaaagtgtttgaccacgaaatttcccaggtcccagagaacaactttagcgtgcaaccaactcacaccgtctctcaggcgagcggggacacatccctcaagcccgttctgtctgccaattctgaaccagcatcctccgatcccgcatcctccgagatgctgtctccctccacacagttgctattttacgaaacaagcgcaagctttagcacggaggtattgctgcaacctagcttccaggcctctgatgtagatacactgcttaagaccgtgctccctgcagtcccaagtgatccgattttggtggagaccccaaaagttgataagatctctagcactatgctgcatctcattgtgagtaacagtgcatcttcagaaaacatgctccactccacgtccgtcccggtatttgatgtgtcccctacctctcacatgcactctgcctctctacaagggcttacaatcagctatgcgagcgaaaagtacgaaccagttctgttaaagagcgaatcatcacatcaggtggttccgtctctctatagtaatgacgagctgttccagaccgccaatctggagatcaaccaagcccaccctcccaagggcagacacgttttcgcaacccccgttctctcgatcgatgagccactcaacacactcatcaacaaactgatccactcggatgagatcctgacctcaaccaaatctagtgtaacaggcaaggtcttcgccggaatccccaccgtggcctctgacacattcgtgtccaccgaccacagcgttcccatcgggaacggccacgtcgccatcactgccgtgagccctcaccgtgacggcagcgtcacttctacgaaactcctgtttccgtctaaggcgacatccgaattgtcacactccgccaaaagtgatgccggattggtcgggggaggggaagacggggacactgatgacgacggggatgatgacgatgacgacagagggagcgacgggctctccattcacaagtgtatgtcttgttcttcctaccgagagtcgcaggaaaaggtaatgaacgactccgacactcacgaaaactcactcatggatcaaaataatccgatctcttattcactttcagagaatagtgaggaagataaccgagtcacgagcgtgtcctccgatagccaaacgggcatggatagatctcctggaaagtctccaagcgccaatggcttgtcccagaagcacaacgatggaaaggaggaaaacgatatccaaacaggctccgccttgcttcccttatcgccagagtccaaagcatgggccgtactgacgtcagatgaagagagcgggtctggccaaggaacctcggattccctcaatgagaatgaaacatcaacagatttcagctttgctgacactaatgagaaagacgccgatggcattctcgctgcaggcgacagcgagattactcctggcttcccacagtcaccgacctcgagcgttacttcagagaatagcgaagtcttccacgtctcggaagccgaagcttcaaacagctcccacgaaagtcgcattggcctggcagaagggttagagtcagagaagaaagccgtgattccattggtcatcgtgtctgctctgaccttcatttgtttggtggtgctcgtcggtatcctaatttactggcggaagtgcttccagactgcccacttctacttggaagattcgacgtccccacgggtgatatccactccacctacaccgatcttccccatctccgacgatgtcggggctatcccgattaagcatttccctaagcacgtggccgacctgcacgccagttcagggtttacagaggaattcgagacactgaaggagttctaccaggaggttcagtcttgtaccgtagatttagggatcaccgctgacagttccaatcaccctgataataaacacaaaaacagatacatcaacattgtcgcctatgatcacagcagggttaagttagcccagcttgctgaaaaggatggaaagttgacagactacatcaacgctaattatgtggacgggtataacaggcctaaggcctacatagcagctcagggcccactgaagtcaacagcggaagatttttggaggatgatttgggaacacaacgtcgaggtcatcgtgatgataactaaccttgttgaaaaggggagaagaaagtgcgaccagtattggccagctgacgggtccgaagagtatgggaatttcctcgtgactcagaagtcagtgcaggtgctcgcatactacaccgtcaggaattttactctccgtaacacaaagattaaaaagggaagccagaaaggcaggcctagtgggagagtggtgacccagtatcattacacccaatggccagatatgggcgtgcctgaatatagccttccagtgttaactttcgtgagaaaggccgcatacgccaagagacacgcagtcgggcctgtcgtggtccattgttccgcaggcgtgggcaggaccggaacgtacatcgtgttggatagtatgcttcagcaaatccagcatgaaggcacagttaacatcttcggatttctcaaacacattagaagtcagaggaactacctggtgcagactgaggagcagtacgtgtttattcatgacactcttgtagaggccatcctgtcaaaggaaaccgaggtgctggattcgcatatacacgcctatgtgaacgctctgctgattcccggaccagctggaaaaaccaagttggaaaagcagtttcagcttctcagtcaatccaatattcagcagagtgactactccgcggctctgaaacagtgcaatagagagaaaaaccgcactagctctattattccagtcgagagatcgagagtcggaattagtagtctgtcaggggagggaactgactacattaacgcatcgtatatcatgggctactatcaaagcaacgagttcataattactcagcacccgcttctgcacaccatcaaagacttttggcggatgatctgggatcacaacgcacaacttgtcgtcatgattcctgacggtcagaatatggccgaagatgaatttgtgtactggccgaacaaagatgaacccatcaattgtgagagcttcaaggtgaccttaatggcagaggagcacaagtgtctcagcaacgaagaaaagctgattatacaggacttcatcctggaggcaacacaggatgattatgtgctggaagtaaggcactttcagtgccccaagtggccgaatcctgactctccaatttccaagactttcgaactgataagcgtaataaaggaggaggcagcaaaccgggacgggcctatgatcgtgcatgacgaacacggcggtgtcacagccggaactttttgcgccttgaccacacttatgcaccagctggaaaaagaaaatagcgtcgacgtttaccaggtggctaagatgattaacctgatgcgcccaggggtgttcgccgacatcgaacaataccaattcctttataaagtgattttgagcctcgtgagtaccaggcaggaagagaacccgagcactagcctcgattctaatggcgctgctctccccgacgggaatatagccgagagcctggaatcccttgtgta

SEQ ID NO: 237191 - DNA, 474 bp, Artificial Sequence
  Description of Artificial Sequence: Synthetic coding sequence
atgggtcggctcactgaggcggcagcagcaggcagtggatcccgagccgctgggtgggccggttctccaccaaccctgttgcctctatcaccaacgagtcctcgctgcgcagccaccatggctagctccgacgaggacggcactaacggaggcgcatccgaagctggtgaggatagggaggcgcctggagagcggagacgcttgggggtcctggcaactgcctggctcactttttacgatatcgcaatgacagcaggcaggttaattctctccccccgtcttgaatgtattggggcaatctcagcccactgccagcctcaacctcccgagttcaagcggttcagttgtctgggtctgcgtagcagctgggattacaaacgaggaccacccaggcccatcaatttctgtattttcgggagggaccgagtgagtccttgttggccaggctggtcaaggacccccgacttaaagtag

SEQ ID NO: 237192 - DNA, 867 bp, Artificial Sequence
  Description of Artificial Sequence: Synthetic coding sequence
atgggcagacttactgaggcagctgctgccggatccggaagccgggcagcgggatgggcgggatctccccctacacttcttcccctatcccctacgagtcctcgttgcgccgctaccatggcatcttcggatgaggacggtacaaacggtggcgcatctgaagcaggtgaagaccgggaggcacccggagaacgtcgcagactaggcgtgttggccacagcgtggctgaccttttacgatatcgcgatgacggccggatggttggtgctggcaatagcgatggtaagattctatatggagaaagggacacaccgcggtctgtataagtctattcagaaaacacttaagtttttccagacattcgccctcttggagatcgttcactgtctaattggaattgtgcccacaagcgttatcgtgaccggagtgcaggtgagctctcgtatcttcatggtgtggctaataacacactctattaaacctatccaaaatgaggagtcagtcgtcctctttctggttgcttggaccgttacagagattacgcgctattccttttatacattctctctcttggaccaccttccctacttcataaaatgggctaggtacaacttcttcattatattgtaccctgtgggcgtggcaggtgaactactaacaatctatgcagcactgcctcacgtgaagaaaaccggcatgtttagcatcagactcccgaataaatataacgttagtttcgattactactatttcttgctaattaccatggcctcttacataccgctcttcccccagctttattttcacatgttgaggcagaggaggaaagtgctccacggcgaggtcattgtagagaaagatgattag

SEQ ID NO: 237193 - DNA, 1269 bp, Artificial Sequence
  Description of Artificial Sequence: Synthetic coding sequence
atggcaggatgtgttcccctgctgcaggggctggttctggtgcttgctcttcatcgcgtagaaccctccgccacatctctaaaagaaagacacggcttacatagtgactctgcatgcactggggtgcaagaatctctctttttaccagcctcaaaggctaacgacgtgcttgtaaggtggaaaagggctggctcatacctcctggaggaattgttcgaggggaatctagaaaaggagtgctatgaggaaatctgtgtctacgaggaggccagagaggtgtttgaaaatgaagtggttacagatgaattttggaggagatacaagggaggttctccctgcatcagccagccctgtctgcataacggctcgtgccaggacagcatttggggctacacctgcacatgcagtccgggatatgagggcagcaattgtgagttggccaaaaacgagtgtcatcctgaacgaacggatgggtgccagcatttctgtctgccaggacaagagagttacacttgctcctgcgcacaaggatatagactgggcgaggatcataaacagtgcgtcccacacgatcagtgcgcttgcggcgtgctgacctcagaaaaacgcgctcccgaccttcaggacctcccatggcaagtgaaacttaccaactccgagggaaaggacttttgcggcggagtcataatccgtgagaattttgtcctcaccacggccaaatgcagtctcctgcaccgcaacattaccgtgaagacctacttcaacagaacaagtcaggacccactcatgattaaaattactcatgtacacgttcatatgaggtacgatgccgacgcaggggaaaatgatctgtccctgttggagctggagtggcccatccagtgtcccggagcaggtctccccgtgtgcacccccgaaaaagacttcgctgagcatctgcttatccccagaacccgcggactcttgagcggctgggccaggaatgggacggacctcgggaacagcctgaccacccgtccagtcacattggtagaaggagaggagtgtggacaggttctgaacgtgaccgtgacaaccaggacatactgcgaacggagctctgtggcggctatgcactggatggatggcagcgtggttacgcgggagcacagaggttcttggttcctcaccggggttctgggatctcagccggtcggtgggcaagcccacatggtactggtgactaaagtgtcgcggtactccctgtggttcaagcaaatcatgaattag

SEQ ID NO: 237194 - DNA, 1203 bp, Artificial Sequence
  Description of Artificial Sequence: Synthetic coding sequence
atggccggttgtgttcctctgttgcagggtctggtcctggttctggctctgcaccgcgtcgagccctccgtgttcctgcctgcgtccaaagcgaacgacgtgttggtgcgctggaaaagagccggatcatatcttctggaggagcttttcgagggcaacctggagaaagagtgctacgaagagatttgcgtgtacgaagaagctagggaggtgttcgagaacgaagtggtgacggatgaattctggaggaggtataaggggggaagcccctgtatctcccagccttgcctgcacaacgggtcatgccaggactcgatttggggctacacttgcacctgcagccccggatacgaggggtcaaattgtgagctggccaagaacgaatgtcaccccgagaggaccgacgggtgccagcacttctgtctgccgggacaggagagttacacctgtagttgtgcgcagggatatcgcctgggcgaagaccataagcagtgcgtcccacatgaccagtgtgcttgcggagtcctcactagcgagaagcgcgcaccagatttacaagacctaccgtggcaagtaaagctgacaaactctgagggaaaggatttctgcgggggtgtcattattcgggaaaattttgtgctgaccaccgcaaaatgttccttgttacacagaaatatcaccgtcaagacatactttaataggacttctcaagaccccttaatgatcaaaataacgcatgttcacgtacatatgcgatatgacgccgatgccggagaaaacgatctgtccctgctggagttagagtggcctatacagtgcccaggagcaggacttccggtgtgtactccagaaaaggatttcgctgaacaccttttaattcctcggactcggggattgcttagcggttgggcacgcaatggtaccgacctgggaaatagcctgaccacccggcctgtgactctcgtagagggcgaggagtgtggacaggtgttaaacgttaccgtgactacacgcacctactgcgagcgttcatccgtcgccgctatgcattggatggatggttccgtggtgacaagagaacacagaggaagttggtttttaaccggagtcctggggtcccagcctgtcgggggtcaggcgcacatggttctcgtgaccaaggtctcccgatatagtctgtggttcaaacagattatgaactag

SEQ ID NO: 237195 - DNA, 1053 bp, Artificial Sequence
  Description of Artificial Sequence: Synthetic coding sequence
atggagcccaagaggataagggagggttatctggtcaaaaaaggcagtgtcttcaacacctggaaacctatgtgggtggttttgctggaggacggcattgaattctataaaaaaaagtcagacaactctcctaagggaatgataccactgaaggggtcaacattgacttcgccttgccaggactttggcaaaaggatgttcgttttcaagatcactaccaccaagcagcaagatcatttcttccaggcagcgttcctggaggagcgcgacgcgtgggtccgcgatattaaaaaagcaatcaagtgcattgaaggaggacagaagttcgccagaaaatccacaagaagaagcatccggctgccagaaaccatcgatctcggcgcactgtacctatccatgaaagacactgaaaaaggtattaaggagttaaatttagagaaagacaagaagatttttaatcactgcttcactgggaactgcgtgatcgactggctggtgagcaaccagtctgtgcgtaaccgtcaagagggactgatgattgccagttcattgctgaacgaggggtacttgcaacccgctggcgacatgtcaaagagtgctgtggatggaacagccgaaaatcccttcctcgataatcccgacgccttctactacttcccggatagcggctttttttgcgaggagaattcgagcgacgatgatgtgatcctcaaggaagaatttagaggcgtcatcatcaagcagggctgcctactcaaacagggccatagaaggaaaaattggaaggtccgaaagttcatactgcgggaggacccggcttatttgcactactacgaccctgcaggtgcggaggatcccctgggagctatacatctacgcggttgcgtcgtcacttcagttgagagtaacagcaacggcaggaaaagcgaggaagaaaatcttttcgaaattataacagcggatgaagtccactattttctgcaagctgccacacctaaggaacgaacagagtggattcgcgcaatccaaatggcctcccggactgggaaatag

SEQ ID NO: 237196 - DNA, 648 bp, Artificial Sequence
  Description of Artificial Sequence: Synthetic coding sequence
atggcatcacttcagatgcggggtaatccaggtagccacttctgcggcggtacacttatccatcctagctttgttcttaccgccgctcactgtcttagggacatcccgcaacgcttggtgaatgtggtgttgggggctcacaacgttagaacccaggagcctacacagcagcacttttccgtggctcaggttttcctcaacaattatgatgccgagaataagctcaatgatgtcctgttgatacagctctcgtcaccagcaaacctatctgcatccgtcgccacagtgcagctgcctcagcaggaccagcctgtgcctcatggcacacaatgcctagcaatggggtgggggcgagttggagcccacgacccacccgctcaggtgctacaggagctaaacgtcacagtggtgacattcttctgccggccacacaacatctgcacattcgtgccccgtaggaaagccggaatctgttttggagactccggtggcccattgatttgcgacggtatcattcaaggtatcgatagcttcgtgatctggggttgcgccactaggctgtttccagatttttttactagggttgccctgtatgttgattggataaggtctacactcagacgggtggaagccaagggtcgtccttag

SEQ ID NO: 237197 - DNA, 858 bp, Artificial Sequence
  Description of Artificial Sequence: Synthetic coding sequence
atgccaggggctcgcagtggcggatccggaggagacgggagtaactcggggtcatactcaggggacgcaagcggcgcagtgacagtgtgggaggttgtgtccttgcttggcaaactgctgggaactgtggttgccctcaaagtggtactttatctgcttcgggtttgcctggctatggcgtggaagagtgggggagcgtcccatagcgagctgatacacaatctccgcaaaaacggcatcatcaagaccgacaaagtgttcgaagtgatgcttgctacggaccgcagccactatgctaaatgcaatccttatatggattcgccacagtctatcggctttcaggctaccatcagcgctccccacatgcatgcttatgctctagagctgctctttgatcaattgcatgagggggcaaaggcgttggacgtcggatccggctctgggatcctgacagcttgttttgcgcgaatggtgggatgtacaggaaaagtgatcggtatagatcacataaaggaattagtggacgacagcgtcaataatgtgcgaaaagacgatcctacccttctgtcatccggccgagtccaactggtagtcggcgacgggagaatgggctatgccgaagaggccccttatgatgcaattcacgtgggggctgccgcaccagtggtaccacaggcactgatcgatcaactgaagcctggaggcaggctaatcttacccgtcggccctgccggtggcaaccagatgctggaacagtacgataagctgcaggatggcagcatcaagatgaagcctctgatgggggtaatatatgtgccactaaccgacaaggagaaacagtggtcaaggtggaagtag

SEQ ID NO: 237198 - DNA, 684 bp, Artificial Sequence
  Description of Artificial Sequence: Synthetic coding sequence
atggcctggaagtccgggggagccagtcatagcgagctgattcacaacttgagaaaaaatggtattataaagaccgacaaggttttcgaagtaatgctggcgactgatcgctcccactacgcaaaatgtaatccttatatggactctccacagtctatcggctttcaagccactatcagtgcccctcacatgcatgcctacgccctggaactcctctttgaccagcttcacgagggcgctaaagctttggacgtcggtagcgggtccggaattctcactgcatgtttcgccagaatggtaggatgtacaggcaaagtgattgggatagaccatattaaggagctggtggatgactccgtgaataatgttagaaaggacgaccctactctcttgtcatccggaagggtgcaattggtagtaggcgacggaaggatggggtacgctgaagaggctccctatgacgccattcacgtgggtgctgctgcgcctgtcgtgccacaggcactgattgaccagctgaaacctgggggacgtctgatacttcctgtcggacctgctggcggtaatcagatgctcgagcagtacgataagctgcaagatggcagcataaagatgaaacctctgatgggagtcatttacgtccctctcacggacaaggaaaagcagtggtccagatggaaatag

SEQ ID NO: 237199 - DNA, 861 bp, Artificial Sequence
  Description of Artificial Sequence: Synthetic coding sequence
atgccaggagcacgcagcgggggtagcggcggagacggtagcaactcaggctcctatagcggggatgcctctggggctgttacagtctgggaggtagtatcactgctaggtaagctgttgggcacagttgttgctcttaaggtggtgctgtatctgctgcgtgtgtgcttggcgatggcatggaagtccggtggggcatcccacagcgagctcatccataatctgcgcaaaaatggcattatcaagacagacaaggtcttcgaggttatgcttgctaccgatagaagccattacgccaaatgcaacccttatatggactcaccgcagtcaatcgggttccaggccactatctccgctccccacatgcatgcttatgcactggaactgctattcgaccaactccatgaaggcgctaaggccttggacgttggctctggctccgggattttgacggcctgttttgccagaatggtgggatgtactgggaaagtgatcggaatcgaccacattaaggaactcgtggatgacagtgtgaataacgtgcggaaggacgatccaaccctgctgtcgtctggtagggttcagctggtggtaggagatgggaggatgggatatgccgaggaggccccatacgatgctatccacgtgggcgcagctgcaccagtggtgcctcaggctttaattgaccagcttaaaccgggaggaaggctgattctgccagtggggcctgccggagggaaccagatgttggaacagtacgataagctccaggatggatctatcaaaatgaagcccttgatgggcgttatctacgtacccctgactgataaggagaagcagtggagcagagacgagttatag

SEQ ID NO: 237200 - DNA, 858 bp, Artificial Sequence
  Description of Artificial Sequence: Synthetic coding sequence
atgccaggggcacgctctggcggatccggcggagacggatcaaactcggggtcctacagcggggacgcctctggggctgtcaccgtctgggaggttgtgagcctattggggaagcttctgggtacagttgtcgctcttaaggtggtgctctatctgctacgcgtgtgcttggctatggcctggaaatctggtggagccagccactctgaactgatccacaatctcaggaaaaatgggatcatcaaaaccgacaaggtctttgaagtgatgttggccacggaccggtcccattacgcaaagtgcaatccttacatggattctcctcaatcaatcggattccaggctacgatttcagcccctcacatgcacgcctacgctctggaattgctgttcgaccaacttcatgagggagcaaaagcacttgatgttggcagtggcagcgggatcctaacagcatgcttcgccaggatggtgggttgtaccggtaaagtgatcggcatcgaccatattaaggaattagttgacgatagcgtgaataacgtgcgcaaggacgatcccactcttctgagcagcgggagggtgcagcttgtcgtgggggacggcaggatgggctatgccgaggaggccccttatgatgccattcatgtcggggcagctgcccctgtcgtaccacaagctttgatcgaccagttgaaaccgggaggaagactgatattgccagttgggccagcgggagggaatcaaatgttggaacaatacgataagctgcaagatggctctatcaaaatgaaacccctgatgggagtcatctacgtgccattgaccgataaggagaagcagtggtctcggtggaaatag

SEQ ID NO: 237201 - DNA, 579 bp, Artificial Sequence
  Description of Artificial Sequence: Synthetic coding sequence
atggcctggaagtcaggcggagcttcgcatagtgagcttattcacaaccttaggagctttcaggccaccattagtgcgcctcacatgcatgcatatgccttggaactcctttttgatcaactgcatgagggcgcaaaggcgctagacgtaggctccggctcggggattttgaccgcatgcttcgctcgtatggtaggctgcacgggaaaggtgattggaatcgaccacattaaggagctggtagatgacagcgtcaacaatgtgcgcaaagacgatcccactctgctgagttccggcagggtccagctcgtggttggcgatgggaggatgggctacgccgaggaagccccttatgatgctattcatgttggcgcagccgctcccgtcgtccctcaggcactcatcgatcaactgaagcctggcggtcgccttatcctgcccgtcggccctgcgggaggaaaccagatgttggaacagtacgataagttgcaagatggcagtatcaaaatgaagcctttgatgggagtcatttatgttccactcacggataaggagaagcagtggtctcgctggaagtag

SEQ ID NO: 237202 - DNA, 2016 bp, Artificial Sequence
  Description of Artificial Sequence: Synthetic coding sequence
atgaaacagattttcttcctcgatgacagcgggccaccatttggtcacatggtcctggcattgggaggctaccttggaggattcgatgggaatttcttgtggaatcgcatcggggcagagtacagcagcaatgtacctgtctggtctctgcgccttctgcccgctctagcgggtgccctgtccgtccccatggcctatcaaatcgtcctggagctgcacttcagtcactgcgctgcaatgggggcagcccttctgatgcttatcgaaaacgcactaatcactcagagccggctgatgctgctggaatctgttttgatattctttaatctgcttgctgtgctaagctacctcaagtttttcaattgtcaaaaacactcacccttttcgcttagctggtggttttggctgaccctaaccggtgtcgcctgtagttgcgcggtgggaatcaagtatatgggcgtctttacctacgtattggtgctgggcgttgcggctgtgcacgcatggcacctgttaggggatcagaccttaagcaatgtttgcgtcttttgtcacctccttgcgcgtgcagtggcactgctggtcatccccgtggttctgtacctcctgtttttttacgtgcatctcattctcgtgttccggtccggcccacacgatcagattatgtcaagcgctttccaggcgtcactggagggcggactggcaaggattacccaaggccagccactggaagtggccttcggcagccaagttacactcaggaacgtgtttggcaaacccgtgccttgctggctccacagtcaccaggacacatatcccatgatctatgaaaatggcagaggcagttcgcatcagcagcaggtgacatgctatccatttaaggatgtcaacaactggtggatcgtaaaagatccacggcgacatcaactggtcgtaagctcccctccgaggccagtgcggcacggcgacatggtccagctcgtccatggaatgactacccgctccctcaacacacacgatgtggcggcaccgctgtcgccccactcccaagaggtgagctgttacatagattacaatatctcaatgcccgctcaaaatttatggagattagaaatcgttaacagaggctcagatacggacgtgtggaagaccattttgtctgaggtgagattcgttcacgtgaatacatccgccgtcctcaagctgtctggtgctcacctaccagattggggctaccgacagctcgagatcgtgggcgagaagctgtctaggggctatcatggatcgaccgtctggaatgtcgaggagcatcgatatggggcatctcaggagcagcgcgaaagggagcgggagctgcacagcccggcacaggtcgatgtgtcacgcaatctgagcttcatggctagattctctgaacttcaatggcggatgttagccctgaggtcggacgatagcgagcacaagtactcttcctctcccctggagtgggtcacgctggataccaatatcgcctactggctgcacccacggacaagtgcgcaaatacatctcctgggcaatatcgtgatttgggtgagcgggtccctggccttggccatctacgctcttctgtccctgtggtatctgctgagaagacgccgtaacgtgcatgacctcccgcaggatgcgtggctgagatgggtattggccggtgctctgtgcgcaggcggatgggctgtgaattatttgcccttctttctgatggaaaaaacactgttcctgtatcactatctgcctgcgctgacttttcagatcctcttactgcccgtggtgctccagcatatatcagaccacttgtgtagaagccagcttcaacggtcaattttttcagctctagtggttgcgtggtactctagtgcctgtcatgttagcaacactctgaggcctctgacgtatggggataagagtctgagcccacacgagctcaaagccttgaggtggaaagactcctgggacatcctgatcagaaagcactag

SEQ ID NO: 237203 - DNA, 2088 bp, Artificial Sequence
  Description of Artificial Sequence: Synthetic coding sequence
atgtggggcttcctcaagcggccagttgtcgtgacagcggacatcaatctgtctctcgtggcactgacaggcatgggcttgctgtctcgactgtggagactgacctatcccagggcggtggtgctatttcgacggatacgatggcaattcttcgtagagcagaactggagcagcgtcgtcgctttccccgagtatagcagcaacgtgcctgtgtggagcctgcgcctgctccctgccctcgccggtgctctctcagtgccgatggcgtatcagatagtccttgagctgcatttttcccattgtgcagccatgggagccgcactgctgatgttaattgagaatgccctgattacccagtcacgccttatgctcctagagtccgtgctgattttcttcaatctcctggcagtgttgtcctatctcaagtttttcaactgtcagaagcattccccgtttagcctatcctggtggttctggctgacactgacgggagtcgcatgcagctgtgctgtgggaattaagtacatgggcgtgtttacgtatgtcctggtgcttggagtcgccgcagtacatgcatggcacctcctcggagaccaaaccctcagcaacgtctgtgttttttgtcacctgcttgcacgagccgtcgcactcctggtgattcccgtggtactctatctgctattcttctatgtgcacttaatattggtcttcagatcgggccctcatgaccagatcatgtcgagcgcttttcaggcctctctggaaggtgggctggccaggattacacaaggacagcccctggaagtagcttttggctcccaggtgaccttaagaaacgtgttcggtaaacccgtgccatgttggttgcacagccaccaagacacatatccgatgatttacgaaaacgggagaggctcttcacaccaacagcaggtgacatgctaccctttcaaggatgtaaataattggtggattgtgaaggaccccaggaggcaccaactggtcgtgagctctccaccccgacccgtccgacacggagacatggtacagctggttcacgggatgaccacccgtagcctcaacacccatgatgtcgccgctcccctgtccccccattcgcaggaagtgtcctgctatattgattataatatctcgatgccggcacagaacctttggaggctggagatcgtgaatcggggatccgatacagacgtctggaagacaattctcagcgaggtccggtttgtgcatgtcaacacttcagcagtacttaagctgtcaggggctcacctgccagactggggctaccggcagctggaaattgtgggtgagaaactgtccagagggtaccacggctccactgtctggaacgtggaagagcatcgctatggcgcttctcaggaacagagggaacgagaacgtgagctgcatagccctgcacaggtcgacgtaagcagaaacctttcttttatggccaggttctccgaattacagtggaggatgctcgccctcagatccgacgatagcgagcataagtacagttcaagcccgctggagtgggttaccctagacacaaatattgcttattggttacaccctcgcacatctgctcagattcaccttcttggcaacatcgtcatttgggtgtccgggagtctggctctggcaatctatgccctgctgtccttatggtatctgctgagacgcagacggaatgtgcacgacttgccacaagatgcctggctccggtgggtactggccggtgccctctgcgctggtgggtgggcagtgaattatcttcctttttttctcatggagaagaccttgttcctgtatcattacctgccagctctgacatttcaaattctgcttctacctgtggtcttgcagcacatatctgatcatttgtgtaggagtcaactgcagcgatccatattttccgcgctggtggtcgcgtggtactcctcagcctgccacgtgagtaatacattgagaccacttacttatggcgataaatcactgagtccacatgaattgaaggcactccgttggaaggattcatgggacatcctcattcgcaaacattag

SEQ ID NO: 237204 - DNA, 1041 bp, Artificial Sequence
  Description of Artificial Sequence: Synthetic coding sequence
tggagaggaggcggatgcacttctcccgctaccttaggagccgctcggggagcggtgggcatagggaaagaagggcagtatcagcccctgattgcatccctgacatggggtctggtaccactgtcacaagcccaagaaattgtcaatagaggaagcgacaccgatgtctggaagacaattctttcagaggtgcgctttgtacacgtgaacacctctgcagtcctaaagctctcaggggctcatttgccggattggggataccggcagctcgaaatcgtgggggagaagctctcacgtgggtatcacgggagcacagtttggaacgtggaggagcaccgctacggagcttcacaggaacaacgggaacgggagagggaacttcactcccctgcacaggttgacgtatccagaaatttgtcttttatggcaagattctcggagctgcagtggcgaatgttagcgttgagatcagacgacagcgaacataagtattcttcctcaccactagaatgggtgactctagatacaaacatcgcatattggttgcaccctaggaccagcgcccaaattcacctcttaggcaacatagttatttgggtgtctggctccctggcccttgctatctatgccctcctgtcactttggtatttgctgcggaggaggcgcaatgtgcacgatcttcctcaggatgcgtggctgcggtgggtactggccggtgctctgtgtgcaggcggatgggccgttaactatcttcccttcttcttaatggagaagaccctgtttctgtaccactacctgcccgctcttacattccagatcttactgttgccggtggtgctgcagcatattagtgatcacttgtgtcgcagccagctccagcggagcatcttcagcgccttggtcgtcgcctggtactctagcgcttgtcatgtttccaacactctgcggccactaacgtacggtgacaagagtttatccccgcacgaattgaaggcactcagatggaaggactcttgggatatccttatcaggaaacactag

SEQ ID NO: 237205 - DNA, 471 bp, Artificial Sequence
  Description of Artificial Sequence: Synthetic coding sequence
atggcgtatcagatcgtgttggagctgcacttcagccactgcgccgctatgggtgctgcattgctcatgttgatcgagaatgccctcatcacccagtcccgattgatgctactcgaatcagtcttaatcttctttaatctgttagccgtactctcctatctcaagttttttaactgccagaaacattctctaccgctgtgggcacccagacctaatcatgtgcaatgccttcctgggcaattacgaggtcgtacttctagcgatcacagtggatccgccacaggagggggactatgggtccctgggcattcagaagaaagactgtgggagacatgcgcactgctggccagtttccccccaggacaccttccacatgatgtaagatatgaaaatggcagaggttccagccatcaacagcaggtgacctgctatcccttcaaggatgtgaataattggtggatcgtcaaatag

SEQ ID NO: 237206 - DNA, 2244 bp, Artificial Sequence
  Description of Artificial Sequence: Synthetic coding sequence
atgtggggtttcctgaaacgacctgtggtggtcaccgccgatataaatctgtcgctggtagcccttacaggcatggggctcttgagcaggctgtggagattaacatacccccgagcagttgtgttcgatgaagtttattacggtcaatacattagcttctacatgaagcagatcttctttcttgacgactccggcccaccttttggccacatggtgctggctttgggcggatatcttggcggatttgacggcaattttctgtggaatcgtatcggagctgagtacagttcgaatgtgcctgtctggtcattgcgtctcctccccgcactcgcgggagcacttagtgttcccatggcctaccaaatcgtgctggagttgcatttcagtcactgcgcagccatgggggctgcacttctaatgctgattgagaatgctctcataactcagtcacggctcatgctactcgagtcagtactcatcttctttaaccttcttgccgtactgtcctacctaaaatttttcaactgtcagaagcattctccattctccctgagttggtggttttggctcaccctcactggagtcgcctgttcatgcgctgttgggataaaatatatgggcgtgtttacctacgtcctggtgctgggcgtcgctgcagtacatgcctggcatctgctgggtgatcagaccctgagtaacgtcggggcagacgtgcaatgctgtatgaggccggcttgcatgggtcaaatgcagatgagtcagggcgtgtgcgtgttttgccacctccttgcgagagccgttgccctcctggtaatacccgtggtgttatatctgctgttcttttatgtacatctcattcttgtattcaggtcgggacctcacgaccaaataatgagttctgcctttcaggcgtcactggagggtggattagcgaggatcacccaaggccagcctctggaagttgctttcggttctcaggtcaccctacggaacgtgttcggaaaaccagtgccatgttggcttcactcacaccaggacacataccctatgatttacgagaacggacggggttcgagccaccaacagcaggttacttgttatccattcaaagacgtcaacaactggtggatcgttaaagatcctagaaggcatcaactcgttgtcagttcaccacccaggcctgtccggcacggcgacatggtgcagctggtgcatgggatgacgaccaggtctctaaacacacatgatgttgctgcccctctcagtccacactcacaggaggtgtcttgctatatcgattacaacatatcaatgcccgctcagaacctctggaggctggagatcgtcaaccgcggaagtgacaccgacgtatggaaaaccattctcagtgaggtcagatttgtccatgtaaatacctctgccgtcttgaaactgtctggcgctcatctcccagattgggggtatcgtcaactggagatcgttggggagaagctgtctagaggctatcacggttctaccgtctggaatgtggaagagcaccgctacggtgccagccaggaacaacgagagcgcgagcgcgaactacactctcccgcacaggttgacgtctcccgaaaccttagttttatggccagatttagtgagcttcagtggcgtatgcttgcactcagaagtgatgattccgaacataagtatagctcaagcccattggaatgggtgaccttggacaccaacattgcatactggctgcatcctaggacctccgctcaaattcacctactcggtaacatcgtaatctgggtcagcggttctcttgcactggctatttacgcgctgctgtccctgtggtacttattacgtcggaggcgtaacgttcatgacctaccccaggacgcctggttaaggtgggttctcgcaggcgctctgtgcgctgggggatgggccgtgaactatcttcctttctttcttatggagaagaccctatttttatatcattacctgcctgcactgaccttccagattctcctccttccggtggtactccagcacatttcagatcatttgtgtcgttcacagcttcagcggtccatcttttctgcactggtggtggcctggtactcttcagcctgtcatgttagcaatacactccggcctctcacgtacggagataagtcccttagcccccatgaattgaaggcgctcaggtggaaggattcttgggacatactcatccgcaaacattag

SEQ ID NO: 237207 - DNA, 2178 bp, Artificial Sequence
  Description of Artificial Sequence: Synthetic coding sequence
atgtggggttttctgaagaggcccgtcgtcgtgaccgccgacatcaatctgtctctcgtggctctgactggcatgggacttttaagccggctatggcgcctgacctatccaagggcggtcgtctttgatgaggtgtactatggacaatatatcagtttctacatgaaacaaatttttttcttagacgatagcggtccccctttcgggcatatggttttagccctgggaggatacttgggcggtttcgatggcaattttctgtggaacaggatcggcgcagagtattcgagcaacgtccccgtctggagtctgagacttctgccagccctggccggagccttgtctgttcccatggcctaccaaatcgttttagagttgcattttagccactgcgctgccatgggtgcagcgctgctgatgctaatcgaaaatgcattgatcacacagtcaagacttatgcttctcgagagcgtgctcatcttcttcaatctgttggccgtgctcagttatctgaagtttttcaactgccagaaacattcccctttctccctcagttggtggttctggttgaccctcaccggtgtggcatgttcctgcgctgtcggaattaaatatatgggcgtgttcacttatgttctggtcctgggagtggcagcggtgcacgcgtggcatctgctgggggatcagactctcagtaacgtctgtgtgttttgtcatcttctggctcgggctgttgccctattggtcattcccgtggttttgtacctgttgttcttctacgtccacctgatcctggtattccgatctgggccacacgaccaaattatgagtagcgccttccaggcttctttagaggggggactggcccgtataacccaggggcagcccctggaagtggcttttgggtctcaggtgactctccgaaacgtattcggcaagcctgtaccatgctggttgcactcccaccaagacacttacccaatgatctatgaaaatggacgaggatcttcccaccagcagcaggtgacctgctatccttttaaggacgtgaacaactggtggatcgtcaaagacccccgaaggcatcaactggtcgttagtagcccacctaggcctgtccgccacggggatatggtgcagctagttcatggcatgaccacgcgctctttgaatactcacgacgtcgctgctccattgtctcctcactcacaggaggtgtcttgttacattgactacaatatcagcatgccagcccagaacctctggcggctggagatcgttaacagagggtctgataccgatgtatggaaaaccattctctccgaagttcgattcgtgcatgtaaacacttccgccgtgctgaaactctccggagcacatcttcccgattggggatacagacagctcgaaattgtgggtgagaaactgagtcggggttatcacggttctaccgtgtggaatgtcgaggaacatcggtacggcgcatctcaggagcagagagagagggaaagagagctccatagtcccgcacaggtggatgtgagtcgcaacctatcttttatggccaggttttccgagctccaatggaggatgctcgccctgcgcagcgatgacagcgagcataagtattcttcctcacccctggagtgggtgacactggataccaacattgcttattggctgcaccctcgcactagtgcacagattcatctgcttggcaatattgtaatttgggtatcagggagcctggccctcgccatttacgctttgcttagcctatggtatctgctaagacggaggaggaacgtgcacgatcttccacaggatgcgtggctgcggtgggtgttggcgggagcactttgcgccggtgggtgggccgtgaattaccttccattctttctgatggagaagacactgtttctgtatcattatctccctgccttgacctttcaaattctcttgttaccagttgtgctccagcacattagtgatcacctgtgccgatcccaactgcagaggtccattttcagtgcactcgtagttgcttggtattcatctgcatgccacgttagcaatacgctgcgcccactcacttacggtgataagtctctctctccccacgagctcaaggcactgaggtggaaagacagttgggatatccttattaggaagcactag

SEQ ID NO: 237208 - DNA, 1827 bp, Artificial Sequence
  Description of Artificial Sequence: Synthetic coding sequence
atggcgtaccaaatcgtccttgagctacatttctcccattgcgctgcgatgggcgctgctctactgatgctgattgagaacgccttaatcacacagtccaggcttatgcttcttgagtctgtgcttattttctttaatttgctggccgttctctcctatctgaaattctttaactgccagaaacactctccttttagcctgtcctggtggttctggctaactttgacaggagtggcctgcagttgtgcagttgggattaaatacatgggcgtctttacttacgtcctggtgttgggggtggccgctgtccatgcctggcacctactgggagaccagactctttctaatgtttgcgtattctgccaccttcttgcaagagctgttgcactgttggtgatccctgtcgtcctgtatttgctgtttttttatgtgcacctcatcctggtgtttcggagcggtccacacgaccagatcatgtctagtgcattccaggcctccctcgaaggaggcctggctagaattacccagggccaacctctggaggtggcatttggatctcaggtgacactgcgaaatgtgtttgggaaacctgtcccatgctggctgcactcccaccaagatacttatcctatgatttatgagaacggtcgaggatccagccatcaacagcaggtgacttgctacccgtttaaagacgttaataattggtggatcgttaaggatcccagacgacatcaactcgtggtaagctcaccacccagaccggtccggcatggggacatggtccagctggtccatgggatgacgacccgtagcctcaatacgcacgacgtggccgctcccctgagcccccacagtcaggaggtctcttgttacatcgactacaacatctccatgcccgcacagaacctgtggaggctggagatagtaaatcgcggtagcgatacagatgtttggaagaccatactgtcagaggtgcgattcgttcacgtcaacaccagtgctgttttaaagctgagtggggctcacttgcccgactggggataccgtcagctagagatagtgggcgagaagctttcacgaggttaccacgggagcacggtctggaatgtggaggagcatcgctatggagcctcgcaggagcagcgcgaacgcgaacgcgagctccactctccagcccaagtggacgttagtcgaaatcttagtttcatggcgagattctccgaactgcagtggaggatgctggccctccgcagcgacgactcagagcataagtattctagttccccgctcgaatgggtcactctggacactaatatcgcctactggcttcaccccagaacctccgcacagatccacttgctgggcaacatagtgatttgggtctccggcagcctggccctggctatttacgctctcctgtcattatggtatttattgcggagaaggcgtaatgttcacgacttaccccaggatgcttggttgaggtgggtactggcaggggctctttgcgcaggaggatgggcggtaaactacctgccattcttcctaatggagaagaccctctttctgtatcattacctacctgccttgacgttccaaatactgctcctgcccgtggtgctgcagcacatttctgaccatttgtgtcgcagccaactgcagaggagtatcttctccgccttagtggtggcctggtacagctctgcatgccatgtgtctaacactttaaggccgctgacatacggcgacaaatctttatccccacacgagctcaaagcactccggtggaaagacagctgggacatattgattaggaaacactag

SEQ ID NO: 237209 - DNA, 471 bp, Artificial Sequence
  Description of Artificial Sequence: Synthetic coding sequence
atggcttaccaaattgtcttagagctccatttctcccactgcgctgctatgggggctgccctactaatgctgatcgagaacgctctcatcacacaaagcaggcttatgctgcttgaatccgtgctgatcttctttaaccttctcgccgtgctgtcatacctgaaatttttcaactgccaaaagcattctctaccactgtgggcaccaagacccaaccacgtgcaatgtctccctggtcaacttagaggcaggacttcgagcgatcattccggctctgcaaccggaggtggactctgggttcccggacatagcgaagagcgcctctgggagacctgcgcccttcttgccagtttccccccagggcacctccctcatgacgttcggtacgagaatggtcgtgggtcttctcatcagcaacaggtaacctgttatccgttcaaagatgtcaacaattggtggatagtgaaatag

SEQ ID NO: 237210 - DNA, 429 bp, Artificial Sequence
  Description of Artificial Sequence: Synthetic coding sequence
atgtggggattcttgaaacgcccagttgtcgtcactgctgatattaacctctctcttgtggcactcactggtatgggcctcttatcacgcctgtggcggcttacttacccacgtgccgtggtgtttgacgaagtttactacggccagtacatcagtttctacatgaaacagattttcttcctggacgactccggacccccatttggacatatggtactcgctttggggggatatctgggtgggttcgatggcaatttcctgtggaataggatcggtgccgagtattcctctaacgtgcccgtctggagtctaaggctcctgccagccctggccggagccctgagcgtgccgatggcatatcagatcgtgcttgaattgcactttagccactgtgccgctatgggggctgcattgctcatgctgatctag

SEQ ID NO: 237211 - DNA, 1722 bp, Artificial Sequence
  Description of Artificial Sequence: Synthetic coding sequence
atgttgctggaatctgtattgatattttttaacctgctcgccgtgctgtcctacctcaagttttttaactgtcagaaacactctccttttagtttatcttggtggttttggctcaccctcactggcgtcgcctgcagctgtgccgtcggcatcaagtatatgggagtcttcacctatgtgctagtgctgggagttgcggctgtccatgcttggcacttactcggagatcagacactgtctaatgtttgtgtcttttgccatctcttggctcgggcagtggcattgctggtaattcccgtagtgttgtacctgctgtttttctacgttcatctcatactggtgttcagatcaggccctcacgatcagattatgtcgtctgcctttcaggcttctctcgagggcggactcgcacgaattactcagggacagccgctggaagtggcttttgggagtcaagtcacccttcgaaatgtctttgggaaacccgtgccttgttggttgcactcccaccaggacacttatcctatgatctatgaaaatggccgtgggagttcccatcagcagcaggtcacatgttaccccttcaaagacgtaaataattggtggatcgttaaggatcccaggcgccaccaactagtagtcagtagcccacccagaccggtgaggcatggcgacatggtgcagctggttcatgggatgacaacccggagcctgaatacgcatgatgtcgccgcacctttgagccctcactcccaagaggtctcttgctacatcgattataacatttccatgccagcccagaatctgtggcggcttgagattgtcaacaggggatcagatactgatgtgtggaaaacgattttaagcgaagtgagattcgtgcacgtgaatactagtgcagttctgaaactctcaggcgcacacctgcctgattggggatatagacaattggagatcgtgggagaaaagctctcaagagggtatcacggttcaactgtctggaatgtagaggagcatcgctatggcgcatcccaggagcaacgggagcgcgagagggaactgcactctcccgcacaggtggatgtgtctcggaatctcagctttatggctcggtttagcgagttacaatggcggatgctcgcactcagatcggatgattctgagcacaagtacagttcatctccactggagtgggtaacactggataccaacattgcttattggctgcatccccgaacgtctgcccagatccacttgttgggtaacatcgtgatctgggtgtcaggaagtcttgccctggccatctacgctcttctgagcctttggtacctgctgagaaggaggagaaacgtgcacgacctcccacaggacgcttggctgaggtgggttctggctggggctctttgtgcaggaggatgggccgttaactatctgcccttctttctaatggagaagacattgtttctgtatcactacctgccagctctcacatttcagattcttctgttgcctgtggtcctgcagcatattagtgaccatctgtgccgctcccagttgcagagaagcatcttttcagcgctggtagtagcatggtacagtagtgcgtgccatgtgtctaacaccttaaggcccctgacatacggcgacaaaagcctgagtccgcatgagctgaaagctctgcggtggaaagacagctgggatattcttatcagaaagcattag

SEQ ID NO: 237212 - DNA, 2178 bp, Artificial Sequence
  Description of Artificial Sequence: Synthetic coding sequence
atgtggggatttttgaagaggcccgtcgtggtgactgccgacatcaatctgtccctcgtggctctcactggtatgggtctgctgagcagactgtggcggcttacttatcccagggccgtggtatttgacgaggtctactacggccagtacatctctttttatatgaagcagattttctttctggatgattctgggccaccgttcgggcacatggttctggcactcggagggtacctcggtgggtttgatggaaattttctctggaaccgaatcggagctgagtacagctccaacgtgccagtttggtccctgcgactgcttcccgcactggcaggggcactttctgtgcccatggcctaccagatcgtactagagttacatttttcccattgcgcagccatgggagccgctctgttaatgctgatcgagaatgctctgataactcaaagtcgcctcatgcttctggaaagcgtgctgattttttttaacctgctggccgtgctgagttatctcaaatttttcaactgccaaaagcactcccccttcagtctaagctggtggttttggctgactctgactggcgtggcctgctcctgcgctgtgggaattaagtatatgggagtattcacatacgttcttgtcttaggggtagcggctgtccatgcctggcacttactgggcgatcaaaccctgtcgaatgtctgtgtcttctgtcatttactggctagagccgtcgctctcctggtgatccctgtcgttttgtacctccttttcttctatgtgcatctcatccttgtttttcggtctgggccacacgatcagatcatgtcatcagcttttcaggccagtctcgagggtgggctggccagaattacacaaggacagcctctagaggtagcttttgggtctcaagtgacacttcgcaatgtctttggcaagcccgtcccctgttggcttcactcccaccaggatacttacccaatgatctacgagaacggcagaggctcaagtcatcagcagcaggtgacttgttacccgttcaaagacgtaaacaactggtggatcgtgaaagaccctaggaggcaccagcttgtggtcagctcacctccacgccctgtgcgacatggagacatggtgcagctggttcatgggatgaccacaaggtcgctcaacactcacgatgttgccgcaccactgtccccccacagccaggaagtaagctgctacatcgattataacatcagcatgcccgctcaaaacttatggagactagaaattgtgaaccggggatccgacaccgatgtgtggaagaccatcctctccgaggtccgattcgtccatgtaaacacctccgcagtactgaagctctctggggcacatctccccgattggggttacagacaactggagatcgtcggtgagaaactcagtagaggctatcacgggtcaactgtttggaatgtcgaggaacaccggtacggagcttcacaggaacaacgtgagcgagaaagagaactgcactctccagcacaggttgacgtgtcacgcaatctctcatttatggccaggttctctgaacttcagtggaggatgttggccctgaggagtgacgactccgagcacaaatacagcagcagtcctctcgagtgggtgacattagacaccaacattgcatactggttacatccacggactagtgctcaaatccatctgctgggaaatatagttatttgggtttcgggttcgctcgccttagccatctacgccttgttatcattgtggtaccttcttcgccgacgcagaaacgttcatgatttgccccaggacgcttggctccggtgggtgttggcgggagctctttgtgctgggggatgggcagtgaactacctgcccttcttcctaatggaaaagactctgttcctttaccattacctacctgccctgactttccagatactcttgttgccagtggtgcttcaacacataagcgaccacctgtgtagatcccagttgcagcgtagcatattcagcgccctggtcgttgcatggtacagctccgcgtgccacgtgtccaacaccctgcggcctttgacatacggggacaaatcgctctctcctcatgaattaaaagccttacgttggaaagacagctgggatatcctcattagaaagcactag

SEQ ID NO: 237213 - DNA, 507 bp, Artificial Sequence
  Description of Artificial Sequence: Synthetic coding sequence
atggcttaccaaatcgtgttagagttgcacttttctcactgcgccgcaatgggcgctgccctcttgatgctcatagaaaacgctctcatcacacaatctagacttatgttgctcgagagtgttttaatcttcttcaacttgctggctgtgctgtcttacctgaagtttttcaattgccagaaacattctccttttagtttgtcatggtggttctggcttacattaacaggggtggcctgttcgtgtgctgtcgggatcaaatacatgggcgtgtttacttatgttcttgttttgggggtggctgcagtgcacgcctggcatctgctgggggatcagaccctgagtaacgtctgcgtgttctgccatctcttggccagagccgtagcccttctggtaatccctgtcgtgctgtacctgctgttcttttacgtgcatctgatccttgtgttccgaagcggaccccacgaccagataatgtcttccgcctttcaggccagcttggaatag

SEQ ID NO: 237214 - DNA, 894 bp, Artificial Sequence
  Description of Artificial Sequence: Synthetic coding sequence
atggcttaccagattgtcctggagctccacttcagccactgcgccgcaatgggcgctgctctcctgatgcttatcgagaatgcactcatcactcagtctaggctcatgctcctggaatcagtactaatcttctttaacctgctggccgtactatcatacctgaagtttttcaactgccagaaacacagccctttctccctgtcctggtggttctggctgacgctcaccggggtggcctgtagctgtgccgttggtattaaatatatgggtgtgttcacttatgtactagttctaggagtagccgcagttcatgcctggcacctcctgggcgatcagactctcagcaacgtaggagctgatgttcagtgctgtatgcgacccgcatgcatgggccaaatgcagatgagtcagggggtgtgcgttttttgccacctcctggctcgagcagtggcccttctggtgatccctgttgtgttatatttgctgtttttctatgtgcacctgatcttggtgtttcgctccggaccacatgatcagatcatgagctccgcattccaagcttcattagaaggcggactggcccgtatcactcagggccagcctctcgaagtggcttttggctcccaggttacattgcgcaacgtatttggaaaaccagttccttgttggctccattctcatcaggatacataccccatgatctacgagaacgggagagggagctcccaccagcaacaggtgacttgctaccctttcaaggacgttaataactggtggatcgtgaaggaccccagaaggcatcagctcgtagtcagctcccctccaagaccagtgaggcatggggatatggttcagttggtgcacggcatgactacacggtctctgaatacctag

SEQ ID NO: 237215 - DNA, 657 bp, Artificial Sequence
  Description of Artificial Sequence: Synthetic coding sequence
atgaaacagatattctttctcgatgactcagggcctccctttgggcacatggtgctggcgcttggtgggtacctggggggttttgatgggaactttctgtggaataggattggggcagaatactcctccaacgtcccagtctggtcccttagactgctgcccgctttagctggggcactgtcagtaccaatggcatatcagattgtgctagagctccacttcagccattgcgcagctatgggtgccgctttgttgatgctgattgagaacgctctcattacccagtcccgcttgatgctgctcgaatccgtactgatcttctttaacctgctcgccgttttgtcatacctgaaattctttaactgccagaaacattccccatttagtctttcttggtggttctggctcactctgacaggcgtagcatgtagctgtgctgtcggcattaaatatatgggagtattcacttacgttttggtactgggagtggccgcagtccatgcatggcacctgcttggggaccagactcttagtaatgtgggagccgacgtgcagtgttgtatgagacccgcatgcatggggcagatgcagatgtcgcaaggcgtttgcgtcttttgtcacctcctggctcgtgccgtagcactcctggtcatctag

SEQ ID NO: 237216 - DNA, 1398 bp, Artificial Sequence
  Description of Artificial Sequence: Synthetic coding sequence
atggcaatattctgcggtaccgagttagagcaggtgtgcgtgttctgtcacctgctagccagagctgtcgcgctgttagtgattcccgtggtgctctatctgctgtttttttacgtgcacctgatcttggtgtttaggtccggcccacacgaccaaattatgagctcagccttccaagctagtctggaaggcggactggcgagaatcacacagggccagcctctggaagtagcatttggctcgcaagtcaccttgaggaatgtctttggaaagcctgtgccctgttggctgcattctcaccaggacacgtaccctatgatatatgagaacgggaggggctcttcacaccagcagcaagtgacgtgctatcccttcaaggacgtgaataactggtggatcgtcaaggatcctagaagacatcagcttgtagtcagcagtccgccacggccagtccgccacggcgacatggtgcagctcgtgcacgggatgaccacacggtcgttgaatacacatgatgtggcggctcccctctccccccacagccaggaggtctcctgttacatcgactataacatatccatgcccgcacagaacctgtggcgcctagaaattgtgaatcgaggatcagacacagatgtctggaaaacaattttgagcgaagtgcgctttgtgcacgttaatacttccgccgtgctaaagctgtccggagcacatcttcctgactggggctataggcaactcgaaattgtgggggaaaagcttagtagagggtatcacgggagtacagtctggaacgtggaggagcacaggtatggcgcatcccaggaacagcgcgagcgagagcgagaattgcattcaccagctcaggtagatgtgtcccgaaacctgagcttcatggcacggtttagcgagctgcaggctcaaatccacctcctgggcaatatcgtaatttgggtcagcggcagtctcgcactcgccatttatgcactccttagtctatggtatctgcttagacgacggagaaacgtgcatgacttgccacaagacgcatggctgcgatgggtgctggctggggctctgtgcgctggcggttgggctgtgaattacctgccattcttcctcatggagaaaacactcttcttgtaccactacctgcctgcattaacatttcagatcctgctgctgcccgtggtgcttcagcacatttcagatcatctctgtcgtagccagttgcagagaagcattttttccgcactcgtcgtcgcatggtatagctccgcctgccacgtgtcaaacacactgcgcccacttacttacggtgacaaaagcctgtccccacatgagctgaaggccctgcgctggaaggattcttgggacattcttatcagaaaacactag

SEQ ID NO: 237217 - DNA, 2253 bp, Artificial Sequence
  Description of Artificial Sequence: Synthetic coding sequence
atgccaccggctacagggggaggcctcgccgagagcgagctgagacccagacggggaaggtgtggtccacaggcagctcgggctgccggaagggacgtcgccgctgaagctgtggccagaagcccaaagcgacctgcttggggctcacggagatttgaggctgtgggatggtgggccctgctggccctggtcactctcctgtctttcgctactaggtttcaccgcctcgacgaacccccacacatctgctgggacgaaactcactttggcaaaatgggcagctattatatcaatcgtacatttttcttcgatgtgcatcctcctctcggaaaaatgctgatcggactagccggttaccttagcggttacgatggcacatttctgttccagaagcccggagacaaatacgaacaccactcttacatggggatgaggggcttttgtgcattcctgggcagctggttggttccattcgcttacctgactgtgttggatctatcaaagtcactgtctgccgctcttcttacagccgctctcctgactttcgacactggttgtctgacactatctcagtacatactgctagaccccatcttgatgttcttcatcatggctgctatgctgagtatggtgaaatataactcttgcgccgaccgacccttctccgctccttggtggttttggctgagcctaactggcgtatctctggcgggagcactcggagtgaagtttgttgggctgtttataatccttcaagtggggttgaatacgattgccgatctctggtatctgtttggcgatttgtcattgtcactggtgacggttggaaagcacttaactgctcgggtactatgcctgatagtgttaccccttgcactgtatacagccacttttgccgtgcactttatggtgctgtctaagagcgggcctggcgacggtttcttttcctctgcttttcaggccaggctcagcggcaacaatctgcacaacgcctcaatcccagagcatctggcttatggctcggtcataactgtcaagaacctgcgcatggccatcggttacttgcacagtcaccgacatctgtatcctgaaggtattggagcccgacaacagcaggtgactacctacctacacaaagactataataatttatggatcataaaaaagcataatacaaactctgaccccctggacccgtcctttcctgtggaatttgtgaggcacggggacataattcggctcgagcacaaagaaactagtcgcaatctgcactctcactaccacgaagccccaatgacccgaaagcactaccaggtgacgggatacggcatcaacgggaccggcgactctaacgatttctggcgaattgaagtagtgaatcgaaaatttggtaataggatcaaggtcttacggtcaagaattcgtttcatacatctggttacgggttgcgtgttaggcagctccgggaaggtgttgccaaagtgggggtgggaacagctggaggtgacctgcacaccctatctcaaagagaccctgaacagcatctggaacgtcgaggaccacatcaatcccaaactgcccaacatctccctagatgtcctgcagcccagtttccccgagattctcctggaatcccatatggtaatgatccggggaaattctgggcttaaaccaaaggacaacgaatttaccagcaagccttggcattggcccattaactaccagggactccggttctctggagtcaacgacacagacttcagagtctacttgctcggcaaccccgtagtgtggtggttaaacctcctgtccatagccctgtatctgctctctggttcaataatagcggtcgctatgcagcgcggagcgcgtctaccagctgaggttgcaggactttcccaggtgctcctccgcggaggcggacaagtgctgctgggatggacacttcactacttcccctttttcctcatgggaagggttctgtacttccaccattatttccctgcaatgctcttttccagcatgcttacagggatactgtgggacacattgctgcgcctgtgcgcctgggggctggcctcgtggccgctcgccagagggatccatgtggccggtattctcagtttgctactgggaaccgcttattctttttacttattccaccccttagcgtacgggatggtcggcccactcgcacaagaccctcagtcaccgatggccggtttgagatggctagatagttgggacttttag

SEQ ID NO: 237218 - DNA, 669 bp, Artificial Sequence
  Description of Artificial Sequence: Synthetic coding sequence
atgaagctgccccttctgctcgccctgctctttggagcagtgtcagccctgcacttaagatccgagaccagcacttttgagacacccttgggagctaagaccttgcctgaggatgaagagacgccagagcaggagatggaggagaccccatgcagagagctagaggaggaggaagaatggggttcaggatcagaagatgcgagtaaaaaggacggagcagtcgagtctatatcggttcctgacatggtggataagaacttaacatgccctgaagaagaagacaccgtgaaggtagtgggcattccaggatgtcagacgtgtcgctacctactcgtcagaagcttacagacgttctcacaggcctggttcacctgccggaggtgctaccgagggaacctcgtctcaatacacaatttcaatattaactacaggattcaatgctctgtcagcgctttgaatcaaggacaagtatggattgggggtaggattactggaagcgggcgttgcaggcgtttccaatgggtggacggatctcggtggaactttgcctattgggctgcccaccagccctggagtagaggagggcattgcgtggcactttgcactcgcggaggacattggcgacgtgcgcactgtctcaggaggctgcctttcatctgctcgtattag

SEQ ID NO: 237219 - DNA, 669 bp, Artificial Sequence
  Description of Artificial Sequence: Synthetic coding sequence
atgaagctgccactgctgctcgccctgctctttggtgcagtttcagctctccacttgcgcagtgaaacgtccacattcgagacaccactcggggcaaaaaccctccccgaggacgaggagactccggagcaggagatggaggagaccccttgcagagagctagaagaggaagaagagtggggatcaggatccgaagacgccagtaagaaagatggtgctgttgaatccattagtgtccctgatatggtggacaagaacctgacctgccccgaggaggaggatacagttaaggtcgtgggcatccctgggtgccagacatgcaggtacctactggtgcggtctctgcaaaccttttctcaggcctggtttacatgtcgaagatgttacaggggtaaccttgtgagcatccacaattttaatatcaattaccgcattcagtgtagcgtttctgcactgaaccaaggccaggtttggatcgggggtcgcatcaccggaagcggtcggtgcagacgcttccagtgggtggacgggtctcgctggaatttcgcctactgggctgcccatcagccctggagcagagggggtcattgtgtggcgctatgtactagggggggacactggcggagagcacattgcctaaggcggctgcccttcatttgtagttattag

SEQ ID NO: 237220 - DNA, 636 bp, Artificial Sequence
  Description of Artificial Sequence: Synthetic coding sequence
atgaagttacctttgctgctggcactgcttttcggagccgtttcagccctccatcttaggtccgagaccagtacctttgagacacccctgggagcaaagaccctgcctgaggatgaagagacacccgagcaggaaatggaagagaccccttgcagagagctcgaggaggaggaggaatgggggagcggttctgaagacgcatctaagaaggacggtgcagtggagagcatcagcgtgccagatatggtggacaaaaacctgacgtgcccagaggaggaagataccgtgaaggtggtgggcatcccaggttgccagacgtgccgatacctgctgtttacctgtcggagatgttacagaggtaaccttgtgagcattcacaatttcaacatcaactataggattcagtgttcagttagcgccctcaatcagggccaggtttggattggaggtaggataaccggttcaggtagatgccggaggttccaatgggttgatgggagtcgctggaattttgcatactgggccgcacatcagccttggtctcggggaggtcattgtgtggccttgtgtacccgagggggacattggcgaagagcccactgcttgcggaggttgccctttatttgctcatattag

SEQ ID NO: 237221 - DNA, 678 bp, Artificial Sequence
  Description of Artificial Sequence: Synthetic coding sequence
atgcaatgtttgcttcttctaccttttttgctcttaggaacagtaagcgccctacacctggaaaatgacgcgcctcaccttgaatcacttgagacgcaggccgatctaggtcaagatctggatagtagcaaagagcaggaacgagaccttgctctcaccgaggaggtcattcaggccgaaggcgaggaagtgaaggcttcagcctgccaggacaatttcgaagatgaggaagcaatggagtctgatccggctgccctagacaaagattttcagtgccccagagaagaagatatcgtcgaggtccaaggttctccccgatgcaagatatgccggtacctcctggtgcggaccccgaagaccttcgctgaagctcagaatgtgtgcagccgttgttatgggggaaacttggtgtccatccacgactttaatttcaattaccgcatccaatgctgtacaagcaccgtgaaccaggcccaggtgtggattggagggaatctcagggggtggtttctgtggaaacggttttgctggaccgacggctcccactggaactttgcttattggtctcctggtcagcccggtaacggacagggtagttgtgtggccctctgtaccaaaggaggctactggaggagggcccagtgtgataagcagctcccctttgtttgctccttttag

SEQ ID NO: 237222 - DNA, 4092 bp, Artificial Sequence
  Description of Artificial Sequence: Synthetic coding sequence
atggcctggaaaaccctccctatctatttgttgctgttactgagtgtctttgtgatccagcaagtgtcctcgcaggagctctcctgtaaaggtagatgcttcgagtcttttgagagggggagagagtgcgattgtgatgctcagtgtaagaaatatgacaaatgctgcccagactacgaaagtttctgtgcagaagttcataacccaacctcccctccttccagcaagaaggccccacctcctagtggcgcatcccagacgatcaagtctaccacgaaacgctcccccaagcctcccaataagaaaaagaccaagaaagtgatcgaatccgaagaaatcacagaagagcactcagtgagcgagaaccaggaatctagtagcagctcctcctcatccagctcatcctccaccattcgtaaaattaagtcttctaagaatagtgcggcaaatcgggagctgcagaaaaagctcaaagttaaggataacaagaagaaccggacaaaaaaaaaacctacgcctaagcctcctgtggtcgatgaagctggatccggcctggacaatggagatttcaaagtgactacccctgatacctccactactcagcacaacaaggttagtacgagcccaaagataaccactgccaagcctatcaacccacgcccaagccttccacccaattcagacacttctaaagagacttccctaacagtcaataaggagacaactgtggaaactaaagagacgacaacaacaaataaacagacaagtaccgacggcaaagaaaaaacaacatcagccaaggaaacccagtcgatagagaagacgagcgctaaagacttggcacccacctctaaagtgctggccaagcctacccccaaagccgaaactaccaccaaaggtcccgctctgactacaccaaaagaacccacacccaccactcccaaagaaccagcaagtacaaccccaaaggagcccacacctacaaccattaaatcggctccgactacccctaaagagcccgctccgaccacaacaaagagcgctcccaccacccccaaggagcccgctccaactaccaccaaggaaccagcccctacaacacctaaagaacccgcaccaactacaaccaaggaaccggctcccaccacgacaaagagcgcccctactacaccaaaggaacccgctccaacaacacccaagaaaccggcacccactactccgaaggaaccagcgccaactaccccgaaagaacccactcctacaaccccaaaggaaccagcacctaccacaaaagagccagctcccacaaccccgaaggagccagcgccaacagctccaaagaagcccgctcctactacacctaaggagccagcacctaccacccctaaagaaccagcccctactacgaccaaagaaccctctcccaccacgcctaaagaaccagcccctaccacaacgaagagcgccccaaccacaaccaaagaaccggctcccaccacgacaaaaagcgcaccaacgacaccaaaggagccttcccctaccactactaaagagcctgcgccaacgactcctaaagagcccgcacccaccaccccaaaaaaacctgctccaaccacccccaaagaacccgctcccaccacccccaaggaaccagcgccaaccaccactaaaaagcctgccccaaccaccccaaaagaacctgcccctactacccctaaggagacagctcctactacccctaaaaaacttacacctacgactccagaaaaattggctccaactactccggagaagcctgcgccaacgacccctgaggagctcgcacccaccactccagaggagccaacccctactacacccgaggagccagcgcctaccactccaaaggcagccgcaccaaacacaccaaaggagccagcgcctaccacgcccaaggaaccagcaccgaccactcccaaagagcccgcacctactactccgaaagaaaccgcccctacgacacccaagggtaccgccccaactaccctgaaggaacccgctccaacgacacctaaaaagcctgctccaaaggaattggcccctactacaacgaaagaacccacctccacaacctgcgataagcccgcacctaccactccaaaggggaccgcccctaccacccctaaagagcccgcacccactacacccaaagaaccagctccaacaacgcccaagggaactgcccctaccaccctcaaagaaccggcacccactaccccaaagaaaccagctcccaaagaactcgctccaactactacaaagggcccaaccagcaccacaagcgacaaacctgcacccaccacccccaaagaaacagcgccaacaaccccaaaagaacctgcacccaccaccccaaaaaaaccagctcccacaacaccagagacaccccctcccacaactagcgaggttagtactcctaccactaccaaggaaccaactactatccataaatcccccgacgaaagtactcctgagctgtccgccgagcccacacccaaagctttggaaaattctcctaaagagcccggtgttccaaccactaagactcctgccgcaacaaaaccagagatgaccaccacagcaaaagacaaaacaacagagcgcgacctgcgcacgacgccagaaaccaccactgccgcaccaaaaatgactaaggagaccgcgacgaccaccgaaaaaactacggagtccaagattaccgcgaccactacgcaggtaacctctacaaccacacaagataccacccccttcaaaatcactactctcaaaacaacaactctcgctcctaaggtgactactactaaaaagactatcacgacaaccgagatcatgaataaaccagaggagaccgcgaagcctaaagatagggctactaactcgaaggctacaaccccaaagccccaaaagccgacaaaagctccaaagaagcctacatcaactaagaaacccaagaccatgccaagggtgagaaagccaaagacaacaccaacacctcgcaaaatgacaagtacgatgccagagctcaacccaacatccaggatagccgaagccatgcttcaaacgaccacgcggccaaaccaaactccgaattcaaagctcgtggaggtgaaccctaagagtgaggatgcgggtggagccgagggtgaaacaccccacatgttactgcggccacatgtgttcatgcccgaggtcactcctgacatggactacctgccgagggtacctaaccaaggaatcattattaaccccatgctgagtgacgaaacgaacatctgcaacggcaagccagtagatggcctcaccaccttaaggaacggtacccttgttgccttccgcggtcactacttctggatgctgagccccttctctcctcctagtcctgcacggaggattacagaagtctggggaatcccgtcacccatcgataccgtgtttacaagatgtaattgcgaaggaaaaaccttttttttcaaggatagtcagtactggcggtttaccaacgatatcaaggacgcaggctatcccaagccaatttttaaggggtttggtggcctgacgggccaaatagttgctgcactctctactgccaaatataagaattggccggagtctgtgtacttctttaaaagaggaggttctattcaacagtatatttacaaacaggaaccggtgcagaagtgccctggacgaagacccgctctgaactaccctgtgtatggagagaccactcaagtgcgaagacggaggtttgagcgggcaattggcccaagccagacccacactattcgtattcaatattccccagctaggctggcctatcaggacaaaggcgttcttcacaatgaggtcaaggtgtccatcctgtggcgagggctcccaaacgttgttacctccgccatttcactcccaaacattcgaaagcccgatggttatgattattatgcattttcaaaagatcagtactacaatattgatgttccatcccggacagccagggccatcacaacccgctctggccagaccctgtccaaggtgtggtataactgcccctag

SEQ ID NO: 237223 - DNA, 2802 bp, Artificial Sequence
  Description of Artificial Sequence: Synthetic coding sequence
atggcatggaaaacgctgccgatctacctcctgctcctgctgagcgtattcgtgattcagcaggtatctagccaggagctgagctgtaaaggacgttgtttcgaaagcttcgaacgagggagagagtgcgactgtgatgcacaatgcaagaaatacgacaagtgctgccctgactacgagtctttctgtgccgaagtgcacaaccctacctctcccccatcttctaaaaaagctccccctccctctggcgcatcacagaccatcaaaagtacgactaaacgctccccaaagcccccaaataagaaaaagaccaaaaaggtgatcgagagtgaggagattaccgaagagcactccgtaagtgagaatcaggagagctcctcctcaagtagttctagttcatcttcctccaccatccgcaaaattaagtcatccaagaattcggctgcaaaccgcgagctacagaaaaagctgaaggtgaaggacaataagaaaaatcgcacaaagaagaagcccacgcctaaaccccctgttgtggacgaagctggctctggtctggacaacggagacttcaaagtgacaactccggacacctcgaccacacagcataacaaggtgtctacttccccaaagattacaacagcaaagcccattaaccctaggccctcactcccaccaaacagcgacacctctaaagaaacatcacttacagttaacaaggagactaccgtcgagacaaaggagacgactaccacgaataaacagaccagcacggacgggaaagagaaaacaacgtcggcgaaggagacccagagcatcgagaagaccagtgcaaaagacctagcacccacttccaaggtgctagcaaagccaacccctaaggctgaaactacaactaagggcccagctctgaccacaccaaaggagccaacgccaacaaccccaaaagagcccgcttcaactacccctaaagagcccaccccaacaacgataaagtcggcacctacaaccccaaaggaacccgcacccaccacgacaaaatcagcaccaaccaccccaaaagagcctgcccctaccacaaccaaggagcctgctcctaccactccaaaaaagccagccccaaccacccccgaaacgcctccacctactacttcagaggtttcaaccccaacaacaaccaaagaacctacaacgatccataagtcgcccgatgaatctacacctgaactttctgccgagcctacacccaaagcacttgaaaacagcccaaaggagcccggtgtgcctaccacgaagacccctgcagccactaaacccgaaatgacaacgacagccaaggataagaccaccgaacgggacctccgtactacaccagagactacaaccgccgcacccaagatgacaaaagaaaccgctaccactactgaaaagacgacagaatcaaaaattactgctacaacaacccaagtcacttcaacaaccacccaagatactactccatttaagatcacaaccctgaagacaacaaccctggctccgaaagtgaccacaacaaaaaagacaattaccactaccgaaattatgaataaaccagaggagactgcaaagccaaaagatcgcgctaccaactcaaaagccactaccccaaagccccagaaacctacaaaggccccaaagaaacccacctctacaaaaaaacccaaaaccatgccccgtgtgaggaagcccaagaccaccccgacccccagaaagatgacctcaacaatgcctgagctgaatccaacttcccgcatcgctgaggccatgctgcagactaccacgcggcctaaccaaactcccaacagtaaactggtggaagttaaccctaagagcgaggatgctggtggagcagaaggcgagaccccccatatgctgttgaggccccatgtattcatgcctgaggtgacaccggatatggattacctaccccgagttccaaatcagggtattataatcaaccccatgctgtccgacgagactaatatatgcaacggtaagccagtggatgggttgacaactctgagaaacggcaccctggtggcctttcggggtcattacttctggatgctaagtccattttctcctccctccccagctcgaagaatcacagaagtttggggaataccatccccaattgataccgtcttcacccgctgtaattgcgaaggcaagacctttttctttaaagactcccaatattggcgtttcaccaatgatataaaagatgcaggttatccaaaaccaatattcaaggggttcggagggctcacagggcagatcgtggccgctctgtcgaccgcaaagtacaagaattggccagaatcagtttattttttcaagaggggtggctccatccagcaatatatttataagcaagagcccgtccagaaatgcccaggcaggcgtcctgccttgaactatcctgtttacggagagaccacacaggtcagaaggcgcaggtttgagcgcgcaatcgggccaagccagacgcacacgatccgcatccagtatagcccagcacggttggcgtaccaggacaaaggtgtcctgcataatgaggttaaggtcagcatattatggagaggactgcctaatgtcgttactagtgccatatcactgccaaacatccgcaaaccagacggctacgactactatgccttctctaaggaccagtactacaacatcgacgtccctagccgcaccgctcgtgctatcactacccgaagtggtcagacactcagtaaagtgtggtataactgtccatag

SEQ ID NO: 237224 - DNA, 3936 bp, Artificial Sequence
  Description of Artificial Sequence: Synthetic coding sequence
atggcttggaaaacgctgcccatctacctgctcctgctgctgtccgtttttgtgattcaacaagtgagtagccaggatctctccagttgcgccggacgctgcggcgaaggctattcacgagacgcgacctgcaattgcgattacaactgtcagcactatatggaatgctgccctgacttcaaaagggtctgtacggccgagctatcctgcaagggtagatgttttgagtcatttgagagggggagagaatgcgactgtgatgcccagtgtaagaagtacgataagtgctgtccggattatgagtcattttgcgcggaagtaaaagacaataagaagaaccggaccaaaaagaagccaactccaaaaccccctgtggtggacgaggcaggatcagggcttgacaatggagattttaaggtgactaccccagatacaagcacaacccaacacaataaggtcagcacatcccctaagatcaccactgccaagcccattaacccacgccctagcctgcccccaaacagcgatacatcaaaagagacaagcttgaccgttaataaagagacaacagtggagacgaaggagaccaccaccactaacaagcagacctcgactgacggtaaggagaagaccacatcagccaaggagactcagtctatcgagaaaacttcagctaaggatcttgcccctacgtccaaagtcctggccaagccaacaccgaaggctgagactacaaccaaaggccctgctctgacaacccctaaagagcctacgcctacgactcctaaggagccagcttccactacaccaaaggaacctactcccactacaattaagtccgcccctacgacacccaaggagccggcaccgactacaactaagtccgctcccacgacccccaaggagccagcacccacaacaacgaaggaacccgcacctaccacaccaaaagaacccgctcccaccaccactaaggaacccgctccaacaactaccaagtctgccccaacaactcctaaagagccagcacctactaccccgaagaaacccgcacccaccacccctaaagaacccgctcctacaacgcctaaggagcccacgcctaccacacctaaagagccagctccaacgacaaaggagcctgccccaacaaccccaaaggaacctgccccaacggctcccaagaaaccagcaccaactaccccaaaagaacctgcccctactacccctaaagaaccggcacccacaacgactaaagagccttctccaaccactccaaaggagcctgctccaacaactactaagtctgcaccgactactacaaaggagcccgcacccaccactacaaagagcgcacctactactcccaaggagccctctcctaccactacgaaagaacctgccccaacgacccccaaggaacccgcaccaaccaccccgaagaagcccgctcctacaaccccgaaggaacccgctcctactacacccaaggagcccgcacctacaacgaccaagaaacctgcacctactacgccaaaagaacccgctccaactacccccaaggagaccgccccaaccaccccaaagaagttgactcccaccacaccagagaaactcgcacctacaaccccggaaaagcctgcaccgaccacacccgaggaactggccccaaccacaccagaggagccgaccccaaccaccccagaagagcctgccccaaccacccccaaggctgccgcacccaatacgccaaaagaacctgcccctaccacacccaaagaacccgctccgaccacccccaaagagcctgcacccacgacccctaaggaaacagctcctactaccccaaaggggacagccccaacgactctgaaggaaccggctcccacaacccccaagaaacccgcacccaaggagctcgccccaactactacaaaagaacctacgtctaccacctgcgataagcccgctcccaccacccctaaaggcacagcccctacaacccccaaggagcctgcacctactacaccgaaggagcccgcaccaacgacacctaaggggactgctcccaccacactcaaagagcccgcaccgaccacacctaagaaacccgctccgaaggagttggcacctacaaccaccaaggggccaacctctaccactagcgataaacctgctcctacaacgccaaaggagactgcccctactactccgaaagagcctgctcccactaccccaaagaagcctgctcccacaacaccagagacgcctccgccaacaaccagcgaagtatctaccccaaccacaacgaaagaaccaacgactattcacaaatctccagatgaaagcaccccagaactcagtgctgagcctacacccaaggctctcgagaactcaccaaaagaacctggagtgccaacgacgaagacccccgcagccacaaaacctgagatgacaacgacggccaaggataaaactacggagcgcgacttaaggactactccagagactacgactgccgctcccaaaatgaccaaagagaccgccactacaacagagaagactactgagagcaagattaccgccacaacgacccaggttacctctaccacaacccaggacaccactccttttaagatcaccactctgaagacaacgactttggcccctaaggtaaccactacgaagaaaacaataacaactactgagatcatgaataagcctgaagagacggccaagccaaaagaccgagctacgaattcaaaggcgactacacctaagccacagaagcctactaaagcacctaaaaaacccacgagcacaaaaaagcccaaaaccatgccccgagtccgcaaacccaagactacccctacaccgcgaaaaatgacctccactatgcctgaactgaatccaacaagtagaatcgcggaggccatgctgcaaacgaccacacgtcctaatcagacccctaattctaagttagtggaggtaaaccccaaaagcgaggacgccggaggcgcagagggcgaaaccccccacatgttgctgagaccccacgtctttatgcccgaggtaaccccagacatggattacctgcccagagtgcctaaccagggtataatcattaacccaatgttgtcggatgaaacgaatatttgcaatggtaaaccggttgacggactcacgactttaagaaacggaaccctggtggcattcagaggtcattatttctggatgctctcaccattttctcctccgtcccctgccagaagaataacagaggtgtggggcatcccatctcctatcgataccgtgttcactagatgcaattgcgagggtaagactttcttcttcaaggactctcagtactggagattcacaaatgacatcaaagacgcaggttaccccaagccaatcttcaagggctttggaggattgacgggacagatcgtcgccgctctgtcaactgcaaaatataagaattggcccgaatccgtctatttctttaagcgcggtgggagtattcaacaatatatttacaaacaggagcccgtccagaaatgtcctggccgacggcctgcattgaactatcctgtgtacggcgaaaccacgcaggtgagacggagacgttttgagagggcaatcggtcccagccagacacatactatcaggatccagtacagtcctgcaaggctcgcataccaagataaaggggtgttgcacaacgaagtgaaagtatccattctttggcggggactaccgaatgtggtgactagcgcaatatccctccctaacattcggaaaccagatggctacgattactatgctttctctaaagatcagtactacaacattgatgtgcctagtcgaaccgcacgggcaatcacaacaagatctggacagactctctcaaaagtgtggtataattgcccttag

SEQ ID NO: 237225 - DNA, 4086 bp, Artificial Sequence
  Description of Artificial Sequence: Synthetic coding sequence
atggcgtggaaaacactgccgatatacctgctgctcctcctgtctgtgtttgtaatccagcaggtctcaagccaagatttgagcagctgtgccggacgatgtggcgagggctactccagggatgcgacatgcaattgcgactacaactgtcaacattacatggaatgttgcccggactttaagagggtgtgcactgccgagcttagctgcaaagggcgatgctttgagtcatttgaacggggtcgggagtgcgattgtgacgctcagtgcaagaaatacgacaagtgttgtccagattatgaatccttttgcgcggaggtgcacaatccaacaagtcccccttcctctaaaaaggctccgccacctagtggcgctagtcagactatcaagtccactacaaagcgatctcccaaaccccctaataagaagaagactaagaaagtgatcgaatctgaagagatcaccgaggtgaaagataataaaaaaaaccgcacaaaaaagaaaccaacaccaaagccacccgtggtcgatgaggccggttccggtctagacaatggcgattttaaggttaccacgccggatacatcgaccacgcagcataataaagtctccaccagcccgaaaattactactgccaaaccaataaacccacgtccttccttacccccaaactcagacacttccaaggaaacgagtctaactgtgaataaggagactacagttgaaacgaaagaaacgaccaccacgaataaacagacgtctaccgacggtaaagaaaaaacgacaagcgctaaggagacacagtctatcgagaaaaccagcgctaaggacctggctccaacgtccaaggtgctcgcaaaaccaactcctaaagctgagactactaccaagggccctgcattgaccacaccgaaagagcctaccccaaccaccccgaaggagccagcttccactactcctaaggagcccaccccaacaacaattaagtccgcccctactactccaaaggaacccgcacctacgacaaccaaatccgcacccactacacccaaggaacctgcgcctacaacgaccaaggagcctgcgccaacaacacctaaagaacccgcacctactactaccaaggagcccgcaccgactaccacaaaatctgcccctacgactccaaaagaacctgcccctacgacgcctaagaaaccagcccctactactcccaaggaaccagcccctaccaccccgaaagagccaacacctaccactcctaaggagccggcacccactaccaaggaaccagcacccactacccccaaggagcctgcacccactgcccctaagaaacctgccccaacaactcccaaagagcccgctccaaccacgcctaaggaacctgccccaacaacgaccaaagagccgtcccctactacacctaaagaaccggctcccactaccactaagtcagctccaactacgacgaaggaacccgcacccacaacgactaaatccgcacctaccacacctaaggagccttctcctaccacaactaaggagcccgctccaaccacacccaaggagccggctcctacgaccccaaagaaaccagcacctacgacccccaaggaacctgctccgactacaccaaaggaacctgctcctacaacgacgaaaaaacctgccccaacaaccccaaaagagcccgcaccaacgacacccaaagagacggcccctacaacaccaaagaagctaacaccaacaacaccggagaagctggcaccaactacgcccgaaaagccagcacctacgaccccggaggaactcgctcctaccacccctgaggagcctacccctacgactccagaggagcctgcaccaacgacacccaaagccgctgccccaaacactcctaaggagcctgcacctacgacccctaaagagccggcaccaaccactccaaaggagccagcacccacaactcccaaagaaacagcgccaactacccctaagggaacagcgcctacaaccctgaaagagcctgctccgactacccctaagaaaccagcacccaaagaactggctccaacaacaacaaaagaacccacctccacaacctgtgacaaaccagcccctaccaccccaaaaggtacggcccctaccacacctaaggaacccgcacccactactccgaaggaacctgctcctacaacacccaaggggacagcccctacaacgctaaaggaacctgctcccacaactcctaagaagcctgcgcctaaggagctggctccaaccacgaccaagggacctaccagcactacttccgacaagcccgcacctacgacgccaaaggagaccgctcccaccacgcccaaggagcccgcacccacgactcccaagaagccggcaccaacaactcccgaaaccccccctccaacaaccagtgaagtctcaacaccaaccactaccaaagaaccgacaaccattcataaaagtcccgatgagtccactcctgagctgagtgcagaaccaacgcccaaagcactggaaaattcgccaaaagagcccggtgttcccaccaccaaaaccccagccgcaactaagccagaaatgacaacaacagctaaggataaaacaaccgaacgcgacttgcggactacccctgaaaccacaacggccgctcccaaaatgaccaaggaaaccgccacaaccacggagaaaaccactgagtcgaagataaccgcaacaacgactcaggtgacctcaacgacaacccaggatacaactccgttcaagattactaccctcaagaccaccactctggccccaaaggtcacaactaccaaaaagacaattacgactacggaaattatgaataaacctgaagagaccgccaagccaaaagacagagcaaccaattcaaaggcgactacccctaaacctcaaaaaccaactaaggcccctaaaaaaccgaccagtaccaaaaaaccgaaaactatgccgagagtaagaaaaccaaagaccacaccaactcccaggaaaatgacaagtactatgcctgagctgaacccaacaagccggatagccgaggcaatgctccagaccactactcgcccaaaccagactccaaatagcaagcttgtggaggtcaatccaaaaagcgaggacgcagggggagctgaaggcgaaacaccccacatgctcctgcgccctcatgtctttatgccggaagtaaccccggacatggattaccttccgcgagtgccgaatcagggcataataattaaccctatgttaagcgacgagacgaacatctgtaatggtaagccagttgacggtcttacaactctccggaatgggaccctggtggcctttagaggccattatttctggatgctatcccctttctcgccaccatcccccgcaagacgaataacggaagtctgggggatcccttcacccatcgacacggtctttacgcgatgcaattgcgaaggtaagactttcttttttaaggatagccaatactggcgcttcacgaatgatattaaggatgcaggctaccctaaacccatctttaaaggatttggaggcctaacaggtcagattgtcgccgctttgtcaactgccaagtataagaattggcccgagtctgtatatttcttcaaacggggaggatcgatccagcagtacatttacaagcaggagccggttcagaagtgtcctgggcgtcgaccagccctgaactaccctgtgtatggagagaccacacaagtgcgcagaaggaggtttgaacgagctattgggccttcccagactcacaccatcagaatacagtacagcccagcacgtttagcttaccaggataagggagtgctccataatgaggtgaaagtgtcgattctctggaggggcctgcctaacgtggtgacaagcgcaattagcttacctaatatccggaaacctgatggctacgattactatgcgttctcaaaggatcagtattataatatcgacgtgcccagccggaccgccagggccataacaaccaggtctggccagaccctgagcaaagtctggtataattgcccctag

SEQ ID NO: 237226 - DNA, 4215 bp, Artificial Sequence
  Description of Artificial Sequence: Synthetic coding sequence
atggcttggaaaacactcccaatatatctgttactgctgctctcagtgttcgtgattcagcaggtcagttcacaggacctgtcttcttgcgccggacggtgtggcgaaggttatagccgtgatgccacgtgcaattgcgattacaactgtcagcattacatggaatgttgcccagacttcaagagagtgtgtacagcagagctttcatgcaaagggagatgtttcgagtcattcgagcggggtcgggagtgtgattgtgatgcccaatgtaaaaagtatgacaagtgttgccccgactacgaatcattttgcgctgaggttcataaccctacatcccccccttcctctaagaaagccccaccccctagcggtgcctcacagacgatcaaaagtaccaccaaacggtctccaaagcctcccaataagaaaaagaccaagaaggtgatagaatccgaagagatcaccgaagaacacagcgtgtcggaaaatcaggagtcgtcttcaagtagcagtagtagcagcagtagctcaacgattagaaagatcaagtctagcaaaaattctgcggctaacagggaacttcagaaaaaattgaaggtcaaggacaacaagaaaaataggactaaaaagaagcctacacctaagccccctgttgtcgacgaggccggtagcggtcttgataatggcgacttcaaagtcaccacccctgacaccagcacaacccaacacaataaggtgtccactagtcctaaaatcacaaccgccaagcctatcaaccccaggccatcactaccgcctaacagcgacacatccaaggaaacttctttaactgtcaataaggaaaccaccgttgagaccaaagagaccactacaactaataaacaaaccagcacagacggcaaggagaagactacttccgccaaggagacacaatcaattgagaagactagcgccaaggatttggcccctacaagtaaagtcctggcgaaaccaactcctaaagcagagactaccacaaaagggccagccctcacaaccccaaaagaaccgacgcccactacccccaaggaacccgcttctacaaccccgaaagagcccaccccaacaacaatcaagtcagctcctacaacacctaaagagcctgctcctacaaccaccaagagcgcacccaccactcccaaggagcccgcacctactacaaccaaggagcctgcgccaacaactccgaaggaaccagcccctactaccacaaaggagcccgctccaaccaccactaagtctgccccaaccacaccaaaggagcctgccccaaccactcctaaaaagccagccccaacaaccccgaaagaaccagccccaaccacaccaaaagagcctacgcctacgacccccaaagaacccgctcctaccaccaaggagcctgctcccacgactcctaaagagcctgcccctaccgcccctaaaaagcccgcacccacaactcctaaagagcctgccccaacaactcctaaggaacccgcaccaacaacgacaaaagagccctcacccactactcctaaagaacccgctcccacaaccaccaagtctgccccaaccaccaccaaggaaccggcacccaccacaaccaagtccgcacctacgacacctaaagaacctagtcctactaccactaaagagcctgcgcctacaacgccaaaggaaccagcaccaacaaccccaaaaaagccagccccaacaaccccaaaggagcctgccccaacaacccctaaggaaccggctcccaccacaacgaagaaacccgcaccaaccacccctaaggagccagctcctacaaccccaaaggagacagcccctactacccccaagaagcttacccccacaacgccagaaaagctagccccaacaacgcccgagaagcccgctcccacaacacccgaggaactggcaccgacgactcctgaagaaccgacgccaacaactcctgaagagcccgctccgaccacaccaaaggccgcagcccctaacacccctaaggaacccgcaccaaccactcccaaggagcctgcgccaaccaccccaaaggagcctgcacccaccactccaaaagaaactgctccgaccactcctaaaggcacagcacccactacactgaaggagcccgctccaaccacccccaaaaagcctgcacccaaggaactcgcgcctaccaccactaaggagcccacctcaaccacttgtgacaagccagcccctactacccccaagggtacagctcccacaacacccaaggagcccgctcccacaactcccaaggagcccgcaccgaccaccccaaaaggaacagctcccaccactctcaaggagcccgcacccaccacccccaagaaacccgctccgaaggagttagcgccaacaacaaccaaggggccaaccagtaccaccagcgacaaacccgcacccaccacgcctaaggagaccgccccaacaacaccaaaagaacctgctccaacaactcctaaaaaaccggcacctaccacgccagagacgccacctccaacgacatccgaagtctccacccccaccaccacaaaggagccgaccaccattcataagagcccagacgagtccactcccgaactgtctgccgagccaaccccaaaggccctggagaatagcccaaaggaaccaggggtcccaaccaccaaaaccccggctgctacaaaacccgagatgacaacaaccgccaaggataagacaacagagagggacctgcgaaccacacccgagactaccactgccgcaccaaaaatgaccaaagaaacagccactactacagaaaagaccaccgaatccaaaattactgccacgacaacccaggtcacttcaactacgacccaggacacaaccccgttcaagatcaccaccctcaagacaacgacccttgcacccaaagtcacaacaaccaaaaaaactattaccaccacagagatcatgaacaaaccagaagagactgctaagccgaaggaccgcgctacaaactctaaggcaacaactccgaagcctcagaaaccgaccaaggctcctaaaaagccaacatccaccaagaagccaaaaactatgcccagggtcaggaagcctaagaccacccccactccacgcaaaatgacaagcacaatgccggagcttaaccccaccagtagaatcgccgaggccatgttacagaccaccacacgacccaaccagactccaaacagtaagctcgtcgaggtcaaccccaagagcgaagacgccggaggggcagagggagaaaccccgcacatgctgcttcggccacatgtgtttatgcctgaggtgactccagacatggattatttaccgagggtgcccaatcagggcattattattaacccaatgctgagcgacgaaacgaatatctgcaatggaaagcctgtcgacggccttaccactcttaggaacggcacactggtggccttccgtgggcattatttttggatgctgagtccattcagtcccccatccccagcgagaaggattaccgaagtttggggaattccttcccccattgacaccgtgttcaccagatgtaattgcgagggaaagacttttttctttaaggatagtcagtactggcggtttacgaacgacatcaaagacgcaggctaccccaagccaatattcaaagggtttggcggattgaccggtcagattgtcgctgctttgtcaacagctaaatacaaaaactggcctgaaagcgtgtacttctttaagcggggtggctctattcaacagtacatctataaacaggagccggtccagaagtgtccaggccgaaggccagccctgaactatcctgtctacggggagaccactcaggtgcggaggcgcaggttcgagagggcaatcggaccctcacagacccacacgatccggatacagtatagcccagccaggctggcctaccaggataaaggcgtgctgcacaatgaggttaaagtgagtatcctttggcgcggactacccaacgtcgtgactagcgctatcagcctacccaacattcgaaagcctgatggctatgactactacgccttttcgaaggaccagtattataatatcgacgtgccttctagaacagcgagggctatcacaacccggtctgggcagaccctttcaaaggtttggtataactgtccttag

SEQ ID NO: 237227 - DNA, 834 bp, Artificial Sequence
  Description of Artificial Sequence: Synthetic coding sequence
atgggcctgctcgagtgctgtgctaggtgtctggtgggcgcaccatttgcttccctggtggcaacaggattgtgtttctttggtgtggctctgttttgcggctgtggacacgaggccctgacaggcacagagaagttaatcgagacatatttctcaaagaactatcaggactacgagtaccttattaacgtgatccatgctttccagtatgttatttacggcaccgcgagttttttcttcttgtacggcgcactgttgttagcagagggcttttacactactggcgcagtgaggcagatattcggggactacaagactacaatctgcgggaaaggactcagcgccacagtaactgggggtcaaaaaggcaggggctctagaggtcagcatcaagcccacagtctggagagagtgtgtcattgtctgggcaaatggttgggccacccagacaaattcgtcggaattacatatgcccttaccgtggtatggttgctggtgtttgcctgttccgccgtacctgtctacatctactttaacacctggacaacatgtcagtcgatcgcctttccatcaaagaccagcgcaagtattggttctctgtgcgccgatgcccgaatgtatggtgtgttgccttggaatgctttcccaggcaaagtgtgtggtagcaatctcctttccatttgcaaaacagccgagtttcagatgactttccacctctttattgcggcatttgtcggcgcagccgctaccctcgtcagtctgctgacttttatgatagccgctacatacaactttgccgttctcaaattaatggggaggggcacgaagttctag

SEQ ID NO: 237228 - DNA, 729 bp, Artificial Sequence
  Description of Artificial Sequence: Synthetic coding sequence
atggggctgcttgagtgctgcgccagatgtctcgtgggcgcacctttcgcctctctcgtagctacaggtctgtgtttctttggggtggcgcttttttgtggttgtggccatgaggccctcactgggacagagaagcttatcgagacatatttcagcaaaaattaccaggattacgaatatttgattaacgtgattcatgcatttcaatatgtcatttatgggaccgctagtttcttcttcctgtacggagcgctcctgttggccgaggggttttacactacaggagccgtgcgccagatatttggagattacaaaacaacaatatgtggtaagggcctgtccgccaccttcgtgggcattacctacgcacttacagtcgtgtggctcctggtctttgcctgtagcgcggttccagtgtatatctacttcaacacgtggaccacttgtcagagcatcgcttttccatctaagacctctgcttcaatcgggtctttgtgcgcagacgcgaggatgtacggtgtgctgccctggaacgcctttccaggcaaagtatgcggctcaaacttactgtcgatctgcaaaactgcggaatttcagatgacgtttcacctgttcatcgctgcctttgtcggggctgctgcaactctcgtgtccctgctcaccttcatgatagccgcaacctataactttgcagtacttaaactcatggggagaggtactaaattttag

SEQ ID NO: 237229 - DNA, 834 bp, Artificial Sequence
  Description of Artificial Sequence: Synthetic coding sequence
atgggcctcctggagtgctgcgccagatgtcttgtgggggctccattcgcaagcctggtggcaacaggcctttgtttttttggagtagccttgttttgcgggtgtggccacgaagctttaacagggacggagaaattgatagagacttatttctccaagaactaccaagattacgagtatctgataaacgtgatacatgctttccagtacgtcatttatggaacagcgagcttttttttcttatatggtgcactcctgttggccgagggtttctacacaaccggcgcagttcgacagatcttcggggactacaaaactaccatctgcggcaagggactcagcgctaccgtgactggcggacaaaagggaaggggtagtcgagggcaacaccaggcacatagcctggagcgtgtctgccattgcttgggcaaatggctgggccatcccgacaagtttgtgggaattacgtatgcattgacagttgtttggttgttggtgttcgcatgctctgccgtacccgtatatatttactttaacacgtggacgacttgccagagtattgcattcccctccaagacatcagcaagcattgggtccctctgtgccgatgctcgcatgtacggggtgctaccatggaacgcctttccaggaaaagtctgtggctccaatctgctgtcgatctgcaagaccgcggagttccaaatgactttccatcttttcatcgcggctttcgtgggcgcagccgctacactagtcagtctgcttaccttcatgatcgctgctacttacaatttcgcagtcttgaaactaatggggagagggactaagttctag

SEQ ID NO: 237230 - DNA, 384 bp, Artificial Sequence
  Description of Artificial Sequence: Synthetic coding sequence
atgggcctgctcgaatgctgtgctagatgcctggttggtgcaccgttcgcttctcttgtggcaaccggcctgtgcttctttggcgttgccttgttctgcggatgcggtcatgaagcactgacaggcactgagaaactaatcgaaacgtatttctctaagaattaccaggactatgagtacctgattaacgttatacacgcctttcagtacgtaatctatgggacagctagctttttctttctgtatggtgccctgcttcttgctgagggattttatactactggagccgttaggcaaatctttggggactacaaaaccacgatttgtggcaagggcctgagcgccacggtgaccggcggacagaagggtagaggctctcgctag

SEQ ID NO: 237231 - DNA, 768 bp, Artificial Sequence
  Description of Artificial Sequence: Synthetic coding sequence
atgggacttctggaatgctgtgcccgttgtcttgtcggcgctcccttcgcctcccttgtggccacgggtctgtgcttttttggtgttgccctgttctgcggctgtgggcacgaggctctgacaggtacggaaaagctgatcgagacatatttctcaaaaaactatcaagactatgagtacctaattaacgtcatccacgcgtttcagtatgtgatctatggaacggcatcattcttctttctgtatggagcattgctccttgctgagggcttttatacaacaggcgcagtacgccagaagggcaggggatccagaggtcagcaccaggcgcacagtctagaacgcgtctgccactgcttaggcaaatggttaggccacccggataagttcgtcggcataacgtatgccctgactgtggtttggctcctcgtcttcgcatgctctgccgtgccagtgtacatctatttcaacacctggaccacttgccaatcaattgcttttccaagtaagacttccgcttccatcggatccttatgtgcggatgcccgaatgtatggggttctgccctggaatgcatttccgggtaaagtctgcgggagcaacctgctgtctatttgcaagacggctgagtttcagatgacattccacctatttattgccgctttcgtgggcgcagccgcaaccctggtgtccctcttgacgtttatgattgccgctacctataatttcgctgtcctaaagctgatggggcgtggaacaaagttttag

SEQ ID NO: 237232 - DNA, 414 bp, Artificial Sequence
  Description of Artificial Sequence: Synthetic coding sequence
atgggcttgctagaatgctgcgctcggtgtttggtgggcgcaccttttgcaagccttgttgccaccggactctgtttcttcggtgttgccttgttttgtgggtgcgggcatgaggccctgaccggcaccgagaagctgatcgagacctactttagcaagaattatcaggattacgagtatctaataaacgtgatccacgcctttcagtatgtcatttacgggaccgcatcattcttctttctgtacggagccttgctgctagctgagggattctacaccaccggcgcagtcaggcagatatttggtgactacaagacaacaatttgtggtaagggactgtctgctacagtgacagggggacagaaaggacgagggtccaggggacaacatcaggcgcactcattggagcggtag

SEQ ID NO: 237233 - DNA, 303 bp, Artificial Sequence
  Description of Artificial Sequence: Synthetic coding sequence
atgggcttacttgagtgttgtgcccgatgcttggttggggctccctttgcctctctggtggcaacagggctgtgcttttttggggtagccctgttttgtgggtgcggccatgaggcccttacaggcacggagaagttgatcgagacttactttagtaagaattaccaagattacgagtacctgattaacgtaatacacgccttccagtatgtgatctacggaacagctagcttctttttcctgtacggcgctttactgctggccgaagggttctatactaccggcgctgtgcggcaaatttag

SEQ ID NO: 237234 - DNA, 372 bp, Artificial Sequence
  Description of Artificial Sequence: Synthetic coding sequence
atgggtcttctggagtgctgtgcgagatgtctcgtaggggcaccgtttgcctctctggtagcaaccgggctgtgtttttttggggtggccctcttctgcggttgcggccatgaagccctcactggtacagagaagttaattgagacttacttttctaaaaactatcaggactatgaatacctcatcaatgtgatacacgcctttcaatacgtgatttatgggaccgcaagtttctttttcctctatggtgcactcctgctcgccgagggattttacacgaccggagccgtgcgccagatctttggggactataagaccaccatttgcggcaaagggttgagtgccacggtgaccgggggtcagaaaggatag

SEQ ID NO: 237235 - DNA, 339 bp, Artificial Sequence
  Description of Artificial Sequence: Synthetic coding sequence
atgggtctcctggaatgctgtgcccgatgtctcgtgggcgcaccttttgccagcctggtggctaccgggctgtgttttttcggcgtggcgctgttctgcggttgtgggcacgaagcactgaccggtactgagaagttaatcgagacttacttctcaaagaattaccaagactatgagtacctgattaacgtgattcacgccttccaatacgttatttatggaacagcatcattctttttcttatacggagcgttactactggctgagggattttacactacaggagcagtgaggcaaattttcggagattacaagactacaatctgcggcaaggggtag

SEQ ID NO: 237236 - DNA, 411 bp, Artificial Sequence
  Description of Artificial Sequence: Synthetic coding sequence
atgggtctcctggagtgttgtgccaggtgcctggtgggagccccatttgctagcttagtagccactggcttgtgttttttcggcgtggctctcttctgcgggtgcggccacgaggcactcacaggcaccgagaaacttattgagacctatttttccaagaattaccaggattacgagtacctgataaacgtcatccacgccttccaatatgtcatctatgggacggcatccttctttttcttgtacggagccctactgctcgcggagggcttctacactacgggggcagttcgtcagatttttggcgattataagacgaccatctgcgggaaaggactgtccgcaaccgtgactggcggacaaaagggaaggggctccagggggcagcaccaggcacacagcctggagtag

SEQ ID NO: 237237 - DNA, 438 bp, Artificial Sequence
  Description of Artificial Sequence: Synthetic coding sequence
atggcagacagcgaacggctgagcgctcccggttgctgggccgcatgcacgaattttagtaggactcggaaggggatactcctgttcgcagaaatcatcttgtgtctggtgattctaatttgttttagtgccagcacccctggctattcttcgctatccgtcatcgaaatgattctcgccgctatcttttttgtcgtttacatgtgcgatctgcacacgaaaataccttttattaactggccctggtctgatttcttccgcacactgattgccgcaattctgtatctaatcacatcgatcgtcgtgctggtcgaacgcggaaatcacagtaagatagtggccggtgtgaaggccatgggggcagccctcaaacatagagccaagggactccgctcccaggggccattcctccctctgctgctggctgaaatcgtgtag

SEQ ID NO: 237238 - DNA, 459 bp, Artificial Sequence
  Description of Artificial Sequence: Synthetic coding sequence
atggccgactccgagcgactgagcgcccctggctgctgggctgcatgcaccaatttttcccgcacacgtaagggcatccttctttttgctgaaatcatcctttgtctggtcatactcatctgtttcagtgccagtaccccaggctactcatctctgtcagtgatcgagatgatcctcgctgcaattttcttcgtcgtatacatgtgtgacctgcacaccaagatccctttcatcaattggccgtggtccgatttcttccgaacgctgattgctgctatcctctatctcatcacttctatcgtggtgcttgtggaacgtggcaaccatagtaagatcgtggccggagtcctcggtctgatagccacctgccttttcggttacgacgcctacgtcacctttccagtacgtcaacccagacatacagcagcaccgactgatcctgctgatggccctgtgtag

SEQ ID NO: 237239 - DNA, 336 bp, Artificial Sequence
  Description of Artificial Sequence: Synthetic coding sequence
atgtccgatgccgctgtggataccagcagtgagatcaccaccaaagaccttaaggaaaagaaggaggtcgtggaggaagccgaaaacgggcgagacgctcccgcaaacggaaacgcggaaaacgaggagaacggagaacaggaggcggataacgaggtggacgaggaggaggaggaaggtggagaagaggaggaagaggaggaggagggtgacggcgaggaggaagatggggatgaggatgaagaggccgaaagtgctaccggcaagagggccgcagaggatgatgaggatgacgatgtcgatacaaagaagcaaaaaactgacgaggatgactag

SEQ ID NO: 237240 - DNA, 408 bp, Artificial Sequence
  Description of Artificial Sequence: Synthetic coding sequence
atgcagacgttcggtccagccggagtggccgcagttgggagacgggtggagtccccagcagatagaagggccacacgtgcatgtcactgcaaattgtgtctcccagcaggaagtctccagggcctcaagggcgaagagggcagtgtcgaagaggcagaaaatgggagagatgccccagccaacggaaacgccaatgaggagaatggagaacaggaggcagataacgaggtcgatgaagaggaagaagaagggggagaggaggaagaggaagaagaagaaggtgacggcgaggaagaagacggggacgaagacgaagaggctgagagcgccactggcaaacgcgctgccgaggatgatgaggacgatgatgtagacacaaaaaagcagaaaacagatgaagacgactag

SEQ ID NO: 237241 - DNA, 333 bp, Artificial Sequence
  Description of Artificial Sequence: Synthetic coding sequence
atgagcgatgccgcagtagacacatcctccgagattactaccaaggaccttaaggaaaagaaggaggtggtggaggaggccgagaacggacgcgacgcaccggcaaatggtaacgccaatgaagagaatggagaacaagaggccgacaacgaggtcgacgaggaggaggaggaggggggagaagaagaggaggaagaggaggagggggatggggaggaggaggatggtgacgaggacgaggaggccgaatccgccacaggtaagcgagcagctgaggacgacgaagatgacgatgtggacaccaagaaacagaagacagacgaggacgattag

SEQ ID NO: 237242 - DNA, 3714 bp, Artificial Sequence
  Description of Artificial Sequence: Synthetic coding sequence
atggatagtggtgctggcggtcggagatgccctgaggccgctttattaattctcggcccacccaggatggagcatttaagacactcccccggtccaggaggacagaggttgctccttcctagcatgcttctggccttacttctgctcctagctccctcacctgggcatgcaacgagagtggtctataaagtccccgaggagcaacccccaaataccttgattgggagcttagcagcagattacggatttccagatgtcggtcacctgtataagttggaggtcggcgcaccatatctgcgcgtggacggtaagaccggtgatatattcaccacggaaacctcaattgacagggaagggctacgggaatgccagaaccagttgcccggagatccatgtatactggaattcgaagtgagcataactgatctggtgcagaacggaagccccaggctcctggagggacagatcgaggtgcaagatattaacgacaacaccccaaattttgcctcccccgtaattacactggctatcccggagaacacaaacatcggaagccttttcccaatcccattagcctctgatagagacgcagggcctaatggggttgcttcatacgagctccaggcgggtcctgaggcccaagagctgttcggactccaagtcgccgaggaccaggaagagaagcaaccacagctaatcgtgatgggaaatctggatcgtgaacgttgggacagctacgacctgacgatcaaggttcaagatggcggatcaccgccacgggcttcatccgctttgttacgagtgactgtgctggataccaatgacaatgctccgaagtttgagaggccttcatatgaggcagagctttccgagaattccccaataggccattccgttatccaggtaaaagccaatgactcggatcagggcgcaaatgctgaaatcgagtacaccttccatcaggctccagaggtggttcggaggctcctgaggctcgaccgcaatactggactgatcacggtccagggtccggttgatagggaggatctcagcacgctgcgctttagcgtgctcgccaaggaccggggaacaaaccccaaatctgccagagctcaggtggtggtgacagttaaggacatgaatgacaatgcacccacgatcgaaattagaggtattggacttgttactcaccaggatggcatggccaatatctctgaggatgtggccgaggaaacagcggtggccctggtccaagtaagtgacagggacgaaggcgagaacgcggcagtgacatgtgtggtcgctggcgacgttccatttcagctgagacaggcctccgagaccggttccgattccaagaagaagtattttctccagaccactacaccattggattatgagaaggttaaagactacacaatcgaaattgtggccgtggacagcgggaatcctccgctgtcctctacaaattctctgaaggtgcaggtggtggacgtgaacgacaatgctccggtttttacgcaaagcgttactgaggtcgcatttcccgagaataacaagcctggtgaggtcattgcagagatcaccgccagcgatgccgacagtggttctaacgccgagctagtctattccctcgaaccggaaccagcggctaaaggactgttcaccataagccctgaaacaggcgaaatacaagtgaagacctcactagacagagaacagagggaatcttacgaattgaaggtagtggctgccgatcgcggatctccatctcttcaagggacggcaaccgtcttggtcaatgttctggattgcaatgataacgatcccaagttcatgctctccggttacaatttctcagtgatggaaaacatgccagccctgagccccgtgggcatggtgacggttatcgacggcgacaagggcgaaaatgcacaggtgcagttatctgttgagcaggacaacggcgatttcgttatccagaacggcacgggtacgattctgagctccctgtcctttgatcgggagcagcaaagtacttacacattccagttgaaagctgtggatggcggagttcctccaaggagtgcttacgttggagtgacgataaatgtgttggacgaaaacgacaacgcaccatatatcacagcgccaagtaacaccagccacaagcttctgacgccacaaaccaggcttggtgagactgtgtcgcaggttgccgctgaagactttgacagcggcgttaacgctgagcttatctactccattgccggaggaaatccttatggtctcttccaaatcggctcccactcaggagccatcactcttgaaaaggagattgaacgtcggcatcatgggctccatagactcgtcgtcaaagtctctgacaggggcaagccacccaggtacggtaccgcactggttcatctttacgtgaacgaaaccttggctaacaggaccctattggagaccctgcttggacacagcttagataccccgctggacattgatatcgcaggcgaccccgagtatgaaagaagcaagcaaagggggaacatcctgttcggcgtggtggccggtgtcgtggcggtggcgcttctaattgcgttggcagtcctggttcggtactgcagacaacgcgaggccaaaagtgggtatcaggccggaaaaaaggagacaaaggacctatatgcccctaagccctcaggaaaggcttcaaaaggaaacaaaagtaaagggaagaagagcaagagcccgaagccagttaaacctgtagaggatgaggacgaggcaggattgcaaaagtctcttaagtttaatctaatgagtgacgctcccggagattccccacgaatccacctccccttgaactacccccctggcagcccagacctcgggagacattacagatccaatagccccttgccctcgattcaactgcagccccaaagcccctctgccagtaagaaacaccaggtggtgcaagacttaccgcctgcaaataccttcgtaggtactggcgacactacatccacaggctctgaacagtatagcgattacagctaccgaacaaaccctccgaagtacccatccaagcagctgccacacaggagagtgactttttctgcaaccagtcaggcccaggagctgcaggacccctcccagcattcttattatgactctgggttggaagaaagcgagaccccaagctccaagtcatcttctggtccacgactcggccctctcgcactcccagaggaccattacgagaggacaacacctgatggtagtataggcgaaatggaacacccagaaaatgatctacgccctttgcccgacgtggctatgactggaacctgcacacgggagtgttctgagtttggacactcagacacctgttggatgccaggccaatcttctccctctagaagaactaagagtagtgctctgaagctttctactttcgtgccatatcaggaccggggtggccaggagccagccggagccggaagccccagtccccctgaggaccggaataccaaaactgcccctgtacggctgctacccagttatagtgctttctctcactcaagtcacgactcctgcaaggattccgccactttagaggagatacctttaacgcagacatccgactttccaccggctgctactccagctagcgcccagactgcaaaaagggagatctacttgtag

SEQ ID NO: 237243 - DNA, 3183 bp, Artificial Sequence
  Description of Artificial Sequence: Synthetic coding sequence
atggactcaggcgctggcggaagaagatgtccagaggccgctttgctgatcctggggcctcctcgaatggagcacctacgccactctcctgggccagggggtcaacgtctgttgctgccctcaatgcttcttgccctgctgttactgttggcaccatctcccggtcacgctacccgcgttgtgtacaaagttccggaagagcagcctcctaatacactgataggtagcctggccgcagattacgggtttccggacgtaggacacctctacaaattggaggtcggtgctccctatttacgagttgatgggaaaactggagacattttcaccactgagaccagtatcgaccgggaagggttacgagagtgtcaaaatcaactgccaggggacccctgcatacttgaattcgaggtgagcattacagacttggtccagaatgggagccctagactgctggaagggcaaatcgaggtgcaggacatcaatgacaacacccctaatttcgcctctcctgtgatcacactcgccatccccgagaacaccaatatcggtagccttttccccatacccctggccagcgatagggacgctgggcctaatggagtcgctagctacgagctccaggccggaccagaggctcaggagctcttcggactgcaagtggcagaggaccaggaagagaagcaacctcagctgatcgtcatgggaaacctcgatcgagaacgatgggactcttatgacttgacaatcaaggtgcaggatggcggatcacccccacgtgcgtcctccgcattgctgcgggtcacagtgctggatacaaacgataatgctccaaaattcgagaggccatcctacgaagccgagctgtccgagaattcccccatcgggcactccgtgatccaggtgaaggccaacgacagcgaccaaggtgcaaacgcagaaattgagtacacttttcaccaggcacccgaagtcgtgaggcggcttttgaggttagaccgcaacactggcttgattaccgttcaagggcctgtagatcgcgaagacctgagcactctgaggttttcagttcttgcaaaagatcgcggtactaaccctaaatccgcacgcgcacaggttgttgtcacggtgaaggacatgaatgataacgctccaacaattgaaattcggggaatcggattagtgacgcaccaggacggcatggcaaacatttccgaagatgttgcggaggaaacagctgtcgccctggtgcaggtttcggatagagatgaaggtgagaacgcagcagttacatgtgtagtcgcgggagacgtgccctttcagctgcgtcaagcttctgaaacaggcagtgattcaaaaaagaagtatttcctgcaaaccacgacccctcttgactatgagaaagtcaaggattacacaattgaaattgtcgccgttgacagcggcaatccacccctttcttcgacgaattccttgaaggtgcaggtcgttgatgtgaatgataatgccccagtctttacccagagcgtgacagaagtcgccttcccagagaacaacaagccaggagaggtcatagccgagatcactgcctcagacgctgatagcggatccaatgccgaactggtgtatagtttggaaccggagccggcagctaagggattatttaccatctcacccgagaccggggagattcaggttaaaacctcactggatcgagagcagcgggaaagttacgaattgaaagtggtcgccgcagaccggggttccccttctctccagggcacagctacagtccttgtcaatgtcctagactgtaacgacaacgatccaaagttcatgctatcgggttacaacttttccgtcatggaaaatatgcccgcactgagtcccgttggcatggtcaccgttattgatggagacaagggagaaaatgcccaggtacaactgagtgtagagcaggataatggagattttgttatccagaacggcactggaaccatcctgtcttcgttaagcttcgatcgggaacaacagagcacgtatactttccagttgaaagccgtagatggtggggtgccaccaaggtccgcttatgtgggggtcacgataaacgtcctggacgagaacgacaacgctccctacatcacggctccttcgaatactagtcataaactactgacaccacagactaggctcggggagactgtgagccaggtggcagccgaagacttcgattccggcgtgaatgctgagctcatatactctattgccggtgggaacccgtatggcctgttccagatcggaagccactcaggggcaattacacttgaaaaagagatcgagagaaggcaccacggcctgcaccggctggtggtcaaagtgtccgatcgaggtaagccgcctcgttacggtaccgcactggtacatctttacgtgaacgagaccctagccaatcggacccttctcgagactctgttggggcactctctcgatacccctttggacattgatatagcaggggatcccgaatatgagaggagtaagcagcgcggaaacatcctgttcggcgtggtagccggtgtagtggctgtggctctcctcatcgctttggcagtcttggttaggtactgccgtcagcgggaggctaaatcaggctaccaagctgggaagaaagagactaaagatctgtacgctcccaagccaagcggtaaggcaagcaagggaaacaaatctaaagggaaaaagtcgaaatccccgaagcccgtcaagccggtagaagatgaggatgaggccggactgcagaaatctctgaaattcaatctgatgtccgacgcgcctggcgactcccctcgcatccacctaccattgaactacccccctggctcccctgacctgggccgacactataggtctaactcacccttgccgtccatccagctgcaaccacagtcccctagcgctagtaagaaacaccaggtagtgcaagaccttccacctgcaaacaccttcgtcgggactggagacacaacctccacgggatcggagcagtacagtgactattcttaccgcactaatccaccaaagtacccttcaaagcaggtgggtcagccatttcagctcagtaccccacagcccttgcctcacccataccacggcgcaatctggactgaggtgtgggaatag

SEQ ID NO: 237244 - DNA, 3147 bp, Artificial Sequence
  Description of Artificial Sequence: Synthetic coding sequence
atggacagcggggcaggcggaagacgatgtccagaggccgctctacttatactgggaccccctcggatggagcacctccgccacagtccgggaccaggcggacaaagacttcttctgccctccatgctgttagccctgctgctgcttttggccccaagcccagggcacgccacacgagtggtgtataaagtccccgaagagcagcctcctaacacactcatcgggtcactggccgctgattacggatttcccgacgtgggccatctctacaaacttgaagttggcgcaccttacctccgcgtcgacggtaagacgggggatatatttacgacagagacatcaattgatagggagggactgagagagtgccaaaaccagttgcctggcgacccctgtattctggaatttgaagtgagcattactgatcttgtgcaaaacggatcaccgcgtctcctggagggccagatcgaagtgcaggatattaatgataatacacctaatttcgcctctcccgtgattactctggccatcccagagaacactaatatcggtagcttatttccaattcctcttgcttctgatagggatgccggacccaacggtgtggcgtcctacgaactgcaggtcgctgaagatcaggaggaaaagcaaccgcagctgattgttatgggaaacttagaccgcgagaggtgggactcttatgacctgaccattaaggtccaggacggcggatcacctccccgagccagctcagcgcttctgcgagttaccgtcctggacaccaacgacaatgctccaaaatttgaaaggccatcatatgaggccgagctgtctgaaaatagccccatcgggcactctgttatccaagtgaaagctaacgattctgatcagggtgccaatgctgaaattgagtacacttttcaccaagcacccgaagtcgtgaggagacttctgagactggatcgcaatactgggctgattactgttcaggggccagtcgatcgggaggacctttctacactgcggttttcagtgttggccaaagacagggggactaatccaaagagcgccagggcacaagtggttgtcaccgtcaaagacatgaacgacaatgctcccactatcgagataagaggtatcgggcttgttactcaccaggacggaatggccaacatctccgaagacgtcgcagaagagacagccgtagcgttggtccaggtctctgatagggacgaaggagagaacgcagcggtaacctgcgtcgtcgccggtgacgttcctttccaacttcgccaggctagcgagaccggaagcgactcgaaaaagaaatactttttacaaaccaccactcccctggactacgaaaaggtgaaggactataccatcgagattgttgcggtggattccggaaacccacctctatcatcaacgaattccctgaaggtgcaggttgttgacgtgaatgacaatgctcctgttttcacccagtcggtgacagaggtcgccttccccgagaacaacaaaccaggagaggtgattgcagaaataaccgctagcgatgctgactcaggatcgaacgccgaactcgtatactctcttgaaccggagccggctgcgaaggggctcttcaccattagtccagagaccggcgagattcaggtcaaaacaagtctggaccgggaacagagggaaagctacgaactgaaggtggtggctgcagaccggggttctccttccttgcaggggaccgccaccgtcctcgtgaatgtgctggactgtaatgataatgaccccaagtttatgttgtccggatataacttctctgtcatggagaatatgcccgcacttagtccagttggtatggtcactgtaattgatggtgataaaggtgagaatgcccaggtacagctaagcgtcgaacaagacaatggtgatttcgtaatacagaacggcacgggaaccattttatcctcattgagtttcgatcgcgagcagcagtccacatataccttccagctgaaggctgtcgatggaggcgtgccgccacgaagcgcctatgtgggcgtcactattaacgttctggacgagaacgataacgccccttatattaccgcccctagcaacactagccataagcttctgaccccacagacaaggctaggagaaacagttagtcaggtggctgccgaagacttcgattccggggtgaacgctgagttgatctactcaatcgctgggggaaacccctacggcctgttccaaatcggatctcacagcggcgcaataacattggagaaagagattgagaggcgacaccacggccttcataggctggtcgtgaaagtgagcgaccggggtaagccaccgaggtacgggacagcccttgtgcacctgtacgtgaacgagactctggccaacaggacgctattagagaccctgctgggccactccttagacacaccgctcgacatcgacatagctggcgatccagaatacgagaggtcaaagcagaggggaaacatcttgttcggcgtggtggcaggggtggtggcagtggccctgttgatcgctctcgcggttctggtaagatactgccgacagcgcgaggcaaaatcaggctaccaagcaggcaagaaagaaactaaagatttgtacgcacctaaaccctctggaaaagcaagcaaggggaacaaatcaaagggaaaaaaatcaaagtcacccaagccagtcaaacccgtggaagacgaggacgaagcgggattacaaaaatccctgaagttcaacctgatgtctgacgcaccaggtgattcacccaggatccatctccctctcaactacccacctggatctccggatctaggtcgccactatcgatcaaacagtcctctgccatcaatccagctgcagcctcagagcccctccgccagcaagaagcaccaagtggttcaggacctaccgcctgctaatacttttgtgggcactggcgacactacttcgactgggagcgagcaatacagtgactatagctatcgcacaaatccacctaagtatccatctaagcaggtgggtcaacctttccaacttagcacccctcaaccactgccacacccttaccatggcgcaatctggacagaagtttgggagtag

SEQ ID NO: 237245 - DNA, 3117 bp, Artificial Sequence
  Description of Artificial Sequence: Synthetic coding sequence
atggaacacttaaggcactccccgggtcccggaggtcagagactcctcctcccatccatgctcctggctctacttttactcctcgcaccatcccctggacatgccacacgggttgtgtacaaagtccccgaagagcaacctcccaataccctcatcggaagcctggcagctgactacggcttcccagatgtaggacatttgtataaactggaggtaggtgctccttacctacgggtggacggaaagacaggcgacatcttcacgacagaaaccagcatcgatcgggagggcctgcgggagtgccaaaatcagttaccaggggacccctgcatcctcgagttcgaggtgtctattaccgacctcgtccaaaacggatcccctcgtctgctggaaggtcagatagaggtccaagacatcaatgataatacacccaatttcgcctctcctgtgatcacactggccatccctgagaatactaacattgggagcctgttccccatccccctggcctctgatagagatgccggtccgaacggggtagcctcgtacgaactgcaggccggaccagaggctcaggagctctttggcctgcaggtggcagaggatcaggaggaaaaacagcctcaattaattgtcatggggaacctggaccgagaaaggtgggattcctatgatctcacaatcaaggtgcaggacggtggctcccctccaagagcttcatcggcccttctccgggtcactgtgctcgacaccaatgacaatgcgccaaaatttgagcgaccctcttacgaggccgagctgtctgaaaacagtcctattggacatagtgtcatccaagttaaggccaatgacagtgaccagggggctaatgctgaaattgaatatacattccatcaggcccctgaggtcgtacgaaggctcttgcggctggaccggaacaccgggttaatcacagttcagggcccagttgacagagaggacctgtccacactcaggttttctgtcctggccaaagaccggggaaccaatcctaagagcgctcgcgctcaggtggtcgtaactgttaaggacatgaacgacaacgcccctaccattgagatccgagggattggcctggtcacacaccaggacgggatggccaatatctccgaagacgtggcagaagagaccgcagtagcgctcgttcaagtcagcgacagagacgaaggggagaatgcagctgtcacgtgcgtggtcgccggagatgtccccttccagcttcgacaagctagtgaaactggctctgattccaaaaaaaagtattttctccagacaactacccccctggactacgagaaggtcaaggactatactatcgagatcgtggccgtcgactcaggcaaccctccactgagtagtacaaactctctaaaagtacaggtggtggatgtgaatgacaacgctcctgtatttacacagagtgtcactgaagtcgcctttcctgaaaataacaagcctggcgaagtgatcgcggaaataaccgcatctgatgcagatagtggcagcaacgccgagttggtgtattcccttgaacctgaacccgctgcgaaaggactttttactatctcccctgaaaccggagaaatccaagtgaagacatccctggatcgcgagcagcgagagagttatgagctcaaggtggtggccgcagatcgtgggtctcccagtctacagggtaccgccaccgtgttggttaatgttctggactgtaacgacaatgatcccaaattcatgctctctggttataacttttctgtgatggaaaatatgcccgctctcagtccagtcggaatggtaaccgtgatcgacggagacaagggggagaacgctcaggtgcagctgtctgtcgaacaggataatggtgactttgtgattcagaacggtaccggtacaatcctgtcctccctgagcttcgacagagagcagcagtctacatatactttccagttaaaggccgtcgatggaggggtgccacctagatctgcctatgtgggcgtgacgatcaacgtcctggacgagaatgataacgccccatacatcaccgctccttccaacacttctcacaagctcctgactcctcagactagactgggtgagaccgtgagtcaggttgctgccgaggattttgatagtggcgtcaacgccgaactcatttactctattgctggcggaaacccctacgggctgttccagattggaagccattccggggctatcacgctcgagaaggaaattgagcggagacaccacggcttgcaccgactggttgtgaaggtaagtgatcgcggaaagcctcctaggtatggcacagcactggtgcatctgtacgtgaatgaaaccctggccaaccgcaccctgctcgagacactcctcggacactctctggacactccgctcgatatagacatcgcaggagatcctgagtacgagcggagtaaacagcgaggaaacatactgtttggtgtggttgcaggggttgtggctgtggctctcttaatcgcacttgccgttttggtccggtattgcagacagagggaggccaagtccgggtaccaggcagggaagaaagagactaaggacctgtatgctcccaagcccagtggcaaagccagcaagggcaacaagagtaaaggtaaaaagagcaagtctcccaaacccgttaagccggtcgaagatgaagatgaggcaggactgcagaagtctctcaaatttaatctgatgagcgacgcccctggtgatagtccacggatccatctgcctttgaattatcctccagggagccccgatttgggcagacattacaggtctaactcaccacttcccagcatccagctgcagcctcagtccccttctgcttccaagaagcatcaggtggtgcaggacctcccaccggcaaatacttttgtgggcaccggcgatacaacatcaaccgggagcgagcaatacagcgactactcgtataggacaaacccacccaagtaccctagcaagcaagtggggcaaccgttccagttgtccaccccacagcccctgcctcacccttaccacggcgctatctggacagaggtgtgggagtag

SEQ ID NO: 237246 - DNA, 3123 bp, Artificial Sequence
  Description of Artificial Sequence: Synthetic coding sequence
atgatcgtactgctactgtttgcgcttttatggatggtggagggagtgttttctcagctccattatacggtacaagaagagcaggaacatggcaccttcgtgggtaacatcgcggaggatctggggctggatatcactaagctctccgctagagggtttcagactgtacctaatagtagaactccctacctggatctcaatttggaaacaggtgtgctgtacgtgaacgagaagatcgatagagaacaaatttgcaaacagagccctagttgcgtcctgcatctggaggtttttctcgagaacccactcgagcttttccaggtggaaatcgaggtgctggatatcaatgacaatccacctagcttccccgaaccagacttgactgtagagatttccgaaagcgccacccctggcacgagattccccttagagtctgcattcgatccagatgtggggactaactcgcttcgtgattatgagattactccaaacagttacttctctctcgacgtgcagacccagggtgacggtaacagatttgcagagttggttctggagaagcctctggaccgcgaacagcaggccgtacaccgatacgtcctgaccgccgtcgacggagggggaggcggtggtgtgggcgagggcggtggaggaggcggaggagcaggacttcctccacagcaacaaagaaccggcacagctcttttgactattcgggttcttgatagcaacgataacgtcccagcttttgaccagcccgtctatacggtatcactgcccgaaaactccccaccgggtacgctggtgatccaactgaacgccaccgaccccgatgagggccagaacggcgaggtggtctactcgttttcatctcacatttcgccgagggcgagggagctctttggtctctcaccccgaaccggtagactcgaagtgtctggcgaactggattacgaggaaagcccggtctaccaggtgtacgtacaggctaaagacttaggtcccaatgccgttcctgcccactgtaaggtcttggtgcgcgttctggatgccaacgacaatgcaccagaaatcagcttcagcactgtgaaggaggctgtatctgaaggtgcggcacctgggacagtggttgccctgttttccgtgaccgatagagactcagaggagaacggccaagtgcagtgcgagcttctgggtgacgtccccttcaggctcaaaagttccttcaaaaactattacaccatcgtcaccgaagctccattggaccgggaagcgggtgattcctataccctgacggtggtggcacgtgatagaggcgaaccggcattgagcacatcaaaatccatccaggtgcaggtgagcgacgtaaacgataacgccccaagattttctcagcccgtatacgatgtctacgttacagagaacaacgtccctggggcttacatatacgctgtgtctgcaacggaccgtgatgagggcgcaaatgcccaacttgcttacagcatcctggaatgtcaaatccaggggatgtctgtgtttacatatgtcagcattaacagcgaaaatggttacctgtacgctctacgttcctttgattacgaacagcttaaggatttctccttccaggttgaagcaagagacgcgggttcaccgcaagccttggctggtaacgcaaccgtcaacatccttatcgttgatcaaaatgataatgctcctgccattgtagcaccacttccaggccgtaacggcactccggcaagagaggtgcttccaagaagtgccgagcccggatatctgcttacacgggtcgcggcagtggacgccgatgatggggaaaacgctcgcttgacgtattcaatcgtgaggggtaacgagatgaacctctttcgaatggactggcggacaggggaactgcgcactgctcggagggttcccgcaaagcgagacccccagaggccttatgagcttgttatcgaggtgcgggatcacggccagccccctctgagctcaactgccactcttgttgtgcagttggttgatggtgctgttgaaccacaaggaggaggcggttcaggcggaggcggatccggcgaacaccaacgacctagcaggtctgggggaggcgagaccagtctcgatctgacattgattctcatcattgccctgggctctgtaagtttcattttccttctggcgatgattgtattggccgtacggtgccaaaaggaaaagaaactgaatatatacacctgcctagcaagcgattgctgcctctgttgttgctgttgcggcggaggcggtagtacatgttgtggacggcaggccagagcccgtaagaagaagctcagtaagagtgatatcatgctggtgcaaagctctaacgtgcccagcaacccagcccaggttccaattgaggagtccggtggcttcggcagccaccatcacaatcaaaattactgctatcaagtgtgcctgacccctgagtccgctaaaacagatttaatgttcctgaaaccctgttcaccttccagatctacagacaccgagcataatccatgtggcgctattgtcactggatacactgatcagcaaccagacatcatttctaacggctccatactatccaacgagaccaagcatcagagagctgagctgtcatacttagtcgaccgcccacgcagagtaaatagcagtgcctttcaagaagcagatattgtgagttcaaaggactctggtcacggcgactcggagcagggcgactccgaccatgatgccacaaatagagcgcagtctgctggcatggatcttttttccaattgtactgaagaatgtaaggcgctgggacactccgacaggtgttggatgcctagtttcgtgccatctgatggccgtcaggccgctgactacagaagcaatcttcatgtgccgggtatggatagcgtgcccgatactgaagtatttgaaaccccagaggcacagccaggcgctgaacggtcctttagtacatttgggaaggagaaagcccttcatagcacgctggagcggaaagaactggacggtctcctaaccaacaccagggcgccttataagcccccttatctaactaggaaaaggatctgttag

SEQ ID NO: 237247 - DNA, 3123 bp, Artificial Sequence
  Description of Artificial Sequence: Synthetic coding sequence
atgatcgttctgttactgtttgctctgctctggatggtcgaaggagtgttttcccagctgcattacacagtacaggaggaacaggaacatgggacattcgttggcaatattgctgaagatctgggtctggatataaccaagttgagcgcccgagggtttcagactgtacccaattctagaacaccctacctcgacctgaacttagaaacaggcgtcctttatgtgaatgagaaaatagaccgcgaacagatttgtaagcagagcccttcctgtgttctgcacctggaggtcttcctcgagaatcccctggagctgttccaggtcgaaatcgaagtgctggatatcaatgacaacccgccatcattccctgagcccgacttaaccgttgagatatctgagagtgctacaccaggtacacgctttccgcttgaatccgcattcgacccagacgtgggcacaaattccctgagagactatgaaatcacacctaattcctacttctcattagatgtccagacacagggcgatggaaatcgcttcgcagaactcgtattggaaaaaccactggaccgcgaacaacaggctgttcaccggtacgttctcacagctgtcgacggtgggggtggtggcggagtgggtgagggtggcggaggcggtggtggagccggattgccgcctcagcagcaacggactggcacagcattactgaccatcagggtgttagacagcaacgataatgttcctgccttcgatcagcctgtctacactgtgagcctccccgagaactccccccctgggacgctggttattcagttgaatgcaacagaccctgatgaaggccagaacggtgaagttgtttattcttttagctcgcacatctctccccgagcacgggagcttttcggactgtcaccgagaactgggcgtctggaagtatccggggagctcgactacgaagagtcacctgtatatcaggtttatgttcaagcaaaggatctcggtcccaacgcagtcccagcccattgtaaggtcctggtccgcgtgctcgatgccaacgacaacgctcccgagatctcattttctaccgtcaaagaggcagtatccgagggtgccgctccgggtaccgtcgtggccttgttcagtgttaccgaccgggacagtgaagagaatggccaagtacagtgtgaattgctgggcgatgtcccttttcgattgaaatcttcgtttaagaactattacactattgtcactgaggcgccactggaccgcgaggctggagattcctacactctgacagttgtcgcccgagaccgaggcgagccggcattaagcactagtaaaagtatccaggtgcaggtgagcgacgtgaatgataatgcacctcggttctctcagccagtgtacgatgtgtatgtgactgagaataatgtcccaggggcttacatttatgcagtgagcgcaaccgacagagacgagggggctaacgctcaactggcatattctattctggagtgtcaaatacaggggatgtcggtctttacttacgttagcatcaattctgagaacggctatttgtacgcacttcgcagtttcgattacgagcagctgaaagacttttctttccaggttgaagccagagacgctggaagcccacaagcattggcgggaaatgccaccgtgaatattctaatcgttgatcagaacgacaacgctcccgctatcgtggccccactgcccggacgcaatgggactcctgccagagaggtgctgcccaggagtgcggaaccaggctacctgctgactcgcgtagccgctgtggacgcagatgacggagagaacgcgagactgacgtactccattgtgagaggtaatgaaatgaacctctttcgtatggattggagaaccggagaactgcgtactgctaggcgggtgccagccaagagagaccctcagcgcccttatgaattggtgattgaagtgcgggaccacgggcaaccgcctctatctagtaccgctactctggtcgtgcagctcgtagacggtgccgttgagccccaaggtgggggaggttcagggggaggaggttcaggcgaacatcagcggccttcccgctctggtggaggtgagacatccttagatctcacccttatcctgattatcgcactgggatctgtgtcctttatctttctactggcaatgatcgtactggccgtcaggtgtcagaaagagaagaagctcaacatatatacctgcctggcctctgattgctgcctctgctgttgttgttgcggtggtggtggctctacgtgttgtgggaggcaagctcgcgctagaaaaaaaaagctgagtaaatccgatatcatgctggtccaaagcagtaacgttccctctaatccagcacaggtcccaattgaggaaagcgggggttttgggtcccaccaccataatcagaattattgctatcaagtctgcctgaccccagaatccgccaagacagaccttatgttcctgaagccttgttcgccttcaagatccaccgataccgagcacaacccttgcggcgctattgtaacggggtacacggaccagcaaccagatataatatccaatggttcgattctgtctaatgagactaaacatcagcgcgctgaattgtcttaccttgtggacagaccaaggcgagtcaattcttctgcttttcaggaagctgacattgttagtagcaaggattcgggacacggagattcagaacagggcgacagcgaccatgacgctaccaatcgcgcacagtccgcaggaatggaccttttttctaactgcaccgaggagtgcaaggctcttggccactctgatcgctgttggatgccttcatttgttccatccgacggtagacaagctgcagattatcgctcaaatctgcacgtgcctgggatggattccgttcctgacactgaagtgtttgagacccccgaggcccagcctggcgctgaacggtcatttagtacatttggaaaagaaaaggccttgcatagtactctcgaaagaaaggagctggacgggcttctgaccaatacaagagcgccttacaagcccccatacctgcgcaaaaagcagaggtgctag

SEQ ID NO: 237248 - DNA, 3933 bp, Artificial Sequence
  Description of Artificial Sequence: Synthetic coding sequence
atggatctgctgtccggaacctatatcttcgcagtgctgctggcctgtgtggtgttccatagcggggcacaagagaagaattatacaataagggaggaaatgcccgagaatgttctgatcggagatctcctcaaggacctcaatttgagtctcataccaaataagagtctcaccacagccatgcagttcaagctggtgtacaagaccggagatgtgcctctgataaggatagaagaagacacaggcgagatcttcacaacaggggcaagaattgaccgcgagaaactgtgcgcagggataccaagagatgagcactgtttttacgaggttgaagtggcgatcttaccagatgaaatttttcgtctcgtgaagatccgtttcctcattgaagatattaacgataacgcaccactcttccctgcaacggttattaacatcagcatacccgagaatagtgccatcaattcaaagtacactttgcctgctgccgtggaccctgacgtaggcattaatggtgtgcagaactacgagctgatcaagagtcagaatatcttcggactggacgtgattgagactccagaaggagacaaaatgccccagctgattgtgcaaaaggaactggatcgcgaagagaaggatacttatgtaatgaaggtgaaggttgaggatggaggcttcccccagcgctcgagcactgccatcttgcaggtatcagtgacggatacgaacgataatcacccagtatttaaagaaactgaaatcgaggtctcaattccagaaaatgcaccagtgggtaccagcgtgacccagctgcatgctaccgatgccgacattggagagaatgcaaagattcacttctctttctctaatctggtgagcaatatcgccaggcggctattccacctcaacgctacaactggattgatcaccattaaggagccactggaccgcgaggaaacacccaaccacaaactgctggtcctggcatctgatggtggtctaatgccagcgagagctatggtacttgtaaatgttaccgacgtgaatgataatgtgccttcaatcgacataaggtatatcgtaaacccagtgaatgatactgtggtcctgtcggagaatatccccctcaatactaaaatcgcattgattactgtgaccgacaaggacgccgatcacaatggccgtgtgacctgtttcacagaccatgagatcccattccgcctccggccagtgttctcgaatcagtttctcctggagaccgctgcatatctggattacgagagtacgaaggagtatgctataaagctactagcggctgacgctggcaaacctcctctgaatcagagtgccatgttatttattaaggtgaaagacgaaaacgataatgcccctgtgttcacacagtccttcgttaccgtgtccatcccggagaacaattctcctggcatacaactgaccaaggtgagcgctatggatgccgattcaggccctaatgccaaaatcaactacctgctgggtccggacgcaccgccagaattctccctggattgccgaaccggtatgctgacagtcgtgaaaaaactggatagagaaaaggaggataaatatttatttacaatactagccaaggataatggagtccctcctctcaccagtaacgttacggtttttgtcagcataatcgaccagaacgataatagccccgtttttactcataatgagtacaacttctacgtgcccgagaacctgccgcgacatgggaccgtgggtctgatcacagtgactgacccagactatggcgataactccgcggttactctgagcatactcgacgagaacgacgacttcaccatcgacagccagactggtgtgattaggcccaatatttcttttgaccgcgaaaagcaagaatcttacacattctacgtgaaggccgaggatggcggtagagtgtcacgaagctcctccgctaaggtgacgatcaacgtagttgatgtgaatgataataaacccgtttttattgtgcctccaagcaactgttcctacgagctggtactgcccagtaccaaccctggtaccgtggtttttcaggtgatcgccgtggacaacgacactggcatgaacgcagaagtgcggtatagcatcgtgggcggaaatacccgggatctctttgccatcgatcaggagaccggtaacatcacactcatggaaaagtgtgatgtcactgacttaggcttacatagggttctcgttaaggccaacgatctcggtcagcccgacagcttgtttagcgtggttatcgtgaatctctttgtgaatgaaagcgtgacaaatgcgacccttattaacgagctcgttcggaaaagcactgaagcacccgtgacgccaaacacagagatagctgacgtgtcttccccgacctcggactatgtaaagatcctggtggccgcagtggccggaaccataactgtggtggtagttattttcataacggcagtagtgcggtgcagacaggcaccgcatctgaaagcggcacagaagaataaacaaaattccgagtgggcaacccccaaccctgaaaaccggcagatgatcatgatgaagaaaaaaaagaagaaaaagaagcatagcccgaagaaccttctgcttaactttgtgacaattgaggagacaaaagcagatgacgtcgactctgacgggaacagagtgacgctggatcttcccatagatctagaggagcaaaccatgggaaaatataattgggtgacaactccgacaaccttcaagccagacagcccagatctggcacgccactataaaagcgcatcacctcagccagcattccagatccagcctgaaacacccttgaactctaaacatcatatcatacaggagctgcctctcgataacactttcgtggcttgtgattctataagtaagtgtagcagttcttcatcagacccctattcagtcagtgattgcggatatccggtcacaacattcgaggttccggtgtccgtacacactcggccatcgcagcgtcgggtgacatttcacctccctgaaggtagccaggagtcctccagtgatgggggactgggcgaccacgatgccggatcattaacttctacctctcatggccttccactggggtacccacaagaggagtatttcgatcgagctaccccgtccaataggacagagggagatggcaactctgatcccgagagcactttcatacctaggagcccaacggccgctgaaatcaccgtgcagccgaccgtcgaggaagccagcgacaactgtacccaagaatgtctgatttatgggcatagtgatgcctgttggatgcccgcatctttggatcatagcagtagttctcaagcccaggcttctgcactgtgtcactcacctccactgtcccaggcatcgactcagcaccacagccccagagtaactcaaacaattgccctatgccattctcctccggtgacccaaacaatcgcactgtgtcactccccacccccaattcaggtgtctgcgcttcaccatagcccgcctctcgttcaagctaccgcactgcaccactctccaccctccgcccaggcctcagcactgtgctactcccccccactagcccaggccgctgcaatcagccacagttctccgctacctcaagtgatcgcactgcatcgaagccaggctcagtctagcgtctctctccagcagggctgggtccagggtgcagacgggctttgttctgtggatcaaggagtgcagggcagcgctacatcgcagttttacaccatgtcagagcgactgcaccctagcgacgatagtataaaggtgatccccttgacaacattcacccctcgccagcaggctcggccttcaaggggggatagccccattatggaagagcatccactgtag

SEQ ID NO: 237249 - DNA, 4044 bp, Artificial Sequence
  Description of Artificial Sequence: Synthetic coding sequence
atggatctgctgtcaggtacctatatctttgctgtgctcctcgcatgcgtggtgttccattcaggcgcacaggagaagaattacacaattagggaagaaatgcccgagaatgtcttgatcggcgatctcctaaaagatctcaatcttagcttaatccccaacaagagcctgaccaccgctatgcagttcaaattggtgtataagactggcgacgtcccactcatcagaatcgaggaagataccggagagatctttacaacaggtgcccgtattgatagggaaaagctgtgcgcaggtatcccgagagacgaacattgcttttacgaggtggaggtggctatcctgcccgatgagatctttcgattagtgaagattcgctttctgattgaggatatcaatgacaatgcccctctgttccccgctactgtgatcaatatctctattcctgagaacagcgcaataaacagcaaatatacactcccggctgctgtggatccggacgtgggcatcaatggggtgcagaactacgaattgattaagagtcagaacatcttcggccttgatgttatcgaaacaccagagggtgacaagatgccacagttgatcgtgcagaaggagttagatagagaggagaaagacacgtacgtgatgaaagtaaaggtggaggatggcggtttccctcagcggtcgagcaccgcaattctgcaggtctctgtaactgatactaacgacaaccacccagtgttcaaagaaaccgagatagaagtctcgatcccagaaaacgctccagtcggtaccagtgtaacccaacttcatgctacggatgccgatattggagagaacgcgaaaattcacttcagcttctcaaacctggtatctaatatcgctagaagactgttccatttgaacgccacgaccggactgattaccattaaagagccgctggacagagaggagactcctaaccataaactcctggtgcttgccagcgacgggggacttatgcccgcaagggcaatggtcctcgtaaatgtgacagacgtgaatgacaatgtgccaagtatcgatattcgctacattgtgaatcccgtaaatgataccgtggtacttagcgaaaatatccccctgaacacgaagattgctttgattaccgtcaccgacaaagacgcagatcataacgggagagtcacttgcttcaccgaccatgaaattccgttccgactccgcccagtattctctaaccagtttctgctggaaaccgctgcctatctggactatgagtccactaaagaatacgctatcaagcttctggccgcagatgcgggaaagcccccactaaatcagtcagccatgcttttcattaaagtgaaagacgaaaacgacaatgccccagttttcactcaatcatttgtcacagttagcatacccgaaaacaactcccccggaatccagctcactaaagtatccgcgatggatgcagattccggtcccaatgctaagatcaattacctccttggacccgacgcccctccagagtttagtctggattgccggaccggcatgttgactgtagtgaagaaactggatagagagaaggaggataagtatctgtttaccatcctggccaaagacaatggggttcccccactgacttccaatgtgactgtgtttgtgtctattattgaccagaacgataattcaccagtgttcacccataatgagtataacttctacgtccctgaaaatcttccgagacatggaacagtggggttgatcaccgtgaccgaccccgactacggcgacaattcagcagtcactctgtcaatcctcgacgaaaatgacgactttactatcgattcccagaccggggtcatcagacccaatattagctttgacagagaaaaacaagagagctacactttttatgtaaaggcggaagacggaggtcgtgtgagccgatcatcgtcagctaaagttaccattaacgttgttgacgtgaatgataataaacctgtctttattgtccccccatcgaattgttcttacgaactcgtgctcccttcaacgaatcccggtaccgtagtgttccaggttatcgccgttgacaatgacaccggtatgaacgctgaggtgcggtatagtatcgtgggaggaaacacccgagacctgtttgctatcgatcaggaaacgggcaacatcactctcatggagaagtgtgatgtcactgatctcggacttcaccgagttctcgtaaaagcaaatgatttaggccagcctgattccctgttctccgtagtaattgtcaatctattcgttaacgagtcagttacgaatgcaaccttgattaacgaattggtgcgaaagagcacggaggcccctgtgaccccaaacaccgagatcgctgacgtgtccagtccaacatccgattacgtgaagatactggtagccgctgtggctggcaccattaccgtagtggtggtcatatttatcacagccgtggtgcggtgccggcaagctccacacctgaaagccgcacagaaaaataaacagaactcagaatgggctacaccgaaccctgaaaacaggcagatgatcatgatgaaaaagaagaaaaagaagaaaaaacattcacctaaaaatctcttactgaacttcgtaaccatagaggaaaccaaagccgacgatgttgactccgacggaaaccgcgtgacccttgacctgcccatcgaccttgaagagcagactatgggtaagtataattgggtcacgactcccaccacctttaagcccgatagccccgacctggcccgacattacaagtccgcttcccctcaaccggcatttcagattcagccagagacccctttgaactccaaacaccatataatccaggagctgcctctggacaacaccttcgtggcctgtgactctattagtaaatgtagctcatctagctcggatccctatagcgtgtccgattgtggttaccctgtgactacattcgaagtcccagtgtcggtgcacacacgacctccaatgaaggaggtggttaggtcttgtactcctatgaaggagtctacgacaatggagatctggatccaccctcaaccccagcggaagtccgaggggaaggtcgcaggcaagagtcagcgacgggtgacatttcaccttcccgaggggtctcaagagtcttcatctgacggcggtctgggagaccacgacgccggttctctgactagtacgtcccacggactccctctcgggtacccacaggaggaatattttgaccgcgcaacacctagcaaccgcacagagggtgatgggaactccgaccctgaatcaaccttcattcctagatcccccaccgccgctgaaataactgttcagcccacagtcgaagaggcgagcgacaactgtacccaggagtgcctgatttacggccatagcgacgcatgctggatgcccgcaagtctcgaccactctagtagcagccaggcccaggcctctgccttgtgccattcacccccactgtctcaggcctctacccaacatcacagccctagagtgacacaaacgatagcactgtgtcacagcccacctgtgactcagactattgccctatgccactcccccccacctattcaggtaagcgcgcttcaccattccccgcctctggtacaggcaactgcccttcaccattcccctccctcggcccaagcaagcgcgctgtgctactcccccccactagcacaggccgcagccatttcccactcttcccccctgccacaggtgatcgcactgcacaggtcgcaggctcagtcaagcgtgagtctgcaacaggggtgggtgcagggtgcggatggactttgctcagtggaccagggggtgcaaggaagcgccacttctcagttctacacaatgagcgagcgcctgcacccgtcagatgacagcattaaagtgattcctctgacaacctttacacctagacagcaagctcgtcctagccggggagacagtcctattatggaggagcaccctctgtag

SEQ ID NO: 237250 - DNA, 3990 bp, Artificial Sequence
  Description of Artificial Sequence: Synthetic coding sequence
atggacctactgtctggcacctacatcttcgcagttttgctcgcctgtgtggtgttccacagcggcgctcaagaaaagaattacacaatacgagaggagatgccggaaaacgttttgataggggacctacttaaggatttgaatctgagcctcatccctaataaatccctgacaactgcaatgcagttcaagctcgtctacaagactggggatgtcccgctgatcaggatcgaagaggatacaggtgaaatctttactacaggtgctaggattgatcgcgaaaaattgtgtgcgggtatccccagggatgagcactgcttctatgaagtggaggtggctatcttaccagacgagatctttcggctggtgaagatccgctttctcatcgaggatataaatgataatgcacccctgttccccgctacagtgatcaacatatcaatccctgaaaactcggctattaactccaaatacacactcccagccgctgtggaccctgacgtgggaataaacggcgtacagaactatgagctgatcaaaagccagaacattttcggactggacgttatagaaacgcctgaaggtgacaagatgccccagttgatcgtgcagaaagaactcgatcgggaggagaaagatacttatgtaatgaaagtaaaggtcgaggatgggggatttcctcagcgttcttccacggccattctgcaagtctctgtgacagacacaaacgataatcaccccgtatttaaggagaccgagatcgaggtttccatacccgagaacgcaccagttgggacctctgttacacaactgcatgcgacggacgctgacataggagaaaatgccaagattcacttttcgttttctaatctagtgagcaatattgccagacgactgttccacctcaacgccacaacaggtcttattactattaaggaaccactcgatcgtgaggaaacccccaaccataagctgctcgtcctagcctctgacggaggattgatgccagcacgcgctatggttctggtgaatgtaactgacgtgaatgacaacgtcccttccatagacatccggtatatcgtgaaccccgtaaatgacacggtggttctgagcgagaacattcctcttaataccaaaattgccctgattaccgtgaccgacaaagatgccgatcacaacggccgagtgacttgtttcactgaccacgagatcccttttaggctcagacccgtcttctctaaccagtttctgcttgagaccgccgcatacctggattatgaatctaccaaggaatatgctatcaaattgctcgcggcagatgcgggaaagccgccactgaaccagagtgctatgctgtttatcaaagtcaaagatgaaaatgataacgcccctgtattcactcagtctttcgttaccgtctcgatcccagagaacaactcacccggtattcagctgaccaaggtctcagccatggacgctgattcaggacccaacgccaagattaactacctgctgggacccgatgcacccccagagttcagcttggactgccgaactgggatgctaacagtggttaagaagctcgacagggagaaagaagataagtacctgtttactatattggctaaagataacggcgttccccctttgacaagtaacgttaccgttttcgtgtctatcattgaccagaatgacaacagtcccgtgttcacccacaatgaatataacttctatgtacccgagaatctgcccaggcatgggacggttggtctgatcactgtcacagacccagactacggcgataactcagccgtgaccctgagcatcctggatgagaatgatgatttcaccattgactcgcagaccggggtcatcaggcccaacatcagctttgatcgggaaaagcaggagtcatataccttctacgtgaaggccgaagatggagggcgagtctcacgctcctcgtctgctaaggtgaccatcaatgttgtggacgttaacgacaataaaccggttttcatcgtcccaccttctaattgttcatatgagctggtgctgccaagtaccaatcccggtacagttgtgttccaagtgatcgctgtggacaatgataccggtatgaatgccgaggtgcgttattcaatcgtgggaggcaacaccagagacctattcgccatcgaccaggagaccgggaacattaccctgatggaaaaatgcgatgtgacagacttaggcctgcaccgggtgctcgttaaagcgaatgacttggggcagcccgactccctcttctcagtagtgattgttaacctattcgtcaacgagtcggtgactaatgccaccctaatcaatgagctggttagaaaatctaccgaagccccagtcacccccaacacagaaatcgcggacgtaagcagccccacctctgactatgtgaaaattcttgtcgccgcagtggctggcacgataactgtggtcgtggtcatctttattacagcagtcgttagatgccgacaagcacctcaccttaaggcggcacaaaaaaataagcagaacagtgaatgggccacccccaacccggaaaacagacagatgatcatgatgaagaagaaaaagaagaagaagaaacatagcccgaagaatcttctgcttaacttcgtgactatagaggaaaccaaggcagatgacgtcgattccgatgggaacagggtgacactcgaccttcctattgatctggaagagcagaccatggggaaatacaactgggtaactacaccaacaactttcaagccagactctccagatctggccagacactacaaatctgcttcaccacagcctgctttccagatccagcccgagacgccgctaaattctaaacaccacatcatccaggagctgcctctcgataatacctttgttgcctgtgacagcatctcaaagtgcagctcctcctcctcagacccatattccgtgtccgactgcggctatccagttacaaccttcgaggtgccagtcagcgtccatacgcgaccgcctatgaaggaagtggtgcgctcatgcactcccatgaaggagtcaacaaccatggaaatttggattcaccctcagccgcaaagccaacgaagggttactttccatctccctgaaggatctcaggagtcaagttctgacgggggactcggtgatcacgatgcgggatccctgacgagcacttctcacggcctcccgctcggctaccctcaagaggagtacttcgatagggccacaccttctaatagaaccgagggggacgggaacagcgaccctgaatccaccgctgagataacagtccagccaacagtagaggaggcatccgataattgtacccaagagtgccttatatatgggcactccgacgcctgttggatgccagcatcactggatcattcgagcagttcgcaggcccaggcaagcgcgctgtgtcattccccccctctgtcacaggctagcacccagcatcacagcccccgagtaacccagactattgctctgtgccactccccacctgtaactcagaccatcgctctctgccacagcccacccccaatacaggtctctgctctgcaccatagcccacccctggtgcaagctacggcactgcaccattcaccgccttcagcgcaggcatccgctctgtgttatagtccaccacttgcccaagccgctgccatatcccattcatcacctctgccgcaggtgatagcgctgcaccggtcacaagcgcaatctagcgtaagtttgcagcaggggtgggttcagggagcagacggactgtgtagcgtcgatcagggagttcaggggagcgctacatctcagttctacactatgagtgagcggctccacccctcagacgattccataaaagtgatccccctcaccaccttcacgccgagacagcaggctaggccctcccgtggcgattctcctataatggaagagcatcctctgtag

SEQ ID NO: 237251 - DNA, 3066 bp, Artificial Sequence
  Description of Artificial Sequence: Synthetic coding sequence
atggatctgctatccggcacttacatttttgcggtgttgttggcctgtgtcgtcttccacagcggagcccaagagaagaattacactatcagggaggagatgcccgaaaacgtcctgataggagatctcctgaaggatttgaacttgtcacttatccccaataaatcactaaccacagcgatgcagtttaagcttgtttacaagacgggggatgtgcccctcattcggattgaggaagatactggtgagatctttaccaccggcgctcgcattgatcgtgagaaactgtgcgcgggaattcccagagatgaacactgtttctacgaggttgaagtcgctatccttcctgacgaaatttttcgtttggtgaagatccgcttcctgatagaggacatcaacgacaacgcccctctctttcctgccacggttatcaacatatccatccccgagaacagcgccataaacagcaagtacacccttccagcagctgtagatcctgacgtcggcatcaatggagtacagaattatgaactgataaaaagtcagaatatcttcggcttggacgtgatagagacccccgagggcgacaaaatgccccaactgatcgttcagaaggaactggaccgggaggagaaagatacttacgttatgaaagtgaaagtggaggatggagggttccctcagaggagtagcaccgccattctgcaggttagtgtaaccgacacaaatgataatcaccccgtatttaaagagacagagatcgaggtgtctatcccggaaaatgccccagttggcactagcgttacgcagttacatgctaccgacgccgacattggagagaatgctaagattcacttttcatttagcaatctcgtctcaaacatcgcccgtagactctttcaccttaacgcaaccaccggacttatcaccatcaaggagccgctggatagagaggaaactcccaaccacaaactgctggtgctggcatcagacggcggactcatgcctgccagggcaatggtgctggtgaacgtaacggacgtcaatgacaacgtgcctagcattgacatcagatatattgtaaatcccgtgaacgacacagtcgtgctctccgagaacatccccctcaacactaagattgccttaatcaccgtcaccgacaaagacgccgaccataatgggagagttacctgctttactgatcacgagatcccttttcggctgcggcctgttttctctaatcaatttctgcttgagacagctgcttacttggattacgaatcaactaaagaatacgctatcaagctgttagccgctgacgccggtaagccccctttgaatcaatcagctatgctgtttattaaagtgaaggacgaaaacgacaacgcaccagtgtttacccaaagcttcgtcaccgtgagcatccccgaaaacaattcccctggcatacagctgaccaaagtgtctgcgatggatgccgactctgggcctaacgcaaaaattaactacttactgggccctgatgctccccctgagtttagcctggattgcaggaccggcatgttaactgtagtgaagaagctggatcgggagaaggaggacaagtatttgtttactattttagccaaggacaacggagtccccccactaaccagcaacgtcaccgtgttcgttagtatcattgaccagaacgacaactctcctgtattcacccataacgagtacaatttttatgtacctgaaaatctcccacgtcacggcactgtgggtctaattacagtgacggatcccgactatggagataatagcgcggttacacttagtatccttgatgagaatgatgattttaccatcgactctcagactggggtgataagacctaatatcagcttcgaccgagagaagcaggaaagctacactttttatgtgaaggccgaggacggaggcagagtctctcggtccagttctgcgaaggtgaccattaatgtggtggacgtcaatgataacaaacctgtctttatagttcctccaagcaactgctcctacgaattagtactcccaagtacgaatccagggacagttgtcttccaggtaattgctgtggacaacgatactggtatgaatgcagaggtgagatatagtatagtggggggaaacacgcgcgacttgtttgccatcgaccaagaaactgggaatataaccctgatggaaaagtgtgatgtaactgacctgggtcttcacagggtgctggtgaaggcaaatgacctaggacagcctgatagtctcttctcggtggtgatcgttaatttgtttgtgaatgaatctgtgacaaacgcaactttgattaatgagctggtcaggaagagtaccgaggctcctgtgacacccaacactgagatcgctgatgtgtcatctccaacctccgactacgttaaaatcctcgtagcggcagtcgcaggtactatcacggtggtggtggtcatctttatcactgccgtcgttaggtgtcgacaggctccccacctgaaggctgcgcagaagaacaagcaaaacagcgaatgggctactcctaatccggaaaacaggcagatgatcatgatgaagaaaaagaagaagaagaaaaaacattcaccgaagaaccttttgttgaactttgtgacaatcgaagaaacaaaggccgacgacgtggattcggatgggaacagagtgactttggatctgcccattgatctggaagagcagactatgggcaaatataactgggtcaccactcccaccactttcaagcccgacagccctgatctggcccgtcactacaagtctgcctccccgcagcctgctttccaaatccagcctgagaccccactcaactccaagcaccacatcatacaggagctgccactggacaacacttttgttgcgtgtgatagcatcagcaagtgcagtagctcgtcatcagatccctactccgtgtccgactgtggttaccctgttactacattcgaggtccccgtctccgtacatacaagacccgtcggtatccaggtgtcaaacacaaccttttag

SEQ ID NO: 237252 - DNA, 3933 bp, Artificial Sequence
  Description of Artificial Sequence: Synthetic coding sequence
atggacttattgtctggcacctacatttttgccgtacttttggcatgcgttgtgttccactccggtgctcaagagaagaactacactatccgtgaggaaatgccagagaatgtcctcatcggggacttgctgaaagacctgaacctgtccttaattcccaacaagagtttgacaactgccatgcagtttaagctggtctacaagacaggcgatgtcccgctcatccggatagaagaagacacaggcgaaattttcacaaccggcgctcgcatagaccgcgaaaagctgtgcgccggtataccaagagacgagcactgcttttacgaggtggaggtggccattctgccggacgaaattttcagattggtgaagattcgctttctgatcgaagatatcaatgacaacgcaccactgttcccggctaccgtcatcaatatcagcatccctgaaaacagtgcgatcaacagtaagtacaccctccctgcggctgtcgatcctgacgtaggaattaatggcgtccagaactatgaactgattaaatctcagaacatattcgggctggatgttatcgaaactcccgagggagacaagatgccccagctcatcgtgcaaaaagagctggaccgggaggagaaggatacatatgtgatgaaagtgaaagtggaggacgggggattcccacaaaggagctccacagccattcttcaggtgtcagttaccgacactaacgacaaccaccctgtattcaaagagactgaaattgaggtttccattcccgagaacgcccctgtggggactagcgtcacccagttgcatgctactgacgcggacatcggggaaaatgcgaagattcactttagcttctctaacctggttagcaatatcgcacgtcgactgttccatctcaatgcaactactggcctgatcactataaaggagccactggaccgcgaggaaacaccaaatcataagctgctggttcttgccagtgatggaggcctgatgcctgcaagagcaatggttctggttaacgtgacagacgtaaatgacaatgtgcctagtatagacattagatacattgtgaacccggtcaatgatacagtggttttaagtgagaacatccctcttaatacaaaaatcgccctgattaccgtcacggacaaagatgcagaccacaacggaagagtaacctgcttcactgatcatgaaatccccttcagactgagacctgtgtttagcaatcagttcttgctggaaacggccgcatatctagattatgagtcaaccaaggagtacgcaatcaaactcctggcggcagatgccggaaaacctcccctgaatcagtctgccatgctgttcattaaggttaaggacgagaatgataacgcccctgtgttcacccaatcctttgtgacggtttccatccctgagaataatagccctggcatccagctgactaaagtgtccgccatggacgccgactcaggcccaaacgccaagatcaactacctactcggtccagacgctcctcctgagttcagtctggactgccgcaccggtatgctcaccgtagtgaagaagttagacagagaaaaggaggacaagtatttgtttacaattctcgccaaagacaatggagtgccaccactgacctctaacgtcaccgtttttgttagcataatcgatcagaatgataacagccctgtattcacacacaatgagtacaatttctacgtccctgagaacctgccacgccacggaacagttgggcttatcaccgtgactgatcctgactacggcgataactcagctgtcactctgtcaattctggacgagaatgacgacttcaccatcgatagccagaccggagtaattcgaccaaatataagtttcgatcgcgaaaagcaggaatcctacactttctatgttaaagcagaggacggtggtagggttagtcgcagctcaagcgctaaagtaaccattaatgtcgtggatgtaaatgacaacaaaccagtgttcattgtcccaccatcgaactgtagctatgagttggtgctgccgagtacgaaccctggaaccgtggtctttcaggtgatcgcagtggacaatgacaccggaatgaatgcggaagtgcgatacagcattgtagggggaaatacaagagatctctttgctatcgaccaagaaactggcaacattactctaatggaaaagtgtgacgtgaccgatcttgggctgcaccgcgtgttggttaaagctaatgacctagggcaacccgatagcctttttagcgtggtgatagttaacctttttgtgaatgagtccgttaccaacgccaccttgatcaacgaattggtgcgaaagtcaacggaggcgcctgtgacccctaacacggagattgcagacgttagtagcccaacgtctgactacgtgaaaatcttagtcgccgctgtggccggaactatcaccgttgtggtggtgatttttattacagccgttgttaggtgcaggcaagcaccacacctgaaagctgcccagaagaacaagcagaactctgaatgggctactcctaatcctgaaaatcgccagatgatcatgatgaagaagaaaaagaaaaagaaaaaacactcccctaaaaatttgttactgaatttcgtgaccatcgaagaaaccaaagccgatgacgttgattctgacggaaacagggtgacactggacctgcccatcgaccttgaagaacaaactatggggaagtataactgggtcactacccctacgacgttcaaaccagatagccctgatctggccagacactataaaagtgcctctccccagccggctttccaaattcaacccgaaacccccctgaatagcaagcaccacatcatccaggagctgcctctggacaacacattcgttgcctgtgactcgatcagcaaatgttcctcctcctccagcgacccttacagcgtgtcagactgcggttatcccgttaccaccttcgaggtaccagtgtcagtgcacacccgcccttcccagagacgcgttacctttcacttacctgaaggctctcaagaatccagctctgacggaggacttggggatcacgacgccggatctctgacatccacaagtcatgggctgcccttaggctaccctcaggaggagtactttgatcgggcaaccccaagcaatcggaccgagggcgacggcaactctgatccagaatctaccttcattcctggcttaaagaaggccgctgagataacggtgcagcccacagtcgaggaagcttctgacaactgcacccaggaatgtctgatctatggtcattctgatgcctgttggatgcccgcatcactggatcactcatcctcgagccaggctcaagctagcgccctatgccattccccccctctgagccaagctagtacacagcaccactcacctagggtgacacagacgatcgcactgtgtcactcccctcccgttacccagaccatagcattgtgtcactcacccccaccaatccaggtgtccgctctgcatcactccccgcctttagtgcaggctaccgccctgcatcatagtccaccctccgcacaggccagcgcattgtgctactctcctccactggcacaggcagctgcaatcagccactcctcgccactaccacaagtcatcgccttacaccggagccaagctcaatccagcgtgtccctgcagcagggatgggtgcagggcgcagacggcctgtgttccgtggaccagggcgttcagggctccgctacctcccagttttataccatgagtgagagattacacccaagcgacgactccattaaggtcattccactcactactttcaccccacgtcagcaggccagaccctcccggggagacagccctatcatggaggagcaccccctgtag

SEQ ID NO: 237253 - DNA, 4044 bp, Artificial Sequence
  Description of Artificial Sequence: Synthetic coding sequence
atggatctactgtccggtacatacatattcgccgttctattggcctgcgtggtgttccattctggcgctcaggagaaaaattatacgatacgagaagaaatgccagaaaatgtacttataggggacctcttaaaagatctgaacctcagtcttattccaaacaagtcattgacgacagccatgcaattcaagttggtttacaagactggtgatgttccgctgatacgaatcgaggaggatacaggggagatattcaccacaggagcaagaatcgaccgagagaaattgtgcgccggtattccaagggatgagcactgtttttatgaggttgaagtcgctatactgcccgacgagatctttcgactcgtgaagatccggttcctcatcgaagacatcaatgacaatgcccctctgtttccggcaactgttattaatatctcaatccccgagaatagcgccataaactccaagtataccctacctgccgctgtcgatccagatgtgggcattaatggggtgcaaaactatgagctgatcaagagccagaatatctttggacttgacgttattgagacccccgagggcgataaaatgccccaactgatcgtgcaaaaggagctcgatagagaggaaaaagatacctacgtaatgaaagttaaggttgaagacggaggattcccccaacgctcatcgactgccattttgcaggtgagtgtgacggacacgaacgataaccaccccgtgttcaaggaaactgaaattgaggtgagcatcccagaaaatgcacccgtgggcacatctgtgactcagttgcacgccaccgacgctgacataggagaaaacgcaaagattcatttctcgttttctaacctggtgtcaaatatcgctagaagacttttccatctcaacgccactacaggcctaatcacaataaaagagccacttgaccgggaggagacaccaaatcataagctactagtgcttgccagtgatggcggactaatgcctgcacgtgccatggtgttggttaatgtgacagacgttaacgataatgtcccttccatcgatattcgatacattgttaacccagtcaacgacaccgtggtgctctccgagaacatcccccttaatacaaagatcgcactaattacggtgacagacaaggacgcagaccataatggaagagtaacgtgctttactgaccacgagattcccttccgtttacggcctgttttcagcaatcaattcctcttagagaccgctgcctaccttgactacgagagtacaaaggagtacgccataaagctcctcgccgctgatgctgggaagcctcctctgaatcaatccgctatgctgttcatcaaagtgaaggacgaaaatgataatgccccagtttttacccaaagcttcgtcacagttagtattccggagaacaactctccaggcattcaattgactaaggtgtcagccatggacgctgatagtggcccaaacgccaaaatcaactatctgctgggacctgatgcgccaccagagttttccctagattgcagaactggcatgttaacagttgtaaaaaagctagacagagagaaagaggacaagtacttattcactattctggctaaagacaatggagtcccccctttgacgagcaacgtgactgtatttgtgagcatcattgatcaaaatgacaattcgcccgtgttcactcataatgaatacaatttctatgtgcccgagaaccttcctcgccatggtaccgtgggactcatcactgtgaccgatcccgattacggggataattccgctgtgacattaagtatactggatgagaacgatgacttcacgattgactcccagaccggagtcattagaccaaacatatcctttgaccgagaaaaacaggagagctacacattttatgtgaaggcggaagatgggggaagagtttcaagatccagctctgccaaagtcacaattaacgtcgtcgatgtgaacgataataagccggtctttatagtaccacctagcaattgttcctacgagcttgtgttacccagcacaaacccagggacagttgtttttcaggtgatcgctgtggataatgacacaggaatgaatgcagaggtccgttattcaatagttggcggaaatacgcgggacctctttgcaatagatcaggagacaggcaatatcacgctgatggagaaatgcgacgtgactgatcttggactccatagggtcctcgtgaaggccaatgatttgggacagccagactcgctcttctctgttgtcattgtgaacctgtttgtgaacgagtccgtcaccaatgcgaccctcattaacgaactggtacggaagtccacagaggccccagttacaccgaatactgagatcgctgatgtgtctagtcccacctcggactacgtgaaaatcttggttgccgcagtggctgggaccataactgtagtggtggtcatcttcattacagccgttgtccggtgtcgccaggcaccccacctcaaagccgcacaaaagaacaaacagaactcagagtgggccaccccaaatccagagaaccgtcaaatgatcatgatgaaaaagaaaaagaagaaaaaaaagcactcccctaaaaatttattgctcaatttcgtcacaatagaagagactaaggcggatgacgttgactcagacggtaaccgtgttaccttggatctcccaattgatctggaagagcagactatgggcaagtacaattgggtcactaccccaacaacatttaagccagattccccagaccttgccagacactacaagtcagcctccccccaaccggctttccagatacagcccgaaacgcctctgaattccaagcaccatatcattcaggaactccctctggacaacacctttgtggcctgcgactccatttcaaagtgttcctcatccagctccgatccatacagtgttagcgactgcggatatcctgtgaccacattcgaagtgcctgtgtccgtgcacacacggccaccgatgaaggaggtggtgaggtcgtgtactccaatgaaggagtccactactatggaaatttggatccatcctcagccacagcgcaagtccgaggggaaggtggcagggaaatcccagcggagggtgacgttccacctgcccgaagggtcgcaagaaagttccagcgacggaggcctgggtgaccacgacgctggtagcctcacgtcaacctcccatggtctgccactcggttacccacaggaggaatactttgacagggctacgcccagcaatagaaccgaaggggatggcaactcagaccctgaatcaacattcatccccggactgaaaaaggctgccgagatcacggtgcagcccaccgtagaggaagcgagcgacaactgtactcaggagtgtctcatttacggacacagcgacgcttgctggatgccggcttcccttgatcactcaagttcaagccaggcccaggcatctgcgctgtgccactcccctcccctgagtcaggcctcgacacagcatcactcccccagggtgacacaaacaatagccctatgtcactctcccccagtaacccagaccatagcgctctgtcatagccccccaccgattcaggtatctgcgcttcaccactccccaccactagtccaggctactgccttgcaccattcccccccttcagcccaggcatcagcactgtgctactctccaccactcgcacaggcagccgctatatcacattctagccctctgccccaggtaatagccctacaccgaagccaggcacaaagtagcgtgagcctgcagcaggggtgggtgcagggagcggatggcctctgctctgtcgatcaaggagtgcaggggtcagcaacctcccagttctataccatgtctgagcgcttacacccctccgatgattctataaaggtgatcccattaaccactttcacaccgcgtcagcaagcacgaccctcacggggtgacagcccgattatggaggaacatcccctatag

SEQ ID NO: 237254 - DNA, 4014 bp, Artificial Sequence
  Description of Artificial Sequence: Synthetic coding sequence
atggatctgctgtccggtacctatatttttgccgttctcctggcttgcgtggtcttccactcgggggctcaggaaaaaaattatacaatcagagaagaaatgccagaaaacgtactgattggtgacctgctcaaagaccttaatctctcactgatccccaataaatcattgaccactgccatgcagtttaagctcgtgtacaagacaggcgacgtcccacttattagaatcgaggaagacaccggagagatcttcactacgggtgccaggatcgatcgcgaaaaactgtgcgcaggtattccacgtgatgagcactgcttctatgaagttgaggtggcaatcttgccggatgagattttcaggctggtcaaaatccgattcctgatagaggacataaacgataacgccccactgtttcctgctaccgtaatcaacatcagtatcccggaaaattccgcgattaattcaaagtatacacttccagccgcagtggaccctgatgttggaatcaacggagtccagaactatgagctgatcaagtcccagaacatcttcggtcttgacgtgattgagacccctgagggggataagatgccgcagctcatcgtccagaaggaactggaccgggaagaaaaagatacatatgtaatgaaagtcaaagtggaggatggcggatttccacagcggagcagcaccgcgatattgcaggtgtccgtcacggacaccaacgacaatcacccggtgtttaaggagacagaaatcgaagtctccatacccgaaaacgcacccgtcgggacctccgttacccagttgcacgcgaccgatgcggacatcggggaaaatgcgaaaatccacttctcattcagtaatctggtgtctaatattgccaggagactatttcacctgaacgccactacaggcctgatcactatcaaggagcccctcgaccgcgaagagacgccaaatcataaattgctggtcctggctagcgatggcggtttgatgcctgctcgggctatggtcttggtgaatgtgacagatgtaaatgataacgtcccatcgatcgacattcgctacatcgtcaaccccgtgaacgataccgtggtcctatcggaaaacataccactgaacacaaagatagctctgataaccgtgaccgataaggatgccgatcacaacgggagggttacttgttttactgatcacgaaatacccttcaggctgagacctgtgttctcaaatcaattccttttagaaaccgccgcatacctcgactacgaatctaccaaggaatatgctataaaattactggccgctgacgcaggaaagccgcctttgaaccagtcagccatgctctttatcaaggtgaaggacgaaaatgacaacgccccagtgtttacacagagctttgtcactgtatcaatacccgagaataatagcccagggatccagttgaccaaagtcagcgcaatggacgcggattctggtcccaacgccaagatcaattaccttttaggacctgacgcccctcctgagtttagcctagactgcagaaccgggatgcttactgtggtcaagaaactagaccgggagaaagaagacaagtatctgtttacaatattagccaaggataatggcgtgccaccacttaccagtaacgtaactgtgttcgtaagcatcatcgatcaaaacgacaatagcccagtgtttacacacaatgaatacaatttttacgtgcccgagaacctgcctcggcacggaaccgtgggactgatcaccgtgactgaccccgactatggggacaatagtgcagtgacactctctatcctggacgagaacgacgatttcaccatagattctcagacaggagtgatcagaccgaacatcagcttcgaccgcgaaaagcaggagagctatactttttacgtgaaagcagaggatggtggccgtgtttctcggagctcatccgcaaaagtgaccattaacgttgtggatgttaacgacaataaacctgtttttatcgttcctccatctaattgtagttatgagctcgtgctgccaagtaccaatccaggcaccgtagttttccaggtgatcgccgtggataacgacacaggaatgaatgctgaggtcagatacagtatcgtcgggggaaatactcgcgatctcttcgctatcgatcaagaaacgggtaacattacactcatggaaaagtgtgatgtgaccgatctgggacttcaccgggttctggtcaaggcgaacgacctgggacaacctgatagcttgttcagtgtcgtgattgttaacctgttcgtgaacgagtccgtcacaaatgccacattgataaacgagcttgtgagaaagtctactgaagccccagttacccccaacacggaaattgcagacgtgtcctcacctacttcagactatgtgaagatcctggtggcagcagtcgctggtaccattaccgttgttgtcgtgatcttcataaccgctgtcgtgaggtgtagacaagcgccacacctcaaagctgcccagaagaataaacagaactcagaatgggccactcccaatccagaaaaccggcagatgattatgatgaagaagaaaaaaaagaagaagaagcactcccctaaaaaccttctgctgaactttgtgactatcgaggaaacgaaggccgatgatgttgatagcgatggcaatagagtgactctagacttacccatcgacttggaggagcagactatggggaagtacaattgggtaacaactccaaccacttttaaacccgactcacccgacttagctcggcactacaaatccgcctctccccagcccgcttttcagatccagcccgagacacctctgaatagcaagcatcacatcattcaggagttacccctcgacaacaccttcgtcgcatgtgactcgatctcaaaatgttccagttcgtcatccgatccctactcagtaagtgattgcggttatcctgttaccacgtttgaggtgcccgtgtccgtccacacacgacctccgatgaaggaagttgtccgctcgtgcaccccgatgaaggagtctacaactatggaaatatggattcatccccaaccccagagtcagcgaagggtgaccttccacttacctgaaggttcacaggaatcttcgagcgacgggggactaggggatcatgatgccggtagcttaacatcaacatcccacggactacccctgggctatccacaggaagaatattttgatcgggcaacgccgtctaacagaaccgaaggagacggtaatagcgaccctgagagcacatttatacctggtctgaagaaggccgctgaaataaccgtgcaaccgactgtcgaggaggctagcgataattgcacacaggaatgcctgatctacggccacagcgacgcttgttggatgccagccagcctggatcactcatcctcttcacaagcacaggcatcagcactctgtcattctccgcctctgagccaagcatcaacccagcatcactccccacgagtgacccagactatcgccttatgccactcaccgccagtgactcaaacaattgcactgtgccactctccaccccctatacaagtgagtgcactgcaccacagccctccccttgtgcaggccaccgctctgcaccactcccctccttcagctcaggcgtcagcactgtgttattcccctcccctcgcccaggccgctgcgatctcacattctagccccctgcctcaggtgattgcgctccatcgctcacaggcccagtcctcagtgagcttgcaacaggggtgggtgcaaggggcagatgggctatgttcagtggatcagggcgtgcaaggttccgccacatcacagttttacaccatgagcgagcgactgcatccaagtgatgactcgattaaagttattccactgacaaccttcacccccagacagcaggcacgtccaagcagaggggattcgcccatcatggaggagcacccactgtag

SEQ ID NO: 237255 - DNA, 3078 bp, Artificial Sequence
  Description of Artificial Sequence: Synthetic coding sequence
atggatctcctctctggaacatatatctttgcagtccttttggcctgcgtggtttttcattctggagctcaggagaagaattacaccatccgcgaagaaatgcctgagaatgtactgattggagacctgcttaaggacctcaacctttccctaattccaaacaagtcactgaccacggccatgcagttcaaacttgtatataaaaccggagacgtcccgcttatcagaatcgaggaagatacaggggagattttcaccactggagcacgcatcgacagagagaagctgtgtgctgggatcccgagagatgagcactgtttctatgaggtcgaagttgccattcttcctgacgagatattcagactggtgaagatccggttccttatcgaagacataaatgataatgccccactctttcccgctacagtgatcaacatctcaatccccgagaactctgccattaactccaagtacacattgccagcagcagtggatccggatgtgggcataaacggagttcaaaattatgagcttattaaatctcagaatatcttcggtctcgacgtgatcgagactcctgagggcgataaaatgccacagctgatcgtccagaaagaactggatcgagaggagaaagatacttatgtaatgaaggttaaggtggaagacgggggattcccgcagcgctcgtctaccgccattctccaggtaagtgtaaccgatactaacgataatcatccagtgttcaaggagacggagattgaggtaagtatccccgagaacgccccagtgggaactagtgtcacccagctgcacgccactgacgccgatattggggaaaatgctaaaatccacttctcttttagtaacctggtgagtaatatcgcccgacgactcttccacctaaacgccactaccgggctgattacaattaaggaaccactggacagggaggagacaccgaaccacaaattgctggtgctggcatcggatgggggactgatgcccgctagagcaatggtcctggtcaacgtgaccgacgtcaatgacaatgtccccagtatcgacatcagatatattgtgaatccagttaacgataccgtagtgctcagcgaaaacatccctttaaacacaaagatcgctcttatcacagtaaccgataaggatgcggatcacaatggcagagtgacatgcttcaccgaccacgaaattcctttcagactgcggccagtgttctcaaaccaattccttttggagacagcagcgtatctggattacgaatcaaccaaagaatacgcaatcaagctgctcgctgccgatgccggaaaaccacccttgaatcagtcagccatgctctttataaaggtgaaagatgaaaacgataacgccccagtcttcacccagagcttcgttacggtatccatcccagagaataattcgcccggaattcagctcactaaagtaagtgctatggacgcagactcaggccctaatgccaaaattaattacttgctcggtccagacgctccaccagagttcagcctggattgtcggaccggcatgctgacggttgtgaaaaaattggatcgcgaaaaggaggacaaataccttttcactattctcgccaaagacaatggagtccccccactgacaagcaatgttactgtgtttgtcagtatcatcgatcagaatgataattcacccgttttcacacataacgaatacaatttctatgtgcccgagaacctgccccgacacgggacagtgggtcttatcaccgtgacggatcctgactacggtgacaattccgccgttaccctgagtatcctagacgaaaacgacgacttcacaatcgactctcaaacaggtgtaatccggcctaatattagctttgacagggagaagcaggagtcctacacattttacgttaaggcagaggacgggggtcgagtgagcaggtcctcgagcgccaaagtcactatcaatgtggtggacgttaatgacaacaaacccgtgttcatagtaccaccatctaactgctcctacgaactggtcctacctagcaccaatcccggaacagtcgtattccaggtgattgctgtcgacaatgataccggaatgaacgctgaggtcaggtactcaattgtgggcggtaacacaagggatctgtttgccattgatcaagaaactggcaatatcactctcatggagaagtgtgatgtcactgacctgggccttcaccgcgtactcgtcaaggcgaatgaccttggacaaccagacagtctcttttcagtggttatcgtgaatctgtttgtcaacgagtccgtcaccaacgccacgctcattaatgagctcgtcaggaaatcgacagaggcccctgtgacccccaacaccgaaattgccgacgtgtcctcccctacctcagactatgtcaagatcctggtagcagctgtggccggtaccattaccgtggtggtcgtcattttcatcaccgctgtggtgcgctgtcggcaggcccctcatttgaaagcagcccaaaaaaacaagcagaattctgaatgggccactcccaatcccgaaaatagacagatgatcatgatgaaaaagaagaaaaaaaagaaaaaacactctccaaagaatttgctcctgaattttgttactatagaggaaactaaggcagatgatgttgacagtgacgggaacagggtcaccttagacctacctatagatttagaggaacagactatgggcaaatataactgggtgaccactccaactacgtttaagcccgactctcccgatttggctcgccattataaaagtgcttctccacagcctgctttccagatccagcctgaaacacccctcaattctaagcaccatataatccaagagctaccactggacaacacctttgtggcatgtgactcaatctcaaagtgttcatctagttcctccgatccctactccgtgagtgactgtggctatcccgtgaccacgttcgaagtcccagtctctgtgcacactagacccacggatagccgcacaagcaccatcgagatctgctcagaaatctag

SEQ ID NO: 237256 - DNA, 4020 bp, Artificial Sequence
  Description of Artificial Sequence: Synthetic coding sequence
atggacctgctcagcggcacttatatatttgccgtcctactcgcctgcgtggtattccacagcggggcacaagagaagaactacactatccgagaggaaatgccagaaaacgtcctcataggtgacttactcaaggatctgaacctgtcactgatccctaacaaaagtttgacaactgctatgcaattcaagttagtctataagacaggcgacgtaccattgattagaattgaagaggacacaggggagatttttaccactggagcacgcattgacagagagaaactttgcgccggtatccccagagatgagcactgtttttacgaagtggaagtcgcaattctgccagatgagatctttcgattagtcaagatccgctttctgattgaggatatcaatgataacgctcctctgtttcctgccacagtaatcaacatcagcatcccagaaaactccgctattaatagcaagtacaccctccccgctgctgtggaccctgacgttggtatcaatggtgttcaaaactatgagttgatcaaatcccaaaatatattcggtctagacgtgatagagacccccgagggcgacaagatgccacaactgattgttcaaaaggagttggacagggaggaaaaggacacgtacgtgatgaaggtcaaggtcgaggacggcggtttcccccaacgctcttccaccgccattctgcaggtcagcgtaaccgacaccaacgataatcacccagtttttaaggagactgagatcgaagtgtccatacctgagaacgcacctgttggtacaagtgtgacacaattgcatgcgacggacgccgacatcggcgagaatgcgaaaatacatttttccttctcaaatctcgtgtctaatatcgcccgtcgactctttcatcttaatgctacaacgggtctaatcacaataaaagaacccctggatagggaagaaacgcctaaccacaagctgttggtgctggccagcgacggtggcctgatgcccgctagagccatggttctcgtcaacgtgactgacgttaacgacaatgttccgagcattgacatacgctacattgttaatcccgtgaacgacacggttgtccttagtgagaacatcccgttgaataccaaaatagcattgattaccgtgaccgacaaagatgctgaccacaacggtcgagtgacatgcttcaccgatcatgaaatcccttttcgcctccgccctgtgttctcgaaccagtttctgcttgagaccgcagcttacctggattacgagagcactaaagaatacgctataaaattgctcgccgcagatgccggaaagccccctctcaaccaatctgctatgctcttcatcaaggtcaaggatgaaaatgataatgctcctgtgtttacccagtcgttcgttacggtgtccattcccgagaacaactcacccggaatacagctgacaaaagtgtccgcaatggatgctgattccggaccgaatgctaaaattaactaccttttggggcctgacgctccacccgaattttcattagactgtcgcacaggcatgctgaccgtggttaagaaactagaccgtgaaaaagaagataagtatctctttaccatactggctaaagataacggtgtcccccctctgacttcaaacgtgactgtttttgtgtccatcatcgatcagaatgataattctcctgtcttcacacacaatgagtataacttttacgttccagagaacttgcctcgccacggaacggtcggcctgatcacagttacagaccctgattacggcgataattctgcggtgactctgtccatactggatgagaacgacgactttacaatagacagtcaaactggggtgattcgcccaaacattagcttcgaccgggaaaagcaggaaagctacacgttctatgtgaaggcagaggacggagggcgtgtgtccagaagcagcagcgcgaaggttactatcaacgtggtggatgtcaacgacaataaaccggttttcatagtgcctccttctaactgcagctatgagctggttctgccctctaccaacccaggaactgtggtctttcaagtcatcgcagtggataatgacaccggtatgaacgctgaagtcaggtatagcattgtgggaggaaatacccgagatctgttcgcaattgatcaagaaacaggcaacataaccctgatggagaaatgcgatgtgaccgacctcggactgcacagagttctggttaaggctaatgatctgggacagccagattctttattttccgtcgtgattgtcaacctctttgtgaacgaatccgtgactaacgcaactctgatcaatgaactcgtcaggaagtctacagaagcgccagttacccctaatactgaaatagccgacgtttcctcccctacctccgattacgtcaagatactagtggccgcagtcgcgggaaccataaccgtcgtcgtggtgatctttatcaccgccgtcgtcaggtgtcgccaggctccacatctcaaggccgctcagaaaaacaagcagaatagtgagtgggctacgcccaatccggagaatcgccaaatgattatgatgaagaagaaaaaaaaaaagaagaagcactcaccaaagaaccttctactgaatttcgtcaccattgaagagactaaggccgacgacgtcgactctgacggcaacagagtcaccttggatctcccaatcgacctcgaggaacaaacgatgggaaaatataactgggttacaacccctactacttttaagccagattccccagatcttgccagacactataagtcagctagtccacagccagctttccagattcagcccgagacacctctgaactcaaaacaccacattattcaagagctgcccttggataacacgtttgtagcctgtgattcaatatctaaatgcagcagttccagcagcgatccctatagcgtgagcgactgcggctatccagtcaccacatttgaagtccctgtctctgtgcataccagaccgcctatgaaggaagtggtacggagctgcactcctatgaaagaaagcaccacaatggagatttggatccacccacagccacaacgtaagtcagagggcaaggtcgccggaaagtctcagcgcagagtgactttccatctgcccgagggctcacaagagagcagtagcgacggtggtctgggagaccacgacgccggtagcctgacctcaacctcccacggcctgcctctcggctatcctcaggaagaatacttcgatcgcgcaacaccatcaaataggactgagggcgacggaaattcagatcccgagtctaccgctgaaattacagtgcagccgactgtggaggaggcttccgataactgcacccaagagtgcctgatatacggccacagcgatgcttgctggatgcccgctagcttggaccatagctcttcatcacaggcgcaggcctcagctctttgtcactctcctccattatcccaggcctcaactcagcatcactctcccagagtgactcagactatcgcgctctgtcacagcccacccgttacccagaccatagcactgtgccattcgccaccgcctatacaggtgagtgctctacatcactcgccccctctagtgcaggctacagccctgcatcactctccgccatccgctcaggccagtgccctttgctactctcccccattggcacaagctgcagcaatctcccactcatcgcctctccctcaggtaatcgcgttgcaccgttctcaagcacagtcaagtgtgtcattgcagcaggggtgggtccagggcgctgacggactgtgctctgtggaccagggtgtgcagggtagcgccaccagtcagttttatactatgtctgaaaggctgcacccttcagacgactccatcaaagtgatccccttaaccacatttacgccccgtcagcaggcccgtccgtcccgtggcgacagtccaatcatggaggagcacccgttgtag

SEQ ID NO: 237257 - DNA, 3198 bp, Artificial Sequence
  Description of Artificial Sequence: Synthetic coding sequence
atggacctcctttctggaacgtatatttttgccgttctcctggcctgcgtcgtctttcactcaggggctcaggaaaagaactacaccatccgcgaggaaatgccggagaatgtgttaattggagatctgctgaaagacctcaacttgtcactgattccaaataagagcctgacaacagctatgcaattcaagttagtgtataagacaggggacgtgccactgatccggattgaggaggacacaggggaaatcttcaccacaggggcaaggatcgacagggagaaactatgtgctgggatcccccgtgatgagcactgcttctacgaagttgaggtggctattttgccagacgaaatctttagattggtcaagatcaggtttcttatcgaagacatcaacgataacgctcccttgttccccgcaacagttatcaatatttccattcccgagaactctgccattaacagtaagtacaccttaccagctgccgtcgaccctgacgtcgggatcaatggtgtgcagaactacgaactcatcaagagccagaacatctttgggctggacgtcatcgaaacgccagaaggcgataaaatgccccagttgatagtgcagaaggaactcgacagagaggagaaagacacctacgtaatgaaagtgaaggttgaagacgggggattcccgcaaaggtcatctacagcaattctacaagtgtccgtcacagacacaaatgataaccatccggtcttcaaagaaacagagatcgaagtgtcaattccagagaatgctccagtggggacaagcgtcacccagctgcacgccaccgacgccgatataggggagaacgccaaaatccacttttcattttctaaccttgtgtctaacatcgccaggcgcttgtttcatcttaatgccaccacagggctgataactatcaaggagccgctggatcgcgaagaaacgcccaaccacaagctgctcgtgctggccagcgacgggggactgatgcccgctcgtgcaatggtgttggtgaatgtgacagacgtgaacgataacgtaccatctatcgatattcgctacatagtcaatccagtcaacgacacggtcgtcttaagtgagaacatccctctgaataccaagatcgctctcattactgttaccgataaagatgctgatcataatggtcgggtcacttgctttaccgatcacgagatccctttccgcctgcgtccggtgttctctaaccagtttctgctggagacagccgcatacctggactacgagtccacaaaagaatacgccatcaaactgcttgccgcagacgctgggaagccacccctgaaccaatccgctatgctgttcattaaggttaaggatgagaatgacaacgcacccgtgtttacacagtcgtttgtgaccgtctcaatccccgagaacaattcccccggaattcagctcaccaaggtttccgccatggatgccgactctgggcctaacgctaagatcaactatctgctgggccctgatgctcccccagaattcagcctggattgccggacgggaatgctaacagtggtcaagaaactggacagggaaaaggaagataaatacctcttcacgatactcgcaaaggataatggcgttcctcctctgacctcaaacgtcacagtatttgtgagtattattgaccagaatgacaacagcccggttttcacccacaatgagtacaacttctatgtaccggagaatctgcccagacacggcacagtcggactaattacagtgaccgatccagattacggagacaactccgctgtgacacttagcatcctggacgaaaatgacgactttaccatcgacagccagacgggagtcatcagaccaaacatctcatttgatcgggagaaacaagagtcctataccttctatgtgaaagccgaagacggaggcagagtttctaggtcctcctcagcaaaggttacaatcaatgtggtggatgtaaacgacaataagcctgtcttcatcgtacctccaagtaattgctcctacgagcttgttctgccctccacaaaccccggaacggtggtattccaagtaattgccgtagataacgatacgggcatgaacgctgaggtgagatattccattgtgggtggcaatactagagacctgttcgccattgaccaggaaacaggaaatattaccctgatggagaaatgcgacgtgactgatctgggcttacaccgtgtgttggtgaaagcaaacgatctcggacagcctgattcccttttttcagtagtgatagttaatctgttcgtaaacgagagcgtcaccaatgctacgttgataaacgaactggttagaaagagcacagaggccccagtgacaccaaacacggaaatcgctgatgtgtcatcccccacgtctgattacgtgaaaatacttgtcgccgctgttgctggtaccattactgtggtcgtcgtgatcttcatcacagcagtggtgaggtgcaggcaggcaccgcacttgaaggccgctcaaaagaataaacaaaattccgaatgggcaaccccgaaccctgaaaacaggcagatgataatgatgaagaaaaagaagaagaaaaagaagcattcccctaaaaatttacttttaaactttgtcacaatcgaggaaacaaaggctgacgatgtggactccgacggcaatcgagtgaccctcgacttgccaatagacctggaagaacagactatgggcaagtataattgggtgacgacaccgactacattcaaacctgactctcccgatttggctcgtcactacaaatccgcttctccccagccggcatttcagatccagcctgaaacgcccctgaactccaaacatcacattatccaagaactgccccttgataacaccttcgtggcgtgcgactccatttccaaatgctcctcatcatcatccgacccttactccgtgtctgattgcgggtaccctgtgacaacgtttgaggtgccagtgtcggtgcacacaagacctcccatgaaagaggtagtacgaagttgtaccccaatgaaggagtcgacaaccatggaaatctggatccacccccagccgcaacgcaagtccgagggcaaagtcgccggtaagaccgtgcttacttcgtccagtccttccgccatgaccctctcttacttggactag

SEQ ID NO: 237258 - DNA, 1344 bp, Artificial Sequence
  Description of Artificial Sequence: Synthetic coding sequence
atggcaaccgccgctaccacaaccacgactaccacggctacagtggcactgaccactagttgggataatgccacggggaggcctacagcggaacctgatcccatcctggacaattatgttcttctggtggtggttatgtcactgtttgtgggcggaacccttgttgttctctcaggggtgctgcttttgtgcaaaaggtgttgggatgtccaccagcgtctgaatcgtgcaatggaggaggctgaaaaaaccactaccacctacctggataatggcacacacccagcccaggatcctgacttccggggagaagaccccgaatgccaggatgcggagactgaacgctttctaagtacttcatccacagggaggagagtatcctttaatgaagctgctctgttcgaacaatcccgcaagactcaagataagggccgacgctacaccctcactgaaggtgactttcatcacctcaaaaatgctagattgacacacctgcatctgccaccactgaaaattgtgacaatccacgagtgcgacagtggcgaggcctcttccgcgacaactccacacccagctacttcccccaaggccaccctggccattttccagccacccggtaaagccctgacgggcaggagcgtgggcccatcgtccgctctccccggagacccctataattccgccgctggcgcaaccgatttcgctgaaatcagcccctccgcctcaagcgactccggtgagggcacctctctggatgctgggactcggtccaccaaagcgggaggtcccggagccgcagcgggaccgggagaggcaggacctggaagcggagccggaaccgtgttgcagttcttgactaggctgcgaagacatgcttcactggacggcgcttcaccctattttaaagttaagaagtggaaactggagccctcccaacgcgctgccagcctggacacccggggtagcccgaagcggcaccatttccaacgccaaagagccgcttccgaatctactgaacaggaggagggggacgcaccgcaagaagattttatccagtatattgctcgggcaggagatgcggtggcgttccctcatccaaggccatttctggcctccccgccaccggcactcgggcgatatttctctgtagacgggggtgccagaggtggacctgtgggcccttgccctccctccccccctccacgaaggcccagagagaggtcgccaggaccagtggatactagaagcccagccagttccggtaaggctcccccacgtggaggccttactggcgctaccagcccagcctggactagagggggaaagcaaggagagacgggttag

SEQ ID NO: 237259 - DNA, 3114 bp, Artificial Sequence
  Description of Artificial Sequence: Synthetic coding sequence
atgactgtgggcttcaatagtgacatcagcagcgttgtccgggttaatacgaccaattgccacaagtgcctcctgtcaggcacatacattttcgccgtgctcctggtttgcgttgtttttcactccggtgcccaggagaaaaattacactatccgcgaggagatccctgagaacgtactcattggcaatctccttaaggatctgaacttatcgctgattcctaacaagagcctcactacaactatgcagttcaagttggtttacaagacaggcgacgttcctctgattaggatcgaagaagacacaggcgaaatcttcacaacaggggctagaatagatcgtgagaagttatgcgctgggatcccgagggacgagcactgcttctatgaagtggaggttgccattctccccgacgagattttccggctagtgaaaatcagatttttaatagaagacatcaatgacaatgcgcctctcttcccagccacagtcattaacatttcgatccctgaaaactcagcaattaacagcaaatacaccctacctgcggcagtggatcctgacgtgggcattaacggagttcagaactacgaacttatcaagtctcagaacatttttgggttggatgtcatcgagacaccggaaggtgacaagatgccccagttgattgtacaaaaggaactggatcgtgaagagaaagacacttatgtcatgaaggtgaaggtcgaggacgggggttttccccagcggtcctcaacagccatcctgcaagtgtctgtgacggacacaaacgacaaccaccctgtgttcaaggagaccgagatcgaggtgtcgatccccgaaaatgctccagtgggaacctctgtcacccagctgcatgctaccgacgctgatattggggaaaacgctaaaattcacttcagcttctctaacttggtgtccaacatagctcgtagacttttccatctaaatgcgacaaccggtttgatcactataaaagagcccctggatcgggaggaaaccccaaaccacaaactacttgtgctggcgtctgacggcggactgatgcccgctcgggctatggtcctggtgaatgtgaccgacgtgaacgataacgttccctcaatcgacatcaggtacatagtcaaccctgtaaatgacaccgttgtgctgagtgagaacatcccactgaacaccaaaatcgcgctcattactgtcaccgacaaggacgccgatcataacggacgagttacctgttttaccgaccatgagatcccttttagactccggcctgtgttcagcaaccagttcctgcttgaaaatgcagcttatctcgactacgaatctaccaaagagtacgcgattaaactgcttgcggctgacgcaggtaaaccacctctaaaccagtcggccatgcttttcattaaggtaaaggatgaaaatgataacgcgcctgtgttcacacagtcctttgtgacagtatcaatccctgaaaacaacagccctgggatccagctcatgaaagtaagcgcaacagatgccgacagcggtcccaatgcagagattaattaccttctaggccctgatgctccccctgaattttccttggacagaagaacaggcatgcttactgtggtaaaaaaactggacagggaaaaggaagataaatacctgttcaccatcctcgccaaagataatggagtgccccctttgaccagcaatgtgacggtgttcgtctccattatcgaccagaatgacaattcaccagtattcacccacaacgagtacaaattttatgtcccggagaacctgcctaggcatggcacagtgggacttattacagtaactgaccccgattacggagacaatagcgctgtaacactctccatcctggacgaaaatgatgactttaccatcgattcgcaaaccggagtaatccgaccaaatatttccttcgaccgcgaaaagcaggagagttacactttttatgtaaaggcagaggatgggggaagggtgtccagatcttccagcgccaaagtaaccataaacgtagttgatgttaatgataacaaacccgtgtttattgttccgccatacaattacagctatgaattggttctgcccagcaccaatcccggaacagtggtattccaagtaattgccgtggataatgacacaggcatgaatgcagaggtccggtactctatagtggggggtaatacacgggatctattcgcaatcgatcaggaaactggaaacattaccctgatggagaagtgtgacgtgacagatcttggccttcaccgagtgttagtcaaggccaacgacctgggtcaacctgactcgctcttttccgtggtgatagtcaatttattcgtaaacgagtcggttacaaacgctacactgattaatgagctggtccggaagtctatagaggcccctgttacacctaacacagaaattgcagatgtttcttcccccactagtgactatgtaaaaattctggtggcagcagttgctggcactattacagtcgttgtggtgatttttataacagctgtggttcggtgtagacaggctcctcatctgaaagcggcacagaaaaacatgcagaacagcgagtgggcaacacccaaccctgagaatcgccaaatgatcatgatgaaaaaaaagaagaaaaagaaaaaacacagtcctaaaaacttattgctcaacgtggtgaccatcgaagaaacgaaagccgacgatgttgactccgatggcaatagggtgaccctagatttgccaatagaccttgaggagcagactatgggcaagtacaactgggtaactacccccacaacgtttaaacctgacagtcctgatctggctcgtcactataagtccgcttcaccacagccggctttccagattcagcctgaaacgccccttaatctgaagcaccacatcattcaagaactgccactggataacaccttcgtggcctgtgacagcatttctaactgtagttccagctcttctgacccctacagtgtgtctgactgtggctatccagtcactacattcgaggtgcctgtgtcggtgcatactcggccaacagatagccgaacctag

SEQ ID NO: 237260 - DNA, 3147 bp, Artificial Sequence
  Description of Artificial Sequence: Synthetic coding sequence
atgttccgcgtgggatttttgattatatcttcctcctccagcctgagccctctacttctggtttctgtggtgcgcgttaacacaacaaattgtcacaaatgcctcctctccggaacatatatctttgccgtcctcctggtatgtgtggtgttccactcaggtgctcaggagaaaaattacacaatccgcgaggaaattcctgagaacgttctaatcggtaacttactaaaggatctaaacttgagcctaatccctaataaaagccttactacaaccatgcagttcaagctggtgtacaagactggcgacgtccccctgattcgaatcgaagaggatactggcgaaatcttcactacaggagcacgaattgacagagagaagctttgcgcgggaattcccagagatgagcactgcttttatgaagtcgaagtggccatcctgcccgacgagattttccgcctcgttaagatcagatttctaatcgaagacatcaacgataatgctccactcttcccagcgactgtcatcaacatcagcattccggaaaactcggcgatcaactcgaaatacactctcccagctgccgtggacccagacgtcggaatcaacggtgttcagaactatgagctgatcaagtcacagaatatctttggcctggacgtaattgagactcccgagggcgataagatgccacagctgattgtacagaaagagttggaccgcgaagagaaagatacctacgtgatgaaagtgaaagttgaagatggcggattccctcagagaagttccaccgcaatcctgcaggtaagcgtgactgataccaacgacaatcacccagtctttaaggaaacggagatcgaagtaagcatacccgaaaacgcccctgtgggaactagtgtgacccagcttcacgcgacagacgcagacatcggcgagaatgcaaaaatccatttctccttctccaatctggtctctaatatcgccaggcgcctatttcatcttaacgcgaccaccggactgattaccattaaggagcccctcgacagagaagaaactcctaatcacaagcttctggttctggcttcagatggtggtttgatgcctgctcgggctatggtccttgtgaatgtcacagacgtgaatgacaatgtgcccagcattgacatcagatacattgtgaacccagtgaatgatacagttgtgctttccgagaatattcccctgaatacaaagattgccctcatcaccgtgactgataaagacgctgaccataacggtagagttacttgttttacagaccacgaaatcccttttaggctccgccctgttttcagcaatcagttcctgctagagaatgctgcctacttggattacgaaagtactaaagagtacgcgatcaaactcctcgctgctgacgcaggcaagccccctttgaatcagagcgctatgctgtttattaaagtcaaggatgaaaacgataatgcgcctgtctttacccagtccttcgtcaccgtctctatcccggagaacaactcacccggtatacagctgatgaaggtgtccgccacagatgctgattccggcccaaacgcagagatcaactacttgttggggccagatgccccacctgagttctccctagatagaagaacaggtatgttaaccgttgtgaaaaaacttgaccgcgagaaagaggacaagtatctgtttacaattcttgctaaggacaatggggttcctcctctcaccagtaacgtgacggtgtttgtgtcgatcatcgaccagaacgacaattcccctgttttcacacacaacgagtacaagttctatgtgccggagaacttaccccgacatgggactgtgggacttatcacggttaccgacccagattatggcgataacagtgccgtaaccctaagtatacttgacgaaaacgacgactttactatcgattcccagactggcgttattagaccgaacatcagcttcgaccgggaaaaacaggaatcctacactttctatgtcaaggccgaagacggcggacgtgtctcaaggtcttcttctgcaaaagttaccatcaatgtcgtcgacgtgaatgataataagccggtgtttattgtgcccccatataactactcttacgagctggtactgccctcgacaaaccctggaaccgtggtttttcaggtgattgccgtagataacgacaccggcatgaacgctgaggtgcgttatagcattgtcggcggtaacacaagagatctgtttgccattgaccaggaaacgggcaatattacgctgatggaaaagtgcgatgtgacagatttgggcttgcaccgcgtgctggtgaaagcgaacgacctgggccagcccgactctctgtttagcgtggttatagtcaacctgttcgtaaacgagagtgttactaacgccactctgattaacgaactcgtgagaaaatctatcgaggccccagtaacaccaaacactgagatcgctgatgtgtcctctccgacttctgactatgtgaagatcctagttgccgcagtggcaggaactattaccgttgttgtggtcattttcatcactgctgtggtgcgctgtcgtcaggccccacacttaaaagctgctcagaagaacatgcagaattcagagtgggccacccccaaccctgagaatcgccagatgatcatgatgaagaagaagaagaagaagaagaagcactcaccgaagaatctgctcttgaatgtggttaccatagaagagacaaaagcagacgatgtggatagcgacgggaaccgggtaacacttgatttacctatagatctggaggaacagacgatgggcaaatacaactgggtaacaaccccaaccaccttcaaaccggatagtcccgatcttgcacgtcactacaagtcagcgtcacctcagccagccttccagattcaacccgagacccccctgaatcttaagcaccacataatacaggagttacctctcgataacacgttcgtcgcgtgtgacagtattagcaattgttcatccagcagctctgacccatacagtgtttctgactgcggctatccagtcactacttttgaggtaccggtttccgtgcatacccgccctactgacagtcgaacatag

SEQ ID NO: 237261 - DNA, 3960 bp, Artificial Sequence
  Description of Artificial Sequence: Synthetic coding sequence
taggttgtgagagtcaataccaccaactgtcacaagtgcttgttgtctggcacctacatcttcgccgtgctgcttgtttgcgttgtgtttcattctggcgcacaggagaagaactacacaatcagggaggagattcccgaaaacgtcctgatagggaacctgctcaaagacctcaatctcagtctgattccgaacaagtccctgacaaccaccatgcaattcaaacttgtgtacaaaacgggagacgtaccgctcatccgcatcgaagaggacactggcgagatctttactaccggagctcgcatcgatagggagaagctatgcgccggaatacccagagatgagcactgcttttatgaggtggaagttgccatccttcccgatgagattttcaggcttgttaaaattcggtttctcattgaggacataaacgataacgcaccactgttcccagctactgtcattaatatctcaatccctgagaatagcgccatcaatagcaaatacaccctgccggcagccgtggaccccgacgtcgggatcaacggtgtccagaactatgaactgattaagagccagaatatcttcggcctggacgttatagaaactcccgagggtgacaaaatgccgcagctgatcgtacagaaagagctggatagggaggagaaggatacatatgtaatgaaggtgaaggtggaggacggtggattcccgcagagatcttccacagcaattttgcaggtctccgtgacggatacaaatgacaatcatcctgtgtttaaggagacagagatcgaagtgtccatccccgagaatgccccagtagggacctcagtcacgcagctgcacgcaacggacgccgacatcggggaaaatgccaagattcacttttcattttccaacctggtctccaacattgcacgcaggctgttccacctcaatgccactaccgggcttatcaccattaaagagcccctggatcgggaagaaaccccgaaccacaagctgcttgttctggcctcagacggtggcctcatgcctgcacgggcaatggttctcgtcaatgtgacagacgtgaatgataatgttcctagtattgacatccgatatatagtgaatccagtgaatgataccgttgtgctgtcagagaacattcctctcaacactaagatcgctctgataacagtcacagacaaggatgcggaccacaacgggagagtaacctgctttaccgaccacgagatcccgtttcggcttcgtcctgtcttctccaatcagttcctcctggagaatgccgcatacctagactatgagagcaccaaggagtacgcaataaagttgctcgccgcagacgctggcaagccccctctcaatcaatccgccatgctctttatcaaggttaaggacgaaaatgataacgcacccgtgtttactcagagctttgtgaccgtctccatccctgaaaataacagccccggaatacagctcatgaaggtctccgcaacagatgccgattctgggccaaatgcagagattaattatttactgggacctgacgcccctcccgagttctcactagacaggcggactgggatgctcactgtggtaaagaagctggaccgcgaaaaggaagataagtatctgtttacaattctcgctaaagacaacggagtgccacctctgacatctaatgtgaccgtgttcgtctctataatcgaccagaacgacaattcacctgtattcacacataatgagtataagttttacgttccagagaaccttccacggcacgggacagtgggactgattaccgtcaccgacccagactacggcgataacagcgccgtcaccctgtcaattctcgatgaaaacgacgattttaccattgacagtcagacaggggtgatcagaccaaatatctccttcgaccgcgagaagcaagaaagttacaccttttacgtcaaagccgaggatgggggacgagtgtccagatcttcgagtgctaaggtgaccatcaacgtggtcgatgttaacgacaacaagccagtgtttattgtgcctccttacaattattcatacgagctggtactcccatcgaccaacccaggcaccgtcgtctttcaggtgattgcagtggacaatgataccggcatgaatgcagaggtgaggtactctattgtggggggaaacactcgtgatctgtttgctattgaccaggaaacgggcaatatcacactcatggagaagtgtgatgtgactgacttgggcttacatagggtgcttgtaaaggcgaatgatctggggcagcccgacagcctgtttagcgtggttattgtcaacctctttgtcaatgaaagcgtcactaacgctactttaatcaacgaactggtgcgtaaatctatcgaagcaccggtcacgcctaacactgagatagctgatgtgagctccccaacatccgactacgtgaagattctggtggccgctgtggccggaacaatcacagtggtggtggtgatatttatcactgcggtggtgaggtgtagacaggcccctcatttaaaggcggctcagaagaacatgcagaattccgagtgggctactcccaaccctgagaatcgccagatgatcatgatgaaaaaaaagaagaagaagaaaaaacattcacccaagaacttacttttaaatgtagtgacaatagaggagaccaaggcagatgacgttgattcagatggcaatagggtcaccttggacctgcccatcgacctagaagaacaaaccatgggcaagtacaattgggtaactacgccaactacctttaaaccagacagccccgacctggcaagacactataaatctgcttcacctcaacctgcgttccaaattcagcctgaaacccctctgaaccttaagcaccatatcatccaggagttacccttagacaatacattcgtggcctgcgacagtatttccaactgcagctcctcctcctctgatccctacagcgtgtcagattgcgggtacccagttactaccttcgaagtgcctgtgtccgtgcacaccagaccaagccagcggagggtcacttttcatctgcctgagggttctcaagaatcatcctcagacggaggcctgggggaccatgatgcaggaagcctgacatcaacctcccacggtcttcctttgggctacccccaggaagaatatttcgatcgtgcaaccccctcaaacaggaccgagggggacggtaatagtgaccctgagtccacattcattccgggattaaaaaaagagataaccgtacagcctaccgtcgaggaggcctcggataattgtacacaggagtgcctaatctatggacactccgacgcctgctggatgcccgcttccctggatcacagttcttccagtcaagctcaggcctctgcactttgccactccccacccctctctcaggcctccacacagcaccattcccccccagtcacccagacgatcgtgttatgccattctccgcctgtaactcagactatagctctttgtcacagcccacctcctattcaggtgtccgcacttcaccattcacctccgctggtgcagggaactgctctccatcactccccgccaagcgctcaggcaagcgctctgtgctactcccctccactcgcccaggctgcggcaatatcacactcctcctctctaccccaagtgatagcgttgcatcggagtcaggcacagtcctcagtgtccttacagcaggggtgggtacaaggagccaacgggttgtgctccgtagaccaaggtgtccaggggtctgccacatcccagttttacacaatgtctgagaggcttcatccaagcgacgattccattaaggttatccccttaacaaccttcgcccctaggcagcaagcccgacccagcagaggtgatagccctatcatggaaacgcacccactctag

SEQ ID NO: 237262 - DNA, 1080 bp, Artificial Sequence
  Description of Artificial Sequence: Synthetic coding sequence
atgagatcaataaggaaaagatggacaatttgcaccatatcactcctacttatcttctacaaaaccaaagaaatcgccaggaccgaggagcaccaggaaactcagctgattggcgatggggagctctctctgtccagatccttagtcaacagctctgataagatcatccgaaaagccggatcgagtatattccaacacaatgtggaaggctggaaaatcaactcctccctagtattggaaatccgaaaaaatatcttgcgatttcttgatgcagaaagggatgtgagcgtagtgaagtcatcctttaagcctggggacgtaatacactacgttctggaccggaggcggactttaaacatctcgcatgatctgcacagccttctccccgaggtgagccctatgaaaaaccgaagatttaagacatgtgcagtcgtgggcaattcgggcatcttactcgattctgagtgtgggaaggagatcgattctcacaactttgtaattcgatgcaatctcgccccagtggttgaattcgctgccgacgtcgggacgaagtctgatttcattactatgaatccctcggtggtgcagagggccttcggaggattccgaaatgaaagtgatcgagagaagttcgtgcacaggttatccatgctgaacgattccgtactgtggatccctgccttcatggtcaaaggcggagaaaagcacgtggaatgggttaacgccctaatcctgaaaaacaagctgaaggtcaggaccgcttatccctcccttagactgatccacgccgttaggggctactggcttaccaacaaagtccctataaaaaggccttcgactggccttttaatgtatactctcgcgacacggttttgcgacgagatccatttgtacgggttttggccttttcccaaagatctgaatggcaaggctgtcaagtatcactactacgatgatctaaagtatagatacttcagcaacgctagccctcatcggatgccgctggagtttaaaactctaaatgtcctgcacaacagaggcgcactcaagctgaccactggcaagtgtgttaaacagtag

SEQ ID NO: 237263 - DNA, 72 bp, Artificial Sequence
  Description of Artificial Sequence: Synthetic coding sequence
atgatgcagctcctgcagcttttgctaggtctcctaggacccggtggctatttgttcctactgggtgattag

SEQ ID NO: 237264 - DNA, 3480 bp, Artificial Sequence
  Description of Artificial Sequence: Synthetic coding sequence
atgtatctttcgatttgttgctgcttcttactgtgggcccctgccttgacactcaagaacttgaattacagcgtccctgaggagcaaggggctgggacagtcatcggtaatattgggagggacgcacgcctccagcccggtctgcctcctgctgagcgcggaggaggaggcagatctaagtctggaagctaccgcgttctggagaattctgcccctcatctgcttgatgtcgatgcagacagtggcctgctatataccaagcagagaatcgaccgagaatctctttgtaggcacaatgcaaagtgtcagttatctctggaggtgtttgcaaacgataaggaaatctgtatgattaaagtagaaatccaggatattaacgacaatgccccttctttcagctccgatcagatcgagatggacatcagcgagaacgcggctccaggcaccaggttcccactcacaagcgcccatgacccggacgctggggaaaacggtttaaggacgtatcttctgactagggacgaccacggcctgtttggccttgatgtgaaaagcagaggagatgggactaaatttcccgaattggtcatacagaaagctttggaccgcgaacagcaaaatcaccatacgctggtccttaccgccctagacgggggagaaccaccgagatccgccaccgtgcagatcaacgtcaaagtcatcgactctaacgataacagtcccgtttttgaggccccaagctacttggtggagctccctgagaacgcccctttgggcaccgttgtcatcgaccttaacgccacagacgccgacgaggggcctaatggagaggttctgtattcattctccagctacgtgcctgacagagtgagggaactgttttcaatagatcctaaaactgggctcatcagggtgaagggaaacctggattacgaggagaacggcatgcttgagatagatgtgcaggctcgtgacctgggcccaaacccaatcccagctcactgtaaagtcaccgttaagctcattgaccgaaacgataacgcgccttctattggtttcgtgagtgtacgacagggagccctctccgaagccgcaccacctggcaccgtcatcgctctggtccgggtgactgaccgcgattcaggcaagaacggacagctgcagtgcagggtactgggtggcggaggcactgggggtggcggaggcctggggggacccggaggaagcgtgcctttcaagttagaagaaaactatgacaacttttacaccgtggttacagataggccgctggatcgggagacacaggacgaatacaacgttactatcgtagcacgagacggcggtagccctcccctaaacagtactaagtcttttgccatcaaaatcctcgatgagaacgacaaccctcccagattcaccaagggactgtatgtgctccaggtgcacgagaataacattcccggagagtacctggggagtgtgctggcgcaggatcctgacctgggtcaaaacggtaccgtcagttattcgatcctaccgagccacattggggacgtttccatctatacgtacgtgagcgtgaacccaaccaacggagccatttacgcccttcggagcttcaacttcgaacagactaaagctttcgaattcaaagtcttggctaaagactctggtgcacccgcacacctagaatccaacgccaccgtcagggttacagtcttggacgtgaatgataatgctccagtcatagtgctccccacattacagaatgacacagccgaactgcaggtacccaggaatgctggtttggggtacctggtgtcaaccgtgcgagccctggatagcgacttcggggaatcggggcgtctgacctacgagatcgtggacggcaacgacgaccacctgttcgagattgacccatccagcggagagatacggactttacatcccttctgggaggacgtgacccccgtggtcgagctcgtcgtcaaagtcaccgaccatgggaaacctacattgagcgcggtggctaagctaatcatccgcagcgtaagcggctctctgcctgagggagtgcccagagtcaacggggaacagcatcattgggatatgagcctccctcttattgtgacattgtcaactatttccattattctgctggccgctatgataactattgccgtgaagtgtaagagagagaacaaggaaatacgcacttacaattgtagaatcgcagaatattctcacccgcagttgggcggagggaaggggaagaagaaaaaaatcaacaagaacgacattatgctggtccagtctgaggtggaggaaagaaatgctatgaatgtgatgaatgtagtgtccagtcctagcctcgccaccagcccaatgtacttcgactaccaaacgcggttgccactgagcagtcctcgcagtgaagtgatgtaccttaaacccgctagtaataacctgaccgtgccacagggacatgctggctgccatacctcatttaccggacaaggcactaatgcgagcgaaacgcccgctacaagaatgtccatcattcagacagacaacttccctgccgagcccaattatatgggatctcgacaacagttcgtacagagttcctctacatttaaagacccagagagagcatctctgcgcgattctggacacggggactcggatcaggctgactctgatcaggatactaataaggggagttgctgcgacatgtcagttcgggaagccctgaaaatgaagacaacctctacaaagtctcagcctctggagcaggaacctgaggaatgtgttaactgcacagatgaatgtagagtgcttggccattccgatcgctgttggatgccacaattcccggcagcaaaccaggccgagaacgcggattaccggactaatctttttgtacccacagtggaagcaaacgtggaaactgaaacctatgagaccgtcaaccctaccgggaaaaagaccttctgcactttcggcaaagacaaacgggagcatacaatcctgattgcgaacgtgaagccatatcttaaagccaagagagccttgtctcccctgttgcaggaggtcccctccgcctcctcctcacccactaaagcttgcatagaaccgtgtactagtacaaagggaagcctggacgggtgtgaggccaaacctggcgctctagcggaagcaagcagtcaatatctgcccacagactcccagtatctgagtcccagcaagcagccccgagatccacctttcatggcttctgaccaaatggccagggtgtttgctgatgtgcactctcgcgcttccagggatagcagtgaaatgggcgctgtgcttgaacagctcgaccacccaaacagagacctaggcagggaaagcgtagatgctgaagaagtggtgagggaaatcgacaaactgcttcaggattgccgtgggaatgacccagtggccgtgcggaaatag

SEQ ID NO: 237265 - DNA, 3408 bp, Artificial Sequence
  Description of Artificial Sequence: Synthetic coding sequence
atgcatcagatgaatgctaaaatgcactttcgcttcgttttcgcactcctgatagtgagttttaatcacgatgtgctgggaaagaatctgaagtatcgcatctacgaagaacagcgcgtaggctcagtcatcgctcgcttatccgaggacgtcgctgacgtgctactgaagctgccaaatccaagcaccgttaggtttagggccatgcagcgtgggaatagtcctctgttagtagtaaacgaggacaacggggaaatatcaatcggggcaacaattgacagggaacaactgtgccagaaaaatctgaattgtagcatcgaatttgacgtaattaccttgccaaccgaacacttacagctgttccatatcgaagtggaagtcttagacatcaatgacaatagcccgcaattcagcaggtcacttatccccatcgagattagtgaatctgccgctgtgggtacgagaatccccttggacagcgcattcgaccctgacgtcggtgagaactctcttcacacctattccctgtccgcaaatgatttcttcaatattgaggtccgaacacgaacagatggcgcaaaatatgctgagctcatcgtagtcagagagctggatcgggaacttaagtcatcttatgagctgcagctcactgcgtcagatatgggggtgcctcaaagatctggcagtagcatccttaaaatttcaatttctgattccaatgacaattctccggcatttgaacagcagagctacattatccagcttctcgaaaatagcccggtgggcactctgttgttggatctgaatgcgactgaccctgacgagggcgcaaacggtaagattgtgtattcctttagtagtcatgtctcacccaagattatggagacttttaaaatagatagtgagaggggccacctaaccctcttcaaacaggtggactacgaaatcaccaagagctacgaaattgatgtccaagctcaggacctcgggccaaattcgatccccgcacactgtaagattatcataaaagtagttgacgtcaatgataacaagccggagataaatatcaaccttatgagtcccggtaaagaagaaataagttatatcttcgaaggggaccctattgatacatttgtagctttggtgcgagtgcaagataaagattcagggctaaatggcgagattgtgtgtaagctgcatgggcacggacatttcaaactgcagaagacatatgagaataactatctgatacttaccaatgctaccttggacagagaaaagaggtccgaatattcactcacagtaattgccgaagaccggggaacgccttctctgtccactgtgaaacactttaccgtacagattaacgatatcaacgataacccacctcatttccagaggtcccgttacgagtttgtaatatctgagaacaactcccccggtgcatacattacgacagtcactgcaacagacccagatttaggggaaaacggacaggtgacttataccattcttgaatcctttatcctgggatctagcatcaccacctacgtcacgatcgaccctagcaacggcgctatctatgccctgcgtattttcgaccacgaggaggtctctcagattacatttgtggtggaggccagagatggtggtagtccaaagcagcttgtgagtaacaccaccgttgtgctcactattattgacgaaaatgataacgtccccgttgtgatcgggcctgcgctgcggaataacaccgccgagatcactattccaaaaggcgcagagtcaggctttcatgtgactaggattcgagccattgatcgggattctggagtgaacgcggagttgtcttgcgcaattgtagctggcaatgaggagaatatcttcatcattgacccccgtagctgcgacattcatactaacgtgagtatggactccgttccctacacggaatgggaactctcagtaataatacaggacaaggggaatccccaactccacacaaaggtgcttctcaagtgtatgatattcgagtacgctgaatccgtgacctctacagctatgacctcggtgtcacaagcatcgttagatgtttcgatgatcattattatcagtcttggcgcaatttgtgccgtacttctcgtcatcatggtgctattcgctaccagatgtaatcgcgagaagaaggacaccagaagctacaattgcagggtcgcggaatctacatatcagcatcatccaaaaaggccctcccgacagatccacaagggggatataacactggtccccactatcaatggtacactcccgatacgctcccaccaccgatcatctccctcatcatccccaacattggagcgtggccagatgggctctagacagagccacaactcccatcagagtcttaacagccttgtgactatctccagtaatcatgtgcctgagaatttctcccttgagctcacccacgcaacaccagcggtcgaacaggtttcccaattgttatctatgctccatcaaggccagtatcagccgcgtccttcttttcggggaaacaaatatagccggtcctacaggtacgctttgcaggacatggataaattttctttaaaggattccggcagaggggacagtgaagccggtgacagcgattacgacctcggaagagattctcccattgaccggctattaggagagggcttctccgacctgtttctgactgatggcaggatccccgcagccatgcgcctgtgcaccgaagaatgcagggtactcggacacagcgatcagtgttggatgcccccattgccctctccctcgtctgattataggagcaacatgttcattcccggtgaggagttcccaacccaaccacagcagcagcacccgcatcagagcctcgaagacgacgctcagccggcagattcgggcgagaagaaaaaatcattttccacctttggaaaggacagtccaaatgacgaggatactggcgatacctcgacatcctcactgctaagcgagatgagctccgtctttcagaggttgttacctccatcactggatacctacagtgagtgcagcgaagtagatcggtccaacagtcttgagaggcgcaagggccctctcccagccaaaacggttgggtatccacaaggcgtagccgcatgggcagcttcgacgcactttcagaatccaaccactaattgcggaccgccactcggtacccacagcagcgtgcagcccagtagtaagtggctgccagccatggaagaaattccagaaaactatgaggaagacgacttcgataacgtgctgaaccatctgaacgatggcaaacacgaattaatggatgcgagcgagctggtagctgaaatcaataaactgttacaggatgtccgacagagctag

SEQ ID NO: 237266 - DNA, 3405 bp, Artificial Sequence
  Description of Artificial Sequence: Synthetic coding sequence
atgcatcaaatgaatgcgaaaatgcacttcagattcgtctttgcattgctgatcgtgtcctttaaccacgacgttctaggcaagaacctgaaataccgaatttacgaagagcagcgtgtggggtccgtgatcgcacgcctgagcgaggacgttgcggacgttctgttgaagttacccaatccttccaccgtaagattcagggcaatgcagagaggtaattcgcctctgttggtggtgaacgaagataacggcgagatttccattggggctaccatcgatcgggagcaactctgccagaagaatctcaactgctccatcgaatttgatgtgattacccttcccaccgagcatctgcaattgtttcacatagaagttgaagtattagacattaatgataacagtccacagttttcacggtctttaattcccatcgaaattagcgagtctgccgcagtggggaccagaatcccccttgactcagcttttgatccagatgtgggagagaattcactacatacctactcactgtccgctaacgactttttcaacattgaggtgagaacacggaccgacggagccaagtacgcagaactgatcgttgtcagggagctggaccgggagcttaaaagctcctacgaactccagcttaccgcatccgatatgggcgtgccacagcgcagtggtagctccatcctgaagattagtatcagtgactctaatgataatagtcctgcctttgaacagcagagttacattattcagctgctggagaactcacccgtcggtaccctgctgcttgatctgaacgcaacagaccccgatgagggcgctaacggaaaaatcgtttactctttttcatcccatgtgagcccaaaaattatggagactttcaagattgatagtgagagaggccatcttaccctgttcaagcaggtcgattacgagatcacaaaatcttatgaaatcgacgtgcaagctcaggatcttgggccaaactcgataccagcccactgcaagataattatcaaggtcgtggacgttaacgacaataagcccgagataaatatcaacctcatgtctccgggaaaagaggagatcagctatatattcgagggcgatccaatcgacaccttcgtggcactggttagggtgcaggacaaggactctgggttgaacggcgaaatagtttgtaaactgcacggccacgggcacttcaagctccaaaaaacatacgagaataactatctgattctaacaaacgctacgctcgaccgcgaaaaaaggagtgagtactctctcaccgtgatcgcagaggacaggggcactccctctctctcaacagtcaagcacttcaccgtgcagattaacgacatcaatgataacccccctcactttcaaagatctcggtatgaattcgtcataagtgagaataatagcccaggcgcatacatcaccaccgtgaccgctaccgatcctgatcttggcgaaaatggccaggtcacatacacaattctggagagctttatcctcggctcctcaataaccacctacgttactatcgaccctagcaacggagccatatacgccctcagaatcttcgatcacgaagaggtgagtcaaattaccttcgtcgtggaggccagagacggcggttctcccaagcagctggtgagcaacaccactgtggttttaaccataattgacgagaatgataatgtgcccgtggtcatcggccctgcactcagaaataacacagctgagataactattcctaagggggctgaatcaggcttccatgtcactagaataagggccattgacagagacagtggcgtcaatgcagagctctcttgtgctattgtggccggaaacgaggaaaatattttcataatagatccacggtcctgcgatattcatactaacgtcagtatggactccgtcccttacacagaatgggaactgagtgtgattatccaggataaaggaaacccccaactgcatacaaaggtgctgttaaagtgcatgatctttgagtacgccgagagcgtgaccagcacggccatgacatcagtcagtcaggcgtccctggatgtgagtatgattatcatcatctcacttggcgctatctgcgctgttctcctagtcatcatggtccttttcgccaccaggtgcaatcgggagaagaaagacacgaggagttataattgtcgagtcgccgagagtacgtaccagcaccatcctaagaggccaagtcggcagatccataaaggtgacatcaccctggtgcccacaatcaacggcaccctgcctattagaagtcaccacaggtcttcgccaagctcttcacccaccctggaacggggtcagatgggctcacgccagagccataactcccaccaatctcttaactccttggtcacaatttctagtaaccatgttccggaaaatttcagtttggaattaacccacgccacccctgcggtcgaagtgtctcagttgctgagtatgctacatcaagggcaataccaaccgaggccttcctttcgaggcaataaatacagcagatcatataggtacgcactgcaggacatggacaaattctcacttaaagatagcggaaggggggactcagaagccggagatagcgattatgatcttggccgagacagccccattgatagactcctcggcgagggcttttccgacctgttcctcactgatggccgtatccctgccgcaatgaggttatgcacagaagagtgtcgagttctgggacactcagaccagtgttggatgccgcctttgccctcaccatcctctgattaccgaagcaacatgttcattcccggagaagagtttcccacccagccccaacagcagcacccccaccagagtctcgaggatgacgcccagccggcagattctggggaaaagaagaagagtttttctaccttcggaaaagactcacctaacgacgaagacactggtgacacctccacatccagcctactgtctgagatgtcatctgtcttccagcggctgctccctccaagcctcgatacatacagcgaatgctctgaagtggaccggtctaacagcttggaaaggaggaaaggaccactgccagctaagacagtcgggtaccctcagggagtggccgcatgggctgccagtacccactttcagaatccaacaacgaattgtggccctcctttgggcacccactcttccgtccagccgtctagtaaatggctgcctgccatggaggagattcctgagaactacgaagaagacgatttcgacaatgtgttgaatcacctgaacgacggcaagcatgagttgatggatgcgtcggaattggtggcggagattaataagctgttgcaggacgtgcgccagtcctag

SEQ ID NO: 237267 - DNA, 3306 bp, Artificial Sequence
  Description of Artificial Sequence: Synthetic coding sequence
atggaaagccttctgctgccagtccttcttttgcttgccattctttggacacaggctgctgccctcataaatctgaagtactccgtcgaagaagagcaaagagccggtacagtgatcgctaacgttgcaaaagatgccagagaagccggtttcgctttggatcccagacaagcctctgccttccgcgtcgtgagcaatagcgcaccacatctagttgacattaaccctagcagcggcttgctcgttacaaagcagaaaatcgatagggatctcctgtgtaggcagtcacccaaatgcataatcagccttgaggtgatgtcctcttcgatggaaatctgcgtcattaaagtcgagatcaaggacttgaacgacaatgcaccctcgttcccagccgcacaaatagaactggagatatccgaggctgcctctccaggaacacgtatcccgcttgatagcgcgtacgatcctgactcgggctcatttggagtgcaaacctatgagctgactcctaacgagcttttcggcctcgaaataaaaactcggggagacggatctaggtttgctgagctcgtcgtggagaagagtctagacagagagacccaaagtcactattcgtttagaattacagccctggacggcggagaccctcctaggttgggcactgttggcttatccatcaaagtgactgacagtaatgataacaatcccgttttcagcgagagcacctacgctgtgagtgtgcccgaaaactctccgccaaacactcccgtgattcgactgaacgcttctgatcccgacgagggcaccaacggacaggtggtttactctttctatggctatgttaatgacaggacaagggaattgtttcagatcgatccacatagcggtctggtgactgtgacaggggcattggactatgaggaggggcatgtttatgagctggacgtacaggcaaaggacctgggcccaaattctatacccgctcattgtaaggtgacggtgtctgtgttggatacaaatgacaaccctcctgtgatcaacctgttgagtgtcaacagtgagcttgtcgaggtctccgagagcgcgccacctggctacgtaatcgccctggttagagtgtcggatagagactcaggtctgaacggacgggtccagtgcagactcctcggcaacgtcccattccgcttacaggagtacgagtctttttcaacgattctggttgatgggcgactcgacagggagcagcacgaccaatataatctcacaatccaagcaagggatggcggtgtacctatgctccagtctgccaagagctttacagtgcttattactgacgagaacgacaatcaccctcacttctccaagccatattatcaggtgattgtgcaggagaataatacccccggagcctatctgctgagtgtctcagcgagggaccccgatcttggtctgaacggatcagtatcctaccagattgttccttcacaggtgagagacatgcccgtttttacctacgtttcaattaaccctaactccggagacatttatgcgctgagaagctttaatcatgaacagaccaaggccttcgaattcaaggtgctcgccaaggacggaggcctgcccagcctgcaatctaacgctactgtccgggtcataattttggacgttaatgacaacacacctgtaatcactgctccaccactgattaacggaaccgccgaagtgtacatccctcgcaattctggtatcggctacctggtcactgtcgtcaaggctgaagactacgatgagggcgagaatgggagagtgacctacgatatgacagagggagaccgtggcttttttgaaatcgatcaagtgaatggcgaggttcggaccaccaggaccttcggggaaagctccaagtcctcatacgagctaattgtagtggctcatgaccacggcaagactagcttgagtgctagtgctctggtgctcatctatctgtccccggctctggatgcacaggaatcgatgggatctgtaaatcttagcttgattttcatcattgcgctcggctcgatcgcgggaatccttttcgtcaccatgatcttcgtggcgatcaaatgcaagcgggacaataaggagattagaacatacaactgtcgaatcgccgaatactcatacggccaccagaagaaaagctccaagaagaagaaaatttctaagaatgacatccggctcgtgcccagggatgtcgaggagacagacaaaatgaatgtcgtgtcctgttccagcctcacgtcctcgctgaattacttcgactaccaccagcagactctccctttgggctgcaggcgtagcgagtcaacattcttgaacgtggagaatcagaatacgcggaacacaagtgcaaaccatatctatcatcattcctttaactctcagggaccacagcagccagatctcataataaacggtgtgcctctgccagagacagagaactacagcttcgattccaactatgttaatagccgcgctcaccttatcaaatccagctccaccttcaaggaccttgaaggcaacagtctaaaagactccgggcacgaggagtcagaccaaactgatagtgagcatgacgtccagcggtcactctactgtgacaccgctgtaaacgatgttctgaacacatccgttacctcaatggggagccagatgccggaccacgatcagaatgagggcttccactgccgcgaggagtgcagaattctgggccactccgatcggtgttggatgccacggaaccccatgcccatccgctccaagagcccagagcacgttcgcaacataatcgcattgagtatagaggcaactgctgccgatgttgaggcatacgacgactgcgggcctaccaagagaacgtttgccacgttcggaaaagatgtgtcagatcatccagccgaggagagacctacgctgaaaggaaaaagaacggtggatgttaccatttgtagcccaaaggtgaattcggtgatccgcgaggccggaaacggctgtgaagcgatatctcctgtaacatctccgttgcacctcaagtcttcactgcctacgaagccttctgtctcctatactatagccttggccccaccagccagggatctagagcagtatgtcaataatgttaacaatggcccaactcgtccgtccgaagcggagcctcggggagcggacagcgagaaagttatgcatgaagtttctcccatattgaaagaggggaggaataaggaatcacccggagtgaagcggctcaaggacatcgtgctctag

SEQ ID NO: 237268 - DNA, 3447 bp, Artificial Sequence
  Description of Artificial Sequence: Synthetic coding sequence
atggagtccctgctgttgcctgtgttgttgttgttggccatcctatggacacaggctgctgccttaattaacctgaaatactcagttgaggaggaacaaagggcaggcacagtgattgccaacgtggcaaaagacgccagggaagccggattcgcattggatcctcggcaggcaagcgcctttagggtagtgagtaactcagctccccacctggtggacattaatccaagttcgggactcctggttaccaaacagaagatcgatcgtgaccttctgtgccgccagtctcccaagtgcatcattagcctggaggtgatgagcagctcaatggagatttgcgtgatcaaagtggagatcaaagatctcaacgacaatgccccttccttccctgctgcccagatcgaacttgagatttctgaggctgcctcccctgggactcgaatcccactggattctgcttatgacccagactcgggatcattcggcgtccagacatacgaattaactccaaatgaattattcgggctcgaaattaagaccaggggggacgggtcgcggttcgctgagttagtcgttgagaaatcgttagaccgagaaacccagtctcactactcgttcagaattacagccctggacgggggtgatccacctagacttggcaccgtgggcttaagcatcaaagtgacagactccaacgacaataaccccgtgttttcagaatccacttacgccgtcagtgtgccagagaatagccccccaaacacgcccgtcatcagattgaatgcatctgaccccgacgagggaaccaacgggcaggtggtgtattcgttctacggatacgtgaatgaccgcactagggaattattccagatagacccccacagtgggctcgttactgtgactggtgcgcttgactacgaggagggccatgtctacgagcttgacgtccaggcaaaggatctgggcccaaactcgatccccgcacactgtaaggtgaccgtgagcgtcctggatacaaacgacaatccccctgtgattaaccttttgagcgttaattctgagttggttgaggtgtcagaaagtgcaccaccgggatacgtgattgcactggtgcgagtgagcgatagggattcgggcttgaatggccgagtgcagtgccgactattgggaaacgtcccctttcgtctgcaggaatacgaatcgttctccacaatactagttgatggcagactcgacagggaacagcacgaccagtataaccttactatccaggcacgcgacggaggcgtgccaatgctgcagtcggcgaagagttttactgttctcatcactgatgagaatgacaaccacccacacttctcaaaaccatactatcaggttattgtccaggagaacaatacgccgggagcttatctgctgagcgtatcagcgagggacccagacctgggcttgaatggatccgtgagttatcagatcgtgccctcccaagtgagggacatgcccgtcttcacatacgtatctattaatcccaattcgggggatatatacgcattgcgaagttttaatcacgaacaaactaaggcctttgagtttaaggtgctggccaaagatggcggactgccttctttgcaatctaacgcgaccgtaagagtcattattttagacgtaaatgacaatacccccgttattactgcacccccacttattaacgggaccgctgaagtgtacatccctcgaaacagcggtataggatatttggttactgtagtcaaagcagaggactacgacgagggggaaaacggcagggtgacttatgacatgaccgagggcgacaggggtttttttgagattgaccaggtgaacggtgaagtgagaaccacccgtaccttcggcgagtccagtaaaagcagctatgagctgatcgtggtagcccatgatcatggtaagacttcactttccgcaagcgccctcgtgttgatctacctgagtcctgctctggacgcacaggagtccatgggttccgtgaacctcagcttaatctttatcattgccttgggatctatcgctgggattctgtttgtgaccatgatttttgtagccatcaaatgcaagcgtgataataaggaaatccggacctacaactgttctaactgtctaacaattacatgcttattgggttgttttatcaaaggccagaattctaaatgtctccactgtatctctgtgtcccctatatccgaagaacaggataagaaaaccgaagaaaaagtgtctttgcggggaaagcgaattgctgagtatagctacggacaccagaagaagtcttctaagaagaagaagatatctaagaatgacattcggctggtgcctcgagatgtcgaggagactgataaaatgaacgtggtttcctgtagctctctgacctcctctctaaactattttgactaccaccagcagacattgcctctgggatgtcggaggtccgaatctacgttcttgaatgttgagaaccagaacacacgcaacacctccgccaatcatatctatcaccactctttcaacagccaggggcctcagcagcccgacctgataataaatggtgtgccactgcccgagacagaaaattatagttttgactccaattatgtgaatagtcgcgcacatctgatcaaatcatcctccacctttaaggatttagaaggcaatagcctgaaggattctggccacgaagagagtgatcagacggatagcgagcatgacgtacaacgttcgctttattgtgataccgcagttaatgacgttcttaacacatcggtaacctctatgggatcccagatgcctgatcacgatcagaacgagggcttccactgccgggaagagtgccgcatcttagggcacagcgacagatgttggatgcccagaaaccccatgccgattcgcagtaagagcccagaacacgtgaggaacatcatcgccctgtcaatagaagctaccgctgctgatgtcgaagcatatgatgactgtggccctacgaaaaggactttcgcgacatttggtaaagatgtgtctgatcaccccgctgaagagcgtccaaccctgaaagggaagagaaccgtggacgtgacgatttgtagcccaaaagtgaattcagtgatcagggaggcaggcaacggttgtgaggccatctcccccgtaacctctccgctgcacctgaagtccagcttgccaaccaagcctagcgtgtcatacacgatcgcccttgctccccctgctcgagatttagaacagtatgtgaataacgtgaacaacggcccaacacgcccttcggaagctgagcctcgcggtgcggacagtgagaaggtcatgcatgaagtgagtcccatcctgaaggagggtcgaaacaaagagagcccgggtgtgaaacggctgaaggacatagtcctgtag

SEQ ID NO: 237269 - DNA, 3303 bp, Artificial Sequence
  Description of Artificial Sequence: Synthetic coding sequence
atggaatcccttctgctccctgtgcttttactcctggcaattctctggacccaggctgccgctcttatcaatctgaaatatagtgttgaggaggagcagcgtgcaggcacagtgatcgcgaatgtcgccaaggacgcccgtgaggctggcttcgctttggacccaaggcaggccagtgccttccgcgtggtttccaattcagcaccccaccttgtggacattaatccttcctcggggctgttagtaactaagcagaagatcgatagggacctgttatgcaggcagtcaccaaaatgtattatctcccttgaagtcatgtcttcatccatggagatctgcgtcattaaggtggagattaaagatcttaatgataatgcaccgtcatttcctgctgcgcagattgagctggaaatatccgaagctgccagccccggaacacggatccctctcgatagcgcgtatgatcctgattccggttccttcggcgttcagacctacgagctcacccccaacgaattgtttggccttgagatcaaaactcgtggagatggtagtagattcgccgagctggttgtggaaaaaagtctggacagggaaacgcaaagccattattcattccgcattaccgccctggacgggggagatccacccaggttaggaaccgtaggactgtccatcaaggtgacggacagcaatgataacaatccagtctttagcgaaagtacctacgcagtctccgtccccgagaatagccctcccaatacacctgtgattaggctgaacgcctcggaccccgatgagggcactaacgggcaggtggtctattcgttctatggatacgtaaatgatcgaaccagagagctgtttcaaatcgacccccacagcggcctcgtgaccgttacaggcgcactggattacgaggaaggacacgtttacgaactcgatgtgcaggctaaggacttaggccctaatagcatccccgctcattgtaaggtgaccgtgtctgtgttagatacgaacgacaacccacccgtgatcaatctgctgtctgtcaattccgagctggttgaagtctcggaatcggccccaccgggttacgtcatcgcactggtgcgcgtcagcgatcgcgactccgggctaaacggcagggtacagtgtcgacttctgggaaatgtgccttttaggttgcaggaatatgagagcttcagtacaattctcgtggatggtcgactggatcgggaacaacacgaccagtacaacctaaccatccaggctcgtgacggcggagttccgatgttgcagtcagcaaagtcattcactgtgctgattacagatgagaacgacaaccatccccactttagcaaaccgtactatcaggtaattgtccaagagaataatacacccggagcctatttattgtcagtctccgcgcgagacccagatcttggtctgaacgggtcagtgagctaccagattgtgcctagccaagtcagagacatgcccgtcttcacctacgtttccattaatccgaactcaggagacatctacgctttacgctcttttaaccacgagcagacgaaagcctttgagttcaaggtcctggctaaagatggaggtctgcctagtctgcaaagcaacgccacagtgcgcgtcatcattctggacgttaacgataatacaccagtcataactgcccctccattgattaatggaaccgccgaagtgtatatccctcgcaattccggaatcggatatctagttacagtcgttaaggctgaagactacgatgagggggaaaatggtcgagtcacttacgacatgactgagggcgataggggattctttgagattgaccaggtcaatggggaggtgcggacaacccggacattcggggaatctagcaaaagcagctatgagctcatcgtagttgcgcacgaccacgggaagacaagcctaagcgctagcgcccttgtccttatttatctttctcccgctctggacgcccaggagtccatggggtccgtgaacctgtcccttatcttcatcatcgccctcggcagcatcgccggaatcttatttgtgaccatgatattcgtggctataaaatgcaagagagataacaaagagatcagaacatacaactgtcgaattgccgagtactcttacggacatcagaagaaatcaagcaaaaagaagaagattagtaagaacgatatccggctggttcccagagatgttgaagaaaccgataagatgaatgtggtcagctgcagctcactgacgagtagcctgaattacttcgattatcaccaacagactctgccactgggttgccggaggagcgagtccacattcttgaacgttgagaatcagaataccagaaacacttccgcaaatcatatttaccatcacagttttaacagtcagggcccacagcagccagatttaatcattaacggggtgcccctgccggaaacagagaactacagcttcgactctaactacgtgaactcccgcgctcatctgattaaatcaagcacctttaaagatcttgagggaaacagcctgaaggactccggacatgaggaaagcgaccaaactgatagcgaacacgatgtccaaagaagcctgtattgcgacacagccgttaacgacgtgctcaatacgagcgttacctccatgggtagccagatgcctgatcacgaccaaaatgaaggctttcactgtcgggaggagtgccgaatcctgggacatagtgatcggtgttggatgccgcgaaatcctatgcccatacggtctaaaagccctgagcacgtacgcaacataatcgctctcagcattgaggcaaccgcggcagacgtggaagcctatgatgactgtggtcccaccaagaggacctttgcaacgtttggaaaggatgtttcagaccaccccgctgaagaaagaccgaccttaaaggggaaaagaactgtggatgtgaccatctgcagtccaaaggtaaacagcgtcataagggaggcaggaaacggatgtgaagcaatctctcccgtgacctcgcctttgcacctcaaaagttcactccccaccaagccttccgtcagctatactatcgcgctcgcgccaccagccagggatctggaacagtatgttaataatgtgaataacggtccaaccagacccagtgaggctgagccacgcggagcagattccgagaaagttatgcatgaggtgtcaccaattctgaaagaggggaggaacaaggagtccccaggcgtgaagcgcctcaaggatatagtgctgtag

SEQ ID NO: 237270 - DNA, 2094 bp, Artificial Sequence
  Description of Artificial Sequence: Synthetic coding sequence
atgttcaccctcgacgtggaggagaacgaaaacggggaaaggactccttacctgatagtgatgggggctctcgatcgtgaaacacaagatcaatacgtgtctataatcatagccgaggatgggggtagccctcctctgcttggtagcgcaaccttgactatcggcatttccgacatcaatgataactgccccctgttcacagatagtcagattaatgttacagtctatggtaacgccaccgtgggaactcccattgccgcagtgcaggctgtcgacaaggatctgggcaccaacgcccagattacatactcatactcccagaaggttcctcaggcaagtaaggatctgttccacctggatgaaaataccggcgtgatcaaactgttcagcaaaattggcggatccgtgcttgagagccataaactgaccatcttggccaatggacctggctgcattcccgctgtcatcaccgccctcgtcagtatcatcaaggtgattttcagacctcccgagatcgttcctcgctacattgctaatgaaatagacggtgtcgtttacttgaaggagctggagcccgttaatacccctattgcattctttacaattcgagaccccgaaggcaaatacaaagtgaactgttacctcgatggagaaggaccgttccgactgtctccctacaagccgtacaataatgagtacctgctggagacgactaagccaatggactacgaattgcaacaattctacgaggtggctgtagtggcctggaactcagagggttttcacgttaagagggtgataaaagttcaactattggacgacaacgataatgctcccatctttctgcagcctctgatagagctcaccattgaagagaacaattctccaaacgcctttctgacaaaactgtacgctactgacgcagattcagaggaaagaggacaggtgagttatttcttgggccctgacgctcctagctacttctccctagattcagtgacaggtattcttacagtgagcactcagttggaccgtgaggagaaggaaaagtacagatacaccgtccgcgcagttgactgcggcaagcctccccgagaaagtgtggcaaccgtcgccttgaccgtacttgacaagaatgataactccccccgtttcattaataaagacttttcattctttgtgcccgaaaacttccctggctatggagagattggagtgatcagcgtgacagatgctgacgcaggacgaaatgggtgggtggccctttctgtcgtgaatcagtctgacatcttcgttattgacaccggaaagggcatgcttcgggcaaaggtgagtcttgacagagagcaacagagctcgtacaccctgtgggtagaggctgtggatggcggtgaaccagccctgtcttctacagctaagatcacgatcctgctgctcgatataaacgacaacccccctctcgtcttatttccacagagcaacatgtcctaccttctcgtattaccctcaacactgcctggatcacctgtgactgaggtgtatgccgtggataaggacaccggtatgaatgcagtaattgcctactctattatagggaggcggggacctcggccagaatccttcagaatagaccccaagactggaaatattacattagaagaagcattgcttcagaccgactacggccttcatagactgctagtaaaagtttccgatcacggctacccggaaccactccatagcaccgtgatggtgaatctcttcgtgaacgacacagtctccaacgagtcatacatcgagagtctcctgagaaaggagcccgaaattaacatcgaggagaaagagccgcaaatctctatcgagcccactcacaggaaggttgagagcgtatcgtgcatgcctaccctggtcgcactttccgtgatctctctgggcagtatcaccctcgtgactggtatgggcatttacatttgcctgcggaaaggtgaaaaacacccgcgagaggacgagaaccttgaagtgcaaattccattaaagggtaaaatcgatctgcacatgcgtgagagaaagccaatggatatcagcaacatctag

SEQ ID NO: 237271 - DNA, 2856 bp, Artificial Sequence
  Description of Artificial Sequence: Synthetic coding sequence
atgcgtggcaggggaaatgcgaggtctagccaggcattgggcgtctcatggtgccctgccacctggcacccacgcctcgacatgggaaggcttcaccggccaaggtcttccacttcgtacagaaacctgccacacttattcctgtttttcctgtttgtgggaccgttttcctgtttggggtcctactctcgagccactgagctactctacagcttgaatgaaggattaccagccggtgttctcatcggtagtctggctgaagatttgagactcctcccacgatctgccggtcgccctgaccctcagtcgcagctccctgagcgaaccggtgccgaatggaacccacccctttccttctccctggcaagcagaggtttgtctggtcagtacgtgacactcgacaatcgatcgggagagttgcatactagtgcacaggagattgatagggaggcactctgtgtggaaggaggaggcggaactgcctggtctgggtcggtttctattagcagttcgccgtctgacagctgtctactgcttctcgacgtgctcgtgctcccgcaggaatattttcggttcgttaaggtgaagattgccatcagagacattaacgacaatgcccctcagtttcccgtgtctcagattagcgtgtgggttcctgagaatgccccagtgaatacaaggctcgcaatagaacatcctgccgttgatcctgacgtgggcatcaacggagtgcagacctatcgcctacttgactaccatgggatgttcacactggatgtggaagagaatgaaaatggcgagcgaacgccatatctgattgttatgggtgcgctggatagagagactcaggatcagtatgtgtcaataatcatcgctgaggacggcggaagcccgcctctcttaggatccgccactctgactattggcatatcggatatcaacgataactgcccattgttcactgactcccagattaacgtcaccgtctacggaaatgcaacggtcggaaccccgatcgccgcagtccaagccgtcgataaagaccttgggacaaacgcacagattacctattcctacagccagaaggttccccaggcctcaaaagacttgttccaccttgacgagaacacaggagtcattaaactgttttctaagattgggggatccgttctggagtcccataagctcaccatattggccaatggcccaggttgtattcccgctgtgatcactgcgctggtctcaatcattaaagtgatttttcgcccacccgagatcgtgccgagatatatcgcgaacgaaatagacggtgtggtgtacctaaaggaactggaacccgttaacacgcccatcgcgtttttcacaatccgcgaccctgagggaaagtacaaggtgaattgctatctcgatggcgagggcccttttcgcctgtccccttacaagccttacaataatgagtatctgctggaaactaccaaaccaatggactacgagctacagcaattctatgaggtcgctgttgtggcatggaattccgagggcttccacgtgaagcgcgtgataaaagtccaactgctcgatgataacgataacgcccctatttttctgcaaccactgattgagctcacgattgaggaaaacaactcacccaatgcattcctgacgaaactgtacgctacagacgcagactcagaggagagagggcaggtatcatacttcctcggaccagacgctcctagctatttttctctcgatagcgtgacaggaatcctcacagtgagcactcagctcgatcgagaggagaaagagaaatacaggtataccgtgagggctgtggactgcggaaagccgccaagagaatctgtggctacagttgctctgaccgtgctggataagaacgacaattcacccagatttataaataaggatttcagtttcttcgtgcctgagaactttcctggctacggcgaaattggtgtgattagcgtgacggatgccgatgcaggacggaacggatgggtggcgttgagtgtggtgaatcagtccgatatctttgtgattgatacgggcaaaggcatgttgcgggctaaggtctctctcgaccgggaacagcagagcagctatacactgtgggtagaggctgtcgacggaggggaaccagctctgtcttccaccgctaagattacaatattgctgctcgatataaacgacaatcctccactagttctctttccccagagcaacatgagttacctgctggttctcccctctactctgcctgggtctccagtgaccgaagtgtacgccgtggacaaggacacaggaatgaacgccgtaatcgcatatagcattatcgggagacgtggcccaaggcctgaaagttttcgtattgatcccaaaaccggaaatattactctcgaagaagcattattgcagacagattacggcctgcacaggcttctcgtgaaggtgagcgatcacggatatcctgagcccttacattctactgtgatggtaaatctgtttgtcaacgatacagttagcaacgagtcatatatcgagtccctgctgcgcaaagaaccagagataaacatcgaagaaaaggagcctcaaatatctatcgagccgacgcataggaaagttgagtccgtctcatgtatgccaacactggtggcccttagcgtgatctcgttaggttcaatcacattggtcacgggtatgggtatctatatctgtctcagaaagggggagaagcatccaagggaggacgaaaaccttgaagtacagatcccgctcaagggcaaaatagatctgcacatgcgtgaacggaaacctatggatatttccaatatttag

SEQ ID NO: 237272 - DNA, 2856 bp, Artificial Sequence
  Description of Artificial Sequence: Synthetic coding sequence
atgagaggcagaggcaacgctaggtccagccaggccctcggagtcagctggtgcccagcgacctggcaccccagacttgatatgggaaggcttcaccggcctagatcctctacatcctatagaaatctaccacatttatttctgttctttttgttcgtgggtccattcagctgcttgggctcatattcgcgggcaactgaactgctatactctctaaatgaagggctccctgccggagtactcattggctccttggcagaggatcttagacttctcccacggtccgccggaaggccagatcctcagagccaactgcccgaacggacaggagccgagtggaatcctcccctcagtttctctctggcatctcggggactcagtggacagtacgtgactctggacaatcggtccggtgagctgcacactagtgcccaggaaatcgatagggaggccctgtgtgtcgaaggcggtggtggaacagcctggtctggctctgtgtccattagtagttcccccagcgatagttgcctcttactcctagacgtgctcgttcttccccaagaatacttcaggtttgttaaagtaaagattgctatcagagacatcaacgataacgccccacaattccctgtcagccagatctctgtctgggtgccagagaatgcacccgtgaacacgcgactcgccatcgaacatcctgcagtagacccagatgtaggtatcaacggtgtgcaaacttatcgactactggactatcacggaatgttcaccttagacgtcgaggaaaatgagaacggtgagcggacaccctatttgatcgtcatgggcgcactggacagggagacacaagaccagtacgtgtctattatcatcgcagaagatgggggaagccctcctctgctggggagcgctacgctgaccatcggcatcagtgatattaacgacaattgcccgcttttcaccgactcccagatcaacgtgaccgtgtacggtaacgctacagtaggaacccctattgccgctgtgcaggccgtcgataaggatttgggaacgaacgcgcaaattacttatagttactcgcagaaagtgccccaggcctccaaagacctcttccacctggacgaaaatacaggcgtcatcaagctcttctccaaaatcggcggatccgtcctggagtctcacaaactcaccatcctcgcaaacgggccaggttgtatccctgccgtcatcactgccctggttagtattattaaggtgattttcaggcccccagagatcgtgcccaggtacattgcaaacgaaattgatggggtcgtgtaccttaaagagctagagcccgtaaacacccccatcgccttcttcaccataagggatcccgagggaaaatacaaggtgaattgctacttggatggggagggtccctttcgtctttcgccctataagccatataataacgaatacctgctggaaacaactaaaccaatggactacgaactgcagcaattttacgaggtagctgtggtggcttggaactcagagggttttcacgtcaaaagagtgattaaagttcagctgctggatgataatgataacgcaccaatatttctccagccattaatagagctgaccatagaagagaacaatagtcccaatgcatttctgactaagctctacgctacagacgcagactctgaagagcgtggccaagtgtcgtatttcctggggcctgacgcacctagctatttctctctagattctgtgaccggtattctcaccgtaagcactcagctggatagggaagagaaagagaaataccgttataccgtgagagcagtagattgcgggaaacctccccgtgagtctgtcgccaccgtagccttgacggtgttggacaagaatgacaactcgcctaggtttatcaataaggattttagcttctttgtcccagagaacttccctggttacggcgaaattggggtaatttccgtgacagacgcagatgccggtcgaaacggttgggtagccctgtccgtggtgaatcagagtgacatcttcgtgatcgatacgggaaagggcatgttaagggccaaggtgtctctagacagagaacagcagagttcttacaccttgtgggttgaagcagtggatggcggtgagccagccctgagctcgacagccaaaattaccatcctgcttttggacattaatgacaatccgccattagtactgtttccccaatctaacatgtcatatttactggtattaccatctacactcccaggcagccccgtgacagaagtctacgcagtagacaaggacacaggaatgaacgctgtcattgcatatagcattatcggtagaagggggcctcgacctgagagtttcagaatagatcccaaaaccggaaacatcactctggaagaggcactcctgcagaccgattacggactacatcggttattggtgaaagtgtctgatcacggctacccagaacctctgcatagtactgtgatggttaatctgttcgtgaacgataccgtgtctaacgagagttacattgagtcattgctgcgtaaggagcccgagatcaacattgaggagaaagagcctcagattagcatcgagccaacacaccggaaagtagaatccgtatcctgcatgccaaccctggttgctctgtccgtcatctcactggggtctattaccctggtgaccggaatggggatttatatctgtttgagaaaaggtgagaaacatcctagagaagatgaaaacttggaggtgcagatcccactgaagggcaaaattgacctgcatatgagagagcggaaacccatggacatttccaacatatag

SEQ ID NO: 237273 - DNA, 3603 bp, Artificial Sequence
  Description of Artificial Sequence: Synthetic coding sequence
atgcttcggatgagaacagcagggtgggctagggggtggtgcctcgggtgttgccttcttttaccactgagtttatctctcgctgccgctaaacaattgctccgctatcgcctcgctgaggaaggtccggctgatgtgcgcatcggtaatgtggccagcgatctcgggatagtgaccgggtccggtgaggtcacattcagtttggagagtgggagcgagtacctcaaaatcgacaacttgaccggagaactttcaacatcagagcggagaattgaccgggaaaaactgcctcagtgccagatgatcttcgacgaaaatgaatgcttcctggattttgaagtttcagtcatcggccctagtcagtcatgggtggacctgtttgagggccaggtgatcgtcctggatattaatgataacacacccaccttcccctcgccggttctaaccctgacagtggaggagaatagacctgtggggacattatatctgctgccgaccgcaactgatcgggacttcggtcgtaatggcattgagcgttacgaactcttgcaagagccaggcggaggtgggtctggtggagaaagcagacgggctggtgccgctgactcggcgccataccctggcggaggtggaaacggggcaagcggaggaggctctggaggaagcaaaagacgacttgacgcatcagaggggggtggaggcacaaatccagggggtagaagttcagtctttgaactgcaggtggcagatactcccgatggcgagaaacaaccgcagctgattgtcaagggcgtctacgaagctgatctggctgaaaatagcgccccaggcacacccatcctgcagcttcgtgccgctgatctagatgtgggcgtcaacggacagatagaatacgtttttggagcggcaactgaatccgtgaggcgactgcttcgcctcgatgagacctctgggtggctgtctgtgctacacagaatagaccgagaagaggtgaatcaattgaggtttaccgttatggcgagggacaggggacaacccccaaaaacggataaggctacggtggtgctgaatatcaaagatgagaacgacaatgtgccatctatcgagattaggaaaatcggaagaatccccttaaaagatggcgtggccaacgtagcagaggacgtgctcgtggacacacccatcgcccttgtccaagtaagcgatcgggaccagggtgagaatggggtcgttacctgcacagtagttggagacgtgccttttcaattaaagccggctagcgacacggaaggcgatcagaacaagaagaagtacttcttgcatacaagcacaccgttggactacgaagctacaagagagtttaatgtcgtgatagtggctgtcgattcgggaagcccttcattatcctccaacaacagtttgattgtgaaggttggcgacactaacgataacccacccatgttcggacaatctgtcgttgaagtttactttccggagaacaacatccccggtgagcgggttgctactgtgctggctactgacgccgactcgggaaagaacgcggaaattgcgtactccctggactcgagcgtgatgggcatctttgccatcgacccagattccggcgacatcctggttaacactgtgctggatcgggagcagaccgaccgatacgaatttaaggttaacgcaaaggataaggggataccagtactccagggaagcactactgttattgtgcaggtcgccgacaaaaacgacaatgacccaaaatttatgcaggatgtctttacattctatgtcaaggagaacctgcagcctaacagccctgtcggcatggtcaccgtgatggatgccgataaaggcaggaatgcggagatgagtctgtacatcgaggaaaataataatatcttcagcattgaaaatgacaccgggacgatttactcaacaatgtcatttgatcgggagcatcaaacaacctatacatttcgcgtcaaagccgttgacggaggagacccgcctcggtcagccacggccaccgtatctctctttgtgatggacgaaaacgataacgccccaacggtcactctgccgaagaacatcagctataccctgctgccaccctcatctaatgtcagaaccgtggtggcgaccgtactggccactgatagtgacgacggcatcaacgcggacctaaactatagtatcgtaggaggcaacccattcaagctgttcgagatcgaccccacatcaggggtagtgagcctcgtgggaaaactgacccagaagcattatggtctgcatagactggtggtgcaggtgaatgactctggccagccaagtcagtccacaacaaccctggtgcatgtgttcgtgaatgaatctgtgtcaaacgccacagcaatcgactcacaaatagctcggtcattgcacataccactaactcaggatattgctggggaccccagttatgagatttcaaaacaacgcctctcgatagtgatcggcgtagtagcgggtatcatgacagtgatcctcattatattgatcgtggtgatggcaagatactgcagatccaagaacaaaaacgggtatgaggctggtaagaaggaccacgaggacttcttcactccccagcagcacgacaagtccaaaaagccaaaaaaggacaaaaagaataaaaagtccaaacagccactatactcatccattgtaacagtggaggctagcaaacctaatggccagcggtacgatagtgttaatgaaaaactgagcgacagcccaagcatgggtaggtaccgctccgtaaacggcggtcctggttcaccagacctagctagacattacaagtcctccagcccactaccaaccgtacagctccacccgcaaagcccaactgctggaaagaaacatcaggccgtccaggacctgccacccgcaaatacgttcgttggcgctggggataacatttcaataggatctgaccattgcagtgaatattcttgtcagacaaataataagtacagtaaacagccatttcgtagggtgaccttctcggttgtttcacagcctcaggacccacatcaagggtccttgcagtcctgctacgattctgggctcgaggagtctgaaaccccctcttctaaatcctccagtggcccacgactgggggctttgccactcccagaggacaattacgaacgaaccacccccgatggaagcgtcgactcacgcccactcccagacgtcgcccttaccgggaagtgtacacgggagtgtgatgaatatggacatagcgactcctgctggatgcctgtgcgaacgtcacctgagcgaaagaagtcacagcctaaactgagtacattcatgccagtcgacgaacgaggctctcaggaaaagctggctaatggcgaggccgcaattatgggagatagaaacaggaatctccttaacaaaaagctgacaagttcctacgaaacttttagcgcagcatcgttcagcaaaaatgaggaggcgaacccggaggatatcccactgacaaagaccggggagtacaaaccatctcccgtcaataccttaacaaggagggaggtgtacctgtag

SEQ ID NO: 237274 - DNA, 3210 bp, Artificial Sequence
  Description of Artificial Sequence: Synthetic coding sequence
atgcttagaatgaggaccgccggttgggccaggggctggtgcttggggtgttgtcttctgctccctctgagtctgagcctcgcagctgcaaagcaactgctgagataccgccttgctgaagaagggcctgcggatgtgaggataggtaacgtggcctctgatctgggaatcgtgacagggtcaggggaagttacattctccctggagagtgggtcagaatacctgaagatcgacaatctgactggtgagttgtccacatctgagcgtagaattgaccgtgagaagctcccgcagtgccagatgatctttgatgagaatgagtgcttcctagatttcgaggtctcagtcatcggtccaagccagtcctgggtggacctgttcgaaggacaagttattgtgctggatatcaatgacaacacacccacctttccttcacccgtgctgacactgaccgtggaagagaatcgcccagttggcacattgtacctcttaccgacagccaccgaccgggactttggacggaacggtatcgaaaggtacgagcttctgcaggagccaggaggcggaggcagtggaggtgagtcaagacgtgctggggcagcagattctgccccatatcccggaggcggtggaaatggggcatcaggaggagggtctggaggcagcaaacggcgtctggatgccagcgagggaggtggcggtacaaaccccggaggacggagcagcgtctttgaattacaggtggcggacactcctgacggggagaaacaaccgcagctcatcgtcaagggcgctcttgatcgggaacagagggacagttacgaactgacattgcgcgttagggacggcggagatcccccaagatcctcacaggctatcttacgcgtcctaatcactgatgtgaatgataattctcccagattcgaaaagtctgtttacgaggccgacctggcggagaattcggcaccgggaacacccattctgcagctgcgggcagctgacctggatgtgggggtgaacggccagattgaatacgtgtttggtgctgctacagaatctgtccgacgtctcctaagactcgacgagactagcggatggctctcagtgctgcatagaattgaccgggaagaggttaaccaactcagattcacggtgatggccagggaccggggtcagccgcctaaaactgacaaagcgactgtagtgttaaatatcaaggacgaaaatgataatgttcccagtattgagattcgcaagattggtaggattccactcaaagatggcgtcgcaaacgtggcagaagacgttctggtagacaccccaattgcattagttcaggtcagcgatcgcgatcagggggaaaacggcgtagtgacttgcacagttgtcggagacgttccatttcagttgaagcctgcttccgataccgagggcgatcagaacaagaaaaagtattttctgcacacttctactccactcgactatgaggcaactcgtgagtttaacgtcgtcattgtggccgtagactcaggctcccctagcctttcatctaataattctctgatagtgaaagtcggcgataccaatgataacccacctatgttcggtcagtccgttgtcgaggtttatttcccagaaaataacatcccaggtgaacgggtggctaccgtgttggcaaccgatgccgactctggtaagaacgccgagatcgcctacagtctggatagctccgtgatggggatcttcgctattgatccggactcaggggacattctcgtaaacactgtattggacagagaacagaccgaccgctacgagtttaaggtgaatgctaaagacaaggggattcccgtgctgcagggcagtactacagtaatagttcaggtcgcggacaagaacgacaacgatcctaagttcatgcaagacgtgtttaccttttatgtcaaggagaacctgcaacctaatagcccagtgggcatggtgacagtaatggatgcagacaagggacgcaatgctgaaatgagcctttatatagaggagaacaacaatatattcagcattgagaatgacacaggtacgatctactccactatgtctttcgatagggagcaccaaactacatacactttccgggtcaaggcagttgatggaggtgacccgcctcgttccgcgacggccactgtgagcttatttgtgatggatgaaaatgacaatgccccaactgtgactcttccaaagaatatctcctatacattgctgcctcctagctctaatgttcgcacggtggtagctaccgtgttggcgaccgatagtgatgacgggattaatgcagacctcaattactctatagtcgggggaaatccatttaaactcttcgaaatagaccctactagtggcgttgttagccttgtgggcaagctcacacagaagcattatgggcttcaccggttggtcgtgcaggtgaacgactcaggccagcctagccagagtactaccaccttagtccatgtcttcgtgaacgaatcagtgagcaatgcaaccgctatcgactcccagatcgcccgttctctgcatatccccctcacgcaggatatcgccggagatccctcctatgagattagcaagcaacgcttgtccatcgtcatcggcgtagtggctgggataatgacggtgattttaatcatactcattgttgtgatggctcggtactgcaggtcaaagaacaaaaatgggtatgaagcagggaagaaggaccacgaggacttcttcaccccccaacaacacgacaaaagtaaaaaaccaaaaaaagataagaagaataaaaagagcaagcagcccctctactcatcaattgtaactgtggaagcttctaaacccaatgggcagcggtacgactccgttaatgaaaagttgtcagactccccctcaatgggaaggtatagatctgtgaacggcggtcccggaagccccgatctggccagacattacaagagcagctccccattgcccactgtgcagctccatccgcaatccccgactgccggtaagaagcaccaagccgtgcaagacttgccgccagctaacacttttgtgggtgcaggcgacaatattagtattggtagtgaccactgctctgagtactcatgccagaccaataacaagtattccaagcaaatgcgtctccacccttacatcacagtgtttggctag

SEQ ID NO: 237275 - DNA, 3768 bp, Artificial Sequence
  Description of Artificial Sequence: Synthetic coding sequence
atgcttaggatgcggacagctggttgggcacgtggctggtgcctaggctgttgccttctgcttcctttatcactttccctggctgccgctaagcagctattgaggtatcgtctcgccgaagagggacccgctgacgttcggatcggcaatgtcgcatcggatctgggaattgtcaccggcagcggagaggttacctttagtctagagtccgggtcggaatacttaaagatcgataatcttacaggggaactatctactagcgaaagacggattgacagagagaaactgccccagtgccagatgatcttcgacgaaaatgagtgcttccttgacttcgaggtaagcgttatagggcctagccaatcctgggtagacttgttcgagggtcaggtgatagtgttggacatcaatgataacacccctacgttcccaagccctgtgcttaccctgactgtggaggagaatcggcctgtggggacactataccttttgccaacagcgaccgaccgtgattttggcaggaatggtatagaaagatatgagctcctgcaggaacccggaggtggcggaagcgggggagagtcgcgcagggctggcgcagccgatagcgccccatatcccggaggaggcggaaacggcgcttccgggggagggagcgggggatcgaagcgcagactggacgcatcagaaggaggcggaggtacgaacccagggggaagatcttctgtgtttgagctgcaggtggctgacacccctgacggcgaaaaacaacctcagcttatagttaagggagctttggatcgagagcaacgtgactcctacgaactcacgttgagagtgcgcgacggcggagaccccccaaggtcctcgcaggcgatcttgcgagtcttaattacggacgtcaacgacaactccccacggttcgagaaaagcgtctacgaggcagacctggctgagaatagtgccccagggacacctatcctgcaactgcgggctgcagatctggatgtcggcgtcaacggtcagattgagtacgtctttggagccgctaccgagagtgttagacggcttcttagactcgatgaaacatcaggctggctctctgtgttgcatcggatcgaccgagaggaggtcaatcagctgcgattcacggttatggcacgggatcgaggccagccgccaaagaccgacaaggccaccgtagttctcaatatcaaggatgagaacgataacgtgccaagcattgaaatccgaaagattggacggattcctttaaaggacggggttgcgaacgttgctgaggatgtgttggtggacacccctatcgcgttagtccaagttagtgaccgagaccagggagagaatggcgttgttacctgcaccgtggtgggagatgtgccttttcagctgaagccagctagcgacactgagggagaccagaataagaaaaaatactttctgcacacgagcaccccgctggactacgaagccacacgtgagtttaacgtcgttatagtagcagtcgacagtggctccccgtccctgtcgtctaacaattccctgatcgtgaaagtcggcgacacaaatgacaacccgcctatgttcggacagagcgtggtcgaggtgtactttcctgagaataatatccctggtgaacgagttgcaaccgtgctggccacagacgccgactcaggaaaaaatgctgaaatcgcttactctctggactcgtctgtcatgggaatttttgctattgatcccgacagtggagatattttggtcaatacagtgctggatagggaacagaccgatcgctacgaatttaaagtcaacgccaaggataaaggaatacctgtccttcaggggtccactacagtaatcgttcaggttgcagacaaaaatgacaacgatccaaaatttatgcaggacgtgtttaccttttatgtaaaagagaacctgcaaccaaatagcccagtggggatggtgaccgtgatggacgcagacaaaggcagaaacgctgagatgagcctttatatcgaggagaataacaatattttttccatcgagaatgataccgggaccatctattcaactatgagcttcgacagggaacaccagacgacttacacctttagagttaaagcagtggatggcggagatcccccacgctccgccaccgccaccgtctcactctttgttatggacgagaacgacaacgccccaaccgtaacgttgcccaaaaacatttcctacactttgctgcctccctcatcaaatgtccgcactgtggtcgcgacggtccttgctacagacagcgacgatggcattaatgctgacctcaattacagtatcgtggggggtaatcctttcaaactgtttgaaatcgatcctactagcggtgtggttagtctggttggcaagctaacccaaaaacactatggtctccatcgtctagtcgtgcaggtcaatgattctgggcagccaagccagagtacgactactctcgtgcatgtttttgtgaatgagtctgtaagcaatgcaactgctatcgatagccagattgccaggtctctacatattccgttgacacaggatattgcaggtgacccttcatacgagataagcaaacagcggctgagcatagttatcggcgtggtagctggaattatgaccgtgatcctgatcatcctaatagtggtcatggcgagatattgcaggagtaagaacaaaaacggttacgaagctggtaagaaggaccacgaggatttctttactccacaacagcacgacaagtccaagaagcccaaaaaggacaaaaaaaataagaaatccaagcagcctttgtacagctccatcgtgaccgtggaggcatccaagccaaatggccagagatacgattcagtgaatgagaagttaagcgactcaccctccatgggccgatataggagcgtaaacggcggtcccggttcccctgacctcgcacgccattataagagctcatctcctctaccgacagtgcaattgcacccacaaagccctaccgccggaaaaaaacatcaggctgtgcaggacctaccccctgcaaatacctttgtgggcgctggcgacaacatctccatcgggagcgatcattgcagcgaatactcatgtcagacgaacaataagtattctaagcagccgtttcgacgggtgactttctcggtggtcagccagccccaggacccccaccagggctccctccagtcctgttacgattccggcctggaggagtctgaaacgccttcctccaaatcgtccagcggcccacggctgggtgccctgcctcttcctgaggataattacgaacgcactaccccggatggatctgttggagaagccgagcatatggagaatgatagccgcccactgcccgatgtagcactaactggaaaatgtacccgggagtgcgacgaatacggtcactcagactcgtgctggatgccagtgcggacatcccccgagcgcaagaagtctcagcccaaactttccacttttatgccggttgatgagagaggtagccaggagaagctggcaaacggcgaggccgctattatgggagataggaatagaaatctcttgaacaaaaaactcaccagtagttatgagacgttcagtgctgcctcctttagcaagaacgaggaggcaaacccggaggacattcctctgaccaagaccggggagtataagccgtcaccagtcaatacgcttacccgccgtgaagtttatctgtag

SEQ ID NO: 237276 - DNA, 2922 bp, Artificial Sequence
  Description of Artificial Sequence: Synthetic coding sequence
atgtctccggtccggcgatggggatccccgtgcctgtttccattgcagttgttctccctctgctgggttctctcagtcgctcagagcaagactgtgcggtactctacttttgaggaggatgcacctggaactgttatcggaacactggccgaggatctgcacatgaaagtctcgggggatacctccttcagactcatgaaacagttcaattcatctctgcttcgggttagagagggagatggccagttaactgtgggggatgccggactcgaccgtgagcggctgtgcggtcaagcaccacagtgtgttcttgcttttgacgtagtgtccttttcgcaggagcagtttaggctggtacatgtcgaggtggaagttcgcgatgtgaatgatcacgcaccacgcttccccagggcccaaatcccggtggaggtctctgagggagccgctgtaggtactagaatccccctggaagtacccgtggacgaggatgtcggggctaacggattgcagaccgtccggctagcagaacctcattcccctttcagagtggaactgcagacccgggcagatggggcacagtgtgctgacctggttctgcttcaagagctggacagagaaagtcaggccgcttacagcctggagctggtagcccaagatgggggacgcccacctagatctgctacagcagcccttagtgtccgggtgctggatgccaacgatcatagtcctgcctttcctcagggggcagtagcagaggtggaattagccgaggatgccccagtggggagcttactgctcgacctcgacgccgctgatcccgacgagggacccaatggcgatgttgtatttgcattcggagccagaacaccccctgaagccagacgtctctttcgcctggatcctaggtcaggacgcctgactctggcgggtccagtggactacgagaggcaggatacatacgagctggacgttagggcgcaggaccggggacccggtcctcgcgcagccacctgtaaagtcattgtgagaattcgggacgttaacgacaatgctcctgatatcgcgatcactccgctggctgccccaggggctccagcgacctcacccttcgccgctgcagccgcagctgcggcattaggaggagctgacgctagctctccagcaggagcgggaacacctgaagccggagcaacctctctggtcccggaaggagcagccagggaatccctcgttgccctggtgagtacatctgatcgtgattctggggcaaacggccaggtcaggtgtgctctgtatggacacgagcattttcgactgcagcctgcctacgccggaagttatctggtggtgaccgccgctagcctggatcgggagcgcatcgcagaatacaacctaactctggtagccgaggacaggggggcaccccctctgcggaccgtgcggccatacactgtacgggtgggagacgagaatgataatgcgccactgttcacgcgaccggtatacgaagtaagtgtgcgcgagaacaacccgccaggagcttatcttgccacagtagcggctagagatcgagaccttggaagaaacgggcaggtaacctatagactcctggaggccgaggtcgggagagcaggtggggctgtgagtacgtacgtgtccgtcgacccggctacaggtgctatttacgctctaagatccttcgactacgagacacttaggcaactggacgtacggatacaggccagtgacggcggaagtccccagctctcaagcagcgcactagtccaggtccgggttctcgaccagaacgaccacgcccctgtccttgtccaccccgcacccgctaacggttccctggaggtcgcagtgcccggtagaacggccaaagatactgtggtggcgagggttcaggcccgagacgccgacgaaggagccaacggggagctcgccttcgaactccagcagcaagaaccacgggaggcttttgctataggccgtaggaccggagagatcttgttgacgggcgatctgtctcaagagccgcctggcagagtttttagggcactgctggtgattagcgatggtggcagaccccctctgaccacaactgctacggtgtctttcgttgtcactgcgggaggcggtcgtggaccagctgctccggcatcagctggatctcctgaacggtcacgtccccctggctccagattaggagtttcgggctctgtactgcaatgggatactcctctgattgttattatcgttctggccggttcctgtactctgcttctggcagccatcatagcgatcgcaacaacttgcaaccggcgtaagaaagagccctacggggctagcccaggcttcggtaaggagccggctccccctgtggctgtctggaagggtcattctttcaacacaatctctgggagggaggccgagaagtttagtggaaaggatagcggcaagggggactccgactttaacgatagtgacagcgacattagcggtgatgcactaaagaaagatctgattaatcacatgcagtctgggttgtgggcctgtacagctgagtgtaaaatcctgggccacagtgaccggtgttggagcccctcatgctctggccctaacgcacacccaagcccccacccacccgctcagatgtccaccttttgcaaatccaccagcctgcctcgggatccgctgcgacgggacaattattaccaggctcagctgccaaagactgtgggcctacagagcgtttatgagaaggttcttcaccgggactacgacagaaccgtaactcttctgtctccaccgagacccggacgccttcctgaccttcaggagatcggagtcccactgtaccagagccccccaggcaggtacctgtctccaaagaaaggagcaaatgagaacgtgtag

SEQ ID NO: 237277 - DNA, 3213 bp, Artificial Sequence
  Description of Artificial Sequence: Synthetic coding sequence
atgagtccggtgaggcggtggggctcaccctgcctgtttccattacagttatttagtctttgctgggtgcttagcgtcgcacagtccaaaaccgtgcgctacagcacttttgaggaagacgcacccggaacagtgatcggcacgctggcggaagatctgcatatgaaggttagtggagacacctcattcaggctcatgaaacagtttaatagttccctcctccgggtgcgcgagggagatgggcagttgactgtaggagatgctggtcttgatagagaacggctgtgcgggcaggcaccacaatgtgtgcttgcctttgatgttgtgtcattttctcaagaacagtttcgattggtccatgtcgaagtggaagtcagggatgtaaacgatcatgcccctaggtttccgcgtgcacagataccagtggaggtaagtgagggagctgccgttggcacgagaattccactcgaagtccccgtcgatgaggatgtcggcgctaatggtctgcagacagtccggttggcagaaccgcactctccattccgcgtggaactccagacacgggcagacggggcacagtgcgccgatctagtgcttctccaggagctcgatagggagtcccaggcagcctattcactcgaactggtggcccaggacggcggaaggcccccacgctcagctactgccgctctctctgtacgtgtgttggatgcgaacgaccactcacctgctttccctcagggcgctgtggccgaggtagagctagcagaagacgcacctgtgggatccctgctgctggatctagatgccgctgaccctgacgaaggccctaacggcgatgtggtatttgcatttggcgctcggacccctcccgaggccagacgcctgtttcggctggacccgagatcaggcagacttacactggccggacctgtcgactatgaacgccaggacacctacgagctcgacgtgcgggctcaggatcggggtcccggacctcgcgctgcaacttgcaaagtcatcgtgcggatccgtgatgtgaatgataacgccccagacatagctatcactcctttggccgctccaggagcaccggcaaccagccccttcgccgcagctgcagccgcagccgcactgggcggagcggatgcatcctcacccgcaggagccggaacaccagaggccggtgctacgagtttagtgcctgaaggtgctgcccgagagtctctggtggcgctggtttccacatcggaccgcgattctggggctaacggccaggtgcggtgcgccctctacggacacgagcacttccggttgcaacctgcctacgctggcagctatctggtggtcaccgcagctagcctagacagggagaggatcgccgagtacaatctcaccctagtagcggaggaccggggtgccccaccactgagaaccgtgaggccgtatacggtcagggttggcgatgaaaacgataacgctcctttgtttactcgtccggtctatgaggtgtcagtacgcgaaaacaatcccccaggagcttatctggctacagttgcagctcgtgaccgggacctgggaagaaatgggcaggtgacataccgtttgctagaggctgaggtcggcagagctggtggcgctgtctccacctacgtgagtgtggaccccgctaccggtgccatctatgctctgcgctcattcgactatgagactttacgccagttggacgtcagaatccaagccagcgacgggggaagcccacaactcagctcatccgccctggttcaggtcagagtccttgaccagaatgatcacgcacccgtcctcgtgcacccagcacccgctaacggatctttggaggtggccgtgccaggtaggactgctaaagatacagtggtggcaagagtacaagcacgggatgcagacgaaggtgcaaacggtgaactggccttcgagctccagcagcaagagccaagggaggcttttgccattggaagacgtactggcgaaatactgcttacaggggacctgtcccaggaaccacctgggcgagtgttccgtgccctgctggtgatctcagacgggggacggccaccacttacaaccacggcaaccgtatctttcgtcgttactgctgggggaggacgcggacccgctgcacccgctagcgctgggtctcctgaacgctctcgccctcccggttctcgcctgggggtgtccggaagtgtgttgcagtgggacacccccttgatcgtgatcattgtcctcgctggctcttgcacgctgctgctggcagccattatcgctatcgctactacttgcaatagacgcaaaaaagaggtaaggaagggtggagctctgcgggaagagaggcctggggctgcgggtggtggagcatccgccccagggtctccggaagaggccgctcggggagcaggacctaggccgaatatgtttgacgttctgacattccccggtactgggaaggctccttttggatcccctgccgcagacgcgcctccgcctgctgttgccgctgccgaagtgccaggcagcgaagggggttctgccaccggggagtctgcctgtcacttcgaaggtcagcagaggttacgaggcgctcatgccgaaccatatggagcaagccccggattcgggaaggaacctgcaccaccagtagctgtgtggaaagggcatagtttcaacaccatcagcggtcgggaggccgagaaattctctgggaaggattcgggtaagggcgactcagattttaacgattctgatagcgacatttctggagacgctctgaagaaggacctgataaatcacatgcagagtgggctgtgggcttgtacagcagagtgcaagatcttagggcactctgacagatgctggagcccctcatgtagcggcccaaacgcacatcctagtccacaccccccagcgcagatgagtactttttgcaagtccacctctcttcctcgcgaccccctgaggcgagataattattatcaggcacaactgcctaaaactgtgggactacaatctgtatatgagaaggtgctgcatagagactatgaccggaccgtgactctgctgagccctcccagacctggcaggctcccggacctccaggagatcggcgtcccgctgtatcagagtcctccagggcgttacctcagccctaagaagggtgccaatgagaacgtgtag

SEQ ID NO: 237278 - DNA, 1791 bp, Artificial Sequence
  Description of Artificial Sequence: Synthetic coding sequence
atgtctccggtgaggaggtggggttcaccctgcctgttcccactccagctcttttcgctctgctgggtgctgagcgtggctcagtccaaaaccgtgagatacagtacgtttgaagaggatgcaccaggcacagtgatcggcactctggctgaggacttacacatgaaggtatctggcgatactagcttccggctgatgaaacagtttaacagctctctgctgagagtgcgcgagggagatggccaacttactgtcggcgacgctggccttgatagggagcgcctgtgtggccaagcaccccaatgtgtgcttgcctttgatgtcgtcagcttctctcaggagcagttccggcttgtgcatgtcgaggttgaagtcagggatgtcaacgatcacgctccagtgctggtccatcccgctccagcaaatgggtcacttgaggtggccgtgccagggcgaactgcaaaggataccgtcgtggcgcgagtgcaggctagagatgccgacgaaggagctaacggcgaactagcgttcgaacttcagcagcaggaaccacgggaggcatttgctattggacggcgaaccggcgaaattcttctcacaggcgatttgtcccaggagccaccagggcgagtgttcagggctctgctggtcatctccgatggcggacgcccaccactcacaaccacagccaccgtgtcctttgtggtcactgccggtggaggaagaggacccgcagccccagccagcgccggttcacccgaacgctccagaccgccaggttcaaggcttggagtcagcggctccgtgctacagtgggacaccccgcttattgttatcattgtattggctggatcttgcactctgttactggccgctatcattgctattgccaccacctgcaaccgcaggaagaaggaagttaggaaagggggtgccctgcgtgaggaacgaccgggagcagcgggtggcggagccagtgccccaggctcacccgaagaagctgcacggggtgccggacctagaccaaatatgttcgatgtgctgacattccctgggaccggtaaagccccatttgggtctccagcagccgacgctccacctcctgcggtcgccgctgccgaggtgccgggttccgaagggggatcagccactggcgaaagcgcgtgtcactttgagggtcagcaacggctgagaggcgcacacgccgagccctatggcgcttcacccggattcggtaaagagccagcaccccctgtggcagtgtggaaaggacatagcttcaacactataagtgggagagaggctgagaaattttctggaaaggattctggtaaaggagattctgattttaatgattcagactccgatataagtggtgatgctctgaagaaagatctgataaatcacatgcagagcggactttgggcatgtactgctgagtgtaaaattctgggtcattcagacaggtgttggagcccctcatgttccggacctaacgctcacccttccccacacccaccggctcaaatgagcaccttttgtaagtccacaagtctgcctagagaccctctccgacgtgataattattaccaagcccagctcccaaagacggttggcctgcagagcgtgtacgagaaagtgctgcaccgcgactatgataggaccgtaaccttgctgagcccccctcgaccaggccgactgccagacctccaggagatcggcgtgcctctctatcagtcaccgcctggaagatatctttccccaaagaaaggagctaacgagaatgtgtag

SEQ ID NO: 237279 - DNA, 2742 bp, Artificial Sequence
  Description of Artificial Sequence: Synthetic coding sequence
atgagcccagtacggaggtggggttcaccttgcctgtttcccttgcagctgttctcattatgttgggtactctcagttgctcaatctaagaccgtacggtattctacattcgaggaagacgctccaggcacagtcataggtaccctggccgaggatctgcatatgaaggtaagcggcgacacatcctttagactgatgaagcaattcaatagctctctgctgagggtgcgagaaggggacggacagttgaccgtgggggacgcaggccttgatagagagcgcttgtgcggacaggccccacagtgtgtgcttgccttcgatgtggtgtccttttctcaggaacaatttaggctggtgcatgttgaggtggaagtgcgtgacgtaaatgaccatgcccctaggtttccaagggcacaaatcccagtggaggtatctgagggagctgctgtggggaccaggattcccttggaggttccagtcgatgaagacgtgggggctaatggcctccagaccgttaggttagccgaaccgcactccccttttcgagtggagctgcaaactagggccgatggggctcaatgcgctgacctggtgttgctgcaggagttggaccgtgagtcacaggccgcatactcactcgagctcgtggctcaagacggagggagacctcccagatccgctactgcagccctgtcagtcagggtgttggacgctaacgaccactcccctgcattcccacagggtgcggtggccgaagtggaactggccgaggacgcacccgtaggcagcctcctgctggacctggacgctgctgacccagacgaaggtcccaatggcgacgttgtctttgcctttggcgctcggactcctcccgaagcccgacgacttttccggttagaccctcggtcaggtaggctcactctagccggtccagtggattatgagaggcaggatacctacgagctggacgttcgggctcaagatcggggaccgggaccacgcgctgctacctgtaaggtgattgtgaggattagggatgtaaatgacaacgccccagatattgccattactcccctcgccgctcctggcgctggtaaccttaccctgagacggaatggacaggttacttaccggctcctcgaggcagaagtagggcgtgctggtggggctgtgtctacatatgtgtcagtagatccggctaccggcgcaatttacgccctgaggtcctttgactatgaaacgctgagacaattggacgtacgcatccaagctagcgacgggggaagcccacagctttcctcatctgctctggtccaggttcgggtgttggatcagaatgaccacgcgcctgttcttgtgcatccagccccagctaatgggagtttggaggtagccgtgcctggaagaaccgccaaagacaccgtggttgcccgtgtccaagcgagagacgctgacgaaggcgcaaatggcgagcttgctttcgaactgcagcagcaagaacccagagaagcattcgctatcggccgacgtaccggcgagatcctgctcactggcgacctcagtcaggagcctcccggtagggtatttagagcgctgctagtgatttcggatggcggtcggcctccactcaccacgaccgcaacagtgtcttttgtagtaaccgcagggggagggagaggccctgcggcacctgcaagcgctggatcccctgaaagatcaaggccacccggatcacggttaggtgtctctggctccgtgctgcagtgggatacgcctttgatcgtgataattgtgctggcaggtagctgcacactcctgcttgccgctatcatagccatagctacaacctgcaacaggagaaagaaagaggtaaggaagggaggagctctgcgcgaagagcggcctggtgccgctggagggggagcaagcgcccctggaagtccagaggaagccgctcgtggggcaggtcccaggccaaatatgtttgatgtgcttacctttccaggcacagggaaagccccatttggatcccctgcagcagatgcccctcccccagctgtggccgctgcagaagtccccggatccgaaggcggtagtgccacaggagagtcagcatgtcatttcgaaggacagcagaggctaaggggagctcatgccgagccatatggtgcctcacctggcttcggtaaggagccggctccgccagtggccgtgtggaaagggcactcctttaacaccatctctggcagggaagctgagaaatttagcggaaaagactcaggtaaaggcgattccgactttaatgacagtgattccgatatctctggagacgccttaaagaaagatttgatcaaccatatgcaatcgggtctctgggcttgcactgccgaatgtaagatcctcggacattccgacaggtgttggtccccatcttgctctgggcctaatgcgcacccaagcccacacccccctgcgcagatgtcgaccttctgcaaaagcaccagcctgcctcgggaccccttaaggagggacaactactatcaggcccagcttcctaagaccgtaggtctgcaatcagtttacgaaaaagtcttgcatcgtgattatgacagaaccgtgacactcctgtcccctcctagacccggacggctgcctgacctccaagagattggagtccctctctaccagagtcccccaggaagatatctctctccaaagaagggcgctaacgaaaacgtgtag

SEQ ID NO: 237280 - DNA, 3612 bp, Artificial Sequence
  Description of Artificial Sequence: Synthetic coding sequence
atggacctcagggacttttacctgctggctgctctgatcgcctgtttgaggcttgacagcgcaatcgcccaagaacttatctacaccattagggaggaattgccagagaatgtgcccatcggcaatatccccaaggatcttaatattagccacatcaacgccgctacggggacaagtgcctccctggtgtaccgtctggtgtccaaagcaggggatgcacctctagtgaaagtgtcgagctcaaccggcgagatcttcaccactagcaataggattgacagagaaaaactttgtgcaggcgcaagctatgccgaagaaaatgagtgtttctttgaactggaagtcgtcattttgcccaacgattttttccgcctcataaagatcaagattatcgtgaaagacactaatgacaacgcccctatgtttccttccccagtgatcaatatttccattcctgagaacacattgatcaattctcgcttccctattccttctgccacagaccccgataccgggttcaacggagtacagcactacgagctattaaatggacaatctgtcttcggcttggatatagtcgaaaccccagagggagagaagtggcctcaactgatcgtgcaacaaaatttggatcgcgaacagaaagacacatacgtcatgaaaatcaaagtggaagacggcggtacaccccagaagagtagtacagctatcctgcaggttaccgtctccgatgtcaatgataaccggcctgtctttaaggaaggccaggttgaagtgcacatccctgagaacgctcccgtcggtactagcgtcatacaattacatgccacagatgccgacattgggtcgaatgctgaaatccgctacatctttggagcccaggtggcccctgcaacaaagcggctgttcgctttgaacaacaccacaggtctaatcaccgtgcagaggagcttggacagggaagagacagcaattcacaaagtgacagttctggcctccgatggatccagcactccggctagagctacagtgacaattaacgttactgacgttaatgacaacccacctaacatagatctccgttacattatctcccctataaacggcactgtgtacctcagcgaaaaagaccccgttaacaccaaaatagcgctgattacagtctcggataaggatactgatgtgaacggaaaagtgatttgtttcattgagcgggaggtcccctttcacctcaaagcagtgtacgacaatcagtatcttcttgaaacaagtagtctgttggactatgaggggactaaagagttctccttcaaaatcgtagcctcagactccggaaagccctcattgaatcagaccgccctcgtgcgcgtgaagctcgaagacgaaaacgacaatcccccaatctttaaccagcccgtgatcgaactgagtgtctccgagaacaacaggcgaggcctctatctcaccacaatttctgctaccgatgaagatagtggtaagaacgccgacattgtgtatcagctcgggccaaacgcctcctttttcgacctggatcggaaaaccggcgtcctcactgccagccgcgtgttcgaccgggaggagcaagagaggtttatcttcacagtcaccgcaagggataacggcacaccaccgctgcagtctcaagcagccgtgatcgttacggtcctcgacgaaaacgataattcgcccaagttcacccacaaccatttccagttctttgtgtcagaaaatctgccaaaatattccaccgtgggcgtgattactgtgacggacgccgatgctggtgagaacaaggctgtaacactgtccatcctgaacgacaacgataactttgttctggacccctactcgggagtcatcaagtctaacgtttcatttgatcgcgagcagcagagctcatatactttcgacgtcaaggcaaccgacgggggacagcccccaagaagttccaccgccaaggtgacaatcaacgtgatggacgtcaatgataactctccagtcgtcatctcccccccaagcaacacgagctttaagttggttcctctgagcgctatacccggatctgtcgtggccgaagtgttcgctgtcgacgtcgacactggaatgaacgcggagctgaagtatactatcgtgagcggaaacaacaaaggactcttcaggatagaccccgtgaccggcaatattactcttgaagaaaaacccgcaccaaccgacgtgggcctgcacaggctagtggtgaacatctccgacctgggatatccaaagagccttcacacactagtcctggtgtttctctatgtgaatgatacagctggcaatgcctcctacatctatgatttgatccgccgtacgatggaaacacccctagataggaacatcggtgattcatctcagccctatcagaacgaagattacttgacaataatgatagcgatcattgccggagcaatggtggtcatcgtggtgatctttgtgacggtgttagtgcggtgcagacacgctagccgattcaaggccgcacaaaggagcaagcaaggggctgagtggatgagcccaaatcaggagaataagcagaataagaaaaagaagcgcaaaaaaagaaagtcccccaagtcatccttgctaaattttgttaccattgaggagtctaaaccagacgacgctgtccatgagccgattaacgggaccattagcctgcccgctgaattggaggaacaatctatcggcagatttgactggggacctgcgcctccaaccaccttcaagcccaattcacccgacctggcgaagcattacaagagcgcatctccccaacctgcatttcacctgaagcctgatacaccagtgagcgtgaagaaacaccatgtcattcaggagctgccgctcgacaacacttttgtgggcggttgtgatacactgagcaagcgttcctccactagctcagatcatttctccgcctctgagtgttcctcacagggcggttttaagacaaaaggtccactacacactcgccaatcacagcgaagggtgacctttcatctacccgacgggagccaggaatcctgtagcgatagcggcctgggggaccacgaacccgtcggatcaggaaccctcatctcccacccactgccccttgtgcaaccccaggacgagttttatgaccaggcgagccccgacaaacggactgaggccgatggtaacagcgaccccaacagtgacggacctctcgggccaagaggcttagcggaagcaactgaaatgtgcacacaggagtgcctagtgctgggacattcagataactgttggatgccgccagggttggggccttatcagcaccctaagagccccctatcaactttcgccccacagaaagagtgggtgaaaaaggacaagctggtcaatggacacaccctgactagagcgtggaaggaagattccaatcgcaaccagtttaacgatagaaaacagtatggttccaatgagggacactttaacaacggctcccacatgacagacattccgctggctaatcttaaatcatataaacaggccggaggagcaaccgaatctccaaaagagcaccagctatag

SEQ ID NO: 237281 - DNA, 3099 bp, Artificial Sequence
  Description of Artificial Sequence: Synthetic coding sequence
atggatctgagagatttttatctgctggcagccctgatcgcctgtctacgcctggatagtgctatcgcccaggaactcatctacacaatccgtgaagaactacccgagaacgtacccataggaaacattccaaaggatctgaacatatcccatatcaatgctgccaccggcacttctgcaagcttagtgtatcgattggtgtcaaaggctggcgacgcgccattggttaaggtctcgagttccaccggagagatttttacaacgtccaacaggattgatcgggaaaaactgtgtgctggggcttcatacgctgaggaaaacgaatgtttctttgaattggaagtggttatcctcccaaatgattttttccgcttgatcaagattaagatcatcgtgaaagatactaatgataatgctcctatgttccccagtccagtgatcaacatctccattccagagaatacgctgataaacagccgcttccccatcccttctgccactgatcccgatactggattcaacggcgtccaacattatgagctcttaaacggccagtccgtttttggcctcgacatcgtagagactccagagggagagaagtggcctcaattgatcgtccagcaaaatttagacagagagcagaaggatacttacgtgatgaagatcaaggtggaggacggtggcacccctcagaagagcagtactgccattctgcaggtgaccgtcagcgacgttaatgacaataggccagtgttcaaggagggccaggtggaagtccatatcccagagaatgcacctgttgggacctccgtgatccagctccatgctaccgatgccgacatcggcagcaatgccgaaatccgctatatctttggggcacaagtggcgccagctactaagcggctctttgctttaaataacaccacggggctcatcacagtccaaaggtccctcgacagggaagagacagccatccataaggttacagtccttgcgtctgacggttcctccactccagcccgagctacggtgacaattaatgtgacagacgtgaatgataaccccccaaacatcgatttgagatatattatctctcccatcaacggcacagtttacctgtcagaaaaggatccggtaaacacaaaaattgccctgatcaccgtgtctgacaaagataccgatgttaatggcaaggtcatatgcttcatagagcgcgaggtgccattccacctgaaagccgtgtatgacaatcagtatttgctagaaacatcaagcctgctggactatgaaggaacgaaggagttctctttcaagatcgtcgctagtgatagtggtaaaccttctttgaatcagaccgccctcgtaagggtgaagcttgaagacgaaaatgataatcccccaatctttaaccagccggtgatcgagctatccgtttccgagaacaacagacgcggactctaccttacaaccatctccgctactgatgaggatagtggaaaaaatgccgatatcgtctatcagctgggccctaacgcaagcttctttgaccttgaccgcaagaccggagtgctgactgcatcccgcgtgtttgatagagaggaacaggagcggttcatcttcacagtcacagcgagagacaatggtacccccccactccagagtcaggcagcggtaatcgtgaccgtgcttgacgagaacgacaattctccaaagtttacccacaatcattttcaattttttgttagtgagaacctccccaagtattccacagtgggagtcataactgtgacggatgctgacgccggagagaataaagctgtgacgctctctatcctgaatgacaatgataatttcgtgttagatccctattccggcgtgattaagtctaacgtctcttttgaccgggagcagcagtcttcctatacattcgacgttaaagctacagatgggggtcaaccgccacggtcttcgactgctaaggtgacaatcaatgtgatggatgtcaacgacaacagcccagtcgtgatcagcccacctagtaatacatctttcaagctggtgccgttgtctgctatccctggctcagtcgtggccgaggtcttcgccgttgatgtggacactgggatgaatgctgaactcaagtatacaatcgtatccgggaacaataaggggctattcaggatcgatcccgtgactgggaacatcacactggaggagaagcccgctccgacggacgtcggcctgcacagactggtcgtgaatatcagtgatctgggataccccaagagcttacatactttggtattggtctttctctacgtgaacgataccgccggaaacgccagctatatttacgatttgattcggagaactatggaaaccccgctcgatcgcaacattggtgatagctcgcagccataccagaacgaggattaccttaccataatgatagccatcatcgcaggagctatggtggtgattgtggtgatatttgtgaccgtactcgttagatgtaggcatgcatcccggtttaaggcagctcaacgcagcaagcagggggctgaatggatgtcccccaatcaagagaacaaacagaataagaaaaaaaaaaggaaaaaacgaaagagtcccaaaagctccctgttaaattttgtaacaatcgaagagtctaaaccggatgacgctgtgcatgaaccaataaacggcactattagcctgcccgcagagttggaagagcagtccatcgggagatttgattggggccctgctcctcccacaaccttcaagccaaactctccggacctcgctaaacactataagtccgcttctccccagcccgctttccacctaaagcccgacacccctgtctccgttaaaaagcaccacgttattcaggaactgcccttggataacacttttgtgggcggatgcgataccctgagtaaacgatcttccacgtcctcggaccactttagcgcttccgaatgcagtagccagggcggtttcaaaacaaaaggacctctgcatacaaggcaggtaaacgagcacttttattggagcatttccactgcctataagtgccccgtgaaccagtattag

SEQ ID NO: 237282 - DNA, 3714 bp, Artificial Sequence
  Description of Artificial Sequence: Synthetic coding sequence
atggacctaagagacttctatctgctagcagccctgatagcttgcttgagactggactccgccatcgcacaggagctcatttatacgatcagagaagagctgcctgagaatgtgcctattgggaacattcctaaagatctgaatatcagtcacatcaacgccgcaacaggtacctcagcgagtctcgtgtaccgcctcgtgtccaaagccggtgacgctccccttgtcaaggtgtcctccagcaccggggagattttcactaccagcaaccgaattgatcgagagaaactttgcgccggtgccagctacgcagaggagaacgaatgcttcttcgagctggaggtggtgatcttacctaatgactttttcagactcatcaagatcaaaatcatagtcaaagacacgaatgacaatgcccctatgttcccgtctcctgtgattaacatttcaatccctgaaaatactttgatcaattctcgcttccctatcccctctgcaaccgaccccgatactgggtttaacggcgtgcagcactatgagttgttaaacgggcagagtgtgttcggccttgacatcgtagagacccccgagggggagaagtggccccagctgatagtccaacaaaaccttgaccgcgaacagaaggacacttacgtgatgaaaatcaaagttgaggatggtgggacacctcagaagagttcgacagcgatactgcaggtgacagtttcagatgtgaatgataacaggccagtgttcaaggaggggcaggtagaagtacatatcccagagaacgcacccgtgggcacatcggttattcagttgcacgcgaccgacgccgacattgggagcaacgcagagatacgctatatattcggggcacaggtggctccagccaccaagaggctgtttgctttaaacaatacaaccggtctcattactgtgcagcgctctttggatcgcgaagaaaccgccatccataaagtgacagtgctagcttcagacggaagtagtactcctgcccgagcaaccgttaccatcaacgtcaccgacgtgaacgataaccctcccaacatcgaccttaggtacatcattagtccaatcaacggcaccgtttatctttccgagaaagaccccgtgaacaccaagatagctcttataaccgtgagtgacaaggatacagatgtgaacggaaaagttatctgctttatagaaagggaggtacccttccacctgaaggcagtgtatgacaaccagtatttgctcgaaacttcgtccttgctcgactatgaagggactaaagagtttagctttaaaattgtggctagcgattctggcaagccatcccttaaccagaccgccctggttcgggtaaaactggaggacgagaatgacaacccacccattttcaaccagccagtcatcgaactctccgtgtccgagaacaataggcgcggtttgtacctgactacaatttctgctaccgacgaagacagtggcaagaacgcagacatagtgtatcaactgggcccaaatgcttccttttttgatttagacaggaaaaccggggtacttactgcctctcgcgtctttgatcgagaagagcaggagcggttcatcttcaccgtcacggccagggacaatggcaccccgccattgcagagccaggctgctgtcatcgtcaccgttctggacgaaaacgataactcccccaagtttacccacaatcacttccaattttttgtgtcagagaacctccccaaatactctacagtcggggtgataaccgtcacggatgctgatgctggagaaaataaggctgtcacacttagtattctcaatgacaatgataacttcgtcctggacccatactccggtgtgatcaaaagcaatgtaagcttcgaccgggaacagcagagttcttacacctttgatgtaaaagcgacggacggcggtcagccacccagatccagcaccgctaaggtcacaatcaacgtgatggacgtgaatgacaattctccggtggtgatttcaccaccttctaacacctccttcaagctggtaccactaagcgcaatcccaggctcagtggtggccgaagtatttgctgtggacgtggatacgggtatgaacgcagagctcaagtacaccatagtgtctggcaataataaaggactgtttagaatcgaccctgtgacagggaatatcaccctggaggagaagcccgctcctaccgacgttggacttcaccgactggtggtgaatatttcagacttgggctaccctaaatcactgcataccctggtactggtgttcctgtacgttaacgatacagccggaaacgcctcatacatttacgacctgattagaagaactatggaaacacctttggaccgaaatatcggggactcctcacaaccttaccagaacgaagattatctgactatcatgatagcaatcatcgccggtgccatggtggtgatcgtcgtgatattcgtaacagtcctggtcagatgtcggcatgcaagccgtttcaaggcggctcagagaagtaagcagggagccgagtggatgagccccaatcaggaaaataagcagaacaaaaagaaaaagagaaaaaagcgcaaatctccgaaaagttctctgctgaatttcgtgactatcgaggagtccaagccagatgacgctgtgcatgagcccatcaatggcactattagcctgccagcagagttagaggagcagtctatagggcgtttcgattggggtcctgcaccaccaacaaccttcaaacctaacagccccgacttagccaaacactataagtcagccagcccccagccagcttttcacctcaagccggatacacccgtctctgtcaaaaaacatcacgtcattcaagaactgccactcgacaataccttcgtgggcggatgtgacactcttagcaagcgctcctctacttcaagcgatcacttctctgcgagcgaatgttcctcccaaggcggtttcaagacaaaaggccctctgcacacccggcaatgtaactcccattctaaatcggacaatattcccgttactcctcaaaagtgtccatcatctaccgggtttcacatccaagaaaatgaggagagtcactatgaatcgcagagaagagtaacttttcacctgccagacggctcccaggagagttgttcagatagcggtctgggcgatcacgagcctgttggctctggcacactgatatcccatcctctcccactggtccagccacaggatgagttttacgatcaggcttctcctgataaacgcaccgaggcagacggaaattccgaccccaactcagacggtccgctagggcctcgcggactggccgaggccaccgagatgtgtacacaagaatgtctcgtgctgggccactccgacaattgttggatgcctcctggactgggcccttaccagcaccctaaaagtccactctccaccttcgctcctcaaaaggagtgggtaaagaaggataaactagtcaatggccacactctcactcgagcctggaaggaagatagcaatagaaaccagtttaatgaccggaaacagtatggatctaacgaaggccatttcaacaacggaagccacatgactgatattcccttagccaacctcaaatcttacaagcaagcaggtggcgctactgagtcaccaaaagagcaccagctttag

SEQ ID NO: 237283 - DNA, 3612 bp, Artificial Sequence
  Description of Artificial Sequence: Synthetic coding sequence
atggatctccgtgatttctatcttctggctgctctaatagcatgtctgaggctggactcagcaatcgcgcaggagctgatctataccattagggaagagctgccagaaaatgtgccaatagggaatattcccaaagatctaaacatctcccatatcaatgccgcaactggcacaagtgcctccctggtataccggctggtgtcaaaggctggggatgccccactggtgaaggtgagctcctccaccggggaaattttcaccaccagcaatcgtatcgatcgggagaaactctgcgctggcgcaagctatgccgaggaaaatgagtgtttttttgagctagaggtcgtgatcctgccaaatgactttttcaggttgattaagattaagatcatcgtaaaagatacaaacgataatgcccctatgttccccagtccagtcattaacatatcaattcccgagaacaccttaatcaattcccgcttccctattccctcagccacagatcctgacaccgggttcaacggtgtccagcactacgagctgcttaatggacaatctgtgtttggactcgatattgtggagacccccgagggagagaagtggccccagttaatcgtccaacaaaacctcgaccgtgagcagaaagatacctacgttatgaaaattaaagttgaggacgggggtacaccgcaaaagtccagtacagccatcctgcaggtgactgttagcgacgtgaacgataaccgccctgtgttcaaggaagggcaggttgaagtgcacattccagaaaatgccccagtgggcacaagcgtcatccaactccacgcaaccgatgccgacatcggctctaacgcagagatccgttacatcttcggcgcacaggtggcgcctgccactaagcgcctctttgccctcaataatacgaccgggctcattaccgtgcagaggagccttgacagggaggaaactgctattcacaaggttacagtcctggcaagcgacgggagttctacccccgctcgcgctaccgtaacaatcaatgttactgatgttaacgacaacccccctaatatcgatctgagatacattatcagtccaattaatggcactgtttacctgagcgaaaaggatcccgtcaataccaagatcgcgctgatcacggtgtccgataaagataccgacgtcaatggaaaggttatttgctttatcgaacgcgaagtccccttccacttgaaagcagtgtacgacaatcagtatctgctcgagactagcagcttgctggactatgaagggaccaaagagttttccttcaagatcgtcgcgagcgattctgggaaaccctcgctgaaccagacggcactggtacgtgtgaagttggaagatgagaacgataatccaccgatctttaatcagcccgtgatcgagctttctgtgtctgaaaacaaccgccgtggcctatatctaactacaatttcggccacggatgaagatagcgggaaaaacgctgacatagtctatcaacttggacccaatgcatcattctttgatctggaccgaaagaccggtgttctcacagcctcacgggtcttcgatagagaggagcaagagcgtttcatttttacagtaactgctcgcgacaacggaacgccacccctacagagtcaggcagcggtgattgtaacagtgctggacgaaaacgacaattctccaaaattcactcacaaccactttcaattcttcgtcagcgagaatctgcccaaatattcaacagtcggggttattaccgttacagacgccgatgcaggtgaaaacaaagctgtgactttatctatactgaacgacaatgataattttgtgttggacccttactcaggagtgatcaaatccaacgtttcctttgatagggagcagcagagttcctatacatttgatgtcaaagcaacggacgggggacagccacccaggtccagcacagcaaaagtcaccatcaacgtgatggatgtgaatgacaatagcccagttgtcatatcacctccaagcaacacctcctttaaactggttcccctgagtgcaatccctgggtctgtggttgcagaagtgttcgcagtggatgttgacacgggcatgaatgccgagctgaaatataccatagtgagtggaaacaataagggactctttcggattgacccggtgactggcaatataaccctggaggagaaacctgctcccaccgacgttggcctgcatcgcctggtggtgaacatctctgacctggggtatccaaaatccctccatacgcttgtgctcgtttttctgtacgttaacgataccgcaggcaacgctagctacatatatgacttaatccgccgaacaatggagactccactcgatagaaatattggcgactcctctcagccataccaaaacgaggactatctaaccatcatgattgctatcattgcgggtgccatggttgtgattgtggtcatattcgtcaccgtcctagtgagatgccggcacgcgtcaaggtttaaagctgctcagcggtccaagcagggcgcagagtggatgtcccccaaccaggagaataagcagaataaaaagaagaagcggaaaaagcggaagtcacccaaaagcagcctgttaaattttgtgacgatcgaagaatcaaagccggatgacgcagtgcatgagcccatcaacgggactatctccctgccggcagaactcgaagaacagtcaatcggccgtttcgattgggggcctgctcctcccacgaccttcaagccaaactctcctgacctcgccaagcactacaaatcagcctccccacaaccagcttttcatctaaaaccagacactcctgtctctgtgaagaagcatcatgtgatccaagaattgccactcgataacacttttgtcggaggctgtgatactctctcgaaacggagttcaacaagtagcgaccacttctcagccagtgagtgttcaagccaggggggatttaaaaccaagggtccgctccacactcggcagagccagcgcagagtcactttccatctccctgatggcagccaggaaagctgctcggacagcggtttaggagaccacgaacctgttggaagtgggacgctgatttctcaccccctgcccttggtccaaccccaagatgagttctacgaccaagcttctcccgataagcgtactgaggcagatggaaactcagacccaaattctgatgggccattgggacctcgtgggctggccgaggccacagaaatgtgtacacaggagtgcctggtgttgggacactccgataattgttggatgccgccaggcctcgggccttatcagcaccccaagagcccattgtcaacatttgcaccacagaaagagtgggtcaagaaagataaactcgtgaacggacacacactaactcgggcttggaaagaggactccaacagaaaccagtttaacgacaggaagcaatatggctcgaatgaaggtcatttcaacaatgggagtcatatgaccgatattccactggcaaacctgaaaagctacaaacaggcaggcggagccaccgaatctccaaaggagcaccagctttag

SEQ ID NO: 237284 - DNA, 3714 bp, Artificial Sequence
  Description of Artificial Sequence: Synthetic coding sequence
atggaccttcgggatttctacctgttagccgcactaatagcctgtctgcgactggacagtgctattgcacaggagctcatctataccattcgggaggaactgccggagaacgttccaataggcaacattcctaaggatttaaacatctctcacatcaatgcagctacgggtaccagcgcttctcttgtgtaccgcctggtgtccaaggctggcgacgcacctctggtaaaggtgagctcttccaccggagagatctttaccacgtcgaaccgcattgatagagagaagctgtgtgctggcgcttcctatgctgaagagaacgaatgtttctttgagctcgaggtcgttattttgccgaacgatttcttcaggttaatcaaaattaagattattgtgaaagacactaatgacaatgcaccaatgtttcccagcccagtgatcaatatcagcattcctgagaataccctcatcaattctagattcccaatccccagcgcaactgacccagacactggcttcaatggggtgcagcactatgagcttcttaacgggcagagcgtgttcggcttggatattgtggaaacgccggagggagaaaaatggccccagctcatcgtgcaacaaaacttggaccgggaacaaaaggacacttatgtaatgaaaattaaggtggaggacgggggaactcctcagaaaagctcgaccgccatattgcaggtgacagtgtcagatgttaatgataatcggccagtgttcaaagaagggcaggtggaggtccacatccctgaaaatgcgccagtgggtacaagcgtcatccagctccacgccacagacgcagacatcggatcaaacgcagaaatcaggtacatattcggagctcaggtcgccccagcaacaaagaggctgtttgccttaaacaacacgaccggtttgattaccgtccaacgcagtctcgaccgcgaagaaactgccatacataaggtgacggtgctggccagcgacgggtcatccactccagccagggccactgttactatcaacgttaccgacgtcaacgataaccctcccaatatcgacctgaggtatattatcagcccaatcaacggaaccgtgtatctttccgagaaagatcctgtgaacaccaaaatcgctcttatcaccgtgtcggacaaggatacagatgtcaacggtaaggtgatttgcttcattgagagggaggtaccatttcaccttaaggcggtgtatgataaccagtatctgttggaaacgtctagcctgctggattatgagggcacaaaggaattcagcttcaaaatcgtggcatctgactcaggcaaaccttccctgaaccagaccgcgctagtacgggtgaagctggaggatgagaacgataaccctcccatttttaaccagccggtaattgaactgagcgtgtctgaaaacaatcgcaggggcctgtatctcacgacgatctccgctaccgacgaagacagcgggaagaatgcagatatcgtataccagctcggcccaaatgcatccttcttcgacctggatcggaagaccggggtgctcaccgcttcacgggtctttgaccgtgaggaacaggaaaggtttatcttcactgtgaccgcccgagacaacggtacccccccactgcagagccaagcagccgtgattgttactgtcctggacgagaacgacaactcacccaagtttacccacaaccacttccagttctttgtgtctgaaaacctgcctaagtactcaaccgtgggggttattacagttaccgatgcagacgccggagagaacaaggcagtaacgctcagcatcctgaacgataacgacaattttgtgctggacccgtatagcggggtcataaaaagcaacgtgtcatttgaccgagagcagcagagttcgtatacgttcgacgtcaaggcgactgatggcggacaacctccgaggtcttccacagccaaagtgacaattaatgtcatggatgttaacgacaacagccctgtggtgatcagtcccccaagtaatacctcatttaagttggtgcccttgtcagccattcctgggagcgtcgtcgcagaagtttttgcagtggatgtggacacggggatgaacgccgagctgaaatacacaatagtttcaggaaataataaaggcctgttcaggattgacccagtgacaggaaatattacgctcgaagagaaaccagcaccaacagacgtgggtttacacaggctcgtggttaacattagcgacctcggataccccaagtctcttcacacgctggttttggtttttctatacgtgaacgacacagctggcaatgccagttacatttacgacctgatcagaaggactatggaaacacctcttgaccggaacattggagactcttcccagccttatcagaatgaggactatctgactattatgattgccattatcgccggtgcgatggtggtgatcgtcgtgattttcgtgaccgtattggttaggtgcaggcacgcttcccggttcaaggctgcgcagaggtccaaacagggtgctgagtggatgagtcccaatcaggagaacaagcagaacaagaaaaagaaaagaaagaaacggaaaagccctaagagctcacttctgaacttcgttactatcgaagagagcaaacccgatgatgcggttcacgaacctatcaacggaaccatttctctgccagccgaactcgaggagcagtctatcggacgtttcgactggggacctgcacccccaaccacatttaaacctaacagccccgacctcgctaagcattataaatcagcctcacctcagccggctttccatctgaaaccggacacccccgtttcagtcaaaaaacaccacgtgattcaggaactccctctagataacacctttgtcgggggttgtgatactttatcgaaacggtcatccacctcatccgaccactttagtgcttcagaatgctcttcacagggagggtttaaaacaaagggcccactacatacacgccaatgtaactcacatagcaaaagcgacaacatccctgtgaccccacagaaatgcccatccagcacgggatttcatatccaagagaacgaggaatcccattacgagtcccagcgaagggtgacctttcacctgccagatggctcccaggagagttgcagtgactcaggcctcggtgaccatgagccagtgggaagcggtactttgatctcacacccacttccgttagtacagccacaggacgaattctacgaccaggcgagcccagacaaacgcacagaggcggacggtaactctgacccaaactctgatggacctctgggacctcgaggactagcagaagctactgagatgtgcacccaggaatgcttagtgctggggcactctgataactgttggatgccccctgggctgggcccttatcagcaccccaaaagtcctctatctacatttgcgccacaaaaggagtgggtcaagaaggacaagctcgtaaacgggcatacactcaccagggcttggaaggaagattccaatagaaaccagttcaacgaccgtaagcaatacgggtcaaacgagggacacttcaacaacgggtcacacatgacggacatccccctggctaacctgaagtcttacaagcaggccggaggcgcaacggagagccctaaagaacatcagttatag

SEQ ID NO: 237285 - DNA, 2424 bp, Artificial Sequence
  Description of Artificial Sequence: Synthetic coding sequence
atggtgttttcccgaaggggaggactgggagcacgggacctgctactttggctgctcctcctcgcagcttgggaggtcgggtctgggcaactccactactcgatccccgaagaggccaaacatgggacattcgtgggtagggtcgcacaggacctgggcctcgagctggccgaattagtcccacggttgttccgtgtcgcctctaagacccaccgcgacctcctagaagtgaaccttcagaatggcatcctgtttgtgaattcccgaatcgacagggaggagctgtgccagtggtccgccgagtgcagtatccacctggagcttatcgcagacaggcccctccaggtgtttcacgtggaagtgaaggtgaaggacatcaacgacaacccaccagtcttcagggggcgagagcagatcattttcatccctgagtcccgacttcttaactccagattccccatcgaaggagccgctgacgctgacatcggcgcaaatgcattgctgacctataccctgtccccgagcgattacttttcactggacgtcgaggcgtcagacgagctgtcgaagtcgctctggctcgagcttaggaagtacctagaccgcgaggaaacccccgaactgcacctccttctcacagctacagatggaggcaaacccgaactgcagggcaccgtggaactcctcattaccgtcttggacgtgaatgacaacgcaccactattcgatcaggcggtatacagagttcatctactagagactacagccaacggcaccctggtgacaactctgaacgccagcgacgcggacgagggtgtcaacggcgaggtcgtgtttagcttcgactccggcatttctcgagacatccaagaaaagttcaaggtcgacagctcatctggagagatcaggctgatcgataaactcgattatgaagaaacaaagtcttacgaaattcaggtgaaggctgtggacaagggatcgccaccaatgtctaatcactgtaaggtcctggtgaaagtgctggacgtgaatgacaatgcccctgaactcgcggtgaccagcctgtatctgccgatccgagaggatgcaccactttccaccgtgattgcgctgattacagtctcggatagggattccggggcaaacggccaagtcacgtgcagcttgatgccccacgtccctttcaagctggtgtccactttcaagaattactattccctggtgcttgactccgcactagatagagaaagtttatccgtatacgagctcgtggtgacggccagagacggtggctcaccgtccctgtgggcaactgcaagggtctcagtagaggtggccgatgtgaacgataacgctccagcctttgctcaaccagaatatacagtttttgtgaaggagaataacccccctgggtgccacatcttcacagtgagtgctcgggatgcagacgctcaggagaatgccctggtttcttattccttggttgagcggcgagtgggagaacgggctctgagcaattacgtgagtgtgcacgccgaatccggaaaggtgtatgctctgcaaccgttggaccatgaagagctagagctactgcagtttcaggtctctgccagagacgccggagttccccctctggggagtaatgtaacactacaagtgtttgtattggacgagaacgataatgcaccagcactgttagctcccagggtcggtggcactattggagccgtgtctgaactggtgccaaggctggtgggagcaggccacgtggttgccaaagttagagcagttgatgccgattcaggctacaatgcctggctttcctacgagctgcagccagccgctggaggcgctcggatcccgtttagggtcggactgtacaccggggagatttccacaactagggttttggatgaggctgatctgagccgctatagactcttggttctggtaaaggaccacggcgagcccgctctcacggccactgccactgttcttgtctcgctggtggagtctggccaagcacctaaggcctcctcgagggcctcagtgggtgtagctggcccagaagctgcccttgtggatgtgaatgtctacctaataattgctatatgcgcagtatcttccctgctcgtattaactcttttgctctatacggccttgcgctgctctgtaccacccacagaaggcgcatacgtgcccggaaaaccaacactcgtctgtagctctgcactcggctcctggtccaactcgcagcaacgcaggcagcgagtctgcagctccgagggaccccctaagacagatctcatggctttcagcccgggactatctccgtccttgaacaccagcgaaagaaatgagcagcccgaggccaatctcgacctgtctggtaatgtgtcaccaacgttcgaattctggttgtag

SEQ ID NO: 237286 - DNA, 2061 bp, Artificial Sequence
  Description of Artificial Sequence: Synthetic coding sequence
atggtcttcagccgcagaggcggtctgggcgcacgcgatctgttactatggctcctcctgttggccgcttgggaggttggctctggtcagcttcattattcaattcctgaggaggccaaacacggaacctttgtgggacgagtcgcccaggaccttggactcgaactggcagagttagtccctcgactgtttcgtgtggcttctaagacacacagagatcttttagaggtgaacctgcagaatggcattctgttcgtgaactcacgcatagatcgcgaagaactctgtcagtggtccgccgaatgctccatacatctggaacttatagctgaccggccactgcaggtgttccacgtggaggttaaggtgaaagatattaacgataatcccccagtcttccgaggcagggagcaaattatcttcatcccggaaagccggttattaaacagtcgcttcccgattgaaggggcagccgatgcagatatcggggctaatgccctgttgacctacaccctgtctccaagcgactacttctcattggacgtggaggcaagtgatgagctatctaagtcgctgtggctcgaactgaggaagtatctggaccgcgaagaaacaccagaactccatctgcttctgactgccacagacggcggaaagcccgagctgcaaggcacggtggagctcctgatcaccgtcctggatgtcaatgataatgcccctttgttcgaccaggccgtctatcgagtgcacctcctagagacaaccgcaaatgggacactggtgaccaccctgaacgcttccgatgctgatgaaggggtgaatggcgaagtggttttcagcttcgattccggaatctcccgggacatacaggaaaagttcaaggtggatagcagctctggcgaaatccgcctgatcgataaactggattacgaagagaccaagtcttacgaaattcaagtcaaagctgtcgataagggttctcctccaatgtcaaaccattgcaaggtgctggtgaaggtgctggacgtcaatgataatgcccctgagttggccgtgacttcgctatatctgcccatccgggaggatgctcccctctccacagtgattgccctgatcactgtatccgatcgggactccggtgccaacggtcaggtaacctgtagcttaatgccacatgtgcctttcaagctcgtgagcacatttaaaaattactattcactggtgctggacagtgctcttgaccgagagagcttgtccgtatacgagctagttgtaaccgccagggatgggggtagccctagcctttgggctacagctcgcgtgagtgtcgaagtagcagacgtcaatgataatgccccagcctttgcacaacccgagtacacagtgttcgtgaaggaaaataatcccccaggctgccacatctttacggtgtctgccagagacgcagacgcccaggagaacgccttggtgtcatacagtcttgtcgagcgtcgcgtcggcgaaagggctctgagcaattatgtgtccgtgcatgctgagtcagggaaagtctacgcactgcaacctctggatcatgaagaacttgagttactgcagttccagcccagacagccaaaccctgactggcgctacagcgcatccctgcgggctggcatgcatagctcagttcacttggaggaagctgggatacttcgggctggaccaggaggccctgatcagcaatggcctaccgttagctctgccacaccagaacctgaagcaggcgaggtgagtccacctgtgggggcaggcgtcaattccaatagctggaccttcaagtatggccctggcaaccccaaacagtctggccctggcgagctaccagacaagttcataatccctgggagtccagcgattattagcattcgacaagaacctaccaactcccagattgacaaatccgactttatcacattcgggaagaaggaagaaaccaagaagaaaaaaaaaaaaaagaagggaaacaagacacaggaaaagaaggaaaaaggaaattctactacagacaattcagaccagtag

SEQ ID NO: 237287 - DNA, 2853 bp, Artificial Sequence
  Description of Artificial Sequence: Synthetic coding sequence
atggtgttttcgagacgaggtggtctgggggcacgcgacctgctgctgtggctcttgctactggccgcatgggaagtcggctcgggtcaactgcattatagcataccggaagaagcgaaacacgggactttcgtggggagggtcgcacaagatcttggtctcgagctagcagagctggtgccaagactgttccgcgtggcgagtaaaacccaccgcgaccttttggaggtgaacttgcagaacggtattctgttcgtcaattccaggatcgatagagaggaactctgtcagtggtctgctgagtgctccattcaccttgaacttattgcagacaggcccctgcaagtttttcatgtagaggtcaaagtgaaagacatcaatgacaatcctccagtctttcggggtagagagcaaatcatctttatacctgagtccagattgctgaactccaggttccccattgagggcgcagctgatgctgatattggagccaatgcactactaacgtacacgttaagccccagtgactacttctccctcgacgtagaggcgtcagacgagcttagcaagtctctttggctggagctgcgtaaatatctagaccgagaagaaacccctgaactgcacttacttctgaccgctactgacggaggcaaacctgagctgcaagggaccgttgagctgctcatcactgtccttgacgtgaatgacaacgctccattattcgaccaggccgtttacagggtgcatttgctggagaccaccgccaatggcaccctggtgaccacgctgaatgcttctgacgccgacgaaggggtgaatggcgaggtcgtgttctctttcgatagcggtatttcgcgcgatattcaggaaaagtttaaggtggattcaagttctggggaaattagactgatagacaagctcgattacgaggaaacaaaatcctatgagattcaggtaaaggcagtggataaggggtctcctccaatgtccaatcactgcaaagtgttagtgaaagtgctggacgtcaatgacaacgcccctgagctagcagtaacatccttatatttaccaatcagagaggacgccccactcagcacggtcatcgctttaatcaccgtttcggacagagacagtggcgctaacggacaagttacctgctccctgatgcctcatgtgccgtttaaactggtctcaaccttcaaaaattattactccttagttttggactcagccttggacagggaaagtctgtccgtgtacgaattggtcgttacggccagggatggcggatcaccatcactgtgggctacggcccgagtgagcgtggaggtggccgatgttaacgataatgcccctgcctttgctcagcccgagtacacggtgtttgtgaaagaaaacaaccctccgggatgtcatatctttacagtgagcgctagagatgccgatgcccaggaaaacgctctggtgagttattccctggtcgaaaggagagtgggggaacgcgctctgtccaattatgtgtccgtgcacgcagaatctggcaaggtgtacgccctccagcccttggaccatgaagagctggaactgcttcagtttcaagtgtctgcgagagatgctggcgtccctcctttagggtctaatgttacacttcaagtgtttgttttggatgagaacgataatgcacccgcactactggctcctagggtgggcggaaccatcggggcagttagcgagctggtgcccaggctcgtgggggcaggacacgtcgtcgcaaaggtccgtgccgtggacgccgatagcggctacaatgcttggctgtcttacgagctgcaaccagcagcgggtggcgctaggatccccttcagagtagggctgtacaccggcgaaatttcgaccactcgtgtgctggacgaagctgatctcagccgttatcgtttgcttgttcttgtgaaagatcatggagaaccagctctcacagctaccgcaaccgtgctggtgagtctggtggagagtggccaggccccaaaggcgtcatcaagggctagcgtaggagttgccggtccagaagccgcactcgtcgacgttaacgtctacctgatcattgccatatgtgcagtctctagcctgctcgtgctgacgctgctgttgtacacagcattacgctgctcagttcctccgactgaaggggcatacgtgccaggaaagcctaccctggtatgttcctccgccttgggttcgtggtctaatagccagcagcgtagacagcgggtatgcagctcagagggccctcctaagacggacttgatggccttctctccagggctctcaccctccctgaacacttccgagagaaatgaacagcctgaggccaacctggacttgagcggaaaccccaggcaaccaaacccggactggaggtacagcgcatctctcagagcaggtatgcattcttccgtgcacctggaagaggcaggcatactgagagccggaccgggaggccctgatcagcaatggccaactgtatctagcgccactcctgaacccgaagccggagaggtgtcccccccagtgggggctggtgttaatagcaacagctggacgttcaagtacggccctgggaacccaaagcagtccggcccaggagagctgccggataagttcataatcccaggttcacctgccatcataagcattcgtcaggaaccaactaattctcagatcgacaaatctgattttatcacatttggaaagaaagaagaaaccaaaaaaaaaaaaaaaaaaaaaaaaggtaacaagacccaagaaaagaaggaaaaaggcaatagcacgaccgataacagcgaccagtag

SEQ ID NO: 237288 - DNA, 2847 bp, Artificial Sequence
  Description of Artificial Sequence: Synthetic coding sequence
atggtgtcccggtgtagctgtctgggggttcagtgtctcctgttgtccttgttactcctggctgcctgggaggtcgggtctggccagctgcattattccgtgtatgaggaagccaggcacggcacctttgtgggcaggattgctcaggacttgggcttggaactggccgaactggtgcagagactgtttcgcgttgcatcaaagcgccatggtgatctgctcgaagtgaacctgcagaacggcattctgttcgttaactctcgtattgatagagaagaactttgcggcagaagcgtggagtgttccattcatctggaagtgattgtggatcggcctcttcaggtgttccacgtggatgtggaggttaaagacattaatgacaacccaccccgtttctccgtgacagagcagaaactgtcgatccctgaatcccgccttttagacagtcgtttccctctcgaaggtgcttcagacgccgacgtcggtgagaacgccttgttgacctacaagctgtcacccaatgagtactttgtgttggatatcatcaacaagaaagataaggacaagtttccagtgctggttttgcgcaaactcttagaccgggaagagaacccccagttaaagctgctgctgactgcgactgatggcggtaagccagagtttactgggtccgtgtctctcttgattctagtcttagatgctaatgacaacgccccaatttttgataggcccgtgtacgaggtgaaaatgtacgagaatcaagtaaatcagactctagtgattagactgaatgcttccgatagcgatgagggcatcaataaggagatgatgtattccttctctagcttagtccctcccaccatccgacgcaagttttggataaatgaacgcacgggagagattaaggtgaatgacgcgatcgattttgaggattcaaatacatatgagatccatgtcgacgtgaccgataaaggcaaccctccaatggtgggacactgcacagtgctggtcgagctcctggacgaaaatgataattcgcctgaagtcatcgtgacaagtctttctctgcccgtgaaggaagacgcccaagttggcacagtgattgccctcatttctgtgagcgaccatgatagtggggcaaacggccaggtgacctgcagcctgaccccacacgtgccattcaaactggtgtccacttataagaactattactcacttgtcctcgattccgcactcgatcgtgagcgggtctccgcctatgagctggtggtgacagctagggacgggggtagccccccactgtgggccactgcttctgtctctgtcgaagtggccgatgttaatgataatgcacctgccttcgcgcagagtgagtacactgtgttcgtgaaggaaaacaacccccctggctgccatatttttaccgtttctgcttgggacgctgacgcgcaagaaaatgcattggtgagctacagcctggtggagaggaggctcggggagcgctctctaagttcctatgtatctgtccatgccgaaagcggtaaggtctatgccctgcagccgctcgatcatgaggaattagaattactgcagttccaggtctccgctagagacggcggtgtgcctcctcttggaagtaatctaacgttacaggtgttcgtcttggacgaaaacgacaatgctcccgcactgttggccagccccgcaggttctgcgggtggggctgtcagcgaactggtgctacggtctgtggtggctggtcacgtggtggctaaagtgagggctgttgacgctgacagtggctataatgcgtggctcagttacgagctgcaatctgccgctgtcggtgctaggataccatttcgcgtaggcctgtataccggcgaaatatctactacccgcgctctggacgaaacagatagcccgagacagaggttactggtccttgtgaaagatcatggcgagccttctctcacagcaaccgctactgtgctggtcagtctggtggaaggatcacaagccccaaaggcctcctcgcgggcatctgtaggcgttgctcccgaagtggccttagtcgatgtgaatgtgtatctgattatcgctatctgcgccgtaagctccctccttgttttaacgctactgctctatacagcactgaggtgcagcgccgcaccaacggagggcgcttgtggcccagtcaaacccactctggtttgcagtagcgctgtggggtcatggtcctatagtcaacagaggagacagagggtgtgtagtggggaaggtttaccgaaggccgacctaatggcattctccccatcgctccctccatgtccgatggttgatgtagacggggaggaccagtcaataggaggggatcattcacggaagccaaggcagcctaatcccgattggcggtattcggccagtctgagagcaggcatgcactcatccgtccacttggaggaagccggaatcctgcgggcaggccctggcggtccagaccaacagtggcctactgtgtcttctgctacaccggaacccgaggcgggtgaggtgtctcctcctgtgggcgcaggggtgaattccaactcctggaccttcaagtacggacctggtaaccccaagcagagcgggccaggagaactgcccgataaatttattattcccggatctcctgccataattagtattcgccaagaacccacaaatagccagattgacaaatctgatttcatcacattcggaaaaaaagaagaaacgaagaaaaagaagaagaagaagaaaggaaacaaaacacaagaaaaaaaggagaaggggaactcaacgacggacaactctgaccagtag

SEQ ID NO: 237289 - DNA, 2058 bp, Artificial Sequence
  Description of Artificial Sequence: Synthetic coding sequence
atggtgtctcgttgctcatgtctaggtgtgcagtgcctgctgctgtccttgctcttgctggcagcttgggaggtaggcagtggacagttacactactctgtgtatgaggaggccaggcatgggacctttgtgggcaggatcgcccaggatcttgggttagagcttgccgagcttgttcagagactctttagagtggcatccaaacggcacggtgatctcctggaagtcaatctgcagaacggaatcctgttcgtgaatagcagaattgaccgcgaagaactttgtggcaggagcgtagagtgctctatccaccttgaggttattgtggatagacctctccaggtgtttcacgttgatgtggaagtaaaagatattaatgataacccacctaggttttcagtgaccgaacagaagcttagtataccggaaagcaggctgcttgacagccgcttcccactggaaggcgctagcgatgccgacgttggtgagaatgccctattgacttataagctgtcacccaatgagtactttgtcctggatatcatcaacaagaaggataaggacaaatttccagtactggtgcttcgcaagctgctggacagagaagagaatccacaactaaaactgctattgaccgcaactgacggtggtaagcccgagttcaccgggtctgtgagcctcctcatactggtgctggacgcaaacgataacgcccctattttcgatagaccagtgtacgaagtcaagatgtatgagaatcaggtgaatcagaccctcgtcatcaggcttaatgcctctgactccgacgaaggtataaacaaagaaatgatgtattctttttcaagtttagttcctccaactatcaggaggaaattctggatcaacgagcggaccggggagataaaggtaaatgacgctatcgactttgaggacagcaacacctatgaaatccacgtcgacgtgaccgacaagggcaatcccccaatggtgggccactgtacggtgctcgtagagttgctggacgagaatgacaattcccctgaggttatcgtcacatccctgtcccttccagtaaaggaggacgcacaggtgggaaccgtcatcgccttgatctccgtgtctgaccacgactctggagcgaatggtcaagtcacttgctccctcacccctcacgtgccttttaagctcgtcagtacttacaagaactattattcccttgtcctagatagtgctctggatagagaacgtgtctctgcctatgagctagtggtgaccgcaagggacggtggctctccccctctgtgggccacggcaagcgtgagtgtggaggtggccgacgtgaacgacaatgcgccagccttcgcacaatctgaatataccgtatttgtgaaggagaacaatccacccggttgccatattttcacagtgagcgcgtgggatgccgatgcacaggaaaatgcgctagtgtcatattctctcgtggaacgaaggttgggggagagatcgctgagttcttatgtctccgtgcacgccgagtcaggaaaggtgtacgccctgcagcccctggatcacgaagagcttgagctgttgcagttccagcctagacaaccaaatcctgactggaggtactctgccagcctccgggcaggaatgcacagttcagtccatctcgaagaggcgggaatcctcagggctgggcctgggggtccggatcagcagtggcctacggtgagtagcgcaaccccagagccagaggcaggagaggtgtcacccccagtcggagcgggagtgaactctaacagctggacttttaaatacggccctgggaaccccaaacaaagtgggccaggagagctccctgacaagtttataattccaggcagtccagcgatcataagcattcggcaagagcccacaaattcacagatcgataagagcgacttcatcacctttgggaagaaagaggagacaaagaagaaaaagaagaaaaaaaaggggaacaagacacaagaaaagaaggaaaaaggtaacagcaccacagacaacagcgaccaatag

SEQ ID NO: 237290 - DNA, 2850 bp, Artificial Sequence
  Description of Artificial Sequence: Synthetic coding sequence
atgtttggcttccagcgtcgcggattgggcacacctaggcttcagctctggctgctgctcttggagttttgggaagtgggaagtggacagctgcattatagcgtaagcgaggaagccaaacacggcactttcgtcggcagaatcgcccaagaccttgggctggagctggccgagctggtccaacgtctcttccgagtggcttccaaaacacacggcgatttgctggaggtgaacttgcagaatgggatactgttcgtgaactcacggattgacagggaagagttatgtggccagagcgccgagtgttccattcacctggaggtaatcgtggaccgtccattacaggtgtttcacgttaatgtggaagtgaaagatattaatgataacccaccggtgttctccctccgggagcagaagctgctcatagcggagagtaagcaatcggattctcgcttccccctagagggcgcatcagacgccgacatagaggaaaatgctctactgacatacaggctgtccaagaatgagtatttctccctggacagtccaactaacgggaagcaaatcaaacgattgtccctaatcctgaaaaagtctctggatagagaaaagaccccggagctgaatctgttactcacggcgacagacggtggaaagcccgaactgacgggtaccgttcgactcctggttcaggtcctggacgttaatgacaacgatcctgagtttgataagagcgagtacaaagtgtctctcatggagaacgctgccaaggaaacactcgtacttaagctcaatgccactgaccgggacgagggagtcaatggagaggtgacatacagtctcatgtctatcaaacctaacggccgtcacttgttcaccctggatcaaaataacggcgaggttagggtcaacgggactttagattacgaggagaataagttttataaaattgaggtgcaggccaccgacaaaggaactccccctatggcgggtcactgtacggtttgggtggagattcttgacaccaatgacaacagccccgaagtggcggtcacctctttaagccttcccgtgagggaggacgctcaaccctccaccgtgatagctctgatcagtgtctcagatcgggattctggcgtgaacggtcaggtgacctgtagtctaaccccgcacgtcccctttaagttagtgagtaccttcaaaaattactattcgctcgtgctagatagcgcgcttgacagggagaacgtttgggcatatgagttagttgtcactgctcgggatgggggaagcccttccttgtgggcaacagccagggtctctgtcgaggtggcagatgtgaatgacaacgctcctgctttcgcccagcccgaatatactgtctttgtgaaagagaataatccaccgggttgccacatcttcactgtctccgctagggacgcagacgcacaggagaatgcgctggtgtcttattcactagtcgagcgcagattgggtgatagagccctttcttcctacgtgtcagtgcatgcagagagcggaaaagtatacgcccttcaacctctggatcacgaagaattggagctcctccagtttcaggtatccgcccgtgacgccggtgtgcctccattgtcttcgaacgtgacactccaggtgttcgtgctggacgaaaatgataacgccccagctctgctcgccactcaggctggcagcgccggtggtgctgtaaacaaactggtgcccagatccgttggtgccggacatgtagtcgccaaagtgagagccgtggacgcggatagcgggtataatgcctggctctcttatgaactccagcccgcagccggaggttctaggataccatttcgagtgggactctacacaggtgagattagcaccacaagggctctcgatgaagccgactcgccacgccatcgacttttggttctagtcaaggatcacggggaacctgccctgaccgctaccgccacggtcttagtatccttggtggaatctggacaagcacctaaggcctctagtcgcaccctagctggcgcagcttcccctgaagccgcactagttgatgtcaatgtataccttatcatcgcaatctgcgttgtctctagcttgctggttctgacactacttctttacaccgctctctggtggtccgcaaccccaaccgagggcgcatgcgcacctggtaagccaacactcgtgtgttccagagcggtgggttcatggtcatactcccaacagcggaggcagcgggtctgttcagaagaggggccaccaaaaactgatctgatggccttttccccatccttgcccctcgggctgaacaaggaggaagaaggcgaacgtcaggaaccaggctctaaccaccctggtcagccaagacaacccaaccctgactggcgttactcagctagcctgcgagccggaatgcacagctccgtccaccttgaggaagcaggaattctccgtgccggaccaggtggtccagatcaacagtggcccaccgtttcttcggcaactcctgaaccagaggcaggagaggtgtcaccgcctgtgggcgcaggagtgaactctaactcctggacctttaaatatggcccagggaatccaaagcagtctgggcctggcgaactacctgataagttcattattcccggatcccccgctatcatatcaattcgccaagaacccacaaattctcagattgacaaatctgattttattactttcggcaagaaagaagaaacaaaaaagaaaaagaagaaaaagaaggggaataaaacacaggaaaagaaggagaagggcaacagcactactgataactcagatcagtag

SEQ ID NO: 237291 - DNA, 2826 bp, Artificial Sequence
  Description of Artificial Sequence: Synthetic coding sequence
atggttatcatcggccctagagggccaggctcgcagcgtcttttgctttccctcctgttactggcagcatgggaagttggctctggtcagttgcactactcagtgtacgaagaggccaaacatggaacgtttgtagggaggattgcgcaagatctcggtcttgagttagctgaactggtgcccagactgtttcgggtcgcctcgaagcgacatggcgatctgcttgaggttaatcttcagaatggaattttgttcgtgaattctaggatcgaccgagagaaactgtgcggcagaagtgcagagtgttctattcatctcgaggttatagtcgaccggccactgcaggtgtttcacgttgacgtggaagtgaaagacattaatgataatcctcccgtttttagagagcgagagcagaaggttcctgtttcggaatcggcccctctggacagccattttccccttgagggcgcttccgacgccgatatcggcgttaatagcctgctcacatacgccctaagcctcaacgagaacttcgagctgaaaatcaaaactaaaaaagacaaaagcatcctgcccgagctcgtgttgcggaagctgctggaccgcgagcaaacaccaaaactcaatcttctcttgatggtgattgacggaggcaaacccgagctcaccggctctgtacagatccaaattacggtattggatgttaatgataacggccctgccttcgacaaaccttcctataaggtggtactgtctgagaatgtgcagaatgatacaagagtcattcagcttaatgcctctgaccccgacgaggggctgaatggggagatcagctacggcattaaaatgatcttacccgtgtcagagaaatgcatgttttctattaaccccgataccggagaaatccgtatttacggcgaacttgacttcgaggagaacaatgcctacgaaattcaggtcaacgctatcgataaagggataccctccatggctggtcactccatggtgctcgtcgaagtgctcgatgtgaacgataatgtgcctgaagttatggttacatctctgagccttcctgtgcaggaggatgcccaggtgggtacagtgatcgctcttatctcggttagtgaccgagatagcggagcaaacggacaggtaatctgcagcctgacgcctcacgttccatttaagctcgtgtccacttataaaaactattactcactggttctcgatagcgctttagacagagaatcggtaagcgcctacgaactggttgttacggcacgcgacggaggatccccatcgttgtgggccactgccagggtttccgtagaggtggcagacgtgaatgataatgcaccggctttcgctcagccggagtacaccgtgtttgtcaaagaaaataatccccctgggtgccatattttcaccgtatcagcctgggatgcagatgcccaaaaaaacgctctggtttcctatagccttgtggagagaagggtgggcgagcatgccctgtctagctacgtgtcagtgcatgctgagagcggtaaagtatacgctttacagcccctggatcacgaagagctggagttgctgcagttccaggttagtgctcgtgacgccggtgtgccccctctgggctctaacgtaaccctgcaagtgtttgtgctggacgaaaatgataacgcaccagccctcctggccacccccgcaggcagtgccggtggtgctgtgtccgaactggtgcccaggtcagtcggtgccggacatgttgtcgccaaagtgcgggctgtggacgccgactcaggatacaatgcttggctgagctacgagttacagcctgctgctgttggtgctcacattcctttccacgtgggactttacacaggagagatatctacgacacggatcctggatgaggcggatgcgccacgacataggctgctggtacttgtgaaagaccatggtgagccagcgctaactagcacagcaacggtgctggtttctttggttgagaatggccaggcacccaagacatcctcccgcgcatcagtaggcgctgttgatcctgaagcagcgctggtcgacatcaacgtgtatctgatcatcgctatttgtgctgtcagttcccttctggtgcttaccctgctcctgtacactgctttgcgctgcagcgctccacccactgtttctcggtgcgctccgggaaagcccacgctggtgtgcagctccgcagtggggtcctggagctacagtcaacaacggcgtcagagagtttgcagcgctgaatcacctcctaagacagacttaatggcattctccccgtccctgcagctaagcagggaggactgcctcaatcccccaagcgagcccaggcagcccaaccctgattggcggtactccgcatccctaagagccggaatgcactctagcgtacatctagaggaagctggtatcctgcgtgcagggccaggagggccagaccagcagtggcccactgtgagtagcgcaacacccgaacctgaggctggtgaggtgagtcctcctgttggcgcaggtgtcaactcgaactcatggacctttaagtacgggcctggcaaccctaagcaatccggcccaggggaactcccggataagtttattatacctggttcccccgcaattatttccattcggcaggaacccacaaattcccagattgataaatcagacttcatcacctttggcaagaaagaggaaaccaagaagaaaaagaaaaagaaaaaaggaaataagacccaagaaaagaaggagaaaggaaattccaccaccgataattccgatcagtag

SEQ ID NO: 237292 - DNA, 2853 bp, Artificial Sequence
  Description of Artificial Sequence: Synthetic coding sequence
atgctgtcaagttggcaggggggacccagaccacggcagctgttgttgtggctgctgattttagccgcatgggaaacagggagcggccagctccactacagcgtgcctgaggaggctaagcatgggacattcgtgggcagaatcgcacaggatctgggactcgaactcgccgagttggtgcccagactcttcagagtggcctccaagaggcacggtgatctgcttgaggtgaacctgcaaaacggaatactcttcgtcaattccaggattgacagggaggagctctgcgggcgatctgcggagtgtagtatccatcttgaggtgattgtcgatcgaccactgcaggtttttcacgtggaagtcaaagtccgtgatatcaatgacaacccccctatcttcccagaatctaagaagcgcattattatcgctgagagtcgaccaccagagacgagatttcccttggacggagctagtgatgccgatattggagtgaacagtgcactgacataccggctggaccctaatgactattttacactggacgctcagaattcattggagcagatgtcaagtcttagtcttgtcttgcgaaagaccctggatagggaagagattcaggagcacagcctgcttctgaccgcaagcgacgggggaaagcccgagctgaccggaacagttcagttactgatcaccatccttgacgtaaacgacaacgcccctgagttctatcagagtgtgtataaggtcaccgtgctcgagaacgccttcaacggcacactggtcatcaagctcaatgccaccgatcccgatgacggtactaacggggacattgtttatagtttccggagaccagtgtggccagctgtagtctatgcttttaccatcaacccaaataacggggagattcgcacgaaggggaaacttgatttcgaggaaaagaaactatacgaaatttccgtcgaagcagtagataaaggtaatatcccaatggccggacattgtaccctgttagtggaagtgcttgacgtcaacgacaacgcccctgaggtgactattacttccctttccctgcctatcagagaggacactcagcccagcgcaattattgccctaatttcagtgagtgatcgggactctggaagcaacggtcaggtcacttgcacgctcaccccacatgtcccatttaaattagtatcaacatacaagaattattactcccttgttctagatagcgctctggaccgggaatctgtgtccgcgtacgaactggttgtgactgctcgggatggtggctccccgtccctctgggctaccgcaagcgtgagtgttggcgtggcggatgttaatgacaacgcccctgcctttgcccaaccagaatatactgtctttgtgaaagagaacaacccgcctggctgccatattttcaccgtgtcggctcaggacgcggacgcccaggagaacgccctcgtgagctatagcttggtcgaacgtagggttggagagcgagcgctcagttcctacgtgtcagtacatgccgaaagtggtaaagtctatgccttacagcccctggatcacgaagagcttgagctattgcagtttcaggtgtcggcacgagactcaggagtgccccctctgggcagcaatgtgacattgcaggtgttcgtcctggatgagaacgacaatgcacccgctttacttacacctggggcaggctctgccggtggcacagtttctgagctgatgcctcgatcagtaggtgccggacacgtagtcgcaaaagtaagagctgtggatgccgacagtggctataatgcttggctctcatacgaattgcaactcgccgctgtgggcgctagaatcccttttcgtgtgggcctgtacactggtgagatctctaccactcggccactggatgaagtcgacgcccctcatcacaggctgctcgttttagtgaaggatcacggcgaaccagcactgaccgcaacggccactgtcctgctttcattggtggaaagcggacaggccccacaggcatcaagcagagcaagtgctggagccgtgggtcctgaagccgctttagttgatgtaaatgtgtatcttatcatagccatttgcgcagtttcaagcctgctggtgcttactctgctgctgtatacagctctgcggtgttccgcaccaccgacagagggggcatgcgcccctggcaagcccaccttggtatgctcttccgcggctgggagttggagttattcccagcaaagacgccctcgcgtgtgttccggggaaggtcctcataaaaccgatcttatggcctttagcccctcccttcccccttgcctgggctctgccgaaggtaccggacaaagagaggaggattccgagtgcctgaaagagccccgacaacctaatccagactggcgctactcagccagccttagggccggtatgcatagcagcgtgcacctcgaagaagccggtatcctccgtgctggccctggaggaccagaccaacagtggccaactgtcagttccgcgacccctgagcccgaggctggcgaggtgtccccacctgtgggagcaggagtaaatagcaattcctggaccttcaagtatgggccaggaaaccccaaacagtctggccctggcgaacttcctgataaattcatcattcccggatctccagctattatatccattcgccaggagccaaccaatagccagattgacaagagcgatttcatcacattcgggaaaaaagaggagaccaaaaagaagaaaaaaaagaagaaaggaaataagacacaggagaaaaaagagaagggtaacagtacaacagataacagcgaccagtag

SEQ ID NO: 237293 - DNA, 2715 bp, Artificial Sequence
  Description of Artificial Sequence: Synthetic coding sequence
atgcttagcagctggcagggtgggccacggcctaggcagttgctgctctggctgcttatcctggcggcttgggagaccggctctggtcaactgcattatagcgtgcccgaggaggccaaacatggcaccttcgtgggcaggattgctcaggacttgggtctggagctcgctgaactggttcctcgtctgtttagggtggccagtaagcggcacggggacctgctcgaggttaatctacagaacggtatcctgttcgtgaacagtcgcatcgaccgcgaagagttgtgtggcaggtcagccgagtgcagtatacatcttgaggtgatcgtggaccgccctttgcaagtgttccatgttgaggttaaagttagggacatcaatgataaccctcccattttcccagagtcaaaaaagcggatcattattgccgagagccggcctccagagacccgtttccctctcgatggggctagcgacgccgatatcggggtgaacagcgcactgacgtatcggctggaccccaacgattattttacattggacgcgcagaactccttggaacagatgagttcactgagcctggtcttacgaaaaactttggatcgagaggagattcaagaacactccttgctgctgaccgcctcagatggaggcaaacccgaactcactgggactgtgcagctgctcattacaatcctggacgtgaatgacaatgcacctgagttctaccagtctgtttataaggtgactgtgttagaaaatgcctttaacggtaccttggtgatcaaattaaatgccactgatcctgacgacggaactaacggagatatagtttattctttccgcaggccagtctggccagccgtagtttacgcctttactatcaatcccaataacggtgaaatccgcacgaaaggaaagctggattttgaggaaaagaagctatacgaaattagcgtggaggcagtagacaagggaaacataccaatggcagggcactgcaccctccttgtggaggttctcgacgtcaacgacaatgccccagaggtcactattaccagcttatcgctccccatcagagaggatacccagccctctgcaattatagctctgatctccgtcagcgatagggacagtggaagcaatgggcaagtgacctgcaccctgacccctcacgtgcctttcaagctcgtgtcaacatataaaaattattatagtctcgtgttggactctgccctggatagggagtcggtgtctgcgtatgagctggtggtgacagcgagggacggcggtagtcccagtttgtgggccacggcaagtgtgtctgttggagtggcagatgtgaatgataacgctcccgcatttgcacagccggaatatactgtgtttgtgaaggagaacaatccacccggttgtcatatcttcaccgtgtccgctcaagatgctgatgcacaggagaatgctctcgtgtcctacagcttggtcgagagaagagttggagaaagggccctcagcagctatgtgtctgtccatgctgagtcaggaaaagtttatgcattacagcccctcgaccacgaggaattggagttgctccaatttcaggtgtcggcacgggattctggtgttccccctctcgggtcgaacgtaactctgcaggtgttcgttcttgacgaaaacgacaatgcacctgccctcctgactcctggggcagggtcggcaggcggaacggtctctgagctcatgccacgttccgtgggcgcaggtcatgtagtcgcaaaggtgagggctgtggatgcagatagcggctacaacgcgtggttatcctacgagctgcagctcgccgcagtcggcgctcgaataccttttcgggtcgggctttatactggtgagatctcaaccacccgacctctggacgaagtcgacgccccacaccaccgcctgctcgttcttgtcaaagatcatggcgagcccgctcttaccgccacagccactgttcttctatcactggtcgaatccgggcaggccccacaggcttcctctcgcgcatcagccggagccgtgggcccagaggctgcattagttgacgtcaacgtgtatctcataattgctatatgcgctgtgtccagtctgcttgtgctaaccctactgctttatactgcgttgaggtgctccgctccccctaccgaaggtgcatgcgctccagggaagccaacactagtttgcagttcggccgctggctcatggtcatactcccagcagcgaagaccgagggtctgcagcggagaaggtcctcataagaccgacctgatggccttcagtccatcgcttcctccctgcttgggctccgctgagggaactgggcagcgggaagaagacagtgagtgcttgaaagagcccagacagccgaatcctgattggagatacagtgcaagcctgcgggcagggatgcacagcagcgtgcacctagaggaggcgggaatcctgcgagccggaccgggtggtcccgaccagcagtggcccaccgtatcttctgctaccccagaaccggaggccggagaagtgagccctccagttggcgctggggtcaacagtaacagttggactttcaaatatggtcctggaaaccctaagcagtccggacccgagcctaaaaaacaaactcaggtcagcttcctactgcgaagaaagggcgaagcaagtcagcctaggcaatag

SEQ ID NO: 237294 - DNA, 2475 bp, Artificial Sequence
  Description of Artificial Sequence: Synthetic coding sequence
atggcatctagtatcaggcgtggcagaggtgcctggacaaggctgctgtccctcctcctgctcgctgcctgggaagttgggtcaggccagctgagatactcggttcccgaggaagcaaagcatggcaccttcgtcgggaggatcgcccaagacctgggcctggaactggaagaactagtgccgcgtctgttcagagtggctagcaaacgccacggggaccttctggaggtgaatctgcagaacggaatactgttcgtgaactccaggatagatcgggaggaattgtgcggaagaagtgccgagtgctcgatacatgtggaagtcattgtcgatcgtccgttacaggttttccatgtggaagtggaggtgaaggacatcaatgacaacccccctatcttccccatgactgttaaaacaatccgattccccgagagcagactcctggattcacgattcccactagagggcgcttccgatgccgacattggagtgaatgctcttctctcctataaactgagctcttccgagttcttctttttagacatccaggcgaatgacgagctttcagaatctttgtcactcgtattgggaaagtcactagatcgggaagaaactgccgaagttaatctgctgttggttgccacagatggcggtaaacccgagctcactggcacagtgcagatcttaatcaaggtgctagatgtgaacgataacgagcccactttcgctcaaagtgtgtataaggtgaagttacttgagaacacagccaacggaaccctggttgttaagctaaacgcatcagatgctgacgaaggcccaaactccgagattgtttactctctgggctccgacgtgtcaagcacaatccaaaccaaatttaccatcgatcctatttcaggggaaatacgtacgaaagggaagttagactacgaggaggccaaaagctatgagatccaagtaaccgctactgacaaaggcacaccatctatgtcagggcattgcaagatttcacttaagttggtggacatcaatgataataccccagaagtctcgataaccagtctgagcctaccaataagcgagaacgcctctctgggtaccgtgattgctctcatcaccgtcagcgaccgcgactccggaacaaatggacatgtgacctgttcactgactccccacgtgccatttaagctggtgtccacgttcaaaaactattactctttggttcttgacagcgctttagaccgcgaaagtgtatccgcatacgagctggtagtgactgccagggacggcggatccccatcactgtgggcgactacatcagtgtccattgaagtggcggacgtcaatgacaacgcacccgcattcgctcaacccgaatatacagtgtttgttaaggagaataaccctcctgggtgtcacattttcactgtctctgcctgggatgcagatgcgcaggaaaatgcgctcgttagctactcactggttgagcgtcgtgtaggagagagggcgctgagttcttatgtctcagtccatgccgaaagcggcaaagtctacgcactgcagccccttgatcatgaggaggtggaattgctgcagttccaggtgagcgccagagacgccggagtgccgccactcggctccaatgtcacactacaggttttcgtacttgacgagaacgataatgcaccagccctcctggcccctcgcgcaggcacagccgctggcgctgtctcggagctcgtgccgtggagcgtgggtgctggtcacgtagtggcaaaggtcagggccgtggacgccgactcagggtataatgcctggctgtcttatgaactgcagcttgggacgggctcggcacggattcccttcagagtcggactttatactggcgagatttccactacccgggctctcgatgaggcagacagccctaggcatcggctcctggtactggtgaaagatcatggtgaaccagctctgacagcaactgcgaccgtcctggttagcttggtcgagagcggtcaggctcctaaggcctcttcacgagcttgggtcggagccgctggcagtgaggccaccctggtcgacgtgaacgtatatctgattattgcaatatgtgccgtgtctagtctgttagtgctgacagtcctgttatacacagctcttcgatgctcggtgccaccaactgaaggcgctcgtgcaccaggaaaaccaaccctggtgtgctctagcgcagttggaagctggagctacagtcagcaacgtcgacagagggtgtgctctggtgaggatccacccaaaactgatctcatggcctttagtcccagtttgtcccaaggcccagactccgctgaggaaaagcagttaagtgaatctgagtacgtcggcaaagtgtcgcttctattattcctggcaaattccaagattgtgcttttcaagaagttctatatgatttccacatcctatcttgattcctag

SEQ ID NO: 237295 - DNA, 2847 bp, Artificial Sequence
  Description of Artificial Sequence: Synthetic coding sequence
atggcgtcatcgatacgaagaggcaggggtgcctggactagactgctgagtctgctcttactcgccgcttgggaggtgggcagcggacagttacgctacagcgttcctgaagaagccaaacatgggacctttgtgggccgtatagcacaggaccttggcctcgagctcgaggagttggtgccacgtttattccgggtggcgtcgaaaaggcacggagatctgttggaggtgaatctgcaaaatggaatcctgttcgttaatagccggatcgaccgggaggagctgtgcggaagatcggccgaatgctccatccatgttgaagtgatagttgaccgccctctgcaagtctttcacgtcgaagtagaagtgaaagacatcaatgacaatccacccattttcccgatgaccgtcaaaaccatcaggttccctgagtcccgtctcttggattcgagattccccctggagggcgcaagtgatgccgatatcggggtgaacgctttactgagttacaaactgagcagcagcgaattcttctttctcgacatccaggccaatgacgagctgtccgagagcctgagcctggtgctgggaaagtctctcgatagggaagagacggctgaggtgaacctactcctagtggcaactgacggcggtaagccagagctgactggaaccgtgcagatcctcatcaaagttctggatgtcaacgataacgagcccacatttgctcagagtgtgtacaaagtgaaactgctagagaacacagccaatggaacccttgtcgttaagctgaatgcttcggacgctgacgaaggaccaaattcggaaatcgtgtacagcctgggttccgacgtatcatcaactatacagacaaagtttacaatcgatcctatctcgggcgaaatcagaacaaaggggaaactggattatgaagaggcaaagagctacgagattcaagtgaccgcaaccgacaagggcactccaagtatgtctggacactgcaagattagcctgaaactggtggacattaacgataacacacccgaagtcagcattacttcactgtcactccctattagcgaaaacgcctcccttggcaccgtgatcgcgttgataacggtatccgatcgcgatagcggcaccaatggacacgtgacatgttcgttgaccccccatgtgccgttcaaacttgtgtccactttcaagaactactactctcttgtgcttgattcagctctggatagagagtccgtgagcgcctatgaattagtggtgacagctcgtgatggtgggagccccagcctctgggctactacttccgtgagtatcgaggtagctgatgttaatgacaatgctcccgcatttgctcagcctgaatacactgtattcgtaaaagagaacaacccccctggttgccatattttcaccgtgtcagcttgggatgccgatgcccaggaaaacgccttggtatcctatagtttggtggagagacgggttggggaaagagcgcttagcagctatgtgtcggtgcatgccgagagtgggaaggtgtacgcactgcagcccttggaccacgaagaggtggaattacttcagtttcaggtttccgccagggacgcgggagtcccccctctcggttctaacgtaaccctgcaggtgttcgtgctcgacgagaacgacaacgctccagccctgcttgcaccacgggctggcaccgccgctggagctgtaagcgaactggttccctggagtgtgggggctggccatgtcgttgctaaggtgcgcgctgtggatgctgacagcggctacaacgcttggctgagctacgagctgcagttaggcacaggctccgccagaattccctttcgagttgggctgtatacgggagagatttccaccacaagggccctcgatgaagccgactccccaaggcacaggctgttggtcctggtgaaagatcacggcgagcccgctctcacggcaactgctacagtcctcgtctcgttggtggagagcggccaagctccgaaagctagttctcgggcttgggtcggagccgcaggttctgaagccaccctggtggacgtgaatgtctatcttattatcgccatctgcgcagttagctctctgctggtcctgactgttcttctctacaccgcgttgagatgctcagtcccacctaccgagggagctagggcccctggtaagcctaccctggtctgcagcagcgccgtaggttcttggagttatagtcagcagcggcgtcagcgggtctgttcaggtgaggacccgcctaagactgacctgatggccttttcaccttcattatcccaaggtccggactcagctgaggaaaagcagctgagcgaatccgagtacgtaggaaagcccaggcagccaaatcccgattggcgctattccgcaagtttgcgtgcaggcatgcatagctcggtgcacttggaggaagccggaatcttgagagccggaccagggggaccggaccagcaatggcccactgtgtcctctgctacccctgaacccgaggccggagaggtctctcccccagttggggctggcgtgaattccaatagctggacatttaaatacggccctgggaatccaaagcagagcggcccaggggaactgccagataagtttataatccccggatcacccgctattattagcattagacaggaacccacgaattctcaaattgacaaatcagactttattacatttggaaagaaggaggaaaccaagaaaaaaaagaagaagaagaagggaaacaaaactcaggagaagaaagagaagggcaactctaccaccgataactccgatcagtag

SEQ ID NO: 237296 - DNA, 2853 bp, Artificial Sequence
  Description of Artificial Sequence: Synthetic coding sequence
atgctcttttcttggcgagaggaccctggcgctcaatgcctgctgctctcccttctcttgttagctgcgtctgaagtgggcagcggccagctgcattatagcgtctctgaggaggcgaagcatggaaccttcgtaggacgtattgcccaagacttgggattggaattggctgaactggtgccacgcttattccgggtggcaagcaagcgccatggcgatcttctcgaggtgaacctgcagaatggcatactgttcgtgaactcccggatcgacagagaggaactttgcggacgatccgccgaatgctcgatccacctggaggttattgtggataggccgctgcaggtgtttcacgtagaagtggaagtgaaagacattaatgataatgctcccgtgtttccaatggccgtgaaaaacctcttcatctccgagtcccggcagcctgggagtcgctttagccttgagggcgcaagtgacgccgacatcggcacaaacagtctgcttacttattcccttgactcaaccgaatatttcaccttagatgtcaagcgcaacgacgaggaaataaaatccttgggcttagtcctcaagaagaatctgaacagagaggataccccaaaacattatctccttattaccgcgattgatggagggaagccggaactgaccggaacaactcaactaaagattacagtgctggacgttaacgacaatgcgcctgccttcgagaggaccatttacaaggtacgacttttggagaatgctccaaacggaactctggtggtcacagtgaatgcaaccgacttggatgaaggggttaacaaggatattgcctacagcttcaataccgatatgagtgctgacatcctcagcaaattccatttggatccagtgaacggacagatctcggtgaaaggaaacatcgattttgaagaaagcaagagttatgagattcaggtcgaggctactgacaagggtaacccacctatgtccgatcactgcaccgtcctgctcgaaatcgtggatatcaacgacaatgtgcctgagctggtaatccagtccttatctctgccggtcctggaggattcacccctatcaacagtgattgccttgatcagcgtcagcgacagggatagtggcgtcaatgggcaagtaacatgctcattaacaccacatgtacctttcaaacttgttagcacctttaagaactactatagcttagtactggacagccctctcgatagggaatccgtcagtgcctacgaattggttgtgaccgctagggacgggggtagcccatctctgtgggccactgcctctgtgagtgtggaggtagcggacgtaaacgacaacgccccagccttctctcagtcggaatacacagtcttcgtgaaagagaataacccgcctggctgtcacatttttacagtttccgcccgagacgcagatgcccaagagaacgcccttgttagttacagcctagtcgaaaggcgcgtaggggagcgggctttatcatcctatgttagcgtgcacgctgagtctggcaaagtctacgctttgcagcctttagatcacgaggagttagagctgctgcagtttcaggtaagcgccagggatgccggtgtccctcctctcggctctaacgtgacattgcaagtatttgtgctcgacgagaacgacaatgcaccagctctgctcatgcccagagtgggaggtatcggcggtgctgttagcgagttggtgcctcgttctgtgggtgcagggcacgtcgtcgcaaaagtgagggccgtcgacgcagactcaggttacaacgcttggctttcttacgaactccagccagggaccggtggcgcaagaattcctttcagagtcggactgtacactggggagatcagtacgactcgggctcttgatgaggttgacgcccctaggcatagattgctcgtgctggtgaaagatcacggagaaccatcactcacggctacagccaccgtactcgtgtctctggtggagagtggacaggcgccaaaggcatcatctcaggcctccgctggcgctaccggcccagaagcagctcttgttgacgtgaatgtctatcttatcgtagccatatgcgccgttagttccctgttggtactaacactattactatataccgcattaaggtgtagcgcccctccaactgaaggggactgtgggcctggaaaacccaccttggtgtgttctagcgcagtagggtcctggagttatagtcagcagaggcagcagagagtctgcagcggcgaggggttgcctaagactgacctgatggctttcagtccttctttgccgccttgcccaatatcgcgcgaccgcgaggagaaacaggacgtcgatgtggacctttctgctaagccccgtcagccgaaccccgactggcggtactccgcttcgttacgggcaggcatgcacagttctgtgcatctcgaggaagccggtatcttgcgtgcaggcccagggggaccagaccagcaatggcccactgtgagcagtgccactcccgaacccgaggctggtgaagtgtcgccccctgtaggggcaggtgtgaattccaattcttggacatttaagtatgggcctggcaatccgaaacaaagtgggcctggcgagctgcccgataagttcataattccaggtagccctgcgattatttctatacgccaggaacctaccaatagccaaattgacaaatcagatttcatcacatttggaaaaaaagaggagacaaaaaagaaaaagaaaaagaaaaaggggaacaaaacccaggaaaagaaagagaagggaaattccaccaccgacaattctgaccaatag

SEQ ID NO: 237297 - DNA, 2475 bp, Artificial Sequence
  Description of Artificial Sequence: Synthetic coding sequence
atgctgtttagctggcgcgaagaccccggagcccagtgcctactgctgagcctgctgttgttggccgctagtgaggtcggctcaggccagctgcattactcggtgtccgaggaggccaaacatggcacctttgtgggcagaatagcccaggatttgggcctggaactggctgaattggtgccaagattatttcgagtggcaagcaagagacatggcgatctgctggaggtaaaccttcagaacggaatcctgttcgtaaattctaggatcgatcgagaagaactgtgcggaaggagcgccgaatgctctattcatcttgaagtaatcgtcgacaggcccctacaagtgtttcatgtagaggtggaggtgaaagatattaacgacaacgcacccgtctttccaatggccgtgaaaaatctgtttattagcgaaagtagacagcctggatctcgcttcagcctcgaaggagcatccgatgctgacataggcactaactcacttcttacctattcgttggattccacagagtactttactctggatgtcaagcggaacgacgaggaaataaaaagcctcggactggtgctgaagaaaaacctgaacagggaggatacacccaaacactatctgttaattactgctatcgacgggggtaaacctgaactcactggaacgactcagttgaagattaccgtcctcgacgtgaacgacaatgcacctgccttcgagcgcacaatttataaagtccgcttgttggagaatgcacctaatggcacattagtggtgaccgtcaacgcgaccgacctcgatgagggcgtgaacaaggatattgcttactcctttaacaccgacatgagtgcagatatcctgagtaagtttcacctcgacccagtaaatgggcaaatcagcgtcaagggaaatatcgacttcgaggagagcaaatcatacgagattcaggtcgaagccaccgacaaggggaacccccctatgagtgaccactgcacagttctacttgagatcgtggatatcaacgacaacgtgcccgagctcgtgatacagtcactatcgctcccggtgctggaggattctcctctctcgaccgtgatcgctctgatctctgtgagtgacagagactccggtgttaacggacaggttacgtgctcgttgacccctcacgtgcctttcaagctggtgagtacatttaaaaattattattctctggttttggattcaccacttgaccgcgaaagtgtgtcggcttacgaactcgtggttactgccagggatggaggcagcccctctctctgggctactgcgtctgtctctgtcgaagtggcggacgtgaatgataacgctcccgcattttctcaaagcgagtacaccgtgtttgtgaaggaaaacaatccacccggatgccacattttcacagtgtccgcaagagatgccgatgcccaagaaaacgcgcttgtttcgtactctctggttgaacggcgagtcggcgagcgcgctctgtcctcatacgtttccgtgcatgccgagagcggcaaagtctatgccctgcaacctctggaccacgaggagctggaacttttacagtttcaggtctcagcccgagatgcaggggtgccaccattgggctccaacgtgacattacaggtctttgttctcgatgagaatgacaatgctcccgcacttttaatgcctcgtgtggggggaatcgggggtgcagtttccgaactggtcccaagatctgttggagcaggccacgtggtagcaaaagtcagagctgttgacgctgactcgggatacaacgcatggttgtcctatgaacttcagcccggaaccggcggtgcacggattcccttcagagttggactgtatactggcgagattagcacaactcgcgctcttgatgaagtcgatgccccaagacatagactgctcgtgctggtgaaagaccatggcgaacccagccttaccgccaccgctactgtcttagtgagccttgtcgaaagcggccaagctcctaaagcaagcagtcaggctagtgccggtgccacaggccctgaggccgctctggtcgacgtgaacgtatacctgattgtcgccatctgtgctgttagttccctgcttgtgctgactctgcttttgtatacagccctgaggtgctccgctccccctacagagggagactgtggtcctggcaagcccacactcgtatgcagttctgccgtgggctcttggtcatactcacagcagcgacagcagcgcgtctgcagcggcgaaggcctgcccaagactgacctgatggcattttccccatcgctgcctccctgccctatctcccgcgaccgtgaagagaagcaagatgttgatgtcgatctttccgctaaagtgtcaaacttttacctcttctttcccaagtgcctgtgcttttcattccttaatgtgtctactcctcttgaaatccattag

SEQ ID NO: 237298 - DNA, 2451 bp, Artificial Sequence
  Description of Artificial Sequence: Synthetic coding sequence
atggtgtacagtcggagaggatctctcggaagccgtctgctccttctttggctgctcctggcctattggaaggcgggaagcggtcagctacactattccattcccgaggaagccaaacacggaacttttgtagggcgaatcgctcaggacctcggccttgaactggcggagcttgttcctcggctgttcagagtcgcatctaagggaaggggggacctcctagaggtgaatctacagaatggcattctctttgtgaatagccgcatcgaccgagaagaactatgtcgcagacgcgctgaatgtagcatacacctcgaggtaatcgttgatcggccactacaggtgttccacgtcgaagtcgctgtgaaggatattaatgacaatcctcctagatttagtcggcaggaacagcgcctgttcatattggagagtagaatgcccgattcccgctttccccttgagggggcatctgacctcgacatcggggcaaatgcacagctgaggtacagactgaaccccaatgagtatttcgacctggatgtcaaaaccaacgaggaagagacaaattttctcgagctggtactcaggaagagcctggacagagaagaaacccaggagcaccgccttctcgttatcgcaaccgacgggggaaagcctgagttaaccggcactgtccaactcctaataaacgtgctggatgcaaacgataatgccccagagttcgataaaagtatttataatgtcagattgcttgaaaacgcaccaagcggtacgctggtgatcaagttaaatgccagcgacgccgacgaaggcattaacaaagagattgtttattttttcagcaatctcgttttggatgatgtgaagtcaaaattcatcataaatagcaacacaggagaaatcaaagtaaacggtgagctggactatgaagactataactcttacgaaatcaacatcgacgccatggataaatcgacctttccgttgagcgggcattgcaaggtcgtggtaaagcttcttgatgtcaacgacaacacaccagaaatggccatcactaccttgtttttaccagttaaggaagatgcacctctgagcaccgtgattgccttgatcagcgtgagtgacagagacagcggtgccaatggccaggtgacatgttcactgatgccccacgtgcctttcaaactggtgagcacttttaagaactattattctctggtcctcgattctgctttagatagggagtcagtgagcgtctatgagctggtggtgacagcccgtgatggaggcagcccctcgttatgggcaaccgcctctgtgtcagtggaagtcgcggacgtgaacgataatgcgccagcatttgcgcagccacagtataccgtttttgtgaaggaaaacaaccccccagggtgtcacatcttcacagttagcgcgcgagacgcggatgcacaggagaatgctctggtttcttattctctggtcgagaggcgcgtgggcgagagacctttgtcttcctatgtatcagtgcatgcagagagcggcaaagtctacgctctgcagccgctggatcatgaggaggtggaactgttgcaatttcaggtctccgctcgtgatgccggtgtgccaccccttggaagcaatgtaacactccaggtcttcgtcctggatgagaacgacaacgctccagccctgctggtgccacgggttggcggaactggcggtgccgtcagtgaactggtgcccaggagcgtgggcgctggacatgttgtggctaaagtcagggccgtcgatcctgactctggatataacgcctggctaagttacgaactgcaacccgcaccgggaagcgcaaggattcccttcagagtcgggctgtatacaggcgaaatctcgacaacccgctcccttgacgaaactgaggcaccaagacacaggctgctcgtactcgtgaaggaccatggggaacctccactgaccgccacggcaacagtgctggtgagcctggtggaaagcgggcaggcccctaaagcctcatctcgggcaagcgctggagccgtgggtccagaggcggcactcgtagatgttaacgtttaccttataatagctatctgcgccgttagcagcctgcttgtcctgaccttgcttctgtatacggccttgcgctgcagtgcccagcccacggaagccgtttgcacgcgcggaaaacccaccctgctgtgttctagcgccgtgggatcatggtcttacagtcagcagaggagacagagggtgtgttccggagaagcaccacccaaaacagatttaatggccttcagcccctccttgccccagggccctacgagtaccgacaatgtctccttccttattcttacctctatatttccttcccagttctcaaacatcaaatgtcatatccaccccctgttcctctatctgaagattatgtcttag

SEQ ID NO: 237299 - DNA, 2673 bp, Artificial Sequence
  Description of Artificial Sequence: Synthetic coding sequence
atggtgtatagcaggcgagggtccttgggtagcagactactgctcctttggctcctgctcgcatattggaaggctgggagtggccagttgcactacagcatcccggaagaggctaaacatgggactttcgtgggcaggatcgcccaggatctggggcttgaactagccgagctcgttccaaggttgtttagagtagcatctaagggacgtggtgacctgttggaagtgaacttacaaaacggtatcttgttcgttaattcccgtatagacagggaggaactgtgcagacgccgagctgagtgctcaattcacttagaggttatagtcgataggcccctccaggtatttcacgtggaagtcgcagtcaaggacataaacgataacccgcctaggttcagtaggcaggaacagcgcctttttattcttgaaagtagaatgccagatagccgcttcccacttgagggagcttccgacctggatataggggctaacgcacagctgcgatatcggctcaatcccaacgaatacttcgacctggacgtcaagactaacgaggaagagaccaactttctggaacttgtcttgaggaaatctttggacagggaagaaacgcaggagcatcgactgctcgtgattgcaacagatgggggaaagcccgaattgaccggcacggtgcagctgttgatcaatgtgctcgatgcaaacgacaacgcccctgagtttgacaagtccatttacaatgtgcggctgctggaaaacgcacctagcgggaccttagttattaagctgaacgcatccgatgcggatgaagggatcaataaggagatagtgtatttcttctctaacctggtgctggacgacgtgaaatctaagtttatcatcaactccaacacaggagagatcaaagtcaacggggagctggactacgaggattacaactcttatgaaatcaacattgacgctatggacaagagtacattcccactctccggtcactgtaaagttgtcgtgaaactacttgacgtgaacgacaacacccctgagatggccattacaaccctgttcctccccgtcaaggaagacgctcccctaagtacagtgatcgctctgatttccgttagtgatagggacagcggggcaaacgggcaagttacctgctctttaatgccacacgtgccatttaagctggtcagcacattcaaaaactactattcactcgtactggactcagctcttgaccgagagtccgtctcagtttacgaattggttgttaccgccagagacggcggttccccttccttgtgggccacggccagtgtgtcagtcgaagtagccgatgttaatgataatgccccagcgtttgcacagccacagtacacagtatttgtgaaagaaaataacccgcctggatgtcacattttcactgttagtgccagagatgccgacgctcaggagaacgcactggtttcatattcattagtcgagcgtagggtaggggagcgccctctgtcaagctacgtgtcagtgcatgccgaaagcggaaaagtctatgcgctccaacctctggaccatgaggaggtagagctgttacagttccaggtgtcagctagggatgccggtgtcccacccctaggtagcaatgtgactctgcaagtgtttgtcctagatgagaacgacaacgcccctgccttacttgtgccccgagtgggaggaaccgggggagctgtgagcgaactggtgcctaggtcagtcggggctgggcatgtggtggctaaagtgcgagccgttgaccccgatagtggatacaacgcctggctatcgtatgaattacagccggctccaggcagcgctcgtatccccttccgcgtgggactctatactggtgaaatctctacaacccgaagcttggatgaaacagaagccccacggcacagattgctagtcctcgtgaaagaccacggagagcccccattaaccgcaacggctaccgtcttagtctccctggtagaaagtggccaggccccaaaagcatcttcacgcgcttcagccggtgctgtcgggccagaggccgctttggtggatgtgaacgtctatctgatcattgccatatgtgccgtctcttcattgctggtgctgaccctcctgctgtacaccgctttgcggtgcagcgctcagccgactgaagctgtttgcactcgtggtaaacccacattattgtgttctagcgccgtcggttcgtggtcctatagtcagcagcgccgacagcgtgtatgctctggtgaggctcccccaaaaaccgacctgatggcatttagcccttctctgcctcaggggcctacctcaactgacaatcctaggcagcctaaccccgattggagatacagtgcatcgctaagggccggaatgcattcctcggtgcacctggaggaagcaggtatactgcgcgcagggccagggggacccgaccaacagtggcctactgtgtcaagtgctactcccgaacccgaagcaggtgaagtgtcgcctcctgtgggggctggtgtcaacagtaactcatggacatttaagtatggacctggaaaccctaaacaatccggacctgaacccaagaaacagacccaggtgtccttccttctacggagaaagggagaggccagccaaccccgtcagtag

SEQ ID NO: 237300 - DNA, 2811 bp, Artificial Sequence
  Description of Artificial Sequence: Synthetic coding sequence
atggtgtactcgcgaagaggaagcctcgggtctagacttctcctcctctggctgctgctagcgtactggaaggccggatcaggtcaactccactatagtatcccggaagaagccaagcacggcacgtttgttggccgaatcgcccaggatttaggtctggaactcgcggaactggtacctcgtctctttagggtcgcctccaaagggcgtggagaccttttagaggtgaatttgcagaacggcatcctctttgtgaacagccgaattgatagagaagaactatgtcgccgaagggctgagtgctcaattcacctggaggttatcgtcgaccggccactgcaggtcttccacgtggaggttgccgtcaaagatatcaatgacaatccaccacgcttttcccggcaagagcagcgactgtttatcctggagagccgtatgccggatagccgatttcccttagagggagcctccgacctggatattggagccaacgcccagcttcggtatagactgaaccccaatgagtattttgatctagacgtcaagacgaatgaggaagagacaaactttttggaactcgtgctccgcaaatccctggatagagaagaaacccaggagcatagactgctggtcatcgccacagacgggggaaagccagaattaaccggcaccgtccagctcttgatcaacgtgctggacgcgaacgacaatgctcctgagttcgacaagtccatctacaatgtgcggctcctagaaaacgcgccatcgggaacgctggtcattaagctgaatgctagtgacgctgacgaaggtatcaataaggaaatcgtctatttcttcagcaacctggtcctggacgatgttaagagtaaatttattattaactcaaatactggggagataaaggttaacggagagctggattatgaggattataattcctatgagatcaatatcgacgccatggacaagtctacctttcccctcagtggtcattgcaaggtggtagtgaagctgcttgatgtcaatgacaatacaccggaaatggccataactaccctcttcctgccagtcaaggaagacgcccctttgagtaccgttatcgccctcatcagtgtttccgacagagactcaggtgcgaacggacaggtaacatgctcgctaatgcctcatgtcccatttaagctcgtcagtacattcaaaaactattacagcctagtgctggatagcgcgttagatcgggaaagcgtttcagtgtacgagttagtagtgacggcgcgagacggcggatctccgagcctttgggccacggcgagcgtcagcgtcgaagtggctgatgtgaatgataatgcacccgcatttgctcaaccacagtacaccgtgttcgttaaagaaaacaatcccccaggttgtcatattttcacagtctctgcgcgtgacgctgatgcccaggaaaatgcgctcgtttcctattccctagtggagcgacgggtgggcgaacggcctttgtcatcatacgtgagcgttcatgcagagagtggcaaagtctatgctctccagcctctggaccacgaggaggtcgagctgctccagttccaagtcagcgctcgcgacgcaggggtgcctccgttaggatctaacgttaccctccaagtgttcgtgttagacgagaacgacaatgctccagcgttactggtaccacgcgtggggggaacaggtggggctgtcagcgaacttgtgcccaggtccgttggagccggacacgtagtggctaaagtcagggccgtagaccctgatagcggatataatgcttggctgtcctacgaactgcagcctgctcctggctcagcgaggatcccttttagggtgggtttgtacacaggagaaatcagcacgaccagaagccttgatgagacagaggccccaagacaccgactcctggtactggttaaggatcacggcgaaccccctctgaccgccactgccaccgtgttggtgtccttggtggaatcaggtcaggctcccaaggcgtcttccagggcttcagctggagctgtggggccagaggcggcactggtggacgtgaacgtgtacctcataatcgccatctgcgccgtgtcatcactgctggtgcttacactgctcctttacacagctctgaggtgcagtgctcagcctaccgaggccgtctgcactagagggaagcccacattgctgtgtagcagcgccgtaggctcttggtcgtattcacagcagcgccgtcagagggtgtgctctggggaagcgcctcccaagacagacctgatggcattctcacccagcttgcctcaaggtcccacatctactgacaaccctcggcagcccaaccctgactggcgatattccgcttccctgagggctggtatgcatagttcggtccatctggaggaagcagggatcttgagggccggtcccggtggacctgaccagcaatggcctacggtgagcagtgcaacaccagagcctgaggccggagaagtgagccccccagtcggcgcaggggtaaattccaacagttggacctttaaatatgggccaggcaacccaaagcagagcggacctggcgagctccctgataagtttatcattcctggctcccctgccataatttcgatcaggcaggagccaaccaactctcaaattgacaagtctgacttcatcacatttggcaaaaaagaagaaacgaagaagaaaaagaaaaagaagaaaggcaacaagactcaggagaagaaagagaaaggtaactctaccaccgataatagcgatcagtag

SEQ ID NO: 237301 - DNA, 2061 bp, Artificial Sequence
  Description of Artificial Sequence: Synthetic coding sequence
atggtttttacccctgaggaccgtttgggaaaacagtgtctgcttctgcccctgctcctgttggctgcctggaaagtcggaagtggccaactccactactcggtgccggaagaagcaaagcacggcacatttgttgggcgtatcgcgcaggatctaggccttgagttggctgagctcgttcctcggctgtttagaatggcatccaaggaccgcgaggacctgctggaggtgaaccttcaaaacgggatactgttcgtgaattcacgcatcgacagggaggaactgtgtggaagaagcgctgagtgctcaatccatctggaggtgatcgtggaccggcctctccaggtatttcacgtggacgtcgaggtgagggatattaatgacaaccccccactctttcctgtggaggagcagcgggtgttaatttacgagagtcgtttgccggactccgtcttcccactggagggagcgagcgacgctgatgtcggcagcaattcaattctgacatataagttatctagctcggaatattttgggctggacgttaagattaactccgacgataataagcagattggcctcctcctcaaaaaaagcctggatagagaggaagctcctgctcacaacctctttctgacagcgacagacgggggaaagccagagcttaccgggactgtgcagctgctcgtcactgtccttgacgtgaacgataatgctcctaccttcgagcagtcagaatacgaggtgaggattttcgagaatgcagataacggcaccaccgtgattcggctgaacgcctccgatcgggacgaaggggctaacggagctatctcttatagctttaactctcttgtggccgcaatggttattgaccacttcagcatcgatcgaaataccggtgagatcgtcatccgcggaaacctggacttcgaacaggaaaacttatacaaaatccttattgacgcaacagacaaagggcaccctcccatggctgggcattgcactgtcctggtgcgcatcttggacaaaaatgacaacgttccagaaattgccctgaccagtctgagccttcctgtgcgtgaggacgcccagtttgggaccgtgatcgcccttatctccgtcaacgacctggattctggagcaaatggccaggttaattgcagcttgacgccccacgtgccctttaaactcgtgtccactttcaagaactactactctctggtgctggattccgctcttgatagagagagcgtgagtgcttacgagctggtggtgacagccagagacgggggtagcccgagtctgtgggccaccgcctctctttccgttgaagtggccgacatgaatgacaatgcccctgcctttgcacagcctgagtacaccgtctttgttaaggagaataacccccctggctgccatattttcactgtttctgcgcgagacgcagatgcacaggaaaatgcccttgtctcatattctttggttgaaagaagagtcggtgagcgcgcactctcgtcctacatctccgtgcacgccgagtctggtaaagtatatgccctccagccacttgatcacgaggagctggagctcctgcaattccaaccccgacagcctaacccggattggagatactctgcaagtctgagggctgggatgcactcctctgtacaccttgaggaggcgggaattctgcgcgctggtcccggagggcctgaccagcagtggccaaccgtctctagtgcaacaccagagcctgaagcaggtgaagtgtctccacccgtcggcgctggagttaattccaacagttggacatttaagtatggcccagggaaccccaagcagtcaggccctggagagctgccggataagtttatcattcctgggagccctgcgatcatttcgattcgccaggagccaaccaattcacaaatcgataagtccgattttatcacttttgggaagaaagaagagactaaaaaaaagaaaaaaaaaaagaaagggaacaagactcaagaaaaaaaagagaaaggaaattcaacaacagataactctgatcaatag

SEQ ID NO: 237302 - DNA, 2853 bp, Artificial Sequence
  Description of Artificial Sequence: Synthetic coding sequence
atggtgttcacgcccgaggatagactggggaaacagtgcctgctcctgccgttgctactactcgccgcttggaaggtgggctcaggccagctacactattctgtgcctgaggaggccaaacatgggactttcgtgggcaggattgctcaggaccttggactggaactggcggagctcgtccctaggctttttagaatggccagtaaggacagagaggacctccttgaggtgaacctccagaatggtattctctttgttaacagtagaatcgatcgagaagaactgtgtgggagatctgcagagtgttctatccatttggaggtcattgtagataggccactgcaggttttccacgtagatgtcgaggtgcgcgatatcaacgacaacccacctctgttccccgtggaagaacagcgggtgctgatctatgagtcccgattgcctgacagtgtctttcctctggagggcgcttccgatgccgacgtggggtcgaacagcattctgacttataaactaagtagtagcgagtatttcgggctcgatgtgaagattaactccgatgataacaagcagattggtttgctattgaagaagtccttggatcgcgaggaagccccagctcacaacctcttcctgactgctacggacggaggcaagccggagttgactgggactgtccaactgttggtcactgtgctggatgtaaatgacaacgcccctacctttgagcagtctgaatacgaagtgaggatatttgaaaacgccgacaacgggactaccgtaataaggctgaatgctagcgacagggacgaaggggcaaacggtgcaattagttatagttttaatagcttggttgccgctatggttattgatcacttctctattgaccggaacactggtgagatagtgataagagggaatctagattttgaacaggaaaatctgtataagattctgatcgatgctacagataaaggtcacccacccatggccggacactgcactgttctggtgcggatactggacaagaatgataacgtgcctgagatagctttgactagtctgtccttacccgtgagggaggatgcacagtttggcacagttatcgctctgatttcagtgaatgatctggacagcggagccaatggtcaagtgaactgcagtctgaccccgcatgtaccgttcaaactcgtttccaccttcaaaaattactactctctggtgcttgatagcgccctcgaccgcgaaagcgtgtcagcctacgagctggttgtgaccgccagagacggagggtcacccagtctgtgggccacagccagtcttagcgtggaggttgcggacatgaacgataacgctccagcattcgcccaaccggagtatacagtgtttgtaaaagagaataatccaccgggttgccatatctttacagtgtccgccagggacgccgatgcgcaggagaacgccctggtgagttatagccttgtggagagaagagtcggtgaacgggcactgtccagttacatttctgttcacgccgaatccgggaaggtctacgccctgcaaccactggatcacgaggagttggaactgcttcagttccaggtgagcgccagagacgctggggtgcctcctctggggtcaaatgtgaccctccaggtatttgtgctggatgagaatgataacgcaccagcgctgctcgcacccagggtggggggaaccgggggtgccgtgagcgaactcgtgccgaggtccctgggagcaggccaggttgtggctaaagtgcgcgcagttgacgcagatagcgggtacaacgcctggctgtcctacgaacttcaaccccctgctagtagcgctcggtttccattcagggtgggcttgtataccggggagatttctacaactcgcgtcctcgatgaggctgacagccctaggcaccgcttgctggtgcttgtgaaagaccacggcgagccagcattaactgcaaccgcgaccgtgctggtgtctttggtggaatctgggcaggcccctaaggcctcgtctagggcctctgtaggggctgcaggtccagaagctgctctggtcgatgtgaacgtctatctaataattgcaatctgtgccgtttcctctttactggtgctgacccttctgctgtataccgccttaaggtgttccgcgccaccgacggaaggtgcgtgcactgccgataaacccacactggtctgttcttctgctgtggggtcctggtcatattcacaacagaggcggcagcgggtgtgcagcggtgaagggccaccaaagatggacctcatggccttctcaccctcgctaagcccctgcccaatcatgatgggtaaggctgagaatcaggaccttaatgaagatcacgatgcaaagcccaggcaacccaatcctgattggaggtattccgcctccttacgcgctgggatgcactcctccgtccacttggaggaagcagggatcctaagagcagggcctggagggcctgaccaacagtggcccaccgtctccagcgccacacccgagccagaagcgggagaagtgagcccaccagtgggagctggcgttaatagcaattcatggacattcaagtatggtcccggaaatccaaagcaaagcgggcctggtgaactccctgacaagtttataatcccaggatcgccagccatcattagcattagacaggagcctactaacagtcagattgacaagagcgattttatcacatttggcaaaaaagaagagacaaagaagaagaaaaaaaaaaagaagggtaacaaaacacaggagaaaaaagaaaaaggaaacagtactactgacaatagcgatcagtag

SEQ ID NO: 237303 - DNA, 2370 bp, Artificial Sequence
  Description of Artificial Sequence: Synthetic coding sequence
atggtgtgccccaatggctacgatccgggaggtcgccatctccttctgttcattatcattttggctgcctgggaggccggaaggggacagcttcactattcggtgcctgaagaggcaaaacacggaaacttcgtaggcaggattgcacaagatctgggattggaactggccgaacttgttcccaggttgtttagggctgtgtgtaagtttagaggggatctgttagaagtgaacctgcaaaacggcatcctgttcgtgaactcccgcatcgaccgggaagagctttgcgggaggagcgcagaatgcagcattcacttggaagttatcgtcgagcgccctttgcaagtattccacgttgatgtcgaggtgaaagatattaacgacaaccccccagtgtttcctgccacccagaggaacctctttatcgccgagtcgagacccctcgattctcgctttcctctagaaggcgcatccgatgctgacattggtgagaatgccttactgacttaccgccttagcccgaacgagtacttctttctggacgtgcctactagcaatcagcaggtgaaacccttagggctggtattgcggaaactgttggatcgggaggagacacccgaactccacctactcctgactgctactgacggtggcaagcccgagctgaccgggactgtgcagctgctcatcacagttctggataataacgacaatgcgccagttttcgatagaaccctgtacacggtcaaacttcctgaaaacgtctccattggcaccctggttatacacccaaatgcttcggatctagatgaggggcttaacggtgacattatctactctttctcatctgacgtgagtccagatatcaaaagcaaattccacatggatcccctgtccggggcaattactgtgataggacatatggattttgaggagtctagagcacataagatccccgtagaggccgtagacaagggcttccctccactggcgggacactgtactgtgctggtcgaagtggtggacgtaaacgataatgctcctcaactcacactaaccagcctgtcccttcctattccagaggacgctcagccgggaactgttatcacacttatctccgtctttgaccgcgattttggtgttaatggccaggtgacatgttctctcacccctcgggtgcctttcaaattggtatccacatttaagaattattacagccttgtactagattccgcactggatcgcgaaagcgtgtcagcatacgaactcgtggttacagcccgagacggagggagcccgtcgctttgggcaacagcttctgtgtctgtggaggtggcggacgtgaatgataacgctcctgccttcgcccaaccggaatacactgtgttcgtgaaagaaaacaatcccccaggctgtcacatttttacagtcagcgctggtgacgctgacgcccagaagaacgctttagtgtcttactctcttgttgagctacgggtcggtgaaagggcactatcctcttatgtctcagtccatgccgagtccgggaaagtctacgcactccagcccttggaccacgaagaactggagctgctgcagttccaggtgtccgcgagagatgctggggtgccaccactgggaagtaacgttacactccaagtgttcgttttagatgagaatgataacgccccagcacttcttgcccctagagtgggaggaactggaggcgcagttcgggagttagtgcccaggagcgtgggggctggtcacgtggtcgcaaaagtgcgggctgttgatgctgattccgggtataacgcctggctctcctacgagctgcagccagtcgctgctggcgcttctattccttttagagtggggctttacacaggagagatcagcacgactcgagccctggacgagacagacgccccaagacataggctactggtgctggtgaaagaccatggggaaccctctctgaccgccaccgcaaccgtcctggttagcttagttgagagtggtcaagcaccaaaagcctcgtctagagcctcattaggtattgctggcccagaaacagaattggtggacgttaacgtgtatctaatcatcgccatctgcgctgtctcaagtcttttggtgcttaccctgttgctctacacggccctgaggtgctcggcaccttcttccgagggggcttgttcacttgtgaaacctactctggtgtgcagcagcgccgtggggagctggtcattttcacaacagaggagacagagggtctgttccggagaaggacctcccaagacggacctgatggccttctctccgtcactgcctcaggggccatcatcaacagataatgtgtcacacaagtag

SEQ ID NO: 237304 - DNA, 2814 bp, Artificial Sequence
  Description of Artificial Sequence: Synthetic coding sequence
atggtctgtcccaatggatatgacccaggaggcagacacctgctgctgtttattatcatcttggccgcatgggaggcgggacgcggacagcttcactactccgtacccgaggaggctaaacacggaaacttcgtagggcgtatcgcccaggaccttgggctggagctggccgagctggtgccccgtctgttccgtgcagtctgcaagttcaggggggacctcctggaagtgaacctacagaacggtattctgtttgtaaactcccggatcgacagagaggagctatgtggacgctcggcagagtgcagtattcacttggaggtaattgttgaacgccctctgcaggtatttcatgttgatgtcgaggtaaaggacataaacgacaatccacctgtgtttcccgctacacagcggaacctgttcatcgcagagtctcggccactggacagtcggttccctctggaaggcgctagcgatgctgatatcggcgaaaatgctctgctgacttatagactgagccccaatgaatacttctttcttgatgtgcctacctctaaccaacaggtgaagcctctgggcctggtacttaggaaacttcttgaccgcgaagagacccccgaacttcacctgttgctaaccgccaccgacggcggtaagcctgaactcaccggtactgtgcagctactgattactgtccttgataacaatgacaatgctcccgtgtttgaccgcaccctctacacagtgaaactcccggaaaatgtttccattggaacgttggtcatacacccgaatgcctccgatcttgatgagggacttaatggcgacatcatatattccttcagttccgacgtcagcccagatattaagtcgaagttccatatggatcctctgtccggcgcaatcaccgtaattggacatatggatttcgaggaatcccgggctcacaaaattccagtcgaagccgttgataagggctttcctcctttggcaggccattgcaccgtgctggtcgaggtggttgacgtgaacgacaatgctccccagctgacacttacaagtctaagcctgcctattcccgaggatgctcaaccagggacggtgattacactgatctcagtgtttgatagagactttggcgtcaatggacaggtgacctgctcactcacccccagggtcccttttaagctggtttcgactttcaagaactattactcattggtcctggacagtgcattggatcgcgagtctgtcagcgcctatgaattggtggtgaccgcccgtgatgggggatccccctccttgtgggccaccgcctctgtaagtgttgaggtggccgatgtgaatgataatgccccagcattcgcccaacccgagtacacagttttcgttaaggagaataacccccctggctgccatatttttaccgtgagcgccggtgatgctgacgctcagaagaacgccctagtgagttacagcctagttgagctccgggtgggcgagagggccttatcttcttacgtgtctgtgcatgctgaatcaggcaaggtgtatgctcttcagcccctggatcacgaggaactggagctgctccagtttcaagtttcagctagggacgccggtgtccctcctctgggatctaacgtcaccctgcaggtatttgttctggacgagaatgataatgctcctgctctgctggcacctagggtgggaggcacagggggtgccgtccgggaactagtgcctagaagcgttggagccggacacgtggtggctaaagtgagggcagtggatgccgacagtggatacaacgcatggctgtcctatgagctgcagccagtggctgctggcgcaagcatcccttttcgcgtggggctgtacaccggcgagatttccactacacgggcactggatgagacggacgccccacggcatagactcctggtactggtcaaagaccatggcgagccctccttaactgccacagctacagtcctcgtctctctcgtcgagtctggtcaagcacccaaggcctcatccagggcaagtctcggaattgcaggtcctgagaccgagctggttgacgttaacgtgtacctcatcattgctatctgtgcagtaagctcgcttctggtgctcacgctgctgttatacaccgcccttcgctgttcggcacccagttctgagggcgcatgttccttagtaaaaccaacgctcgtgtgctccagtgcggttggatcctggtctttcagccaacagcgccgacagagagtgtgctccggtgaggggccacccaaaacagacctgatggcgttcagcccttcgctgcctcagggaccgagcagcacagataatccacggcaacccaaccctgactggcgatattctgcctccctgagagctgggatgcatagttctgtgcaccttgaggaggcgggtatcctgcgggctggtcccggaggtcctgatcagcaatggcctacggtctcttcggcaacgccagagcctgaagcgggtgaagtttccccaccagtaggcgctggcgtcaattctaacagctggactttcaaatacggtccaggtaaccctaagcagtccgggcctggtgaattgcccgataagttcatcattccaggttctccagccatcatttcaatccgccaggagccgaccaactcacagatagacaaatcagattttattacttttgggaagaaggaggaaaccaaaaagaagaagaagaagaaaaagggtaataaaactcaggagaagaaggagaaaggcaactctacgaccgacaattcggaccaatag

SEQ ID NO: 237305 - DNA, 2445 bp, Artificial Sequence
  Description of Artificial Sequence: Synthetic coding sequence
atggattatcattggcggggagaactcgggtcctggcgtcttttactcctactgctgttactagccgcttggaaggttggctccggccagcttcactactccgttcccgaggaggccaagcatggcacattcgtcgggcgaattgctcaggacctgggactggaattagcggagctggtgccaagactgtttcgggtggcatcaaagcgccatagggacctgctcgaagtgtcccttcagaacgggatactgttcgtaaatagtcgcatcgacagagaagagctgtgtggccgaagcgccgaatgtagtatacatttggaggtcattgtagacagacctctgcaggtgtttcacgtggacgtggaggtgaaggatgtgaatgataatcctccggtgttccgcgtgaaggatcagaaactttttgtgtccgagagtagaatgcccgacagccgatttcctctggagggtgcctcggatgcggacgtgggggctaattccgtgctgacttataggctcagctcccacgattactttatgctcgacgtgaattcaaaaaatgatgagaacaagctcgttgagcttgttttgaggaagtcactggatagggaggatgcgcctgctcatcatctgtttctgaccgctaccgatgggggaaagcctgagctgacgggaacagtgcaattactggtgacagtcttggacgtcaatgacaacgctcctacgtttgagcagtccgagtatgaggtgcgcattttcgagaatgccgataacggaacaaccgttatcaagcttaatgcctctgatcctgacgaaggggcaaatggcgctatttcttacagcttcaacagcctcgtggaaacaatggtgatcgatcatttttccattgatagaaacactggcgaaattgtgattcgcggtaatctggacttcgaacaggagaatctctataagatcctgatcgatgcaaccgacaaaggccacccccctatggctggacactgcaccgtcttggtgcgcattctcgataaaaacgataatgtccccgaaatcgccttgacatctctttccctcccagtgagagaggatgcacagttcggaaccgttattgcactcatcagcgtgaatgatctcgattctggagctaacggtcaggtcacctgttctctcatgcctcacgtccccttcaagctcgtctctaccttcaaaaattattacagtctcgtgctggactcggccttggatagggagagagtcagtgcatatgagttggttgtcacggcgcgagacgggggatcaccaagcctgtgggcaacagcctccttgtccgttgaagttgccgacgtcaacgataatgcgcctgctttcgcacaacctgagtatacggtcttcgtgaaggagaataatccacccggatgccacatcttcacagtgtcagctagagacgccgatgcccaggagaatgctctcgtctcttattctctagtggaacgaagggtaggcgaaaggtccctgtcgtcttatatttcagttcacactgaatccggcaaagtctacgccctacagccattagaccatgaagagctcgagctactgcagttccaggtctctgccagagatgcaggcgtgcctcctctgggttctaatgtgacactgcaggtgtttgtcctcgacgagaatgacaatgcccctgccctcctagagccgcgagttggcggaacgggtggggcagcttcgaagcttgtgcccaggtccgtcggcgctgggcacgtggtggctaaagtgagagcagttgacgccgactctggctacaacgcctggttaagctacgagctacaaccagccgctagcagcccacgaattccctttcgggtggggctctacaccggcgagattagcacaacccgcgtgctggatgaggcagactcacctcggcaccggctgctggtgctcgtcaaagaccacggagagccggcattaacggcaaccgctacagtcctcgtttcacttgtggaatcaggacaggcccctaaagcgtcctcacggcagtctgctggtgtgctgggcccagaggctgccttggtggatgtcaatgtttacctcattatcgctatctgtgccgtttcttcgttgctggtgctgactcttctgctgtataccgcactcaggtgctccgcgctgcccactgaaggcggatgtagagccggaaagccaaccctggtgtgttcctccgcagtaggttcctggagttacagtcagcagcagccccaaagggtttgttcaggtgaaggaccacctaagaccgacctaatggccttctcaccatgtctgccgcctgacttagggtcagtggatgtcggcgaggagcaagatcttaatgtagaccacggactgaaagttagcccattcaaattccggacgcataaattttatctgtggaagctgtag

SEQ ID NO: 237306 - DNA, 2853 bp, Artificial Sequence
  Description of Artificial Sequence: Synthetic coding sequence
atggactaccattggcgcggagagctgggttcttggcgactcttactgctgctgctccttctcgctgcctggaaggtaggatctggccagctacattactctgttcctgaagaagccaaacacggaacgtttgtagggagaatcgcacaagatctcggattggaactggccgaattagttcccagattgtttagagtggcatcaaagaggcaccgggacttgctggaggtaagtctacagaatggtatcctgtttgtgaattcccggattgatcgcgaagaactgtgcgggagatccgccgagtgctccattcatctggaggttatcgtggaccgtccgctgcaggtgttccacgtggatgtggaagtgaaagatgtgaacgacaaccctcccgtcttccgggtcaaggatcagaagttatttgtaagtgaatctcggatgcccgattcaaggtttcccctcgagggtgcgtccgatgcagacgtaggagcgaactccgtgctgacctatcgtctaagctctcacgactatttcatgcttgacgtgaactcaaagaatgatgagaacaaattagtagagctggttttgagaaagagtctggatcgggaggacgcacccgcacatcatctgtttcttactgcaaccgacgggggaaagccagagttaacagggaccgtgcagcttctggtgactgttctggacgtgaacgataatgcgccaacatttgaacagagcgagtacgaggtgcgaatatttgagaacgctgacaatggcacaactgtgataaaactgaatgcctccgatcccgatgaaggtgctaacggggctatttcgtatagctttaactcgctcgtcgagactatggtgatcgaccatttttccattgataggaacacaggcgaaatcgtaatccgcggaaatttagatttcgaacaggagaatctgtataaaatcctgatcgacgccacagataaaggtcaccctccaatggccggtcactgtactgtcttagtaagaattttagataaaaacgataacgtacccgaaatcgcactgacaagcttgagcctgccggtgcgggaggacgcgcaatttggaacagtaatcgcactgattagcgttaacgaccttgactctggagctaatggacaggtgacctgctcgctcatgccccacgtaccgtttaagctcgtctccacttttaagaactactacagcctggtgctggatagtgccctggaccgagaacgagtgtccgcatatgagctggtggttacagccagggatggcggatccccttctctgtgggccacagcgtcattatcggtcgaggttgccgatgtcaacgacaacgcccctgcattcgctcaaccggagtatactgtgttcgttaaagagaataatccacctgggtgccatatcttcacggtcagcgccagggacgcggacgcgcaagaaaacgccctggtgagctacagcctggtcgaacggagggtgggtgaaaggagtctgtcttcttacatatccgtgcacaccgaatctggcaaggtgtacgccctgcagccactagatcacgaagaactagagctgcttcagttccaagtgagtgcccgagacgccggagtgcctccgctaggaagtaacgtgacgctgcaggtcttcgtcttagacgaaaacgacaatgcaccggcacttttagaaccgcgagtcgggggaaccggaggagcagcttcaaagctcgttcccagatctgtcggcgctggccatgtggtggctaaagttagggcagtggatgctgacagtggatataacgcctggctgtcgtacgagctccagcctgccgcaagctccccaaggattccctttcgcgtgggattatacacaggcgagatttctactacgcgggtgcttgatgaggctgacagtccaagacacagacttcttgtgttagtcaaagaccatggggaaccagctttgacagccactgcaacggtccttgtttcactagtggagagtggacaggcgccaaaggcgtccagtcggcaaagtgctggggtcctcgggcctgaggcagccctggtggacgtgaacgtttacctcatcatcgccatttgtgccgtctcctctttacttgttctaaccttgctattatacactgcccttagatgcagcgcgctgcccacagagggtggatgccgcgcaggcaagcccactcttgtttgcagcagcgcggtgggcagttggtcatatagtcaacaacaaccccaacgggtctgttcaggcgagggaccacctaagactgacctgatggccttctctccctgtttgcccccagatctgggcagtgtggatgtcggggaggagcaagatctgaatgtcgaccatggcctgaagccacggcagcctaatccggattggcgttactcagctagcctgcgggctggtatgcacagtagcgtacacctcgaggaagcgggaattctcagagcgggaccgggagggccagaccaacagtggccgaccgtctccagcgccacccccgaacctgaggcaggggaagtctcgccacctgttggggctggggtaaacagtaattcatggaccttcaaatacggacctggaaatcccaagcaatccgggcctggtgagctcccagataagttcatcattcccggaagccctgctattataagtattcgccaggaaccaaccaattcccagatagataaaagtgactttattactttcgggaaaaaggaggaaactaagaaaaagaaaaaaaaaaaaaagggcaataagacccaggagaaaaaggagaagggcaattctacaactgataacagcgatcagtag

SEQ ID NO: 237307 - DNA, 2529 bp, Artificial Sequence
  Description of Artificial Sequence: Synthetic coding sequence
atgctgtactcttctcgtggtgatcctgaaggacaacccctgctgctaagcttgcttattctcgccatgtgggtggtcggatccgggcagttgcattacagtgtccccgaagaagccgaacatggcacctttgtcggtcgaatcgctcaggatctgggacttgaattagccgaattggtacctcggctgtttcaactggattccaagggacggggagacctgctcgaggtgaacctccagaacggcatcctgttcgtgaattcacggatcgaccgcgaggagctgtgcggtcgctccgctgaatgtagcatccatcttgaagttatagtggataggcccttgcaagtgttccacgtggatgttgaggtcaaggacattaatgacaacccaccggtctttccggctacccaaaagaatctgttcatcgccgaatcccggccactggattctcgattccctttagaaggcgcatccgatgctgacattggagagaacgccctgctgacctaccggctttcccctaatgagtatttcttcttggacgtcccaacctccaaccagcaagttaaaccactggggctggttctgcgcaagctgttggacagggaagaaacccctgagctccatctgctactcaccgctaccgacggcggaaaaccagaactaaccggaacagtccagctgcttattactgtcctggataacaacgataatgcccctgtgtttgaccggactctgtatacagtcaaactgccggagaatgtttcaatagggaccctagtcatacacccaaatgcatcagacttggacgaggggcttaatggcgatattatatatagtttctcatcagatgtaagcccagacatcaagtctaaattccatatggatccgttgagcggcgctattacggtgatcggacacatggattttgaggaaagcagggcacacaaaatacctgtcgaagctgtggataagggcttcccaccactcgcaggccactgcactctgttggtcgaggtggtggacgtgaacgacaatgcacctcagctcaccatcaaaactttatctgtgcccgtgaaggaggacgcccagttaggaactgtaatagctctcatctctgtgatcgacctggatgccgacgcaaatggccaggtcacatgtagtctgaccccacacgtgccctttaaacttgtctcaacctacaaaaattattatagtctggtgctcgacagagcacttgaccgcgaaagcgtttcagcctacgaactcgttgtaactgcgagagatgggggttcaccttcgctgtgggccaccgcccgagtgagtgtcgaggtcgctgacgtcaacgacaatgctcctgccttcgctcagtctgaatatacagttttcgtcaaggagaataaccccccaggttgtcatatatttacagtctctgctcgcgatgcggatgcccaggaaaacgcactggtaagttactcactcgttgaaagaagacttggggaacgcagcttgagttcctatgtgtctgtgcatgccgagtcagggaaggtatacgctctacagcccctggatcacgaggaactggagctgctccagttccaggtaagcgctcgcgacgccggtgtcccaccactgggcagtaatgttacactgcaggtcttcgtgttggacgagaacgataacgcgcctgccctgctaacccccagaatgcgcggtaccgacggcgcagtctcagagatggtcttgagaagcgtcggcgctggggtagtcgtggggaaggtccgtgccgttgatgccgactctggatataacgcttggctgagctatgagttgcagcccgagacggcctccgctagcataccattccgggtgggtctgtatacaggcgaaatcagcactacccgagccttagacgagactgacgcacctcgccaaagactgctagtgctcgttaaagatcatggggagcccgctctgaccgcgaccgctaccgtgttggtgtcgctggtcgagtccgggcaggcaccgaagagttcatcccgcgctagtgtcggcgctaccgggcctgaggtgaccttagtggacgttaatgtatacctgattatcgccatttgcgccgtgtcatcgttgctcgtgttaacactgctgttgtatactgtgctcagatgtagtgccatgccaaccgaaggcgagtgcgcaccaggaaaacccacactggtttgtagctctgcggtggggtcatggtcatattcccaacaaagacgacagcgtgtgtgcagtggggaaggcaagcaaaagacggacttgatggccttcagccccggtctcagtccctgcgctggcagcacagaaaggacaggggaaccttctgcatcaagtgacagcaccgggaaggtcggtttttcttcaatactgttcatttatatcatctttttccttgagcgatactaccgcctcctgcctggggctgtgcagatcgttctgttcatttttctggagatacagcagatcttctttctgattaagtag

SEQ ID NO: 237308 - DNA, 2853 bp, Artificial Sequence
  Description of Artificial Sequence: Synthetic coding sequence
atgctttatagctccaggggggatccagagggacaacctttgctgctgtccctcctgattctcgccatgtgggtggtgggatccggacagctgcattacagcgttcccgaggaagccgaacacggcacattcgttgggaggatcgcgcaggatctcgggcttgaactggctgagctcgtccccagactctttcagctcgacagtaaggggagaggcgacctgctagaggtgaacctacaaaacggaatactgtttgtaaattcaagaattgaccgggaagagctgtgtggtcgatccgccgaatgcagtatccacctcgaggtcatcgtggacagacctctgcaggtgttccatgtcgatgtggaagtcaaggatatcaacgacaatcccccagtttttcctgccacacagaagaacctcttcattgcggagtcgcgccctctcgatagccgattccccctcgagggtgcctcagatgccgatatcggagagaatgctctgttaacttatcggttgagtcccaatgaatattttttcctggacgtgccaacatctaatcagcaagtaaagccccttggcctggtgctgagaaagcttttagaccgtgaagaaactcctgagttgcatctcctgttgactgccacagatggtggcaaacccgagctgaccgggaccgtgcagctgttgataacagtgctggataataatgataacgccccagtctttgaccgcacactgtacaccgtgaaactgcctgaaaatgtgtccatcgggactctggttattcaccccaacgcatcggatctggacgaaggcctcaatggcgacatcatctatagtttctcatctgatgtctcgccagacattaaaagcaagtttcacatggacccgctctccggggcaatcacagtgatcggacacatggactttgaagagtctagagctcataagatcccagtggaagccgtggacaagggttttcctcctcttgccggacactgtactcttctggtcgaggtcgtggatgtcaatgacaacgcaccccaacttacgattaaaaccctcagcgttccagtcaaggaagatgcgcagttaggcacagtcatcgcactgatcagtgtcatcgacctggatgctgatgcaaacggccaggtgacgtgcagccttaccccacacgtgcctttcaaactggtcagtacctacaaaaactattattccctggtgctagaccgcgctctggatcgcgagagcgtaagtgcatacgagctcgtggtcacggccagagatggcggaagcccaagcctctgggctactgcgagggtgtcagtggaggtggccgatgtcaacgataatgcacccgcttttgcccagtctgagtataccgtgttcgtgaaggagaataatccccctggttgtcacatatttacagtgtctgcccgtgacgctgacgctcaggagaacgcgttggtgtcctactccctggttgaaagacgcctgggagagcggagtctgagcagctatgtgtctgtgcacgctgagtctggaaaagtgtacgccctccagccgttggatcacgaggagctcgaacttctgcagtttcaggtgtctgccagagacgccggagtgcccccattgggtagcaatgtcaccctccaggtcttcgtccttgacgagaatgacaacgcccctgcactacttacccctcgaatgaggggtaccgacggagcagtgagcgaaatggtactgaggtctgtcggagctggcgtggtggtcggaaaagttcgcgcagtagatgctgacagtggttacaacgcctggctgtcctacgaactgcagcctgagacagcaagtgcttctatccctttccgcgtaggcctctacaccggagaaatctcgacgacccgggcactggatgagacagacgctccaagacaaaggctgctggttctcgtgaaggaccacggagaacccgcattgaccgccacggcgactgttctggtgagcctggtggaatccgggcaggctccaaagagctcctcaagagccagcgtgggggctaccggccctgaggtgactttggtggacgttaacgtctatctgatcatcgccatttgcgcagtgtccagcttgttggtgctgactctgctgctctacaccgtgcttaggtgttccgcgatgccgaccgaaggcgaatgtgccccaggcaagccgactctggtgtgtagcagtgccgtgggctcctggagctactcacagcagcgtagacaacgggtctgttcgggagaaggaaagcagaagactgacctcatggcatttagcccaggtctgagtccctgcgctggaagcacagagcgcacaggcgagccttcagcctcttctgatagcaccgggaagcccagacagcccaatccggattggaggtattccgcctcgctgcgtgcaggcatgcactcgagcgtacacctggaagaagccggaatcttgcgagcgggaccgggaggcccagatcagcagtggcccacagtgagcagtgcaacaccagaaccagaagctggggaagtgagtcctccggtaggagcgggagtcaacagcaacagctggacctttaagtacggccctgggaatccaaaacagtccggcccaggcgaattgcccgataaattcataatcccaggcagcccagctattatcagtatacgtcaagaaccaacaaattcacagattgacaaatctgactttatcacttttggcaagaaagaagagaccaagaagaaaaaaaaaaagaagaaaggaaataagacccaggaaaagaaggaaaaggggaactccaccactgacaacagtgaccagtag

SEQ ID NO: 237309 - DNA, 2892 bp, Artificial Sequence
  Description of Artificial Sequence: Synthetic coding sequence
atggtcggttgtggcgtcgcagtactgtgcctctgggtgagctgtggggcagccgcaggtcagctggaatactccgtacctgaggagacagaaagaggcgtggccgtcggcaacctttcagctgatctaagattgcctgcggcagccatgagctctagaaacttcaggttcctctcttcgcaccgggagttgtactttggggttgatcttccgtccgggaacctggtcgtccgagagcctgccgacagagagcagttatgtagggctaaagctgcgtgtgtgttgacttacgacttggttctggaagacccgttagagttacataagattcggattcacgtcctcgacacaaacgacaacagcccgctgttccccgctggcgacgtgcagcttcatattccggaattcctcactcctggcgctaggtttacactgcccaatgcccaggatgatgatgagggttcaaatggtatcctctcatactccctcagcccatcccagcactttcggttggatatgggatctcgtgtggacgggtcggaatatcccgagttggttctggagaaagcactggacagagagcagagagcaacacacttactcgtcctcacagccagagacgggggactaccagcccgttccggcgatgcacaggtgaccataattgtggtggacacaaacgacaatgcacctgtttttgaaagatcagtctaccggaccaaggtcccggagaccgcacccaatgggaccgtgttattccgagtgcaggctctggatccggacgaggggtctaacggggaggtccagtacagcttatccaattctactcaggcagaactacgccatagatttcatgtgcacccaaagagtggcgaggtacaggttgcagccagcctcgggcctccggagacgttgctggaagcgtatattgaagccagggacgagggagtgtttggactagcctcgaccgccaaattgctcgtagaggtgaccgatgtcaacgatcacgccccagaactcgattttctgactctgagtaacccggttccagaagacgctgccccagggactgtcattgctctgttttctgtgaaggacgaagacctagattccaacggaagagtcatatgcggtatgagcagcgctggcccattccaactgacggcttcctttgacaattactacagtctcctgattgatggtcctttggaccgcgagcagatcagcgagtaccaggtgcttataactgcctctgactcagggtcaccccctctgtctacacgccgtacgataactgtgtcggtggccgacgtgaacgataatacaccaaacttccctcaaccgcagcaagagctatttgtggcagaaaataatggacccggtgcttctctggggagagtctttgcccaggatcctgacttagggaagaatgggctcgtctcctatgaactgctggacgtaatctctgaaggcccttctgcatcctctctgctggcggtggaatccagctccggagcaattaccgcaaagacaagcttcgactttgagcagcttcgtgggtttcactttcaggtagaaggcagagacggcggtatccctccccgatctgccactgtgaccatcaatctgtttgtggttgatcggaacgataactatcccgtaattttatttccactgccacgtaacggttctgttcctgtggagatcgtgcctcggtccgccaggactggtcatctggtcaccaaagtagtggctgaggatgcagacagtggctctaacgcttggctgagttatcacatttctagagcttcagattcctctttgttccgcatctccgccaatataggggaactgcgaaccgctcgcttagtactgccaacagatgccgtcaagcagagagtggtggttgttgtccgggaccatggagatccaccgttatcatctagtgtaacactcggagtgctcctgtccaacagcgtgccacaactacttccagatttcgaggacgtgtgggagcctggcggacagttatcagctcaaaacctgtacttagtaatcgccctagcgtgcatttccttcctgttcctcggatgcctgcttttttttgtatgtaccaagctccatcaatcaccaggctgttgtgcccaatcctgttgccgtagcaccgaggacctgcggtacggcagcaaaatggtcagcaacccatgcatgactagcgctacaatagatgttaccaccgtcgagcgcctctcacagacctacctctatagggcatctctggggctgggttccgataataattcactgttactgcggggtgagtataacgcagctgacctccgaaatcttgctactggcgtcggattgaacctccccatatcatgtatacagattaggaatagaaagggtgatcatgccaacgttaacgcaatgcccaggcagccaaacccggactggaggtactccgccagcttacgcgctggcatgcactcttccgtccacctggaggaagccggtatcctgcgggctgggcctgggggacccgaccagcagtggcctaccgtgtccagcgcgactcccgagccagaggccggagaggtgagtccccctgttggggctggcgtgaattctaactcttggacgtttaaatatgggcctggcaatccgaaacagagtggcccaggcgaactgcccgataagtttatcatccctggctcacctgcaataattagcatccgtcaagaaccgactaattctcagatcgataagagcgattttatcacatttggcaagaaggaggaaaccaagaagaaaaaaaaaaagaaaaaaggcaacaagacccaggagaaaaaagaaaaaggaaacagtaccactgacaatagcgatcaatag

SEQ ID NO: 237310 - DNA, 2457 bp, Artificial Sequence
  Description of Artificial Sequence: Synthetic coding sequence
atggtaggctgtggagttgccgtgctatgtttgtgggtcagttgcggcgcagccgctggtcaactcgagtacagtgtgccagaggagactgagcgtggggtggctgtaggaaatttgagtgctgaccttaggctgcctgccgcagccatgagtagcagaaattttcgcttcctctctagtcatcgcgagctctacttcggcgtggatcttccctccggtaatctggtggtgcgggagccagccgatcgagaacagctgtgccgggcaaaagcggcttgtgttctgacctacgacctggtgctggaggatccactagagctgcataagatcagaatccacgtgttagataccaatgataattctccgctgtttcccgcaggcgacgtgcagctgcatattcccgaattcctgactcctggtgccagattcaccttacccaatgcgcaagatgacgacgagggctccaatggaatcctctcatacagtctgtctccttctcagcacttcagactggatatggggtcccgagtagacgggtccgagtacccagagctggtcctggaaaaggcgctcgatcgggagcagcgcgctacgcacctcctggtccttactgccagggatggagggcttccagcccgaagcggagatgctcaggtaacaattatcgtggtggatacgaacgacaacgccccagtgtttgaacggtccgtgtaccgcacaaaagtccccgaaacagcgcctaacggtactgtgttatttagagtacaggcactggacccagatgagggtagcaatggcgaggtccaatactcattgtctaattccactcaagcggaattgagacatagatttcacgtccaccctaagtcaggcgaggtgcaagtagctgcgtcgctgggaccacctgagacactgttggaagcttacatcgaggctcgcgatgagggagtattcgggctagcgagtaccgccaagctcctggttgaagtgaccgatgttaatgatcacgcccctgagctggattttctgacgttgagtaaccctgtccctgaagatgctgccccaggaactgtaatagctctgtttagcgtaaaagatgaagacctggactcaaatggacgagtcatttgcgggatgagtagcgctggtccctttcaattaactgcaagtttcgacaactattacagtttgctgatcgacggtcctttggatagagaacagatttccgaataccaagtgctgattaccgcaagcgatagcggctctccacccctgtcaacacgccgtacaataacagtctccgtggctgatgtgaacgacaacaccccaaactttccccagcctcagcaagagttgttcgtcgccgagaataacggccctggcgcttctctgggcagagttttcgctcaggacccagacttaggtaaaaatgggttagtgtcatatgagctcctcgatgtgatctccgaaggcccatcggcaagttccctgctcgcagtggaaagcagcagtggggctatcaccgcaaagacttctttcgacttcgagcagctccggggtttccattttcaagttgagggcagagacggtggtatcccaccacgaagtgcgacagtcacaatcaatctgttcgttgtcgatagaaacgacaattatccagttatcctcttccccttaccacgaaacggcagcgttccagtggaaatagttcccagaagtgcacggacgggccacctggttacaaaagttgtggccgaggacgcagattctggctctaatgcttggcttagttaccacatctccagggctagcgatagctctttgtttaggatttccgccaacattggggagctgcgaactgccagattggtcctcccaaccgacgctgttaaacagcgcgtggtagttgtggtgcgcgaccatggggacccgcctctgtcttcaagcgttactttgggcgtgctgctgagcaacagtgttccccagcttctccccgattttgaggacgtgtgggagcccggagggcaattgtcagctcagaacctatatctcgtgatcgcactggcctgtatcagcttcctgtttctgggctgcttgcttttcttcgtttgcactaagcttcatcagtcaccagggtgttgtgcccagtcatgttgtcgttccaccgaggacctgagatacggatcaaaaatggtgtccaatccatgtatgacatccgccaccattgacgttaccaccgtagaacggctttcccagacctatctgtatcgggcaagtcttggtctgggaagtgacaacaattcactgctgctgcggggagaatacaacgctgcagatctaaggaatctagcgactggtgtgggtctgaatcttcctatatcatgtattcagataaggaacagaaagggggaccatgccaacgttaatgccatggtgtccaaattctacggcatatag

SEQ ID NO: 237311 - DNA, 3024 bp, Artificial Sequence
  Description of Artificial Sequence: Synthetic coding sequence
atggagcaggccggtactcgccctgctgccaccgagcatcctcggctcaggcgacctatgccctggctgctgctgttaccactcctgttactgctgcttctgctgctgcctggtcccgcagcgtcccagctgcgctacagcgtgcctgaggagcaggccccaggtgctctggtcggtaacgtggcacgtgccctcggcctggaactccgacgcctgggccctggttgcctgagaattaatcatctgggagcgccatcacctagatacctcgagcttgatctcacttcaggagctctgttcgtgaacgagcggattgatcgcgaggccctgtgtgagcagagaccgaggtgcttattaagcctcgaagtcttggcacataatccagtcgctgtcagcgctgtcgaagtagaaatactggatataaacgacaactcccccagattcccaaggcctaattaccaactgcaggtgagtgagtcagtggcgccaggcgcacgcttccatatcgagtctgcacaagatcccgacgttggcgcaaactcggtccagacttacgaactttcccccagcgagcactttgaattggacctcaagcctctccaggaaaacagcaaggtccttgagctggttctgcggaagggactcgatcgcgaacaggcagccctgcatcacttggtgctcacagccgttgatgggggaattccagcccgaagcggtacagcccagattagcgtgcgggttttagacaccaacgacaattcccctgccttcgaccaatccacctaccgagtacagttgcgggaggactctcccccaggaacgctcgtcgtcaagctcaacgcatccgatccagatgaaggctctaatggcgagctgcgctattcgctgagtagttatacctcagatcgggaaaggcagctgttttccatagatgccagtacaggcgaagttagagtcattggcggtctagactacgaagaggcttcctcctaccaaatctatgtgcaggcaaccgacagggggccagttccgatggcagggcattgtaaagtcttggtggacatcgtggatgttaacgataatgccccagaggtggtgttgactgatttatacagtccagttcctgagaatgcgacgcctaacactatagtagccgttctgtctgttaatgatcaggacagcgggcctaaccggaaagtttctctggggttagaggctaccctgccattccgtctaaatggtttcgggaacagctatacactggtggtaagcgggcctctagatcgcgagagggtggctgtgtataatatcacggtgacagcaactgatggtggtatcccccagcttacttctttgcgtactttaaaagttgagatctcggatattaacgacaatccaccttcgttcctggaggattcctactcaatatacattcaagagaataatttgcccggagtgctgttgtgcactgtacaggccacggatcctgatgagaaagaaaatgccgaagtgacttattctctgctcgagcgggagatacaaggcctcccggtaacaagctacgtttctattaattcggccagcggaagcctgtatgccgttaactcttttgactacgagaagtttagggagttttttgtcacagttgaagctcaggataaaggaagcccaccgttgagctccaccgtgaccgccaacgtttatgtcgttgatatgaacgaccatgcccctcacatcctgtatcccacctctacgaactcaagtgctgctttcgagatggtccccagaacagctcctgcagggtatctcgtaacaaaagtgattgccatggacagcgacagtggacagaacgcctggctattctaccacctcgctcagacttcggatctggacctctttaaagtggagctccataccggagaaatcagaaccactcggaagatgggtgacgaaagcggaagcaccttcaaccttacagtcgtagtgcgagataacggggagccaagtctttcagccagcgtagcaatcacagttgccgtggtggacagggtcagtaaaattctacccgacacgcaaagacacgtgaagagcccacggacgtactcggagatcactctgtaccttatcatcgcattgtccacggtctcattcatcttcctgctgactattataatcttaagcatcataaagtgctatcggtacacagcatacggcacagcctgttgtgggggtttttgtggagtacgcgagcgaagccctgccgaactgtacaagcaggctaacaacaacatcgatgctcgaattccgcatggcctgaaagtacagccacatttcatcgaagtccgcggtaacggttctctcaccaagacatattgttataaagcctgtctgactgcaggttccggttccgacacgtttatgttttataacactggcgcacagactggcccagggccaagtggagctcaggctgctgtgacagacagccgaaacttgacaggtcaaagcggccaaaacgctggaaaccttataatcctgaagaacgaggctgtaagtcagaacgagcctcgccagccaaatccagactggcgctattcagcatcactgagggctggcatgcatagctcagtgcacctggaagaagccggaatcctccgcgcaggtccgggtggcccagatcagcagtggcctacagtgagcagtgccacgcctgagcctgaggctggcgaagtgagtcctcccgtgggtgcaggggtgaacagcaattcctggaccttcaagtatgggccaggcaatcctaaacaaagcggccctggcgagctacctgacaaattcataataccaggaagcccagccatcatttcaatcaggcaggaaccgacaaattcccagattgataagtctgactttatcacattcggcaaaaaagaagaaacaaagaagaagaaaaaaaagaaaaaaggtaataaaactcaagagaagaaagaaaaaggcaattccacgacagataactcagatcagtag

SEQ ID NO: 237312 - DNA, 2457 bp, Artificial Sequence
  Description of Artificial Sequence: Synthetic coding sequence
atggcagggacccgacggaaatccctgcaaaaccgacaggtggggtccctcctcatcttcctctgcatatctgtaggagacgctacaaccatcagatacagcgtggcagaggaaatggagtccggcagctttgtcgcgaacgttgcaaaagacctagggctggaagtgggaaagctcgctgcccgtggcgctcgcttggtttctgaggggaacaagatgcactttcgactgcatcggaagacaggtgacctctttgtgaaggagaagctggaccgcgaatcactctgcggaaaagctgatccttgtgttctccacttcgaggttgtgctggtggagcctctgcagtcatttagggcggaagtgcgagttttcgatatcaatgataacgcaccggtgttcttgaataaggaacctcttttgaagataccggaaagtactccgctcggcagtcggttccctttacagtcagctcaggacttggacgtgggtcttaacggcttgcagaactacaccctcagtgctaatgggtattttcatctgcatacccggttctgcagtcacggcccaaagtatgctgagcttgtactgaacaaaccgctcgatcgcgaggagcagcccgaagttaatctcaccatcacagcggtagatggtgggtccccacccaaaagcgggaccgcccacattcacgtcgtcgtgcttgatgtgaacgaccacgtcccgcagttttcacgattggtctacagagcccaggtgtcggagaatagccccaatgggtcattggtagctactgtgacagctgttgacctggacgagggtaccaacaaagcaattacctactccctggcccagaacccagaagcaattttaaaaacattccagatcgatccccagaacggagaggtgaggctgagaggtccattagacttcgaggcaatcgagacatatgatatcgatatccaggctaccgacggcggaggactgtctgcacactccaaggtcttggtcgaagtcgtagatgtcaatgataaccccccagaggttatggtcagcagtgttagtagtccgttacctgaagactctccgcctcaaacagtagtggccctcttcactattcgggatcgagatattcgggttggaggcaaggtcacctgcttcctacgggaggatctccccttcgttattaagcctactttcggcaattcttattcattagtgacagaccgctcgctagacagagaagaggtgtccggctataatatcacaattgtggctatggatacaggccctcccagtctctcagccgagaccatgatagaggtgcttatatctgacgtgaatgataacccgcctattttccgggaagattcttacatactcacagtccgggagaataatagtcctgccgtttttattggaaaagtgcatgctgaggatctcgatctcggtgaaaacgcacagatcacatattcactgctccctccgaagaatggagaccttagcgtattcgcttacatatccattaacagtggcaacggcaaattatatgcactccggaccatggactatgaggccattcaggatttccagttcgtggtgaaggccacagatggaggcttcctgagcctcagctcccaggtgactgttcgcgtggtggtgctcgatgataatgataacaggcctatgatactatatcccctacaaaatggtactctgccttgcaacgacctggtgccacggagtgctgaggccggttacttagtgacgaaagtcgttgccgtggacggagactcgggtcaaaacagctggctctcctaccacttactcaaggcaaccgacttagggctcttcagcgtgcagaggcagaatggcgagattcatacgctccgccagattagcgagcgtgaccccatgatgcagaaactgattatcctggtgcaggaccacggccagcccgcactgtcaactacagtatccctgaacattctgttggtcgatggatttagcgaaccctatcttcaattccaggaccccactaaacattcccggaaagtgaatccctctacaaagtacctcgtaatatcattagtaatcctttccttcctgttcttgcttagtgttatcgtgatctttatcatacatgtgtatcagaagatcaagtatcgcgaaaagtttacaatccaggaacacttctacgatgactgcaacttttctaataacctcgttcagggacaaggtaacggttcactgagccgaccatgcccttatgaaatgtgctccgctaccgggaccggtaattcagaatttaggttccttaagcggtttatgcctaactttccttttccccacgctacaggagagattaaaatggaagcaggaagctccctgccaccgaactccgatagaaacaaatcacagcggctggaaggacatgatcaggtgtcagatgattatatgtag

SEQ ID NO: 237313 - DNA, 2394 bp, Artificial Sequence
  Description of Artificial Sequence: Synthetic coding sequence
atggagaaccaaggaacccggacacagcaaatcagacaagtgctgctgcttttcgttctgcttggaatgtctcaggcaggatcagagacttggtccttttcagttgctgaagagatgcagagcgggagcttcgttgggaacttggccaaagacctgggactgaaggtgagagagttgtcttcaaggggggctcgggtggtttctaacgacaagaaacagcggctgcagttagatataaacaccggcgacctgctcctgtccgagacgctagaccgcgaggaactgtgcgggagcattgaaccatgtgtgctgcatctgcaggtgctaatgcaaaatcccacccagttcttgcagattgaactgcaggtgcgggacattaatgaccacagtccaatattttcagagaaacaaatgctgttggagatcccagagaacagtcccgtaggcgctgtgttcctgctggaaagtgccaaggacctggatgtggggatcaatgcagtcaagtcgtataccatttcccctaacagccacttccatattaagatgagagtgatccctgataataggaaatatccggaactggtccttgataaagccctcgattacgaagagctgccagagctgtccttcattctatctgctctggacggcggttcaccaccacgcagtgggacagcattagtgcgggtcgtggtggttgacatcaacgacaacagtcccgaatttgagcaggcattttacgaggtcaagatacgcgagaacagcattctcgggtcactgatcctaatagtgagcgcctgggatctggacagtgggacgaatggagagatttgctatacatttagccacgcatctgaggatatcagaaagacattcgagattaatcagaagtcgggcgagatcaccctgagagccccattggacttcgaaacgatcgaatcctactcaataattattcaggcgactgatgggggtggcctgtttggaaagagcaccgttattatccacgtaatagacgtcaatgacaatgctcccgagatcaccgtgtcttcaatcacatctcccattccagaaaatacacctgaaaccgtcgtaatggtgttctctatccaggatattgattctggtgataatggtcgaatcgtgtgttccataccagaagacctgccgttcgtcctcaaaagttctgtcgagaattattatacactggagacggagcgtcccctggatcgcgagagcacagctgagtataacataacgatcacagtcacagacttgggcattcctagactgaagaccgagcataacaccacggtgcttgtttccgacgtcaatgataacgcccctactttcacccagacatcatataccttgttcgttagggaaaacaattcaccggcacttcatatagggagtgtgagtgcgaccgaccgcgactccggtaccaacgcccaggtcaattatagccttcttcctccgcaggacctgcatctgccgctggcctcactggtcagtatcaacaccgataacggtcaccttttcgcccttcgcagcctcgattacgaagcactccaggcgtttgattttcgcgttggtgccacggatcgaggatctcccgcattatcaagcgaggccctggtgcgggtgttggtacttgatgctaacgacaacagccctttcgtgctatatccccttcaaaatggttccgcaccatgtaccgagctggtgccgagagctgccgaacccggttatttagttactaaggtagtggctgtggacggagatagtggtcaaaacgcatggttgtcttaccagttgttgaaagcaaccgagcccggattatttggagtatgggcccacaacggggaagtgcgcaccgcacggcttttatccgagagggatgcagccaagcaccgattagtggttctggtgaaagacaacggagaaccaccaaggtcagctacagccacgttacaagtactcctggtggacggcttcagccagccttacctgcccctacctgaagcagcacccgcacaggcacaggccgactcactcacagtgtacctggtggtggccctcgcgtctgttagctcactgtttcttttctctgtgctactctttgttgccgttagactatgtcgaagatcccgcgctgcaagtgtgggcagttgtagcgtgcccaaagggccttttcctgggcatttggtcgacgtttccggaacagggacattgtcacaatcttatcagtacgaggtctgtttgaccggcggaagcgaaacaaatgaatttaagttccttaaacctgtcatccccaatatccaggctaagggactgggcaagaactctgaagagaacagtacatttcgcaattcatttggttttaacttctag

SEQ ID NO: 237314 - DNA, 1299 bp, Artificial Sequence
  Description of Artificial Sequence: Synthetic coding sequence
atggttttctcaatccaggacatcgactcaggggataacggtcggatcgtctgtagcatcccagaagacctgccttttgtcctgaaatcatcagtggagaattattacacactcgaaactgaacgccctttggaccgggaaagcactgctgagtacaacatcacaattactgtgacagatttaggaattcctcggctgaaaaccgaacacaacaccacagtgttggtgtcggatgttaacgataacgcacctacgttcactcagacatcttataccctcttcgtgagagagaacaacagtccagccctacatatcgggtctgtgtccgccactgatcgcgactcagggacgaacgcccaggtcaactatagtctcctcccccctcaagatctacatctgccgctagcaagtctggtgtcgatcaatactgataatgggcacctcttcgcgcttcgcagcctggactatgaagcacttcaggcctttgacttccgggtaggggctacagaccgaggctccccagccctgtcttcggaggccttggttcgcgtgttggtcctggacgccaacgataactctccattcgtactttacccacttcagaatggttctgccccatgcaccgaattggtgccacgagctgccgaacctgggtacttagtgaccaaagtggtggctgtggacggggattcggggcagaatgcatggttatcctaccagctgcttaaagccaccgaacccggattgttcggtgtgtgggcccacaatggcgaggtgcggaccgccagactcttatcggaacgcgatgctgccaaacatcgcttagttgtgctagtcaaagacaatggagagccgccaagaagcgctactgccacactgcaggtgttactggtggatgggttctcccaaccctatttgccactacccgaagcagcccctgcacaagcacaagccgacagtttgaccgtgtatttagtggtggcgttagcttccgtctccagtctgttcctgtttagcgtcctgctgttcgtggcagtgcgactctgtaggcgtagtcgcgcagcatcggttggctcatgttcagtgcctaagggaccttttccgggacaccttgtagatgtgtctggcacaggtactctgagccagtcttaccaatacgaggtatgtctgaccggtggttcagaaaccaatgagtttaaatttctgaaacctgttatcccgaacatccaggcgaaaggtctggggaagaattccgaagaaaactctacttttcggaacagcttcggatttaacttctag

SEQ ID NO: 237315 - DNA, 399 bp, Artificial Sequence
  Description of Artificial Sequence: Synthetic coding sequence
acaatcgagtcgtacagcataattatccaggctaccgatggcggaggcttgttcgggaaatctaccgtaattattcatgtaattgatgtgaatgataatgccccagagataaccgtgtcttcgattacctctcctattcctgagaatactccagagaccgtggtgatggtgttcagtattcaagatatcgatggtaccactgaagagctgtttgtaccatttagaaagacaagccacgttttgaagagctcggtggagaattactacacactcgagaccgagcggccattggacagggagtccaccgctgagtacaacatcaccatcaccgtgacagaccttggtattccaagattgaagaccgagcataacacgaccgttcttgtgagtgacgtctag

SEQ ID NO: 237316 - DNA, 2388 bp, Artificial Sequence
  Description of Artificial Sequence: Synthetic coding sequence
atggaaaacgggggtgctggcacacttcagatccggcaggtgttactgttcttcgtcctcctgggtatgtcccaggccggaagcgaaacgggcaattttctggtcatggaagagctgcagtcaggcagttttgtaggcaacctcgcaaagacattgggtctggaggtgtccgaactgtcctctcgcggagcgagggtcgtttccaacgataataaggaatgcttgcagttggatacaaatactggagatcttcttctgagagaaatgctcgacagggaagaactctgcggctcaaacgagccctgcgtactgtattttcaagtactgatgaagaatcctacccagtttttgcagatagagctccaagtgcgcgacataaacgatcactcacccgtgtttcttgagaaggagatgttgctggagatacccgaaaattcccctgtgggcgcagttttcctgttggagtctgcgaaagaccttgacgttggaataaatgcagtaaaaagctataccattaatcccaacagtcattttcacgtaaaaatcagggtgaatcctgacaacagaaagtatccagagctggtgcttgacaaggcacttgattacgaagaaagacctgagctcagcttcatcttgactgctctagacggcggaagccccccaaggagtggcaccgcgctcgtccgtgtcgtggtcgtggatattaatgacaatagtcccgaattcgagcaggcgttctatgaagtcaagatccttgagaacagcatcctcgggagcctcgttgtcactgtgtcagcatgggatttagactcgggcactaactctgagctctcatacaccttttcccacgcctctgaggatatacggaagacattcgaaattaaccaaaaaagcggggacatcactcttacagccccactggattttgaggctatagaaagctattccatcattattcaggctacggacggaggcggattattcggcaagtcaacagtgcggattcaggttatggatgtcaacgataatgcacctgaaataaccgtctccagcattaccagccccatcccagaaaatacgcccgaaactgtggtcatggttttccggatccgagatcgggactccggcgataatggaaaaatggtgtgttccatccccgaagacatccccttcgttctgaaatcaagtgtgaataactactacaccctggagacggagagacctcttgatcgtgagtccagagcagagtataatattaccataacagtgaccgatctgggcacacccaggctgaaaactgagcacaacattacggtgctggttagtgacgtcaatgacaacgcgcctgctttcactcagacctcctatgctctcttcgtccgagagaataattctccagcactgcatatcggatccatttccgccacagaccgggactccggtactaatgcgcaggtaaattatagtttactccccagtcaggaccctcacctgcccctcgccagtcttgtgtctattaatgccgataacgggcatctgttcgctttaagaagccttgattatgaagctttgcaaggtttccagttccgagtgggtgccaccgaccacggctccccagccctgtccagcgaagccttggtaagggtacttgttctggacgccaatgataattccccttttgtcctctaccccttgcagaatggatctgctccctgcacagagctggtgccttgggcggcagaacctggctacctggtaaccaaggtggttgcggtggacggagattcaggccagaatgcctggctctcctatcagcttctgaaagccaccgaacctgggctttttggggtgtgggcccacaatggcgaggtgaggaccgcaaggctcctgtccgagcgcgacgcagccaagcaccgcctggtggtgctcgttaaggacaatggagaacctcctcggtcggcaacagctacattacacgtgctcctggtggacgggttcagccagccctatcttcctttgccagaggccgctcccgctcaggcgcaggcagatagtcttactgtttatctagtggtggccctcgcttctgtgtctagcctcttccttttttccgtactcctctttgtggccgtccgcttgtgccgtcgaagcagagctgcccctgtgggcaggtgcagtgtgccggaaggcccatttccaggccaccttgttgatgtgtctgggacaggcacactctcacagagctaccattatgaagtctgtgtgactggcggtagcagatcaaataagtttaaatttctcaagccaattattcctaatttcctgccacagagcacaggttcagaggtcgaggaaaaccctccatttcagaacaatctggggttctag

SEQ ID NO: 237317 - DNA, 1257 bp, Artificial Sequence
  Description of Artificial Sequence: Synthetic coding sequence
atggtgtgtagcatccccgaggacatcccgtttgtgttgaaatctagtgtgaacaactactatacactcgagacagaacgaccactggatcgagagagtcgggcagagtataatatcactattaccgtgacggacctaggaaccccgaggctgaagactgagcacaacattactgttttagtctccgatgtgaacgataacgccccagcctttacccagacttcctatgcactgttcgtgagggagaacaactcgcctgctcttcatataggatctatctcagcgaccgaccgggactctggcacaaatgcccaggttaattactcgctgcttccctcccaggacccgcacctgcccctggcaagcctggtgtctattaacgccgataacggacatctgttcgctctgcgatccctggattacgaagctcttcagggctttcagttcagggttggcgcaaccgaccacggatctcctgccctgtcgtctgaagccctggttcgggttctggtactcgacgccaatgacaactcaccttttgtgctgtacccattgcagaatggctctgctccctgtactgagctggtaccgtgggcagccgagcccggatacctagttacaaaagtggttgcagtggacggcgactcaggacagaacgcctggctctcctatcagctgctaaaggcaactgagccaggactcttcggcgtttgggcccataacggtgaggtaagaaccgctcgtctgctgagcgagcgcgatgccgcaaagcacagactggtcgtgttagtaaaggacaatggagaaccccctcgcagtgccacggcgacgttgcacgtcctcctggtggacggctttagtcagccatatctccccctgcctgaggctgcaccggcacaagcacaagctgactccctcacggtttacctggtggtggcactcgcctctgtgagctcgctgtttctgttttccgttctgctgtttgtcgctgtgcggttgtgccgtcgatcccgggcagcccctgttgggcgttgcagcgtccctgaaggccctttccccggacatctggttgatgttagcggcacaggaaccctctctcagtcttatcactacgaggtgtgcgtgaccggaggaagcagatccaacaaatttaagtttctgaaaccaattataccaaacttcctcccgcagtccactgggtctgaagtcgaggagaacccccctttccagaacaacctaggcttctggatacagtag

SEQ ID NO: 237318 - DNA, 1377 bp, Artificial Sequence
  Description of Artificial Sequence: Synthetic coding sequence
atggacgtgaatgacaatgcgcctgaaattactgttagctcaattacatcacctatccctgaaaacacacctgaaaccgtggtgatggtgttcagaataagggaccgggatagcggtgacaatgggaaaatggtttgctctatacctgaagacataccttttgtcctgaagtccagtgtgaacaactattatacattggagacagaacgccctttagatcgggagagccgggctgagtacaatattacaatcacagtcactgacctaggaacccctcgcctgaaaaccgagcataacataaccgtgctagtctcggacgttaacgataatgccccagcttttacccagacatcttacgcgctcttcgtccgggaaaataacagtcccgcactgcacattggctcaattagcgccaccgacagagactctggaaccaatgcccaggttaactacagtctgctccccagccaggacccacatctgccgctggcctcactggtgtccatcaacgcagacaatggccatctgttcgctcttaggagcctggactacgaggcactgcagggcttccagttcagggtcggagcaacagatcacggctcccccgcactgtcctccgaggcattggtcagggtccttgtgctggacgccaacgacaacagcccatttgtcctttaccccctccaaaacggaagtgcaccatgtaccgaactggtgccttgggcagccgaaccgggatatctggtcactaaagttgttgctgttgatggagatagtgggcagaatgcatggctttcatatcagctactgaaggctacagagccgggactgtttggtgtatgggcacataacggtgaggttcgcaccgcccgacttcttagcgaacgcgacgccgcaaaacaccgtctggtggtgctggtgaaagacaatggggaaccccctcgtagtgcgactgccacactacacgtgctgttggttgacgggttttcgcagccctacctcccattgccagaggccgcacctgcacaggctcaggccgacagtctcactgtgtatctggtagtcgccctagcatccgtgtctagcctgttcctgttctccgtcctcctgtttgtagctgtccggctctgcagacgatcccgtgccgctcccgtgggacgctgctcagtcccagaaggccctttccccggtcatttggtggatgtaagtggaactgggaccctgtcccaaagttaccactacgaagtgtgtgtgacagggggtagcaggtccaacaagtttaagttcctgaaacctatcattcctaactttctgccccagtctaccgggtcagaggtggaggaaaaccctccttttcagaacaacctgggattttag

SEQ ID NO: 237319 - DNA, 2397 bp, Artificial Sequence
  Description of Artificial Sequence: Synthetic coding sequence
atggaagcgtcagggaagctgatctgccgccagcgacaggtattattcagttttctccttctgggtctgtccttagctggggctgcagagcccaggtcttattctgttgttgaagagacagagggttcttcttttgtgaccaatttagccaaggatctcgggcttgaacaacgggagttctcccggagaggcgtgcgtgtcgtgtccagaggtaacaagttgcaccttcaactaaatcaagaaacagctgacctgctgctgaacgaaaagctcgaccgggaggacctatgcggtcacacagaaccttgtgtactacgctttcaggtgctgcttgagagcccatttgaattctttcaggcggaacttcaagttatcgacatcaacgaccactcccctgtcttccttgacaagcagatgttggtgaaggtttcagaatccagcccgcctgggacaaccttccccctgaaaaatgcagaggatctggacgttgggcagaacaatatcgagaactacatcatttcccccaacagctactttcgggtgttgacacgcaagaggagtgacggccgaaagtacccagagctcgtcctcgacaaagcactggatagggaggaggaggcagaattacgcctcaccctgaccgcattggacggcggatcgccaccacggagtggaacagcccaggtatatatcgaggtccttgatgtgaatgataatgcaccggagttcgaacagccattttatcgtgtacagatcagtgaggattcccccgttgggtttttagtggtcaaagtttctgctactgatgtggataccggtgtgaacggcgaaatcagctacagtctgtttcaggccagcgaggagatcggtaaaacttttaagataaaccccctcacaggagaaatagaactaaaaaaacagctcgacttcgaaaagcttcagtcttatgaggtgaatattgaggcccgtgacgccggtacattcagcgggaagtgcactgtgctcattcaggtgatagacgtgaatgatcatgccccagaagtaaccatgagcgcctttacgtcgcctattcccgagaacgcaccagagacggtggtcgcgcttttcagtgtatcggatctcgactcaggcgagaatggaaaaatatcctgctctatccaggaggacttacctttcctgttaaaatctgcagagaatttttacaccttgctaacggagagaccattagatagggagtccagagccgaatacaatatcacgatcacggtcacagatctgggtacccctatgctgatcacacagttgaacatgactgtcctaattgccgatgtgaatgataatgcaccagcctttacgcagacttcttatactctgttcgttagggaaaataattctccagccctacacatacggtctgtgtccgctacagatagagactccgggactaatgcccaggtgacatactcattacttcccccacaggacccacacctcccccttacctcactcgtttctattaacgcagataatggacacttattcgccctgcgcagcctcgattacgaagccctgcaaggatttcagttccgggtaggggcatccgaccatgggtcgcccgcactgtcttccgaagcactcgtccgagtggtggtgttggacgcaaacgataacagccccttcgtgctatatcctctgcaaaacggctccgccccatgtactgagctggtacctagggctgccgagcccggttacctcgtgacaaaagtcgtagccgttgacggcgacagcggccaaaatgcttggctatcctaccagctgctcaaagccactgaactgggattgttcggcgtgtgggctcacaatggcgaagtacggacagctcgtctactgtccgagagagacgcggctaaacatagactcgtggtactggtgaaagataatggggaacctcctcgttccgctacagcgaccctgcacgtcctcctcgtggacggcttctcgcagccttacctacctttaccggaagccgcacccacgcaggctcaggcagacctgttgactgtctacctggtggttgccctggccagcgtctcaagtctgttcctgtttagcgttctcttgttcgtggcggttcggctctgtcgcaggagtcgcgctgcaagcgtaggccgatgcctggtgccagaagggccacttccaggacacctcgtcgacatgagcgggactaggaccctgtcccagtcctatcagtatgaggtttgtttggccggaggctctggcacgaacgaatttaaatttctaaagccaattatcccaaactttccaccccagtgtccagggaaagaaattcagggcaactccacatttcccaataactttggctttaatatccagtag

SEQ ID NO: 237320 - DNA, 2235 bp, Artificial Sequence
  Description of Artificial Sequence: Synthetic coding sequence
atggaagcatccgggaagttaatctgtaggcaacgccaagtgctcttttcctttctgctgctgggactcagcctggcgggagccgctgaacctaggagctacagcgtcgtggaagagactgaggggtcgagcttcgtaaccaatcttgccaaggatctggggctcgaacagcgcgaatttagcaggaggggcgtccgagtggtctcccgtgggaataagcttcacctgcagctgaatcaagagacagccgacctcctgctgaacgagaagttggacagggaggatctctgtgggcataccgagccttgcgtgttgagattccaggttctcctcgagtcacctttcgagttttttcaggccgagctgcaagtcatcgacattaatgatcattccccagtatttctggataagcagatgctggtgaaagtgtcagagtcttcacctcctgggacaacattcccactgaagaacgcggaggatctggatgttggccagaacaatatcgagaactacatcatttcacccaactcctactttcgggttctgactagaaagcggtcagacggacgcaaatatcctgagctggttctcgataaagccctggaccgggaggaagaagcagagctccggctaaccctgacagccctcgatggcggaagtcctcctcggtccgggactgcccaggtctacatcgaagtcctggatgttaatgataacgcgcctgaattcgaacaaccattttacagagtgcagatttccgaagattctccagttggattcctcgtggtgaaagtgtctgcaactgatgtggataccggggtgaatggagaaattagctacagcctctttcaggccagtgaagaaattgggaaaaccttcaagattaacccccttaccggagagattgaactgaagaaacagttagatttcgaaaagctgcagtcctatgaggtgaatattgaggccagggacgccggaactttctccggcaaatgtaccgtgctcatccaggttatagatgtcaacgaccacgcaccagaagttaccatgagcgcctttacatcccctatccccgagaatgccccagaaacagttgtggccctgttttccgtgagcgatttggacagcggagagaacggtaagatatcttgcagcattcaggaagatctccctttccttctgaagtccgccgagaacttttacacactactgaccgagcgcccactggatagagagtcgcgagccgaatacaacatcacgatcacagtcacagacctcggaactcctatgctgattacccagctgaatatgaccgtgcttatcgccgacgttaacgataatgcgccagctttcacacagacttcttataccttgtttgtgagagagaataactcccctgccctgcatatcaggagcgtcagcgccaccgaccgcgacagcggaactaatgcccaggtgacgtatagtctgctgccccctcgcgtcgtggtccttgacgccaatgataattccccatttgtactctatcctctgcagaacggctccgccccttgcaccgagttggtgccgcgagccgcagagcccggatacctagtaaccaaggtggtggcggtggatggagatagcgggcagaatgcttggctctcctatcagctgctaaaagccacggaactggggctattcggcgtgtgggcacacaatggtgaggttcgtaccgctagactcctctctgaacgtgacgcggcaaagcatagactagtggtgctagtgaaagacaacggagagccgcctagatctgccactgccaccttacacgtcctcctggtggacggcttctctcagccctacctgcctctgccagaagcagcacccacacaggcccaagctgacctgctgaccgtgtacttggtagtggcactggcaagcgtttctagcttgtttcttttctctgtactgctattcgttgcggtccgcctatgtaggagaagccgtgccgcatctgtgggaaggtgtctggtgcccgagggtccattacccggtcacctggttgatatgtccggcactcggacactgtcccaatcctaccagtacgaggtgtgcttggcaggcggatctggaactaatgaattcaaattcctgaagcccatcatccctaatttcccccctcagtgccctggcaaagaaatccagggtaacagcacattcccaaacaacttcgggtttaatatccagtag

SEQ ID NO: 237321 - DNA, 2409 bp, Artificial Sequence
  Description of Artificial Sequence: Synthetic coding sequence
atggaagcttccgggaagctaatatgtaggcagcgacaagttctgttctcattcctgctcctgggactgagcctggcaggcgctgctgagcccaggagctacagtgtcgtggaagagaccgaaggctccagttttgtgactaatttggccaaggacctggggctggagcagagagaattctccagacggggagttagggttgtgtcaagaggcaacaagttgcacctgcagcttaatcaagaaactgccgacctcctgttgaatgagaagctggacagggaggacctgtgcggacacacggagccttgtgtgctgcgtttccaggtgctacttgagtctccctttgaatttttccaggccgaacttcaggtcatcgatatcaatgaccactcaccggtcttcttagataagcagatgctggtcaaagtgtccgagtcttctccccctggcaccactttccctttaaaaaacgcagaggatctcgatgtcggacagaacaacattgagaactatatcatatctccaaactcgtatttcagagtgctcaccagaaagaggagtgacggcaggaagtaccccgagcttgtgttagacaaagctttggatagagaggaggaggccgaactacgcttaacactgaccgcccttgacggcggtagcccccctcgtagcggcaccgcacaggtctatatagaagtgctggatgtcaacgataatgcaccagagtttgagcagccattttatagagtgcaaattagcgaagattcgccagtcggctttcttgtcgtgaaggtgtctgctactgacgttgacaccggagtcaatggcgaaatctcctacagcttgtttcaggcaagtgaggaaatcggcaaaaccttcaagatcaaccctctcacaggtgagatcgagcttaaaaagcaattggatttcgagaagctgcagagctatgaggttaacatcgaggcgagggacgcaggtaccttctcaggaaagtgtacagtgctcatccaggtgattgatgtaaacgatcatgctccagaggtgacgatgtctgcctttacgtccccaatcccagagaacgctcctgagacggtggtagcgcttttcagtgttagtgatctcgacagtggggaaaatggtaagatctcatgctccatccaggaggatctgccatttctgctgaagtctgccgagaatttctacactctgctgaccgagagaccgctggatcgggagtccagggctgagtacaatatcactattaccgttacggatctggggacaccaatgctgattacacagctgaacatgacggtgctgattgctgacgttaatgacaatgcacctgcgttcacgcagactagctacactctcttcgtgagggagaacaattcacccgcactgcatatacgaagcgtgtccgcgaccgatcgcgactcagggaccaacgctcaggtcacttactctttactaccgcctcaagacccccacctgcctcttacttcccttgtttctataaacgcagataacggccacctgttcgctctcaggtccctggactatgaggcgcttcagggcttccaattccgagtcggagcttcagaccacggcagtcctgccttgtccagtgaggccctggtgcgtgttgtggtactcgacgccaacgataactcgcccttcgttctgtaccccctccagaacggctcagcgccttgcaccgagctcgtccccagggccgcagagccgggatatctagtaactaaggtggtggcggttgatggcgacagcggccagaatgcctggctttcttaccagctgttgaaggcaacagagctgggtctgttcggcgtgtgggcccacaatggggaagtgcgcactgctcgtctgttgtccgagcgcgacgcagccaagcaccgcctggtcgtgctggtgaaagacaacggtgagccccctaggagtgcaaccgctacgttgcacgttctcctggttgacgggttttcacagccttatctgccactgccagaagcggctcctacccaagctcaggccgacctgttgacagtttacctcgtggtggccctggcttccgtcagctctttattcctgttctccgtactgctgttcgtcgctgtgcggctgtgccgaagatctagagcagcatctgtcgggcgttgcctcgtccctgagggaccactgcccggtcatctcgttgatatgtctgggacccggactttgtctcagagttaccaatatgaagtctgccttgcaggaggttctgggaccaatgaatttaagtttttgaagccaatcatcccaaatttcccgcctcagtgccctgggaaagaaatccagggcaatagtacatttccaaatctttgtgtgtgcaacattgtgcggatttacagctag

SEQ ID NO: 237322 - DNA, 2397 bp, Artificial Sequence
  Description of Artificial Sequence: Synthetic coding sequence
atggaaatccgcggtgccctggatctcaggaagagacaggttctcatatttctggtgctgctgggcctttcccgcgctggaaccgaatcagctcattactctgtggcagaggagactgaaatcgggagtttcgtggcaaacttagcaagagatttagggctgggagtggaggaactctcctcccgcgaggctagagttgtgagtgatgataataaaaaatatctgcatcttgatttgcttactgggaatttgcttttgaacgagaagttagacagggacgagctttgcggttctactgagccttgcgtcctgcactttcaggtggtgctcgagaatccactgcagtttttcagatttgaactgtgtgtcaaggatatcaatgaccactcaccgacattcttggataaggagatactcattaaaatcagtgagggcacaaccgtgggggcaacattcttgatggagtccgcacaggatcttgatgttggatccaacagcctgcagaactatactatcagccctaattctcacttttatattaagatccctgattcttctgatcgcaagatatatccagaactcgttctggaccgggcactggattacgaacaggaggcagagctgaggctcacattaaccgctgtggacggaggatctcccccaaagagcggaactacgctcgtgcttataaaggtcctggatatcaacgacaacgctccggaattcccccagagcctctatgaggtacaagttcctgaagataggcccctggggtcctggatcgcaacaattagcgcaaaggacctggatgccggaaattacggcaagatatcttatacctttttccacgcatcagaagatattcgtaaaacttttgagataaatccaatcagcggtgaagtcaaccttaggtcacccttggactttgaggttatacaatcctatacgatcaacattcaagccactgacgggggtggcctgtccggaaaatgtacattacttgtaaaggtcatggatattaatgacaacccccctgaggtgacaatcagctcaattactaagcggatccccgagaacgcatctgagacgttggtcgccctcttttccatccttgaccaggatagtggcgacaatgggagaatgatttgttcaattcaggacaacctcccctttttcctgaagccaactttcaagaacttcttcacattagtatctgagaaggcgctggaccgcgagtcacaggctgagtataatattaccatcacagtgaccgacctgggtacaccgagacttaaaactgaatataatatcaccgtgctcctcagcgatgtgaatgataatgcccctaccttcacacagacctcatatacattgttcgtgagagaaaataattctccagcgctccatatcggaagcgtgtcagccactgaccgcgacagcggtactaacgcacaggtgaattatagtctgctgccgcctcaggaccggcatctcccactggcctcgctcgtaagcattaatgccgataacggacacctgtttgccctgcgtagcctcgattacgaagctctgcaggaattcgagtttagagtgggagccacagatagaggctcccccgctttgagctcagaggcattggttcgggtgctcgtcttagatgctaacgataatagcccatttgtgctctatcccctacaaaacggttccgccccatgcacagagttagtgccacgtgcggctgaaccagggtacctggtgaccaaggtggtggccgtggatggagattctgggcagaacgcgtggctaagctaccagcttctgaaagctactgagccgggtttattcggcgtatgggcccacaatggggaagttcgcacggctaggttgttgtcagagcgcgatgccgctaaacacagacttgtggtcctcgtgaaggataatggcgaaccgcctagaagcgctaccgctactctacatgtgcttcttgtagatggtttttctcaaccatacctccctctcccagaagcagccccagctcaagctcaagctgattctctcacagtgtatctggtggtcgccctggccagtgtaagtagcttattcctgtttagtgttctcctgtttgtggctgtccggttgtgccgtagaagtagagcagcctccgtgggtagatgctcggtaccggagggtccttttccagggcacctcgtcgacgtgtcagggacggggacgctgagccagagctatcagtacgaagtgtgcctgaccggtggatcaggaaccaacgagttcaaatttcttaagcccattattccaaactttcaggtacacgacaccggcagaaacatgggggaaattgagaacttcaggaatagcttcggactgaacatccagtag

SEQ ID NO: 237323 - DNA, 1938 bp, Artificial Sequence
  Description of Artificial Sequence: Synthetic coding sequence
atggaatcggcccaggatctggacgtgggcagtaactccctgcagaactatacgatttctcctaactctcatttctatataaaaatccctgattcctctgatagaaagatctatcccgaactcgtgctcgaccgggcactggattacgagcaagaggccgagctccggcttaccctcaccgctgtcgacgggggtagccccccaaagtctggaacaactctggtcctgattaaggtcctcgacatcaacgacaatgcccctgagttccctcaatccctttacgaggtgcaggtgcctgaggaccggcctctggggagttggattgcaaccatttccgctaaggaccttgatgcgggaaactacgggaaaattagttatacttttttccacgcatccgaggacatcaggaaaacatttgaaattaaccccatctccggtgaagtgaatcttcggtcccctctggatttcgaggtcatccaatcatatactatcaacattcaggcaaccgacggagggggtttgtctggcaaatgtactctgctggtgaaggtcatggatatcaacgataatcccccagaggtcactatctcaagtattacaaaacggatacctgaaaacgcctcagaaacgctggtagccctgttcagcatactggaccaagattctggagacaacggacgaatgatttgttccatacaggacaatctgcccttctttctaaagccaacctttaaaaacttctttaccttagtgagcgaaaaagctctggatagagagagtcaggctgagtacaacattactatcaccgtgacggatttaggcacgcccagacttaagacagaatataatattactgtgctgctgagcgatgtgaatgacaacgctccaacttttacacaaaccagttatacccttttcgttagggaaaataatagcccagccctgcacatcggcagcgtatctgcgacagaccgggattcgggaactaacgcccaggtaaattattccctactcccaccgcaagatcggcatttgcccttggccagtctggtcagcattaacgctgataacggtcatttatttgccctccgctcccttgactacgaggcacttcaggagtttgagtttagggtgggagctaccgaccggggatcgccggctttatcgagtgaggccttggtcagagttctggtgctcgacgcgaacgataacagtccattcgtcttgtaccctttacagaatgggtcagcaccatgtaccgagctggttcctagggccgctgaacccggttacctggtgacaaaggtggtggctgttgacggcgattctggccagaacgcctggctttcttaccagctcctgaaagccactgagcctgggctatttggggtatgggcacataatggtgaagtgaggacagccaggcttttaagtgagagagacgccgctaaacacaggctggttgtcctcgtgaaggataatggggagcccccaaggagcgccaccgcaacgttgcatgtgcttttagtggacgggttttcacaaccttatctaccgctgcccgaagccgctccagctcaggcacaggcagactctctgactgtctacctggtagtagccttagccagcgtgagttctttgtttctgttttccgtactgctgttcgtggctgtgaggctgtgccgcaggagtagagcagcaagcgtgggaagatgttccgttccagagggcccttttcctgggcacctagtggacgtcagcggcaccgggacactgagccagtcataccagtacgaggtgtgcctaactggagggtccggtaccaacgagttcaaatttctcaagcccatcatacccaacttccaggtacatgatactggcaggaacatgggggaaatcgaaaattttcggaacagttttggcctcaacattcagtag

SEQ ID NO: 237324 - DNA, 2382 bp, Artificial Sequence
  Description of Artificial Sequence: Synthetic coding sequence
atggaagccagagttgagcgggcagttcagaagcggcaagtgctctttctgtgcgtatttctggggatgtcctgggcgggtgccgagccactgcgatacttcgtggcagaggaaacagagaggggaactttccttacaaatctggccaaggacctgggactgggtgtcggagagctaagagcgcgaggaactcgcatagtcagcgaccaaaatatgcaaatcctgctcctttcaagcctgaccggagatctcctactcaacgagaaactagatcgcgaggaactgtgcggtcccagggagccttgcgtcctgcctttccagttgttgttagagaagcctttccaaatctttcgcgctgagctgtgggtgagggacatcaatgaccacgcgcctgtgttccttgacagagagatctctctgaaaatcttggagtcaaccaccccgggagccgcatttctgctggagtccgcccaggactctgatgtcggaaccaatagcctgtccaactacacgatcagcccaaacgcctattttcatatcaatgttcacgattcaggggaagggaacatctaccccgagctggtgctgaatcaggtcttagaccgggaagaaatccctgagttttccttaactctcaccgccttagatggcggatcaccaccacgttctgggaccgccctggtgagaatcctggtgctcgacgtaaacgacaatgcccctgacttcgttaggtctttgtataaagtgcaggtccctgagaactctccagtgggctcaatggtagtgtcagtgtctgccagggacttagatactggctcaaacggggaaatcgcgtacgccttcagctatgctacagaaagaattctgaaaacgttccaaatcaacccaacttctggctctctccacttaaaagcccagctggattacgaggccattcagacgtacactttgacgatccaggctaaggatggcggtggactcagcgggaagtgcaccgtggttgttgatgtgacagacataaacgacaacaggcctgagctgcttctatccagcctcaccagcccaatcgcagagaattctcccgagaccgtggtggctgtctttcgaatcagggatcgagatagcggaaataatggtaagactgtctgtagtattcaggacgatgtcccttttatactgaaaccgagtgtggagaacttttacacgctcgtgactgagaagcccctagacagggagcgcaacaccgagtacaacatcacaatcactgtcactgatctcgggacccccagactgaaaacagagcacaacatcaccgtactagtgtccgatgtgaatgataacgcgcctgcttttacccaaactagttacaccctgtttgtgagggaaaacaattcccctgctcttcctattggcagtgtcagcgctaccgaccgggattccgggaccaatgcacaggttatctattccctccttccatcccaggatccccacttgcccctggcgagccttgtctccataaatgccgataacggccacctgttcgccctcagatccttagattatgaagcgcttcaagcattcgagtttagggtgggagctacagacagggggtcccctgccttgtcctctgaagctctggtccgcgtgctggtgctagatgctaacgacaatagcccgtttgtgttatatccactgcagaactcatctgccccatgtaccgagccccttcccagagccgcagagccgggttacctggttacgaaagtcgtcgccgtagacggcgactctggtcagaacgcatggctgtcctatcagcttttgaaggcaaccgagcctggcttgttcggggtatgggcccacaacggggaggtacgcaccgccagattactgtcagagagagatgcagccaagcaacgacttgtagtcttggttaaggacaacggagaacctcccagatcagcaaccgccactctgcatgtcctactggtcgacgggttctctcaaccttaccttagacttccagaggccgctccagaccaagccaattccctcaccgtttatctcgtcgtcgcactcgcttctgtatcttcactgtttctgttgtctgtcctgctgttcgtagccgtgcgcttgtgcagacgctcccgagcagctccagtgggcaggtgttctgtgccagagggcccttttcctaggcatcttgtggatcttagcggaacgggtacccttagccagagctatcaatatgaggtgtgcttaacggggggttcagggaccaatgaattcaaattccttaagcccattatcccaaatttactgccgcagtctacaggtcgagaagtcgaggaaaatcggccatttcagaacaacctgggtttttag

SEQ ID NO: 237325 - DNA, 2331 bp, Artificial Sequence
  Description of Artificial Sequence: Synthetic coding sequence
atggagatcggatggatgcataataggcgccagcgccaggtactggtctttttcgtgctgcttagtctgagcggcgctggcgcagagctcggctcttatagcgtggtggaggagacagagaggggaagcttcgtggcaaatctgggaaaagatctgggactcggactgactgagatgtcaaccagaaaggctagaattatttcgcagggcaacaaacagcaccttcaattaaaagcccagacgggagacttgctgataaacgagaagctggaccgcgaagagctctgcggtcccactgaaccatgtatccttcatttccaagtcctgatggaaaatccactggagatatttcaggctgagctgcgggttatcgatattaacgatcatagccctatgtttacagaaaaagagatgatcctgaaaattcctgagaacagtccgctgggtacggagtttcccctgaatcatgcactcgacctggatgttggatcaaacaatgtccagaactacaaaataagcccaagctcgcattttagagtgctgattcatgagtttcgagatgggaggaagtatcctgaattggtccttgataaagaactggacagagaagaggagcctcaactacgccttaccctaacagcgctcgacgggggatctcctcctcggtcgggaacagctcaagttcgaattgaggtcgtcgatattaacgataacgcaccagagttcgaacaacccatctataaggtccagatcccagagaatagcccacttggcagcctggttgcgacggtgagtgctagggatcttgatgggggagcaaacggaaagatcagttacacacttttccagccgtccgaagatatctcaaagaccttggaggtcaaccctatgacaggcgaagtgcgcctccgaaagcaggtggatttcgaaatggtgacttcttacgaggtgaggattaaggccacagacggcggaggcctgtctggaaagtgtacattactcctgcaggtagttgatgttaacgacaatcccccacaggttactatgtctgcgcttactagtccaatacccgagaactcaccggagatcgttgttgccgttttttcggtaagcgaccctgatagcgggaataatggcaaaacgattagcagcatccaagaggacctaccatttctcctgaaaccatccgtgaagaacttttacacattagtgactgagagggctttagaccgtgaagcacgtgccgagtacaatatcacacttacagtgaccgatatgggcaccccccgattgaagacagaacataacatcacagtacaaataagcgatgtcaacgacaatgcccctacctttacgcagactagttacaccctctttgtgagggaaaacaacagtcccgcattacatatcggcagtgtcagtgccacagaccgcgactcaggcacaaacgctcaagtgacctatagcctccttcctccacaggacccccatctgcctctggcctcactcgtgtcgattaacgccgataatggccacctctttgccctccgctccctggactatgaggcactccgggagtttgagttccgtgttagtgcaacagaccgtggcagtcccgctctgagttccgaagctttagtaagagtgctggttctggatgctaacgacaattcgcccttcgtcctgtatcctcttcagaacgggtctgccccttgcactgaactcgtgcctcgcgctgccgagcctggctaccttgtcacaaaggtggttgctgttgatggagattccggacagaacgcttggctaagctatcagttattaaaagccacagagcccggactgtttggcgtgtgggctcacaatggcgaagtgcgcaccgctagattgctctcagagcgtgatgctgcaaaacagcggctcgtggtattggtgaaagataatggcgaaccccctagaagtgcgacagccaccttgcacgtactccttgtagatggtttctctcagcccttcctgcctcttcctgaggcggcacccggacagactcaagccaacagcctcactgtgtatctggtggtcgcactagctagcgtgagttctcttttcctcttttccgtcctgttgttcgttgccgtccggctttgcaggagatcacgtgctgcatcggttggtagatgcagtatgccagaggggcctttccctgggaggctggtggatgtctctggcacggggacgctgagtcagtcttaccagtatgaagtttgtctgaccgggggttcagagacctcagagtttaagttcctcaaaccgatcatcccaaatttcagtccgtag

SEQ ID NO: 237326 - DNA, 2397 bp, Artificial Sequence
  Description of Artificial Sequence: Synthetic coding sequence
atggaggccggagagggaaaggagcgggtgcccaagcaaagacaagttctcatcttctttgtccttttgggcatcgcccaggcaagctgccagcccaggcactatagcgtcgcagaggagactgaaagcgggtcctttgtggccaacctgctcaaggacctcggcctggagattggagaactggcggtcagaggggctcgggtcgtgtctaaaggcaagaagatgcatctccaattcgacagacagaccggtgatttactgcttaacgaaaagctcgaccgtgaagagctgtgcgggcctaccgagccctgtgttctgcctttccaggtcctcctggagaatcccttgcagttctttcaagcagaattacggattagggacgtgaacgaccacagccccgtcttcctggacaaggagattctgttgaaaattcccgagtccattacaccgggtacaacattcctgatcgagagggctcaagatctggatgtggggaccaacagtttgcagaactacacaatttcaccgaattttcacttccaccttaatctccaagattcactcgatggcataattttaccccaactggtgctgaatagggcactggaccgggaagaacagcccgagattcggttgacactcacagcgctcgacggtggctccccaccacgctccggaacagcccttgttcgcattgaagtggtggacatcaatgataacgtccctgaattcgctaaattgctctacgaagtacagataccagaagattcccctgtgggctcccaggtggcgatcgtgtcagccagagatctggacattgggaccaacggagaaatcagctatgcttttagccaggcctccgaggatatccgaaaaacattccggctttcggccaaaagtggtgaactgctgctcagacagaaactggactttgaaagcattcagacctatactgtcaacatccaggcaacggatggcggagggctttctggtacttgtgtagtatttgtacaggtgatggacttaaatgataatccacccgaactcaccatgtctaccctcattaaccagattccagaaaatctgcaggacactcttattgcagtcttttcagtaagtgatccagattctggggacaacggcagaatggtgtgttcaattcaggatgacctgccattctttcttaaaccatccgtggaaaacttttataccctcgtcatttccactgctctggaccgcgagaccagaagcgagtataacatcaccatcactgtaactgacttcggtaccccgagattgaagacggagcacaacatcaccgtgctggtctccgacgtcaatgacaacgcacccgcatttacacaaacatcatataccctgtttgtgcgggaaaataatagccccgctttacacatcggctccgtgtccgcgacagacagggattcaggcacgaacgcccaggtgacttattccttgctcccacctcaggaccctcatctccctctggcctctctggtgtccattaatgctgacaatgggcaccttttcgctctgcagagtcttgactatgaggccctccaggctttcgagttccgtgtaggtgctgccgatagaggcagccccgcacttagctccgaggcgctggtcagggtcctggttttggacgcaaatgacaattcaccgtttgtgctctaccccctgcaaaacggaagtgccccatgcacagaactagtgccgagggctgcagaaccaggctatttggtaacaaaagtcgttgctgtggatggtgattctggacagaatgcatggctgtcataccagctattaaaagcaactgagcccggattgttcggggtgtgggcccataacggggaagtccggactgctagactccttcgcgaaagggacgctgccaagcagaggctggtggttctagttaaggataatggcgaaccacccaggtccgctactgcaaccctccatgtcctgttggtcgatggctttagtcagccttatctgctgctgccagaagccgctcccgcacaggcacaggctgacctgctgaccgtctatctggtggtggccctggcatcagtgtcctcgctgtttctctttagtgtcctgttatttgttgccgtcagactctgccgtcgcagtagagccgcttccgtgggaagatgcagcgttcctgagggaccatttccagggcaaatggtggatgtaagcgggacaggtacactgagtcagagctaccagtacgaggtgtgcttgactggcggatccggtaccaatgaattcaagttcctgaaaccaatcattcccaacttcgttgcgcagggcgcagaacgtgttagtgaggccaacccctcattccgaaaaagcttcgagtttacctag

SEQ ID NO: 237327 - DNA, 648 bp, Artificial Sequence
  Description of Artificial Sequence: Synthetic coding sequence
atgaatttagtggggtcatatgcccatcaccatcaccaccaccacccacatccagctcatcctatgttacatgagccttttttattcggtccagcatcacggtgtcaccaggaacgaccttattttcagtcttggctgctcagtcctgccgatgccgcaccggacttccccgcaggaggacctccacccgctgccgctgctgcagcaaccgcttacggtcccgacgcaaggcccggacagtcaccaggacggctggaagccttgggcggaagactaggtcgcagaaagggatccgggccaaagaaggagcgtcgcaggactgagtccatcaacagtgcgttcgccgaactcagggaatgcattcctaatgttccagccgacaccaagctgtctaaaatcaagaccctccggttagccacctcatatattgcctacctgatggacgtcctggctaaagacgcccaatcgggggatccggaagcatttaaagcagaattgaagaaggcggatggtgggagagagtccaaaaggaaacgtgagctgcagcaacacgaaggatttcccccagcccttgggccagtcgagaagagaatcaagggcagaacagggtggccacagcaagtgtgggctctggagctcaaccagtag

SEQ ID NO: 237328 - DNA, 2388 bp, Artificial Sequence
  Description of Artificial Sequence: Synthetic coding sequence
atgaagaaacttggtcggatccatccaaacaggcaggtactggcatttatccttatggtgttcctaagtcaggtgaggctggaaccgatacgctattccgtgctcgaagagaccgaatccggtagtttcgtggcccacttggccaaagatctcggtctgggcatcggcgaacttgcaagcagatctgcccgagtgctgagcgatgacgacaaacagaggcttcaattggaccggcagaccggtgatctgctgctgagggagaaactggatagagaggagctctgcggtcctatcgagccctgtgtgctccacttccaggtctttctggaaatgccggtgcagttcttccagggcgagctgctgatccaggacataaacgaccattctccgattttccccgagagggaggttctcctgaaaatcctagagaattcacagcctggtacactgttcccactgctgatcgccgaagaccttgatgttggaagtaacggtctccagaagtacactatcagccccaactcgcattttcacattctgacccgcaatcatagtgaggggaagaagtaccccgatttggtccaggataagcctcttgacagagaagagcagccagaattctctctgaccctcgttgcactggatggtggctctcccccaaggtcgggcacagtgatggtcaggattcttatcatggatatcaacgacaacgcaccagagtttgttcataccccttatggggtccaagtacttgagaattcgcctctcgactccccaattgttagagtcctcgcacgggatatcgacgcgggaaattttggttccgttagttacggactgtttcaggcatccgacgaaatcaaacagaccttctctattaacgaagtgactggggaaatactgcttaagaaaaagttagacttcgaaaaaattaaatcatatcatgttgagatagaggccaccgacggcggagggctatcaggtaaaggcacagtcgtgattgaggtggtggacgtaaatgataatccgccagaattgatcattagcagtctgacttcctcaattcccgagaacgccccagagacagtggtaagcatttttcgtatcagagatagagactcaggcgaaaatgggaaaatgatctgcagtataccagacaatctaccctttattctgaagccgactctgaagaatttttatactctagttacagagcgccctctcgatagggagacaagcgccgagtacaacatcacgatcgcggtcactgatctcggaacgcctcgactcaagacacagcaaaacatcacagtccaggtttccgatgtgaacgacaatgctccagcatttacacagacatcttataccttgtttgtgagagaaaacaattcgcccgctctccacataggtagtgttagcgcaactgaccgagactctggtacgaatgcacaagtgacctacagtttgttgcctccgcaggaccctcatttaccactggcttctttggtgagtataaacgctgataacggacacctcttcgcgctcagaagcctggattatgaagcgcttcaggcatttgagtttcgcgtgggagcctcggatcgtggatctccggcactgagtagcgaagctcttgtgcgagtgctggtgcttgacaccaacgacaatagccctttcgtactatatcccttacagaatggcagcgccccttgtaccgaacttgtgccaagggctgctgaacccggatacctggtcacaaaagtggtagctgtggacggtgacagtgggcagaacgcatggttaagctaccaactgctcaaggcaacagaaccaggactcttcggcgtttgggcccacaacggagaggtgcgaaccgcaaggctcctctcagagcgcgatgcagccaagcacagactcgttgttcttgtgaaagacaacggggagcctccacggtctgccaccgctaccctgcacgtgctgttggtggacggcttctcacagccctatcttcctctgcctgaggccgctcccgctcaggctcaagctgattccctgacagtttacctggtggttgcactggcctcagtttcgtctcttttcctgttctcggtcttacttttcgtggctgttcggctttgtaggcgaagtagagccgctagcgtcggcagatgctctgtccctgagggcccttttccaggtcacctggtagacgtgtcaggcactgggacactcagccaaagctatcagtacgaagtctgcctaaccggtgattccggtacgggcgagttcaaatttttgaagcccatctttccaaatctgttggtgcaagacacaggccgtgaagttaaagagaacccaaagtttcgcaacagcctcgtgttctcctag

SEQ ID NO: 237329 - DNA, 2391 bp, Artificial Sequence
  Description of Artificial Sequence: Synthetic coding sequence
atggaggctgggggagagagattcttaaggcaacgacaggttttgcttctgttcgttttcttggggggaagtctcgctggttctgaatccagacgatactccgttgctgaggagaaagagaaaggcttcctcatagccaatttggccaaggacttgggtctgcgggttgaagagcttgccgcacgcggagctcaggtcgttagcaagggcaacaagcagcacttccaacttagtcatcagaccggggacttattgctcaatgagaaattggacagggaggaattgtgcggccctaccgagccatgtattctgcattttcagatcctactgcagaaccccctgcagttcgttaccaacgagctgaggattatcgatgtgaacgatcacagcccagtgttcttcgaaaatgagatgcatcttaaaatcttagagtccactttgcctggcaccgtcatcccactgggcaatgctgaggacctggacgttgggaggaatagcctgcagaactatactatcacaccaaactcgcattttcacgtgcttactcggtccagaagagatggtcgaaaatatccggaacttgtattagataaggctctggaccgcgaagaacagccagaactgagcctgactttgaccgctttagatgggggaagtccaccacgatcagggactgctcaaataaatatacaggtcctcgacattaatgataatgcacccgaattcgcccaacctctgtacgaggtcgcggtcctggagaacactcccgtgaattcagtgatcgtgaccgtttccgccagcgacctcgacaccgggagtttcggaacaatttcatatgcgttcttccacgccagtgaggagattagaaagacctttcaacttaatcctatcactggcgacatgcaactggtgaagtatctcaatttcgaggctatcaattcttatgaagttgatattgaggcaaaagacggcggagggttgtccggcaagagcacagtcattgtccaagtggttgacgtgaacgacaatcccccagagcttactctgagtagtgtgaactctccaatccctgagaactctggcgagacagtgctggccgtgttttcagttagtgaccttgactccggtgataatgggcgtgtcatgtgcagtatagaaaacaacctgccctttttcctaaagcccagcgtggagaacttttacaccctcgtgagtgagggagccctggatagggaaacccgatctgagtataatatcaccataacaatcaccgatctgggcacacccaggctgaagaccaagtataatatcactgtactggtgagcgatgtaaacgacaatgctccagccttcacgcagatttcctacaccctattcgtcagagaaaacaactcacccgcattgcatatcggatccgtatcagctacagaccgcgacagcggcaccaacgcccaggtgacctactcactgttgccgccacaggacccacatctgcccttaagtagtttggtttcaatcaatgctgacaatggacacctgttcgctctgcgttcactggattatgaggctctccaagcctttgaattccgagtaggagctaccgatagaggcagcccggcactgtctagcgaggcgctcgtgcgggtcttggttctggatgccaacgacaacagtcccttcgtattatacccactgcagaacgggagcgctccttgcacagagctggtccctagggccgcagagcccggttatcttgtgacgaaagtagtagctgtcgatggagacagtggccagaatgcatggttgtcctaccagttgttaaaggcgacggaacccggtctctttggtgtgtgggcgcacaatggagaggttcgcaccgctcgactgctttctgagcgcgatgcagcaaagcacaggctcgtcgtactcgtgaaagataacggggagccacctcggtctgctaccgccacgttgcacgtactgctggtcgatggcttctcccaaccctatctgcctctccccgaagccgctccggcacaggcccaggctgatctgcttacagtgtatctggtggtggctctagcctctgtgtcctcgctgttcttattctccgtcttgctgttcgttgctgtgcggttgtgcaggagatcgcgcgcagctagcgttgggagatgttccgtgcccgagggcccattcccaggacagatggtcgatgttagcggtaccggtaccctttcgcaaagttaccagtacgaagtctgtttaactggtggcagtggcactaacgaattcaagtttctgaaaccaattatcccaaattttgtcgcacagggcgctgaaagagtgagtgaagctaatcccagctttaggaaaagtttcgaattttcttag

SEQ ID NO: 237330 - DNA, 1107 bp, Artificial Sequence
  Description of Artificial Sequence: Synthetic coding sequence
ggaggcgctccccctcggtccggcaccaccaccatccgcattgtggtgttggataacaatgacaacgcccctgagtttctccagtccttctatgaagtgcaggtgccagaaaattcaccacttaatagcctggtggttgtagtgagcgccagggatttagatgcaggagcatatggatccgtagcttatgccctatttcagggcgatgaggtcacccaaccattcgtcatagacgagaagactgcagagattcgtctgaagagggccttggacttcgaggcgacaccctattacaatgtcgaaattgtggccaccgacggaggaggcctctccgggaagtgtaccgtggcgattgaagttgtcgacgttaacgacaacgcacctgaactcactatgtcgactctgagttcacccactcccgagaacgccccagagaccgtcgttgctgtgtttagtgttagcgatccggatagcggagataatggtcgcatgatatgcagcattcagaacgacctgcccttcctattgaagcctactctcaagaatttttacacactggtgactcagcgcactctggaccgggagtcccaggctgaatacaatattaccattaccgttaccgatatggggactcctcgtctgaaaaccgagcacaacatcaccgtactggtgtctgacgtgaacgataacgcccctgcctttactcagactagttacacccttttcgtgagagagaataattcacctgctctgcatatcgggtccgtatctgcaaccgatcgagatagcggcactaacgcacaagtaacttattccctgcttccccctcagaacccccacctgcgtttggctagtttggtctcaatcaatgccgacaacggccacctgttcgccctaagatccctagattatgaggccctgcaggcttttgagtttagagtgggagcaacggataggggttcacccgctctctcctctgaagctctcgtgcgcgtcctttgctggacgccaaccactacgcgtccctcatgctgtatccgttgtagaaccgccagaaggctcgcacccagctggtgccctgggcgaccatccagagccacatggtag

SEQ ID NO: 237331 - DNA, 2388 bp, Artificial Sequence
  Description of Artificial Sequence: Synthetic coding sequence
atggagacagcgttggctaagacaccacaaaaacgccaggtaatgttcctggccattttgctcttactatgggaagcgggtagcgaggctgtgcggtactctattccagaggaaaccgaatccggttactccgtcgcaaacttggctaaggacctgggcctgggggtcggggagctggccactaggggcgctcgaatgcactacaaaggcaacaaagaactgctccagttggatatcaaaaccggcaacctcttgctgtacgagaaactggacagggaggtgatgtgcggcgctaccgagccctgtattctgcattttcagctactgctggaaaacccagttcagttcttccagactgacctccagctgacagatataaatgaccacgcgccagagttccctgagaaagagatgttgctgaagatacctgaaagtacccagcctggcactgtcttccctttaaaaattgctcaagactttgacattgggagcaatacagtacaaaattatacaatctccccgaactcacattttcatgtggccacacataaccggggagacggccgaaagtatcccgaattggtactggataaagccctggacagagaggagcggccagaactctcgcttactcttacggcgctcgatgggggtgcacctcccaggtctgggaccacgaccatcaggatcgtcgttcttgataacaacgataacgcgcctgagtttcttcagtccttctacgaggtgcaggtgccggagaacagccccttaaattccctagttgttgtggtcagcgctcgagatcttgatgctggcgcttacggctccgtggcatatgctctgtttcagggcgacgaagtaacacaaccatttgtcatagatgaaaagacagccgaaattaggctgaagcgggcactcgactttgaagctactccctattataacgtagagattgtggccactgatgggggtggactctccgggaaatgcactgtggcaatagaagttgtagacgtaaatgacaatgcaccggagctgactatgtctaccttgtcatctcccacaccggaaaacgcacccgagactgttgtggcagtcttttctgtatcagatccagactctggtgacaacggtcgaatgatttgctccattcagaatgatctgcctttcttgctgaagcccaccctcaaaaacttttacactctggttactcagcgaaccttggatcgagaatcacaggctgagtacaatatcaccataacagtgacagatatgggcacacccaggcttaaaaccgagcacaacatcactgtgctcgtcagcgatgtgaatgacaacgccccagcattcacccagacctcctacacgctcttcgtgcgggagaataatagccctgctttgcatattggttccgtctctgcaacagatcgggattctggcacgaatgcccaggtgacatactctctgctcccaccccagaacccccacctgcgcctggctagcctggtatccatcaacgcggataacggtcatctgtttgcactccggagtctggactacgaggcgctgcaggcattcgagtttcgagtaggggctactgaccgagggtcacccgctctctcctccgaagctttggtccgcgtgttagtgctagatgctaacgacaatagcccctttgtgttgtatcctttacagaacggaagtgccccttgcacagagctggtgccaagagccgctgagcccggataccttgtgacaaaggtagtggccgttgatggcgactccggccagaacgcttggcttagctaccagttgctgaaggcaaccgaacccggtctgttttccatgtgggcgcataatggagaggttaggacagctcgcctcctctctgagagagatgctgccaagcatcgccttgtggtcctagtgaaagataacggagagcctcctagaagcgcgactgccaccctgcacgtcctgttggtggatgggttcagccaaccatacctgcctttgccggaggctgctcctgcccaggcccaggcagatagcctaaccgtatatctagtcgtagccctggcctccgtgtcctctctttttctgttttcagtgctactctttgtggccgtcaggttatgcaggagatcgcgtgctgcctcagttggcagatgctccgttccagagggcccttttccagggcatctcgtggacgttagtggaaccggcacactatctcaatcatatcactacgaggtttgcctcactggggattctggggcaggggagtttaaattcctgaagccaatcattcctaatctactgcctcagggagctggtgaagagatcgggaagacagctgccttccggaactcatttggactcaattag

SEQ ID NO: 237332 - DNA, 1107 bp, Artificial Sequence
  Description of Artificial Sequence: Synthetic coding sequence
ggcggtagcccacctcgatctggcacatcggagatccagattcaggtccttgacatcaacgacaatgtccccgagtttgctcaggaactgtacgaggctcaggtccctgagaataatcccctgggatccttggtcattaccgtgtctgctagagatctcgacgctggtagctttggtaaggtaagctatgcgctcttccaggtggatgacgtcaatcaaccctttgagatcaatgcaatcactggagagatcagactgagaaaggcccttgatttcgaggagatccagagttacgacgtggatgtggaagccactgacggaggcggtctctctggaaaatgcagccttgttgtgagagtgctggatgtgaatgataatgctccagagctgacgatgtctttcttcattagtttgattccggaaaacctccccgagattacagtggctgtgtttagcgtttctgatgcagattctgggcataaccagcaagttatttgcagcattgagaataatcttccatttctcttgcgtccatctgtggagaacttttatactctggtaactgagggagcgcttgacagggaaagcagagcagaatacaatatcaccatcactgttactgacctgggcacgcctcggcttaagacccagcagagcatcactgtgcaggtctctgacgtgaacgacaacgtgccagctttcacacagactagctacacgttgtttgtgagagagaataattcaccggctttacatatcggctccgtaagcgccaccgaccgcgatagcgggataaatgcacaggtgacctactctctcttgccccctcaggatccacatctgcccctgtcttccctggtgtctattaacgcagataatggacatctcttcgctctccggagcctggattacgaagctttgcagtcctttgagtttcgggtgggggcaaccgacagaggaagtcctgccctgagttccgaagctctggtacgactcctgtgctggacacccacgacaacccgcccttcgtgttgtaccagatgtaggacagcacccaggccagcgccatcctggtgtcccggtcggccatcccgggcaacatggtag

SEQ ID NO: 237333 - DNA, 1977 bp, Artificial Sequence
  Description of Artificial Sequence: Synthetic coding sequence
atgctgctgaagatcagcgagatcactatgcctggcaagattttcccactcaaaatggcgcacgacctagatactggctccaatggtcttcagaggtacaccatatctagcaaccctcatttccacgtgctcacgagaaataggtctgagggaaggaagttccctgagctcgtcctggataagcctctggatagagaggagcagcctcaacttagactgaccctgattgccttggatggaggcagcccacctcgcagtggaacatccgaaattcagatacaggtactcgatatcaacgataacgtaccagaattcgctcaggagctgtatgaagcccaagtgccagagaacaatccgctgggatctctcgttatcaccgtgtcggcgcgagatttagacgccggatcattcgggaaggtgtcgtacgccttgttccaggtcgacgacgtgaaccagcctttcgagatcaatgcaatcactggagagattcgattgcggaaggccctggacttcgaggagatccagtcctacgacgtcgacgtcgaggccaccgatggcggaggattgtccggcaaatgctcgttggtagtaagggtgttggacgtgaacgacaacgcccctgagctcactatgtcctttttcatctccctgattccagaaaatcttcctgagattacagttgccgtgttctccgtttccgacgccgacagtggtcacaaccaacaggtgatatgtagtatcgaaaataaccttccattcctacttaggccatcagtagagaacttttataccctggtgacagagggcgctctggatcgcgaatcacgcgctgagtataacattacaatcacagtgactgacctcggtaccccgaggctcaaaacccagcagagtattaccgttcaagtgtccgacgttaacgataacgtgcccgcatttacccagacaagctacacgctcttcgtaagagaaaataatagtccggctcttcacatagggtccgttagtgcaacagatcgcgacagcggaataaatgcccaggtgacctatagcctgctgcctccccaggacccccacttgccattaagttctctggtgagcattaatgccgataacggacacctcttcgctttgcgttccctggactatgaagccctgcagagcttcgagtttcgtgtcggggcaacagatcgtggctcacctgctctatcatcagaagcactcgtccggctccttgtgctcgacgcgaatgacaatagccctttcgttctctatcctttacagaacggaagcgcgccttgtactgagctcgtgcctcgcgcagcagagcccggatatttagtgacgaaagttgtagctgtagatggtgactccggacagaacgcttggctgtcatatcagttgctgaaagctacagagctcgggttgtttggcgtgtgggcacacaatggcgaagtgaggaccgctcgcttgcttagcgagagagatgcagctaaacaccgcttggtcgtgctcgttaaggacaatggtgagcctccacggtcagctacagctaccctgcatgtgctgttagtggacggattttcacaaccttacctgccactgccagaagcagccccagctcaggcacaggctgattcactgaccgtgtacctcgtggtggctctagcctcggtctcctccctgtttctcttcagtgtactgctattcgtggccgtgcgcctgtgtcgccgtagccgcgctgccagcgtaggcagatattcagtgcccgaagggcctttcccgggacaccttgtggatgtgtcagggacaggtacactatcccagagttatcaatataaggtgtgcctaaccggcggatctgaaaccaatgaattcaaattcctgaaaccgattatgccaaacttcccccctcagggcactgagagagaaatggaggagacacccacttccagaaactcattcccattcagttag

SEQ ID NO: 237334 - DNA, 2385 bp, Artificial Sequence
  Description of Artificial Sequence: Synthetic coding sequence
atgatgcaaaccaaagtgcagaataagaaacggcaagtggcgttttttatcctgctcatgctgtggggagaagtgggctccgagtccattcagtattccgtgctcgaggaaaccgaatctggaactttcgtggcaaacttgaccaaagacctcggcttgcgcgtgggtgaactggcatcgcgtggagctcgagtcgtcttcaaaggaaaccggcagcacctacagtttgatccccagacccacgacctgttgctcaacgagaagttagaccgggaggagctgtgtggctccacggagccctgtgtgctgccattccaggtgctcctggaaaacccactgcaattttttcaggcaagtctcagagtcagagatattaacgaccacgctccagagttcccagcgagagagatgttgctgaagatcagcgaaattaccatgcccggtaagatttttccgctcaaaatggcccacgacctcgataccggttctaatggactccaacgatataccatttcttctaatccccacttccacgtgttaactaggaatcgaagcgaggggcgaaaatttcccgaactcgtcctggacaaaccccttgaccgggaagagcaacctcaactgagactcacacttatagctctcgatgggggtagtccgccaagaagcggcacttcagagattcaaattcaagtgctggatatcaacgacaatgttcctgagttcgcccaagaactgtatgaggcacaggttccagagaacaaccccctagggtcccttgtgatcacagtatcagctagggatctagatgccggatcttttggaaaggtcagttacgcattgtttcaggtagatgacgttaaccaacccttcgagatcaacgctattactggtgagattcgcctgagaaaagcgctggactttgaagagattcagagctacgatgtcgatgtggaggcgacagatggaggaggactctcaggaaagtgctctttggtcgtcagggtgcttgatgtaaacgataatgctcctgaactgacaatgtccttctttatcagcttgattcctgagaacttaccagagataacggtggccgtcttttcggtgtccgatgccgacagcggtcataatcagcaggtgatttgttcgatcgaaaacaacctgccttttttattgcgccctagtgtggaaaacttctatactcttgttaccgaaggagcacttgaccgcgagtcaagagcggagtataacatcaccattacagttaccgatctcgggacccctcgcctgaagacccagcagagtatcacggtgcaggtgtctgacgtcaacgataatgtccctgcattcactcagactagctacacgttgttcgtccgtgaaaataattcccctgccttgcatatcggctctgtgtctgcaacagaccgggatagcggaattaacgcccaggtgacctactctttacttccacctcaggaccctcatctgcctctctcaagtctcgtctcaatcaacgccgacaacgggcatctgttcgcactgaggagtctggactacgaggctctgcagtcatttgagttccgagttggcgcaacagaccgagggtctcctgcactgtctagcgaggctctcgtccggcttttggtactggacgcgaatgataatagcccatttgtgctctatccgcttcagaacggatccgccccatgtacagagctggtacctcgtgctgccgaaccgggttatttagtaacaaaagtggtagctgttgacggcgattccggtcagaatgcttggttgtcttaccagcttctcaaagcgaccgaactggggctattcggcgtctgggctcacaacggggaggttcgaaccgccaggttactgagtgaaagagacgccgcaaaacatcgtctggtcgtcctcgtgaaagataatggtgaacctcccagatctgccacagcaacgctacacgtgttgttggtggatggattcagtcaaccctacctacctcttcccgaggccgcacctgcccaagcccaagccgactcactcaccgtgtacctggtagtggcgctcgcttcagtcagtagcctgttcttgttcagcgtcctcctgttcgtcgccgtgcggctgtgtaggaggtcccgggcagcctcagttggtagatactccgtgcccgagggccctttccctggccatctggtggatgtgtcaggcacaggcaccctgtcgcaatcataccagtataaggtctgtcttaccggtggcagcgaaactaacgaatttaaattccttaaaccaattatgccaaacttcccacctcagggaacagagcgagagatggaggaaaccccaaccagtcggaattctttcccttttagttag

SEQ ID NO: 237335 - DNA, 1107 bp, Artificial Sequence
  Description of Artificial Sequence: Synthetic coding sequence
gggtctcctccgaggtctggtacggcgctcgtgaggatccttgtgcttgacgtcaatgacaatgccccagatttcgttcgatcactgtataaagtgcaggtcccagaaaactcgccggtgggctctatggtcgtcagcgttagcgctcgggatctggacacaggatccaacggggagattgcatatgcctttagctatgccactgagaggattctgaaaacgtttcaaataaatccaaccagcggcagcctccatttgaaagcgcagttggactacgaagcaatacagacatatacgctcactatacaggccaaagatggcggtggcttaagcggcaaatgcaccgtggtggtggacgtgacagatatcaacgacaacaggcctgagctgctactcagctcattgacgtcaccgatagcggaaaactcacccgaaacggtagtggccgtgtttcggatcagggaccgagacagtgggaataatgggaagaccgtttgtagtattcaggatgacgtgcccttcatcctgaagccaagcgttgagaacttctacacgctggtgacggagaagccactcgacagggagcggaacacagaatataacatcaccatcacagtcactgacctggggaccccgagactgaagacagagcacaacatcacggttctcgtctctgacgtgaacgataatgcccctgcctttacacaaacatcctatacactgtttgtgcgggaaaataatagccccgctctcccaatcggcagtgtttccgcaacagaccgagatagcggtaccaatgcacaggttatttacagcctgttgccttcccaggatcctcatctgcccctagcttcgctcgtttctatcaatgccgataatggccacctgtttgcactgcgaagtctcgactacgaggctctgcaggcctttgagttcagggtgggggctaccgacagagggtctcccgctttgagtagtgaggccctggtgagggtcttatgttggacaccaacaaccaccagaccctcatgttgtactaggtgccgcaccgccccacggccagcccctagccgctgtcccggtcgaccatcccgcgcaacctggtag

SEQ ID NO: 237336 - DNA, 2406 bp, Artificial Sequence
  Description of Artificial Sequence: Synthetic coding sequence
atggaagcatcaggcaaactcatctgcagacaacgccaggtgctcttcagctttctgcttcttggactgagcttggcaggcgctgcagagccaaggtcctacagtgtcgtcgaggaaacagagggaagcagctttgtgaccaatctcgccaaagatctgggtctcgagcaacgcgaattttccagaaggggcgtgagggttgtcagtcggggtaacaaacttcatctccagctcaaccaggagacagccgatttactactgaatgaaaaactggacagagaagatttatgtggacataccgaaccgtgtgtcttgcggtttcaggtgctgctcgagagcccattcgaattctttcaggcagagctgcaggttatagatatcaacgaccacagtccagttttcctcgataagcagatgttagtcaaagttagcgaaagctccccaccgggtactgccttccctctgaaaaatgcagaggatctggatatcggtcagaacaacatcgagaattacatcataagcccaaattcttacttccgagtcctgacaaggaaacgctctgacggtcggaaatatccagagctggtcctggacaaggcactcgacagggaggaggaagccgaattgcgactgactctgaccgcactcgacggcggttcaccacctcggtctggcacagctcaggtgtatatagaggtcgtcgatgtgaatgataatgcacctgagttcgagcaacctttctaccgagtgcagataagtgaagacagtcccatctccttcttagtcgtcaaggtcagcgcgaccgatgtggataccggcgttaacggcgagatatcttactcactctttcaggcctccgatgagataagcaagacttttaaggtcgactttctcacaggggagattcgactgaagaaacagttggacttcgaaaagttccaatcgtacgaggtgaacatagaggcacgtgacgccggaggcttcagcgggaagtgtaccgtcctcatccaggttatcgatgtgaatgatcacgctcccgaggttacgatgtccgctttcaccagccctatccccgagaacgcacctgagacagtggtggctctattcagcgtcagcgatctcgattcaggggaaaacggaaaaatatcatgctctatccaggaggatctcccgtttttgcttaagagttctgtgggcaatttctataccctgctgaccgagacacccctcgacagagaaagcagggccgagtataacgtcactataacagtgaccgatctggggactcctcggcttacaacacacctgaacatgactgtcctcgtctctgatgtaaatgacaatgctcccgctttcacgcaaaccagctacaccctgttcgttagggaaaacaattctcctgctcttcacatcggatctgtctcggccacagacagggattccggtaccaacgctcaggtcacatactctctgctcccccctcaggaccctcacctgccgctggcatctctggtgtctattaacaccgacaatggccacctgttcgcactgcggagcttggactacgaagccctgcaagcattcgaattccgggtgggcgcttccgacaggggctccccagccctgagctccgaggccctggttagggtcctcgtcttggacgccaacgacaacagcccatttgtgctgtaccccctccaaaacggctccgcaccttgcacagagttagtccctcgcgcagcagagcccggataccttgttactaaggtggtggcagtggacggcgattctggacagaatgcctggctgtcgtatcaactgttgaaagctactgagcctggtctgtttggcgtatgggcccacaatggggaggtgcgcactgccagactgctgtctgaaagggacgcggcaaaacagcggttggtagttctggttaaagataatggagagcctccctgcagtgccacagcaacactacaccttctgttggtggacggattttctcagccctacctgccactgccagaggcggctccggcacagggccaagccgacagcttgaccgtgtacctggtggtggcactggcttctgtgtccagcctctttctcttttcggttctgctctttgtggcggtcctgttgtgccgtcgcagccgcgctgcaagcgtagggcgttgcagcgttcctgaaggacctttcccaggacatctcgttgatgtccgtggtaccgggtcgttgtctcaaaattaccagtacgaagtctgtctggcgggagggtcaggtaccaatgagttccagttcctaaagcctgtactcccgaacatccaagggcattctttcggccctgagatggaacagaactctaatttccgcaatgggttcggcttctctcttcaactgaaatag

SEQ ID NO: 237337 - DNA, 2472 bp, Artificial Sequence
  Description of Artificial Sequence: Synthetic coding sequence
atgaaaatccaaaagaaactcacaggatgcagccgtctgatgctgctctgtctctcgctcgagttgctgctggaggcaggggctggcaacattcactacagcgttccagaagagaccgacaagggatccttcgtcgggaatattgccaaagaccttggcctgcaaccccaggagctagccgatgggggagtgcgcatcgtgtcccgcggaagaatgcccttatttgccctcaacccacgaagcgggtcgctgatcactgcaagaagaattgaccgcgaggagctctgcgcgcagtccatgccatgcctggtgagttttaatatccttgtcgaggataagatgaaactctttccggtggaagtcgagattatcgatattaatgataacacaccacagttccaactggaggagctcgagttcaaaatgaatgagataacaacgcctgggaccagagtctctcttccatttggacaggacctcgacgtgggaatgaactcgctccagtcatatcagctatcctcaaatccacatttcagcttggatgtgcaacaaggcgctgatggccctcagcatcctgagatggtgctacagtctcctcttgaccgcgaagaggaggccgttcatcacctcatcctgacggccagcgacggcggagaacctgtgcgcagcggtacactgcgcatttatatccaagtggtggacgccaacgataaccccccagcgtttacccaggcacaataccacatcaatgtgcccgagaatgtgccactcggaacacagctcctgatggtaaatgccacagatcctgatgaaggagcaaatggcgaagtgacctattcatttcacaacgtggatcacagggtcgcccagatattcagactggacagctataccggagaaataagcaacaaggagcccctggattttgaggaatataaaatgtactccatggaagtccaggcccaggatggcgcaggcctgatggccaaggtcaaggtgttaataaaagtcctggatgtcaatgacaacgcacccgaggttaccattacaagcgtaactacggctgtcccagagaactttcctccaggtaccatcattgcattaatatctgtgcatgaccaggattcaggcgacaatgggtacacaacttgttttataccgggaaacctaccgttcaagctggaaaagctcgtggacaactactatcgtcttgttacagagaggaccctcgaccgggagctgatcagcgggtacaatataacaataactgcgatcgatcaaggaactcccgctttaagcacagaaacccatatttcgttacttgttacagatatcaacgataattcacccgttttccaccaggacagctactccgcctacattcctgaaaacaaccctagaggcgcttccatattcagtgtccgggcacacgatctggacagcaacgagaatgcccagattacctactcacttatcgaagatacaatccagggggcaccgctatctgcttacctctctataaacagcgacacaggcgttctctacgccttgagaagctttgactatgagcagtttcgtgacatgcagctcaaggtgatggccagggactctggagatccacctctgtcaagcaatgtttcactgagcttgtttctgctggatcaaaacgataacgccccagagattctgtatccagctttgccaaccgatggatctactggtgtggaattggctccgcttagcgcggaacctgggtatttagtcacaaaggtggtcgctgtcgacagagattctggccagaacgcttggctctcttatcgcctgctcaaggcttccgagcccggacttttcagcgtggggctacacactggagaggtccgcacagccagggctctcctcgacagagacgctctgaaacagagcctggtggtagctgtgcaggaccacgggcagccgccactctccgctactgtgacacttaccgtggctgtggccgatagaatcagcgacattttagcagacctgggctccctcgagccgagcgccaagccaaatgacagcgacctcacactgtacttggttgttgctgcagccgctgtcagttgtgtctttttagcttttgtgatcgtgctcctcgctcaccgcctccggagatggcacaaatctagattgctgcaggcatctggtggaggactggcctccatgcctggttcccactttgtgggagtggatggagtgcgggctttcctgcagacctactcacatgaggtgagcctgaccgcagatagcaggaaaagccatctgatctttcctcagcctaactatgccgatacgcttatctcacaagaatcttgcgaaaaaaaaggttttctttcggccccacagagtttgctagaggacaagaaagagccttttagccaagtcaacttctgcgatgaatgcatcagttatttggagaaaaacaatagctag

SEQ ID NO: 237338 - DNA, 2796 bp, Artificial Sequence
  Description of Artificial Sequence: Synthetic coding sequence
atgaagattcaaaagaagcttacaggctgcagtagactgatgcttctctgtctgtctctggagttgctgcttgaagctggcgctggtaacatccattactctgtgcccgaggaaactgacaagggatcttttgtgggtaacattgctaaggatttgggcctgcagccgcaggaactcgccgacgggggtgtgagaattgtatcccgcggacgaatgccactcttcgctttaaatcctaggtccggttctttgatcaccgctcgtcggatcgatcgcgaagagttatgtgcccagtctatgccctgcctcgtgtcctttaatattctggtcgaggataaaatgaagctgttccccgtcgaggtggagatcatcgacataaacgacaataccccccagttccagttagaggaactggaattcaaaatgaacgaaatcacaacgccagggaccagggtgagtctgccattcggccaggatctggatgtgggcatgaacagcttgcagtcctatcaactgagctctaatccccatttttcgctagacgtgcaacagggagcagacggcccacagcaccctgagatggtgctgcaatcccctctggaccgggaggaggaggcggtccatcacttgatcctgaccgcctctgatgggggtgagccagtgaggtccggcaccctgcggatctatatccaggtggtggatgccaacgataacccacctgctttcacacaggctcaataccacataaacgtgccagagaatgtacctctcgggacgcagctgctgatggtgaatgccacggaccccgatgagggagctaacggagaagtgacttactcctttcataacgtcgaccaccgagtggcccagatttttaggctggacagctataccggtgagatctcaaacaaggaaccattggacttcgaagagtataagatgtatagcatggaggtgcaggcacaagatggcgcaggactgatggccaaggtaaaggtcttaattaaagtcctcgacgtgaatgacaacgctcccgaggtgacgataacgtctgttaccaccgctgtgcctgaaaattttcctcctggaacaatcatcgctctcatttcagtgcatgaccaagatagcggggataacggatatacaacgtgtttcatacccggaaacttaccctttaaactcgagaaattagtcgacaattactatcgactggtgaccgagagaactcttgacagggagctcatttctggctataacatcaccatcactgcaattgatcaaggcacccctgccttaagcaccgagacccacatctctctcctggttacagacatcaatgataactctcctgtctttcaccaggattcttacagcgcctacattcccgaaaataatccacggggtgcctcgattttttcagtgagggctcatgatctagactcgaatgaaaatgcccaaatcacctacagcctgatcgaggatacaattcagggcgctccgctttctgcttatctgtccattaacagcgatacaggtgtgctatacgccctgcgaagcttcgattatgagcaattccgcgacatgcagctgaaggtgatggcgagggacagcggcgatcccccactgtcttcaaatgtgagcctctccctgttcctcctcgaccagaatgacaacgcacctgagatactgtacccagctctgcctaccgacgggagtaccggtgtcgaactggcccctctgagcgccgaaccaggatatcttgttacgaaggtcgtagcagtcgatcgcgattccggccagaacgcgtggttgagttataggttactcaaggcctccgagccaggcttgttctcagtgggcctccataccggggaggttagaaccgctagagccctgttggaccgcgacgctctgaaacagtcacttgtagtggccgtgcaggatcacgggcagccgcctcttagcgctacagtgacattgaccgtcgccgtggcagacagaatctctgatattctagccgatctgggtagcctcgaaccatctgctaaacccaacgatagcgaccttacattgtatctggtggttgccgctgctgctgtctcctgtgtctttcttgcttttgtaattgtgttacttgcacatcgcctgcgaagatggcataagagcagactgctccaggcaagtggcggaggtctggcttcaatgcccggaagtcacttcgtaggtgtggatggtgtgagggccttcttgcagacgtacagccatgaagtgtcccttaccgccgactcaaggaagagtcaccttattttcccccaacccaattatgccgacacactcatttcccaggagagttgtgagaaaaaaggctttctaagcgcaccacaatccctgctggaggataaaaaggaaccatttagtcagcaggcgccacccaacacagattggcgattctcccaggctcagagaccaggaacttctgggtctcaaaatggtgatgacacgggcacctggcccaataatcaattcgacacagaaatgctgcaggctatgattcttgccagcgccagtgaagccgctgacggttctagcacactgggcggtggagcgggaaccatgggactgagcgcccgttacgggcctcagtttactctgcagcacgtgccagactaccgacagaacgtgtatattcccggatcaaacgcaacgctgacgaacgctgctggaaaacgggatggcaaagcccctgcgggtggaaacgggaacaagaaaaagagtggcaaaaaagagaagaaatag

SEQ ID NO: 237339 - DNA, 2811 bp, Artificial Sequence
  Description of Artificial Sequence: Synthetic coding sequence
atggcagcccagaggaacagatccaaggaatccaaagattgttccggcttagtattgttgtgcctgttcttcggtattccctgggaggcaggggcaagacaaatctcttacagcataccagaggagctcgaaaagggctctttcgtcggtaatatcagcaaggacctgggcctggccccaagggaactggccgaacgaggtgtgcggatcgtgagcagagggcgtacccaactgttctcccttaatccacggtctggttccctaattaccgccggtaggattgatcgggaggagctgtgtgctcaaagtgctaggtgcgtggtttctttcaacatactggtcgaggatagggttaagctctttggtatcgagattgaagtgaccgatatcaacgataatgcgccaaagttccaagcagagaatcttgacgtcaagatcaacgaaaatgtggctgcgggtatgcggtttccacttcccgaagctattgacccagatgtcggcgtaaactccctccagtcctatcagctctcgccaaacaaacacttcagcctgcgggttcaaagcagggctaacggcgtgaaatatccggaactcgttctggagcacagtctggaccgcgaagaagaagctattcatcacctggtgctcactgcgtccgacggcggagatcctctgcgttctggaaccgtgctagtgtccgtcaccgtcttcgacgcgaacgacaacgctcctgtgttcaccctccccgagtatagagtgtcagtgcctgagaacttgccagtgggcacgcagctacttacagtgaccgctacagacagggatgagggggctaacggcgaggtcacatactcctttcgaaagctgcccgacacacagctactcaaattccagttaaataagtatacgggagaaataaagatttccgaaaacctggattacgaggaaaccggcttttatgagattgagatccaggccgaagatgggggagcctacctcgctacagcaaaagttctgataacggtcgaggacgtgaacgataattctcctgaactaactataactagtctcttctcccctgtcacagaagatagtcctctaggtacagtagtcgctctcttgaacgtccacgacctggattccgaacaaaacgggcaggttacctgctccattcttgcctacttaccatttaaactagagaaatctatcgattcttattacagactggtcattcaccgagccctcgatagggaacaggtatcgtcctataacatcacggtgacagccacggatggcggaagccctccattgtccactgaggcccatttcatgctccaggtggccgacattaacgacaaccctccaactttttcacaggtgtcatattttacctatatccctgaaaacaatgcaaggggggcatctatatttagcgtgacagccctggatcctgactccaaagagaacgcccagatcatttattcactggctgaggacaccatacaaggtgtgccactgtctagttacatctcaattaacagcgatactggggtgctctatgctctccgcagcttcgattatgaacagtttcacgaactccagatgcaggtcaccgcgagcgattcaggggacccccctctttcctcaaatgtgagccttagcctgttcgtgttggaccagaacgacaacgctccagaaatcctgtacccagcccttccaacggatggcagtacgggtgtcgaacttgctcccaggtccgcggagccgggatatctcgtgaccaaggttgtggcagtcgacagagattccggtcagaacgcttggcttagctaccggctgttgaaagcgagtgagccgggactttttgccgtaggcgaacacacaggcgaggtgcgaacggcgagagctttgctcgatagagatgcccttaagcagagcctggtagtcgctgtccaggaccatggccagcctccgttaagcgctactgtcacgctaacagtggctgttgccgatagtatccctcaggtcctcgctgatctcggcagtttcgaatctccggctaatagtgagacttctgacctgaccttgtatctcgtggtggcagtggctgctgtctcatgcgtattcctggctttcgtgattgttctgctggctcacagactacgcaggtggcacaagtcacgactgctgcaagcttccggcggaggcctgacaggtgtctcaggttcacatttcgtgggcgtggacggcgtgcgcgctttcctgcagacctactctcacgaagtatcacttacagccgactccaggaaatcacatcttatttttcctcagcctaattatgcggatacactgattagtcaggagagttgtgagaagaacgatccactgagcctgctggacgatagtaagttccccattgaagacacacctttggtccctcaagccccacccaataccgactggaggttctcacaggcccagcgcccaggcacgtccggctcccaaaatggagacgataccggaacttggcccaacaatcagttcgacactgaaatgctgcaggcaatgatcttggcatccgcatcagaagctgcagatggaagctccaccctgggagggggagccggaactatgggcctgtctgctcggtacggacctcagttcaccctgcagcacgtgcctgattacagacaaaacgtgtacattcctgggtctaatgctactctgacaaatgccgcaggcaagcgcgacggaaaggccccagctggaggcaatggaaacaaaaagaaaagcggcaagaaagaaaaaaagtag

SEQ ID NO: 237340 - DNA, 2808 bp, Artificial Sequence
  Description of Artificial Sequence: Synthetic coding sequence
atggctaaccgattgcagaggggcgaccgctcacgactgctgctgctgctgtgcatttttctcgggactctgagaggcttccgcgctaggcaaattcgctactccgtccccgaggagactgaaaagggctctttcgttggtaacattagcaaagacttagggcttgaacccagggaactggccaagcgaggagtccgtatcgtgtccagaggaaagactcaactttttgccgtgaatcctcgcagcggtagccttattactgcaggcaggatagaccgggaggaactctgcgagacagtatcaagttgctttttaaacatggagctgctggtggaagacactctgaaaatttacggcgttgaagttgagattatcgacataaacgacaacgctcctagtttccaggaggatgaagtggaaattaaggtttctgaacatgctattcctggtgctcgcttcgccctccctaatgcccgagatccggacgtgggggtcaactcactgcaatcttatcaactgtcccccaacaattacttctccctccagttaagggggcgaactgatggcgcaaagaaccctgagctcgtgctcgagggttccctagacagggaaaaagaagcagcccatctgctcctattaaccgctctggacggaggagacccaatcaggaaaggagcagttccaatacgggtcgttgtgctggatgtcaacgatcatattcccatgttcacccaatcggtgtatcgggtcagtgttcccgagaatattagctccggcacccgcgttctgatggttaacgctaccgacccagatgagggtatcaatggagaagtgatgtacagttttagaaacatggaatcaaaagcctccgagatctttcagctggatagccagactggggaggtgcaggtgagaggtagcctcgattttgaaaagtaccgattttatgaaatggaaattcagggccaggacggcggtggcctgttcacaaccactacaatgcttataaccgtggtcgacgttaatgacaatgctcctgaaattaccattacatcatccatcaactcgatcctagagaactcgccgccaggaacagtaatcgcactccttaacgtccaggatcaagatagtggcgagaacgggcaagtcagctgttttatacccaaccacctgcccttcaagctggagaagacttacgggaattactataagcttattacctcccgcgttctggatcgcgaactggtccagtcctataatatcaccctcacagcgaccgatcagggatccccccctctcagtgccgaaacccacgtttggttgaacgttgccgatgataatgataacccccctgttttccctcatagctcttactccgcgtatatacccgagaataacccacgcggtgcaagcatcttctcagtcactgccctggatccggacagcaagcagaacgctctcgtgacatacagcctgaccgatgataccgtccagggggttccactatcttcatacgtctccatcaattcaaatacaggggtcctgtacgctctgcagagtttcgattatgagcaattcagggacctggaattgagagttattgccagagactctggggacccaccgcttagctccaatgtttcactatccttatttgtgctcgatcagaacgataacgccccagaaatactgtaccctgccttgcccaccgacggatccaccggggttgaactggcaccgagatcggcggaaccgggatacttagtgactaaggttgtagctgtggacaaagacagtggtcagaacgcgtggctatcctaccgcctccttaaggcttctgaaccaggactgttcgctgtcggcgagcacactggggaggtccggactgccagagcccttctggaccgagatgcgcttaaacaatctcttgtcgttgcagtccaagaccatggtcaaccacccctttccgctaccgttactctgactgtagcagtggcagatagcattcccgaggtgcttgccgacctggggtcactggagtcgctcgcaaactctgaaactagcgacctcagcctctacctggtagtggctgtggccgcagtatcctgcattttcctagtgtttgtgatagttctcttggcgctgaggttgtggagatggcacaagtcacggctgttgcaggcgtctgagggaggactggccggaatgcctacctcgcattttgtgggcgtggacggggtccaggccttcctccaaacctactctcacgaggtgtccttaattgccgattctcaaaaaagccacctcatattcccccagcccaattatggggacacactgatcagccaggaatcatgcgagaaaagcgaacccctactgatcgccgaagactctgccattatcctcgggaagtgcgatcctacttccaatcaacaggcaccacccaatacagattggcgcttctctcaggcgcagcgtcccggaacatcagggtctcagaacggagacgataccggcacctggcccaataaccaatttgacactgagatgctgcaggccatgatccttgcaagtgccagcgaggcagcagatggcagcagcactctcgggggtggagcgggaactatgggtctgtcggcgaggtatggccctcagtttactctccaacatgtgcctgattacagacaaaatgtgtacattccaggaagtaatgctaccctcacgaacgcagcaggaaagagagacggcaaggcacccgctgggggaaacggcaataagaagaaaagcggaaagaaagaaaagaaatag

SEQ ID NO: 237341 - DNA, 2253 bp, Artificial Sequence
  Description of Artificial Sequence: Synthetic coding sequence
atggcgaacagacttcagcgcggtgacaggagccggcttctgctcctactgtgtatctttctaggtactctaagaggtttcagggccaggcagatacggtatagtgtcccggaggagaccgaaaaaggcagcttcgtgggaaatatctcgaaagatcttggcctggagccccgagaactcgcaaagcgtggtgtcaggatagtgagtagggggaaaacccagctgttcgcggtaaatcctcgaagcgggagcttgatcacggccggacgaatcgaccgtgaggagctttgcgagaccgtcagttcctgtttcctgaacatggaactgctggtcgaggacacccttaaaatttacggcgtggaggtggagatcatcgacattaatgacaacgcacccagcttccaggaggacgaggtggaaattaaggtttccgagcatgctattccgggagcacgctttgccctgccaaatgccagggatcccgatgtgggtgtgaattctctgcagtcgtaccagttgagcccaaacaactacttctcactgcaattaagaggacggaccgatggcgctaaaaaccctgaattggtcttagaaggcagcctcgatagggaaaaggaggccgcacatctccttctgctgaccgccctggatgggggtgatcccatcaggaagggtgcagtgcctatccgtgttgtggtgctagacgttaatgaccacatccccatgtttacacagtccgtgtatagagtaagcgtcccagagaacatctccagcggtacaagagtcctgatggttaacgcgacggaccccgatgaggggatcaacggagaagttatgtattcatttcggaacatggagtcgaaggcatctgaaattttccaactggatagccaaacaggtgaagttcaggtgcgcggatctctcgattttgaaaagtaccgcttttacgaaatggagatccagggccaagacgggggaggactcttcacaacaaccacaatgttgataaccgtcgtggatgtaaacgacaatgcccctgaaattaccatcaccagcagcattaattctatccttgaaaatagcccgccaggaaccgtgatagcattgctcaacgtccaggaccaggatagtggcgaaaacggtcaggtgtcttgtttcattcccaaccacttacctttcaagctggaaaagacgtatgggaattattataagcttattacatccagggtgttagatagagagctggtgcaatcctataatatcacgttgaccgccactgaccagggcagtccccctctcagcgccgaaacgcatgtttggctgaacgtcgccgatgacaacgacaatccacccgtgtttccccatagcagttacagtgcttacattcctgagaataatccaagaggtgcgtctatcttctctgtcactgccctcgaccccgactctaagcagaacgccttagtcacatactctcttactgatgatacagtccaaggagtccctctgtcctcgtacgtgagtattaatagtaacacgggcgtgctgtacgcactgcagagtttcgattacgagcagtttcgggacttagaactcagggtgattgcaagggatagtggcgaccctccactgtcttccaacgtttccctgtctctgtttgtcctagatcagaacgataacgcaccggaaatcctctatcccgctctccccacagacggttcaaccggagtcgagctcgctccaaggtctgcagaacctgggtatttggtcacgaaggtggtggcggtggataaggacagtggtcagaatgcatggctgagctataggctacttaaggcctccgagccagggctgttcgccgttggggagcacacaggggaacaggcacctccaaacacagattggcgtttctcccaggcacagagacctggcacatctgggtctcagaatggagatgacactgggacctggcctaataaccagttcgataccgagatgttgcaagcgatgatccttgccagcgcttctgaggccgcagatggctcctcaacgctgggcggtggcgcaggaactatgggcttgtccgccaggtatggaccccagtttacactccagcacgtccctgactacagacagaatgtgtatattccgggaagcaatgctactttgaccaacgctgccggtaaacgcgacggcaaggcgccagctgggggtaacggaaataaaaaaaaaagcgggaagaaggaaaaaaaatag

SEQ ID NO: 237342 - DNA, 2799 bp, Artificial Sequence
  Description of Artificial Sequence: Synthetic coding sequence
atgattcctgcacgcctgcacagagactataaaggattagtgcttctcgggatactgttgggaactctctgggaaacgggatgtacccagatcaggtattccgttcccgaggagcttgaaaaggggtctcgtgtcggggacatttccagagatctgggcctggagccgcgtgagctggcagagagaggggtgagaataatcccaagagggaggacgcaactcttcgcgcttaatccaaggagtggctcactcgtcacggcaggacggatagaccgagaggaactgtgcatgggggcaatcaaatgtcagctgaacctcgacattctcatggaggacaaagtgaagatatatggggttgaggttgaagtgagagacatcaacgacaatgcgccttatttccgagaaagtgaactggaaataaaaatttctgagaatgctgccaccgagatgagattcccccttccccacgcctgggatcctgatattggaaagaatagcttacagtcttatgagctctcacctaacacgcatttttctctaatcgtccagaacggagccgacggtagcaagtatcctgagctcgtactcaagagggctctggaccgcgaagagaaagcagctcatcacttagtcttaacagccagcgatggtggggatcccgttaggacaggaaccgctcgcattagagttatggtgctggatgccaatgacaatgcgccagcctttgcccagccggagtacagggcatctgtgcctgagaacctggctcttggcacccagctgctcgtcgtcaatgccactgaccccgacgagggggtaaacgccgaagtgcggtactcattcagatacgtggacgataaagctgctcaggtctttaaacttgactgcaacagtggtactatctccaccataggtgagctggatcatgaggaatcggggttctatcagatggaggtgcaggcgatggacaatgccggttatagtgcacgggctaaagtgctcattaccgtgctggacgtgaatgacaatgctccagaagtggtgctcacgtcattggccagctccgtgccagaaaattccccacgtggaactctgatcgcccttttgaacgtaaacgatcaggacagtgaggaaaacggacaggttatatgcttcatccagggcaatctgccctttaagttagaaaagagttacggtaactactattctttagtcacagatatcgttctcgaccgcgaacaggtgccctcctacaatattacagtgaccgcgacagaccggggtactcctccactgagtaccgagactcatatcagtcttaacgttgcggacaccaacgataacccgccagtgtttccacaggcgtcctacagtgcgtacatcccggaaaacaaccctagaggcgtgtcactcgtaagcgtgaccgcccacgatcctgattgcgaagaaaatgctcagataacctatagtctggccgaaaacaccatccagggcgcaagcctgtcatcttacgtgagtattaattccgatacaggggttctgtatgccctgagttccttcgattacgagcaatttagggatctgcaggtgaaggtgatggcgagggataatggacatcctcccttgtccagtaatgtgagtctctcactgttcgtgcttgatcagaacgacaatgcacccgagatattatacccggcactgccgactgatgggagcaccggtgtcgagttggcccctagaagtgctgagccaggttacctagtgaccaaagttgttgcagtggaccgggactcgggccagaatgcatggttgagctaccggctactgaaggcatccgaacccggattgttttcggtcggcctgcataccggtgaggtacggaccgcacgggcactgctggacagagatgccctgaaacagtctttagtggtggccgtccaggatcatggacagccacctctttctgccaccgttactctgaccgtggctgtcgctgactcaatcccgcaggtcctggcagacctgggctcgctggaaagcccagcgaacagtgaaacttctgacctgacgctttacctcgtcgttgccgtggccgctgtctcttgtgtgtttctggcgttcgttatccttctgctggccctgagactacgacgatggcacaaatcacgactgctgcaggcctctgggggtggtctcactggcgctcctgcctcacacttcgtgggagtggacggagtacaggcattcctacagacttactcccatgaggtgtctctgacgactgactcacgcaagtcccaccttatctttccccagccaaattacgccgacatgctggtgagtcaggagtcctttgaaaaatctgagcctcttctgctgtcaggcgacagtgtgttctctaaagactcgcatgggttaatcgagcaggcaccccctaatacggattggcggttctcccaggctcagaggcccggtacctccggatcccaaaatggcgatgacaccggcacttggccaaataaccaattcgatactgaaatgctacaggccatgatcctggcgtcggccagcgaggccgctgatggttcaagcacactcggcggtggcgctgggactatggggcttagcgcaaggtacggccctcagttcacactccagcatgtgccagactaccgtcagaatgtgtatatacccggaagtaatgcaactctcacaaatgccgctggtaagagggacggtaaggccccagccggaggaaatgggaataaaaaaaagtcgggtaaaaaggaaaagaagtag

SEQ ID NO: 237343 - DNA, 2799 bp, Artificial Sequence
  Description of Artificial Sequence: Synthetic coding sequence
atggccgctcttcaaaagcttccacactgcagaaaactcgttctgctgtgttttctattggctacgctctgggaagcaagggctggccaaatccggtattcagtcagggaggaaattgacagaggcagcttcgtggggaatatcgccaaggatctcggcctggagcctctggccctggcggaacagggtgttagaattgtgtcccgaggacgcagccaactgttcgccctgaaccccaggagcggatcactggtcactgccaacagaattgaccgtgaggaactgtgcgctcagtccgccccatgcctcctcaacttcaatatcctgctggaggacaaactgacgatttatagcgtggaggtggagataacagatataaatgataacgctccacgctttggcgtagaggaactggagctgaagatcagcgaaaccaccactcccggtttccgaatccctctgaagaacgcccacgatgcggatgtgggcgaaaacgcattgcaaaagtatgcgcttaatcctaacgaccacttttctcttgatgtgagaagaggggctgacgggaacaagtaccccgaactggtcttggagcgttctctggatcgcgaagaggaagccgtacaccacctagtgttagttgccagcgatgggggtgatccggtcctctcaggcacctctcgcatttgtgtgaaggtgctcgacgccaacgacaatgccccagtgttcacacagccagaatatagaatcagtataccagaaaataccctcgtaggcacaaggatactgacagtgaccgcgaccgatgcagacgagggctattatgctcaggtggtgtacttcctggaaaaaagccctggggagacctccgaggtatttgaactgaaatccaccagcggggaactcacaatcattaaggatctcgactatgaggacgcgacctttcatgagatcgatattgaagctcaagacggacctggtttgttaactcgggcaaaagtgatcgtcacggttctggacgtgaacgacaacgctccagagttttacatgacatcggctacaagcagtgtatcggaagactccctcccaggaactatcataggtttgtttaacgtgcacgaccgagattctggccagaacgccttcaccacttgttcccttccagaggatctgccttttaaactcgaaaaaagcgtggataattattatagactcgtgaccacccgcgcactcgacagagagcagtttagtttttataatatcactctcacagcgaaagacggcggaaacccttcgctctctaccgacgctcatatcctgcttcaggtggccgacatcaatgacaatgccccagcgttctcaaggacatcttattccacatatattcctgagaataaccctagaggcgctagtgtgttcagtgttacagcacacgaccccgattccaatgataacgcacatgttacctacagtttcgcagaggatactgtgcagggtgcccctctgtcctcctatatcagcattaattccgataccggggtgctctatgctcttagaagctttgattatgagcagctgcgagacttacaggtatgggttatagccagagacagtggaaaccctcctctctcaagtaacgtatcgctgtctctgtttgttctggaccagaatgataatgctccagagattctgtatcctgcctttcccaccgatggctctacaggtgtggaactggctcccagaagtgcagagcccggatacctcgttaccaaagtcgtggccgtagaccgtgattcgggacaaaatgcgtggctttcgtaccacctcctcaaggctagtgagccaggcctcttctctgtgggacttcatacgggtgaggtgcggacagccagggccctgctggaccgcgacgcccttaagcagtcccttgtggttgcgatccaggatcacggtcagccgccattgtccgccacagtgaccctgaccgtcgctgttgcagaccgtattcccgacattctcgccgacctaggatcactggagccctctgccattcccaacgatagtgacctgaccctgtatttggttgtcgctgtcgccgctgtcagctgcgtgtttttagctttcgtgatcgtgctacttgctcacagactcagaaggtggcataagagtcgactacttcaggcaagcggaggatcccttaccggcatgcaatcctcacatttcgtcggggttgacggcgtgcgcgcattcctgcagacatacagccacgaagtgtcccttacagccgattccaggaagtcccatttgatcttccctcagcctaactacgcagacaccctcatttcccaggaaagctgtgaaaagaaggatttcctcagcgccccacaatcactccttgaggaagagcgggaagagacattttctcagcaggcaccccctaatacagattggcggttttcacaggctcagaggccgggaacaagtgggagccaaaacggagatgacacggggacttggcccaacaatcagtttgatacggaaatgcttcaggccatgatcctcgcttcggccagcgaagccgcagacggttccagcacactgggaggcggagctggcacaatgggcctcagcgcccgatacggtccacagttcacgctccagcacgtcccggactaccgccagaacgtgtatatcccaggaagtaacgcaactttgactaacgccgcaggaaaaagagacggtaaagcccctgccggtggaaacggcaataaaaaaaagtcaggcaagaaggaaaagaagtag

SEQ ID NO: 237344 - DNA, 2799 bp, Artificial Sequence
  Description of Artificial Sequence: Synthetic coding sequence
atgaccaactgcttatcttttcgcaacgggagagggcttgcactgctgtgtgcattgttgggcacactctgtgagactggctccggccaaatacgatactcggtgagcgaagaactggataaagggagcttcgtggggaacatcgccaatgatttgggcctggaaccccgagaactggcagagagaggggttcgaatagtgagtaggggaaggacacagctcttcagcctcaatcctcaatctggctcactggtgacagccgagcggatagatagagaggaactgtgtgcccagatccccctgtgtctcgtgaagatcaacattttagtggaggacaaactcaagatctttgaggtggaaatcgagatcaaagatatcaacgataatgcacccaacttccccactgaagaattggagatcaagatcggagagctcacggtgcccggtaccagattccccatcaagacagcctttgatcctgacgttggaatcaattccctgcagaactataaactgtcccccaatgactatttcagtctcgccgtgaactccgtcagcgaaggggctaaatatcctgagctggtgttagaacgagccctggatagggagaagaaggagattcatcagttagtactcgtggcatcggatggcggtgatcccgtccattccggcaacctacatatccaggtgattgtgctcgacgctaatgacaaccctcccatgttcacccagcccgagtacagagtctcagtctgggagaatgtcccagtcggcaccaggctgctgacagttaatgctacagaccccgatgaagggtttaatgcccaagttagctacatcttagataagatgccaggcaagatagccgaaatcttccaccttaacagcgtctcgggcgaggttagcattcttaagagtctggattacgaggacgccatgttctacgaaattaaaatcgaggctcaggatgggccaggccttctcagtcgcgcaaagatcttggtgaccgtgctagacgtgaacgataacgccccagagataaccataactagcttaacatcttctgtgcccgaagaaggcactgtcgggagggaaatcgctttgatcgacgtccatgatcgtgactcaggccagaatggccaggtggaagtgtttgtactggggaaccttccgttcaagctggaaaagagcatcgatcagtattaccggctggtgaccgcgaccagcttagaccgggaacaaatctcggagtataacatcagtctgagggcttcagatgggggaagcccacctttaagcactgagacccatatcactctgcacgtcatcgacataaatgataaccctcctacgtttccccatcttagctattctgcctacatcccagagaacaacccacggggagccagcatttttagcgtgactgcccaggacccggatagtaataacaatgcacgcataacctatgctcttactgaagataccttgcagggggctccgctcagttcctttgtgtccattaattccaacaccggcgtgctatacgccttgcgtagctttgactacgagcaattcagagatctcaagctactcgttaccgcctcagatagtgggaatccccctttatcgtcaaacgtgtcactgaacctgttcgtgttggatcagaacgacaatgctcctgagatactctaccctgctctccccacggatggatctacaggtgtggagcttgccccacggagcgcggagccaggttacctggtgacgaaagtggtagcagtggacagggacagcggtcaaaacgcctggctgagctaccgactgttgaaagcgtccgagcctggtctattctcagtgggcttgcacactggcgaagttagaaccgccagggccttgttggaccgggacgccctgaagcagagcttggtcgtggcggtgcaggaccacggacagccacccctgagcgccaccgtcacactgacagtggccgttgctgaccgcatcccggatattctggcagacttagggagtctggagcccagcgccaagcctaatgacagtgacctcactctgtacttggtggtcgccgtcgctgcagtgtcctgcgtgtttctggcctttgttatagtcctcttggccctcagactgagacgatggcataagagcaggcttttacaagcaagtggtggtggactcgcaagtactccaggaagtcactttgtcggagcagacggcgtccgcgcatttctgcagacctattctcatgaagtgagcctgaccgcagattcgcggaagtcgcacttaatttttcctcagcccaactatgccgataccctcatatctcaagagtcttgcgaaaaatcagaacctcttcttatcacccaggacctgcttgaaatgaaaggcgacagcaacctgcttcagcaggcccctcctaataccgactggcgattcagccaggcccaaaggcccggtacaagtggctctcaaaatggggacgataccggaacctggcccaacaaccaattcgacacagaaatgctgcaagccatgattctggccagtgcaagcgaagcagccgacggttcaagcactctcgggggtggtgcaggaacaatggggctgtccgccagatacggcccacagtttacactgcagcatgtacccgactacaggcagaacgtctacattcctggcagcaatgctacccttaccaacgcggctggcaagcgtgatgggaaggctcctgcgggaggcaatgggaacaagaagaaatccggcaaaaaggaaaagaagtag

SEQ ID NO: 237345 - DNA, 2796 bp, Artificial Sequence
  Description of Artificial Sequence: Synthetic coding sequence
atggcctctcctccacggggatgggggtgcggtgagctgctgctgccctttatgctgctggggacgctttgcgagcctggctccgggcagatccgctatagtatgcctgaagagcttgataagggatcctttgtggggaacatagctaaagacctgggactggagccccaggagctggctgagcgcggagtgagaatcgtttcacgtgggaggacacagttatttgcccttaaccccagatcagggtcactggttacggcaggcaggattgatagagaggaactttgtgcccagtcacctctgtgtgtggttaatttcaacattcttgttgagaacaaaatgaagatttacggggttgaggttgaaatcatagatattaatgacaatttcccaagattcagggatgaggagctcaaagtgaaagtcaacgaaaatgccgcagccggaacccgtctggtcctaccctttgcacgggacgccgatgtgggggtcaattccttgcggagctaccagctgtctagcaacttgcatttctctcttgatgtggtgtctggaaccgacggtcagaagtacccagaattggtgctggaacagccccttgacagagagaaggagacagtgcatgacctactgcttactgccctggatggcggtgacccagtactaagcggaaccacgcatattagagtgacagttttggacgcaaatgacaacgcccctctattcaccccttccgaatactcagtttccgtgccagagaacatacctgtcggcactcgccttcttatgctcacggccacagatccggacgagggaatcaatggaaaactaacttattcgttccggaatgaggaggaaaagatcagtgagacgttccaactcgacagcaatctcggggagattagtaccctgcagtctttagactatgaagagtcacgcttctaccttatggaagtggtcgcccaggatggtggggcacttgtggcatctgctaaagtcgtcgtgactgtgcaggatgtgaatgataacgccccagaagtaattttgactagcctcacttcttccattagcgaagactgcctgcctggaacggtgatcgccctcttcagcgtgcacgacggagatagcggcgagaatggtgagattgcctgctcaatacctcgcaacctgcccttcaagcttgaaaagagtgttgacaactattaccatctgttgacaacccgcgatttagatagagaggagacaagtgactacaacatcacactgacagtgatggatcacggtacccctcccttgtcaacggagtcacatattcctctgaaagtagctgatgttaacgacaacccccctaacttcccccaggcctcatattccacaagtgtgaccgaaaacaaccctcgcggagtctccatcttctctgtgaccgctcatgatcccgatagcggcgataatgctcgcgttacatactcacttgccgaggacacattccagggagcacccctgagctcgtatgttagcatcaactcagacacaggcgtcctatatgccttgagatcttttgactatgaacagctgcgtgacctccaactttgggtgacagcctccgattctggcaatccgccattatcctcaaatgtgagcctatcgctgtttgtgttagaccagaatgacaatacacctgagattttatatccggcactgccaaccgatggctcaactggcgtggaactagccccacggagcgctgagccgggttatctggtcaccaaggttgttgcggtcgataaagattcaggccagaacgcatggctgagttaccgcctgctgaaggccagtgagcccggtctctttgctgtgggactgcataccggagaagtgcggacagcacgggcattgctggatcgggacgctctaaagcagtccctggttgtggccgtggaggatcacggacagccaccgctgtcagccacatttaccgtgaccgtagccgtcgcagaccgcattcccgacatcctggccgatttaggcagcatcaaaacgccaattgatcctgaagacctcgacctcactctgtacctggttgtcgctgtcgccgctgtgtcttgcgttttcctggccttcgtgatagtgctgttggtcttgaggctcaggaggtggcataagagtcgcctgctgcaggcagagggcagccgattggctggcgttcctgccagtcatttcgtcggcgtcgatggagtgcgggctttcctgcagacttatagccatgaagtgtccttaactgctgattctagaaagtcacatctaattttcccccagccgaactacgccgacactctcttatcagaagagtcatgcgagaagtccgaacctctcttgatgtcagataaggtcgatgccaacaaagaggaacggagggtgcagcaggcaccaccaaacacggactggcgattctcccaggcacaaagaccaggaacatctggtagtcaaaacggggacgataccgggacttggccgaacaaccaattcgacaccgagatgttgcaggccatgattctagcaagtgctagtgaagccgcagatggatccagcacacttggtggaggagctgggaccatgggactgagtgcccgatacgggccacagttcacgctgcagcacgtccctgactatcgtcagaatgtctatatccctggatctaacgcaacgctgaccaacgcagccggaaagcgcgacggaaaagcccctgccggaggaaatggcaacaaaaaaaagtcgggcaaaaaggagaaaaagtag

SEQ ID NO: 237346 - DNA, 2799 bp, Artificial Sequence
  Description of Artificial Sequence: Synthetic coding sequence
atggccccaccccagcggcaccctcagaggagtgaacaagtacttctcctcacccttcttggaaccctgtggggcgctgctgccgctcagattcgctacagcatccccgaagaactggagaagggatccttcgtcgggaatatcgtcaaggacctcggtctggagccccaagagctggctgaacacggagtccgtatcgtctctcggggtcggatgcaattgttttctttgaacccccgtaatgggtccctcgtgaccgcaggaagaattgatcgggaggaactgtgtgctcagagccccagatgtctagtctcattcaacatacttgtggaagataaactcaacctataccccgtggaggtggaaattgtagacatcaacgacaacacacccaggttcctgaaggaggagctggaggtgaagatacttgagaatgcggctccttcttcccgttttccactgatggaggtatacgatccggatgttggtatgaatagcctgcaaggcttcaaactaagtggtaattctcatttcagcgttgatgtgcagagcgaggctcacgggcctaagtacccagagctagtcctggagggaactctggacagagaaggagaggccgtttacaggctggtgcttacagcgatggacgggggagaccctgttaggtcaagcgtcgcacagatcctagtcaccgtgctggatgtgaatgataacacacccatgtttacacaaccagtctaccgggtctctgtgcccgagaatctacctgttggcactccggtgctggccgtcactgcaacagatcaagacgaaggggtgcatggtgaagtgacctactcctttgtgaagatcacagagaagatatcacagattttttgcctgaacgtgttgacaggcgagattagtacatcagccaacctggactatgaagatagttcgttctacgagctcggtgttgaggctagggatggcccaggacttcgagatcgggctaaagtgctaatcacaattctcgacgtgaatgacaatgtgcccgaggtggtggttacatcaggatcccggacaattgccgagtcagcacccccaggcacggtgatcgcccttttccaggtgttcgacagagacagcggtctgaacggactggtgacttgctcaattccaaggagcttaccatttgagttggaaaaaagcgtcggaaactattatcggctggtgaccaacgccgctctcgatcgggaagaggttttcctgtacaatatcacggtcaccgctaccgacaagggcaccccccctcttagcactgaaaccattattagcctgaacgtcgccgataccaacgacaatccccctacattcccacacagttcgtattccgtatacgtactggagaacaatcctcgcggtgcgtcaatattttctgtgaacgccctcgaccctgatgtagaccagaacgcgcaggtgagttacagcttagccgaagacaccctacagggggcacccttaagttcgtacgtgagtatcaattcagacaccggaattctatatgcactgcgctcgttcgattacgagcagctgcgagatctccagttgtgggtgactgcgtcagactccggagacccccctcttagtagcaatgtaagcctcagtctgttcgtgctggaccaaaacgacaatgctcccgagatcctttatcccgcactgccaactgatggctccactggggtggagctggctccgaggtcagccgaacccggatacctggtgactaaagtagtcgcagtggatcgcgatagcggccagaatgcctggctctcctacagactgctcaaagccagcgagcctggattgttctctgtgggtctgcacacaggagaggtcagaaccgcgcgagccctgctcgaccgagacgcactaaagcagagcctcgtggtggcggtccaggaccacggacagccacctctgagcgccactgtgactcttactgtcgccgtagctgacagaatccccgacatattagccgatctcggttcccttgagcccagtgctaaacccaatgacagcgacctgacactttatttggtcgttgcagtcgcagctgtctcttgcgtttttttggcgttcgtcatcgttcttcttgcactgaggctgcagcgatggcacaaaagcaggcttttacaggcatctgggggaggcctggccagcatgccaggatctcattttgtgggggtggaaggcgttagggcctttctgcagacctacagccacgaggtgagtcttacggcagattcccgcaaaagccacttaattttcccccagcctaactatgcagacaccctgatcaaccaggagtcctacgaaaaaagcgaaccactgctgatcacgcaagatctcctggagaccaagggagagcctagacaactgcaacaggccccacccaataccgactggcggttcagccaggctcaacgaccaggcacaagcggctcacagaatggggatgataccggtacatggcccaataaccagtttgatacggagatgctgcaggctatgattctggcttctgcaagcgaagccgcagatggctcttcgactctgggcggtggcgctgggactatgggcctgagcgccaggtatggcccacagtttactctccagcacgtccctgattatcggcagaatgtctacatccccggttctaacgctacattaactaacgccgctggaaagcgggacggaaaggcacccgctggtggcaacggcaacaaaaagaagtcaggtaagaaagaaaagaaatag

SEQ ID NO: 237347 - DNA, 2799 bp, Artificial Sequence
  Description of Artificial Sequence: Synthetic coding sequence
atggccgctcagccccgaggcggtgactatcggggatttttcctcctgtcaatcttactgggcactccgtgggaggcttgggccggaagaatcttgtattccgtctcagaagagaccgataagggttcatttgtgggggacatcgccaaagacctcggacttgagccccgtgagttagccgaacggggagtgagaataatctcccgagggagaacccagctgttcgcactgaaccagcggtctggtagccttgtgaccgccggtagaattgatcgggaagaaatatgcgcacaatccgcacgttgtctggtgaatttcaacatcttaatggaagataaaatgaacctctatccgatcgatgtggagattatcgacatcaacgataacgttcctagattcttaaccgaggagatcaatgtaaaaataatggaaaacactgcccctggtgttcgattccctctgtccgaagccggagatcctgacgtcgggacgaactcactgcagtcttatcaactgtcacccaatcggcatttttcgctggcggtgcaatcaggggatgatgagactaaatatcctgagcttgtcttagagcgcgtcctcgacagggaagaggaacgagtacatcacttggtgcttacagccagcgatggtggggatccccctcgctcttctaccgcccacatacaagtcactgttgttgacgttaatgatcatacccctgttttcagcctacctcagtatcaagtcaccgtgccagagaatgtgcccgtaggcacgcgccttctgactgtgcacgcaattgatctggacgagggcgtgaatggcgaggttacctacagcttccggaaaattacgcctaagctgccaaagatgttccacctgaattcacttacaggcgagattagcactctggaaggcctggactacgaagagaccgcgttctacgagatggaagtgcaggcacaagacggtccaggcagcctcaccaaagccaaagtcctgattaccgtgttggacgtgaatgataacgccccagaagttacaatgacaagtctcagtagctctatccctgaggatacccccctcgggacagtgatcgcactgttctacctgcaggatagagactcaggaaaaaacggagaagttacctgtaccatacccgagaatctgcccttcaaactcgagaagtcaatcgacaactattacaggctggtgaccacaaagaatctggaccgcgaaacacttagtctgtataacataactttaaaagcaactgacggaggaacacctcccctttcacgagagactcacatcttcatgcaggtggccgacacgaacgacaaccctcccaccttcccccactctagctactctgtctacatagccgagaataaccctcggggagcttctatttttctggtgaccgctcaggaccacgattccgaggataatgcccaaataacctactctcttgcggaggataccatccagggcgctcctgtttcgtcctatgtgtccatcaatagtgatacgggtgtgctatacgccttacagtccttcgattacgaacagcttcgcgaacttcagttgagagttactgctcacgactccggcgatcccccactgtctagcaatatgagcctcagtctttttgtgctcgatcagaatgataatccaccagagatcctatatccggctctacccaccgatggatctactgggatggagttggcaccacgcagtgccgaacccggatacctggttaccaaggttgtcgcagtggataaggactctggacagaacgcctggttgtcatacctactcctcaaagcgagtgagccaggcctcttcgcggtgggtttatatactggtgaggtgaggactgctcgtgccctgctcgatagggacgccttgaagcagtccctggtggtggctgtgcaggatcatggtcaaccccctctctcagccacagtgactctgacggttgctgtggcggacagtatcccagaggtcttggctgacttaggatcattggaaccatccgacggcccttataattacgatttgactctgtacctggttgtggcagtggcaactgttagctgcgtgtttttggcctttgtgctagtcctgcttgcccttaggctccgcagatggcacaagagccgactgttgcaagccagcgagggaggactcgccaacgttccaacctcccactttgtgggtatggatggagtccaagctttcctgcagacttacagtcacgaagttagtctgacggccgattcccgaaagagccacctcatcttcccacagcccaactatgtggacatgctgatcagtcaggaatcctgcgaaaagaacgactccctcctgactagtgttgatttccaggaatgtaaggaaaatctgccaagtattcagcaggctcctcctaatactgactggaggttctctcaggcgcagcggcctggtacgtctggaagccaaaatggcgatgacacaggaacctggccaaacaaccaattcgacacagagatgctgcaagccatgatccttgctagtgcttccgaggcggctgacggaagcagcacattgggtggaggtgccggtacaatgggtctttctgctcgctacgggcctcagttcacacttcaacacgtgcccgactatcgacaaaacgtatacatacccggaagtaacgccacgctcacgaatgccgctggaaaaagagatggcaaggcacccgctggaggtaatggcaacaaaaagaagtccggcaagaaggaaaagaagtag

SEQ ID NO: 237348 - DNA, 2799 bp, Artificial Sequence
  Description of Artificial Sequence: Synthetic coding sequence
atggcagccccacaatctcgccctcggcgtggggagctgatactcctgtgtgcactgttgggcacactgtgggaaataggacgaggtcaaatccgctactccgtgcctgaggaaacagacaaaggaagctttgtgggaaatatctccaaagacctggggttggaccctagaaaactggctaagcacggtgtccgaattgtgagcagagggcgtacacagctgtttgcccttaatcctcggagtggatccctgatcacagcaggtcgtattgaccgggaggaattatgcgcccagagcccaaggtgcctcattaacataaatacattggtggaagataagggaaaactctttggggttgagatagaaatcatagacattaatgataacaacccgaagttccaggtggaggatctagaagtaaagatcaacgaaatagcagtgcccggagcccgttaccctctcccagaggccgtcgaccctgacgtgggcgtgaacagtttacaaagctaccaattaagcccaaaccaccacttctctctcgacgttcagactggagacaatggagccatcaatcctgaattggtattagaacgcgcactcgatagggaggaggaagcagctcaccatcttgtcttgaccgcttctgacgggggaaagcctcctcgctcatccactgtgcgcattcacgtaactgtgctggataccaatgataacgcacccgtgtttccacacccaatctacagggtgaaggttctggaaaacatgccgcctgggacccggctgctcactgtgactgcgagcgatcctgacgagggcataaacggaaaggttgcttataagttccgaaagatcaatgagaagcagacaccactgtttcagctcaatgagaatacaggcgaaattagtattgccaagtctctggattatgaggaatgttccttctacgagatggaaatacaggccgaagacgtgggggcactgctcggcaggacaaagctgctaatctccgtggaggatgtgaacgacaatcgcccagaagtgatcatcacttctctgttcagtcctgtgctggaaaactctcttcctggaactgtcatcgcttttcttagtgtccacgaccaggactctgggaaaaatggtcaggtggtctgttacacccgcgacaacctgccctttaagctagagaagagtatcggcaattactacagacttgttaccagaaaatacctggaccgggagaatgttagcatctataacattacggttatggcaagtgacctgggcacacctcccctgagtaccgaaacccagattgcccttcacgtggctgacattaacgacaatcctcctaccttcccgcatgcaagctacagcgcatacatcctggaaaataatctccgtggagcctctatattttccctgacggcccacgaccccgactctcaagagaatgctcaggtgacgtattcagtgaccgaggataccctacagggtgcacccctgtcgagttacatctctattaactctgatactggtgtattatatgcactccagagctttgattatgaacagatccgtgacttgcagctgctggttacagcctcagattccggggaccctcctttgtctagcaatatgtccctgtccttattcgtgctggatcagaatgataatgccccagaaatcctgtaccccgctctgcccaccgatggttccaccggagtggagctggcccctaggtctgcggagcgtggttatctagtgacaaaggtcgtagcagtggatagagatagcggtcaaaacgcttggctttcctaccggttgctcaaagcgagcgagcccggactgttctcggttgggctgcacacgggggaggtccggacggctcgtgccctgctcgatcgcgatgccctgaagcaaagccttgtggtagccgtgcaggaccacggtcagcctccactctcagccaccgtcactctcaccgttgccgttgccgattctatccctgaggttctcaccgaattagggtctcttaagcctagcgtggatcccaacgacagcagtcttactttgtacctagtggttgcagtggcagcgatcagctgcgtgtttctggcgtttgtggcagtgttactggggctgaggttgaggagatggcacaagtcccgccttttgcaggattccgggggtcgactggttggcgtcccagcatctcattttgtgggagtggaggaagtgcaggcatttcttcagacatactcacaggaggtgagcctgacagcagattcccgcaagtcacatcttatttttcctcaacccaattacgcagatatgctcatttcccaggagggctgcgaaaaaaatgatagcctgctcacgtctgtggatttccatgagtacaagaacgaggctgaccacggacagcaggcgccacccaacaccgattggagattttcacaggctcagcggccaggcacttctggctctcagaatggagatgatacgggtacctggcctaacaaccagttcgatacggagatgctccaggcaatgatcctggccagtgcaagcgaagccgcagatggaagcagtacattaggtggaggtgcagggactatgggcttgagtgctagatacggaccacaatttaccctgcaacatgtacccgactaccggcagaatgtttatatcccaggctcgaacgccacccttactaacgcagccggaaagcgggatggaaaagcgccagctggaggtaacggcaataagaaaaagtccggcaaaaaagaaaagaagtag

SEQ ID NO: 237349 - DNA, 2784 bp, Artificial Sequence
  Description of Artificial Sequence: Synthetic coding sequence
atgcagagagctagggaagcagagatgatgaagtcacaagtgctgtttccgttcctgctgtctctcttctgtggagccattagtcaacagattcgatacacaatccctgaggaactggccaatggttctagagtgggcaagctggccaaggatctaggacttagcgttcgcgagctaccaacacggaaactgagagtttcagcagaggattatttcaatgttagccttgagagcggggacttacttgtgaatggcaggatcgacagagaaaaaatctgcggcagaaagcttgaatgcgcactagaattcgaaacggtggccgaaaatccaatgaatgtttttcacgtcgtggtggtgatccaggacattaatgataatgctcctcgattcgtggccaagggtatagatctggagatctgcgagtctgctctgccaggtgtaaagttttccctggattccgcccaagatgccgacgtggagggaaacagcctgaaattatatacaataaaccctaaccagtacttcagtttgtcaaccaaggagtcgcccgatggaagcaaatatcctgttttgctgctcgagaaacccctcgacagggagcaccagtcaagtcatcgcctcatcctaaccgcaatggatgggggagatccccctttatctgggactacgcacatctggattcgggtcacagatgctaacgataacgcccctgtattctcacaggaggtgtatcgagtttcactgcaggagaacgtgccatggggaactagtgtgcttcgggtaatggctaccgaccaagacgaaggcattaatgcagagatcacctacgcctttttaaacagtcccatttccacttctctgtttaacctcaatcctaatacaggcgatattacaacaaacggcaccctcgacttcgaagagacctcaaggtacgtgctgagcgtggaggccaaggatggcggagtacacaccgcgcactgtaatgtgcagattgaaatcgtagacgaaaacgataatgctcccgaggtgactttcatgtcattcagcaaccaaattccagaggatagcgacctgggaactgtcatcgcgctcattaaggtgagagataaagactctgggcaaaacggcatggtaacttgttatacccaggaagaggtgccatttaagctggagagcactagcaagaactactacaagctggtgattgcaggggctttgaatagagaacagactgccgactataatgttacaatcattgccacggacaaggggaagccagcacttagtagcaggacatccattaccctccacatctccgatatcaatgacaatgccccagtgttccatcaggcaagctatgtcgttcacgtgtcagagaacaaccctcctggtgcatccattgcccaggtgtccgcgtctgacccagacctggggccaaacggaagagtctcatactctatactggcgtcagacctcgaacctagggagcttctgtcctatgtcagcgtgtctccccaaagcggggtggtgttcgcacagagagcctttgatcacgagcagctgagagcattcgagttaaccctgcaggccagagatcagggctctcccgctttgagtgccaatgtaagcttacgagtcctggttggtgacttgaacgataacgctccccgtgtcctttatcccgctcttggacccgacggcagcgccctgtttgacatggtgcccagggctgccgaacctgggtacctggttacgaaggtggtagctgtcgacgcagatagcggccacaatgcgtggctctcttatcacgttctgcaggccagtgagcccggtctgttctctttgggcctgcgcacaggagaggtgagaaccgcacgagccttgggagacagggatgccgcacgacaaagacttttagtggctgtgcgcgacggcggacaaccccctttatcagctaccgctacactccacctgatctttgctgattccctgcaggaggtgcttcctgatctgagtgaccggccagaaccatctgacccacagaccgaacttcagttttatctggtggtggccttggcactgatcagtgtgctcttcctactggctgtaatcctggctatcgcactgcggctgcgtcgctccagtagtctcgacactgaggggtgtttccagactggactctgtagtaagtctggtcctggagttccccctaatcacagcgagggcacattgccttactcatataacctgtgcatcgcctctcactcagccaaaacagagttcaactccttaaacctgacccccgagatggcaccaccccaggacctgctatgtgacgacccttcgatggttgtctgtgctagtaatgaagaccataaaattgcgtacgacccaagcttgtcgagtcaccaggctcctccgaacacagactggcgcttcagccaggcccagaggccgggaacctcaggttctcaaaatggcgatgacactggcacctggcccaataaccaattcgatactgaaatgctgcaggcgatgatcctggcctccgcttccgaggcagccgacgggtcttctaccctcggcggtggggctgggaccatgggcctgtccgctcgatatggacctcagtttacattgcaacatgtcccagattatagacagaacgtgtacatccccggtagcaatgctactctgacaaatgctgctggtaagcgggacgggaaggccccagccggaggaaacggtaataagaagaaatccgggaaaaaggagaaaaaatag

SEQ ID NO: 237350 - DNA, 2796 bp, Artificial Sequence
  Description of Artificial Sequence: Synthetic coding sequence
atgaaggcctcttcaggaagatgcggccttgtgaggtggctccaagtcctgttaccattcttgctgtcgttatttcctggagcccttcccgtgcagattcggtactctatcccagaggagctggcgaagaactccgtggtcggcaacttggccaaagacctgggtttgagtgttcgggacctaccagccagaaagttgcgggtctccgctgagaaagaatatttcacagtgaaccctgagtccggggacctgttagtctcggatcggattgaccgtgaacagatttgtggaaagcaaccactgtgcgtgttggatttcgacaccgtcgccgaaaacccccttaacattttctacattgcagttatcgtgcaggacattaatgacaacaccccactgttcaaacagacaaaaattaacctgaagattggtgaatccaccaagcctggaactacgttcccactcgacccagctcttgactccgatgtgggtcccaattctcttcagcggtatcacttgaatgacaacgaatactttgatctcgctgaaaaacagacccctgacggcaggaagtaccctgaattgatcctgaagcactctctggaccgggaggagcatagcctccaccagttagtgctcaccgccgttgatggcggagaccctccacagagcgggacaacacagatcagaatcaaggttaccgatgccaacgataaccctccagtgtttagccaagatgtatatcgcgtgaccctccgagaggacgtgccacccggatttttcgtgctgcaggtaactgccacggacagagatgaaggcataaacgctgaaattacttacagcttccacaatgtcgatgaacaggtcaagcatttctttaatctcaatgaaaagaccggagaaataaccaccaaagatgacctggacttcgaaatagcctccagctacaccctgtctatagaagcaaaggacccgggtgaccttgccgcacactgctctattcaggtcgaaattctggatgacaatgattgtgctcctgaagttattgttacatccgtgagcacacccttgcctgaggacagccccccaggtacggtaattgctttaatcaagacaagggaccgtgactccggagagaatggggaggtctattgccaagtgctgggaaatgcaaagttcatcctgaaatcttcctctaagaactactacaaacttgtgactgacggggctcttgatcgggaggagattcccgaatataatctcacaatcaccgctactgatggagggaagccacccctttcatctagtataattgtaaccctgcatatcagtgatgtcaacgataatgcaccagtgttccagcaaacaagctacatggtgcacgttgctgaaaataatccacctggggcatcaatcgcacagatttcagcctcagaccctgatctggggccttctgggcaggtgagttatagcattgtggcctccgatttgaaaccaagggaaattctctcttacgtctctgtgagcgcccagtcgggggtggtctttgctcagagagcattcgaccatgaacaattaagagcattcgaactgacactacaagcacgggatcaggggagccctgctttgagtgccaacgtgtctctccgcgttcttgtgggagatctgaatgataatgcccctcgggtgctgtacccagcactaggcccagatggctctgcgctctttgacatggtcccccgtgccgctgagcctgggtacttggtgacgaaggtggttgctgttgacgcggactctggccacaatgcatggttgtcttaccacgttctccaggcaagcgaacccggtctgttttcacttggattgcgcacgggtgaggtgcgcactgcgcgtgctcttggtgaccgagatgcagctcgccaaaggctgctggttgccgtccgcgatggcggtcaacctcctctgtctgccaccgctacgctgcacctgattttcgctgattctttacaagaagtgctgccggaccttagcgatcgcagagagcctagtgatccacaggctaaactccaattttatctggtggtcgcgctcgccctgatcagcgtacttttctttttggccgtcatacttgcaatctctctgaggctccgactctcctcccgctccgatgcttgggattgctttcaacctgggcttagctctaaaccagggccaggggtgctgcccaactatagtgagggtacccttccatatagttacaacctgtgcgtggccagccagtctgcaaagacggaattcaattttctgaatatcacccccgagctagtcccagcccaggacttggtgtgcgacaatgctagctgggagcagaatactaatcacggtgccgctggcgtaccattcgctagtgatacaatccttaagcaggcgccacccaatactgactggagattctctcaggcacagcgaccagggacctcgggatcacagaatggcgacgacacaggaacctggcccaataaccagtttgatacagaaatgttgcaggcaatgatattggcatccgcatccgaagccgcagacggctcaagcaccttgggcggtggtgcgggtaccatgggattatcagcgagatacggtcctcagttcaccttgcagcacgtgccagactatagacagaacgtatatattcccggaagcaacgccactctgacaaatgctgctggaaagagggatggcaaggcgccagctgggggtaacggaaacaagaagaaatcagggaaaaaggaaaaaaaatag

SEQ ID NO: 237351 - DNA, 2772 bp, Artificial Sequence
  Description of Artificial Sequence: Synthetic coding sequence
atgggatccggcgctggggaactgggcagagccgagcgtctgcctgttctatttcttttccttctttccctcttttgtccagctttgtgcgaacagattcgatacaggatccccgaagagatgccaaaggggagtgtggtcggcaatcttgctactgatctcggcttcagcgtacaagagctccctacgcgaaaactgcgcgtttcttcagaaaaaccatactttaccgtttcagcggagagcggagaattgctagtgagctctcggctggacagagaagagatttgtggcaagaaacctgcttgtgccctagagttcgaagccgtcgcagagaatcctttgaacttctatcatgtgaatgtggagatcgaagatatcaacgaccatacacccaagtttactcaaaattcgtttgagctgcagattagtgaatctgctcaacccggaactcggttcatcttgggaagcgcgcatgacgctgatatcggcagtaacacactgcagaactaccaactatcacccagtgatcactttagcttgattaacaaggagaagtctgacggctccaaatatcccgagatggtcctgaaaactccactggatcgtgagaagcaaaaatcctaccacctcactttgactgctctggactttggcgctcctcctttgtctagcacagctcagatccacgtcctcgtgaccgacgctaacgacaacgcccctgtgttctcccaggacgtgtatcgggtctccctgagcgagaatgtttaccctggtactacagttctgcaggtcaccgcaaccgaccaagacgaaggcgtgaacgcagagattaccttttccttctcggaagcaagtcaaattacacaattcgacctgaacagcaacaccggagaaatcactgtgcttaacacactagacttcgaggaagtcaaggagtactcgatagtccttgaagcgagggacggcggaggaatgatcgctcaatgcacagtagaagtggaagtgatcgatgagaacgataacgccccagaagtgatcttccagtccttacccaatctgataatggaggacgccgagctgggaacacacatcgctctcttaaaagttcgcgacaaggattccagacacaacggcgaagtgacttgtaagcttgagggcgatgtgccatttaagattttgacgagcagccgcaatacctacaaacttgtcaccgatgcagtgttggatagagagcaaaatcctgagtacaacatcacagtgaccgccacagaccggggaaagcctcctctatctagttcctcttcaataacactgcacattggcgacgtaaatgataacgccccagtttttagtcagagcagctatattgtgcatgtcgccgaaaacaaccccccaggggctagcatctcgcaggtacgcgctagcgaccccgacctcgggcctaacggccaggtttcctattgtatcatggccagcgacctcgagcaacgtgagctgtccagttacgtatctatctccgcagaaagcggggtggtcttcgcccagcgcgcattcgatcatgagcagctgagggcttttgagctcacactgcaagccagagatcaggggtcgcctgccctgtcagctaatgtctcgctgcgagtgcttgttgacgataggaatgataacgcacccagggtcttgtatcccgctctgggaccagacggtagcgcgctgttcgatatggtgccccatgcggctgagcctggatacttggtgaccaaagtggtggcagtcgatgcagactcgggacataacgcttggctgtcctaccacgtgttacaggcctccgagcctggcctctttagcctggggcttcggaccggtgaggtccgcactgcacgcgctctgggggaccgggacgcagttaggcaacgtttactcgtggccgttcgtgacgggggacagcctcctttgtctgccaccgcgactctccatttagtgttcgcggattctcttcaagaggttcttcctgatatcaccgaccgcccagatccttccgatctgcaggccgaattacagttctatttagtagttgccctggcactcatttccgttctgtttctggtcgccatgattctggcaatagccttacggctcagaaggtctagctctcccgcttcatggtcctgctttcagccaggactctgtgtgaagtcagagagcgtcgtacctcctaactatagcgagggaaccctcccctactcatataatctgtgcgtcgctcacaccggtaagactgaattcaatttcttgaagtgttctgagcagctcagctcgggccaagatatcctatgtggagatagtagtggggcactgtttcccctgtgtaacagttcagagctaacctcccaccaacaggcccctcccaatacagattggcggttctcccaagcacagagaccaggcacaagtggaagccagaacggggacgacactggtacctggcccaataaccagttcgatacggaaatgctgcaggccatgattctagcctcagcgagcgaggcagcagatggatcttcaacgctaggcggaggagccggtaccatgggattatctgccagatacggtccacagttcacactgcaacacgtgcctgattaccggcaaaacgtgtatattccgggaagtaatgcaaccttgaccaacgccgctggaaaacgtgacggcaaggccccagccggtggaaacggtaacaagaaaaagtctgggaagaaggagaaaaaatag

SEQ ID NO: 237352 - DNA, 2793 bp, Artificial Sequence
  Description of Artificial Sequence: Synthetic coding sequence
atgggaggatcatgcgcccagagaagaagggccggacctcgccaggtgctgttcccgcttcttctaccactgttctaccctacgctgagcgaaccgatcagatactccatccccgaggaactggcaaaaggaagtgtggttgggaatctcgctaaggacctggggctgagcgttctggatgtcagcgccagaaaactgcgtgtgagtgctgagaagcttcacttctctgtggacgccgagtctggcgacctgctggtgaaaaacagaatcgacagggagcaaatttgcaaagaaagacggagatgcgaactgcagctagaagcagtggtcgagaatcctctcaatatcttccacgttatcgttgtgatcgaggatgtcaacgatcatgcaccccagttcgataagaaggagatacaccttgagatcttcgaaagtgcaagtgctggcacccggctgagcctggacccagccacagaccctgacatcaacattaacagcataaaagattataagatcaatagtaatccctatttttcactcatggttagggtgaactctgatggaggaaagtatcccgaactctccctcgagaagctgctcgatagagaagaacaacggagtcattccctcattttgacagctctcgacggtggcgatccacccaggtcagccacagcccatatcgaaatttccgtgaaagatacaaatgataatccgcctgtgtttagccgggacgagtatagaataagtctgtcggaaaacttgcccccaggctctcccgtccttcaagtcaccgccactgatcaggatgaaggtgtcaatgcggaaattaattattatttcaggagcactgcccagagtacaaaacacatgtttagtttggatgagaaaactggtatgatcaaaaacaaccaatccttcgatttcgaggatgtagagcgttacacaatggaagtcgaggccaaagatggcggtggtctgtctacacagtgcaaagtgataattgaaatcctggatgagaacgataattccccagaaataatcataacatccctgagcgaccagattctggaaaatagcccaccagggatggtcgttgctctcttcaagacaagagatttggattttggagggaacggggaggtgaggtgtaatattgaaactgatattcccttcaaaatctattcatcctcaaataactattataaactggtgacagatggcgcactcgatcgcgagcagacacccgaatacaatgtcactatagttgccactgacagaggtaagccccctctctcttctagtagatcgattacactgtacgtggcggatattaacgacaatgccccagtatttgatcagacaagctatgtcgtgcatgtcgccgaaaacaaccctcctggggcaagcattgcgcaggtgtccgcaagtgatcccgacttaggccttaatggccacatcagctatagcatcgtggctagcgatctcgaaccattggccgtgagtagttacgtcagtgtctccgcgcagtcaggcgtcgtattcgcccagcgggcatttgaccatgagcaattgagagcttttgctcttaccctacaggcaagagaccacggaagtccaaccttgagcgccaacgtttccctcagagttctagttggtgacagaaacgataacgcccctagggtgttatatcctgctctcggacccgatgggagcgcattttttgacatggtaccaagaagcgcagaaccaggctatctggtgactaaggtcgtggccgtggatgccgattccggccataacgcctggctgtcttaccacgtcctgcaagcatcagagccaggactcttctctctcggcctgcggaccggggaagtgcgcacagcccgagcgctgggagaccgcgatgcggcacgacaacgcctactggttgctgtccgggatggcggtcagcctccccttagtgccaccgctaccctccatctcgtgtttgccgacaatttgcaggagatattgcccgatttgagcgataggccggtactttcagacccccaggcagagctgcagttttacctggtggtagctctggcgctgattagtgtgctgtttctcctggctgtaattctggctatagccttgcgactacgccgaagtctttctcccgcaacatgggattgcttccaccctgggctgtgtgtgaagagtggacccgttgtaccgcctaactacagcgagggtactctgccttactcctataatctatgtattgcccacacagggacgaaggaatttaacttcctgaaatgctctgtaccccttcattcaaacgaggatatggtatgcagtgtgagtccgggtgcccttatccctccacacggcggagaggacctgacctcgcatccggagactctgacgagccaagctccccctaataccgactggcggttcagccaagcccagcgaccaggcacatccgggagccagaatggggatgacacagggacttggccgaacaaccaattcgataccgagatgctgcaggccatgatactcgcatctgccagtgaggctgcggacggttcttctactctggggggaggcgctgggaccatgggactgtccgctagatacggccctcagtttacccttcagcatgtgccagattacagacaaaatgtctatattcctgggagcaatgccacactgacaaatgctgccggaaagcgcgacggcaaagcaccagcgggaggtaacggtaacaagaagaagtccggcaagaaggaaaaaaaatag

SEQ ID NO: 237353 - DNA, 2790 bp, Artificial Sequence
  Description of Artificial Sequence: Synthetic coding sequence
atgggcggatcatgcgcccagcgcaggcgcgcagggccaagacaggtgctgttccctcttttgcttccactgttctacccgactctgtgtgaacccatcagatacagtattccagaggaacttgcaaaaggttcagtcgtcgggaatctggccaaggatttaggtctttcagttctggacgtgagcgccagagagcttagagtttcagcagaaaagttgcatttcagtgttgacgctcagtctggtgatctgctggtgaaggataggatcgatcgcgagcagatttgtaaggaacggaggcgatgtgagctgcagcttgaagcagtcgtggagaatcctctgaacatattccacgtgatcgtggttatcgaagacgtgaacgaccacgcaccccagttcagaaaagacgagattaatttagaaattagtgagtccgtcagcctgggtatgggcaccattctcgagagtgccgaggatcccgatatcagcatgaactcccttagcaaatatcagctttcaccaaatgaatatttctccctcgtggagaaagacaatcctgacgggggaaagtatcctgagctggtgctgcagaagacacttgatcgggagacccaaagcgcccatcacctagtactcacagctctagacggtggggatcctccaagaagcggtaccgcccagatccgtatactcgtgatagatgctaacgacaaccctccagttttttcgcaggacgtgtatcgggtgtccctgcgagaagacgtgcccccaggcacttccatcctgcgagtcaaggccaccgatcaggacgagggaattaactcggagatcacctattcattcttcggagttgccgataaggctcagcacgtgttctcccttgactacactactggaaatatcctaacccagcagcctctggattttgaggaagtcgagcggtacacaatcaacatagaggccaaggacagagggtctctgtctacgcggtgcaaggttatcgtggaagtcgtggacgaaaacgacaattcccccgagatcattattactagtttaagcgaccagatcatggaagattcccctcctggggtcgtggtggcccttttcaagaccagagatcaggactccggggagaacggtgaggttaggtgctcactgagcaggggagtcccatttaagatccactcttcttcaaataactattacaagctcgtgacagacgaggctttggatcgtgagcagacccccgagtacaacgtgacgattgcagcgactgatcggggaaaacccccactgtccagctctaagacgattactctacatattacagacgtcaatgacaatgcaccggtgttcggccagagcgcgtaccttgtccacgtgcccgagaataaccagcctggcgctagtatcgcccaggttagtgcctccgacccagactttggcctcaacgggcgtgtctcttactccctgattgccagtgacctggagtccagaaccctttctagttacgtatctgtttccgcacagtccggtgtggttttcgcccagcgcgcttttgatcacgaacaactgcggacatttgaattgactctgcaggctcgtgatcaggggagcccagctttaagtgctaatgtcagtttaagggtgctggtgggggacaggaacgacaatgcacctagggtcttgtatcccgctctaggtccagacggatcggcactctttgacacagtacctagggcagcccagcctggatatctggttacgaaggtggttgcagtggacgccgactccggccacaatgcatggctgtcctatcacgttgtgcaggcatccgagccagggctctttagtctggggctgagaacaggcgaagtgcgtatggttcgagctcttggtgacaaggactcagtgcggcagcgcctcctggtcgccgttcgcgatggaggacaaccccctctatccgctacagccacacttcacctcgtctttgctgacagtctgcaggaggtcctgcctgatttcagtgaccatcctacacctagtgattcccaggctgagatgcaattctatcttgtagtggcgctcgctctgatcagtgtcctgttccttctggcggtgatcctggcgatcgccttgcggcttcgacaatccttcagtccgaccgccggagattgctttgagtctgtgttgtgtagcaagagcggccctgtaggccctcctaattacagcgaaggaactttgccctatgcctacaacttctgcgttcccggtgaccaaatgaaccccgaattcaatttcttcacttctgtggaccactgcccagcaactcaggacaacttaaataaagattccatgttactggcaagtatactcactccttctgtggaggctgacaaaaagattctgaagcaacaggcccctcccaacactgactggcggttctcacaggctcagagaccgggtacgtccggttcgcagaatggggacgacacgggaacatggcccaacaaccagttcgataccgaaatgctgcaagctatgatcctcgcaagtgcttcagaagccgcagatggctcctcaaccctcggcggtggcgcaggtacaatgggcctgtcagcgaggtacgggccacagttcaccctgcagcatgttccagactaccggcaaaacgtttacattcctggctcaaatgcgacgttgaccaacgccgctggtaaacgcgacgggaaggctcccgcaggtggtaacggaaataaaaaaaagtctggaaagaaagagaagaaatag

SEQ ID NO: 237354 - DNA, 2805 bp, Artificial Sequence
  Description of Artificial Sequence: Synthetic coding sequence
atggtgccagaggcttggcgaagtggcttggtctccactggtcgggttgttggagtgctcttgctccttggagcgcttaataaggcctcaaccgtgatacactatgagataccagaggagagggaaaagggatttgcagtgggaaatgtggtagccaacctgggcctggatctgggcagtctgtctgctcggaggttcagggttgtgagcggggcaagccgacgtttctttgaggtgaaccgagagactggagagatgtttgttaatgatcgcctcgatcgagaagagttgtgcggcaccctcccatcttgcaccgttaccttagagctggtagtagaaaatccccttgaattgttctcagtggaggtcgttatccaagacatcaacgacaataatcctgcttttcccacacaagagatgaagctggagatttccgaggccgtggcaccaggaactcggtttccgttggaatccgcacacgatccagacgtagggagcaattccctacagacatacgaactgtctagaaacgaatactttgccctgagagtccaaacccgcgaggactctaccaagtatgcagaactggtcttagaacgagcccttgaccgtgagcgtgaaccctctctgcagttagtcttgacagccctggacggtggaaccccagccttatccgcaagcttgccgatccatattaaagtcttggatgccaacgataatgcccctgtatttaatcaaagcctctacagggcacgggtcctagaggatgcacctagcgggacccgcgtagtacaggttttagcgacggatctcgacgaaggccctaacggggaaatcatctactcatttggatcacataacagggcgggagttcggcagctgtttgccctcgatttggtgaccgggatgttaacgatcaagggcaggctagacttcgaagacactaaacttcatgagatctatattcaggcgaaagacaagggagccaatcctgaaggggcacattgtaaagtcttagtggaggtggtcgatgtgaacgataacgcacccgaaatcaccgtcacttccgtttactcgcccgttcccgaggacgcaccgttggggaccgtcatcgcattgctgagtgtcacggacctcgacgccggagagaatggacttgtgacgtgcgaagtcccacctggactgcctttcagtttaaccagctctctaaaaaactattttacgctgaagaccagcgcggacctcgatagggagactgtccctgaatataatctgagcatcaccgcacgtgacgcagggacccccagcttgtccgcattaactatcgtccgcgtccaggtatctgatattaacgacaaccctccacaaagcagccaaagctcctatgatgtctacattgaggagaacaatctgcccggagcccctattctgaatttgtccgtttgggatcctgacgcaccccagaacgcgagactctctttttttcttctcgagcagggggctgagacgggcttggtggggagatatttcactatcaatagagataacggcattgtctcttcgctcgtgccactggattatgaggatcggagggaattcgaactcaccgcccatataagtgatggcggaacaccggtcctcgcaacaaatatctccgtgaacatcttcgtgaccgaccgcaatgataacgctccccaggtgctctatcctaggcctggagggagctccgttgaaatgctgccaaggggaacatctgcgggacaccttgtcagtcgcgtggtcggttgggatgccgatgccggtcataacgcgtggctgagctactccttgctggggtcacctaaccagtcactgttcgctatcggtctgcataccggccagatctccacagccagacccgtgcaagataccgactcccctcgccaaactctgacagtgctaattaaggataacggcgaaccgtccttgagcactaccgccaccctgactgtgagcgtgacagaagattcccctgaagcacgggcagagttcccatctggctctgcaccccgagagcagaaaaagaatcttactttctatttattgctgagtctgatcctggtaagcgtcggcttcgtagtgacagtatttggcgtgataatttttaaagtctacaaatggaagcagagccgcgatctatatagggcccctgtttcgtctctttaccggactcccggtccttcactgcatgctgatgctgtgaggggcggtcttatgtcaccacacttgtaccatcaggtgtacctgacgaccgatagtagacgttccgaccccttgctgaaaaaaccaggtgcagcttcgcctctggccagccgtcagaacacgctgaggagctgcgaccctgtattctaccgtcaggtgttgggggctgaaagcgcccctccgggacaacaggctccccctaacactgactggcggttctcccaggcccagaggcctggaacaagtggaagccagaacggggatgacactggaacgtggccaaataaccaatttgatactgagatgctgcaagctatgattcttgcatctgcctccgaagctgccgatggcagcagcacactggggggtggggctgggactatggggctgtctgccaggtacgggcctcagttcacactgcaacacgtaccggactacaggcagaatgtgtacatcccaggcagcaacgcaacactgactaacgccgctggaaagcgggatggaaaagctccggctgggggtaacgggaacaaaaagaagtcagggaaaaaggaaaagaaatag

SEQ ID NO: 237355 - DNA, 2817 bp, Artificial Sequence
  Description of Artificial Sequence: Synthetic coding sequence
atgctcaggaaggtgagatcctggaccgagatctggagatgggcaacacttctgtttctcttttatcacctcggctatgtctgtggccaaattagatatccggtgcctgaagagtcgcaggaggggacgttcgtcggtaatgtggctcaggacttcctactggacactgacagtctgtccgcccgtcgcctgcaggtggcaggcgaggtcaaccaacggcacttcagggtggatctcgattctggcgctcttctgatcaagaacccaatcgaccgcgaagccctttgcggcctgagcgccagctgcatagttcccctggagttcgtcacagaaggacccctagagatgtatcgtgcagaagttgagattgtcgacgtgaatgaccatgccccacggttccccagacaacagcttgacctcgaaatcggggaggcggcacccccagggcaaagatttcccttggagaaagcgcaggatgcagatgtcgggagcaacagcatctcatcataccgcctgagttcgaacgagcattttgctctagatgtgaagaagagatcagacggcagcctggtccctgagttactgctagaaaagcccctggatcgcgaaaagcaatctgactatagactggtcctgacggcagtggatggcggaaatcccccaaggagcggtaccgcagagctccgggtatcagtgctcgacgtcaacgataacgcaccggcattccaacagagttcctatagaatttcagtgttggaatcagccccagccggaatggtcctgatacaacttaacgcctctgatcccgatctggggccatcaggcaacgtcaccttctacttttcaggccacacccctgaccgggtgaggaacctcttctcgttgcaccccaccactggcaagctcaccctcctaggtccacttgatttcgaaagcgagaactactacgagtttgatgtccgcgcaagggatggtggatccccagcaatggaacagcactgcagcctgcgcgtggacctgttagacgtcaacgataatgccccatacataaccgtgacatcagaactgggtacactccccgaaagcgctgagccgggtaccgtagtggcactcatctctgtccaggatcccgatagtggaagcaacggagatgtgtctctgcgtattcccgatcaccttcctttcgcgctgaaatctgccttccgaaaccaattcagccttgttacagccggacctctggaccgcgaggcaaaaagcagctacgatatcatggttacggctagcgatgccggaaatccacccctgagcacccaccgcaccattttccttaatatatcagatgtgaacgacaacccacccagctttttccaacgaagtcacgaggtgttcgtgccggaaaacaataggcccggtgatctcctgtgttcattagccgcatctgaccctgactctggcctgaacgcactgattagttattcactgcttgagcccagaaatcgggatgtttcggcttcgtctttcatcagccttaacccgcaaacaggtgccgtgcacgccacacggtctttcgattatgagcagacccagactctgcaattcgaagttcaagctcgggaccgcggaaatccaccactatcgagcacggtaactgtaaggctgtttgtcctggatctgaacgataatgctcccgctgtccttcggcctagggcacggccaggatcactctgcccacaggccctgccaccatccgttggagctggacaccttatcactaaggtgacggcagtggatctggacagcggctacaatgcttgggtctcctaccagctgctcgaagctcccgacccatccctgtttgcagtcagcagatacgctggcgaagtaagaacagctgtgcctatcccagcagacttgcccccacagaagctggtcattgtcgtcaaggacagtggaagcccccctttatctacttccgtaactctcctggtgtccttagaggaggatacacatcccgtagtgcctgatcttagggagagcagtgcaccccgtgagggggaaagtcggctgactttgtacctagccgtgtccctggtcgccatctgttttgtttccttcggctcatttgtcgccctgctgtccaagtgtctccgtggagccgcttgtggcgtgacttgcttcccagccggaacatgtgcctgccttaccagatccagacgtcgcgaagggctgcccccatccaatgggattctgagaatccaactgggaagcgacgacccaatcaagttcgtggatgtcggcggacactcccatgggtgtactcccctggcctctgcaccgaccagatccgattcattcatgatggtgaagagtcccagtgctcctatggccggagaaccagtacggccatcttgtccccctagtgacttgctgtatgggctagagcaggccccaccaaatactgattggagatttagtcaggcccagcgcccaggtactagtggatctcaaaatggtgacgacacagggacctggccaaataaccagtttgacacggagatgctccaggccatgattttggccagcgcgtccgaagccgctgacggatcaagcaccctgggagggggagctgggacaatggggctgtcagcgcgttacggccctcaatttacactgcagcatgtcccagactacagacaaaacgtctatatacctggatcgaacgctaccctcactaatgcagcaggtaaaagggacggaaaggctcctgccggtgggaacgggaacaaaaagaaatccggaaaaaaagagaagaagtag

SEQ ID NO: 237356 - DNA, 2835 bp, Artificial Sequence
  Description of Artificial Sequence: Synthetic coding sequence
atgggccctaaaaccctgccccaactggctggaaaatggcaggtcttatgcatgctgtctctttgctgttgggggtgggtcagtgggcaactgcgttatagtgtcgttgaggagagtgaacccggaacccttgtggggaatgttgctcaggatctggggttgaagatgacagatctgctttcacgacggcttcagcttggttccgaggagaacggacgctacttctccctgtcactgatgtctggcgcactggctgtgaaccaaaagatcgaccgggaatccctgtgcggagcttctacatcgtgtcttctccccgtccaggtcgtgacagaacaccctctcgaactgatccgggtggaggtggaaatcttagatctgaatgataactccccatcttttgctacccctgagagagagatgagaattagtgaaagcgctgcaagcggcgcacgctttccattagatagtgcccaagacccagacgtggggacaaacaccgtgagtttctatactctgtccccaaactcacacttctccctgaacgtgaaaactcttaaggatgggaaaccctttccagagctagtgttggaacagcagctcgacagagaggcgcaagccagacatcagcttgtgctcactgctgtcgatgggggtacccccgcaagaagcggaacaaccctgatttcggtgattgtgcttgacatcaacgataacgcgccaaccttccagtcctctgtcctgcgggtaggcatacctgaaaatgctccaattggcacactgcttttgagactcaatgccaccgatccagacgaaggcaccaacgggcagctggactactctttcggggaccacaccagcgaagcggtgcgtaacctttttgggcttgatccttcatctggtgctattcacgtgctcggtcctattgattttgaagaatcccgattttacgagattcatgcgcgtgcccgtgaccaaggccaaccagcaatggaaggccattgcgtgatccaggtagacgtaggcgacgtaaacgacaacgctcccgaggtacttctcgcgagtctggcaaacccggtcctcgaatccacgcccgtaggcacggtcgtgggcctgtttaacgtgagagatagggattcaggcagaaatggtgaggttagcctggatatctcacccgacctgccgtttcagattaagccctcggagaatcactacagtctgctgacctcacaacccttggatcgggaggcaacttcccactacatcattgagttgctggcctccgacgctggaagcccaagtctgcataagcatctcaccattcgactcaacatcagcgacgtcaacgataatgcgcctcgcttcaaccagcagttatatacagcctatatcttggagaaccgacctcctgggagtctgttgtgtaccgtagcggcttccgatccggatacaggcgataatgcccgattgacctatagcatagtgggtaatcaggtgcagggagccccagcctcatctttcgtctatgtcaatcccgaggatggcagaattttcgcgcaacgtaccttcgactatgagctactgcaaatgttgcagatcgtagtaggagtcagagacagcggatctcctcccctgcatgccaatacaagcctgcacgtgtttgtgcttgacgagaacgataacgcgccagcagttctccatccaaggcctgattgggaacactccgcacctcagcgcctcccacgatccgccccaccaggatcccttgtgaccaaagtcactgccgtggatgccgacgcgggtcacaatgcctggttatcctacagcttgctcccccaatctactgcccctggtctgttcctcgtgagcacccatacaggcgaggtcagaacagctagagcgttgttggaggatgattccgatactcagcaggttgtggtgctcgtgcgggacaacggcgaccccagtctctcttctactgccactgtgttgttagttctggaagatgaagatcccgaagagatgcccaagtcgagcgacttcctcatccatcccccagagcgttctgacctaactctttacctgatcgtggctttggctaccgttagcttgctatctctggtgaccttcacttttttgagcgctaaatgcctgcagggcaatgctgatggcgacgggggtggcggacagtgctgtcgacggcaggattctccgtccccagacttttataaacaatcaagtcctaacctgcaagtgagttccgacggcacacttaagtacatggaggttactctgcggcctaccgactcacagtctcattgctatcgaacctgtttttcccctgcaagcgatggcagtgacttcaccttcctccgaccgttgtccgttcagcagcctacagctctggcactggaacccgacgcaattcgctcacgcagcaacaccctgagagaaagatcccaacaggcacctcctaacaccgattggagattcagccaagctcagagaccaggcaccagcgggagtcaaaacggagatgatacggggacctggcctaacaaccaatttgacaccgagatgttgcaggcaatgatccttgcttcagcgagcgaggctgctgatggaagttcgaccctgggcggtggggcaggcacaatgggtctgtctgccaggtatggaccacagttcaccctccagcacgttcccgactacaggcagaacgtctatatccctggcagcaatgctacactgactaatgctgctggtaagcgagatggaaaggctcccgctgggggaaacggcaacaaaaaaaaatcgggtaaaaaagagaaaaaatag

SEQ ID NO: 237357 - DNA, 5867 bp, Artificial Sequence
  Description of Artificial Sequence: Synthetic coding sequence
atgttccggcagttttacctttggacttgtcttgccagcgggattatcctgggatctcttttcgaaatatgtcttggccagtacgatgacgactgcaagctcgcgagagggggaccaccagccactatcgttgcaattgacgaagaatcacggaacggcacaatcctcgtggacaatatgttgattaaggggacggctggaggccctgatcctactattgagctgtcgttgaaggataacgtcgactactgggttctgatggatccggtcaagcaaatgctttttcttaacagcactgggagagtgttagacagggaccccccaatgaacatccatagtatcgtggtgcaggtacagtgcattaacaagaaagtcggaaccattatctatcacgaagtgcgaattgttgtccgggacagaaatgacaatagtccaacctttaaacacgagtcttattatgcaacggttaacgagctgacccccgtgggtactacaatttttaccgggttttctggggataatggcgctacagatattgacgacgggccaaatggtcaaatcgaatacgtgatccagtataatccagatgaccccactagtaatgacacctttgaaatacctttgatgctcactgggaacatagtactccgcaaaagactaaactatgaggataaaacaagatacttcgtgatcattcaagcaaatgacagagcgcagaacctcaacgagcgcaggactaccaccaccactctcaccgttgacgttcttgacggagatgatctaggccctatgttccttccgtgcgtgcttgtcccaaatactcgggactgccgccctttgacctatcaagccgctattcctgaactgcgcaccccagaggagctgaacccaatcatcgtgacacctcccattcaggcaattgatcaggatagaaacattcagccaccctctgatcggcctggaattctgtattccattcttgtgggtacacccgaggactacccaagattcttccacatgcatccacgcactgctgaactgtccctgctggaaccggttaatagggattttcaccagaagtttgatctggtaatcaaggctgagcaagacaacgggcaccctctgccagccttcgcaggtcttcacatcgaaattctggacgaaaataaccaatccccctatttcactatgccaagttaccaaggctacatcctggaatcggctccagtgggagccacgatctcagatagcctcaatcttacgtcccctcttaggatagtcgccctcgataaagacattgaggatactaaggacccggagctacatctgtttcttaatgactatacgtcggtattcacagtcacacaaaccggcataactcggtatctcacactgctgcagccggttgacagagaggagcagcagacgtataccttttcaatcacagccttcgatggggtgcaggaatcggaaccagtgattgtgaacatccaggttatggatgctaatgacaataccccaacgttcccagagatctcttatgacgtctatgtgtataccgacatgcgcccaggtgacagtgtcattcagctgacggcagtggacgccgatgaaggttccaatggtgaaatcacctacgagattctggtaggggcacaaggagacttcataattaacaagactaccggcctgataactatcgcgccaggagttgagatgatagtggggagaacatacgctctgacagtacaagcggctgataatgcccctccggctgagagacggaacagcatctgtacagtctacattgaggtactgccgccaaacaaccaaagccctccacggttcccccaattaatgtactcactggagatttcagaggccatgagggttggggcagtcctgctgaaccttcaggccaccgatagggaaggggatagcatcacatacgctatagagaatggggacccccagagagtttttaacctgtcagaaacgacaggaattctcacactggggaaagccctggaccgcgagagcaccgataggtacattctcattatcaccgcctctgatgggagaccagacggtacctcaactgcaaccgtgaatatcgtcgtcactgatgtcaacgataatgcgcctgttttcgatccgtatctgcccagaaacctatctgtggtcgaggaggaagctaacgctttcgtgggccaggtgaaggctaccgacccggacgcaggtatcaatggacaggttcattactcactcggtaactttaacaatctgtttcgaattacgtctaacggctcaatttacacggccgtgaagctgaaccgcgaagtaagggattactatgagcttgtggtggtggcaacggatggggcagtgcatccacggcacagtaccttaaccctggccattaaggtgctggacattgacgataactcccccgtgtttacgaactctacttacaccgttttggtggaagaaaacctgcccgctggcactacaattcttcagattgaggcgaaagacgtggaccttggggcaaacgtgtcctacaggattcgttccccagaggtgaagcacttctttgccctgcaccccttcactggcgagctcagtctgctcaggagtttggattacgaagcgtttcccgatcaggaggctagtattacatttctggtagaggcttttgacatttacggaaccatgcctcctggtatcgctaccgtcacagtgatcgtcaaagacatgaatgactaccctcctgttttctccaagcgcatctataaaggcatggtggcacctgacgctgtcaagggtaccccaatcaccactgtttacgcggaagacgcagatcctccaggcctgccagcaagcagggtgaggtatagggtggacgacgtgcagtttccttatcctgccagtattttcgaggtagaggaggactctggacgagtgatcactagagtcaaccttaatgaagagcctacaaccatttttaaattagtagtggtcgctttcgacgatggggaaccagtcatgagttcctctgctacagtgaaaatcctcgtcttacacccaggcgagatcccgaggtttactcaggaggagtataggcctccacctgtttctgagctcgcgactaaagggacgatggtcggggtaatcagcgccgctgcaatcaaccagagcattgtttattcaatagtcagtggcaacgaagaagatactttcgggatcaacaatataaccggagtgatctatgtgaatgggccattggactatgagacacgaacatcctatgtcttgagagttcaggcagatagtttggaggtggtgctcgcaaatctgagagtaccgagcaaaagcaacaccgctaaggtgtatattgagatccaagacgagaataaccaccctccagtttttcagaaaaaattctatataggcggtgtgtctgaagacgctaggatgttcacgtctgttttgagagtcaaagcaacggataaggacactgggaattattcagtcatggcatacaggctgattatacccccaataaaggaggggaaagagggttttgtcgtggagacttacactggcctcatcaagactgcaatgctgttccacaacatgcggagaagttatttcaaattccaggtgatcgcgaccgatgactatggcaaagggctgagcgggaaggcagatgtgctcgtgtcagtggtgaatcaactcgacatgcaagttattgtgagtaatgtcccacccactcttgttgagaagaaaatcgaggacttgacggaaattttagacagatacgtgcaggaacagattccgggagctaaagtggtcgttgagtcaatcggtgcacgccgacacggcgacgcattctccttggaggactatacgaaatgtgatctcactgtgtatgccatcgaccctcagactaaccgcgctattgaccgaaatgaattatttaaatttctagacggcaaacttcttgacataaacaaggatttccagccttactatggggaaggcggaagaattctggaaatccgcacaccagaggccgtgaccagcatcaagaagcgaggtgaaagcttggggtatacagaaggcgctctgctggctttggcctttataatcatcctctgttgtatccccgctatccttgtagtactggtctcctatcgccagttcaaggtgcgccaggcggagtgcacaaagacggcgagaatacaggccgctctgcctgcggcaaagcctgctgtccccgctccggcacccgtagccgctccccctccacctccaccaccaccgcctggcgcacacctatacgaagagctaggtgactcttctatcttgtttttactctatcatttccagcagagtcggggaaacaactcagtgagtgaagaccggaagcatcagcaagtggtgatgccgttcagtagtaatactatcgaggcccacaagagcgcccacgtggacgggagccttaaatcaaataaactcaagtctgcaagaaagtttacctttttatcagacgaggatgacctgagcgctcataatcccctgtataaggaaaatatcagccaggtgtctactaactccgatatttcacaacgtacggatttcgtggatccattcagtccaaagatacaggccaagtctaaaagtcttagggggccaagagagaaaatccagaggttgtggtctcagtcagtcagtttgccaaggagactgatgcgcaaagttccgaacagacctgagataatcgatcttcagcagtggcagggaacacggcaaaaggctgaaaatgaaaataccggcatatgtactaacaagcgcggaagttcgaacccccttttgactaccgaggaggccaatctgaccgaaaaggaggaaattagacaaggtgagactctcatgattgaaggtaccgagcagctaaagtctctttccagcgatagcagcttttgttttccacgacctcatttcagcttctctacgctgcccaccgtatcccggacagtggagttaaagagcgaacctaacgtcataagtagcccagctgagtgtagcttggaacttagcccctcccgtccttgcgtgctacacagtagtctgagccggagggagacaccaatttgtatgctgcccatcgagaccgagcggaacattttcgagaatttcgcccatccacctaatataagtccatccgcctgtcctctgcctcccccaccaccgattagccccccatctcctccgccagccccagcccctctagcccctcccccagatattagtccttttagtcttttctgccctcctccatcaccaccatcaatccccctgcccctgcctcctccaaccttctttccattatcggtctcgacatccgggcctccaacaccccctctacttccgccatttccaacaccactgccaccaccaccacctagcatcccttgcccacccccacctagcgctagttttttaagtaccgagtgcgtgtgcatcacgggtgtgaaatgcacgacgaacctcatgcccgcagaaaagattaagtcgagtatgacacagctgagcacgaccacggtgtgtaaaaccgatccgcagcgcgagcccaaaggcatcttgcggcatgtcaagaatctggccgagctcgagaagtcagttgcaaatatgtacagccagattgagaagaactatctgcgtactaacgtgagtgagctgcagactatgtgcccttcggaagtgaccaacatggagatcacatccgaacagaataagggctcattgaataatatagtagaaggtacagagaaacagtcccactctcagagcacctcactgta

SEQ ID NO: 237358 - DNA, 5873 bp, Artificial Sequence
  Description of Artificial Sequence: Synthetic coding sequence
atgtttaggcagttttacttgtggacatgcctggcctccggtatcattttagggtcactctttgagatttgcctggggcaatacgatgacgattgcaagcttgcacgtggcggtccgcctgctacaattgtcgctattgacgaagagagtagaaacggaaccatcttggtcgacaatatgcttatcaaaggaacagccggagggcctgatccaacgattgaactcagtctgaaggataacgtcgactactgggtgctcatggatcctgtcaagcaaatgctgttcctgaattctaccggtcgggtcctagaccgggaccctcccatgaatatccattccatcgttgtccaagtgcagtgtataaataaaaaggtgggtactatcatttatcacgaggttcgtattgtggtgagggatcgcaacgacaactcacccaccttcaaacacgagtcttactatgcaaccgtaaatgaactgacccctgtggggaccactatatttacagggttttccggggacaatggtgccacagacatcgacgatggccctaatggacaaatcgagtatgtcattcagtataatccagatgacccaacttcgaatgataccttcgaaattcccctcatgctgactgggaacatcgttttgcgcaaaaggctaaattatgaggacaagacgaggtattttgtgattatacaagctaacgatcgagcccagaacttgaatgagagaagaactactacaaccactctcaccgttgatgtcctagatggcgatgacctggggcctatgttcctcccctgtgtactggtcccaaatacacgagattgtagacccctgacttatcaggccgcaatccccgagctacgcactcctgaagaactgaaccccatcattgtaacacccccaatccaggccatcgatcaggacaggaatattcagcccccttcagataggcctgggattctttattccatcctggtgggcaccccggaagactacccaaggttttttcatatgcacccacgtactgccgaactgtcactgctagagcctgtgaaccgcgactttcaccagaaatttgacttggtaattaaagctgagcaagataacgggcacccccttcccgctttcgctgggctgcacattgagatattagatgaaaataaccagagcccctacttcactatgccgagctatcaagggtacatccttgagtcagcccctgtgggggcaaccatctccgactctctgaacctgacatctcctctgcgtatcgtcgcactggacaaagatatcgaagataccaaggaccccgaactgcacctgtttctcaatgattatacaagtgtcttcactgtgactcaaacaggcataaccaggtacttaaccctccttcagcccgtcgatcgggaagaacagcagacgtataccttctctatcacagcttttgacggcgtacaggagagcgaaccagtaatcgtgaatattcaagtgatggatgcgaacgacaacacacctacctttccagaaatctcatacgacgtatatgtctatactgatatgcggcctggggacagtgtcatacagctaacagcagtggatgcagatgagggaagcaatggcgagataacgtatgagatcttggtcggtgcccagggcgatttcattattaataagactactggcctcataacaatcgccccaggcgtagagatgatcgtggggagaacatacgctctgaccgtacaggcagctgacaatgcaccccctgcagagcgtcgaaactcaatttgcactgtctatatcgaagtgcttcctccaaacaatcagtcacccccacgctttccacagcttatgtattccctggagatcagtgaagcaatgcgggtgggcgctgttctgctaaatttacaggctactgaccgagaaggcgattcgatcacttacgccatcgaaaatggcgacccacagagggtgttcaatctgagcgaaactactggtatccttaccttgggaaaggccttggaccgggaatccaccgatcgatatatcctcataattaccgcatctgacggccgtccagacggaacatccacagccacagtaaatatcgtggtgacagatgtcaatgataacgctccagtgtttgatccttacctgccgaggaacctgtctgtggttgaggaagaagccaacgcctttgtggggcaggtgaaagccacagatcctgatgcaggaatcaatgggcaggttcattactctctgggaaattttaacaatctgttccggatcacgagcaacggctctatctacaccgccgtcaagctgaaccgggaagttcgtgattactacgagctagtggtagtggcaactgacggggctgtgcatccccgacacagtaccctgacccttgcaatcaaggtgctggacatcgatgacaactcccctgtttttaccaactccacttatacggtgctggtcgaggaaaatttacctgcagggactacaattctgcagatcgaagccaaagacgttgatctcggcgcaaacgtgagctatagaattagaagtcctgaggtgaagcacttttttgccctacacccctttactggcgaattgtccctccttcggtcactcgactatgaagctttcccagaccaagaagcctctatcactttcttagtggaagcattcgacatctatggcaccatgccgccagggatcgcgactgtgaccgtgatagtaaaggacatgaatgactaccctcccgtgttttctaagcggatctataaggggatggtggcaccagacgcggtgaaggggaccccaataaccaccgtgtatgcagaagacgctgatccccctggcctgcctgcatcacgggtgcgatatagggtggacgatgtccagttcccctacccagccagcattttcgaggtggaagaagacagtgggagagtcattacccgggtaaatcttaacgaggagcccacaacaatcttcaagcttgtggttgtggcgttcgatgacggcgagccagtcatgtcgtcctcagcgactgttaagattttggtgcttcaccccggagaaattccacgctttacgcaggaggagtaccggccaccacctgtgagcgagctggccaccaagggaaccatggtgggagtcataagcgccgcagctatcaatcagtcgattgtctattccatcgtgtctggcaacgaggaagacactttcggaataaacaatatcactggagtgatctacgtcaacgggccactggactacgaaaccagaacatcctacgtattgagagttcaggctgacagtctagaagtggtcctcgctaatttgcgggtgcccagcaagtcgaacaccgccaaagtgtacatcgagattcaggatgaaaataaccaccctccagtgttccagaagaaattttacatcggaggagtctccgaagacgctcgcatgttcacatccgtcctgagggtgaaagccaccgacaaagacaccggcaattatagcgtgatggcgtatcggctgatcattcctccaatcaaggagggcaaagagggttttgtggtagaaacatacaccgggctgattaaaaccgccatgttgttccacaatatgcgcaggtcctactttaagtttcaggtaatagctacagatgactacggaaaagggctgtccggaaaagccgatgtattggtgtctgtcgtaaaccaactcgatatgcaggtcatcgtcagcaatgtcccacccaccctagtggaaaagaaaatagaggatttaaccgaaatcctcgacaggtatgttcaggaacagatcccaggtgccaaggtggtggtggagtcaatcggcgcaagaagacacggggatgcattttcactcgaggactacactaaatgcgatttgacagtatatgctattgatccacaaacgaaccgcgcaattgatcggaatgagttgttcaagtttttggacgggaaacttctggacatcaataaagactttcagccatactacggtgaaggaggtcggatcctggaaatcagaacacctgaagcagtcacgagtatcaagaagcggggagaatcgctgggctacaccgagggcgcactgctagcccttgcctttattatcattctttgctgcatccccgcaatattagtggtgttagtgtcttatcggcagttcaaagttcggcaggccgaatgtactaagactgcccgtattcaggcagccttgcctgctgctaagcctgccgtacctgcgcctgctcctgttgctgcgcctccaccacctccccctcctccgccaggcgcacacttatatgaagaactcggagacagtagtatgcacaatctgtttctcttgtatcactttcagcaatcaagagggaacaatagcgtgagcgaggaccgcaagcatcagcaagtggtaatgcccttcagctctaatactatcgaggcacacaaatctgctcatgtggatggttcgttaaaaagcaacaagctgaaatctgctcgaaaattcacatttttaagcgacgaggacgatttatctgcgcacaaccccttatataaagaaaacatttcccaggtgagcaccaactccgacatatcacagcgaacagatttcgtagacccattttcacctaagatccaagcaaagagcaaaagcctccgcggaccacgggagaagatccagaggctatggagccaatccgtgagcctcccacgcaggttgatgcgcaaggtgcccaaccgccctgagataatagacctgcaacagtggcaagggaccagacagaaggctgagaatgaaaatactggaatttgtaccaacaagcgtggaagctctaacccgctcctgaccacagaggaagccaatctcacagagaaggaggaaatacgccagggcgaaacccttatgatagagggaaccgagcaactaaagtcactttctagtgactctagtttctgtttcccccgacctcatttctctttttctaccctgccgacggtttcccgaacagtggagctgaagagtgagccaaacgtaattagcagcccagcagagtgctccctggagctgagtccttctcgaccctgtgttctgcactcctccctgagccgaagggagactccaatttgtatgctgcctatcgaaacggagagaaatatctttgagaactttgcccaccctcctaacatcagtccatcggcttgccctctccctccccctcccccaatttcgccacccagcccccctccggcacccgctcccctggctcctccgccagacatcagcccgttctctctattctgcccacccccaagtcctccgtctattccactcccattgcctcccccaacattctttcctctgagcgtgtcgacttccggacctccaaccccccctctactcccaccgttccccactcccttgcctcctccgccaccaagtatcccctgtcccccaccacccagcgcttcatttctgtctacagagtgtgtatgcattacaggagtgaagtgtacaacaaatttgatgccagccgaaaagattaagagcagcatgacacagttgtcaaccacaaccgtttgcaaaacggatcctcagagagaacctaagggcatcctcagacatgtgaaaaacctggctgaacttgaaaaatccgtggcaaacatgtacagtcagatcgaaaagaactacctacggacaaacgtgagtgagctccagactatgtgcccatctgaagtaacaaacatggagataacatccgaacagaataaagggtcactgaacaacatcgtggagggaactgagaaacagtctcattcacagtcaaccagcttata

SEQ ID NO: 237359 - DNA, 2886 bp, Artificial Sequence
  Description of Artificial Sequence: Synthetic coding sequence
atgtttcggcagttctacctgtggacttgcctcgcatcgggtatcattctcggaagcctgttcgagatctgcttgggacaatatgatgatgattgtaagctcgctcggggaggacctcccgcaacgatagtcgccatcgatgaggagagtcgcaatggtacaattctggtggataacatgcttattaagggaaccgcagggggaccagaccccactatcgaactgtcgctgaaggataacgttgattattgggtgctgatggatcccgttaagcagatgctgtttctgaatagcacaggacgcgtcctggatcgagaccccccaatgaatattcactcaattgtcgtgcaggtccagtgtataaataagaaagtcgggacaatcatctatcacgaggtgcgcattgtcgtcagggatcgaaatgataacagtcctacattcaaacacgaatcctattatgcaacggttaatgaacttacacctgtgggaaccacaatttttacaggcttttccggtgacaatggggctaccgatattgatgatggacccaatggccagatcgagtatgtgatccagtataatcccgacgatcccacgtccaacgacacgttcgaaatcccgcttatgttgacaggaaatatcgtgctacggaagcgcctgaattacgaagataagacccgatacttcgtcattatacaggccaacgaccgggctcagaacctgaacgagcggagaactactaccaccactctgaccgtcgacgttctggatggcgatgacctcggacccatgtttctaccctgcgtgctggtgcccaatacgagggattgccgtccgctcacctaccaagcagccatcccagaactgcggaccccagaggagctgaacccaattatagtgacaccaccaatccaggccatagaccaagaccgcaacattcaacctccctccgaccggcctggcatcctgtattcaatactggtggggacacccgaggactacccgagattctttcacatgcaccccaggaccgctgagctcagcctactcgagcccgtcaaccgcgacttccaccagaagtttgacctcgtgattaaagccgagcaggataacgggcatcctttgcctgcttttgcgggtttgcatatcgaaatactggacgagaataaccaatccccctatttcacaatgccttcataccaggggtacatcctcgagtcggcgcctgtcggtgctacgatttctgactctctgaatcttacctcccccctccggatcgtcgccttagataaggacatagaagatacaaaggacccagaactccacctgttcttgaatgattatactagcgtttttaccgtcacacagactggaatcactcggtatctgaccttgctgcagccagtggatagagaagagcagcagacctacacgttttctataaccgcatttgatggggtgcaggagtccgaaccagttatcgtgaacattcaggtcatggacgccaatgataatacccccacatttcccgagattagctacgatgtgtatgtttataccgatatgcgcccaggcgactctgtgattcaacttactgccgtggatgccgatgaggggtcaaacggagagatcacttacgagatactggtcggggctcagggagacttcatcatcaataagacgacagggctgatcaccattgcccctggcgtggagatgatcgtcggtcggacctatgcattgactgtgcaggcagcagataatgcccctcctgccgaaagacgaaacagcatttgtacagtgtacattgaggtcctaccccctaataatcaaagtccacccaggttcccacagctcatgtatagtctcgaaataagcgaggcaatgagggtcggggctgtactgttaaatcttcaggccacggatcgtgaaggcgacagcatcacctacgctatcgagaacggcgaccctcagagggttttcaacctgtccgaaacaaccggcattctgacactgggcaaagctcttgatcgggagagcacagatcggtacatcctgataattactgcttctgatggaaggcctgacggaaccagcacagccacagtcaacattgtcgtgaccgacgtaaatgacaacgccccagtcttcgatccctacctgcccaggaacttgtctgttgtggaagaggaagccaacgcatttgtgggccaggtgaaagcgaccgatcccgacgctggcatcaacggacaagtgcattacagtctggggaactttaataacttatttaggatcacctctaacggctccatctatacagccgtcaaactgaatagagaagtgcgcgactattatgagctcgttgtggttgcaactgatggcgcagtccatccaagacatagtaccctgacattggctataaaggttcttgatattgacgataactctcccgtcttcaccaactctacttacactgttttggtggaagaaaatcttcccgcaggcaccaccatcctgcagattgaagcaaaagacgttgacctcggagccaacgtgtcctacaggatccggtctccagaggtgaaacattttttcgccctgcatccttttacaggcgagctgtcgttattacgcagtctggactatgaggcatttcccgaccaggaggcctccatcacctttttggtggaagcattcgatatttacggaaccatgccccctggcattgctactgtgaccgtgattgtgaaagatatgaacgactaccccccagtgttctctaagagaatatacaagggaatggtcgctcccgacgctgtgaagggcactccaattaccacggtatacgccgaagacgctgatcccccagtttcacgtagacactag

SEQ ID NO: 237360 - DNA, 2430 bp, Artificial Sequence
  Description of Artificial Sequence: Synthetic coding sequence
atgtttcggcagttttatctttggacttgcctcgccagtggcatcattctaggttccttattcgaaatctgcttgggtcagtacgatgacggaacaatactcgtggacaacatgctgataaagggcaccgcaggcggacccgatccaactatagaactttcattaaaagacaatgtagattactgggtgttgatggatcctgtgaagcagatgcttttcctgaacagtacgggccgtgtgctggacagggatccgccaatgaatattcattccattgtggttcaggtgcagtgtatcaacaagaaggtgggaacgatcatctaccatgaggttcgtattgtcgtccgcgatcgcaatgacaactcccccacctttaaacatgagtcatactacgcaactgtgaacgagctcactcccgtggggaccaccatttttacagggttctcgggtgataatggcgctaccgacatagatgatggccctaacggacagatagaatacgttatccaatataacccagacgaccctaccagcaatgacacattcgagattccacttatgctgacaggtaatattgtgctgcggaaacgacttaactacgaggataaaacacgatatttcgtcataatccaggccaacgaccgcgcacagaatctaaacgaaagacgtaccacaacaactaccctgacggtggacgtgctcgatggggatgatctcgggcctatgttcctgccctgcgtcttagtgcctaatacaagggactgcaggcccctgacctaccaggcagccataccagagctgaggacccccgaggagctgaaccctatcatcgttaccccgccaatccaggctattgatcaagaccggaacattcaaccaccctccgacagacctggaattctttattcaattctggttgggactccagaagactaccccagatttttccacatgcatccacgcacagctgagctaagtttgctggagccggtgaatagggactttcatcagaagttcgatcttgtgatcaaagccgaacaggataacggacacccactgcctgcctttgctggattgcacatagaaatcctcgacgaaaacaatcagtcaccctactttactatgccttcgtatcagggatatatcctcgaaagcgcaccagtgggagcgactattagcgatagtctgaacctgacaagccccttgaggattgtcgccctggataaagacattgaagacactaaagaccccgaactacacctgtttctcaacgactacacatctgtgttcaccgtgacgcagacaggtatcacccgttatctgaccctcttacaacctgtggaccgcgaagagcagcaaacatacaccttttccattactgctttcgatggagtgcaagagtccgaaccagtgattgttaacattcaagtcatggatgctaatgacaatacgcccacattcccagagatcagctatgacgtgtacgtatacaccgacatgcgacctggcgatagcgtgattcaactaaccgctgtggatgctgacgaagggtccaacggcgagatcacttacgagatcttggtgggagcccagggggatttcatcattaataagactaccgggctgatcaccattgccccaggagtcgaaatgatcgtcggacggacctatgccttaaccgtccaagcagccgataatgccccaccagccgaacggagaaactccatctgcacagtgtacatcgaagtcttgccaccaaacaatcaatccccacctagattccctcaactgatgtactccctggagatatccgaggctatgcgagtgggagccgtgcttctcaatctgcaggctacagatcgcgagggcgacagtataacttacgccatcgagaatggcgatccccaacgcgtctttaacttaagtgagactaccggcatcttgacactcggaaaggcacttgaccgggagagcaccgataggtacatcctgatcattactgcaagcgacggaaggcctgatggaacttccacagctactgtcaacatcgtggttactgatgtgaatgataatgcccctgtgtttgacccttatctcccgaggaatctctctgtggtagaggaagaggcaaacgcattcgttgggcaggtgaagttaagcaccactacagtttgtaaaacggacccacagcgggaacccaagggcattctccggcatgtgaaaaacctcgctgagctagagaagagtgtggctaacatgtacagccagatcgagaaaaactatcttcgcacaaatgtgagcgagttacagaccatgtgcccatccgaggttaccaacatggaaatcacatcagagcaaaataaggggtcacttaataatatagtggagggaaccgagaaacagtcacattcgcaaagcacttctctctag

SEQ ID NO: 237361 - DNA, 5054 bp, Artificial Sequence
  Description of Artificial Sequence: Synthetic coding sequence
atgtttagacagttctacctgtggacatgcctggccagcggcataatcctaggatcacttttcgaaatatgcctagggcagtacgatgacgactgcaaactcgctcgcggaggtccccctgccaccatcgtcgccatcgatgaagagtctcgtaacggaaccattttagtggacaatatgctgatcaaaggaacagccggaggtcctgatcccacaatcgagctgtcactcaaggacaatgttgactattgggtactcatggatccagtaaagcaaatgttgttcctcaatagcactggtagagttctggaccgggatcccccaatgaatatacactcaattgtggtacaagtgcagtgcattaataagaaggtgggcactatcatttatcacgaagtgcgcattgtggtgcgcgacagaaacgataactctcctacgtttaagcacgagtcctactatgccaccgttaacgagctgactccagtggggaccactatattcaccgggttttccggagataatggggctactgatatcgatgatgggcctaacggccaaatcgaatacgtgattcaatacaatccagacgacccgacatctaacgatacgttcgaaattccactgatgttgaccggcaacatagttttaagaaaaagactaaattacgaggataagacaaggtactttgtcataattcaggctaacgatcgggcacagaatctcaatgaacggagaactactacaacgaccctgacagtggacgtcctggacggtgatgacttgggccctatgtttcttccctgcgtgctcgttccaaatactcgggactgccggccactgacgtaccaggccgcaatcccagaactgaggacaccagaggaactcaaccccataattgtgaccccccctatccaggccatagaccaggataggaatattcaaccacccagtgaccggccaggcatcttgtacagcatattggtagggacccctgaggattacccacggtttttccacatgcatcctcggactgctgaactgagtctactcgaaccagtgaacagggacttccatcagaaatttgatcttgtcatcaaagctgagcaagacaacggccaccctctgccagcctttgccggtctccacatcgagatcctggatgagaacaatcagtccccctacttcaccatgccctcctatcagggctacattctagagtctgcccctgtcggtgctaccattagtgacagcctgaacctcacatcgcccctccgcatcgtggcccttgacaaagatatcgaggatgtgccgccaagtggcgtgcccacaaaggaccctgaactgcatttattcctaaatgactacacatccgtcttcactgtgacacagacaggaatcacccgttatctgaccctgttgcaaccagtcgacagggaagagcaacagacctataccttttcgattacagctttcgacggagtgcaggagtccgagccagtgatagttaacattcaagtgatggacgcgaacgacaacacacctaccttcccagaaatcagctacgacgtgtatgtttacactgatatgcgaccaggcgactctgttatccagctcaccgctgtggacgctgacgaggggtccaacggggagataacgtatgaaatcctagtgggagcgcagggagatttcattattaataaaaccaccgggctcatcacgatcgcacctggcgtcgaaatgattgtgggtcgcacatatgcactgaccgtacaagcagccgataatgcccctcctgccgagcgcaggaattccatttgcacagtttacattgaagtacttccacctaataatcagagccctccgagatttccccagcttatgtattccctggagatttccgaggctatgagagtgggcgctgttttactgaatctccaggctacggatagggaaggcgatagcataacgtacgctatcgagaacggagacccccaacgagtgttcaatttgtccgaaaccacaggcattctcactctggggaaagcactcgatcgcgaatcaaccgataggtacattctcatcattacggcttccgatgggagacctgacggcacgtctactgctacggtgaatatcgttgtgacggacgtgaatgacaacgctccagtatttgacccttatttgcccagaaatctgagcgtggtcgaggaggaggcaaatgcctttgtgggacaagtgaaggccaccgatcccgatgcaggcatcaacggacaagtccactactccctcgggaacttcaataatttgttcaggatcacctccaatggcagcatctatacagcggtgaagcttaatcgggaagtgcgtgactattacgagctcgtagtcgtggccaccgatggcgctgtgcatccaaggcattcaaccctgacactagcgatcaaggtcctcgatatcgatgataattccccagtatttaccaactctacttatacagtcctggttgaggagaatttgcccgctggaacgaccattttgcagattgaggccaaggatgtggatttgggcgcaaacgtgagttaccggatcaggagcccggaagtaaaacattttttcgctctacacccctttacgggagagctctccctcttgcgctcactggactatgaagcctttccagaccaggaggcgtcaataaccttcctggtggaggctttcgatatctacggcactatgccccctggtatcgccacagttactgtgatcgtgaaggacatgaacgattatccgccagtattttccaaacggatctacaaggggatggtggcaccagatgcagttaaggggactcccattaccacggtctacgccgaggacgctgatcctcccggattacctgcttcaagagtccgttatcgagtagatgatgtacagtttccgtatcccgcaagcatatttgaagtcgaagaggatagtggacgggtgatcactcgggttaatcttaacgaagaaccgaccacaatcttcaagttggtcgtggtagccttcgacgacggcgagccagtcatgtcttcctccgccacagtcaagattttagtgctgcatcccggagaaatcccgagatttacccaggaagaataccgacctccacctgtaagtgaattggctacgaaaggaaccatggtcggcgtaattagcgcagcggcaattaaccaatccatagtgtattcaattgtcagtgggaacgaagaggacactttcggaattaataacatcaccggtgtgatttacgtcaatggcccattagattatgagactcggacttcttatgtcttgagagttcaggctgacagtctggaagtcgtgctcgcgaacctcagggtcccctccaagagcaatactgccaaagtctacatcgaaattcaggatgagaataatcatccaccagtattccaaaaaaagttctacattgggggtgtaagtgaagatgctcgaatgtttacgtccgtactgagagtcaaagcaacggacaaggatactggtaactatagtgtgatggcctaccggcttattattccaccaattaaggaggggaaggaaggcttcgtcgtagagacatacactggattgatcaagaccgcaatgttgttccacaacatgcggcgttcatatttcaagttccaagtgatcgccacagatgactacgggaaaggactgagtggcaaagctgatgtactcgtatcagtagtcaaccagttagatatgcaggttatagtgtctaacgttccgcctactttggtggagaaaaagatcgaagatctaaccgagatcttggacagatacgtgcaggagcagattccgggtgccaaagtagttgtggagagcattggggctcgccgacatggtgatgctttttctctcgaggattatactaaatgcgatctgaccgtttatgcaattgacccgcagacgaatagagctatagaccggaatgagttgttcaagttcctggatggaaagctactcgatatcaacaaggatttccaaccatattacggggagggagggagaattttagagatccggactcctgaagccgtcacctctattaagaaaagaggagagagcctaggctacacagagggtgcactcctcgcacttgctttcataattatactgtgctgcataccagctatcctggtggtgctggtgagctaccgccagtttaaggtcaggcaagccgaatgcaccaaaaccgcacgcatacaggcagcactgcctgccgctaagccagctgtcccagcgcctgctcccgtggccgcaccaccaccacccccacccccacctcctggcgctcatctgtacgaggagctgggcgactccagtatgcataagtatgagatgccccagtacggtagccggagacgtttactaccacctgcaggacaagaggaatacggagaggtcgtgggcgaggccgaggaggagtatgaggaggaggagtgggccagaaagcggatgatcaagctcgtggtggacagagagtacgagacaagttccacaggcgaggatagcgcacctgagtgccagcgaaaccgcctgcaccatcctagtatccacagcaatatcaatgggaatatttatatcgcgcaaaacgggagtgttgttaggacacggagagcatgtctcacagataatctgaaggtggcgagtcccgttaggctggggggtccttttaaaaaactggataagcttgcggtgacacacgaggagaacgtcccgctgaacacactctctaaaggacccttcagcacggagaagatgaatgccagacctacccttgtgacatttgccccttgtccagttggtaccgataacacggctgtgaagcccctgcgaaaccgcctaaagtcaacagtcgagcaggagtcaatgattgacagcaagaatatcaaagaagccctcgagtttcactccgatcatacacagagcgatgacgaagagctgtggatgggcccatggaataacctgcacatccccatgaccaagttgta

SEQ ID NO: 237362 - DNA, 5858 bp, Artificial Sequence
  Description of Artificial Sequence: Synthetic coding sequence
atgttccgacagttttacctatggacgtgcttggcctcaggcatcatcctgggtagcttgtttgaaatatgcctggggcagtatgacgatgattgcaaattagccagaggtggtccccctgccacaatcgtagctatcgatgaggagtctaggaatggcacaattctcgtggacaatatgctcatcaagggcaccgccggagggccagaccccaccatcgaactctcactgaaggacaatgttgactactgggtgctgatggatcctgtcaaacaaatgctgttcttgaacagtactggacgcgtgctggaccgcgaccctcccatgaacattcactcaatcgttgtgcaggtacagtgcatcaacaagaaggtgggaacgatcatctatcacgaggtgaggattgtagtgagggaccggaatgacaattctcccacattcaagcacgaatcttattacgccacagtgaacgagctcactccagttggaactactatctttacaggtttctccggagataacggcgcaactgacatagacgacgggccaaatggtcagatcgagtacgtgattcagtacaaccccgacgaccctacgtctaacgacacattcgagatcccactgatgcttacaggcaacattgtgctgcggaaaagactcaactatgaggataagactcgctactttgtcattatccaggccaatgatagggcacagaacttgaacgagagacgcaccacaactactactctgaccgtagacgtgctcgacggcgatgacctcggtccaatgttcctgccttgcgtgttagtgccaaacaccagggattgcagacccctgacgtatcaggctgcaatacctgaattgcgaacaccagaggaattgaatcccataattgtgacccctccgattcaggccatagaccaggataggaatatccagccccctagtgatcgacctggaattctgtacagcatcctggtgggaacaccggaggactatccgagatttttccacatgcaccctcggacagctgagcttagccttctcgaacccgtcaaccgagattttcatcagaaatttgacctcgtcattaaagctgaacaggataatggtcaccccttgccggctttcgctggtctgcacatcgagatactggacgagaataatcagtctccttacttcacaatgccaagttaccaagggtacattttggaatccgcccctgtcggggcaaccatctccgacagcctaaatcttacctctcccctcaggattgtggccctggacaaagacatcgaagacacaaaggacccagaactccacctctttctgaacgactacacatcagtttttaccgtgacccagactggcataactagatatctcacgttgctgcagcccgttgatcgcgaagagcagcaaacatatacattctccattactgcttttgatggcgtccaggagtcggaacccgttattgtgaacatacaggtaatggacgccaatgacaacacgcccacttttcctgagatctcctacgacgtctatgtgtatactgacatgcgacccggagattcagtaattcaattaaccgctgttgacgcggatgaaggctctaatggcgaaatcacatacgagatattagtgggagctcagggcgactttattataaataaaaccactggactgataacaatcgcacccggagtagagatgatcgtcggtagaacatatgcgctcacggttcaagctgcagataacgccccacctgccgagagaaggaatagcatatgtacggtatatattgaggttctgccacccaataatcagtccccaccgcgtttcccccagctgatgtattcactggagattagcgaggctatgagggtcggcgctgtgctgctcaatttgcaggctactgaccgagaaggtgacagcatcacgtacgcaatcgagaacggggacccacagagagttttcaatctctcagaaacaacaggcatcctgaccctggggaaagcgctcgacagagagagtactgacaggtacattctaattataactgcctcagatggaaggcctgatggcacttcgaccgccaccgttaatattgttgtcaccgacgtcaacgacaatgcacccgtgtttgatccctacctgcccagaaacctctcagtggtagaagaggaagccaatgcattcgtggggcaggtaaaggctactgacccggatgcaggaattaacggccaagttcactattccttaggtaacttcaacaacctttttcgcattacttccaacggctctatctataccgccgtgaagttgaatcgggaagttagagattattacgaactcgtcgtcgtggcaacagacggcgctgtgcaccctaggcatagcacgctgactctagctataaaggtcctggacatcgatgacaatagccctgttttcacaaactcaacttacactgtgctcgtggaggagaatctcccggctgggactactatacttcaaattgaagctaaggacgttgatctgggtgcaaacgtgtcttaccgcatccgctctcccgaggtcaagcacttctttgcgctacatccctttaccggagagctgagtctgctgagatctttggactatgaagcattcccagaccaggaggcatctatcacttttctcgtagaggcattcgacatttatggaacgatgcccccaggtatcgccaccgtgacagtcattgttaaagatatgaatgactacccccctgtgttcagtaaaagaatttacaagggcatggtggctcctgatgccgttaagggaacaccaatcaccactgtgtacgctgaagacgccgatccacccggtttaccagcatctcgggttcggtacagggttgacgatgtgcagttcccgtatcctgcaagcatcttcgaggtggaagaggattctggcagggtgattactcgtgtaaacctgaacgaggaaccgactacaatatttaaacttgttgtggtggcatttgacgacggagagccagtcatgtcttctagcgccacagtgaaaatcctagtcctgcatcccggagagatcccccgttttactcaagaggagtaccggcctcctcccgtctccgaattggccacaaaagggactatggtgggggtgatctctgccgcagcaataaaccagtctattgtctatagtatcgtctccggtaatgaagaagatactttcgggatcaacaatatcactggggtcatatacgtcaatggccctttggactatgaaaccagaacctcctacgttctgcgagtacaggcagactcattggaggttgtactggctaacctcagagtcccatccaaatcgaacacagcgaaggtatacatcgaaatccaggatgaaaacaaccaccctcccgtattccagaagaaattttatattggaggcgtgtcagaggatgccagaatgtttactagcgttcttcgggtgaaggcaacagataaagacactgggaattatagtgtgatggcatataggcttatcatccctccaataaaggaagggaaggaagggttcgtggtggagacatataccggcctgatcaagacggccatgttgtttcacaatatgaggagatcctacttcaaattccaggtgattgccactgacgattacggaaagggcctcagcggtaaggctgatgtactggtctctgtcgtaaatcagctggatatgcaggtcattgtctccaatgtcccaccgactttggtggagaagaaaatcgaggaccttaccgaaattctcgaccgatacgtgcaggaacagatccctggggcaaaagtggtcgttgagtctataggagccaggcgccacggcgacgcattcagcctggaggactatacaaagtgcgatttaacagtctacgccatcgacccacaaactaaccgggctatcgatcgcaatgagttgtttaaattcctagacggaaagctcctggacataaacaaggatttccagccttattatggcgagggtggaagaatccttgaaattcggacaccagaggcagtgacttccataaaaaaaagaggcgaaagtctgggctacaccgagggagccctgcttgcgctggctttcattatcatcctgtgttgcatccccgcaatcctcgtagtgctggtttcctacaggcagaggcaggctgagtgcaccaagaccgcccgtatacaggccgctttgcctgcagcaaagccagctgtgccagctcccgcacctgtggccgctcctccacctcctccacccccaccacccggtgcccatttgtacgaagagcttggcgacagttcaattttgttcctgctgtatcacttccagcagagtcgcggaaacaacagcgtgagcgaagatcgcaagcatcagcaagtggtgatgcctttttccagcaatacaatcgaagcccacaaatcagcccatgtcgacgggagccttaagtcaaacaagcttaaatctgctcggaagtttacatttctcagcgacgaagatgatctgtccgctcacaaccccctgtacaaagaaaatatctcccaggtgagcacaaactcggatatcagtcagcgcaccgacttcgtggacccctttagccctaagatacaggccaaaagtaaaagcctgagggggcctagggagaaaattcagagactctggtcacagtcagtgagtttgcccagacggctgatgcgaaaagtgcccaatcggcctgagatcattgacctgcagcaatggcagggcacgcgccagaaggctgaaaacgagaacactggcatctgtaccaataaaagaggctcaagcaatccgttgctaacaactgaggaagccaacttgaccgaaaaagaagaaattcggcagggagaaacgctcatgattgaaggaactgagcagctaaagagtctgagctcagactcatctttctgtttccccagaccgcattttagcttctccaccctgccaacagtttccaggactgtggaacttaaatctgagccaaacgtgataagcagtccggcagaatgtagcctggagttgagcccgtcccgtccctgcgtgttacactcaagtctctccaggagggagacgcccatttgtatgctgcctattgaaacagaaaggaatatattcgagaactttgctcatccccctaacatatccccgtcggcatgccccctgccgcctccaccgcctattagtcccccatctccaccaccagctcccgctcctctggcccctccacccgatatttcaccattttccctattttgcccacctccttctccgccatcgatcccgctgccactgcctccacctacattcttccctctctccgtgagtacgtcaggacccccaacacctcccttgctgcctccattccccacacctctgcctccgcctcctccttccataccatgtccccctcccccttcggcgtcttttttaagtacagaatgcgtatgtattacaggagtcaaatgtaccactaatctgatgccagccgagaagattaagtcttctatgacgcagttgagcaccactaccgtgtgcaagacggacccccagcgagagccaaaagggattctgcggcacgtcaagaatctcgccgagctggagaagtcagtcgccaacatgtactcccagatcgagaaaaactacctccggacaaacgtgtcagagctgcaaactatgtgcccatctgaagtgactaacatggagataacatcagagcaaaacaaagggagtctgaacaacatcgtggagggcacagaaaagcagtctcactctcagtccaccagcctcta

SEQ ID NO: 237363 - DNA, 5748 bp, Artificial Sequence
  Description of Artificial Sequence: Synthetic coding sequence
atgtttaggcagttttatttgtggacttgccttgcctccgggataatcctgggctccctatttgaaatttgcctgggacagtacgatgacgattgtaagttggcgaggggcggaccgcctgctacaattgtcgcgatcgacgaggagtcccggaatggcacaatcctcgttgacaatatgctaatcaagggcactgccggtggtccggacccaaccattgagctgagtctcaaggataacgtggactattgggtgctgatggatccagtaaagcagatgctgtttcttaactctacagggagggtgctggatcgggaccccccaatgaacatccatagcatcgttgtgcaagtacagtgtattaacaagaaagtgggtacaatcatttatcatgaggtgcgtattgtagttcgagatagaaacgacaactcaccaaccttcaaacacgagtcatattatgctaccgtcaatgagctgacgccggtggggaccacaatattcacgggcttttcaggcgacaacggtgctacggacatagacgatggccctaacggccagattgagtacgtcatccagtacaaccccgatgatccagacagggcccaaaatctgaatgaacggagaactacaactacaacccttacagtagacgtgctggacggcgacgatttaggcccaatgtttcttccctgcgtccttgtgcccaacactcgcgattgtcgcccacttacgtatcaggccgcaatcccggagctccggacaccggaggaactgaacccaatcatcgtaactccccctatacaggctatcgaccaggatcgcaatatccagccacccagtgacagaccgggaattctgtactccattctagtgggaactccagaagactacccaaggttctttcatatgcatcccagaactgcggaactgagtcttctggagccggtgaatagggactttcaccaaaagttcgatctggtcataaaggcagaacaggacaatggccacccgctgcctgcgtttgcgggtctccatatcgaaatcttagacgaaaacaatcagtctccatatttcaccatgccatcataccagggctacattcttgagagtgcaccagttggcgcaaccattagcgactcactgaacttaacttctcctctgagaatcgttgcgctggataaagacatcgaagacaccaaggatcccgagctccacctgttcctgaacgattacacatccgtgtttactgtgactcagactggaattacccgctacctcactctgctacagcctgtcgacagggaggagcagcaaacttatacctttagtatcaccgcctttgatggagtccaggagagcgaaccggtcatcgtgaacatccaggtgatggatgcaaatgacaacacccccactttccctgaaatctcttacgatgtctatgtctatactgacatgaggcctggggactctgttatccagctgactgcagttgatgcagacgagggcagcaacggcgagataacttacgaaattctcgtgggggcacaaggcgattttataattaacaagacaacgggtctgatcaccatcgctcctggcgtggaaatgatcgttgggagaacatatgctctcaccgttcaggctgctgataatgccccacctgctgagcggcgaaactcaatctgcacagtctatattgaagtcctgcctccaaacaaccagagtccccctcgatttccccagctgatgtattctttggaaatatcagaggctatgcgggtaggggctgttctgctgaatctgcaggccacagaccgtgagggcgactcgatcacatacgccattgaaaacggtgaccctcagagagtgttcaacctgagtgagacaacaggcatcctgactctaggcaaagcccttgacagggagtccacagacaggtacatcctgattatcactgcaagtgacggtaggccagacgggacaagcacagctacggtgaacattgttgttaccgatgtgaacgacaacgccccagtgtttgatccatatctgccaagaaatctatctgtcgtggaggaagaggccaacgccttcgtcgggcaagtgaaagccacagatccggacgccggaattaacgggcaggtgcactactctctgggcaactttaataacttgtttaggattacctccaacggtagcatttacaccgctgtaaagttaaatcgagaggtacgcgattactacgaactggtggtagtggctactgacggtgcagtccatcctcggcattccaccctcacacttgccataaaagtactggacattgacgacaactcgccagtcttcacgaacagcacctatactgtactcgtggaggagaacctacccgcaggcacgactatcttgcagatcgaggctaaggacgtggacctgggagctaacgtgtcctacaggattaggagccctgaggttaagcacttttttgcactacacccattcacaggcgagctgagtctgctgcggagcctagactacgaagcctttcccgaccaggaggcttcaataacgtttttggtggaggccttcgatatctacggcactatgcctccaggcattgcaacagtgacggtgattgtgaaagatatgaatgactatccaccggtgttttcaaaaagaatctataagggaatggtcgcccctgatgcggtcaagggcacccctatcaccacagtgtatgctgaggatgcagacccccctggactgcccgcttctcgtgtacgctacagagtggacgacgtgcagttcccatacccggctagcatcttcgaagtcgaagaggactccgggagggtcatcacacgcgtgaatttgaacgaagagcccactactatttttaaactcgtggtggtagcctttgatgatggtgaaccagtgatgagtagctcggctaccgtgaaaatcctcgtactgcatcccggagagataccacggttcactcaagaggaatatcgccctcccccagtttctgagctcgcaaccaagggaaccatggtcggcgtgatcagcgccgctgcaatcaatcagtctatagtgtattcaatagtctctggaaacgaagaggacactttcggtatcaacaacatcaccggggttatctacgtgaacggtcccttggattatgagacccggacatcctacgtgctcagggttcaggccgacagcttagaggtggtgctggcgaacctgagagtccctagcaagtccaacacagccaaagtatacattgagattcaggatgagaataaccaccctcctgtcttccagaagaagttctatattgggggtgtgtcagaagatgcaaggatgtttacgagcgttttgcgggtgaaagccaccgataaagacacagggaactatagtgtaatggcctacagactgatcatcccccctatcaaggaagggaaggagggctttgtggtcgagacatacactggattaattaagacggcaatgctcttccacaatatgaggcgatcgtacttcaagtttcaagtgattgcaaccgatgattatggcaaaggactcagcggcaaagccgatgttttagtttctgtcgtgaatcagttggacatgcaggtaatcgtgagcaatgtgccccctaccctcgtcgaaaagaaaatcgaggacttgaccgagatcttggatcgctatgtgcaggaacagatccccggagccaaagtggtcgtggaatcaatcggggcacggcgacacggggatgccttttcactggaggactacaccaaatgtgacttgactgtctatgcaatagatccccagactaacagagcaatcgatagaaatgagctgttcaagttcctcgacggtaagttgctcgatattaataaagatttccagccttattacggtgagggcggtagaatattggaaatccggacgcccgaagccgtgacctcaattaagaaaagaggcgaatctctagggtacacggagggtgcccttctggcccttgcattcattattatcctctgctgtatccctgccattctggtagtactggtctcttatcgtcaacgccaggcggaatgcaccaagaccgctcggatccaggctgcattgcccgctgcaaagccagccgttcccgcacctgcccctgtggccgcaccccctcccccacctcctccacctcccggtgcccacctgtacgaagagctgggcgatagcagcatcttattcctgctgtatcatttccagcagtctcgagggaacaattcagtgtctgaagatcggaaacaccagcaggtggtgatgccattcagctctaacaccattgaagcccataagtcagcacatgttgatggctcactgaagtctaacaaattaaaatcagccagaaagtttaccttcctgagcgacgaggacgacttaagcgctcataatccactatacaaagagaacatatcacaggtgagtacaaacagcgatatctcacagcgaacagatttcgtcgatcctttttctccaaagatccaagctaagtccaaatccctgcggggacctagagaaaaaatccaaaggctgtggtcacagagcgtgtccttgccacgccgactcatgagaaaagtgcctaatcggccagaaatcatcgaccttcagcaatggcaggggacaaggcagaaggcagagaatgagaataccggaatctgtacaaacaagcgtggatcttctaatccattgctgaccaccgaagaggccaacctgacggagaaagaagagattcgccaaggcgagactctgatgatcgaaggcactgagcagttgaagagcctgagctccgatagctcgttctgctttcccagacctcatttttcgttttcaacgttaccaacagtatcacgcacagtggaattgaaatcagaaccaaacgtgatctctagcccggcagaatgcagcctggagctgtctccatctcggccatgtgtgctgcacagcagtctcagtaggcgggaaacccccatctgtatgttgcctattgagactgagaggaatatctttgaaaacttcgcccatccccctaacatctctccttccgcgtgtcccctccctccaccacccccaatctcgcccccatcgccccctcctgcccctgcgccactggcgccacccccagatatttccccattcagccttttttgtcctcctccgtctccgccttctattcctctccccctgcctccaccgaccttcttcccgttgtccgtgagcacatctggtcctcctacacccccactcctgccaccgttcccaacacctttgcctccaccccctccttcgataccgtgcccccctccaccaagtgcatcattcttatccacggagtgcgtgtgcatcacaggtgtgaagtgcacaaccaatctgatgcccgcagagaaaataaagtcttccatgacccagctttctactacaacagtttgcaagaccgaccctcaaagggagcctaagggaattctcagacacgttaaaaacctcgccgagctcgaaaaaagcgtcgcgaatatgtattcgcagatcgagaagaactacctacggaccaatgtgtccgaattgcaaacaatgtgtcccagcgaagttacaaatatggagattacgtccgaacagaacaagggatccttgaacaatatcgttgagggtaccgaaaagcagtctcattctcagagcacaagcctgtac

SEQ ID NO: 237364 - DNA, 5798 bp, Artificial Sequence
  Description of Artificial Sequence: Synthetic coding sequence
atgtttcggcagttctacctgtggacttgcctggcaagcggaatcatcctgggtagtcttttcgagatctgtctggggcaatacgacgatggaacaattctcgtagacaacatgttaataaagggcacagccggtgggcctgatcctacgatcgaactatcattaaaggataatgtggattactgggtcctgatggacccagtcaaacagatgctctttctaaactcaaccggtagggtgctggaccgcgacccaccaatgaacatccacagcatagttgtacaagttcagtgcataaacaaaaaggtgggcacaatcatttatcacgaggtgcggattgttgtcagggatcgaaacgataacagccctacctttaaacacgagtcatactacgctacagtaaacgagcttacaccagttgggacaaccattttcactgggttttccggcgataacggggcaacagatatcgatgacggccctaatggacagatcgagtacgtgatccagtataatccagacgatcccacgagtaacgatacttttgaaattccacttatgctcacgggtaacatcgtgctacgaaagcggttgaattacgaggacaagaccagatattttgtcataatccaggccaacgatcgagcccagaacctgaacgaaaggagaactacaaccaccactctgacagtggacgtcctcgatggggacgatctggggccaatgtttttgccttgcgtgcttgttccaaacactcgagactgtcgtccattgacctaccaggccgcaatccctgagttgagaacccctgaagaactcaaccccattatagtaacaccgcctatccaggctatcgaccaggatcgaaacatccagccaccatccgacagacctggcattctttattcaattttggttgggacccccgaagattatccgcgattcttccacatgcatccaaggaccgccgagctgtccctgctggagccagtgaatagggacttccaccagaagttcgatcttgttatcaaggccgagcaagacaatgggcacccgctgccagcattcgctggcctccacatagagatacttgatgaaaataaccaatcaccttacttcacaatgccttcgtatcagggatatattcttgagtccgcacctgttggcgctaccatctctgactcactgaatctgacaagccctctgcgcatagttgccctggacaaggacattgaagacacaaaggatcccgagctgcaccttttcctgaacgattatacatcggtgtttactgttacacagacaggaataactagatatctgaccctgcttcagcctgtggaccgcgaggaacagcagacatacacgttctctataaccgcctttgatggcgtccaggagtcagagccggtgattgtgaacatccaagtcatggacgcaaacgacaacacccctacatttccggagatatcatatgatgtgtacgtttataccgacatgaggcctggggattccgtgattcaattgacggcggtggacgctgatgagggctcgaacggcgaaatcacttacgaaattctggtgggagctcaaggcgactttattattaataaaacaactgggcttattactatcgccccaggtgtggaaatgattgtggggagaacatacgcgctgacagtgcaggcggctgataacgctcccccagccgaacgcaggaactcaatttgcacggtatatattgaggtactgccccctaacaatcagtctccccctcgattccctcaattaatgtattcgctggagatatccgaagctatgagggtgggcgcagtgcttctgaatttacaggctaccgatcgggaaggcgatagcatcacctacgccatcgagaacggcgatccccagcgcgtgtttaatctgtccgagacgacgggaatcctcaccctgggcaaggcgcttgatagggagtcgacggatagatatattctgattattaccgccagcgatggaaggcccgacgggacatccaccgccactgttaacatcgtcgttacagacgtgaatgataacgcacctgtcttcgatccatatttgccaaggaacctttctgtcgttgaggaagaggccaatgcctttgtcgggcaagtcaaggcaaccgatcccgacgctggaataaatggccaggtgcactattcccttggcaatttcaacaacctgtttcgaattacgagcaatgggtccatttacactgccgtgaagttgaatagagaggttcgtgattactacgaactggtagtggtcgcaacagatggggcagtgcatccacgtcattctaccttgacactcgccatcaaggtgttagacatagacgacaacagtccagtatttactaacagcacctatactgtgctcgtcgaggaaaacttaccagccggaacaaccattcttcagatcgaagccaaggatgtggacctgggcgcaaacgtgtcttaccgcatccgttcacctgaggtaaaacatttcttcgcacttcatcctttcaccggagagctatctttgctacgttcgttggattatgaagcatttcctgatcaggaagcaagtattacctttctggtggaagcttttgacatctatgggaccatgcctcctggtattgcaaccgtaaccgttatcgtcaaagatatgaacgattatcccccagttttcagcaaacgtatctataaagggatggtcgcacccgatgcagtgaaggggacccccatcacaacagtttacgctgaagatgcagacccaccaggtttgccagcttccagggtgagatatagagtggatgatgtccagttcccctacccagccagtatcttcgaagtcgaggaagattcaggcagagttataacgcgagtcaatcttaatgaagagccaactaccatattcaagctggtggtagtggcttttgatgacggagagccggtcatgtcatccagcgccaccgtcaaaatcttggttcttcaccccggtgagatcccgagatttacgcaggaagaataccgaccaccgcctgtgagtgaactggccaccaaaggcaccatggtgggcgtgatttcagccgcagctatcaatcaaagtatcgtgtatagcattgtttctggaaacgaggaggacaccttcggtatcaacaacatcaccggggtgatctacgtcaatgggcctctggattatgagacgagaacgagctacgtcttgagggtgcaggccgactcgcttgaagtggtactggccaacctgcgagtgccaagtaagagcaacaccgccaaagtgtacatcgaaatccaggacgagaacaaccaccccccagtttttcaaaagaaattctatatcggaggagtgtccgaggacgctagaatgttcacaagtgtgctgcgtgtgaaagccaccgataaggacaccggaaactattccgtcatggcctaccgactgattatccccccaataaaagagggaaaggagggattcgtggtcgagacctacaccgggctgatcaaaaccgcaatgttattccacaacatgcgccgatcgtactttaagttccaggtgattgccactgatgactatggtaaggggctgtctggtaaagctgatgtcctagtaagtgtggtgaatcagctggatatgcaggtaattgtctcaaatgtgccaccaactctggtcgaaaagaagatcgaggacttaaccgaaatcctcgaccggtacgtgcaggaacaaattcccggagcaaaagtggttgtcgagagcataggcgctcgacgtcacggcgatgcttttagtcttgaggactacacgaagtgtgatctgaccgtgtatgcaatcgatccccaaactaacagggcaatcgaccgtaatgagttatttaagttccttgacggcaagctgttggacattaacaaggattttcagccgtactatggggagggcggtagaatcctcgaaattcgcactcccgaagccgtgacctccataaagaaacgcggagagtcgttgggatatactgaaggggcactattagccctggccttcattattatcctctgctgcatcccagcgatcttggtggtcttggtatcatacaggcagaggcaagccgaatgtactaagactgccagaattcaggccgctctgcctgccgcaaagccagccgttcccgctccagcgccagtcgcggcacccccacctcctccaccaccacccccaggggcacacctgtacgaagaattaggagattcctccatgcataatttgttcctgctctaccatttccaacagagcagggggaacaattcggtgagcgaagaccgtaaacaccagcaggtagtcatgccctttagttcaaacacgatagaagctcataagtccgcacacgtagacggctcccttaagtcaaacaagttgaagagcgcacggaaattcacattcctgtctgatgaagatgacctctccgcgcataacccattatacaaggagaatatttcccaggtgtctaccaacagcgacatctcacagaggacagatttcgttgacccgttctcaccaaagattcaagcaaagagtaagtccctgagggggccaagagagaagattcagaggctgtggagtcagagtgtctctttgcctcgaagactgatgcgaaaagtcccaaacagacctgagattatcgacctgcaacaatggcagggcaccaggcagaaagcagaaaatgaaaatacagggatctgcactaacaagcggggttcatctaatccccttcttacaacagaagaggcgaacctgaccgagaaagaggaaattagacagggagagacattgatgattgaaggtacggagcaattgaagagcctgagcagcgatagcagtttttgctttccacggccacattttagcttttcaactcttccgactgtttctaggacggtcgagttgaaatcggagcccaacgtgatctcctctccagcagaatgctctctggagctgagtcccagtcgcccatgcgtgctacatagctccctgagccggagggaaacaccgatctgtatgttgccgatagagaccgaacgtaatatattcgaaaattttgcccaccctcctaatattagcccgtctgcctgccccttaccaccacctcccccaatctccccaccaagcccacctccagcacccgctccgctcgctccgcctcctgacatttctcctttcagccttttctgccccccaccttcacccccttccatcccactgccgttgcccccacccacattttttcccttgagcgtctctacctctggcccaccaacccctccgctattgcctcccttcccaacgcctctgccgccacccccaccatcaatcccctgtcccccaccaccatctgcttccttcctgtctactgagtgcgtttgtattaccggagtcaaatgtactacaaacttgatgcccgcagagaagatcaaaagcagtatgacccagcttagcactactactgtctgtaagacagacccccagcgcgagcccaagggcatattacgccacgtgaaaaatctcgctgaattagagaagagcgttgctaacatgtacagccagatcgaaaaaaactaccttaggactaatgtgagtgagctccagactatgtgcccaagcgaggtgacaaatatggaaattacttcagaacagaataagggcagtttgaataatattgtcgaaggaaccgagaagcagagccactcccagagtactagccttta

SEQ ID NO: 237365 - DNA, 4620 bp, Artificial Sequence
  Description of Artificial Sequence: Synthetic coding sequence
atgtttaggcagttctatttgtggacatgtctggcttccggcatcattcttggctccctgttcgagatttgtctagggcagtacgacgacgactgtaaactggccagaggcggtccccctgccacaattgtggccattgatgaggaatccaggaatggtaccatcttggtcgacaatatgttaatcaagggcaccgccggtggtccagacccaactattgagttgagcctcaaggacaacgtcgattactgggtgttgatggaccctgttaaacagatgctgtttctcaattcgacgggccgagtgctggaccgggaccctcctatgaacatccatagtatcgtcgtacaggttcaatgtataaacaaaaaagtgggtactatcatctaccatgaagttcgcatcgtggtgcgggataggaacgacaactctcccaccttcaaacacgagagctattacgcaactgtgaatgagcttacgccggtcggaactacgatcttcacaggctttagcggcgataatggggcaacggacatcgacgacggaccaaatgggcaaattgagtacgttatacagtacaaccctgacgatccaacatcgaacgacacattcgaaatcccccttatgctcaccggcaacatcgtcctcaggaagcgactgaattatgaagacaaaacgaggtactttgtgattattcaggccaatgaccgtgcccagaatttgaatgagaggaggactaccacaacaacacttaccgtggatgtgctggacggggatgatctgggtccaatgttcttgccctgtgtcctagttccgaataccagagactgtcggccattgacataccaggccgcaatccccgagctgcgcaccccagaggagcttaaccccataatcgtaacccctccaatccaagcgatcgatcaggacaggaatatccaacccccatccgataggccaggcattctctattctattctcgtgggcaccccggaggactatccaagattctttcatatgcatccccgaaccgccgagctctccctcttggaaccagtgaatcgcgattttcaccagaagtttgacctcgtcatcaaggccgagcaggacaatgggcaccccctccctgcgttcgccggattacacattgagatcttggatgagaataatcagagtccatacttcacgatgcctagctaccagggctacattctcgaatctgcccctgtgggggcaacaatcagtgatagcctgaacttaaccagcccactcagaatcgttgcactcgataaggatatcgaggatactaaggaccctgagctgcatcttttcttgaatgattacaccagtgtcttcactgtgactcagacagggattacacgctacctgaccctgctgcaacccgtggatcgagaagagcagcaaacgtataccttctctatcaccgccttcgatggggtacaggagtcggagcctgttattgtgaatattcaggtcatggatgcaaatgataacacacctacttttcctgagatttcctacgacgtctacgtttataccgatatgcgtcccggtgattcagttatacagctgaccgccgtggacgctgacgagggatcaaatggagagattacatatgaaatcctggtcggagcccaaggtgattttattatcaataagaccactggtctcatcactattgcaccgggagtggaaatgattgttggcagaacttatgcccttaccgtgcaggccgctgacaatgccccacccgcagaaaggcgtaattcgatctgtaccgtgtacatcgaagttttgcccccaaataaccagtcacctccgaggtttcctcagctgatgtacagcttggagatctcagaggcaatgcgggtcggggctgtgctcctgaatctccaggctaccgatcgcgagggggactccattacatatgcaatcgagaacggagaccctcagcgtgtgttcaatctctctgaaaccaccggtatcctgacgctgggcaaggcactggaccgtgaatctaccgatcggtacattttgattattacagcctccgatggtcggcctgatggaacgtccaccgctacagtgaatatcgtggtaaccgatgttaatgacaatgcacccgttttcgatccttatctccctcggaacttatcagtggtggaagaggaagccaacgcctttgtgggacaggttaaggccactgacccggatgcaggtattaatggtcaggtccactattcactgggaaattttaacaatctattccgtataacctcgaacgggtccatttacactgccgtaaaattgaatagagaggttcgggactactatgagttagttgtcgtggctacagacggtgctgtgcacccgagacactccacactcactctggctatcaaggtgctggatattgatgacaattcgcctgtattcaccaattcaacttacacagtcctggtggaagaaaatcttccggcaggtactacaatcctgcagatcgaggcgaaggacgtggacctgggggctaatgtgtcatataggatccgctcccctgaggtcaagcatttcttcgccctgcatccttttacaggagagctgtccctgctccgatcactagactacgaggctttccccgatcaggaggcttctattacttttctagttgaagcctttgatatctacggaaccatgcctcctgggatcgctacagtcaccgtgattgtgaaagatatgaacgattaccctcctgtgttttccaagaggatttataaggggatggtggcaccagatgctgtaaaaggcacccccatcacaactgtgtatgctgaggacgcagaccccccaggactcccagcgtccagggtgaggtacagggtggacgacgtccaattcccttaccccgcatccatatttgaggtcgaagaagactctggacgtgtgataaccagagttaacctgaatgaagagccaaccaccatcttcaagctcgtcgttgtggcttttgacgacggggaaccggtgatgagctcatccgccactgttaaaatcttggtgctccacccaggagaaatacctcggttcacacaggaggaatatcggcctccccctgtatcagaactggcaactaagggtacaatggtcggagtcatctccgccgctgcaattaaccaaagcattgtgtacagcattgtttctggcaacgaggaggatacctttggtatcaacaatatcaccggggtcatttacgtgaatggcccactagattacgagactcggaccagctacgttctcagggttcaagcagattccttagaggtggtgctagctaacctgcgcgttccatccaagtctaacacagccaaagtctacatcgagatccaagatgagaacaaccatccacccgtgtttcagaagaagttttacatcggcggtgtgagtgaggacgcccgaatgtttacctccgtactgcgcgttaaagctactgataaagacacgggaaattacagcgtgatggcgtatcgcttgatcattccaccgattaaagagggcaaagaggggtttgtcgtagagacatacactggactgataaaaacagcaatgctgtttcacaatatgcggcgttcgtatttcaagtttcaggtgatcgccacagatgattacgggaaaggactctccggtaaggcagacgttctggtttctgtagtaaatcaactcgacatgcaagtgattgtcagtaatgttccaccaactctggtggagaaaaagatcgaagacctaaccgaaatactcgatcggtacgtacaggagcagataccaggcgctaaggttgtcgtcgagagtataggagctagacgccatggggacgcattcagtcttgaggattataccaagtgcgaccttacagtctatgcaatagatccccagactaacagagccatcgataggaacgaactgttcaagttcctggacggaaaactcctcgatataaataaggacttccagccctattatggagagggcggaagaatccttgagattcggactcccgaggccgtaacatccatcaagaaaaggggagagagcttgggctacaccgagggcgctctccttgccctcgcctttattatcatcctttgttgcattccagcaatactcgtggtcctggtcagctaccgccagttcaaggtgcgccaggcagaatgtactaaaacggctcggatacaggctgctctgccagcggcaaagcctgccgtaccagcacctgctccagtggctgctcctccgccacccccacctcctccacctggtgcacacctgtacgaagaattaggggacagttctatgcataaaaactacccatggtccctagagctcatcttagcacgaaacatggacaaaataattacggttatgagcatgggcatgaagtgcctgaatatgggcgtcgccgttgattgctatcaccagctggataggcgaaatatggtaagatggttggtcaagttgcgcaagaatatgagacggaagaggaagtcacagcgtaaattgaaaaaccagaggttaaaattagaatccctcgtgagacggaaaaaatag

SEQ ID NO: 237366 - DNA, 2160 bp, Artificial Sequence
  Description of Artificial Sequence: Synthetic coding sequence
atgtttcgacagttctatttgtggacttgcctggccagtggcatcatcctcgggtctctctttgaaatttgtttgggccagtacgacgacgactgtaaactcgccagaggaggtcctcctgcaaccatagtggctatcgacgaagaaagtaggaatgggacgattcttgtcgataacatgctgattaagggaaccgctggaggtcccgaccctacaatagagttgtcattgaaagacaatgtagattattgggtgctgatggaccccgtcaaacagatgctctttctgaatagtaccggacgagtgttagatagggaccctcccatgaatatccactctatcgtggtgcaggtacaatgtatcaacaagaaggtgggaactattatatatcatgaggttcgtattgtggtgagagaccgcaatgataattctcctacgtttaagcatgagtcttactatgcaaccgtgaacgagctgacgccagtaggtaccaccatcttcacaggcttcagtggcgataacggagccactgacatcgacgacggccctaacggtcagatcgagtacgtgatccagtacaatcctgacgaccctacaagcaacgacacctttgagatccccctcatgctgactggcaacatagtacttaggaagaggctgaattacgaggacaagacaagatactttgtgatcatccaggcaaacgacagagcacaaaatctaaacgagaggcgcaccacgacaaccaccctgacggtggacgttcttgacggagacgatctggggcctatgttcctcccctgcgtgctggttcctaatacacgagattgtaggcccctgacctaccaggccgcaatcccagaactccggacaccagaagaacttaacccaattatagtgacaccccctatccaggctatcgaccaggacaggaatatccaacctccaagtgaccgtcctggaattttatattcgatcctagtgggcacaccagaggattacccacggttcttccatatgcatccaagaactgcagagctatctctgctggagcccgtcaatagagattttcaccagaagtttgacctcgtgattaaagccgagcaagataatggccatcccctgcctgcctttgccggactgcatattgaaatactcgatgagaataatcagtcaccatactttaccatgccgagttaccaggggtacatcctggagtctgctccagttggggctacaatctctgactccctgaatcttacatcccccctgcgcatagtggctcttgacaaagatatcgaggacgaagaacctaaaaaaatcaagaagcctaaagttgaaattcgggaacccagcgaggaagaagaggtcgtcgtgaccattgagaaacctccagcagcagaacctacatacactacgtggaaacgggcaaggattttcccgatgatatttaaaaaggtccggggtttagcggataaacggggaattgtggatctggagggcgaggaatggcagagacgtctagaggaggaggacaaagattatctgaagctcactctggaccaggaggaagcgacggaaagtaccgtggaatccgaggaagagtcgagcagcgactacacggagtattccgaagaggagagtgaattttctgaatctgagaccaccgaagaggagtcagaaagcgagaccccaagcgaagaagaggagagcagtacaccagagtccgaggagagcgagtccactgaatccgagggcgaaaaggcccgaaagaacatcgtcctggccaggagacggccaatggtggaggaggtcaaggaagtgaagggcagaaaggaggagccccaggaggagcaaaaggaaccaaaaatggaggaggaggagcactctgaggaggaggagtccggtcctgctcccgttgaagagtcaacggatccagaggcccaggacatccccgaagaagggtccgctgagtcagcgtcagtcgagggaggcgtcgagtctgaagaggaatcagaatctgggtcttcatcttctagctctgagtctcagagtggcggaccctggggatatcaggttccagcatacgaccgcagcaaaaatgctaaccagaaaaagtctcctggtgctaatagtgaaggctacaacacggctctctag

SEQ ID NO: 237367 - DNA, 1953 bp, Artificial Sequence
  Description of Artificial Sequence: Synthetic coding sequence
atgttccggcagttttatctctggacctgtcttgcctccggcatcatcctgggaagcctgtttgaaatctgcctgggccagtacgacgatgattgcaagctcgcgcgtgggggaccacctgcaaccatcgtggccatcgatgaggagtcgcgtaacggcactattctggtggacaacatgctcattaagggtacagctggcggaccggaccccacaattgaattaagcttgaaggacaatgtggactattgggtactgatggatcctgttaagcaaatgctctttctaaatagcacagggcgtgtgctggaccgtgatcctcccatgaatatacactcgattgtggtacaagtgcagtgcataaacaagaaggttggtaccatcatatatcacgaagttaggattgtcgtcagggatcggaatgataatagcccgacctttaagcacgaatcctactatgccacagtgaatgagctgactcccgtggggacgacaatatttaccggtttttcaggagacaatggagccaccgacatcgacgacggtcctaacggccaaatcgagtacgtgattcagtataaccctgacgatcccacaagtaatgacacttttgaaatccccctgatgctgacggggaacatcgtgttaagaaagagactcaattatgaagacaaaacccgatactttgtcatcattcaagcaaatgaccgcgctcagaacctcaacgagcggcgtaccactacaacgacactgaccgtcgatgtgctggatggagatgaccttgggccaatgttcctgccctgtgttcttgtgcccaatactagagactgccgccctctcacttatcaggccgcaattcctgagctgcgtacacccgaagaactcaaccccataatcgttacacccccaatccaggctatcgatcaggaccggaatatccagccaccaagcgatcgtcccggtatcctgtatagtatcttggtcggcaccccagaagattacccgaggttctttcacatgcacccacgaaccgccgagttatctttactcgagcccgtgaatcgcgatttccatcaaaagttcgatctggtgatcaaagaggagccaaaaaagataaagaagcccaaggtggagattagagagccaagcgaagaggaggaagtcgtcgtgactatagaaaaacccccagccgctgagcctacctacacaacatggaaaagagcccgaatttttcccatgatcttcaagaaggttcgaggactcgctgataaaagaggcattgtggatctagaaggggaagaatggcagcgcagacttgaagaggaggataaggattatctaaagttaaccctggaccaggaggaggcaactgaatcaacggtggagtcagaggaggagagttcctctgactatacagaatactcagaagaggaaagcgaatttagtgaatcagagacaaccgaagaggaatccgagagcgagacacctagcgaagaagaggagagtagtacccccgagtccgaggagagcgagagtaccgaatctgaaggcgagaaagcgaggaagaacattgtgctcgctcgccgaaggcccatggttgaagaggtaaaagaggttaagggaagaaaggaggagccccaggaagagcagaaagaacccaaaatggaagaggaagaacacagtgaggaggaggaatccggacctgcccctgtggaggagtctactgatcctgaggcacaggatatccccgaggaagggtccgccgagagtgcaagcgtggaggggggtgtcgagtctgaggaagaatccgagagcggaagttcctcatcatcaagcgaaagccagtccggaggtccatggggttaccaggtgcccgcatacgacaggtctaagaatgcgaatcagaaaaaatctcccggagctaacagcgaggggtacaatacagccctatag

SEQ ID NO: 237368 - DNA, 5357 bp, Artificial Sequence
  Description of Artificial Sequence: Synthetic coding sequence
atgtttcgtcaattttatctgtggacttgcctggcctccgggataatcctcggaagcctgttcgaaatttgcttgggccagtacgacgacgactgcaaactcgccagggggggacctcccgcaacaattgttgcaatcgacgaggaatccaggaatggcactatcctggtagacaatatgcttattaagggaacagccggtggcccagacccaaccatcgaactgtctctcaaggacaatgtcgactactgggtcctcatggacccagtaaagcagatgttattcctgaactccacaggacgggtgctcgacagagaccccccaatgaacatacattcaattgtagtgcaggtgcaatgcattaacaaaaaggtggggactatcatttaccatgaggtacgcatagtggttcgagatagaaacgataacagtcctacctttaaacacgagtcttattacgccaccgtcaatgagctgacgcctgtcggcaccaccatcttcaccggattctccggcgacaatggagcaaccgatatcgacgatggaccaaacgggcagatcgagtacgttattcagtacaacccggatgaccctacctctaacgatacatttgagatacctctgatgctcactggcaacattgtgctcaggaaacggttaaactacgaggataaaaccaggtacttcgtgataatacaagccaatgatcgggctcagaacctcaatgagcgccgtactacaacaacaacattaacggttgatgtgctggatggggatgacctcggacccatgttcttaccgtgtgtgttggtgcctaataccagagattgcaggccactgacctaccaggcagctataccggagctcagaacccctgaggagctgaacccgataatcgtgacaccccctatccaagccattgatcaggatcgcaatattcagcctccttccgaccggccaggaattctgtattctatcctcgttggaaccccagaggactacccgcgttttttccacatgcaccccagaacagcggagctctctttgttagaaccagtgaatagggatttccaccagaagttcgatctcgtcattaaggcagagcaggacaatgggcatcccctgccggcatttgcaggcttgcatatcgaaattctagacgagaacaaccaatcaccctacttcaccatgcccagttatcaggggtacatcctggaaagcgctcctgtcggagccactattagtgattccttgaacctgaccagccccttgagaattgtagctcttgacaaagatatcgaggatgtcccgcctagtggcgttccaaccaaggaccccgaactgcacctcttcttaaacgactacaccagcgtgttcactgtcacccagaccggtattacaaggtatctgacacttctccagcccgtggaccgcgaggaacagcaaacctataccttttccattacggcctttgacggggtccaggaatcagagcccgtgatcgtcaatatacaggttatggatgccaatgacaacacacctacatttcccgaaatctcatacgacgtttacgtatatactgacatgagacctggtgattccgtgatccagctcacagctgtggatgccgatgagggcagtaacggagaaattacctatgagattctggtaggggcacaaggggattttattatcaacaagacaaccggactgatcaccatcgcaccaggggtcgagatgattgttggaagaacctacgcactgacagtgcaggctgccgataacgctcctcctgcagaacgacgaaacagcatctgcacagtctacattgaggtgttaccccctaataatcagtcacctccacggttcccccagctgatgtattcactggaaatcagtgaggctatgcgggtgggcgcagtgctgcttaatctgcaggccactgaccgtgaaggcgacagcattacctatgccatcgagaatggcgaccctcagagagtatttaatctgtccgagacaactgggatcctcactctaggcaaggccctggatagggagtccaccgaccgatacattctgattattacagcatccgacggaaggccagacggcacaagcacagcaacagtcaacatcgtcgttaccgatgtgaacgacaatgcccctgttttcgacccgtacctccctcgcaatctgtccgtcgtggaggaggaggcgaatgctttcgtcggacaagtcaaagctactgatccagacgctggaatcaacggtcaagtacactactcactgggcaattttaacaacctctttaggatcacatccaacggtagtatttatacagctgtgaagctgaatagagaggtccgtgattactacgagctggtagtcgtggccacagacggtgccgtccaccctagacactcaaccctcacattggcaatcaaggtgttggatatagatgacaattccccagtttttaccaattccacctacactgtgttggtggaggagaatcttcctgcagggacaactatcctgcagatcgaagccaaggacgtggaccttggtgccaatgtcagctacaggatccgctcaccagaggtaaagcacttctttgcattgcatccgttcaccggcgagctctctttactccgtagtctggattatgaggcattcccggatcaggaggcctctatcacctttctggtggaggctttcgatatctatggaaccatgccaccgggaatcgcaacagtgactgtgatcgtcaaggatatgaacgattacccgccagtgttttcgaagcggatttataaaggcatggtcgcccctgacgctgtgaagggtacacccatcacaaccgtatacgcggaagatgccgatccccctgggttacccgcttcccgtgtgcgctaccgagtcgacgacgtgcagttcccctaccctgcctccatatttgaagtggaagaggacagcgggagggtgatcactcgcgtgaatctaaatgaggaaccgaccacaatctttaagctggtggtcgtggccttcgacgatggcgagccagttatgtcatccagcgcaacagtcaaaatccttgtgttgcaccccggagaaattccacgtttcacgcaagaggagtatagacctccccctgtgtctgaactcgccactaagggtaccatggtcggagtgatctccgccgcagcgatcaatcagtccattgtatattccattgtgtcagggaatgaagaggacacttttgggatcaataatattacgggagtgatttatgttaacggacctctcgattatgaaactcggacgtcctacgttctgcgtgtgcaggccgactccctggaggtagtgctcgctaacctcagagtaccctcaaaaagcaataccgccaaagtgtatattgagatccaggacgaaaataaccatcctcccgtgtttcagaaaaagttctatatcggcggtgtctccgaagatgccaggatgttcactagcgtattgcgagtcaaggccaccgataaagacaccgggaactactctgtaatggcctatcgtctcatcatcccccctatcaaggagggcaaggaaggtttcgtggtggaaacttacacaggacttattaagacggcaatgctcttccataatatgagacggagttatttcaagttccaagtcatcgccactgatgactacgggaaggggttgtcaggcaaagccgatgtgctggtgagcgtggtgaaccaactggatatgcaggtgatcgtgagtaatgtaccccctactctggtcgagaaaaagatcgaggatctgacggagatactcgatcggtacgtgcaggaacagattccaggcgcaaaagtcgttgtggagagtatcggagcaagacgacacggtgacgcattttctcttgaagactacactaaatgcgaccttaccgtttatgctatcgatcctcagaccaaccgtgccatagaccgaaatgaactgttcaagtttttggacggcaaattgctggacataaataaggatttccaaccctattatggtgagggcggacgaatccttgagatcaggacccccgaggctgtgacctccattaagaagaggggggaaagtctgggatataccgagggcgcactgttagctctcgcctttatcattattctgtgttgtatcccagcgatcctcgtcgtgctggtctcatatcgacaattcaaagtacgtcaagcagagtgtaccaaaaccgccaggattcaggcagcgctacctgcggctaaacctgccgtacctgctcccgcaccagttgcagcccctccacctcctccccctccaccgcctggtgcacatctgtacgaagagttaggcgactcctctatgcataagtacgagatgccacagtatggctctaggcggagattgctcccaccagccggacaagaggaatacggtgaagtggttggtgaagcagaggaagaatatgaagaggaggaggaggagcccaagaagatcaaaaagcctaaagtcgaaatacgagagccgagcgaggaagaagaagtggtcgtgacaattgagaaacccccagcagctgagcccacatataccacttggaaacgggctcggatctttccaatgatttttaaaaaagtgcgcggattggctgacaaacggggaatcgtggacctggagggtgaagagtggcagagaagactggaagaagaagataaggactaccttaagctgacactggatcaggaggaggcgactgagtccacagtagagtctgaagaagaaagtagcagcgactacaccgagtactccgaagaggagtccgagttcagcgaatccgagacgacagaggaggaaagcgagagtgaaaccccctctgaggaggaggagtctagcactcccgaaagtgaggagtcagaatcaacagaatccgagggagaaaaggcgcgtaagaacatcgtgcttgctcgtcgaagaccgatggtagaggaggtgaaagaggttaaggggagaaaggaagaacctcaagaggagcagaaggagcctaaaatggaggaggaagaacattcagaagaagaggaatcaggccctgcccctgtcgaggaatccacggatccggaggcccaggacatccccgaagaaggttctgctgaaagcgctagcgtagagggcggtgtcgaatccgaagaggaatctgagtctggatcctctagctcttcatccgaatcccagtctgggggaccatggggctaccaggttccggcttacgacagatcaaaaaacgccaaccagaaaaaatctccgggagcgaattccgaaggctacaataccgcgctgta

SEQ ID NO: 237369 - DNA, 2946 bp, Artificial Sequence
  Description of Artificial Sequence: Synthetic coding sequence
atgttccgacagttctatctatggacttgtttagcatccgggatcattttgggctcactgttcgagatttgtctgggacaatacgacgatgattgtaaactcgcgaggggaggtcctcccgcaaccatagttgctattgatgaagagagcaggaacggaacaatcctggtggacaacatgcttatcaaaggaacggcgggagggcctgatcccacaatcgaactttcactgaaggacaatgtggattattgggtgttaatggaccccgtaaagcagatgctgttcctgaacagcacagggagggtactggatagggacccccctatgaatattcactccattgtggtgcaagtccagtgcatcaacaagaaagtgggtactatcatctaccacgaagtgagaatcgtagtgcgcgacagaaatgataactctcccaccttcaaacatgagtcgtactatgctacagttaatgagctgacccctgtgggtaccaccatcttcactggcttttccggggacaatggagccactgatatagacgacggcccaaacggccagatcgaatacgtaatccagtacaatccggacgaccctactagcaacgacacgtttgagattcctctcatgcttactggaaatatcgtcctccgcaagcgcctcaactatgaggataagacacggtacttcgtcatcattcaggctaatgacagagctcagaatcttaatgagcgacgcacgaccacaaccaccctgactgtcgacgtgttggacggcgacgaccttggtccaatgttcctgccatgtgttctcgtcccgaatacgcgagattgtagaccccttacttatcaagccgctattcccgaactgcggacgcccgaagaactaaaccctattattgttacccccccaatccaggcaatcgaccaggataggaatatacagccaccctctgacagacccggaattctgtactctattctggtaggaacccctgaggactaccctcgcttctttcacatgcatcccagaacagcagagttgtccctgctggaacccgtaaatagagatttccatcaaaagttcgatctggtcatcaaagccgagcaggacaacggccatccactcccggctttcgcgggtctccacattgaaatcttagatgagaacaaccagagtccctacttcactatgcccagctatcaaggctatatacttgaatctgctcctgtgggagccactatctcagacagccttaatctgactagtcctctcagaatcgtggcactcgataaggacatcgaagacaccaaagaccccgaactccatctcttccttaacgactatactagcgtttttacagtcacacaaacaggcatcacaagatatctcaccctcctgcagccggtcgaccgggaagaacagcagacctacaccttcagtatcaccgcctttgatggcgttcaggagtcagagcccgtaatcgtcaacatacaggtcatggacgcaaatgacaacacacctacattcccggaaattagctacgacgtctatgtatacaccgacatgcgccctggggattccgtcattcagctcactgctgtcgatgccgatgaggggagtaacggagagattacgtacgaaattttggtgggcgctcagggtgactttattatcaacaaaacaacggggcttatcaccatagcgcctggggtggagatgattgttgggagaacctatgccctaaccgtgcaggcggcagataacgctcccccagctgagagacgtaattcaatttgcaccgtttatatcgaagtgttacccccaaataaccagagtccacccaggttccctcagctgatgtactcactggaaatatctgaagcaatgagggtgggggctgtgcttctgaatctgcaggctaccgatcgggagggggacagcatcacctacgcaatcgagaacggagacccccaaagggtttttaacctgagtgagacaaccgggatcctcacactcggaaaagctctggaccgggaatcaaccgatcgctatattttaattatcaccgcatctgacggtcggccagacggggaggagccaaagaagatcaaaaaacccaaagtcgaaatcagggagccaagcgaagaagaggaggtcgtggtgacgatcgaaaaaccgcctgcggcagagccaacgtacaccacctggaaaagggcccgaattttcccgatgatctttaaaaaggtgcgcggattggcagataaaagggggattgtggatctggagggtgaggaatggcagagacgactcgaggaggaagataaagattacctcaagctaactctggaccaagaagaggctaccgagagtaccgtggagtcagaagaggaaagttcaagcgattataccgagtacagtgaagaggaatccgagttttcagagagcgaaaccaccgaggaagagtctgaaagcgaaacccccagcgaggaggaggaatcctctacccccgaaagcgaggagtcagaatccaccgagagcgagggcgagaaggccaggaaaaatatcgtcttggcccgtcgcagaccaatggtggaagaagtaaaggaggttaaaggaaggaaggaagaaccccaggaggagcagaaagagcccaagatggaggaggaggagcactctgaagaagaagagagcggtccagctccagttgaggagagtacggaccctgaggcccaggacatcccagaagagggtagtgctgaaagtgcttccgttgaaggaggggtggagtcagaagaagaaagcgagtccggttctagctccagcagcagtgagtctcagtcgggcggaccttggggttaccaagtacccgcttatgaccggtccaagaacgcgaatcagaaaaagtctcctggggctaacagtgagggctacaatactgctctctag

SEQ ID NO: 237370 - DNA, 3453 bp, Artificial Sequence
  Description of Artificial Sequence: Synthetic coding sequence
atgcctagttaccagggatatattctggaatcagcccctgttggcgctacaatttccgactcattaaatctgacaagccccctgagaatcgtggcactggacaaggacatagaagatgttccaccgtcaggggtaccaactaaagatcccgaacttcatctcttcctgaatgactacaccagcgtgttcaccgtgacacaaaccgggattactcgctacctgacgctgcttcaaccggtggaccgcgaggagcaacagacttatacctttagtatcactgccttcgatggtgtgcaagagtcggagcccgttatcgttaatatccaagttatggacgctaacgataacacacccaccttcccagaaatctcatacgatgtatatgtgtataccgacatgagaccgggtgatagcgtcattcagcttacagcggtcgacgctgacgagggttccaacggcgagatcacctacgagatcttggtcggggctcagggggatttcataattaataagaccactggcctgataactattgctccaggcgtggagatgatagttgggagaacctatgcactcactgtgcaggctgcagataatgctcctcccgcagagagaagaaactccatttgcactgtctatatcgaagtgttgcccccaaataaccagtcaccaccgcgttttcctcagctaatgtatagtcttgagatttcagaagctatgcgagttggcgctgttctgttgaatttacaggctaccgaccgagagggggacagtatcacttatgctattgaaaacggcgacccacagagagtgttcaacctgtccgaaacaactggcattctcacactcggcaaggccctagatcgagagagtacagacaggtacatcctcattattaccgcttcagacgggcgtcctgacggaacatctaccgccaccgtgaacattgtggttacagacgtcaatgacaacgccccagtgtttgacccttatctccctaggaatctgagtgtggtggaggaggaggctaatgcgttcgttggtcaggtgaaagcaacagaccctgatgcgggaatcaacggacaggtgcactactctctgggcaacttcaataatctgtttcggatcactagtaacggatccatctacaccgccgtgaaattaaatagagaagtgcgggactattacgaactggtggtggttgcaacagatggggcagtgcacccaagacatagtaccctgactctggctataaaggtcctggacatagatgacaatagtccggtgttcacgaatagcacatatacagtcctcgtggaagaaaacttgcccgcagggaccaccatactgcagatagaggccaaggatgtcgatctgggcgcaaatgtgtcatacaggatccggagccccgaagtgaaacactttttcgctctccatccatttactggggaactctctttgctgcgaagcctggactacgaggcattccccgatcaggaggcatccatcacgttcctggtggaagcctttgatatctatgggacaatgccaccgggaattgccactgtcaccgtcattgtgaaggatatgaacgactaccccccagtgttttccaagcgcatatacaagggaatggttgccccagatgctgttaagggaacaccgatcaccactgtgtatgcagaggatgctgatcctccgggtttacccgcaagtcgagtccggtaccgggtcgacgatgtgcagtttccctaccccgctagcatcttcgaggttgaggaagatagcggccgtgtcattacaagagtgaatcttaatgaggaacctacaaccattttcaagctcgtggtggtggccttcgacgatggagagccagtgatgtcaagctctgccacagtcaaaatcttggtgctacatcccggtgagatcccccgattcactcaggaagagtatcggcctcccccagtctcggagctcgcaacaaaaggcaccatggtgggcgtcatcagcgcagctgccataaaccaaagtatcgtctatagcatcgtgtctggcaacgaagaggacacatttggcatcaataacatcactggagtcatctatgttaacggccctctggactatgagaccaggacctcctatgtgcttcgggtgcaagccgactcccttgaagttgtgctggcaaacttgagagtgccctcgaaaagcaatacagccaaggtgtatatagagatacaagacgaaaataaccacccgcctgtattccagaaaaagttctacatcgggggtgtgtcagaagacgccagaatgtttacctccgtactgcgggttaaggcaaccgacaaggataccgggaactactccgtcatggcttatcgattaataattccccctattaaagaaggtaaggaggggtttgtcgtggagacgtataccggtcttatcaaaaccgctatgctgtttcataatatgcgacgctcttattttaaatttcaagtgattgccactgacgattatgggaaagggctgagcggaaaagcagatgttttggtatctgtcgttaaccaacttgatatgcaggtcattgtatccaacgtaccccctacgctagtggagaaaaagatcgaagacttgacagagatcctcgacagatacgtgcaggagcagatccctggagcaaaggttgtggtggagagcatcggggcaagaaggcacggagatgccttttcgttggaagactacaccaaatgtgacttaaccgtctacgcaatcgatccacaaaccaacagagctattgatcggaatgaactgtttaaatttttggatgggaaactccttgatatcaacaaagactttcagccttactatggagaaggcggtcggattcttgagatccggacgccagaagctgtgacttctatcaaaaagagaggcgaaagcctcggttacactgagggcgctttgctggctctggcctttattatcatcctgtgctgtatccctgccatcctcgtggtgctggtgtcctatcgtcagtttaaagtgcgccaagcagagtgcacaaagaccgctcgtatccaggccgcattgcccgcagctaaacctgccgttcctgcacctgccccagtggctgccccacctccacctccacctccccctcccggagctcacttgtacgaagaacttggggactcaagcatgcataaaaactatccctggagccttgagctgatcctggcacggaatatggataagattataacggtgatgtcgatgggaatgaagtgtttgaatatgggggtggccgtagattgttatcatcagctcgatcgcaggaatatggtgcggtggctggtgaagctgcggaaaaacatgcgcagaaaaagaaagagccaacgcaagctgaagaaccagagactgaagctcgaatctctcgttcgccgtaagaaatag

SEQ ID NO: 237371 - DNA, 990 bp, Artificial Sequence
  Description of Artificial Sequence: Synthetic coding sequence
atgtttcgccagttctatctgtggacgtgtctggcaagtggcattatccttggctccctctttgagatctgcctggggcaatacgacgacgattgcaagctggcaagaggcggtcccccagccaccatagtagccattgatgaggaaagccggaacggaaccatccttgtcgacaacatgttaatcaaagggaccgccggtgggccagaccccacaatcgagctttcgctcaaggataatgtggactattgggtgcttatggaccccgtgaaacaaatgctcttcctcaactcaacaggccgagttcttgaccgagatccaccgatgaatattcattctatcgtcgtgcaagtgcagtgcataaataagaaagttggcaccatcatctaccacgaggtaagaatcgtggtgagagaccgtaatgataactcccctacattcaaacatgagtcctactacgccacggtgaacgaactgaccccggtagggacgaccatctttaccggttttagcggcgacaatggagcaactgacatcgatgatggccctaatggccagatagagtacgtaattcagtacaatccagatgaccctacaagcaatgatactttcgagattcccctgatgctcacaggaaatatcgtattgaggaaacgtctgaactacgaggacaagacaagatacttcgtgattattcaggctaatgatcgcgctcagaatttaaacgagcgtaggactacaactaccaccctcaccgtcgacgtgctggatggtgatgacttggggccaatgttcctgccatgtgtgctggttccaaatactagagattgccggccactcacttaccaggctgctattccagagttacggacaccagacttaggatcgctgtgctcgggaactaattcgtggtgccaaggccgttctggcgttcattggtcttccccagcttggcgatgcctgtttccccgtcgcttgcatcagatgtag

SEQ ID NO: 237372 - DNA, 5045 bp, Artificial Sequence
  Description of Artificial Sequence: Synthetic coding sequence
atgtttagacaattctacctttggacatgcctcgcctctggaattattctagggtctttatttgaaatttgtctgggccagtacgatgacggatggcggtatatgtactgcaagttggctcggggtgggccaccagctaccatagtggccatagacgaggagagcaggaacggaacgatcctggtcgacaacatgctcattaagggcacagccggaggtcctgatccaacaatagagctatccctgaaggataacgtcgattattgggttctgatggaccctgtcaaacagatgctgttcctgaactccacgggacgcgtactcgatagggacccgcctatgaacatacactcgattgtggtccaagtgcagtgcatcaacaagaaggtgggaaccattatataccacgaagtgaggatcgtggtccgcgacagaaatgataacagccccacctttaagcacgagtcatattatgcgacggttaacgaactgacacctgtgggcactacaattttcacaggtttctctggggataatggagcgacagacattgatgacggcccaaatggccagatcgagtacgtgatccagtacaatcccgacgatcctaccagtaatgatacatttgaaattccgcttatgctgaccggtaacatagtcctacgcaagcgcctcaactacgaagataaaacccgctattttgtgattatacaggcaaacgacagggcgcaaaacttgaacgaaaggaggacgaccacgacgactttaacagtggatgtgctcgacggagatgacctcggacctatgttcttgccttgcgtcctggttccaaatacccgcgattgcaggcctttaacgtatcaggcagcaattccagaactcaggactcctgaggagctgaatcctattattgtgacaccccctattcaggcgattgaccaggatagaaatattcaaccaccgagcgaccgacccggaatactatatagcatcctagtgggtacaccagaagattatcctcgtttctttcatatgcatcccagaacagcagagttgtccctgctagagccagtgaaccgtgactttcaccagaaatttgacctggtgataaaagccgaacaggacaatggtcatccactgccagccttcgctggcttgcacattgagatcctcgacgagaacaatcagagcccctatttcactatgccgtcgtatcagggttacatactagagtccgcccctgtaggggcaactatttctgattctctgaaccttacttctcctctgcgaattgttgcactggataaggacatcgaagatactaaggatcccgaacttcacctattcttaaatgattacactagcgtcttcactgttacacaaaccggtatcacccggtacctcactctcctgcagccggtcgatcgggaagaacagcagacctacactttctccatcacagccttcgatggggttcaggaatctgagccagtcatagtcaacatccaagtgatggatgcaaacgacaatacccctactttccctgaaattagttacgatgtgtacgtatatactgacatgcgccctggggacagcgtgattcagttaacggccgtggatgctgacgaaggatcaaacggagaaatcacatacgaaattttggtcggcgctcaaggggactttattattaataaaacaaccggcctgatcactattgcccctggcgtggagatgatcgtaggcaggacgtacgctttgacagtgcaggcggctgataacgcccctccagccgaacggcgtaacagcatctgcacagtgtacattgaagtgttgccaccaaacaaccagtctccacctaggtttccacaactgatgtactcccttgaaatctcagaggccatgagagtgggggctgtgctcctcaacctgcaggcaaccgatcgagagggcgattctattacctacgcaattgaaaacggggatccacaaagggtgtttaacctgtcagagactacgggcattctgacccttggcaaagccttagatcgcgagagcaccgacagatatattctgatcatcactgccagtgatggcaggccggatgggacgtctacagcaaccgtgaatatagtggtaaccgacgtgaatgataatgccccagtcttcgacccctacctcccaagaaacctgagcgtggttgaggaagaagcaaacgccttcgtggggcaggtcaaagctacagatcccgacgctggaataaacggccaggttcactattctctcggtaattttaacaacttgtttagaatcacttctaatggcagcatttacactgctgtgaagctcaaccgtgaagttcgggattattatgaactagtagtcgtagctactgatggcgctgtccaccccagacactccactctcacgctggcaatcaaagttctcgatattgacgataactctcccgtatttaccaacagcacgtacaccgtcctggtcgaagaaaatctaccggctggcactacaattctgcagattgaagccaaagatgtggatctgggcgcaaatgtcagttaccgcatcagaagtcccgaggtgaagcacttctttgccctccatccgtttaccggtgagctgtccctgctgcggtccctggattatgaggcattcccggatcaagaagcttctataacgttcctggtagaggctttcgacatttacggcacgatgccccctggaatcgccaccgtgacagtaattgtgaaagacatgaacgactacccccctgtgttctctaaacggatttacaaagggatggtagcgcctgatgcagttaagggtacccctataaccacggtgtatgcagaggacgccgatccgcctggattacctgccagcagggtaaggtatcgggtggacgacgtgcaattcccctaccccgcttctatttttgaagtcgaagaggattccggcagagtgattacacgtgttaatttgaatgaggagccaacgaccatttttaaactggtcgtcgtcgcgttcgacgatggagagcctgtcatgagttcctccgcaactgttaaaatcctggtgctccatcctggcgagatcccccgattcacgcaggaggaatataggcccccaccggtatcagaactggctaccaagggaaccatggtcggtgtgatctctgccgcagctataaatcagagtatcgtgtactcgattgtgtccggcaatgaagaagatacgttcgggattaacaacattacaggtgtcatatacgtcaacgggccacttgattacgagaccagaacctcatacgtgctaagggtgcaggccgactcccttgaggtagttttggctaacctgcgggtgccctctaaaagcaatactgctaaggtctacatcgagattcaggatgagaataaccacccccctgttttccaaaaaaaattttatatcgggggagtctcagaggacgccagaatgtttactagcgttttgagggtgaaagccacagataaagacacaggcaattattcggttatggcttatagactgataattccaccgataaaggaaggaaaggaggggttcgttgtcgagacttacacaggtctcattaagacagccatgctattccataatatgagacggtcatacttcaagtttcaggtgatcgccacagacgactacggcaaggggctaagtggtaaagctgacgtcctggttagcgtggtgaatcagctcgacatgcaggttatcgtctctaatgtgccaccaacactcgttgagaagaagatagaggacttgaccgagatactggataggtacgtgcaggagcagatccctggtgcgaaggtggttgtggaaagcattggcgctaggcggcatggtgatgcctttagtctcgaggactatacgaagtgtgatctgacagtgtatgcaattgacccacagactaaccgcgctatagacaggaacgaattattcaagtttcttgatggaaagctgttggacatcaacaaggactttcaaccctactacggagaggggggtagaatacttgaaatacggaccccagaggcagttacctcaatcaagaagagaggggagagcctagggtacaccgagggtgcgttactggccttagcattcataattatcctgtgttgcatccctgccattctcgttgtgcttgtaagctataggcaacgacaggccgaatgcaccaagactgcgagaattcaggcagccctgcctgctgcgaagcctgcggtgcccgctcctgctccagtcgctgcacctcccccacctccgcctcccccaccaggagcacacctttacgaggaactgggagactccagcatcctctattacaggtacgaaatgcctcaatacggctctagacgccgacttctcccacctgcaggacaggaagagtacggggaagtcgtgggggaagccgaggaagagtacgaggaggaagagtgggcaaggaaacgtatgatcaagctcgtagtggatagggagtatgagacatcctcgacaggcgaggattccgccccagaatgccagagaaatcggctgcaccatccctctatccatagtaatatcaacgggaacatttacatagcacaaaatggttcagtcgtacgcactcggagggcatgtctaactgacaacctcaaagttgcctcccctgtgcggctgggcggtccttttaaaaagctggacaagctggctgtgactcatgaagagaacgtcccactgaacactctctccaaagggccttttagtacagagaaaatgaacgctcggccaacactggtaaccttcgcaccatgccctgtcggcactgacaacacagctgtcaagcccctgcgaaatcggttgaaaagcacagtagagcaggaatcaatgatcgatagcaagaacatcaaggaggccctagagtttcattctgaccacacacagtctgatgacgaagaattatggatgggaccctggaacaatctgcatatacccatgaccaagctgta

SEQ ID NO: 237373 - DNA, 5888 bp, Artificial Sequence
  Description of Artificial Sequence: Synthetic coding sequence
atgttccgccaattttatctctggacgtgcctggcgtccggcatcatccttggatctttatttgagatttgtctcggacaatatgatgacgcatacagctacgaagactgcaagctcgctcggggaggaccaccagccaccattgtcgccattgatgaggagtcccgcaacggcacgatcctggtcgacaacatgctgatcaagggaacggctggaggccctgaccctactatcgagctgagtctcaaagataatgtggactactgggtcctgatggatccagtgaagcagatgttgttcctgaactctaccgggcgagtgttggatagagatcccccaatgaatattcattcaatagtggtccaagttcagtgcataaataagaaagtaggaactattatttatcatgaggtccggatcgttgtacgcgatagaaatgataattcgcccacattcaaacacgaaagctactacgccactgtcaatgagttgacccccgtgggtactactatttttacggggttcagcggcgacaacggagcgaccgatatcgatgatggtcccaatggccagattgaatacgtcattcagtataaccccgacgaccccaccagcaatgacaccttcgagatcccgctaatgcttactgggaacatcgttttgcgcaaacggctgaactacgaagacaaaaccaggtacttcgtaattattcaggccaatgaccgagctcagaatcttaacgagagacgtacaacgactactacactgaccgtcgacgtcctcgacggcgatgatctcggcccaatgtttttgccctgcgtgctcgtcccgaatacccgcgattgccgaccgctgacatatcaggccgcaatccctgaactcagaacacctgaagagctgaatcccattattgtcacgcccccaattcaagctatagaccaggaccgaaacatccagccgccatccgaccggcctggcatcctttactctatactcgtaggcacacctgaggattaccccaggttctttcacatgcatcccagaactgcagaactcagccttttagaacctgtgaaccgggactttcatcagaaatttgatttagtgatcaaggccgaacaagataacgggcaccccttaccagcttttgcagggctccacattgagatcctagatgagaacaatcagagcccatacttcacaatgccgagctaccaggggtatatcctggagtctgccccagtgggtgccaccatatctgactcccttaatcttactagccctctccgcatcgtggcgctcgacaaagatatcgaggatacgaaagaccccgaactacacttgttcctaaacgactacaccagcgtttttacggtgacccaaaccggtattacgaggtacctgactctcttgcagccagtggatcgcgaggagcaacagacctataccttcagcattacagcgtttgatggcgtacaggagagcgaacctgtgatagtgaacattcaggtgatggacgccaatgataatactccaacattccccgagatcagctacgatgtatacgtgtataccgacatgagacctggagatagtgtgattcagctcacagctgtagacgccgacgaaggcagtaatggagagatcacctatgagatcctagtcggcgctcagggcgatttcattatcaacaaaacaaccgggttgatcacgatcgcacctggcgttgagatgatcgtcggaaggacttatgccctcactgttcaggccgctgataatgcccctcctgcagagcgccgaaactccatctgtactgtctatattgaggttctcccaccaaataaccagtcacctcctaggtttccccagttaatgtattccctggaaattagcgaagctatgcgggtgggagccgtgctgcttaatctgcaagccactgaccgtgagggagacagcatcacttacgcaatagagaacggcgaccctcagagggtcttcaacctgtctgaaacgaccggcattctgaccctgggtaaggcacttgatagagagtccactgataggtatattctgatcatcactgcaagcgatgggcgtcctgatggaactagcaccgccactgttaatattgtggtgactgacgtcaacgacaacgccccagtctttgacccatacctgccacgcaatctgtccgtggtagaagaagaggccaacgcattcgtcggtcaggtaaaggccacagaccctgacgccggaataaacggacaggtgcactactctctgggcaatttcaataacttatttcgtatcacttccaacggatccatctacacagcagtgaagttgaatcgcgaggtcagggattattatgagctggttgttgtggcaacagacggcgcagtccatcccaggcactccacactgacactggcgattaaagtgctggacatcgatgacaatagccccgtgtttactaacagtacctacacagtgctggtggaggaaaatcttccagccggaacgacgatccttcagatagaggcgaaggatgttgacctgggggctaatgtgagctacagaatccggtcacctgaagtgaagcactttttcgcactgcacccctttaccggggagctctcactcctgcgttcccttgattatgaagctttccctgaccaagaagcaagcattacattcctcgtagaggccttcgacatctatggaaccatgccgcctggaatagccacagtcacagtgatagtcaaagatatgaatgactatccaccagtttttagcaagcgaatctataaagggatggttgctcccgacgctgttaagggcacccctataaccacagtgtacgccgaagatgctgaccctcccggattgccagcaagcagggttcgctacagagtggacgatgtccagttcccttaccctgcctctatttttgaggtcgaggaagactccggcagagtaatcacccgggtgaatttgaacgaggaacctaccaccattttcaagctggtagtggtcgcatttgacgacggagaacctgtaatgagctcaagcgctacggtgaaaatcctcgtgcttcatcccggagaaatccctaggtttacacaggaggagtaccgtccgcctcctgtctcggaattagcaaccaagggtaccatggtcggagtgattagcgcagctgcgatcaaccagagcatagtgtactctatagttagcggcaacgaagaggacacctttgggataaataatataaccggtgttatctatgtaaatggcccactggattatgaaacacgaacaagttacgttcttagagtgcaagcagatagcttagaggtggtgctagccaacctcagggtgccctcaaagagtaataccgctaaagtgtacattgagattcaggacgaaaacaaccacccccctgttttccagaaaaagttttacatcggcggtgtgtcagaggacgccagaatgtttacatctgtgctaagagtgaaggctaccgataaagacacaggcaactattctgtaatggcttataggttgatcattccaccaatcaaagaagggaaggaaggtttcgtcgtcgagacttatacaggcttaattaagacagccatgctctttcacaacatgcggcgttcctattttaaattccaggtaattgccaccgacgattacgggaaaggccttagtggaaaggctgacgttctggtgagtgttgttaaccagctggacatgcaagtcatcgtgtctaatgtgcctcctacgctcgtggagaaaaaaatagaggatctgacggagattctggacagatatgtgcaggaacagatccctggggctaaggtcgtcgtggagtctattggagcaagacgccatggggacgccttctccctggaagattacacaaaatgtgacctcaccgtatatgccattgacccacaaaccaacagggccattgacaggaatgaactgttcaaattcctcgacgggaagctgctggacataaataaggattttcaaccttactatggggagggcggtcggatccttgagatcaggaccccagaagccgtcacttctattaaaaaacggggtgagtccctggggtatacggaaggtgcgctactggctttggcattcattatcattctttgctgtatccctgctatcctggtggtcctcgttagctatcgccatttcaagcgccgacaggctgaatgcaccaagaccgctcgcattcaggcagcgttacccgctgcaaaacctgccgtgcctgccccagctccagtggcggctcctcccccacccccaccacctcccccaggagctcacctgtacgaggaactaggcgattcgagtatgaaaggcctcttccttctttatcatttccagcagtcaagaggaaacaactctgtgtccgaagaccggaagcatcagcaggtcgtcatgccatttagctccaacacaattgaagcacacaagtccgcccacgtggacggatctctgaagtcgaataagctgaagtccgcgaggaaatttacttttctctctgacgaggacgacctgtcggcccacaaccccctgtacaaggagaacatcagtcaggtgtctaccaactcagacatcagtcaacgaacggacttcgtggaccctttttcacccaaaatccaggctaaatccaaatccctgcggggtccgagggagaaaattcagcggctgtggtcccagagtgtaagccttcctagacggttgatgagaaaggttcccaaccgacccgaaataattgatctccagcagtggcaggggacccgtcagaaagccgagaacgagaacactgggatttgtaccaacaagaggggcagcagcaatccactgctaactaccgaagaggccaacctgactgagaaggaagaaattcgtcagggggaaactcttatgattgaaggaaccgaacagctgaagtccctgtcttctgatagttcattttgtttcccacgccctcacttcagctttagcacattgcctaccgtaagccggacggtggagctgaagtctgaaccaaatgtcatctcttcacctgccgagtgcagtctcgagctgagcccgtcccgcccatgcgtgttacatagtagcctgagcagacgggagacacccatatgtatgttacctatcgagaccgagaggaacattttcgagaatttcgcgcatcctcctaacattagcccgtctgcgtgcccactgccacctccccctcccatttctccaccgtctcctcccccagctccagcccctttagctccaccccctgacatttccccattctcattattttgcccccctccatctcccccttccatcccattgcctctgcctccgcctacattcttcccactttctgtgagtacatctggcccacccactccacctctgctgcctcctttccccacgccactccctccgccaccaccttcgattccctgtcctccccctccttccgcctccttcctttcaacagaatgtgtctgcatcacgggagtgaagtgcactacaaacctcatgcccgctgagaaaattaaaagcagcatgactcagctcagcacgaccaccgtctgtaaaaccgacccccagagagagcccaagggcatcctgagacatgtgaagaatctggccgaactggagaagtcggttgcaaatatgtactcccaaattgagaagaattacctgaggactaacgtgagtgagctgcagaccatgtgtcccagtgaggtcactaacatggagatcacgtcagaacaaaataaggggagcctaaataatattgttgaaggaactgaaaagcagagccactctcaaagcacttccctcta

SEQ ID NO: 237374 - DNA, 5660 bp, Artificial Sequence
  Description of Artificial Sequence: Synthetic coding sequence
atgtttcgacagttttatctgtggacatgcctggcctcaggaataatcctcggctcgctattcgagatttgtcttggtcagtacgatgatgactgcaaactggccaggggaggaccaccagccactattgtggcaattgacgaagaaagccgaaatggcaccatccttgtggataatatgctgattaagggcaccgccggtggccctgaccccaccattgaactatcactaaaagacaacgtggactactgggtattgatggaccctgtgaagcagatgctgttcctgaatagcactggcagagtgcttgatcgtgacccacctatgaacatacattccatcgtagttcaagttcagtgcataaacaagaaagttgggaccatcatatatcacgaagtccgaatcgtggtgcgagaccgtaatgataactcgcccacctttaaacacgaaagctactacgcaacagtaaacgagctgacccctgttggcacaaccatatttacaggattcagtggagataatggcgctacggatatcgacgatgggccaaatggacagatagaatatgtaatccaatacaatccggacgaccccaccagcaatgacacctttgaaatccctctaatgttgaccggtaacatcgttctacgtaaacgacttaattatgaggacaagacacggtattttgttataattcaggcaaatgatagagcccagaacctcaacgaaagacgaacaacaactacgacactcactgtggacgttctggacggtgatgacctgggacccatgtttctgccctgcgtcctggtcccaaatacccgcgattgcagaccacttacttaccaagccgcaattcctgagttgagaacgccagaggaactcaaccctatcatcgtaactcctccaattcaagccattgatcaagaccgaaacatccaaccccctagtgatagacctgggattctgtactcgattctggtagggacacccgaagattatcctaggtttttccacatgcatcctcggactgctgagctgtcactcctcgaaccagtgaatagggactttcatcagaagtttgacctcgtaattaaagcagagcaagacaatggacacccactgcccgcattcgccggactccacatagaaattttggacgagaacaatcagagtccatacttcacgatgcccagctatcaagggtatatcctggaatccgctcctgtcggagccacgataagtgatagccttaacctcactagccctctgcgtatcgtcgcacttgataaagatatcgaagatacaaaagatcccgagctccacctgtttctgaatgactatacctcagtcttcaccgtcacccagacagggatcacccgctatctcacactcctgcagccagtggaccgagaggagcagcagacctacaccttcagcattacagcattcgacggagtacaagaatccgagcccgtcattgtgaacattcaggtgatggatgccaacgacaacactccaacgttccccgagatcagttacgacgtgtacgtgtacaccgatatgcgacctggagatagcgtgatccaactcaccgccgtcgatgctgatgaaggtagcaatggggaaataacatatgaaatcctggtcggcgcacagggtgactttatcattaacaaaacaacagggctcataacgattgcgcctggtgtggagatgatagttgggaggacttacgcactaacagtgcaggcagccgacaacgcccctcctgccgaacgaagcacaggcatacttaccctgggaaaagccctggatagagagagtacagacaggtacattctgatcattactgcatctgacggacgacccgatggaacatctactgcaaccgtgaacattgtagtgactgatgtgaatgacaacgcgccagtgtttgatccatacctacctcgtaacctctctgtagtggaggaagaggccaacgcatttgtgggccaggtgaaggctaccgatcccgacgccggaatcaacggccaggtacattattctttagggaactttaataacctgtttcggattacatccaatgggagcatttacaccgccgtgaagttgaatcgcgaagtccgggactattatgaattggtcgtggtggctaccgatggagcagtgcatcctcgacactcaacacttacactagctattaaggtcctcgatattgacgacaacagtcctgtgttcacaaactccacctacaccgtgctcgtggaggaaaacctgccagccggtactacgattttgcagatcgaggctaaggatgtcgacctgggggctaatgtgtcttataggatccggtcccctgaagtgaaacacttctttgctctgcaccccttcacaggggagctctccctgctgcgctccctcgactacgaagcctttccagaccaggaggcaagcattacctttctggtggaggcctttgacatctatgggacaatgcccccaggcatcgctaccgtcacggtaatcgtcaaggacatgaatgattaccctcccgtgttctcaaaacgaatctataaagggatggttgctcctgatgcagttaaaggcactcccataaccactgtctacgccgaggacgctgaccctcctgggctgcccgctagcagagtgcgctatcgcgtggatgacgtgcagttcccctaccccgcatcaatatttgaagtggaggaggattccgggagggtaatcacccgcgtgaatctcaacgaggagccaacaactatttttaagctggtggtcgttgctttcgatgacggagagccagtaatgtcctcctccgctaccgttaagatcctggtgttgcacccaggcgagattccaaggttcacccaggaagagtatcgcccaccacccgtatcggagctggccacaaaaggcactatggtgggggttatctcagctgccgcaattaatcagtcaattgtctactccatcgtctccggaaatgaggaggacacctttgggataaacaatatcacaggcgtgatctacgtcaatggcccactggattacgagactaggacttcttacgtactgagggtgcaggctgattcccttgaagtggtgttagccaacctgagggttccctccaagtcaaataccgccaaagtatacatcgagatccaggacgaaaacaatcatcccccagtgtttcagaagaagttctatataggaggtgtctctgaagatgcccgaatgttcaccagcgtcctccgcgttaaggccaccgataaggataccgggaattatagtgtcatggcctatcgcttgattatccctcctatcaaggaggggaaagagggattcgttgtggagacctatactggcctgattaaaacagccatgctcttccacaatatgcggcgtagttattttaaatttcaagttatcgctactgatgactacgggaaggggctgtcaggcaaggccgacgtgttggtgtctgtggtcaatcagctagacatgcaggttatcgtatcaaacgtccctcccaccctggttgagaaaaagattgaggatctgaccgagatcctcgaccgctacgtccaggaacagattcctggggcaaaagtggttgtggagtccatcggagctcgtcggcatggggacgcctttagcttggaggattacactaaatgtgatcttaccgtgtatgcaatagacccgcagaccaaccgggctattgacagaaatgagctcttcaagtttctcgacggcaaactactggacatcaataaggactttcagccttactacggtgagggaggcaggattttggagataagaactcctgaagcagtaacgtccataaaaaagagaggtgaaagcctggggtatactgaaggcgctcttctggcacttgcgtttattataatactgtgctgcattcccgcaatactggtcgtcctggtgtcctaccgccatttcaaaaggagacaggccgagtgtacaaaaacagctcgaattcaggctgctctgccggctgcgaagccagcggttcccgcacccgctcctgtggctgcaccgcctccacccccaccacctccccctggcgcacacctctacgaggaattaggagatagttcaatgaaggggctgttcctgctgtaccatttccagcaatctagaggcaacaacagcgtgagcgaggatcggaagcaccagcaggtggtgatgcccttttccagcaataccattgaggctcacaagagcgcccacgtagatgggtccctgaaaagcaacaagctcaagtctgccaggaagtttactttcctgtctgacgaggacgacctgagcgcacataacccgctgtataaggaaaatatatctcaagttagtacgaattcagatatctcacaaagaacagacttcgtcgatccattttctcccaaaatccaagctaaaagtaaatcactgcgcggaccaagagaaaagatccaaaggttgtggagccaaagtgtgtctttgccacgtcgcctcatgcggaaggtccccaataggccagaaattatcgacctgcagcagtggcaaggcacaagacagaaagccgagaatgaaaatacgggtatctgtacaaataaaagggggagttctaatcctctgctgaccactgaagaggcaaatttgaccgaaaaggaggaaatccgacagggagagacactgatgattgaggggacggagcagctcaagagcctgagctctgattcatcattctgttttccgaggccgcacttctccttctctacgctcccgacagtgtcacggactgtggaactgaaatctgagcccaacgtcatctcttcacccgctgagtgtagccttgagttatctccgagtcggccatgcgttctgcattcatccctgtccagacgcgagactccaatctgcatgttgcctatagagaccgaacggaacatcttcgagaacttcgcacatccaccgaatatcagcccctccgcctgccccttgcctcccccaccacctatttcccccccatccccccctcccgcacctgcgcctttagcccctccaccagatatctccccattcagcttattctgcccacccccttctccccctagcataccgcttcccttgcccccacccacattcttccctcttagcgtttcaaccagtgggccacccaccccgccacttctgccacccttccctaccccattgccgccaccaccaccaagtattccatgccccccaccaccatctgccagctttctgagtaccgaatgcgtttgcattacaggagtgaaatgtaccacaaacctcatgcctgctgaaaaaatcaagagcagtatgacacagttgtctacaaccaccgtctgtaagacagatccccagagagaacccaagggcatcctgagacatgtcaaaaatctagcggaacttgaaaagtcagtggctaacatgtacagccagatcgaaaaaaattatctcaggacaaacgtgtcagaactgcagaccatgtgccccagtgaagttactaatatggaaatcacctccgagcagaacaagggcagtctcaacaacatagtggaggggacagaaaagcagtctcattcccagagtacgtctctata

SEQ ID NO: 237375 - DNA, 1965 bp, Artificial Sequence
  Description of Artificial Sequence: Synthetic coding sequence
atgtttcgacagttttacctgtggacttgcctagcctcaggtattattctaggaagcctctttgaaatttgtttgggtcagtatgacgacgattgcaagttggcccgtggcggaccaccagcgacaatcgtggcgatcgacgaagagtccaggaatggcactattctcgtggacaatatgctgatcaagggaacagccggaggacctgatcctacgatcgaactgtcactcaaagacaacgtggactactgggtgcttatggatccagttaaacaaatgctattcctgaactccactgggagggtgctggaccgcgatcctcccatgaacattcattcaattgttgtgcaggtacagtgtatcaataaaaaagttgggacgatcatttatcacgaggtccggatagtggtgagggacaggaatgacaacagcccaacttttaaacacgaaagctactacgctactgtgaatgagctgacacccgtcgggactacaatattcacggggttttctggtgacaatggcgcaaccgatatcgatgatgggcctaacgggcagattgaatatgttatccagtataatccagacgatccgaccagcaacgacacatttgagatcccactgatgctcacgggcaacatcgtactccgcaaacggctgaattatgaagataaaacccgctacttcgtgattatccaagccaatgatagggctcagaatctcaatgagcgcagaacaactaccactactctgaccgttgacgttttagatggagatgatttgggccctatgtttttaccctgtgttcttgtgcccaataccagagattgtaggccactcacttaccaggccgctatcccagagcttcgcacccccgaagagctgaatccaattatcgttaccccaccgatccaggccatcgaccaggatcggaacatccaaccccctagcgaccgccctggtatactgtattccattctcgtgggaacacccgaggactatcccaggtttttccacatgcatcctcgcacagcagagttgtccctgctagaacccgtgaatagagattttcaccagaaattcgacctagtcattaaggccgagcaggacaacggccaccctctgcctgcattcgccggactccacatcgaaattctagatgaaaacaaccaaagcccgtactttaccatgcccagctaccaggggtacatcttggaatcagccccagttggggcaaccatcagtgattccctgaatttaaccagcccattgcgtatcgtcgccttggacaaggatatagaagacaccaaggacccagagctccacctcttcctaaatgattatacatccgtgttcactgtgacccagacaggaatcactaggtatttgaccctgctccagcccgtcgatcgtgaggaacaacaaacctatactttctccattacagcatttgacggcgttcaagagtccgagccggtcattgttaatatccaagtcatggacgccaatgataacacgcctaccttccccgagatctcatatgatgtgtacgtgtatacagatatgaggcccggagatagtgtgattcagctaactgcggtggacgcggatgaggggagcaacggtgaaattacctatgaaattttggttggcgctcagggagattttattattaacaaaactactggccttattacaattgcgcctggagtcgagatgatcgttggcaggacctatgctttgacggtgcaggccgctgacaacgccccacctgccgagcgtcggaactcgatttgcacggtctacatcgaggtactgcctccaaacaaccagagcccaccaagatttccacagcttatgtattctcttgagattagcgaggctatgcgagtgggggctgtgcttctcaacttgcagcacggagactccaatctccgagagagtaccggccagggaaagcactag

SEQ ID NO: 237376 - DNA, 5033 bp, Artificial Sequence
  Description of Artificial Sequence: Synthetic coding sequence
atgttcaggcagttttatctgtggacctgtctggctagcggcatcatccttgggtctttattcgaaatttgtctgggacaatatgatgatgactgtaagttggcccgaggcggtcctcccgcaaccatcgtggctatcgacgaggagtcccggaacggaactatcctggtggataacatgttaatcaaagggacggccggtggcccagatcctaccattgagttgtctctcaaagacaatgtcgattattgggtactgatggaccccgtcaaacaaatgctgttcctcaacagcactgggagagtgcttgaccgcgacccccctatgaatattcacagtatagtcgtgcaggtccagtgcattaacaagaaggttggtactatcatttaccatgaggtgagaatagtagtccgggataggaatgacaattccccaactttcaagcacgagagctactatgccaccgttaacgagctgacacccgtgggtactacaattttcaccgggttctccggagacaacggcgctactgatatcgatgatggaccaaacgggcagattgaatacgtcatccagtacaaccccgatgaccccactagcaacgataccttcgaaatcccattgatgttgacgggcaacatagtccttaggaaacgcttaaactacgaggataagacaagatatttcgtcatcatccaagccaatgaccgagcccagaatctcaatgaaagacggactaccaccactaccctcacagtggacgtgctcgacggcgacgatctggggccaatgttcctgccctgcgtgctggtgcctaatacaagagattgcaggcccttgacatatcaagcagccattccggaacttaggacccccgaagagctgaaccccattattgtaacaccccctattcaggccatcgaccaggaccgtaacattcagcctccttccgatagaccgggtatcctgtacagcatactggtcgggacgccggaggactatcctcggttctttcatatgcacccaagaaccgcagaactgtcactcttagaaccagttaatcgcgatttccaccagaagtttgatctggtgatcaaggctgagcaggataatggacaccctctgccagccttcgcgggtctgcatattgagatccttgatgagaataaccagagtccatattttacaatgccatcttaccagggttacatcctcgagagcgcgcctgtcggcgcaaccatttccgattcgctgaatctgacctcccccctgagaattgtggctctggataaggatattgaagatacaaaggacccagaactgcacttgtttctgaatgattacacctcggtattcactgttacccaaactgggataactaggtacctgacattactccaacctgtggacagggaggaacagcagacctataccttttcaattaccgcttttgatggggtgcaggagtcagagccagttattgtcaacattcaggtcatggatgccaacgacaacactcctacctttcccgagatcagctacgacgtttatgtgtatactgacatgcgtccaggagactcagtgattcagctgacggccgttgacgcagacgagggctcaaatggtgagattacctatgaaattctcgtaggagcccaaggagactttatcataaacaaaacaacaggcctgataaccattgccccaggtgtggagatgatcgtagggcgaacctacgcgcttacagtgcaggcagctgataacgctccaccagccgagagacgcaactccatctgcactgtgtatattgaagtcctgccacctaacaaccagagccctccaaggttcccgcagctgatgtatagcttggaaataagcgaagcaatgagagtgggcgcagtactgctcaatctgcaagccacggaccgagagggcgattctataacctatgccatagagaacggcgaccctcagcgcgtgtttaatctatctgaaactaccggtattctgacactcggtaaagccctggatagagagtcgaccgataggtatattctcattatcacagcctccgacggacggcctgatggaactagcactgcaacagtcaatattgtggtcaccgatgttaacgacaatgctcccgtgtttgatccgtatctcccaaggaacttgtctgtggtggaggaggaggcaaatgctttcgtgggacaggtcaaggctaccgaccccgacgccggaatcaacgggcaagttcactatagtctgggaaacttcaacaacctgttccgcattacgagcaatgggagcatctatacggctgtgaagttgaacagggaagttcgggactactacgaactggtcgtggtcgccactgatggggcagtccatcccagacattccacactgacacttgctatcaaggtgctggatattgatgataacagcccagtgtttaccaatagtacctataccgtgctggtggaggagaacctcccagcaggcaccaccattttacagattgaggcaaaagacgtggatcttggtgcaaacgtttcttaccgaatccgctcgccagaagtcaaacatttctttgccctccatccatttactggcgaacttagcctcttacgcagtctggattatgaagcattccccgaccaggaggctagcataacctttctcgtggaagcgtttgacatttacggtacgatgcctccgggaatcgcaacagtgaccgtgatcgtgaaggacatgaacgattatccgcctgtgttctccaaacggatttacaaggggatggtcgctcctgatgccgtgaaggggacgcccatcacaacagtgtatgctgaggacgcagatccccctgggctgcccgcttctcgcgtgagatacagagtggacgatgttcaattcccataccccgcatcaatcttcgaggttgaggaggatagcggacgagttatcactcgggtgaacttaaacgaagagccaactaccatcttcaaactggtggtcgtagcatttgatgacggggagcccgtcatgtcttctagcgccaccgtgaaaatattggtgttgcaccctggggagatccctaggtttacacaggaagagtaccgtccccctccagtgagcgagctggccactaaggggaccatggtgggagtaatttctgcggctgctatcaaccagtctattgtctactcgattgtgtccgggaacgaagaagacaccttcggaattaacaatataactggcgttatttatgtgaacgggcctctcgactatgaaacaaggacctcctatgtgctgcgggttcaggccgactccctggaggtagtgctcgcaaatttacgcgtaccgtccaaatccaataccgccaaagtctatatcgaaatccaggatgagaacaatcaccctcctgtgtttcaaaagaagttttacattgggggtgtgtcagaagatgctcggatgttcacctcagtgctgcgcgtaaaagctactgacaaagatactggaaattactcagtgatggcctatcggcttattatcccccctatcaaagagggtaaggaggggttcgtggtagaaacatacactgggctaataaagacggctatgctctttcataatatgaggcgcagctactttaagttccaggtgatagccactgacgactacggcaagggactgagcggaaaggccgacgtcctcgtctctgtggtgaaccagctcgatatgcaggtcattgtctctaatgtgcccccaaccctagtggagaaaaagattgaggacctgactgagatcctggaccgatatgtgcaggaacaaatcccaggcgcaaaggtggtggtagagtctatcggcgctcggaggcatggcgatgctttcagcctggaggattatacgaagtgtgatttgaccgtgtatgccatcgatcctcaaacaaaccgcgcaatcgatcggaatgagctgtttaagttcctcgatggcaagctgctcgacattaacaaggattttcagccatactatggagagggcggacgcattctggagataaggacacctgaggcagtgacgagtatcaagaagcgaggagagagcctcggctatactgaaggggctcttctagccttagcatttattataattctgtgttgcatccctgccatcctggtggtcctggtgagctataggcactttaaaaggcgtcaggcggaatgcaccaagacagccaggattcaggctgccttgcctgcagcgaaaccggctgtgccagccccagctcctgtggccgctccccctcctccgccacctccgccacccggagcccatctgtatgaggagctgggggactccagcatttataggtacgaaatgccccagtatgggtccagaagacgtctgctacccccagccggacaggaggagtacggagaggtggtgggcgaggctgaagaggagtacgaggaagaggaatgggctagaaaaaggatgattaaactggtcgtggaccgcgaatatgaaacttcctccaccggagaggacagcgcgcctgagtgccaaagaaaccggctgcatcatccatccattcattccaacatcaatggtaatatttatattgcccagaatggctccgttgtgagaactcgtagggcctgccttaccgacaacttaaaggtcgcttccccagtgcgcctgggagggccttttaaaaagctggataaactggccgtgacccacgaggagaatgtccctctgaatacactcagcaagggaccattcagtaccgagaaaatgaatgctcgccctaccctggtgacttttgctccttgcccggttggaaccgataatactgcagtgaagcctctgaggaatcgcttaaaatccacagtggaacaggaatctatgatagacagtaaaaatattaaagaggcactagagttccactcagaccacacccagagcgacgacgaggaattgtggatgggtccttggaataatctccatattccaatgacgaaactgta

SEQ ID NO: 237377 - DNA, 279 bp, Artificial Sequence
  Description of Artificial Sequence: Synthetic coding sequence
atgttccggcagttctatctctggacttgtttagcatctgggattatactgggctctctctttgaaatttgtctcggacagtatgacgatgactgcaaacttgcccgagggggaccccctgctacgatcgttgctatagacgaggagtcccgcaatgggacaattcttgttgacaacatgctgatcaaggggacagctggcggaccagacccgacaattgagctgagccttaaagataatgtcgattattgggtgctcatggatcctgtgaaacaatag

SEQ ID NO: 237378 - DNA, 3453 bp, Artificial Sequence
  Description of Artificial Sequence: Synthetic coding sequence
atggctccccctttgcgcccactggcacggctgcggcctcctggaatgctgctgcgggcactgcttcttctgctccttctcagcccactgccaggcgtctggtgctttagtgagttaagtttcgttaaggaacctcaggacgtgacggtgacaagaaaagaccctgtggtgctggattgtcaggcgcacggggaggttcccattaaagtcacgtggctaaagaatggggctaaaatgagtgagaataaaaggatcgaagtgctgagtaatgggagcttgtacatttcagaggtggaaggccgaaggggggagcaatctgacgagggcttctatcagtgtttagctatgaacaagtacggagcaatcctcagccagaaggctcatctagctctttccacaatctctgcttttgaggttcagcccatctctaccgaggttcacgagggtggagtggctcgattcgcctgcaagatctcttcacacccccctgccgtgatcacttgggagttcaacagaaccactctgccaatgactatggatcgtattacagccctgccaacaggggtgctccagatctatgacgtgtcacagcgagacagtggtaattaccgatgtattgcagctaccgtcgcgcaccggaggaagtctatggaggcgagtttgacagtgatacctgcaaaagagtccaagtcattccatactcccacgataattgctgggccacagaacattacgactagcttacatcaaaccgtcgtgcttgagtgcatggccaccggcaaccccaagcccatcatctcctggtctagactcgaccacaagtcaattgatgttttcaacactcgggtgcttggaaatgggaacttaatgatttctgacgttcggcttcagcacgccggtgtctatgtgtgcagagctacaacccctggaacaaggaattttactgtggcaatggcgactctcacagtcctcgccccacccagttttgtggaatggcctgagtcactgacccggccaagggctggaactgcacgcttcgtttgtcaggctgaggggataccaagccctaaaatgagttggcttaagaatggcagaaaaatccacagcaatggccgaatcaagatgtataactcaaagttagttatcaatcagatcatacccgaggacgacgccatctatcagtgcatggccgagaattctcagggtagcattctgtctcgcgctagactcacggtcgtcatgagcgaggatagaccatctgccccttataacgttcatgccgagacgatgagctcgtctgctattctgttagcatgggagcggcctttatacaattccgacaaggtgattgcttacagtgtacattatatgaaggccgagggactgaataacgaggagtaccaagttgtgattggaaacgacactacacattacatcattgatgacttggagcccgcttctaactacaccttttacattgttgcctacatgcccatgggggctagtcagatgagtgatcacgtaacccaaaacacactggaggacgtgcctttaagaccccctgagatttcactgacctcaaggtcccccaccgatatactgatctcgtggctgcccatacctgctaaataccggagaggtcaggtggttctgtacaggctgtctttcaggctgagtacagaaaacagcatccaagttctggaactgccaggcacaacccacgaatacttattggaggggttgaagccagacagcgtgtatttagtccggattaccgcagcaacacgcgtgggtcttggcgaatcatctgtgtggacaagccatcgcacgccaaaggcaacttctgtgaaggctccaaaatcgccagaacttcacctcgaacccctcaactgcacaacaattagcgtgcgatggcagcaagatgtcgaggacacagctgcgatccagggctataaattgtattacaaggaggaaggccagcaagaaaacggacctatttttctcgacaccaaggacctgctgtataccctaagcggtttggaccccaggcgcaaatatcatgttagactgctcgcatacaataacattgatgacggatatcaggccgatcagaccgtgtcaacccccggatgcgtgtctgttcgtgatcggatggtgccgcctcctccacctcctcaccatctgtacgcaaaggctaatacatcctcttctatctttttacattggaggcgtcccgctttcaccgccgcacagatcatcaattatacaataaggtgcaatcctgtaggtctccagaatgcttcactggtgctctacttgcagacatccgagacacatatgcttgtacagggactcgaacccaacaccaaatacgagttcgcagtccgtctgcacgtagatcagctgagttcaccatggtcacccgtagtttaccacagtactctgccagaagctccggctggaccccctgtgggggtcaaagtgacccttatcgaggacgatactgcactcgtgagttggaaaccacctgacggccctgaaaccgtggtgactcgctacacgattttgtacgcgtcacggaaggcctggatagccggagagtggcaggtcctccatcgcgaaggtgcaatcaccatggccctcctggagaatctggttgccggtaatgtgtacatcgtgaaaatcagcgctagtaatgaggtaggcgaaggacctttcagtaactccgtggagttggctgttctgccgaaagagacttccgaaagcaatcagcggcctaagagacttgacagcgctgacgctaaggtttatagcggatattaccaccttgatcaaaaatctatgacggggatagccgtgggagtggggatcgctctgacctgcattcttatctgcgtcctgatactcatctatcgtagcaaagccagaaagagcagcgcgagtaaaaccgctcagaatggcactcagcaactgccacggacctctgcgtcactcgcaagcggcaacgaggttggaaaaaacctagagggggcagttggaaatgaggaatctcttatgcccatgattatgcccaatagctttattgacgccaagggaggtacggatctgattattaactcatatggtccgatcattaagaacaactctaagaagaagtggtttttctttcaggattccaagaagatccaagttgaacagccacagagacgttttacaccggctgtttgcttttaccaaccgggaactacagtattaatctctgatgaggacagtccatcttccccgggacaaacaacatctttttcaaggccttttggtgttgctgcggacacggaacatagcgccaactccgaagggagccacgaaacgggcgatagcggacgattcagccatgaatcaaatgacgaaattcatttgtcatctgtgatcagcacaaccccacctaatctgtag

SEQ ID NO: 237379 - DNA, 1434 bp, Artificial Sequence
  Description of Artificial Sequence: Synthetic coding sequence
atgggcaggaccgtcgtcgttctgggcggaggcatctcggggctggctgccagttatcacctatctcgggcaccctgccctcccaaggtggtactagtggagtcatcagaacggttgggaggatggatccgctctgtcaggggccctaatggggctatcttcgagctgggaccccgtgggatccggcctgctggtgccctgggcgctcgaacattattgctagtttcggaactgggtctggatagcgaagtgttgcctgtgaggggagatcaccctgccgctcagaaccggttcctctatgtgggtggtgccctgcacgctttacccaccggcctgaggggcttgctgaggccgagcccgcctttctcaaagccgctgttctgggccggtctgcgggagttaactaagcccagaggtaaggaacctgatgagacggtgcatagcttcgcccagcgacggctgggacctgaggtcgcatctcttgccatggactcactctgtcggggtgtgtttgccggtaattctcgagagctttccatccgcagctgtttccctagcctcttccaggctgagcagactcatcgctcgatcttgttggggctgctgttgggggctggcagaactccacagccagatagcgcacttatcaggcaggctctggctgagaggtggtctcagtggagtctgcggggaggcttagaaatgctcccacaggctctagagactcacctgacgagcagaggggtttcagtactgcgcggacagccagtctgcggactctccctccaggcggagggccgatggaaggtctctttgcgggattcaagccttgaggcggatcacgtaattagtgctatccctgcctccgtactgagtgagttattaccagcggaagctgcccctctggccagggccttatccgccatcaccgccgtgtctgttgccgtggtaaacttgcaataccagggggctcacctaccagtgcaggggtttgggcacctggtgccttcttcagaggatccaggagtgctcggaattgtctatgactccgttgccttccccgagcaagacggctccccccctggactgcgagtgactgtgatgctggggggatcctggttgcagacactggaggccagtggctgcgtcctgtcacaagagctgtttcagcagcgagcccaggaggcagctgcaacacaactcggcttaaaggagatgccatcacactgtttagtacacctgcacaagaattgtatccctcagtatacgttagggcactggcagaagcttgagtctgccaggcaattcctgacagcacacagactgcctctgaccctggcaggcgcatcctacgagggggtcgcggtgaatgattgcatagaatccggtaggcaagcagcggtgagcgtgctcggcacggaacccaattcgtag

SEQ ID NO: 237380 - DNA, 1434 bp, Artificial Sequence
  Description of Artificial Sequence: Synthetic coding sequence
atgggccgtacagttgtcgtgctgggagggggtatcagtgggttggccgcttcttaccacctgagtagagccccttgccctcccaaggtggtcctggtggagtcatccgaacggctaggcggttggatccgctctgtgagaggacccaacggggctatctttgaattgggccctagagggattagaccagccggtgccctaggagcaaggactttgctcttagtgagcgagcttggcctagactctgaagtgttgccagtcaggggcgatcaccccgctgcacaaaaccggttcctttatgtgggaggagcattgcacgctctccccacagggctcagagggctgcttcggccttcccccccatttagtaagcctttgttttgggcaggtctgcgggaactgactaagcccaggggcaaagaacccgacgagaccgtacactccttcgcccagaggcgtctggggccagaggtggctagtcttgcaatggacagcctttgccgcggagtgttcgcaggcaattcccgggagttgtcaattagatcctgctttcctagtttgtttcaagccgaacagacgcaccgctccatactgctggggctgctcctgggcgcagggagaacaccccagccggactcagccctgatccgtcaggcactggccgagcgctggtcacagtggtcactgcggggaggtctggagatgttgccccaagcactcgaaacacacctgactagcagaggggtgtccgtgctgaggggtcaacctgtttgcggattgagtctgcaagctgagggtagatggaaggtaagtctcagggactcatcgctggaagccgaccatgtcatatctgctatcccagcttccgtgctttctgagctactaccagccgaggccgctcctctggccagggccctgtcagccatcactgctgtttctgtcgccgtggtgaatctgcaataccaaggggctcatctgcccgtgcaggggttcggccacctggtgcccagcagcgaggaccccggagtcctaggcattgtctatgactctgtagcctttccagaacaggatggttctccgcctgggttgcgggtgacggtcatgctcgggggatcctggctgcagactctggaggcatcaggatgtgtgctgagccaagaactcttccagcagagggcccaggaagcagccgctacccagctcggactgaaggagatgcctagccattgcttagtgcatcttcacaaaaactgtatcccccagtacacgctggggcactggcagaagctggagagtgccagacaatttctgacagcccaccggctgcccctgaccctggctggtgcttcctacgaaggcgtggcagtgaacgactgtattgagagcgggaggcaggctgctgtgagtgtacttggtaccgagcctaattcttag

SEQ ID NO: 237381 - DNA, 717 bp, Artificial Sequence
  Description of Artificial Sequence: Synthetic coding sequence
atgggcagaaccgtggtagtgctgggcggagggataagtggactggcggcatcataccacttgagtcgggctccttgccctcctaaagttgtattggtggaaagctctgagagattgggaggttggatccggagcgtgcgtggtcccaacggggctatcttcgagctgggcccacgaggaattaggcccgctggtgcacttggcgctagaactctcttactaggtttcgggcatctggtgccttctagcgaggacccaggtgtcttggggatagtgtacgatagcgtggctttcccggagcaggacggatccccacccggattacgagttacggtcatgttgggcggttcttggctccagactttagaggcctcaggctgcgtgctgtcccaagagctattccagcaaagagcccaggaggccgcagctacacaattaggcctgaaggagatgcctagccactgcttggtacacctgcataagactaagaatcagctgaagtggagacaatcacacgaccgaactgtggagtggcctaaggagtaccccggtcgctcacggaagcaggcaccctctattctccacgtacctggttgccagctcctgcgctgtcgtgaccgtgatcatctgggtgcggtctcggaacagccaaggagctcagctgaatcgcgtgtcggagtggccagtagtaccttcagtacattccctctgttctag

SEQ ID NO: 237382 - DNA, 1335 bp, Artificial Sequence
  Description of Artificial Sequence: Synthetic coding sequence
atgggaagaacggttgtggtccttggcggaggcatttcaggtctagcagcatcttatcatctctctagggccccatgtccccctaaagtagtgcttgtcgaaagctcagagaggttaggcggatggattagatcagttcgtgggcctaacggggctatatttgaactgggacccagagggatcaggcctgcgggagccttaggggcaaggacccttctgctggcatgcggcgagcaagtttctgaactcgggttagatagcgaagtcctccctgtgcgcggtgaccatccggcagctcagaaccggttcctgtatgtgggcggagctctacacgctctgcccactggactgagcccgtccctcacacttaaagtcgccagccttgctatggacagcctatgtaggggtgtcttcgctgggaattcccgtgagctttcaatccggagttgcttcccttccctgttccaggctgagcagacacaccgatcaatcctcctcggtctccttcttggagcaggtagaacgccacagcctgattcagctctgattaggcaggctctcgcagaacgatggtctcagtggtctctgcggggtggtctggaaatgctcccccaggctttagaaacccacctcaccagtcggggagtttcagttttgcggggacagcccgtatgcggcctgagccttcaagcggaaggccgttggaaggtttctctaagggattcttcactggaagccgaccatgtgatcagcgccatccccgctagcgtgttgtccgaactcctgcccgctgaagccgctcctctggcaagggcactgagcgcaattactgccgtcagtgtcgccgtggtcaatctgcaataccagggcgctcatttgccagtgcagggtttcggccacctggttcccagctctgaggatcctggtgtattagggatcgtctacgactcggtcgccttcccggaacaggacggcagtccacccggacttagggtgacagtgatgcttggcggttcttggctgcagacactcgaagcttctgggtgtgtgctcagccaagagcttttccaacagagggcacaggaagccgcagccacgcagttggggctgaaagaaatgcccagtcattgccttgttcatctccacaagaactgcatcccgcagtataccctggggcattggcaaaaacttgagagtgctagacagtttctcaccgctcaccgcctgcccctcaccctcgccggtgcaagctacgaaggcgtcgctgttaatgactgcatcgagagtgggagacaggcggcagtaagcgtgctcggcacagagcccaattcctag

SEQ ID NO: 237383 - DNA, 144 bp, Artificial Sequence
  Description of Artificial Sequence: Synthetic coding sequence
atggacattctcaagtcagagattcttcgtaaaaggcaacttgtggaagaccgaaacctactatcagaaagcatgtgtgctaacgacgcatacctgcagatggctattgggaatgccccttggcccattggggtaaccatgtag

SEQ ID NO: 237384 - DNA, 504 bp, Artificial Sequence
  Description of Artificial Sequence: Synthetic coding sequence
atgatccgaacgtttcccggagagaacaagaagtattttaagaggagcgaactagccaaaaaagaggaggaagcctacttcgagcgttgtggctataaaatccagcctaaagaggaagaccagaagcctctcaccagttcgaacccggttctcgagttggagctcgcagaggagaaactgccaatgactctcagtagacaggaagtaatacgacgtcttcgggaacgaggagaaccaattcgcctattcggcgaaaccgattatgatgcattccaacgcttgcgcaaaatcgagatattgactcccgaggtgaataaaggtttgcgaaacgacttaaaggccgctctggacaaaattgaccagcaatatctgaacgagattgtgggaggtcaggagcccggagaggaagacacccaaaacgacctgaaggtccacgaggaaaataccactatcgaggagctggaggctttgggcgaaagcctcgggaaaggggatgaccactag

SEQ ID NO: 237385 - DNA, 750 bp, Artificial Sequence
  Description of Artificial Sequence: Synthetic coding sequence
atgatccgtaccttccctggggagaataagaagtactttaagaggagcgaattggccaagaaggaggaagaggcatacttcgaacgctgtggatataaacccatcaatgagaagccatcaggtgaaattcagccgaaagaagaggatcagaagcctctcacctcttcgaacccagtgttagagctcgagcttgcagaggagaagcttccaatgactctgtctcggcaggaagtcatcagacgattgagggaacgaggcgaacccattcggctgttcggagaaacagattatgatgcatttcaacgacttcgaaagatagaaattctcacccctgaagtgaataaaggattgcgaaacgacctgaaagcggctttagacaaaatcgaccagcagtacctgaacgaaatagtgggagggcaggagccaggcgaggaggacacccaaaacgatcttaaggtgcatgaagagaacaccaccatcgaggagttagaagctctgggagaaagtctcgggaaaggggacgatcacaaggacatggacattatcactaagtttcttaaatttctgctcggagtatgggcaaaagagctgaacgctcgcgaggattacgtgaaaagatctgtgcagggcaagctgaatagtgccacacaaaaacaaacagagtcatacctccggcctctttttaggaagctgaggaagagaaacctccccgcagatatcaaggagagcattaccgatatcatcaagtag

SEQ ID NO: 237386 - DNA, 1029 bp, Artificial Sequence
  Description of Artificial Sequence: Synthetic coding sequence
atggatattctgaaaagtgagatacttaggaaacgccagctggtggaagatcgcaaccttctcgtggaaaataagaagtacttcaagcgtagtgaactggccaaaaaagaggaagaggcttacttcgagcgttgcggttacaagatccagcccaaggaagaggatcaaaagcccctcactagttctaatccggtgctagaactcgaacttgccgaagaaaaattacccatgactctgagccggcaggaggtcatccgtcgcctgcgggagcgcggagaacccatcagattgtttggcgagactgattacgatgccttccagcggctgcgcaagattgagatcttgacaccagaagtgaataagggactgcgtaacgacctgaaggccgctctggacaaaattgaccagcaatacttaaacgagatcgtcggcggtcaggagccgggtgaggaggacacccagaacgacctgaaggtgcacgaagaaaacaccaccattgaagagctggaggctttgggcgaatctctcggtaagggcgatgaccacaaggacatggatatcattacgaaattcttaaagttcctgctcggcgtttgggccaaagaattgaacgctcgcgaagattacgtcaagcggtccgtacaggggaagcttaacagcgcgactcaaaagcagactgaatcctaccttaggccactctttcgcaaactcaggaagcggaacctccccgctgatattaaggaatccattacggatattattaagttcatgctacagagagagtacgtaaaggccaatgatgcatatctgcagatggccattgggaacgccccttggccaatcggtgtgaccatggtcggtattcatgccagaacaggtagggaaaagatcttctccaaacatgtcgcccacgtattgaacgatgagacgcaacgcaaatacatccaaggactcaagagactcatgacaatctgccaaaaacacttcccgacagacccctcaaaatgcgttgagtataacgccttatag

SEQ ID NO: 237387 - DNA, 750 bp, Artificial Sequence
  Description of Artificial Sequence: Synthetic coding sequence
atgattaggacgtttcctggagagaacaagaaatacttcaaaaggtctgagctggccaaaaaagaggaggaggcttattttgagagatgtgggtataaacctatcaacgagaaaccatccggcgagatccaacccaaggaggaggaccaaaagccactcactagctcaaatcccgtcttagaactcgaactggccgaggaaaaacttccaatgactttatcccgacaggaagtcattaggcgcctgagggaaaggggggaacccataagactattcggggagaccgactacgatgccttccagcgcctccgtaaaattgagattctgactccggaggtaaacaagggcctgcgcaacgaccttaaggcggctctggacaaaatagaccagcagtacctgaacgagattgtgggtggacaagaaccaggggaggaagatacacaaaacgatctgaaggtccacgaggaaaatacaaccattgaagagctcgaggcacttggcgagtcactgggtaaaggagacgatcacaaagatatggatattataacgaagttcttgaagtttctgctcggcgtgtgggccaaagagctgaatgctcgagaagactacgtgaaaagaagcgtccaagggaaactgaacagcgctactcaaaaacagaccgagagctacctgcggcctctctttagaaaattgcgaaagcgcaacctcccggcagacattaaggagtccataacggatataattaagtag

SEQ ID NO: 237388 - DNA, 1083 bp, Artificial Sequence
  Description of Artificial Sequence: Synthetic coding sequence
atggatacacctctgaggaggtcccgtagactcggaggactcagacccgagtcccccgaatcgctgacgtctgtctctcgaacaaggcgagcacttgtcgagttcgaatccaacccagaggagacccgcgaaccaggtagccctcccagtgtgcagcgagcaggcctcgggtctcccgagcgcccacccaagacctctccgggaagtccccgtctacagcagggagcagggctggaatccccgcaagggcagcctgaacctggtgcggcatccccccagaggcagcaggatcttcacctggaatcgccccagagacaacccgagtactcccctgaatccccacgttgtcagcccaagccttccgaggaggccccaaaatgcagtcaagatcagggcgttttggcttctgaactagcacagaacaaagaggaactaacccccggagctccccagcaccagctgccccctgtgcctggttcccccgagccctacccagggcagcaagccccagggccagagccctcccagccattgttagagctgaccccgcgagcaccaggaagtcccagaggacagcacgaaccctctaaaccaccaccagctggcgagaccgtgaccggaggatttggagctaaaaaaagaaagggttcctcctctcaagctccggcttcaaaaaaacttaacaaggaggaactgcccgtcatccctaaaggaaaaccgaaatcaggacgagtctggaaggaccggagtaagaaacgcttttctcagatgttgcaagataaaccattaaggacatcctggcagcgcaaaatgaaagagagacaggagcggaaactggccaaagattttgccaggcacctcgaggaggaaaaggaaagacgcagacaggagaaaaagcagcgtcgagctgagaacctgaaacgtagactagagaacgaacgcaaggccgaggtggtccaggtcatccggaacccagcaaagctcaaaagagctaaaaaaaagcagctaaggtctatcgagaaaagggataccctggctcttctgcaaaaacaacctccgcagcagcctgccgctaaaatttag

SEQ ID NO: 237389 - DNA, 1095 bp, Artificial Sequence
  Description of Artificial Sequence: Synthetic coding sequence
atgtcacttgctgacgaactgctggcagacttagaggaggcggcagaagaagaggagggcggttcctacggagaggaggaagaggagccagctattgaagacgttcaggaagagactcagctggacctgtcaggggattccgttaagaccatcgcaaagttatgggactctaaaatgttcgcagaaattatgatgaagatcgaggaatacataagcaaacaggctaaggctagcgaagtgatgggccctgtggaggctgcacccgaatatagagtgatcgttgacgctaacaacttaactgtggagatcgaaaatgaactgaacatcattcataagttcattagagataaatactctaaacgcttccctgagctggagagccttgtgcccaacgccctggattatatcagaactgttaaggaactgggaaattccctcgataagtgtaagaacaacgaaaaccttcaacagatcctcacgaacgctacgatcatggtagtgagtgtgaccgcttccacaacacaggggcagcagctgagcgaggaagagctggaacgactggaagaagcctgtgacatggccttagagctcaatgcatccaagcatcggatctacgaatatgtcgagagccgaatgagctttatagcgcctaacctctccataatcataggggctagcactgctgctaagatcatgggtgtagcaggagggctcacaaatctgtccaagatgccggcatgcaatatcatgcttctgggcgctcaacgaaagacactttctggcttttccagcacttctgtcctaccgcataccgggtatatctatcattccgatattgtgcagtctctgccccctgatctacgccgaaaagccgctagactggtagccgctaagtgtaccttggctgctagagtcgattcttttcatgagtccactgagggaaaagtgggctacgagttgaaggacgaaatcgagagaaagtttgataaatggcagaggcgcaggtggttgcgcccaaccagatcaatttcacccgcttggttgagtagctccaggtctcgggcaagaagagtcgctctatgcccacctgagtag

SEQ ID NO: 237390 - DNA, 1500 bp, Artificial Sequence
  Description of Artificial Sequence: Synthetic coding sequence
atgagtctcgctgacgaactgctcgctgacctcgaagaagcggctgaagaggaagaaggaggctcctacggcgaggaagaggaagagcctgccattgaagacgtccaggaggagacccagcttgacctgagcggagatagcgtcaaaaccattgcaaaactgtgggattctaagatgtttgccgaaattatgatgaaaatcgaggaatatatcagtaagcaagctaaggcgtctgaagtgatgggccctgtggaagccgcacccgagtaccgagtaatagttgacgctaacaacctgaccgtcgagattgaaaacgagctgaacataatccacaaatttattcgtgacaagtattcaaagagatttcccgagctggagagtctggtacctaacgcccttgattacattaggaccgtgaaggagctcggaaactctttagacaaatgcaagaacaacgaaaatctacagcaaatactgacgaacgcaaccataatggtggtgagcgttacagcctctaccactcaagggcagcagttaagcgaggaggagctggaaaggctggaggaggcatgcgacatggctctcgaactaaatgcctccaagcacagaatctatgagtatgtagagtccagaatgtcctttattgcccctaatctaagtattatcatcggcgctagtacggctgccaagattatgggggttgcaggcggtctaacaaacttgtctaaaatgcccgcatgtaatatcatgttgctgggtgcgcagaggaaaacccttagcggcttttcctctacttccgtgctgccccataccggatatatatatcacagcgacatagtccagtccctcccacctgacctaagaagaaaggcggcacgtctggtcgcagccaaatgcaccctggctgccagagtcgactccttccatgagagcaccgagggaaaagtgggctacgagctgaaggatgagatcgagaggaaattcgataagtggcaggagccccctcctgtgaagcaggtcaagcctctccctgcacccctggacggtcagcgaaagaaacgcggaggacgaagataccggaagatgaaagaacgattgggcttaaccgaaatcaggaagcaagcaaatcgaatgagctttggagaaattgaagaggacgcctaccaggaagatctcggcttttccctaggacacctgggaaagagcggttctgggagggtgaggcagacgcaggtgaacgaggccacgaaggcgagaatctctaagaccctccaacgtactctgcagaaacagtctgtcgtttacgggggaaaatccacgattcgggatcgctcctctggtaccgcgtcctctgtcgcctttacacctctgcaggggctcgagatcgtcaatcctcaggctgccgagaaaaaagttgctgaggcgaaccagaagtactttagcagcatggctgagtttctgaaggtgaaaggcgagaagtctggactgatgagtacctag

SEQ ID NO: 237391 - DNA, 1353 bp, Artificial Sequence
  Description of Artificial Sequence: Synthetic coding sequence
atgagcctcgcggacgagctgctagccgacctggaggaggccgctgaggaagaagaaggaggctcctacggagaggaggaggaggagcccgcaatcgaggatgttcaagaggaaacacagctggacctgagcggcgatagtgtaaagacaatcgccaagctgtgggactcaaaaatgttcgccgaaatcatgatgaagatcgaggagtatatctcaaaacaggcaaaggcctctgaggtgatgggcccagtggaggccgctcccgaatacagagtgatcgtggatgcaaacaacctgacggtcgagatcgaaaatgagctgaatatcatccacaaattcattcgagataagtactccaagaggtttccagaacttgagtctttggtgcccaacgcgctagattacatcagaacagtaaaggaactggggaattccctagacaaatgcaagaacaacgagaatctgcagcagattctgactaatgctactatcatggttgtcagcgtgaccgcaagtacaacacagggacaacagctgtccgaggaagaactggaaagactcgaggaggcatgtgatatggcgctagagctcaacgcctctaaacatcggatttatgagtacgtagagtctcgaatgagcttcatagcccctaatttgtctatcatcattggggcaagtaccgctgccaagattatgggagttgctggaggcctcactaatctgagcaagatgcccgcttgcaacattatgttgctgggcgcacagagaaagaccttgtctggatttagcagcacatctgtgctgccacacaccggatacatttatcactcagacattgtccagtcactgccacctgacctgcggcgaaaggcagcacgacttgtggccgcaaagtgcacgttggccgctcgggttgactccttccacgagtctaccgaaggaaaggtcggctatgagctaaaagatgagatcgagcgcaaatttgacaagtggcaagagccaccccctgtcaagcaggtgaagcccctgcccgcacccctggacggacaaaggaagaagcgcggtgggagacgctaccggaaaatgaaggaacggctggggctgacagagatcaggaaacaagccaatcgaatgagttttggagagattgaagaggatgcctaccaggaggatctgggtttctcactcgggcatctcgatgccgcagccgaccccgctgaagccgagcgccgtatatggagagaggtccaccatcccagacctctgctgggtcacggcctgcaacgaggcctccacccaaccccagggcctggggactgtgagcctactggtggcagggaggagggtgggtag

SEQ ID NO: 237392 - DNA, 831 bp, Artificial Sequence
  Description of Artificial Sequence: Synthetic coding sequence
atgagtctggctgatgagttgcttgctgacctcgaggaggcggcagaagaagaagagggcggttcctatggagaggaggaggaggaacccgcaatagaggatgtgcaggaagaaacgcagcttgacctaagtggtgacagcgtcaaaactattgccaaactttgggatagtaaaatgtttgccgagattatgatgaagattgaagaatacatttcaaaacaggctaaagcttccgaggtcatgggtcccgtggaggctgcaccagagtacagggtcatagtagacgccaacaacctaacagtcgagatcgagaatgagctcaacatcattcataagttcatcagggataagtacagtaagcgattcccggaactcgagtcacttgtacctaatgccctggactacatccggacggttaaagagcttggcaattcattggacaaatgtaaaaacaacgaaaatctgcagcagatccttactaatgctaccatcatggttgttagcgtgactgcctcaactacccaaggacaacagctgtccgaggaggagctcgagagacttgaggaagcatgtgacatggccctcgagctcaacgcatctaagcacaggatttatgaatatgtagaatctcgcatgagctttatagcccctaatctgtctatcatcattggagcaagcaccgctgcgaagatcatgggagtggccggaggactaaccaacctgtcaaagatgcccgcatgcaacattatgctgttaggggcacagcgcaaaaccctctccggattctctagtacctccgttcttccacacaccggatatatctatcattag

SEQ ID NO: 237393 - DNA, 855 bp, Artificial Sequence
  Description of Artificial Sequence: Synthetic coding sequence
atgtctctggccgatgaacttctggccgatctcgaggaagccgctgaggaagaagaaggtggctcttacggagaggaagaggaggagccggctatcgaggatgttcaagaggagactcaactcgatctgtccggggactccgtgaagaccattgctaaattgtgggatagcaagatgtttgccgagattatgatgaagatagaagaatatatcagtaagcaagcaaaggcctccgaggttatgggtccagttgaagcagcccctgagtaccgtgtcatcgtggatgcaaataatctcaccgttgagatcgaaaacgaacttaacatcatccacaaattcatcagagataaatattctaagcgattccctgagctggagtctctggtgcctaatgccctcgactacattaggactgttaaggaactcggaaattctctggacaagtgcaagaataacgagaacttgcagcagattctgaccaatgctaccattatggttgtttccgtcaccgcttcgactacccagggtcagcagctcagcgaagaggaactggagagattagaggaagcatgtgacatggccctggagttgaacgcctctaagcaccggatttatgagtacgtagaaagcagaatgagctttatagcaccaaacctgagcattataatcggcgctagcactgcagccaagatcatgggagtggcaggcggactgacgaacctctctaaaatgcccgcatgcaatatcatgttgcttggggctcagcgaaagaccctgtcaggcttttcttcaacaagcgtgctgccccacactgggtatatctaccactcggacatagtacagagtctgccttag

SEQ ID NO: 237394 - DNA, 786 bp, Artificial Sequence
  Description of Artificial Sequence: Synthetic coding sequence
atgtccctagccgacgaactgttggccgatctggaggaggctgcagaagaggaggaaggcggttcttatggcgaggaggaggaagaacccgcaatagaagacgtacaggaggagacccagttagatcttagtggcgacagcgttaagaccatcgcaaagctgtgggatagtaagatgtttgctgagatcatgatgaagattgaagaatatatctccaagcaggccaaggcatcagaggtcatgggaccggtagaagcagcccctgaatatcgggttatcgtagacgcgaataatttgacagtcgaaattgagaatgagctaaacattatccacaagttcattcgggataaatattccaaacggttccccgagctcgagagtctggtgccaaatgcccttgactacatccggaccgttaaagaattgggcaactccctcgataagtgcaagaacaacgagaatctccagcagattttgaccaacgctaccatcatggtggtgtcagtcaccgcgtccactacgcagggacagcagctttcagaggaggaactcgaacgcctggaggaagcatgcgacatggcgctggagctgaatgcaagcaagcaccggatttacgagtatgtggagtcacgaatgtccttcattgctccgaacctatcaatcattataggggcatccacggcagctaaaatcatgggtgtggccggaggactgacaaacctgtcgaaaatgcccgcatgcaatatcatgctcctcggggcacaacggaagactttatccgggtag

SEQ ID NO: 237395 - DNA, 1569 bp, Artificial Sequence
  Description of Artificial Sequence: Synthetic coding sequence
atggccagtagtagggcctcatccacccaggcgaccaagactaaggcccctgacgatctggtggcgccagtggttaagaaaccacacatctattatggcagcttggaggaaaaggagagagaacgtctggcgaaaggtgagtctggtatactgggaaaagacggtctcaaagctggaattgaagctggaaatattaatatcaccagtggcgaagtgttcgaaatagaggagcatattagtgaacgccaggcagaggtgctggcagagtttgagagacggaagagggccaggcagattaatgtgagtaccgatgacagcgaggtaaaagcatgcctaagagccttgggggaacccatcactctcttcggcgaggggccagcagaacgcagagaaaggctgaggaacatcctttccgttgttggaactgatgctcttaaaaaaacaaaaaaggatgatgaaaaaagtaaaaagtccaaagaggagtaccaacagacctggtaccacgaaggcccaaatagcttaaaggtagccaggctctggatcgctaactattctttgcccagggcgatgaaacggctcgaggaagcaaggctacacaaagagattcctgaaaccacacgaacctcacaaatgcaggaacttcataaaagtctgcggagcttgaacaatttctgtagtcaaatcggtgacgataggcccattagttattgtcatttcagtccaaactccaagatgctcgctactgcctgctggagtggcctctgtaaactctggagcgtccctgattgtaatttgctccacactctgagagggcataacaccaatgtcggggcaattgtgttccaccccaaatcaaccgtaagcctggacccaaaggacgtgaacttggcttcctgtgcagccgatggatcagtcaaactgtggagcttagattccgacgagcctgtggcagatatagagggtcacacggtgcgtgttgcacgagtcatgtggcatccttccggccgattcctcggtacaacttgctacgacaggtcctggcggctgtgggatctggaggcccaggaagaaatcctgcaccaggaaggtcactcaatgggggtgtacgatatagcctttcatcaggatggcagtctcgccggaacgggagggcttgacgcctttggtagggtgtgggacctgagaaccggacggtgtatcatgtttctcgagggccacctcaaagaaatctacggaattaacttctcccccaatggatatcacatcgcgaccggctcaggcgataatacatgtaaggtgtgggacctacgccagaggaggtgtgtgtacaccatccctgcccaccagaacctagtcacaggagtgaagttcgaaccaattcacggcaacttcttgctcacgggcgcttacgacaatacagccaaaatatggacccacccaggatggtcaccgcttaaaactttggccggacatgagggcaaggtcatgggactggatatctcatccgatggacagctgatagctacatgtagctacgaccgaacatttaagctgtggatggcagaatag

SEQ ID NO: 237396 - DNA, 1566 bp, Artificial Sequence
  Description of Artificial Sequence: Synthetic coding sequence
atggctagcagccgggcatcaagcactgcaacaaagaccaaggccccagatgatcttgtcgctcccgtagtcaagaaaccccacatctactatggatccctggaagaaaaggagagagagcgcctggcgaagggtgagagtggcatccttggaaaggatggattgaaggcgggaatcgaagcagggaacatcaatatcaccagcggagaagtgttcgagatcgaagaacacatttcagagcgacaagccgaagtcctcgccgaattcgagagacggaagcgtgctcgccaaatcaacgtgtccaccgacgattcagaagtgaaggcctgcctacgagcacttggcgaaccaatcacactgtttggcgagggcccagcggagcggcgtgaacggctcagaaacattctgtcagtggttggtacagacgccctgaagaaaaccaagaaggacgacgagaaaagcaaaaaaagcaaagaggaataccagcagacatggtaccacgagggcccaaattctctgaaagtggccaggctgtggattgccaactattcattaccaagggccatgaaacgcctggaggaggccagactacataaggaaattcccgaaaccacccggacctcccagatgcaggaactccacaagtcattgcgatccctgaacaacttctgttctcagatcggggatgataggcctatttcttactgccacttctcccccaattccaaaatgcttgccacagcttgttggagtgggctgtgcaagctgtggtcagtgcccgattgcaacttattgcatacactgcgcggacacaacacaaacgttggcgcaatcgtcttccacccaaaatccaccgtgtctttagaccctaaggatgtgaatttggccagttgcgccgctgacggctctgtcaaactgtggtccttggattcggacgagcctgtcgcagatatagagggtcatactgtgagagtggccagagtgatgtggcacccgtcggggaggtttctaggtactacatgctatgataggagttggcggctgtgggacctagaagcccaggaagagatactgcaccaggagggacatagcatgggggtctatgatattgcattccatcaggacggtagcctggccggtacaggcggactcgatgcctttggcagagtgtgggacctgcggactgggcgatgcatcatgtttctcgagggtcacctgaaggagatctatgggatcaatttctcccctaatggctatcacattgcaacaggctcgggtgataacacatgcaaggtatgggacctgagacaacgcaggtgcgtctacacaattccagctcatcaaaacctggtcaccggagtgaaatttgagccgattcatggaaattttctattgactggggcatacgacaatacggccaagatctggactcaccctggatggtccccactgaaaaccctggccggacacgagggcaaagtgatggggctggatatttccagcgacggtcagttgatcgcaacctgctcctacgatagaacctttaagttgtggatggcagaatag

SEQ ID NO: 237397 - DNA, 3024 bp, Artificial Sequence
  Description of Artificial Sequence: Synthetic coding sequence
atggcagctgcggagactcagtctctacgcgaacaacctgaaatggaggatgctaactctgagaagtccattaatgaggagaatggcgaagtttccgaagaccagagtcagaataagcattccaggcataaaaaaaaaaagcataaacacagatccaagcataagaagcataagcattcatcagaggaagataaggacaaaaaacataaacacaagcacaagcataagaagcacaagagaaaagagattatcgatgcatccgacaaagaaggaatgtcacccgctaaacggacaaagctggatgatctggccctactggaggacctggaaaagcagcgtgctcttattaaggccgagctggacaatgaactgatggagggaaaggtgcagagtggcatgggtctgatcctgcagggctacgagagtgggtctgaggaagaaggcgagattcacgagaaggcacgtaatgggaatagatcaagcacaaggagcagctcgacaaaggggaagctggagctggtggataacaagatcacaactaaaaagcgtagcaaatctcgaagcaaggaaaggactcggcaccgcagtgacaagaagaaaagcaagggcggtattgagatcgtcaaagaaaaaacaacccgctcgaagagtaaagaaaggaagaaaagcaaatccccatccaagagatcgaagtctcaggaccaggccagaaaatctaaatcccccacgctgaggcggcgttcccaggagaaaatcggtaaagccagatctcctactgatgacaaggtcaaaatagaggataagagcaagtctaaagaccgcaaaaaaagtccaattatcaatgaaagtaggagcagagaccggggtaagaagtcccggagccccgtggatttgcggggtaaaagtaaagaccggaggtctcgaagtaaagaacgcaaaagtaagcggagcgaaactgataaggaaaaaaagcctatcaagagcccatcaaaagatgcctccagtggaaaagagaatcgatccccttctagacgccctggcagatctcccaaacgccgatctttgtcaccaaaacctagagacaagtcccgtaggtcaaggagtcccctgttgaatgacaggcggtctaagcaaagcaagtctcccagccgcaccttaagccccggacggagagctaagtcacggagtttggagcgaaagagacgggagcccgaacggaggagactctcttcacctaggacccgtccccgagatgatatcttgtccagacgagagaggtccaaggacgcttcacctatcaacaggtggtccccgactcgcagacggtctaggtcacccatccggaggagaagtcggtcacccctgcggagatctcggagccctaggagaaggtccagatccccacgccgacgagataggggtagaaggtcacgctcccggcttcggaggcgctctcgatcaagaggaggacgccgtcggagatcccgatcaaaagtgaaggaggacaagttcaagggtagcctgtccgaaggcatgaaggtggagcaggaatccagttctgatgacaacctcgaagattttgatgtagaagaggaggacgaggaggccttgatcgagcaaaggagaatccagcgccaagccattgtacaaaagtataagtacctggccgaagattctaatatgtcagtacctagcgagccctcctccccacaaagctcgacacggacccggagtccatctccggacgatatcctggagagggtcgctgcagatgttaaggagtatgaacgcgagaacgtggacacctttgaggcttccgttaaagccaaacataaccttatgactgtggaacagaataacgggagttcacaaaagaagctcctggcgccagatatgtttactgagagcgatgatatgttcgccgcatattttgatagtgcgagactgcgggctgctggcatcggaaaggacttcaaagagaatcctaacctaagagataactggacagatgctgagggatactacagagtcaatatcggggaggtcctggataaacgctataatgtctacggctataccggccagggcgtgttcagcaacgtggtgcgggcacgagacaacgctcgcgcaaatcaggaggttgcggtgaaaatcatccgcaataatgagctgatgcagaaaacaggccttaaagagcttgagttcctgaaaaagctgaacgacgccgacccagatgacaaatttcactgcctccggctgtttaggcacttctaccataagcagcacctgtgtttagtgtttgaaccactttcgatgaatctgcgcgaggttctaaaaaaatatggaaaggacgtgggtctacacatcaaggccgttcgaagctattcccagcagttgttcctggcactgaagctgttaaagcggtgtaatatccttcacgcggacatcaagcccgacaacatactggttaatgaaagcaagacaatcctgaaactgtgcgatttcgggtctgcttcccatgtagcagataatgatatcaccccgtatctcgtttcgcggttctatcgagcgccagaaatcattatcggtaaaagctacgactacgggattgacatgtggagcgtggggtgtaccctctacgaactgtacaccggcaaaatattattccctgggaagactaataaccatatgcttaaattggccatggacctcaaggggaaaatgcccaataagatgatcaggaagggggtcttcaaggaccagcacttcgaccaaaacttgaatttcatgtatattgaggtcgataaagtaaccgagcgcgagaaggtcaccgtcatgagtaccatcaacccaacaaaggacctgcttgctgaccttatcgggtgtcagcgcctcccggaagatcagaggaaaaaagtgcaccagctcaaagacctattggaccaaattctgatgttagaccccgcaaagcgaatatctatcaatcaggcccttcagcacgcctttatacaggagaaaatatag

SEQ ID NO: 237398 - DNA, 3024 bp, Artificial Sequence
  Description of Artificial Sequence: Synthetic coding sequence
atggccgcagccgagacccagagcttgcgggagcagcccgaaatggaagacgccaattcagagaagtcaattaacgaagaaaatggcgaagtgtctgaagaccagtcgcaaaacaagcattccaggcacaaaaagaaaaaacacaagcatcgtagtaaacacaagaagcataagcattctagcgaggaagataaagataaaaagcataaacacaagcacaagcacaagaagcacaaacggaaagagatcatcgatgcatccgacaaagaaggcatgtcacccgctaagagaactaagctggacgatctggccctgctcgaggatttggaaaaacagagggcactgattaaagccgagctggataatgagctgatggagggaaaggtccagtccggaatggggctgattctacaggggtacgaatctgggtctgaagaggagggagagattcacgagaaagctcggaatgggaaccggagttccactaggagctcttccaccaagggaaagcttgaattagttgacaataagataaccacgaagaagcgaagcaaatccagaagtaaagaacggactcggcaccgcagtgacaagaagaaatctaaaggaggcattgaaatagtcaaagagaagacaacacgatccaagagcaaagagaggaagaagagtaagtccccctcaaagagaagcaagagtcaggaccaggcgcgtaaaagcaagagtccgaccctgcggagacgttcccaagaaaagatcgggaaggccaggagccctactgatgataaggtgaagattgaagataagagtaagagtaaggacaggaaaaagtcccccataattaatgagtcccggtcccgcgaccgcggtaagaaaagccgttctcccgttgacctgcgcggtaaaagtaaggatagaaggtcgaggtctaaagaacgaaaatcaaaacgttctgaaaccgataaagagaagaaacctatcaaatcacctagcaaggatgctagcagtgggaaggaaaatcggtctccttccagaaggccaggaagatctccgaagagaagaagcctgagccctaaacccagggacaaaagtagaaggagccggtccccactgcttaacgatagacgttcaaagcagtccaagtctccttccagaacgctgtccccgggaaggagagcaaagagcaggtcccttgaaagaaaacgaagggaaccggaacgcaggcggctgagcagtcctcggacacgtcccagggacgacattttgtctcggagagaacggagcaaagatgcttcccccattaaccggtggagtcctacccgccgtcgaagcagaagcccgatcaggcgccgatcacgatcccctcttcgaagatcaaggagtccacggaggaggagccgatctcccagacgaagagacaggggaagacgaagccgatccagattaaggagacggtcaagatcccgcggtggcagacggcgtagaagcagatcaaaggtgaaggaggataagtttaaaggaagcttgtctgaggggatgaaagttgagcaagaaagctctagtgacgacaatttggaggattttgacgtggaggaggaggatgaggaagctctgatcgagcagcgccgtatccagcgccaggctatagtccagaagtacaagtacctcgccgaagactccaacatgagcgttccctcagagccaagtagcccccagtcatcaacaaggaccagaagtccctctcccgacgacattcttgaaagggtggcagctgacgtgaaggaatacgagagagaaaatgtggacacctttgaggcatcggtgaaggcgaaacataatctgatgacagtggagcaaaacaacgggagttcacagaaaaagctgctcgcaccggacatgttcaccgaatctgacgacatgtttgccgcttacttcgacagcgctagactacgggcagccggtattgggaaggactttaaggaaaatcctaatttgcgcgataattggaccgatgcagaaggatactatcgagtaaacatcggagaggtgcttgataagcggtataacgtgtacgggtacacgggacaaggcgtgttttcgaacgtggtcagggcccgtgacaacgcaagggctaatcaagaggtcgccgtcaaaattattagaaacaacgaacttatgcagaagacggggttgaaggaattggaattcctaaaaaagttgaacgacgcagatccagacgataaattccactgtttgcggttgttcaggcatttctatcacaagcagcatctgtgtctggtatttgagcccctcagcatgaatctccgggaagtgctgaagaaatatgggaaggacgtcggcttgcacattaaggctgttagatcttactctcagcagctctttctggccctgaagctgctgaagagatgcaacatcctgcatgcagacataaagccagataatatcctcgtcaacgaatcgaagactatcctcaagctgtgcgacttcggcagcgcttcgcatgtggctgataacgatatcacgccctacctggtgagccggttttatagggcccctgagatcattatcggtaagtcgtacgattatggcatcgatatgtggtctgtgggctgtactctgtacgaactgtacaccggaaagatcctgtttcctggtaaaacaaataaccacatgctgaaacttgctatggacctgaaggggaagatgccaaacaaaatgatccgcaaaggggtgtttaaggatcagcactttgatcagaatctaaatttcatgtatatcgaggttgataaggtgacagagagagaaaaagtgacagtcatgtctacgatcaatccaactaaggacctcctggccgaccttatcgggtgtcaaaggcttccagaggaccagcgcaagaaagtgcaccagctgaaggatctgctggatcagatcctgatgctcgatcctgccaaaagaatctccattaaccaggccctgcagcacgccttcatccaggagaaaatctag

SEQ ID NO: 237399 - DNA, 2982 bp, Artificial Sequence
  Description of Artificial Sequence: Synthetic coding sequence
atggaagatgcaaatagcgaaaagagcattaacgaggaaaacggtgaggtgagtgaagaccaatctcagaacaaacacagtaggcacaagaagaaaaagcacaagcatagatcgaaacataaaaaacacaagcattcgagtgaggaggacaaagacaagaaacataagcacaagcacaagcataagaagcacaaaaggaaagagattatcgacgcttcagataaggaaggaatgtcacctgccaagcgaaccaagctggatgatctagcactgcttgaagatctcgaaaagcagagagccttaataaaagccgagctcgacaatgaactgatggaggggaaagttcaaagcggcatgggacttatccttcaaggctatgagtccggtagcgaagaagaaggggagatccacgaaaaagctaggaatggcaatcggagtagcacccgcagttcttcaacgaagggaaaactcgagctggtcgataacaagatcacgacaaaaaagcgttcgaagagtagaagcaaagagcggacaagacataggagcgacaaaaagaaatcgaaaggtgggatcgaaatcgtcaaagagaagaccactcgcagcaagtcaaaagagcgcaaaaaatctaagtcacctagtaaaagatctaaatcccaggatcaggctagaaaatccaagtccccaaccttaaggagacggtcacaggaaaagataggcaaagccagatcccctaccgacgacaaggtgaagatcgaagacaagtcaaaatctaaggaccgaaagaaaagcccaatcataaacgagagtcgctcacgggaccggggaaagaaaagcagaagccctgtggatctgcgaggcaagagtaaagatcgcaggagcaggtccaaggagcggaaatcaaaacgtagcgagactgacaaagaaaaaaagccgataaagagcccttccaaagacgcaagctcagggaaagaaaaccgatccccttcccggagaccaggacggagccccaagcgcaggagcctcagtcctaagcccagagacaagtcacgccgaagccggtctccgctgcttaacgatagaaggagcaagcaatctaagagtccgtcacgtactctgtcccctggccgaagggccaaatcacggtctcttgaaagaaaacgacgggaacccgaacgacgcagactgtccagcccccgtactcggccacgggatgatattctctcgcggcgtgagcgcagcaaggacgccagcccaatcaaccggtggtcccccactcgacgccgtagtagatcccccattcggaggcgctctaggtcaccactccggaggtcccggtcccccagaagacgctctcgcagccctcggcgacgcgatcggggtcgaaggtcacgatcaaggcttcgcaggcgttctcgatcccggggaggtcgcaggcggagatcacgatcgaaggtaaaagaagacaagttcaagggctcattgtcagaaggtatgaaagtggagcaagaatcctccagtgacgataacctggaggactttgacgtggaggaggaagatgaggaagcactgatcgaacaacgtcgtattcaacggcaggcaatagtgcagaagtacaaatatctcgcagaggattccaatatgagtgtcccatctgagccaagctcaccacagtcgagtacacggaccagatctccaagtcctgacgatatccttgaaagggtcgctgcagacgtgaaggaatacgaaagagagaacgtggacacctttgaggctagcgtgaaagctaaacacaatctgatgaccgttgaacaaaataatggctcctcccagaaaaagctgctcgctcccgacatgttcaccgaatcagatgatatgttcgctgcttactttgactccgccagattgagagccgcaggtattggtaaggacttcaaggaaaaccccaaccttcgcgataactggaccgatgctgagggttactaccgggttaacattggcgaagtcctcgacaagcgttataacgtgtacgggtacacagggcagggagtcttttcaaacgtggtaagagccagggataatgccagagctaaccaagaggtggctgttaaaataattagaaacaacgagttaatgcagaaaactggcttaaaggagctggagttcctgaagaagctgaacgatgccgatcccgacgataaattccactgccttcgcctatttaggcacttttatcacaaacagcatctgtgcttagtgtttgaacccctgagcatgaatctacgagaggtgctgaagaagtacggtaaggacgttggcctgcacattaaagctgttcgtagctattctcagcaattgtttctcgccctcaagctgctaaagcggtgtaatattttgcacgctgacatcaaacctgataacatcttggtaaatgagagcaaaaccatactgaaactctgcgacttcggtagtgcctcacacgtggccgataatgatattacaccctatttagtctctcggttctatagagccccagaaatcatcatcgggaaaagctacgactacggaattgatatgtggtctgttggatgtactttgtatgagctttatacaggcaaaattctcttccctggaaaaaccaataatcatatgcttaagcttgccatggatttgaagggcaaaatgcccaacaagatgattagaaaaggagtctttaaagaccagcacttcgaccagaacttaaatttcatgtatatcgaagtggacaaagttaccgagagggaaaaagttacagtcatgtcaaccattaaccctacaaaagaccttttggcggacctcatcggatgccagcggcttcctgaggatcaacggaaaaaggtgcaccaactgaaggacctgctggaccagatcctgatgctggaccccgctaaaagaattagcatcaaccaggcactccagcacgcatttattcaggagaagatttag

SEQ ID NO: 237400 - DNA, 2820 bp, Artificial Sequence
  Description of Artificial Sequence: Synthetic coding sequence
atgcgaccaggaaccggtgcagaacgcggaggattgatggttagtgagatggagtcacatcccccatcccagggccctggagacggagaaaggagactgtctgggtcatccctgtgcagtgggtcctgggtgtctgctgacgggttccttcgacgcaggccaagtatgggacacccgggaatgcactatgcaccgatggggatgcaccccatgggtcaacgagccaacatgccaccagtccctcacggtatgatgccccagatgatgcctcctatgggcggacctccaatgggacagatgcctggcatgatgagctccgtcatgcccggtatgatgatgtcccacatgtctcaagcctcaatgcagcccgcactgcccccaggtgtaaatagcatggacgtggccgcaggcacctacactctgtacaagtctatgtggactgagcataagtctcctgatggtcgcacatactactacaacacagagacaaaacagtctacctgggaaaaacctgacgacttaaaaacacctgcagagcagctcctcagcaaatgtccgtggaaggagtacaagtctgactccggaaaaccatattactacaattcacaaacaaaggagtccagatgggctaaacccaaagagctcgaagatcttgagggaaaaatgggcaagataaaatactctaaacaggaggagtgcactaccacttctaccgcccctgtgccaacgacagagatccctactacgatgtcaacgatggcggctgctgaagcagccgctgccgtcgtcgcagctgcagctgcagccgcagcagccgcagccgctgcaaacgccaacgcttctacttcagcttccaataccgtaagcgggaccgtgcctgtggtgcctgaaccagaggtcacttctattgtcgcaacagtggttgataacgaaaacacagtaacaatatctaccgaagaacaggcccagctcacttctacaccagcaattcaggaccagagcgtggaagtctcatccaacactggtgaagaaacatcaaaacaggagactgtcgcggacttcaccccgaagaaggaggaggaggagtcacaaccggctaaaaaaacatacacttggaatacgaaggaggaggcaaagcaggcattcaaagagctgttaaaggagaaacgtgtgccctctaacgcgtcttgggagcaggccatgaaaatgattatcaatgatcctaggtactctgccttggctaagctgtctgagaagaaacaggccttcaacgcctacaaggtacagaccgagaaggaggaaaaagaagaggctaggagcaaatacaaggaagcgaaggagtcttttcaaagattcttagagaatcatgaaaagatgactagtaccacccgatacaagaaagctgagcagatgtttggggaaatggaagtatggaacgccatctctgagcgtgataggctggagatttacgaagacgtactgttctttctatccaagaaggaaaaggaacaggctaagcagctgaggaaacgtaactgggaggccctcaaaaacatcctggataacatggcaaacgtgacttactctacaacgtggagcgaggcgcagcaatacctgatggacaacccgacctttgccgaggacgaggagctccagaacatggacaaggaggacgccctgatctgttttgaggagcacattcgggctctcgagaaagaggaggaagaagaaaaacagaaatccctgttgcgagaacggagacgccagcgaaagaatcgcgagtcttttcagatttttctcgatgagttgcatgagcatggacaactccattccatgtcaagctggatggagctgtaccctacaatctctagcgatattaggttcaccaatatgctgggccaacctggatctactgcattagatctatttaagttttatgtggaagacctgaaggcacggtaccacgacgaaaagaagatcattaaagacattctcaaggataagggttttgtagtagaggtcaatacgacctttgaggattttgtggcgatcattagcagcacaaaacgaagcaccaccttagacgcaggtaacattaaactggcttttaatagcctcctagaaaaagccgaggcgagggagcgcgagcgggagaaggaagaagcacggaagatgaaaaggaaagaaagcgcgtttaaaagcatgctaaagcaggccgctccccctatcgaattagatgccgtgtgggaagatatccgggagcggttcgtgaaagagcccgctttcgaggatataacacttgagagtgaacgcaaacgtatttttaaggattttatgcacgtgctggagcatgaatgtcagcatcatcacagcaagaacaagaagcacagcaagaagtcgaaaaaacatcatcgcaagagatcacggtccagatccggttcagacagcgatgatgatgacagtcattctaaaaaaaagaggcagcggtctgagtcaagatcggcatctgaacatagcagctccgctgaatctgaacggtcctacaaaaaaagcaagaagcacaaaaagaagtctaagaagcggcgacacaagtctgacagccccgagtcggatgccgaaagggaaaaagacaaaaaggagaaggatagagagtcagagaaggacagaacacggcagcgctccgaatccaagcataaatcgccaaaaaaaaagaccggcaaagactcgggcaattgggataccagtggcagcgaactatctgagggggaacttgagaagcggagaagaacattgttagaacagctggacgacgatcaatag

SEQ ID NO: 237401 - DNA, 2451 bp, Artificial Sequence
  Description of Artificial Sequence: Synthetic coding sequence
atgtgcagtggaagtgggaggcggagaagtagtctttctcctaccatgaggccgggtaccggcgctgaaagaggaggcctcatgatgggtcatcctgggatgcactacgccccaatgggcatgcacccaatgggtcagcgagctaacatgccaccagtgcctcatggcatgatgccgcaaatgatgccacccatgggaggcccaccgatgggtcagatgccgggaatgatgagttccgttatgcccggaatgatgatgagtcatatgtcacaggcttcaatgcagcccgctctgccccagcttctcagtaaatgcccctggaaggagtataagtctgactccggaaagccatattattataattcacagaccaaggaatcccgatgggccaaaccgaaagagctcgaagatttagaagggtaccaaaatacaattgttgctggttccttgatcacaaaatctaacctccacggtatgcttactgagttgaaatacagtaagcaggaagagtgcacgacgacctcaaccgcgcctgttcctaccacagaaatccccaccaccatgtccactatggctgccgctgaagccgcagccgcagtcgtggcggctgccgctgctgcggcagccgctgcagctgcagcaaacgctaacgcaagcacgtctgcatccaacaccgtgtccgggaccgtacccgtcgtgcctgaacccgaagtgacatcaatcgtcgcgactgtggttgataatgaaaatacagtcacaatctcaaccgaagaacaagctcaattaaccagcacgccagctattcaggatcagagtgttgaagtatcctccaacactggggaggagacctcaaaacaagagactgtggccgatttcactccaaagaaggaggaagaagagagccagcctgctaaaaagacctacacttggaatacaaaggaggaagctaaacaggcgtttaaggagttgctgaaggagaagagggtaccttcaaatgctagctgggaacaggccatgaaaatgatcatcaacgacccacggtactctgcattggctaaactgtccgagaagaagcaagccttcaatgcttacaaagtccaaacagagaaggaagaaaaagaggaagctagaagcaaatataaggaggccaaagagtcctttcagcgcttccttgagaatcacgagaagatgaccagcactacacgatacaaaaaggcagagcagatgttcggtgagatggaggtatggaatgcaatctctgagcgcgaccggcttgagatttatgaggatgtcctctttttcctcagtaagaaagaaaaagaacaggccaagcagttaaggaaacggaactgggaggccctcaaaaacatcctcgataacatggctaatgtgacttactcaaccacgtggagtgaggcacagcagtacttgatggacaatccgacgttcgccgaagacgaggaactgcagaatatggacaaagaagacgcgcttatctgctttgaagagcacattagagcgctcgagaaagaagaagaggaagaaaagcagaagagcctgttacgcgagcgaagacgccagcggaagaacagagagtcctttcagattttcctggacgaactgcatgagcatggccagctacactccatgtcaagctggatggaattataccccaccatcagcagcgatattagattcacaaacatgttggggcagcctgtgttctcactgggctctactgcgctggatctgtttaagttctatgtggaagatctaaaagccagataccatgacgagaaaaaaattattaaggatatactgaaagacaaaggcttcgtggtcgaggtgaatacaacctttgaggattttgtggccatcatctcctcaaccaagcgaagtaccacattggacgcaggcaatattaagctggcctttaatagcctgctggaaaaagccgaggcacgagagcgtgagcgtgagaaagaggaggcgcgaaagatgaaaagaaaggagtcggcttttaaaagcatgctgaagcaggccgcacctcctatcgaattggacgctgtgtgggaggatatccgtgagcggtttgttaaagagcccgcattcgaggatatcacgctagaaagtgagagaaaacgcatattcaaagattttatgcacgttctcgagcacgaatgccagcaccaccactccaaaaataagaagcatagcaagaaaagtaagaagcaccataggaaacgctcacggagcagatctggctccgacagcgacgatgacgatagccactcaaagaagaaaagacagcggagcgaaagtcggagtgcctccgagcactcttcctcagcagaatcagagcgctcatacaaaaagtctaagaagcacaagaaaaagtccaagaagagacggcacaaatccgactccccagagagcgacgctgaacgctag

SEQ ID NO: 237402 - DNA, 2793 bp, Artificial Sequence
  Description of Artificial Sequence: Synthetic coding sequence
atgtgttcaggttcaggtcgcaggaggagttccctgagcccgacaatgcgcccaggtacgggagcagagaggggcggactgatgatgggccacccgggaatgcattatgctccaatggggatgcaccctatgggtcagcgtgccaacatgcctcccgttccgcacggtatgatgcctcagatgatgccaccaatggggggacctcccatgggtcagatgcccggaatgatgtcttcggtgatgcccggtatgatgatgtcgcatatgagccaggcttccatgcagcctgccctccctcccggagttaactctatggacgtggctgccggtaccgcatctggcgcaaaatccatgtggaccgagcacaagtcacccgatggaaggacatattactacaataccgagaccaaacagagcacatgggagaagccagacgacttgaaaacaccagctgaacagctgttgtccaaatgcccgtggaaagaatacaagagcgacagcgggaagccctattattacaacagccagaccaaagaatcacggtgggcaaagcctaaagagctggaagacctcgagggctatcagaatactatcgtggctgggagtttgatcacaaagtccaaccttcacgctatgattaaagccgaagagagttctaaacaagaggaatgcacaacgacatctactgcgccagtgcccacaacagaaattccaaccactatgagtacaatggcggctgctgaagccgcagctgccgtcgtagcagccgcagccgctgccgctgcagcagcagccgctgccaatgccaacgctagtaccagcgcttccaataccgtgagtggcaccgtgccggtggtgcccgagcccgaagtgacctcgatcgtggctaccgtggtagataatgaaaatactgttacaatctctactgaggagcaggcccagcttactagcaccccagctattcaggaccagagcgtcgaagtctcctctaacactggcgaggagacctcaaagcaggaaactgtggccgactttacccctaaaaaagaggaagaggaaagtcagccagcaaagaaaacatacacctggaataccaaagaggaagcaaagcaggcgttcaaagagctgctgaaagaaaaacgcgtgccatccaatgcgtcctgggagcaggcaatgaaaatgatcatcaacgacccaagatactcagcattggcaaaactctcagagaaaaaacaggcctttaacgcatacaaggtgcagacagaaaaggaggaaaaggaagaagcacgcagtaagtataaagaggccaaagagtcattccagcgctttttagaaaaccacgagaagatgacaagcacgactcgatataagaaggctgaacagatgtttggcgagatggaagtgtggaatgcaatctctgaacgggatagacttgaaatatatgaagacgtgctatttttcctgagcaagaaggagaaggaacaagccaagcaactgcggaaacggaactgggaagcattgaaaaatatcctggacaacatggctaatgtaacctacagcacaacatggtctgaagctcagcaatacctgatggataacccaacctttgctgaagatgaggagctacagaatatggataaagaggacgctctaatctgctttgaggaacacatcagagctctggagaaagaggaggaagaggagaagcagaagtctttgctacgagaaagacgcaggcagaggaagaaccgggagtccttccagatctttctggacgagctccatgaacatggacagcttcacagcatgtcttcatggatggagctctacccaacaatctcttccgacatacgcttcacgaatatgttaggtcagcccggatctactgcactcgacctattcaagttctacgtagaagatctgaaagctaggtaccacgacgaaaaaaaaattattaaggacatcctgaaggacaaagggttcgtcgtggaggtgaacaccactttcgaggacttcgtagcgatcatttcgtctacaaagaggtctactaccctcgatgccggaaatatcaaactggcttttaacagcctgctggaaaaagccgaagccagagagagggagcgcgagaaagaagaagcgaggaaaatgaaacggaaggagagtgcttttaaatcaatgctaaagcaagccgctccacctattgaactggacgcggtttgggaggatatccgcgaaagatttgtcaaagagcccgctttcgaagatatcaccttggaatcagagaggaagcgcatcttcaaagactttatgcacgttctggagcacgaatgtcagcaccaccattccaagaacaagaagcatagtaaaaaatctaaaaaacaccaccgaaaacgaagtcgcagccggtcgggttctgacagtgatgacgatgatagccactctaaaaagaaacggcagcggtccgaatctcgaagtgcgagcgaacattcgtccagcgccgaatctgagagaagttacaagaagtctaaaaagcacaagaagaagagcaagaaacggcgtcacaagagcgacagcccagagagtgacgctgagcgggagaaggataaaaaagagaaggatcgcgagtcagagaaagaccggactaggcagaggtctgagtcgaaacacaagtctccaaagaaaaagactgggaaagactcagggaactgggataccagcggaagcgagctctctgagggcgagctggagaaacgccgacgcaccctcctcgagcagctcgatgacgaccagtag

SEQ ID NO: 237403 - DNA, 2481 bp, Artificial Sequence
  Description of Artificial Sequence: Synthetic coding sequence
atggatgtggcagctggtactgcatccggtgcaaaatctatgtggacggaacacaagtcacccgacggccgaacctactactacaacacagagaccaagcagagcacttgggagaaaccagacgatctgaagactccagccgaacaactgcttagtaaatgcccatggaaagagtataaatctgacagtggcaagccctactattacaactcccagacaaaggagtctagatgggctaagcctaaggagctggaggatctagaaggctaccagaatacgatagtcgctggaagcttaattactaaatccaatcttcatggaatgctgaccgagttgaagtacagcaaacaggaggaatgcacgaccaccagtactgccccagtgccaacaacagagattcctaccaccatgtcaaccatggccgctgccgaggccgcagccgcagtagttgccgcagccgcagcagctgcagcagccgcagccgcagccaatgccaatgcaagtacgagcgcttctaacaccgtcagcgggaccgttccagtggtccccgagccggaagttactagcatagtggccaccgtagtcgacaacgagaataccgtaaccatctccacagaggagcaagcccaactgacgtccacgcctgcaattcaagaccagagcgtggaagtttcttctaacacaggagaggaaacttccaaacaggagacagtggctgacttcacacctaagaaagaggaggaagagtcacagccggcaaagaaaacatacacgtggaataccaaggaggaggctaaacaggctttcaaggagttgctgaaagagaagagggtgccttctaacgcgtcttgggagcaagcaatgaagatgattatcaacgaccccagatactcagcattagcgaaactctccgagaagaaacaagcgtttaacgcttacaaagtacagactgagaaggaggaaaaagaagaggcacggagcaagtataaagaggcgaaggagagtttccagagatttttggagaaccatgagaagatgacgtctactacaagatataaaaaggcagaacaaatgtttggagagatggaggtgtggaatgctatctccgaacgcgatcgcttggagatttacgaggatgtgctgttttttttgtcaaaaaaagaaaaagagcaggctaaacagctccgcaaaagaaattgggaagctctgaaaaatatcttggacaacatggccaatgttacctactcgactacatggtctgaggctcagcagtacttaatggacaatcccacttttgcggaggatgaagagcttcagaatatggataaggaggatgctctgatttgttttgaggagcacatcagagcactcgaaaaagaggaggaagaagagaaacagaagtctcttttacgagaacggaggaggcaacgtaagaacagagaatccttccaaatttttctggacgagctgcacgagcacggacagctgcactccatgtcttcatggatggaactctacccaaccatcagctctgacattcgtttcacaaatatgttagggcagccgggatctaccgcgctcgatctctttaaattttacgtcgaggacctgaaagcgagatatcatgatgaaaagaagatcatcaaggacatcctgaaggacaaagggttcgtagttgaggtgaatacaacatttgaggactttgtggccatcatcagcagtaccaagaggagcacaacccttgatgcaggaaacatcaagcttgccttcaactctctcctggagaaagcagaagcaagagagcgggaacgcgagaaggaggaagccaggaaaatgaaacgcaaagaaagtgctttcaagagtatgttgaaacaggccgctcctccaatcgagctggacgcagtttgggaagacatccgagagcggtttgttaaagaaccggcatttgaggacatcacacttgaatcagagagaaagcgcatctttaaggatttcatgcatgtgctcgagcatgaatgccagcaccatcacagcaaaaacaagaaacatagtaagaagtcaaagaagcaccaccgcaaaaggtctagaagtcggtcaggatcagacagcgacgatgacgacagccactccaagaagaaacgccagcggtccgagagtcggagcgcatcagagcacagttcctccgctgaaagcgaaaggtcctataagaaatcaaagaaacataagaaaaaatcaaagaagagacggcacaagtcagattccccggaatccgatgccgaaagggagaaggacaagaaggagaaagatcgtgaatcagaaaaggacaggacccgccagcgctctgagtcaaagcacaagagccccaagaaaaaaacagggaaggacagcgggaactgggataccagcggaagcgaactcagcgaaggagagttagaaaaacggcgacgcactcttctggagcagttggacgacgaccaatag

SEQ ID NO: 237404 - DNA, 1347 bp, Artificial Sequence
  Description of Artificial Sequence: Synthetic coding sequence
atgcggccagggactggtgccgagcggggaggccttatggtctcagaaatggaatcccatcccccaagtcagggcccaggcgatggtgaaagacgcctgtccggcagtagtctgtgctctggcagttgggtatctgctgatggatttctacgtaggagacccagcatggggcatcctggtatgcactatgctccaatgggtatgcacccgatgggtcaacgtgcgaatatgcccccagtcccccatggtatgatgccgcagatgatgccccctatgggaggaccccctatgggccagatgcccggaatgatgtcgagcgtgatgcccggtatgatgatgtctcacatgtcacaggcgagtatgcaacctgccctgcctcctggggtcaactctatggatgtggcggctggaaccgcctctggtgcaaagtcaatgtggaccgagcataaatcacccgatggcaggacttactactataacacagaaactaagcagtccacatgggaaaagcccgacgacctcaaaacaccagcagaacagcttctttcaaagtgcccctggaaagaatataagtctgatagtgggaaaccgtactattataattcacaaaccaaagagtcgaggtgggccaaacccaaggagctggaggaccttgaaggctatcagaatacaatcgtggccggatccctgataaccaaatctaacctccacgccatgataaaggcggaggaaagctcaaaacaggaggaatgcacaaccacaagcactgccccagtcccgactacagaaattcccacaacaatgagtaccatggctgcggcagaagcagccgctgcagtcgtggccgctgctgctgccgctgcggcagccgcagcagcagctaacgcgaacgccagcacttcagccagcaatactgtgtccggcacggtcccagtggtgcccgagccagaggtcacaagcatcgtggcaacagttgttgacaacgaaaataccgtaacaataagtacagaagagcaggctcagcttacctcaaccccggctatccaggatcagagtgtcgaggtgtcctctaataccggcgaagaaacgagcaagcaggagacggtcgccgatttcacgcccaagaaagaggaggaagaaagtcagccagccaagaagacatacacttggaatacaaaggaggaagcaaagcaagcctttaaagagctgttaaaggagaagcgtgtgccaagcaacgcttcttgggagcaagccatgaagatgattatcaatgacccacggtactctgccctagccaagctgagcgaaaaaaaacaggcttttaatgcgtacaaggttcagacgtag

SEQ ID NO: 237405 - DNA, 2826 bp, Artificial Sequence
  Description of Artificial Sequence: Synthetic coding sequence
atgaacaagaaaaagaaaccctttttgggcatgcccgctccattggggtatgttccgggattgggcagaggtgctaccggcttcacaacaagaagtgacattggcccagctagagatgctaacgatccagtggacgatcggcacgcgccaccgggaaaaaggaccgtgggcgaccagatgaagaaaaatcaggccgcagatgatgatgacgaagatctgaatgacaccaactacgacgaatttaacggttacgcagggagtctgttcagttcaggtccttatgagaaggatgacgaggaggccgatgccatatacgccgctctcgacaagcggatggatgagcgcagaaaggaacgtagagagcagcgcgaaaaggaagagatcgagaagtacagaatggagcgccctaagatacagcagcagttttccgatctgaaaaggaaactggcagaggtgacagaggaagagtggctgtccatcccagaagtgggagatgcccgtaataaacggcagcgcaacccgagatatgaaaagttgacgccagtccctgatagcttctttgccaaacatttgcaaactggtgagaaccacaccagtgttgatcccagacagacccagttcggaggcttaaatactccctacccgggtggcttaaatacaccttaccctggcggtatgaccccaggcctgatgactccaggaaccggtgagttggacatgcgcaaaattggacaggcgcgaaacactcttatggatatgaggctgagccaggtgagtgacagcgtttccggccagacagtggtggaccccaagggatacctcacagacctgaattctatgattcctacgcatgggggtgacatcaacgatatcaaaaaagcaaggcttttgttgaaaagcgttagggaaacaaaccctcatcaccccccagcctggatcgctagcgcaaggttagaagaggtgacaggtaagctgcaggtcgccagaaatttaatcatgaaggggaccgaaatgtgcccgaagtctgaggacgtctggcttgaggctgccaggctccaaccgggagacaccgctaaagcagtggtggctcaggcagtcagacacctgccccaaagcgtcagaatctatattcgagccgcagaactggagaccgatatacgggcaaagaagcgagtgctgcggaaagctctggagcacgtacccaactcagttcggctgtggaaagctgccgtggagctagaggaacccgaggatgcacggataatgctgagcagggcagtagagtgctgtcccacatcagtagagttatggttggctcttgcaagacttgagacttacgagaatgccagaaaggtgctgaataaggccagagagaatattccaacagatagacatatatggattactgctgctaagttggaggaggccaatggtaacactcagatggtggagaagattattgaccgcgcaattaccagcttgagggccaatggagtggagatcaatcgggagcaatggatccaggacgccgaagagtgtgatcgagccggatctgtagcgacctgccaggcagtgatgcgcgcagtgataggcatcggaatagaggaagaagatagaaaacacacttggatggaagacgctgacagctgcgtcgctcacaatgccctggaatgtgcccgagccatctacgcctacgccctccaagtgtttccttctaagaagagcgtctggctgcgggcagcctattttgagaagaaccacggtacaagagagtcccttgaagcactgctgcagcgcgcagttgctcactgccccaaggctgaggttctgtggctcatgggtgccaagtctaaatggctggctggcgatgtgcctgccgctcggagtatattggcgctagccttccaggcaaatcctaacagcgaagagatatggctcgctgctgtcaagctggagtccgaaaacgacgagtacgagagggcccgacgcctgttggccaaagctcgctcaagtgcaccaacagctagagtcttcatgaaatccgttaaattagaatgggtgcaagataacatcagagcggcacaagatctgtgcgaggaagccctgcgccattatgaggatttccctaagctgtggatgatgaaaggccaaatcgaagagcagaaagaaatgatggagaaggccagggaagcttacaatcaagggcttaaaaagtgtcctcatagcacacctctctggctgctgctgtcccgcctggaagagaagattggacagttgactagagccagagctattctcgagaaatctcggctgaagaatccaaagaacccgggactctggttggagagtgtccgtttggagtatagagcgggtttaaagaacatcgctaataccctcatggccaaggcacttcaggagtgtcctaacagcgggattctgtggtccgaggctatcttcctcgaagctagaccgcagcggagaacaaagtccgtcgacgctctcaaaaaatgtgagcacgatccccacgtgctgctggcggtcgctaaactcttctggtcccagaggaagatcactaaggccagggaatggttccaccggacggtcaaaattgatagcgacttgggcgacgcctgggccttcttttacaaattcgaattgcaacacgggaccgaggagcagcaggaggaggtacgcaaacggtgtgaaagcgccgagccaagacacggtgaattgtggtgcgccgtctctaaagatatcgcaaattggcagaaaaagatcggcgacatcttacgtctggtcgcgggacggatcaagaatacattttag

SEQ ID NO: 237406 - DNA, 2706 bp, Artificial Sequence
  Description of Artificial Sequence: Synthetic coding sequence
atgaataaaaaaaagaaaccctttctgggtatgccagcccctcttggctacgtacccggactaggcaggggtgccacaggtttcactaccagaagtgacatcgggcctgctcgtgacgccaatgacccagtcgacgaccggcacgcccctccgggaaagcggaccgttggcgaccagatgaaaaaaaatcaggccgctgacgacgacgatgaagacctcaatgatactaattatgacgagtttaacggttatgcgggaagtctgtttagctctggaccctacgagaaagacgatgaggaagcagatgcaatttacgctgcactggacaagaggatggatgaaagaagaaaggaacgacgtgagcagcgtgagaaagaagaaatcgagaagtacagaatggagagacctaaaatacagcagcagttttctgatctgaagcgtaagcttgctgaggtgactgaggaggaatggctgtccattcctgaagtgggcgacgcaagaaacaaacggcagcgtaatccacggtatgaaaagctgacgcctgtgccggacagtttctttgctaaacatctccagaccggcgagaaccatacatctgttgaccccaggcagacacagtttgggggtctcaatacaccataccccggaggattgaataccccttacccaggaggtatgacccctgggcttatgacccccggaaccggagagctggatatgaggaagatcggccaggccaggaataccttgatggatatgcgactatctcaggttagcgactctgtgagcggccagactgtggtcgatcccaagggttaccttaccgacctgaactcgatgatccccacccacggtggggacataaacgacattaagaaagccagactgttactcaagagcgttagagagactaacccacaccatccccctgcctggatcgccagtgctagactggaggaagttactggaaaactgcaagtggccaggaatctgataatgaagggcaccgagatgtgtccaaaatctgaagacgtctggttagaggccgcacgcctacagcccggtgacacggccaaagctgtagtcgcgcaggccgtcagacatcttccccagtctgtccgtatatatattagggccgcagagcttgagaccgatatcagggccaaaaagcgggtgctgcgaaaggcactcgagcacgtgcccaactcagtgagactttggaaagccgcagtggagctcgaagagccggaagacgctagaatcatgctgagtcgtgccgtagagtgttgtccaaccagtgtggagctgtggctggccctggctaggctggaaacctatgagaacgccagaaaagttctcaataaggctagagagaacatcccgacggatagacatatttggattacggccgcaaagctggaggaagccaacgggaatactcagatggtcgaaaagatcatcgaccgcgctatcacctctctaagggctaacggtgtcgagatcaaccgcgaacaatggatccaggatgcggaggaatgcgatcgtgctggtagcgtcgctacctgtcaggctgtcatgcgggctgtaattggcattggcattgaggaggaggatagaaaacacacctggatggaggatgcagatagctgcgttgcccacaacgccctcgagtgtgcacgcgcaatatatgcgtacgctcttcaagtcttcccctcaaagaagagtgtctggctgcgagctgcctatttcgaaaaaaaccatggcacccgcgagtcactggaggctctactgcagcgcgctgtggcacactgccctaaggcggaggtcttgtggttgatgggcgcaaagagcaagtggcttgctggtgacgttcctgccgcacgaagtatacttgccttggcttttcaagtatttatgaagtccgtgaaactggagtgggtgcaagataacatcagagctgcgcaggacttgtgtgaggaggcactccgccactacgaagattttccaaagttatggatgatgaagggacagattgaagaacagaaggagatgatggaaaaagcaagggaggcctataaccagggcctgaaaaagtgcccccattcgactcctctgtggctgttgctgtcacggctagaggaaaaaatcggccagctcacaagagccagggccatcctggagaagtctaggctaaaaaacccaaagaaccccggtctgtggctcgaatcggtcagattggaatatcgggctggccttaagaacattgcaaacacacttatggctaaagcgctgcaggagtgccccaattccggtattttatggtctgaagccatcttcctcgaggctcggcctcagcggagaaccaagagtgtggatgctttgaaaaagtgcgagcacgaccctcacgtgctgcttgctgtggctaaattgttctggtctcagagaaaaatcacaaaggcccgtgagtggtttcatcgcacggtaaagatagattccgatctgggtgacgcatgggcattcttttacaagttcgagctccagcacggcactgaggaacaacaagaagaggtgcggaagcgatgcgagtccgcggaacctagacatggggaattatggtgcgcagtgagcaaggacatcgctaattggcagaaaaagattggggacatcttaaggctggtggccggacggatcaaaaataccttctag

SEQ ID NO: 237407 - DNA, 7007 bp, Artificial Sequence
  Description of Artificial Sequence: Synthetic coding sequence
atggcaggggtgttcccctatagaggcccagggaaccctgtgcctggccctctggcccctctgcccgactacatgagtgaagaaaagctgcaagagaaggctcgcaaatggcagcaattgcaggctaaaagatatgccgaaaagcgtaaattcggctttgtcgacgcgcagaaggaagacatgcccccagagcacgtacgcaaaatcattagagatcacggggatatgactaaccggaaatttcgccatgataagcgagtttacctcggggcactgaaatacatgcctcacgccgtgcttaagctgctggaaaatatgccaatgccctgggagcagattcgtgacgtgcctgtcttataccatattacaggcgctattagttttgtgaatgaaataccctgggtcatcgaacccgtgtatattagccagtggggatccatgtggattatgatgaggcgggagaaaagggatagaaggcacttcaagcggatgcgatttcctcctttcgacgatgaggagccccctctggattatgcagataatatcttagacgtcgaacctctcgaagctatccagttggagctggatcctgaggaggacgcccctgtccttgattggttttacgatcatcaaccccttagggatagtcgcaaatatgttaatggatcgacttaccagcgctggcaatttaccctccccatgatgtcaaccttgtacaggttggccaaccagctgctgaccgacctggtagacgacaactatttctacctgtttgatctgaaagctttctttacttccaaagcactgaatatggctatccccggtggtccgaaatttgagccattggtgagagatataaatttgcaggacgaggattggaacgagtttaacgacatcaataagatcatcattcggcaaccaattagaaccgagtataagatagcgttcccttatttatacaataatctgcctcaccacgtgcatttgacctggtaccacacacccaatgtcgtgtttattaagaccgaggacccagatctgcctgcattttatttcgatccactcattaaccccattagtcaccgtcattccgtgaagtctcaagaaccgttgcctgacgatgatgaggaattcgagctgcccgagtttgtggagccgttcttgaaagatactccgctctatactgacaacaccgccaatggcatcgccctcctgtgggcacctcgacccttcaacctaagaagcgggagaacccgacgtgctctggacattcctttagtgaagaattggtatcgtgagcactgcccggcaggacaaccagttaaggtgcgggtttcttaccagaagctgttgaaatattacgtgctgaacgcccttaaacatcggccacctaaggcccaaaaaaagagatatcttttccgctccttcaaagccacaaaatttttccaatcgaccaaactggactgggtggaggtaggactccaagtgtgtcgacagggatataatatgctcaacctgctgatccaccggaaaaacctaaactatcttcacctggactataactttaatctcaagcccgtgaagacgctcactaccaaagagaggaagaagagccgttttggcaacgcttttcatttatgccgcgaggttttaagactaactaaactcgttgtggactcacacgtacagtatagacttgggaacgtggatgccttccagttggcagatggactgcaatatatatttgcacacgtagggcagctcacaggcatgtataggtataagtacaagctgatgaggcagataagaatgtgcaaagacctcaaacacctcatatattaccgtttcaacactggccctgtggggaagggcccaggatgcggattctgggcagcaggttggagggtgtggctattcttcatgcgaggcattacaccgctgcttgagcggtggttaggaaaccttctggctcggcagtttgagggcagacactccaaaggggtcgccaaaacagtgaccaagcagagggtcgagtcccatttcgacctggagttacgggctgctgtgatgcatgatattctggatatgatgcccgaggggatcaaacagaataaggcccgtacaattctacagcatctgtcagaggcttggcggtgctggaaagccaacatcccatggaaagtgccgggtttacctacaccaatagagaacatgattcttcgatatgttaaagcgaaggctgattggtggactaacactgcccactacaacagagagcgcatccgcaggggcgctaccgttgacaaaactgtgtgcaagaaaaaccttggaaggctgacccggttatacctcaaagccgagcaagagcgccagcacaattacctgaaagacgggccatacattactgctgaggaggcggtggcggtgtatacaaccactgtgcactggctcgaatcacggcgtttcagtccaattccgttccctccactgtcctacaaacatgataccaagcttctcatcctggccctggaacgtctgaaggaagcttacagtgtgaagagtaggctgaatcagagccagagagaggagttgggcttgatcgaacaggcatatgacaacccccacgaagccctgtctcgaattaagcgacacctactgactcagagagcttttaaagaagtgggaatcgaattcatggatctgtactcgcatctggtacccgtctatgacgtggagccgctggagaaaatcactgatgcctacctcgatcagtacctgtggtacgaggcagacaagcgcaggctgtttccgccttggattaagcccgctgacaccgaacctcccccactgctcgtgtataagtggtgccaggggattaataacctgcaggacgtatgggaaacatctgagggcgagtgtaacgtgatgcttgagtcacgatttgagaaaatgtacgagaagatcgacttgacactgctgaaccggctgttgcgtctcatagtggaccacaacattgccgactatatgacagcaaagaacaacgtcgtgatcaattacaaggacatgaaccatacaaactcctacgggatcatcagaggccttcagttcgcatcattcatagtgcagtattacggactggtgatggatctgttggtcctaggcctacatcgcgcatcagaaatggccggacctccacaaatgccgaatgactttctgtccttccaggatattgctacagaggctgctcatccgattcgactgttttgtcggtatatcgaccggatacacattttttttaggttcaccgccgacgaggcgagggacctgattcagaggtacttgaccgaacaccccgatccaaacaatgagaatatcgtgggctataacaacaagaaatgctggcccagggatgcaagaatgcggctgatgaagcacgacgtgaatctcggcagggccgtgttctgggacattaagaaccgcctgcctaggtcggtgaccactgtgcaatgggagaatagcttcgtcagcgtttattcgaaagataatcctaacctcctttttaatatgtgtggatttgagtgcagaatcctccccaagtgcagaacaagctatgaggaattcacgcacaaggatggcgtgtggaacttacagaacgaggtcaccaaggagcgtacggcccagtgttttttgcgagtcgacgacgaaagcatgcagcgctttcataatcgcgtcaggcagatacttatggctagcggaagtactacgttcaccaaaatcgtcaacaaatggaatactgccctgatcgggctcatgacctactttcgtgaagccgtcgtcaacacccaagaacttctcgacctgcttgtgaagtgtgagaataagatccagacccggattaagatcggactgaattctaaaatgcccagccggtttccccctgtagtcttttacacccccaaggagctgggtgggcttggtatgcttagtatggggcacgtgctgattccacagtcagacctcaggtggagcaaacaaaccgacgttggaataactcatttccgtagcggtatgtcacacgaggaggatcagctaatccccaatctgtacaggtacattcagccatgggaatccgagtttattgattctcagagagtgtgggctgagtatgcgctgaaaagacaggaagctatcgctcagaaccgcagattgaccctggaagacctggaagactcttgggacaggggtatccccaggattaacaccctgttccagaaagacaggcacaccttggcctacgacaaggggtggcgggtgcgcacagatttcaaacagtaccaggtcctgaagcagaaccctttttggtggactcatcagcgtcacgacggaaagctctggaatctcaataactataggactgacatgatccaggccctgggtggggttgagggcatcctggagcatactctcttcaagggcacatattttcccacctgggagggcctattctgggaaaaggctagtggctttgaggaaagcatgaaatggaaaaagttgactaacgcacagcgctccggactcaaccaaatccctaataggcgtttcacactttggtggtcccccactataaacagggcaaatgtttatgtcggttttcaggttcagctcgatctgacaggaatctttatgcatggcaagatcccaactctgaagataagtcttattcagattttcagggcacatctttggcagaagatccacgaaagcattgttatggatctatgccaggtcttcgatcaagaactcgatgcacttgagatagaaaccgtccagaaagagaccatacatcccagaaagtcctacaaaatgaactcttcttgtgccgatattctgctgtttgcctcatataagtggaacgtctcaaggccctcactccttgcagattctaaagacgtaatggattctactaccacgcagaaatactggatcgatatccagctgcggtggggggactatgattcacacgacatcgagcgctatgctagggccaagttcctggactacacaaccgacaacatgtcgatctaccctagccccactggggttctgattgccattgatttggcttataacctccattcggcctacggtaattggtttcctggctccaagcccctaatacagcaggcaatggctaaaattatgaaggcaaatccagctctatacgtgttgcgtgagaggatcagaaaagggcttcagctgtactcatctgaacctactgagccatacctgagtagccaaaactatggagagctcttttcaaaccaaattatttggttcgtggatgacacgaacgtatatagggttacgatacataaaacctttgaaggcaatttgaccactaagcctatcaatggagctatttttatcttcaatccacgcacaggccagctgtttctgaagattatccatactagcgtttgggccggtcagaagcgtctgggtcagttagctaagtggaaaactgcggaagaggtagcagccctcattagatccctgcccgtcgaagaacagcccaaacagattattgtaacccggaagggaatgctagacccacttgaggtgcaccttctagactttcccaacatcgtgataaaaggcagcgaactgcagttgccctttcaggcgtgtctgaaagtggagaaatttggagacctgattttgaaggcgactgagcctcaaatggttttgtttaacctctacgatgattggctcaagacgatctctagttatacagccttctccagactcatcctcatcctgagagcccttcatgtgaacaacgaccgcgctaaggtaattctaaagccggacaaaactacaatcacagagccacatcatatctggccaacgttgaccgacgaggagtggatcaaagtcgaagtgcagctgaaggacctaatattggcggactacggaaagaaaaacaacgtgaacgtagctagtctcactcagtctgagatccgtgacatcatcctgggtatggagatctctgccccatctcaacaacgccaacagatcgccgaaatcgaaaaacagaccaaagaacaaagtcagctgactgccacccagacccgtaccgtgaacaaacatggcgacgagatcatcaccagtaccacttccaactatgaaacacaaaccttctcttccaagacagagtggcgcgtgagagcaattagcgcagctaatttgcacctgaggaccaatcacatctatgtgagtagcgatgacataaaggagacaggctatacttatatcctgcccaagaatgtgttgaagaagtttatttgcattagcgacctgcgagcacagattgcaggctacctgtacggagtctctccaccggacaacccacaggttaaagagatccggtgtatcgtgatggtcccacagtggggaactcaccagacagtacacctgccaggacaactgcctcagcatgaatacctaaaggaaatggagcctctgggttggattcatacccagcctaacgaaagccctcagctgtccccccaagacgtgactactcacgctaaaatcatggctgataatccctcttgggatggagaaaaaaccattataatcacctgctcattcacccccggatcgtgcaccctgaccgcctacaagctgacaccttcagggtacgaatggggacgccagaataccgacaaaggcaacaatcctaaggggtatctcccatcacattacgaaagggtacagatgctgctaagcgaccgattcctgggcttcttcatggtgccggctcagtcaagttggaactacaattttatgggcgtacgacacgaccctaatatgaagtatgaactccagctcgccaacccaaaggaattttaccacgaagtgcacaggcccagccactttttaaatttcgccctcttgcaggagggcgaggtgtacagtgctgacagggaggatctgtatgcgta

SEQ ID NO: 237408 - DNA, 1392 bp, Artificial Sequence
  Description of Artificial Sequence: Synthetic coding sequence
atgatccaagcgctggggggagtagagggaatcttggaacacacactgtttaaaggcacatatttccccacctgggagggcctcttctgggaaaaagccagtggcttcgaggaatcaatgaaatggaaaaagctcacaaatgcacagaggtcaggcctgaatcagattcctaatcggagatttacgctctggtggtccccaactattaaccgtgccaatgtctatgttgggttccaggtgcagctcgacctcacaggaattttcatgcatggaaagattccaacccttaaaatctcacttatacaaatcttcagagctcacttgtggcagaagattcacgagagcatcgtgatggacctctgtcaagtgtttgaccaggagctggatgctctcgagatagaaactgtccagaaggaaacaatccatccgagaaagagttataagatgaattccagctgtgcagatattctgctctttgcaagctacaagtggaacgtaagccgccctagccttttagccgacagcaaggatgtaatggactccacgactacgcaaaagtactggatagatatccagctgaggtggggcgactatgacagccatgatatcgagaggtacgccagagccaaattcctcgattatactactgacaacatgtccatctacccaagccctaccggggtgctgatagcaatcgacttggcgtataatctgcattcatacagcgaggtgggtagcctccaacaagcttctcataccaccggtgccaagatcatgaaggcgaatccggcactatacgttctcagggaacgtattagaaaaggcttgcagctgtattcgtctgaacccaccgagccatatctgtcgagccagaactacggagaactgtttagcaaccagattatatggtttgtagatgatactaacgtctatcgtgtgaccatccacaagacgtttgagggcaacctgaccaccaagcctattaatggtgcaatctttatttttaatccaagaaccggacagttatttcttaagatcatacacacgtcagtctgggccggacaaaagcgattaggacagctcgccaagtggaaaaccgcagaggaggtcgccgcactcatcaggtcactgcccgtagaggaacaaccaaaacaaattattgtgactcggaagggtatgctggatcctctcgaggttcatctgctggacttcccaaacatagtgatcaaagggagcgagttgcaactgccatttcaggcctgccttaaagtggagaagtttggggatctgattttaaaagctacggaacctcaaatggtcctgttcaacctgtacgacgactggcttaagactatttcaagttatactgccttctcacgcctcattctgtag

SEQ ID NO: 237409 - DNA, 2727 bp, Artificial Sequence
  Description of Artificial Sequence: Synthetic coding sequence
atggcggacgggggaggacccaaggatgcgcctagcttgcgatcctcacccggaccagccccacgtgtgccgagggccgtaggtccttcaggaggaggtggtgagacaccacgcactgctgcactggcccttaggtttgataagcccataaaacaggctttttacaatacgggggctgtattgttcgtttgcctgtgctgcggcgctgccgttttggtatactttatcttggaggcttttctcagacccctcctgtgggccgttctctgcgggaccttcctgcacccctttaagtcatccctgaccaggctgggcaggcattggctccagaggctccatagggcccacacccctatagtacttgcagcactactccttcccctctgtttcgtcgactatggcgttgaggctttaggtgaacaggccctgcggaggaggcgcttgctgcttcttctgggcgcagggggacccctgttatatggcttatactgtctgggttcataccttggcgttcaggtgctgctggtgcacgctgccaccctgatctgcagagggttagattacttctcctcactctggatctggactctggtagtcggctatgtacttacggtgtcattcaagtggaacgcatctacagaacgctacctacgagcggtgagtatccccgtgtggataatcttattgttccatctcgcctccctagcgggatcttggcgcatccctgtttttctggttattgtcttcctgatgtcagtgggtacgctgtacgaaaagcagaatggcaaggagtcgtctggggcagagctccccggtcaggtcatcagtatggccgcttccacacttgcaaaccttgccatttctatcacaggctacgaaagcagctcagaggatcagccttctactcaacctgctgaagcggtggatcggggtgagagcgcaccaacactgtccacatctccctctccatcttccccgtcgcctaccagccctagtcccacacttggccgacgaaggcctgagatcggcacatttctgcgaaagaaaaagacgtctgatatctacttcgtctctttagtatgggcaattgtcgttatgcaaatttggctcaacctctggatagtgcagctgctgccagtcccaatcgctgtgtggatcctgaagaagctagtgattcattttggcgtggtggattttttggagaaaaggtaccatgtgtggtggggcatcatcgagagcttcctcaaagagaggcaaggtgctctggcgccatggccaattgtcggtctggggaaattccttctgaaggtggattcaaaactctggcattggctgaataaaaaaatgataatttggctggaaaagatgctggacaaaatcatctcgatttttataatttttctgctggtcatcggaacacttctgctggctctgctgctcacagctaaagtacaccaggagtctgtgcatatgatagaagtgacttctaacctcatcaatgagaccttagctaatcatcctgaatgggcaaactggctcccagaggcccaggtggtccagcgggctctcaactccgcagccaacaacgtttaccagtacgggagagaatggattacccacaagctgcataaaattctaggagataaggtgaacaacaccgcagttattgagaagcaggtgctggagttgtgggataggctgtaccactcgtggttcgtgaagaatgtgacacactctggacgacacaagggacaaaagctgcatgttagccgccagaatagttggctgggcgacatattggactggcaagatattgtgtcgtttgtgcatgagaacatcgaaactttcttgagtatactggagagcctgtggatagtgatgagccgcaatgtgtctcttctattcacaactgtcactacactgttgaccatcctgttttattccggaaccgcactgcttaactttgtcctgtccctaataattttccttaccacactgttctatttgttgagcagtagcgatgagtactataagcccgtaaaatgggtgatctcactaacaccactgagccagcccggaccctccagcaatatcatcggccagtccgttgaagaagcgatcagaggcgtttttgatgcgtcacttaaaatggcgggattctacggtttgtacacctggcttacacacaccatgtttggcataaatatcgttttcatcccatcagcacttgcagcaattttgggggctgtaccgtttttgggaacatattgggccgctgtccccgctgtgctggacttgtggcttacgcaggggcttgggtgtaaggcgatattgctcctcattttccatttgttgccaacttattttgtcgatacggcaatctacagtgatatctctggaggtgggcacccgtatctgaccggactggcagtggccggaggagcttattacctcggactggagggtgctattatcggcccaatcctcttatgcatcctagtggtggctagcaacatctattccgcaatgctcgtgtcccccacaaactccgtgcccactccaaaccaaaccccctggcccgctcagccacagcgcacattccgggacatctcacgcagtgaaatcttttctgtggacgtggtatcttcagctgttatcttccggaaatttaagttcgatagcgaattcagctccgctgtggccttgtgtcccagtagttgcgcctag

SEQ ID NO: 237410 - DNA, 1062 bp, Artificial Sequence
  Description of Artificial Sequence: Synthetic coding sequence
atgctaaagagctgttctagggcctccttcagtccttctgtccgcaaaccgcctctgattctgcgccgacttttgagtgaagacgttggcatggatattccattcgaggagggggtgctgagcccttcagctgcggatatgaggcccgagcccccaaactccctagaccttaacgacacccatccccgtcgaattaaactgactgccccaaacatcaatctttcactggaccagtctgaggggagtatactgtccgacgataatcttgatagtcccgatgaaatagatataaatgtggacgaactggataccccagacgaagcagacagtttcgagtacacaggacatgaggatcccaccgccaataaggacagtggtcaggagagcgaaagcataccagagtacacagccgaggaggagagggaggataacaggctgtggcgaacagtggtgatcggagagcaggagcagcggatcgacatgaaagtaattgagccctaccgccgtgtgatctctcacggagggtactatggagacggactcaatgctattatagttttcgctgcctgcttcctccccgactcttcccgagcggactaccactatgtgatggagaacctgttcctgtacgttatctccaccctggaactgatggttgccgaagactatatgattgtctatttgaacggggcaacaccacgtcgtcgtatgccgggtcttggttggatgaagaagtgctaccaaatgattgatcgaagattaagaaagaacctgaagagctttattattgtacacccatcatggtttatcaggactattctggccgtaaccagacccttcatttctagtaaattctcaagcaagataaaatatgtgaactctctgtctgaactgagcgggttgattcctatggattgcattcacatacctgaatctatcattaaactggatgaagagctcagagaggctagtgaagcagccaaaacctcctgtctctacaatgatcccgagatgagctcaatggagaaagacatcgaccttaaactcaaggagaaaccttag

SEQ ID NO: 237411 - DNA, 9266 bp, Artificial Sequence
  Description of Artificial Sequence: Synthetic coding sequence
atggaggagttcttacagcgggctaaaagtaagctgaatcggtccaagcggcttgagaaggtgcacgtcgtgatcggccctaaatcctgcgatctcgattccctaatttcaacgtttacatacgcctattttctggataaggtctcccccccaggagtgctgtgtctgcctgttctcaacatcccgaggacggaatttaattatttcactgagacgcggtttatcctagaggagctgaatattagcgagagttttcatatttttagagacgagataaatttgcatcaactcaatgatgagggaaaactaagcattacacttgtagggtcctccgtgttggcgagcgaggacaagactctcgagagtgccgtggtgaaagttattaacccagtggagcagtctgacgctaatgtggagttccgggaatccagctcatctcttgtactgaaggaaatcttacaagaagccccagaactcattacagaacagttggcgcacaggctccgcggatccatcctatttaaatggatgaccatggagagtgagaaaatttccgagaagcaagaggagatcctgagtatcctcgaagagaaattcccaaatctgcctccaagggaggacattattaatgtattgcaggaaacccagtttagcgcgcagggcctgtccattgagcagactatgttaaaggacctgaaggaactctcagacggggaaatcaaggtggcgatcagtaccgtctctatgaatctcgaaaactgtctgttccactctaacattacgagcgacttaaaggccttcaccgacaaattcgggttcgatgtgttgatccttttcagctcctacctttccgaagagcagcagccccgtagacagattgccgtgtattccgagaatatggagctgtgctcccaaatctgctgcgagttagaggagtgccagaacccatgtctcgaattggagccattcgactgcgggtgcgatgagatcctcgtgtatcagcaagaggacccaagcgtgacctgtgaccaggtggtgcttgtggtgaaggaggtaattaacagacggtgtcccgagatggtctctaattcccgaacaagctctacagaggccgtggctggaagcgccccactgtcacaggggtcatcaggcattatggagctctacgggagcgacatcgagccccaaccctcttccgtgaacttcatcgagaatcccccagatctgaacgattccaatcaggctcaggtcgacgccaatgtagatctggtgagtccggactctggccttgctacaatacgaagcagtcgttcatcaaaggagagttctgtgttcctgtccgatgatagccctgtgggggaaggcgcaggacctcatcataccctgctgcccggacttgatagctatagtcctatccctgagggggcagtcgccgaggagcacgcctggagtggggaacacggagagcactttgacctgttcaattttgaccctgcccctatggcaagtgggcagtctcagcaaagctcccactccgccgattactcccccgcagacgacttctttccgaacagtgatctcagcgaggggcagctgcctgccggtccagaaggactcgacgggatgggcactaatatgagtaactatagctcctccagtctgctgagcggagctggcaaggactcactggtggaacacgatgaagaatttgtccagcggcaagatagccctagagacaatagcgaacgcaatctcagtcttaccgactttgtcggggacgaatctccaagccctgaacgccttaaaaataccgggaaaaggattccgccaacgccaatgaattccctggtcgagtcctcaccatccacagaggagccagcttcgctctacacagaggatatgacccagaaggcaactgacacgggccacatgggtccgccacagacacatgcacggtgtagttcttggtggggtggtttggagatagattccaagaacatcgcagatgcttggagcagttcagagcaggagagtgtgtttcagtcccccgagtcctggaaggagcacaaacccagctccattgatcgccgtgcatcggactccgtgtttcagcccaaaagtctggagttcaccaaatctggcccatgggagtccgaattcggccagcccgaactggggtctaatgatattcaggacaagaatgaggaatctttgccctttcagaatctgccgatggaaaagagccctctgcccaacacaagtccccagggcacaaaccacctgatcgaggattttgcttctctctggcattccgggaggtcccctaccgctatgccggagccgtgggggaatcccactgacgacggcgagcctgccgctgtcgctccctttcccgcttggtcagcttttggcaaggaggaccacgacgaggctcttaaaaacacatggaacctgcatcctaccagcagcaagacaccctcggtaagagacccaaatgagtgggcaatggctaagtcggggttcgctttcagtagttcagagttgctcgacaactcgccatccgagatcaataatgaggctgcacccgagatctggggaaaaaagaataacgattcaagagatcatatcttcgcacctggcaacccctcatctgatttggatcatacctggacaaattcaaagccaccaaaggaggatcagaacggcctggtggatcctaaaactagaggcaaggtttacgaaaaggtggactcatggaacctcttcgaagaaaacatgaagaagggtggcagcgatgtgctagtcccctgggaggatagttttctatcctataaatgctctgattacagtgcctcaaatctgggagaggatagcgtaccttctccactggataccaattactcgactagcgacagctacacttccccaactttcgccggtgacgaaaaggaaacagaacacaaaccatttgctaaggaagaaggcttcgaaagcaaggacgggaattctaccgctgaagagaccgatatccccccacagtctttgcagcagagcagtcgcaatcggatttcatccgggccaggtaatctggacatgtgggcctcaccccatactgacaattccagcgagatcaacacaacccacaatcttgacgaaaacgagctcaagacagagcataccgacggcaagaatatcagtatggaggatgacgtcggagagtcctcacagtcctcctacgatgacccaagcatgatgcagctctacaacgaaaccaaccgtcagctgaccctgctgcatagcagcaccaatagccggcagaccgcccctgatagcctggatctgtggaatcgggtcatcctcgaagatacccagtccaccgccactataagcgatatggacaacgatctcgactgggacgactgtagcggaggtgctgctattcccagcgatgggcaaaccgaagggtatatggcagaaggctccgaacctgaaactcgcttcacagtgcggcagctggagccctggggcctggagtatcaggaagccaaccaggtcgattgggagctaccagccagcgacgagcacacaaaagacagtgccccaagcgaacaccacacactgaatgagaagtccggtcaactcattgcgaacagcatctgggattcggtcatgcgcgataaggacatgtcatcgttcatgctccccggaagcagccacatcaccgattcagagcaacgcgaactgccccctgagatccccagccacagcgcaaacgttaaggatacccatagtccggatgcccctgccgcaagtggaacttctgaatccgaagcgctgatctctcacctagataagcaagacactgaacgcgagacgctccagagcgatgcagcatcgttagctacccgcctggaaaatcctggctactttcctcacccagacccatggaaagggcacggggacggacaatctgaatccgagaaagaagctcagggtgccaccgatcggggacatttggatgaagaggaggtcattgcgtcgggcgtggaaaacgcctcaggaatttctgaaaaagggcagtcagaccaggaactgagctcattggttgcgagtgaacatcaagagatctgtattaagtctggcaagatctcatcactagccgtcacatttagtccacagacagaggagcccgaggaggtgttggaatatgaagagggctcgtacaacctcgattctagggacgtccagactggaatgagtgctgataacctgcagccgaaagatacccatgagaagcacttgatgtcccagcgcaacagcggggaaaccacagaaacatccgacgggatgaattttacgaagtacgttagtgtgccagaaaaggacctggagaagaccgaggagtgcaacttcctggagccagaaaatgttgggggagggccacctcaccgtgtcccgcgttcactggacttcggagacgtcccaattgattccgacgtgcacgtgagctccacttgtagtgagatcacgaagaatctggacgtgaaaggatcggaaaatagtcttccaggcgctggcagctctggaaactttgaccgcgatacaatctcaagtgagtacacacacagctctgcttcctcaccggaactgaatgactcctccgtggctttgagttcatggggccagcagccatcgagtggatatcaggaggagaaccaggggaactggtcagaacaaaaccatcaggaatccgaactcattacaacagatggacaggtcgagattgttacaaaggtcaaggacctggagaaaaataggataaatgagttcgaaaaatcatttgatcgtaaaacaccaactttcttagaaatatggaacgattccgtagatggcgacagcttcagctccctgagtagccccgagactggcaagtatagcgagcattccggaacccaccaggaaagcaaccttattgctagctatcaagaaaagaatgaacacgacatcagtgcaactgtgcagccagaagacgctcgagtgattagtacatcatccggcagtgacgacgatagtgtaggaggcgaggagtcgatcgaagaggaaatccaggtggctaactgccacgtggctgaggatgagagtagggcttgggactctctcaacgagagcaataaatttcttgtgaccgccgatcccaagtccgagaacatttacgattacctggatagctcagagcccgcagagaacgagaacaaatcaaacccgttctgtgacaaccagcagagttctccagacccatggacattttcccctctgactgaaaccgaaatgcaaattaccgccgtggaaaaggagaaacgaagttctccagagaccggcacaacgggagacgtagcctggcagatctcccctaaagcaagttttcccaagaatgaagataattctcagctggaaatgctgggattttctgcagatagcaccgaatggtggaaggcttcgccccaagaaggtcggcttatcgagagtcccttcgaacgggaactgtctgattcatcaggcgtgctggaaattaattcttcggttcatcagaacgcctctccatggggggttcccgtgcagggggatatcgagcccgtggagacccactatacgaacccattcagtgacaatcatcaatctcctttcttggagggcaatgggaaaaattcccacgaacagctgtggaacattcagccacgacagcctgacccggacgcagacaagttttcacaactagtgaaactggatcagataaaagagaaggactctcgggagcagacctttgtgtccgcggcaggggatgagctgacaccggagacccccactcaggagcaatgccaggatactatgctcccggtttgcgaccacccagatacggcttttactcatgccgaggagaactcttgcgtgactagcaatgtaagtactaacgagggccaggagaccaaccaatgggagcaggaaaagtcttacctgggcgaaatgacaaacagttctatcgccactgaaaacttccccgctgtctctagccccacacaactgattatgaaacccggaagcgagtgggacggaagtactccatctgaggattctcgcggtaccttcgtgcccgacatacttcacggaaattttcaagagggagggcaactcgccagcgcagcacccgacctgtggattgatgccaagaagccattttctttgaaggcagacggcgagaaccctgacatcctcacacactgcgagcatgatagcaatagtcaggcctcggattctccagacatctgtcatgactcggaggccaaacaggaaactgagaagcatttaagcgcttgcatgggtcctgaagtcgagtcatctgagctgtgtctgacagagcctgaaatcgatgaagaacctatttacgaaccgggacgggagtttgtgcctagtaacgcggagttagactcagagaacgccaccgtgcttccccctatcggctaccaggccgacatcaagggttcatcgcagcccgcttcccacaagggatcacccgaaccgagcgagataaacggagataatagtacaggactgcaggtgtctgaaaaaggggcatctccagacatggccccaattttagagcctgtggaccggcgtattcctcggatcgagaatgtggccacatcaatatttgtgacccaccaggagcccacacccgagggtgacgggtcatggatctccgatagtttctcccctgagtcccagccaggcgctagggcgttgttcgacggagacccccacctaagtactgagaacccggctctggttcccgatgccctgttggcatccgatacatgcctcgacatatcagaagccgcatttgaccactcgttttccgatgcatccggtctcaatacctctaccggaaccatcgatgacatgagcaagctgacactgtctgagggtcacccggagactcccgtggatggagacttgggtaagcaggacatttgcagcagcgaagcatcctggggcgacttcgagtacgacgtcatgggacagaacattgatgaggacctcctacgtgagcccgaacatttcctctatggaggcgaccccccattagaggaagactcccttaaacaaagtctcgcaccatatacgcccccttttgacctgtcgtatctgactgagcccgctcagagcgccgaaacaatcgaagaggctggatcaccagaggatgaatcattgggttgtcgcgcagccgagatcgtactttctgctctcccagatcggcgatcagaaggcaatcaggccgagacaaagaacagactgcccggaagccagctggcggtgctgcacatccgggaagatccagaaagtgtgtacctgcccgttggtgccggatccaacatcctttccccaagcaacgttgactgggaggttgaaacagataatagtgacctgcctgccggaggtgacattggaccaccgaacggcgcaagcaaggagatctcagagctggaggaagaaaaaacaatcccgactaaggaaccagaacaaataaaaagcgaatataaagaggagaggtgtaccgagaaaaacgaagataggcacgcactccatatggattacatcctggtaaatagagaagagaacagccactctaagccagaaacttgcgaagaacgggagtccatcgcggaactggagttgtacgtgggaagcaaggagactggcctgcaggggacccaactggcatccttcccagacacgtgtcagcccgcttccctgaatgaaagaaaaggtttgagcgccgaaaagatgtcctctaagagtgacacgcgaagctctttcgagagtccagcccaagaccagtcctggatgtttctggggcatagcgaggtgggcgacccttccctggacgctcgggactccggaccaggatggtctggtaaaacagtagaacccttctcagagcttggcctgggcgagggccctcagctgcagattcttgaagagatgaagccccttgagtctctggctttggaagaggcaagtggtccggtctctcagagtcaaaagagcaagagccggggtcgcgctgggccagatgcggtcacgctccaggctgtgacccatgacaacgagtgggagatgttgtcgccgcaacccgtgcagaaaaacatgattcctgataccgagatggaggaggagaccgaattcctggaactggggaccagaatctcccgacctaatggcctattaagcgaggatgtgggcatggacatccccttcgaggaaggagttctgagcccctccgctgctgacatgagacctgagcctcccaatagcctagacctgaatgatacccatcccaggcgtatcaagcttaccgctcccaacattaatttatctctagatcaaagcgaggggtccattctctcagacgacaatcttgattcacctgatgagatcgacatcaatgtggacgagctggatacacccgatgaagccgacagcttcgagtacaccggtcacgacccgactgctaataaggactctggacaagaaagtgagtcaattccggaatatactgctgaggaagaacgggaagacaatagattgtggaggacagtggtgatcggagagcaggagcagcgaatcgacatgaaggttatcgaaccttatcggcgagtgatttctcatgggggatactacggcgatggcttgaacgccatcatagtctttgcagcctgttttttgccggactctagccgggctgactatcactacgtgatggagaacttgtttctgtacgtcatctccacactggagttaatggtcgccgaggattatatgattgtgtatctgaatggcgctacaccgcgacgacggatgccaggtcttggctggatgaagaagtgttatcagatgattgaccgtaggctgcggaagaatctgaagagcttcatcatagttcatccaagttggtttatccgaaccattctggcagtgaccaggccgtttatatcctccaagttttcctccaagatcaaatatgtaaatagcttgtcggagttgtccggactgattccaatggactgcatccacatcccagaatccattatcaaactggatgaggaacttcgtgaagcctctgaagctgctaagacatcttgcctttacaacgatcccgagatgtcctccatggagaaagacatcgatttaaagctcaaagaaaagcctta

SEQ ID NO: 237412 - DNA, 9164 bp, Artificial Sequence
  Description of Artificial Sequence: Synthetic coding sequence
cggaatttgatgcacagaatgaaggagtctgaaaaccggtcaaaaagacttgagaaagtgcacgttgtgatcgggccaaagtcgtgtgatctggacagcctgatatctaccttcacctatgcctacttcttggataaggtgagcccgcctggcgtgctttgcctgccagtgttaaatatacctcgcacagagtttaattacttcactgaaactcggtttattttagaggaactgaatatcagtgagtcctttcacatattcagggacgagatcaacttgcatcagctgaatgacgaagggaagttgtctatcacactcgttggtagcagtgtcctggcctcagaggacaagacccttgagtcagccgtggtgaaggtgattaaccccgtggagcagagcgacgcaaatgtggaatttagggagagcagcagcagcctggttcttaaagaaatacttcaggaagcacccgaactcattacagagcagctagcacacagactgagaggctcaattctgtttaagtggatgactatggagagcgaaaaaatttcagagaagcaggaggaaatcctctctattctcgaggagaaatttcccaacctgccacctcgggaggatatcataaatgtgctgcaagagacacagttcagcgcacaggggctgtctatcgagcaaaccatgctgaaagacctgaaggaactgtctgacggagagattaaagtcgctataagtacagtcagcatgaaccttgagaattgtttgtttcacagcaatatcacctcagacctgaaagcctttaccgataaatttggttttgacgttctgatcttattttcctcatatctttccgaggagcagcaacctcggagacagatagcagtctacagtgagaacatggaactgtgtagtcagatttgctgtgaacttgaggagtgtcaaaacccatgcctggagctcgaaccattcgattgcggatgcgatgaaattctggtgtaccagcaagaagaccccagcgtgacttgtgaccaggtcgtcctggtagtgaaggaggtaattaaccgaaggtgcccagagatggtgtctaacagcaggacctcctctacagaggccgtggccggtagtgctcccctcagtcagggtagcagtggcatcatggagctctacggatcagacatagagccacagcccagctccgtcaacttcatcgagaatccacctgatcttaacgattctaaccaggctcaggtggacgccaatgtggatttggtatcgcctgactctgggctggctaccatccggtctagtcgaagcagtaaggaatcctccgtgttcttatctgacgacagtcccgttggagagggcgcagggcctcaccacactctcttacccggattagactcctacagtccgatccctgagggagccgttgccgaagagcacgcctggagtggcgagcatggagaacattttgaccttttcaattttgacccagcaccaatggcaagcggccaaagccagcagtcctctcattccgcggattattctccagctgacgatttcttccctaattctgatctgtccgaagggcagctgcccgctgggcctgagggccttgatggaatgggtaccaacatgtcaaattattcatcttcatccctgctgtccggcgctggcaaagactccttggtggagcacgacgaagagtttgtgcagcggcaggatagtcctagggacaactccgaaagaaaccttagcttaaccgattttgtgggggacgaaagcccgtccccggagcgcttaaaaaatacaggaaagaggatccctccaaccccaatgaattccctggtggagtcctccccttcaaccgaagaaccggctagtctgtatactgaggatatgacacagaaagccaccgacactggccacatggggcctcctcagactcatgcccgttgctcatcctggtggggtggtctggagatcgactctaagaacattgcagatgcctggagctcttccgagcaggaatccgtttttcagtctcctgaatcctggaaggagcacaagccgtcttccatagatcggagggcaagcgactcagtattccaaccaaaaagtctcgagtttaccaaatccgggccttgggaatccgaatttggtcagcctgagctgggcagcaatgatatacaggacaaaaatgaggagtctctccccttccagaacctgcccatggaaaaatcacctcttcctaacacatcacctcagggaactaatcatctgatcgaagatttcgccagtctctggcattcagggaggagcccgacagccatgccagaaccctgggggaaccccaccgacgacggtgaaccggctgctgtcgctccattccccgcttggtccgcatttggcaaagaggaccatgacgaagccctcaaaaacacctggaacctgcatcccactagcagcaagacgccatccgtcagagaccccaatgagtgggccatggctaaatctggcttcgcattctcaagcagcgagctgctggacaacagccccagcgagattaacaacgaggcggctcctgaaatctgggggaagaagaacaatgactctcgtgaccacatcttcgctccgggaaatccgtcctccgacctggaccacacctggaccaacagtaagccgcctaaagaggatcaaaacggtctggtggaccctaagaccagaggaaaggtttacgaaaaggtcgactcctggaatctgttcgaagagaatatgaaaaagggcggttccgacgtgctggtgccttgggaggactcattcctgtcctacaagtgcagtgactactccgcctctaacctaggcgaggatagcgtgcccagccctctggacaccaactactctacgtctgattcctacacctctcccacgtttgccggtgatgagaaggaaacagagcacaagccatttgccaaggaagaaggtttcgaaagcaaagatggcaacagcacagccgaggagactgacatcccccctcagtcacttcagcagtctagccgcaaccgcatttcctccggcccaggaaacctggacatgtgggcctcaccgcatacagacaattccagtgaaattaatacgacccataacctggacgagaacgagcttaagacagaacatacggacggtaaaaacatctctatggaggacgacgtcggtgaaagtagccagagctcgtacgatgacccttccatgatgcagctctataacgagacgaaccgccagctgactctgctgcacagctccaccaactcacggcaaaccgctcctgacagccttgacctgtggaatcgtgtgatcctcgaggatacacaaagcaccgccacgatcagtgatatggataatgatttggattgggacgattgctcaggcggtgcagcaattccttccgacgggcagactgaggggtacatggcggaaggatctgagcctgagactcgtttcaccgtccggcagttagaaccatgggggctcgaataccaagaagctaaccaggtggactgggaactcccagccagtgacgaacacaccaaggattccgccccatcagaacaccacactctgaacgaaaaatccgggcagctgatcgctaattccatttgggactcagtcatgcgcgataaggacatgagtagctttatgttaccgggttcaagtcatatcaccgactcagagcaacgagagctgcccccagaaattcccagccatagcgccaacgtgaaggacactcactcccccgacgcaccagccgcaagcggcacatccgagtccgaagccctgattagtcatttggacaagcaggacactgagagagagacattacaatcagatgccgcatctcttgccacaagattggaaaaccccggatacttcccacaccctgacccctggaaggggcacggagacggccaatcagaatcagagaaagaagctcagggcgctaccgaccgcggacaccttgatgaggaagaggtaattgcctccggcgtcgaaaatgcctccgggataagtgaaaagggtcagtccgaccaggaattgtcctctctggtggctagcgagcatcaggagatttgtatcaagtccggcaagatcagttccctcgcagtcaccttttcgccgcagaccgaggagcctgaagaggtcctggagtacgaggagggatcctataatctggacagtagggacgtgcagacgggcatgtctgccgataacttgcagccaaaagatacacatgagaaacacttgatgtctcagcgcaactccggagaaacaactgaaacatccgacggcatgaacttcaccaagtacgtcagtgtgcctgaaaaggacctggaaaaaactgaggaatgcaatttcctcgaacctgaaaacgttggcggaggaccaccccaccgtgtcccaagatccttagattttggcgacgtgcctatcgactctgacgtgcacgtgagctccacttgcagcgagataaccaaaaacctggacgtgaagggcagcgagaatagtctgccaggtgccggaagttctggcaatttcgatagagataccatttcctcagaatatacacatagcagtgcttctagtcccgaactgaacgatagttccgtcgctctttctagttggggacagcaacctagctcagggtatcaggaggagaaccaggggaattggagcgagcagaaccaccaggagtctgagctgatcacgactgatggacaggtggaaatcgtcacgaaggtgaaagatctcgagaagaataggatcaacgaatttgaaaagagtttcgatcgcaagacacccaccttcctggagatctggaacgattcagtcgacggtgactctttctcctccctctcatcaccagagaccgggaagtacagcgagcactctggcacccaccaggaaagcaacctgattgcttcctaccaggagaagaatgaacacgacattagcgcaacggttcagcccgaagatgctcgcgtgatcagcacctcttcaggctcagacgacgatagcgttggcggagaggaatcgatcgaagaggagatccaggttgctaactgtcatgtcgcggaagacgagagtcgggcttgggattcccttaatgagagcaacaagttcttggttacggcagatcccaagtcggaaaatatctacgactacctggacagttcagagcctgccgagaacgagaataaaagcaatcccttttgtgacaatcagcagtcatcacccgacccttggaccttctccccattgactgagactgagatgcagataactgcggtggagaaggagaaaaggagtagtcccgaaaccggcactaccggcgacgtggcctggcagatttccccaaaagccagctttcccaagaacgaggacaattctcagctcgaaatgttagggtttagcgccgatagcaccgaatggtggaaggctagtccacaggagggtagactgattgagtcaccctttgagagggagttgtctgatagcagcggtgtactggaaattaactcctcggtgcatcaaaacgcaagtccttggggagttccggtgcagggagacatagagcccgttgaaactcattacaccaatcccttttcagacaaccaccagtcacccttcttggagggcaacggcaaaaattcccatgagcagctctggaatattcagcccaggcagccagaccctgacgcggacaagttctctcagctagtgaagttggaccaaatcaaggaaaaagactcacgagagcagaccttcgtgtctgctgccggagacgagctgactccagaaactccgacgcaggaacaatgccaagacacgatgttgccggtttgtgaccatcctgatactgcatttacacatgccgaggagaattcctgtgtgacatcaaacgtatcaacaaacgagggccaagagaccaaccagtgggagcaggagaagagctatctgggggagatgactaactcaagcatcgccaccgaaaactttcccgctgtgtccagtcctacacagctcatcatgaaaccgggaagtgagtgggatggatctacgcccagcgaagattcccgcggaactttcgtgcccgacatcctacacggaaattttcaggagggtggccagttagcttctgcagctccggacctgtggattgacgctaaaaagccattctctctaaaagcagatggcgaaaatcccgacattctcacgcactgtgaacatgactctaattcccaagcatctgactcacccgacatctgccatgacagtgaggccaagcaagaaactgagaagcatctgtccgcgtgtatgggtccggaagtggaaagctccgagctttgcctaacagaaccagagattgacgaggagccaatttatgagccgggtagggagtttgtgccctcaaacgcagagttggattcggagaatgctaccgtgcttccgcctatcggctaccaggccgacatcaaaggttccagtcaacctgcttcgcacaagggcagccccgaaccatcagagatcaatggcgacaactccacaggcttacaggtgtccgaaaaaggggcttcccctgacatggccccaatcctagagccagtcgatagacgcattcccaggatcgaaaatgtggccactagtatcttcgtgactcatcaagagcccacgcccgaaggcgatggctcatggatatctgacagtttctcccctgaatcccaacctggggcacgcgctttattcgatggagaccctcatctgagcactgagaacccagctctggtcccggatgctttattggcaagcgatacatgtttggatataagcgaggccgcttttgatcattcattctctgacgccagcggcttgaatacatctacagggacaatagacgacatgtcgaagttgacactctctgagggccacccagagacgcctgtggatggagatttggggaagcaagacatttgctcttcagaggcgtcgtggggggacttcgagtatgacgtaatgggacaaaacattgacgaagacttactgagggagcccgaacactttctgtacggcggtgatccaccccttgaggaggactccctgaagcagtccttagccccttatacaccacctttcgatctgagttatttaactgagccggcacagtccgccgaaaccatcgaggaagcaggctcacctgaagacgagagcctgggatgccgcgctgctgaaattgtcttgtcagcgctgcctgaccgaaggtctgagggaaatcaggccgaaactaagaacagactccctggcagtcagctggctgtactccacatccgcgaggacccagaatccgtgtatctgcctgtaggagccggttcaaatatcttatcccctagcaacgtggattgggaggtggagaccgataacagcgacttgcctgctggcggagatattggccctcccaatggcgcttcgaaagaaattagcgagttagaggaagagaagacaatacccactaaagaaccggaacagatcaaaagcgaatacaaagaagagaggtgtaccgagaagaacgaagatcgccatgccctgcacatggactatatcctggtgaatcgagaggagaactctcattccaaacccgaaacctgtgaggaacgagagtcaatcgcagagctggagctgtatgtcggaagcaaggaaactggattgcaaggcacccagctagccagcttccccgatacctgtcagcccgcttctctaaatgagcggaagggtctgtctgccgagaagatgagttcaaaaagtgacacccgtagcagcttcgaaagtccagcccaggatcagtcctggatgtttctggggcacagcgaagttggagatcccagcctagatgccagagacagtgggccaggttggtccggaaaaacggtagagccattttctgagctcggattgggcgagggtcctcagctccagattttggaggagatgaagccattggaaagcctggccctggaggaagcttccggccctgtgtctcagtctcaaaaatccaagagcaggggcagagccggacccgacgcggtgacactgcaagcggtgacccacgacaatgagtgggagatgctgtctcctcaaccagtgcaaaagaacatgattcctgatacggagatggaggaggagaccgaattcctggaactgggcactcgcatctcccggccaaacggactgctctcagaggacgtgggaatggacatcccctttgaagaaggcgtgctgagcccatctgccgctgacatgagaccagagcctccaaattctctggatctgaacgatacacacccaagacggattaaactgactgctcctaatatcaatctgtcattggaccagtccgaaggcagcatcctatctgacgacaatctggatagtcctgatgaaatcgatatcaacgtggatgagctggacacccctgatgaagcagacagttttgagtacaccggccatgaggatcccaccgccaataaagattccggacaggagtccgagtccattccagaatacacagcagaagaagaaagggaagacaatcgattgtggcggaccgtcgtcatcggggaacaggagcaacgaatcgacatgaaggttattgagccctatagacgcgtaatcagtcacggtggcagcagaggatattacggcgacggtctgaacgctattattgttttcgcagcatgtttcctaccggatagctcccgagcggactaccattatgtaatggagaatctattcctttatgtgatttctacactggaactgatggtagcggaggactatatgatagtttacctgaacggcgctactcctcggagaagaatgccaggcctcgggtggatgaaaaagtgttaccaaatgattgacagacgcctgcgaaaaaaccttaagtcttttatcatcgtgcatccgtcctggttcatccggacgattttggcggttacccgacctttcatctcctccaaattctcttctaagatcaaatatgtcaactcactgagtgagctcagcggactgatccctatggactgcatccatatcccggagtctataatcaactacta

SEQ ID NO: 237413 - DNA, 783 bp, Artificial Sequence
  Description of Artificial Sequence: Synthetic coding sequence
atagatatcaacgtggatgaactggacactcctgatgaggccgatagtttcgaatacacaggccacgacccaactgccaacaaggactccgggcaagagtccgaaagcatcccggaatacacagccgaagaggaaagggaagataacaggctgtggcggaccgtcgtgattggcgagcaggagcagcggatcgacatgaaggtgattgaaccctaccggagagtgatttcccatggcggtgactccgggtactacggcgacggacttaacgccattattgttttcgctgcttgcttcctgcctgattcgtcccgcgcagattaccattatgtgatggagaatctgtttttgtacgtcatcagcactcttgaactcatggtggcagaggactatatgatagtctaccttaatggagccacccctaggcgacggatgccagggttagggtggatgaagaagtgttatcaaatgatcgacagacggctgcgaaaaaatctgaagagctttattattgtgcatcccagctggttcattcgcactattctcgctgttacgcgccctttcatctcttctaagtttagcagcaagataaagtatgtcaacagtctatctgagctcagcggactcataccaatggactgtattcacattcctgagagcattattaaatacgatgaagagagatcttacaagagaagcgtcagaacaagttgcctctataatgacccagaaatgtcctctatggaaaaggacatagacctgaagctcaaagagaaaccatag

SEQ ID NO: 237414 - DNA, 7154 bp, Artificial Sequence
  Description of Artificial Sequence: Synthetic coding sequence
tagttccagtctccagaaagctggaaagagcataagccaagttccattgaccgccgtgcgtcagacagcgtgtttcagcctaagtcattggagttcactaagtcaggaccatgggagtctgagttcggacaacccgaactcgggtcaaatgatatccaagataaaaatgaagaaagcctgcctttccagaatctccctatggagaaatcaccactgccaaatacctcaccgcagggaactaatcacctgatcgaggattttgcttctctgtggcactccggcagaagcccgacagcaatgccggagccttggggtaatccgacagacgacggggaacctgccgcagtagcccctttccctgcgtggtcagcattcggaaaggaagaccacgatgaagccctgaagaacacttggaatttacatcctacatcctcgaagaccccttccgtgcgggatcctaatgaatgggccatggccaaatccgggtttgccttctcctcaagcgaacttcttgataatagccccagtgagataaacaacgaggccgctcccgagatctggggtaagaagaacaatgactccagggaccatattttcgcacccggaaacccctctagtgatctcgaccatacctggactaatagtaaaccccctaaggaagatcagaacgggttggtggatccaaagacccgagggaaggtttatgagaaggtggatagctggaacctcttcgaagagaacatgaaaaaggggggttctgatgtcctggtcccgtgggaggactcctttctgtcctataagtgttcagattacagcgccagtaatctgggcgaagatagcgtcccctcccccttggacactaattactcgacatctgactcctacactagccccacattcgcaggggacgagaaagaaacggaacacaaacccttcgcaaaagaggagggattcgaatctaaggatggcaatagcactgccgaggagactgatatacctccacagtctctacagcagagctcccggaataggataagcagcggccctggcaacttggatatgtgggcaagtccccacactgacaattcctctgaaatcaatacaacccacaatcttgatgagaacgagctaaaaaccgaacacacagatggtaaaaacatctccatggaagatgacgttggcgagagctcgcagagctcctacgatgatccaagcatgatgcagctctataacgaaacaaacaggcagctcacccttctgcactcttccactaatagccgacaaactgcgcctgacagcctcgatctgtggaacagggttattttggaggatacccagtcaaccgctacaatttctgacatggacaatgacctcgactgggatgattgctccggcggagcagcaatccccagcgatggacaaacagaggggtacatggcggagggatctgaaccagagactcgcttcacagtgaggcagttggaaccctggggattggaataccaagaggccaaccaggttgattgggagctgccagcctctgatgaacataccaaagattctgccccttccgagcaccatacactgaacgagaagagcggacagctgatcgccaactctatctgggacagcgtgatgcgcgacaaggatatgtcttccttcatgttacccggtagctcgcatatcacagatagtgaacaaagggaacttcctcctgaaattccatctcatagtgcaaatgtaaaggatactcatagtcccgatgcaccagcagcatctgggacttcggaatctgaagctctgatcagccacctggacaagcaggataccgagcgcgagacactccagagtgacgccgctagcttggctacacggctggaaaatcccggatatttccctcatccagacccctggaagggacacggggacggtcagagtgaatcagaaaaggaggcacagggagcgaccgaccgcggtcacttagatgaagaagaggtgattgctagtggcgtggagaatgcctccgggatatctgaaaaaggacagtctgatcaagaactttctagtctggtggcatcagaacatcaggaaatttgtatcaagtccggaaagattagctcgctggcagtcactttctcacctcagaccgaggagccggaagaggtgctggagtacgaggaaggtagttacaatctggacagccgcgatgtccagacaggtatgtccgccgacaacctgcagccaaaggacacacacgagaagcacctaatgagccagcggaactctggtgaaaccaccgagaccagcgacggtatgaattttacaaaatacgtgagcgtgcctgagaaagatttagagaagactgaagaatgtaactttctagaaccagaaaacgtggggggtggcccacctcaccgcgtccctaggtctctcgacttcggagatgtaccaattgatagcgacgtccacgttagttccacctgctcagagattactaagaatttggacgtcaagggcagtgagaattcgctcccaggagcgggttctagcggaaactttgatcgggatacaattagctccgaatacactcacagttccgccagttctcccgagctaaacgactcaagtgtggccctttcttcctggggacaacagcccagctccggataccaagaggagaaccaaggcaattggtcggaacagaaccaccaggaaagtgaactgatcacaacagatgggcaggtggaaattgtcaccaaggttaaggatctggaaaagaatcggatcaatgaatttgagaaatctttcgacagaaagacccccacattcttggagatttggaatgattccgtggatggagattctttttccagtctgtcatctcccgagactgggaagtactccgaacattcagggacacaccaagagtctaatcttatcgcaagctatcaggaaaagaatgaacacgatattagtgccacagttcagcccgaggatgctagggtgatcagtaccagctcgggaagtgacgacgacagtgtaggcggagaagagtcaattgaagaagagattcaagttgctaactgtcatgtcgccgaagacgagtcccgagcatgggacagtctaaacgagagcaataagtttctggtcacagccgacccgaaatcagaaaacatttacgactatctggactcttccgaacctgctgaaaatgagaacaagagcaaccctttttgcgacaatcagcagtctagcccggacccctggacatttagcccccttacagaaaccgagatgcagataaccgctgtagagaaagagaaacgcagttctcccgagacaggcacaaccggcgacgttgcatggcagatttctcctaaagccagtttccccaagaacgaggacaatagccaactggagatgctcgggttctcagcggactctaccgaatggtggaaagcatcccctcaggaaggacggctcatcgagagcccctttgaacgggaactgagcgactcttctggcgtgctagagatcaactccagcgtccaccagaacgcatccccttggggggtgcctgtgcagggagacatcgaacctgttgagacacattacacaaatcctttttctgacaaccatcaatccccatttttagagggaaacggcaaaaatagtcatgagcagctatggaacattcagccacggcagcctgatcccgatgccgacaagttttcccagctcgtcaagttggatcagatcaaagaaaaggatagcagagagcagacattcgttagcgccgcaggagacgagctgactcccgaaacccccactcaggagcagtgccaggacacaatgctgcctgtatgtgatcaccccgacaccgcattcacccacgccgaagagaactcctgtgtgactagcaatgtgtccaccaatgaggggcaggagactaaccaatgggaacaagaaaaatcttatttaggggagatgacaaattcttccatcgctactgaaaatttccctgccgtgtcgtcccctacccaactaattatgaagccaggatccgagtgggatggctctactccatccgaggatagcagagggacatttgtgcccgacatccttcatgggaatttccaggaggggggacagcttgccagcgctgcacctgacctgtggattgatgcaaagaagcctttctcacttaaggcagacggggaaaatcctgatatcctaacccactgcgagcacgacagtaactctcaggcttcagatagtccagacatatgtcatgacagtgaggccaagcaggagacagaaaagcatctgtcggcctgtatgggacctgaagtggaatcaagtgagttgtgtctcaccgaacctgagatcgacgaggagccgatttacgagccgggacgggagtttgtgcccagcaacgccgaactcgactccgaaaatgcaacagtactccctccgatcgggtaccaggcagatataaagggaagtagccagccagcctcacataagggatccccagagcccagcgagatcaatggcgataatagcacgggccttcaggtttcagagaaaggggcatcaccagatatggcccctatcctggagcctgttgaccggagaatccctcgcatcgagaacgtcgccaccagcattttcgtcacgcaccaggagccaacaccagagggcgacgggagttggatctccgactcattttctcctgagtcccagccaggagccagggcactctttgatggagacccacatctgtccactgagaacccggctctcgttccagatgccctgttagcctccgacacatgcctggacatctcagaggcggcttttgaccattcctttagcgatgcctctggcctgaacacttcgaccggaactatcgacgatatgtcgaagctaactctgtccgaaggtcacccagagaccccggtcgatggcgatctcgggaaacaagacatatgctcgtcagaagcaagttggggggatttcgagtatgacgtcatgggccagaatattgatgaagacctgctgcgcgagcctgagcattttctctatggcggagatcctcccctggaggaggattctttgaaacagtctcttgctccttatacacccccttttgacctgtcttatctcaccgagcccgcacagtccgccgagacaattgaggaggccggatctcccgaagacgaatcactgggatgccgagccgctgagattgtgcttagcgcgctgcccgaccgaaggagcgagggtaatcaggccgagactaaaaaccgcctgccgggaagccagcttgccgttctgcacattagggaggaccccgagtcagtgtatctgcctgttggcgcaggtagtaacattctcagcccatccaatgttgactgggaggtcgagaccgataattcggatttgcctgccggtggcgatatcggaccacctaatggggcttccaaagaaatctccgagctggaagaggagaaaacgattcccacaaaggagcctgagcagatcaagtcagagtacaaagaggagcggtgcaccgagaagaacgaggatcgtcacgcacttcatatggactatatcctggtaaatcgagaggaaaattctcattctaagccagagacttgtgaagagagagaatccatcgcagagctcgaactgtacgtcggatcaaaagagaccgggctacagggaactcagttagcttcctttcccgacacgtgccaaccagctagcctgaatgaacgcaagggattgtctgcagaaaagatgagttctaaatccgatacccgaagctccttcgagtctcctgcacaggatcagtcctggatgtttctcggccactcagaggttggggatcctagtttggacgcaagggacagcggacctggatggagcgggaaaacggtcgaaccgttcagtgaactcgggctgggggaaggccctcagctgcagattcttgaggaaatgaaacctctcgagagtctggccctcgaggaggctagcggaccagtctcacagtcccagaagtccaagtcacgagggcgtgccggaccggatgccgttaccctgcaggctgtcactcacgacaacgagtgggaaatgctttcaccacagcccgttcagaagaatatgatcccagacaccgagatggaggaggaaactgagttcctcgagctaggcactcgaatctccaggcctaacgggctcctgagcgaggacgttgggatggacattcctttcgaggagggggtcttaagcccttcggccgctgacatgcgcccagaacctccaaattctctggaccttaatgacactcaccctaggaggataaagctcaccgccccaaacattaacttgagcctagaccagtctgaggggtccatcctgagcgacgataatttggactcccctgatgagatcgacatcaacgtagacgagcttgacacccccgacgaagccgactcatttgagtatacgggccatgacccaacggccaacaaagattcaggtcaggaatcagagagcatccctgaatacactgcggaggaggaacgggaagataatcggctgtggcgtacggtggtgatcggggagcaagagcaacggatagatatgaaagtgatcgaaccttatcgcagagtgatatcgcacggcggtgatagcggctattatggcgacggcctgaacgccataattgtcttcgccgcatgtttcctccccgattccagcagagcagactaccactacgttatggagaatttgttcttgtatgtgatctccacactagaattgatggtggccgaagactatatgatcgtgtatttgaatggagccactcctcgccgacggatgcccggattgggctggatgaaaaaatgttaccagatgatcgacagacgactgcgaaagaatttgaagagctttattatcgttcatccttcatggttcataaggaccatactggccgttaccaggccgtttatctcctctaagtttagttcgaagataaagtatgtaaatagtctatcagaattatcaggtcttattccaatggactgcatacatattcccgagtctattattaatatcgatctgaagctcaaggaaaagcctta

SEQ ID NO: 237415 - DNA, 8192 bp, Artificial Sequence
  Description of Artificial Sequence: Synthetic coding sequence
atggtgagcaattcccgaaccagttcgactgaggcggtggcaggatctgctcccctgtcacagggatcatccggaatcatggagctgtacgggtccgacatcgaacctcagcccagcagtgttaatttcatagaaaaccctccagacttgaacgactcaaaccaggcgcaggttgatgcaaacgtggatctggtcagtcccgattcgggtttagccacaattaggtccagccgatcctccaaggagagtagcgttttcctgtccgacgactctccagtgggtgaaggtgccggtcctcaccacaccctgttgccaggattggactcctactccccaataccggagggcgctgtcgccgaagagcatgcttggagcggagagcatggcgagcattttgacttattcaatttcgatcccgcacccatggcctccggccagtcgcagcagagttctcatagcgctgactattctcctgccgacgatttttttcctaactctgatctcagcgagggccagctgcctgcaggaccggaaggactcgacggcatgggcacaaacatgagtaattacagtagtagctccctactttccggggctgggaaggacagtctggttgaacacgatgaggaatttgtgcagaggcaggattcacctcgtgataactccgagcgaaacttatctttgacggacttcgtgggtgacgagtccccatcccctgaacgtctgaaaaatacggggaagcggatcccccctacccctatgaactccctggtggaaagtagcccgagcacagaggaaccagcgtctctgtatactgaggacatgactcaaaaggccacagacacggggcacatgggtcctccccagacccacgccaggtgttccagttggtgggggggactggagattgatagcaaaaacattgcggacgcgtggtcatcatcagagcaggaatcagtgtttcagagtcctgagagttggaaagaacataaaccatcttcaatcgataggcgggcatccgatagtgtgtttcagccaaaaagcctcgaatttacaaaaagcggaccttgggaatctgaatttggtcagcctgaactcggctctaatgacattcaggataaaaacgaagaaagcttgccttttcagaacctgcctatggagaaaagcccactgccaaacacctcgccacagggaactaaccacctcatcgaggatttcgcctcattgtggcattctggacggagcccaaccgcaatgccagagccttggggcaaccctacagatgacggtgagcccgctgccgtggcaccatttcctgcctggtcagctttcggaaaagaggaccatgacgaagctctcaagaatacgtggaaccttcaccccacgagtagtaagaccccaagtgtaagagaccctaacgaatgggctatggctaaaagcggcttcgccttttcttcgtctgagttgctggacaatagcccgtctgagatcaataacgaggcagcaccagaaatctggggcaagaagaacaatgatagccgtgaccacatttttgcgccagggaacccctcctctgatttggaccacacatggaccaacagcaagccacccaaagaggaccaaaatggcctggtggatcctaagacacggggtaaggtatatgagaaggtcgacagctggaacctcttcgaggaaaatatgaagaaaggcggttctgatgtgctggttccctgggaggactcattcctgagttataaatgctcggattattccgcgagtaacttgggggaagacagcgtgccctctccgctggacactaattacagcacatccgattcctatactagtccaacatttgccggtgatgagaaggagacagaacataaaccattcgccaaggaggaaggtttcgaatccaaggatggcaatagtacagctgaggaaacagatattcctcctcagtcactacagcaatccagccggaatcggatcagtagtgggccaggcaacctggatatgtgggcgtccccacatactgacaactcctctgaaattaacacgacccataatcttgatgagaatgaacttaaaaccgaacatacagatggaaaaaacatcagcatggaggacgatgttggcgagtctagtcagtcatcctatgacgacccctccatgatgcaactatacaacgagaccaataggcagctcaccctcttgcactccagtactaattcacgccagaccgctcctgacagcctggatctgtggaatagagtcattctagaggacacacagtctaccgctaccatttcggacatggacaacgaccttgactgggacgattgtagtgggggagccgcaatcccttcagacggacaaactgagggctatatggctgaaggttcagagccagagactaggtttaccgtgagacagctggagccatggggactggagtaccaagaggcaaatcaagtcgactgggagttgccagctagcgatgagcacacaaaggacagtgcaccctcggagcaccacaccttgaatgaaaaatcaggacagctcatcgcaaactccatttgggactccgtgatgcgcgataaggacatgagtagtttcatgcttccagggtcttctcatatcacagacagtgagcagcgggagttaccccctgagataccctctcattcagctaacgtcaaggacacccactcccccgatgctccagccgcttcagggacatctgaatctgaggccctgatcagtcatctcgataaacaggatacagagagagaaacgttgcagagcgacgccgcttccctcgccactcgtctcgaaaaccctggttatttcccacatcccgatccttggaaaggccacggcgacggacagtctgagagcgaaaaggaagcccagggagcgaccgatcggggacatctcgatgaggaagaagtcatagcctctggagttgagaacgctagcggcatcagtgagaagggtcagtcagatcaggaactctcctcgctggttgcctcagagcatcaagagatttgcattaagagcggcaaaatttctagtctggctgtgacattctcaccccagacagaggaaccagaagaggttctggaatacgaagaggggtcatataatctggactctcgcgacgtccagacgggcatgtctgccgataacttacaacctaaggacacgcacgagaagcaccttatgtcacagaggaattccggggagactacagaaacatctgacggaatgaatttcacaaaatacgtttctgtgccagaaaaggacctagagaaaaccgaagagtgtaatttccttgaaccggaaaatgttggcggagggccacctcaccgagtgccgaggagcctggatttcggtgatgtgcccatcgattcagacgttcacgtatcttcgacgtgttctgagataacgaagaatctcgatgttaagggaagtgagaacagtctgccgggagctggaagcagtggaaactttgatcgcgacacaatctccagtgaatacactcattcctctgcgtcaagccctgaactcaacgactccagcgttgcactgtcaagttggggccagcagccaagttcaggataccaggaggaaaatcagggaaattggagtgagcagaaccaccaagaatctgaactgatcactactgatggacaggtggagatcgttactaaggtgaaggacctcgagaagaatcgaatcaacgaattcgagaagagttttgatcggaaaaccccaacattcctggaaatttggaatgactctgtggacggggactcctttagctccttgagtagtccagagaccggcaagtacagcgaacattcgggtacgcaccaggagtcaaacttgatcgcaagttatcaggaaaaaaacgagcacgatataagtgccactgtccagccggaagatgccagggtgatctcgacctcctcaggaagcgacgacgacagtgtgggcggagaggaatctatcgaagaggaaattcaggtggctaactgtcacgtcgcggaagacgaaagtagggcctgggactcgctgaacgagagcaataagttcctcgtgacagccgatccaaagtccgaaaatatatacgattatttagatagttcagagcctgccgaaaacgaaaataaaagcaatccattttgcgacaaccaacagtcatcgcctgatccctggaccttcagcccacttacagagactgaaatgcaaatcacagccgtcgagaaagagaaaaggagttcacccgagaccgggaccacaggggatgttgcctggcagatatctcccaaggcaagtttcccaaagaacgaagataattctcaacttgagatgctggggttcagtgctgactccacagaatggtggaaggcttctccccaggaggggaggttgatagaatcacccttcgaaagggaactatcagactccagtggcgtactggagataaactcttccgtgcaccagaacgcatctccttggggggtccccgtgcagggcgacatcgagcctgtcgagacgcactacactaacccatttagcgataaccaccagagccctttcctagaagggaatggcaaaaacagccatgagcaactgtggaatatacagccacggcaaccggatccagatgccgataagttttcacaactggtcaaactggatcaaatcaaggaaaaggattctagagaacaaacattcgtgtccgctgctggggacgagctgacccccgagacaccgacccaggaacagtgtcaagatacaatgcttcccgtgtgcgaccacccagataccgcattcactcacgccgaggagaattcatgcgtaacaagtaatgtgagtacgaatgagggacaagagaccaatcagtgggaacaagagaagagctacctgggagaaatgacaaacagttccattgccactgaaaatttccccgcagtgtccagcccaacgcaactgataatgaaacctggctcagagtgggacggaagcacgccgtcagaggatagccggggaacatttgtacccgacatcctccatggtaactttcaggagggaggacaacttgcaagcgctgccccagatctctggattgacgccaaaaagccctttagcctgaaagcagatggagaaaaccccgacatactgacccactgtgagcacgacagcaacagccaagcatcggacagccccgatatctgccacgatagcgaagccaagcaagagacagagaagcacctttccgcctgcatggggccagaagtggagagttccgagctgtgcttgaccgagcctgaaattgacgaggagccaatttacgaaccgggaagagaatttgtgccgtcaaacgctgagttggactctgagaacgccaccgtgctgcccccaatcggctaccaggcagatattaaaggctccagccagccagctagtcacaaggggtcaccagagccaagtgaaatcaatggtgacaatagcaccggactgcaggttagcgaaaagggggcaagccccgacatggcaccaatcttagagcctgtggatagaagaatccccaggatagaaaacgtcgctacatccatcttcgtgacacaccaggaacccacccctgagggtgacgggagctggatttctgattcctttagtccagagtcccaacctggcgcacgcgctttattcgacggagacccacaccttagcacagagaatcccgctttggtgcctgacgccttgttagcatccgatacctgtctggatatcagtgaggctgccttcgatcactccttctcagatgctagcggactcaacacatcgacaggaaccatcgacgacatgtcaaagctcaccctgagtgagggccatccagagacccctgtcgacggagacttaggaaaacaggacatctgctccagcgaagctagttggggagacttcgagtacgacgtgatgggtcagaacattgatgaagatttgctccgggagccggagcatttcttgtatggcggtgatcctcccctggaggaggatagtctgaagcaatcgctcgccccttacaccccaccctttgacctaagttacctgactgagcctgctcagtccgccgagacaattgaagaggctggctctcccgaggatgagtcactgggctgtcgggcagccgagattgtgctcagcgccctccccgatagacgtagcgaaggcaatcaagcagaaaccaagaaccgcctccccggatctcagctcgccgtacttcacatccgggaggatccagaatccgtttacctccccgtcggtgctggctccaatattctgagcccctcaaacgtggactgggaggtggagaccgataatagcgacctgcctgccggtggggatatcggacccccaaacggcgcttctaaggaaatctctgaactggaggaagaaaagactattccaacaaaggaacctgaacagatcaaatcagaatataaggaggaaagatgcacagaaaagaacgaggatcggcatgccctccatatggactatatattagttaatagggaagagaactcacactctaagcctgagacatgcgaggagagagaaagtatcgctgagttggagctttacgtgggcagtaaagagacggggctgcaaggaactcagctagctagcttccctgacacttgtcagcccgcatcacttaatgagcggaaggggctgtcggcggagaaaatgagctctaagagcgacaccaggtcgagcttcgagtctccagctcaggatcagagctggatgtttttagggcatagcgaggtcggtgacccatccctagacgctcgagacagcggaccagggtggagcggcaagacagtggagcctttttctgagcttgggttgggcgaaggtccccagctccagatcctcgaagaaatgaagcctctggagtcattggcactcgaggaggccagcggcccagtgtcacagagccagaagagcaaaagcagaggacgagccggacctgatgccgtcactctgcaggctgtcacccatgacaatgaatgggagatgctgagcccccagccagtgcaaaaaaacatgattcccgacaccgaaatggaagaggaaaccgagttcctggagctcggaaccagaatcagccggccaaacggccttctaagcgaagatgtcggaatggatatcccgttcgaggagggcgttctgagtccctccgctgccgacatgagacctgaacccccaaattcccttgatttgaatgacacgcaccccaggcgcattaaactcacagctcccaatattaacctgtctctggaccagtccgaggggagcatactcagtgacgacaacctggacagtcctgatgagattgacattaacgtggatgagctggacacaccagatgaggccgattcttttgagtatacgggacatgaagatcctaccgcgaacaaagacagcggccaagagtccgagtctatccctgaatatactgctgaagaagaacgtgaagataacagactttggcggacagtggtgatcggcgagcaggaacaaagaatcgacatgaaggtgatcgaaccctaccgcagggtcatttcacacggagggtactacggcgatggcctcaatgccattatagtgttcgccgcatgctttctacctgactccagtagggcagactatcactacgtcatggaaaatctgttcctgtatgtaatttcaaccctcgagttaatggtggccgaggattacatgatcgtttacctgaatggagcaactccaagacggagaatgcctggattgggctggatgaagaagtgctatcagatgattgaccgccgtttaaggaaaaatctgaaaagttttattatcgtccacccaagctggttcatcaggactatccttgcggtcactcggccattcatcagctcaaagttttcatccaaaattaagtacgtcaattccctgagcgagctgtccggactgatcccaatggattgtatccacattccggagagcattatcaagctcgacgaggagctgagagaggcgtctgaggccgctaagacatcttgtttatacaacgatcccgagatgagtagtatggaaaaggacatcgacctcaagttaaaggagaaacccta

SEQ ID NO: 237416 - DNA, 927 bp, Artificial Sequence
  Description of Artificial Sequence: Synthetic coding sequence
atgcggcctgaaccccctaactctttagatctcaacgacactcaccccagaagaatcaaactgacggcgccaaatattaatctgtccctggaccagagcgaaggcagtattctctctgatgacaatttagactcaccagatgagatcgacatcaatgtggacgaactggatacacctgacgaagcagattctttcgagtacaccggacatgacccaacggcaaataaggattccgggcaggagtcggagtctatcccagagtacactgctgaggaagagcgcgaagataaccgcctgtggaggacagtagtaattggggagcaggaacagcggattgacatgaaagtaattgaaccatatagacgggttatctcgcacggcggtaaattaagatactatggagacggtctgaatgcaattatcgtcttcgcagcctgcttccttcccgatagttctcgggcagattatcactatgtcatggaaaatctttttctgtacgttatatcgaccctcgaactcatggtggccgaggactacatgattgtctatctaaatggggctaccccacgcaggagaatgccagggttaggctggatgaagaagtgctaccagatgatcgatagaaggcttagaaaaaatctaaagtccttcattattgtgcacccttcctggttcattcggaccatattggctgtcactcgtcccttcatctcgtctaagttttcttcaaagataaagtacgttaactccctttctgagctgtctgggctaatccctatggactgcattcacatacctgagagtattatcaaatatgacgaagaacgctcctataaaagatccgtcagaaccagctgcttatacaacgatcctgagatgtcatcgatggagaaagacattgatctcaagttgaaagaaaagccttag

SEQ ID NO: 237417 - DNA, 1014 bp, Artificial Sequence
  Description of Artificial Sequence: Synthetic coding sequence
atgaatggtctgcgtaataaacaactgctcagcgaagatgttggtatggatatcccctttgaggaaggcgtcctgtcgccttctgccgcagatatgagacccgaaccccctaactcacttgacttgaacgacacccacccacgacgaatcaaactaaccgcccctaatatcaatctttcattagatcagtctgagggatcaatcttgtctgacgacaacctggattcacctgacgaaattgatatcaacgtagatgaacttgacactccagacgaggccgattcattcgagtacacgggacacgacccaaccgccaacaaggacagtgggcaggagtctgagtctatccccgagtatactgccgaggaagaacgggaagacaatagactatggaggaccgtagtaattggcgagcaagaacagcggattgatatgaaagtgatcgagccttacaggagagtcatctctcatggtggatactatggcgacggactgaatgccattattgtgttcgctgcatgctttttacctgactcctccagagccgattaccactatgttatggaaaatctgtttctgtatgtgatcagcaccctggagctgatggtggctgaggactacatgattgtgtacttgaacggggctacccccagaaggcgaatgcccggacttggatggatgaaaaagtgttatcagatgattgaccgcaggttaaggaaaaaccttaaatccttcattatcgtgcacccatcgtggttcatacgtaccatcctggccgttacccggcctttcatctcctcaaagttctcttccaaaattaaatatgtcaatagcctatcagagctctcaggtctcatacccatggattgcatccacatcccagagtctattataaagctagacgaagaactaagggaggcttccgaggccgctaagacatcctgtttatacaatgatcccgagatgtcatcaatggaaaaggacatcgacctgaaactaaaggaaaaaccgtag

SEQ ID NO: 237418 - DNA, 1155 bp, Artificial Sequence
  Description of Artificial Sequence: Synthetic coding sequence
atggccggtaacgctgagccgccaccagccggtgcagcctgtccccaggaccggcgatcttgcagcggtcgagccggtggagaccgagtgtgggaagatggtgagcatcccgctaagaaattaaaatccggcggagatgaagagagacgggagaaaccgcctaaaaggaagatcgttctcttaatggcttacagcgggaagggatatcatggaatgcagcgaaacgtgggcagctcccaatttaagacaatcgaagatgatcttgtcagcgcgctagttcgaagcggatgcatcccagagaatcatggggaagacatgaggaagatgtcttttcagcggtgtgcaagaaccgacaagggtgtgtccgctgctgggcaagttgtgtcactcaaggtgtggctgatcgacgacatcctggagaagataaactcgcacctgccatctcatatccgcatcctggggcttaagcgcgtcacgggcggatttaactccaagaaccggtgtgatgctcggacttattgctaccttctacctaccttcgcctttgctcacaaggaccgagatgttcaggacgagacttaccggctgtccgcagaaactcttcagcaggtcaacaggctcctagcgtgttataaaggtacacataactttcacaattttactagtcaaaaagggccacaagacccctccgcctgcagatatatcttagaaatgtattgtgaagaaccctttgtgcgcgagggccttgagttcgccgtgataagagtgaagggccaatctttcatgatgcaccagattcgaaaaatggtcggccttgtagttgcaatcgttaagggatatgcccctgaatctgtgttagaacggtcatggggcactgaaaaagtagatgtcccgaaggctcccggattggggctggtgctggaacgcgtgcactttgagaaatacaaccagcggttcggtaacgacggtctacacgagccactggattgggcccaggaagagggcaaagtcgcagccttcaaagaagagcacatttaccctactattattggaaccgaaagggatgaaagaagcatggcccagtggctctctacgcttccaattcataacttcagtgccaccgcactgacagcaggcggaactggcgctaaatag

SEQ ID NO: 237419 - DNA, 1284 bp, Artificial Sequence
  Description of Artificial Sequence: Synthetic coding sequence
atgggtctccagttacgcgcattgttaggcgcttttggccgatggactctgcgattagggccacgcccatcttgtagcccaaggatggccggaaacgcagagccacctcctgctggcgctgcctgtccccaggaccgcaggtcttgttccggccgtgcaggcggtgacagggtctgggaagatggtgagcatcccgcaaagaagctcaagtctggcggtgatgaagaacggagggagaaacccccaaagagaaaaatcgtgctgctgatggcatatagcgggaaggggtaccacggaatgcagcgcaatgtgggaagctcacagttcaagactattgaggacgacttagtgagcgccttggtgcgtagcggatgcatccctgagaaccacggagaagatatgcgcaaaatgagttttcagcgatgtgccaggacagataagggcgtatccgcagcgggtcaggtcgtctctttgaaggtatggctgatcgacgacattcttgaaaagatcaactcccatctgccatcacacataaggatcttggggctcaaacgggttacaggcggatttaacagcaaaaataggtgcgatgcacgaacatactgttatctcttaccaacgttcgcttttgcacacaaagatagagatgtgcaagatgagacataccgcttatcagccgagacactccagcaagtgaaccggctgttagcttgctataagggtacccacaattttcacaactttacctctcagaaagggccacaagacccatcagcctgcagatacatcctggaaatgtattgcgaggagccctttgtcagagaaggcctagagttcgccgtcatccgcgtcaagggtcagagctttatgatgcatcagattaggaagatggttggactcgtcgtcgcaattgtgaaaggctatgcgccagaaagcgtcttggaacggtcctggggcaccgaaaaggtagatgtgcctaaagctcctggactcggcttagtactggagcgggtgcactttgagaaatacaatcagaggtttgggaacgatgggctgcatgagcctctggactgggctcaggaagagggaaaggtggccgctttcaaagaggagcatatctaccccaccattattggaacagagagggacgaacgttcaatggcacagtggctcagcacactgcctatccataacttttctgccactgctttgacagctggtggcacaggcgcaaaggtgccttcccccttggagggatctgagggggatggcgatacagactag

SEQ ID NO: 237420 - DNA, 1200 bp, Artificial Sequence
  Description of Artificial Sequence: Synthetic coding sequence
atggctggcaatgcagagcctcctcctgccggtgccgcatgcccccaagataggcggagctgttctggaagagccggaggcgatcgcgtgtgggaagacggtgaacaccctgctaaaaaacttaaatcggggggtgatgaagagaggagagagaaacccccaaagagaaagatcgtactgctgatggcttacagcggtaagggataccacggaatgcagcgaaacgttgggagttctcagttcaaaaccattgaagacgacctggtgtccgccctcgtacgcagcggttgcatccccgagaatcacggggaagacatgcgcaagatgtcatttcagaggtgcgcccgaaccgataagggagtgtcagcagccggacaagtcgtcagtcttaaggtgtggctcatagatgacatcctggagaagattaatagtcatctccctagccatattcgaatactgggactgaagcgcgtgaccggcggattcaattctaaaaatcgatgtgacgccaggacctactgttacctgctccccactttcgcatttgctcataaggaccgggatgtacaagatgaaacttaccgactgagcgccgaaactcttcaacaggtcaatcgcctgttggcctgctataagggtacacacaattttcataactttaccagtcagaagggccctcaagacccctccgcctgtagatacattctcgaaatgtattgcgaggagccgtttgttagagaggggctggagtttgcagtgatccgcgtaaaagggcagagcttcatgatgcaccaaataagaaagatggttggactcgttgttgcaatagttaagggatatgcccctgagagcgtgctggagagaagctggggtactgaaaaagttgatgtgcctaaggcccctggactcgggctcgttttggaaagggtccacttcgaaaaatacaaccagagatttgggaatgatggcctccacgaacctttggattgggcacaggaagagggcaaggtggcggctttcaaagaggagcatatatacccaacgattatcggtacagagagagatgagagatctatggctcagtggctcagcactcttcccatacataacttttccgccacagctcttactgcgggagggacgggcgctaaagtgcccagtcccctggaaggttcagaaggggacggtgacacggactag

SEQ ID NO: 237421 - DNA, 1200 bp, Artificial Sequence
  Description of Artificial Sequence: Synthetic coding sequence
atggccggtaacgccgaaccgccacctgcgggagctgcatgtcctcaggaccgcaggtcctgtagtggcagggctgggggtgatagagtatgggaagatggcgagcacccagccaagaaattaaaaagcggaggtgatgaggagcgcagagaaaagccaccaaagcggaagatagtccttcttatggcgtactccggcaagggctatcatggtatgcagaggaatgtcggatcctcccagttcaagacgatcgaggacgatctcgtaagtgcccttgtaagatcaggctgcatccccgagaaccacggggaggacatgcgaaaaatgtccttccagagatgcgctcgaaccgataagggagtgtctgctgcaggacaggtggtgagtctaaaggtgtggcttattgacgacatcctcgagaagatcaactctcacctgcctagccacatacgcatcctcgggttaaaaagagtgactggcggatttaatagtaagaacaggtgtgatgctaggacatattgttacctgctgcctaccttcgcttttgctcacaaagaccgggatgtgcaagatgagacctatagattgagtgcagaaaccctgcaacaggttaataggctgctcgcctgttacaaaggaacccacaactttcataacttcacttcacagaagggaccacaggacccttcggcttgcagatacatcctggaaatgtattgcgaggaaccatttgtccgtgaaggactggagtttgcggtgattcgcgtcaaagggcaatcattcatgatgcatcaaatacgtaaaatggtgggactggtggtcgccatagtgaagggatacgctccagaaagcgtgctggaacgatcatggggaacagaaaaggttgatgttccaaaagccccaggcctcggtctggtgcttgagcgggtgcatttcgaaaagtataatcagagattcggaaatgatggactgcatgagccactcgactgggcccaggaagaagggaaagtggcagcttttaaagaggagcacatctaccccaccattatcgggaccgagcgtgacgagagaagcatggctcaatggctgtcaactctgcctattcataatttttccgccactgctctcactgctggtggcaccggcgctaaagtccccagccctctagaaggatcagagggtgatggcgacacggactag

SEQ ID NO: 237422 - DNA, 465 bp, Artificial Sequence
  Description of Artificial Sequence: Synthetic coding sequence
atggctggcaatgctgagcccccaccagcaggagccgcatgcccccaggatcgcagatcatgcagtggacgcgcaggaggcgatcgcgtttgggaggatggtgagcacccagccaagaaattaaagagcggtggcgacgaggaaagacgcgagaagcctccaaagcggaagatagtcttgctgatggcgtacagtgggaaaggctatcacggcatgcagcggaatgttggctcgtctcagtttaagactatcgaagatgacctggtgagcgcccttgttagatccggttgcatacccgagaatcatggcgaggatatgcgtaagatgagctttcaacgctgcgcgagaacagacaagggcgtcagcgctgccggtcaggtggtaagcctgaaagtctggctaatcgacgatatcctcgagaagattaattcccatctgcccagccatatcagaatcctggggtag

SEQ ID NO: 237423 - DNA, 618 bp, Artificial Sequence
  Description of Artificial Sequence: Synthetic coding sequence
atgtctaagggacgggctgaggccgctgcgggagcggcaggcatcctgctgcgctatctgcaggaacagaacagaccatattcctcccaagacgtctttgggaatctgcaaagagagcacggactcggtaaggccgtcgtcgtgaagacgttggagcagctcgctcagcaagggaagatcaaggaaaagatgtacggtaaacagaagatttattttgccgatcaggatcagtttgacatggtgtctgacgcagatttgcaggtactcgatggcaagattgtggctttgacagccaaggtgcagagtctgcagcagtcctgcaggtacatggaggctgagatgcagaaggagatccaggagctcaaaaaggagtgcgcaggctatagagagcggctcaagaacattaaggctgccacaaaccacgtaacccccgaggaaaaggagcaggtgtatcgtgaaaggcagaagtattgtaaagagtggcgcaaaagaaaaagaatggcaactgagttgtctgatgccattctggagggataccccaaaagcaagaagcagttctttgaggaagtgggcatcgaaacggacgaggactataatgtaacattgcccgacccgtag

SEQ ID NO: 237424 - DNA, 654 bp, Artificial Sequence
  Description of Artificial Sequence: Synthetic coding sequence
atgtccaagggtagagctgaagcggcagccggtgccgctggcatccttctgcgctacctccaagagcagaacagaccctatagtagccaagacgtgttcggtaatctgcagcgagaacatgggctcggaaaggccgtcgtggtgaagaccttagagcaattggcacagcaggggaaaataaaagaaaaaatgtacgggaagcagaagatctacttcgcagatcaggaccagtttgacatggtctcagatgctgatcttcaggtgctggacggcaagatcgtggcgttgacagctaaggtccagtcattacagcagtcgtgtagatacatggaggctgagctgaaagagctttcctccgcactgactactccagaaatgcaaaaagaaatccaggaattgaagaaggagtgcgccggttatagggagcggctgaaaaatattaaggcagccaccaatcatgtgacacctgaggagaaagaacaggtctatcgggagagacagaagtattgcaaagagtggcgtaaaaggaagcggatggcaaccgaactctccgacgcaatcctcgagggttaccccaagtcgaagaagcaatttttcgaggaggtgggtattgagacagatgaggattacaacgtcacacttcccgacccgtag

SEQ ID NO: 237425 - DNA, 465 bp, Artificial Sequence
  Description of Artificial Sequence: Synthetic coding sequence
atgtatggaaagcagaagatatattttgcagatcaggaccaattcgatatggtgagtgatgctgatttgcaggtgttagatggcaagatcgttgctctgacagccaaagtgcagagcctccagcaatcttgccgctatatggaagccgaactgaaggagttgtctagtgcactgaccacaccagagatgcagaaggagatccaggagctgaagaaggagtgcgctggatatcgggaacgcctcaaaaacataaaggccgcaaccaatcacgtgactcctgaggaaaaggagcaggtctatagggagagacagaaatactgtaaggagtggaggaagcgcaagcgaatggctaccgagctcagtgacgctatcttggaggggtatccaaaatctaaaaaacaatttttcgaagaggttgggattgagaccgacgaagattataatgtcacattacctgatccatag

SEQ ID NO: 237426 - DNA, 915 bp, Artificial Sequence
  Description of Artificial Sequence: Synthetic coding sequence
atgtttagtgtgttaagctacggccgtcttgtagccagagcagtgctggggggtctgtcccagactgacccacgcgctggtgggggaggcggtggggactacggcttagtgacggctggctgtggcttcggtaaggattttagaaagggcctgttgaagaagggggcttgttacggtgacgacgcgtgctttgttgcccgacacaggtctgccgatgtacttggcgtggccgatggagtgggcggttggcgagattatggcgttgatccatcacaattctcaggcactctgatgcgaacgtgcgagcggctggtcaaggagggtagattcgttccgagcaatccaattggcattctgacgacatcctattgtgaactgcttcaaaataaggtaccactgctcggatcttccaccgcctgcatcgtcgtgctggacaggaccagtcaccgactgcacaccgccaacctaggagactcaggttttctagtggtaagggggggtgaggtggtccatcgctccgacgagcagcagcactatttcaacactccattccagttatcaatcgccccaccagaagctgagggcgttgttctctcagactctcctgacgccgctgattctaccagtttcgacgtccagctaggggacatcattctcaccgcaactgacggcctgtttgataatatgcccgattacatgatcttacaggaactaaaaaagctgaagaatagtaattatgaatccatccaacagaccgctagatcaattgctgaacaggcacatgaactggcttatgaccctaattatatgtcccccttcgcccagtttgcctgcgacaacggccttaatgttcgcggtggcaagcccgacgacatcacagtgctcctgagcatcgtggcggagtacacggattag

SEQ ID NO: 237427 - DNA, 1746 bp, Artificial Sequence
  Description of Artificial Sequence: Synthetic coding sequence
atggctgttaggcaggcactgggacggggtctccagttagggcgtgcacttctgctaagatttactggcaaaccgggaagggcatatggtctcggccgtccaggacctgccgcaggctgcgttagaggcgaacgtccaggttgggccgcagggccaggcgcagagcccagacgggtaggtctgggcttgccgaacaggctgcggttctttaggcaatccgtagccggactcgccgctaggctgcaaaggcagtttgtcgttagagcttgggggtgcgctggaccatgtggcagagcagtttttctcgcattcggcctaggcctggggcttatcgaagagaaacaagccgagtccaggcgcgcagtttctgcctgtcaagagattcaggcgatttttacacaaaaatcgaaaccaggtccggatccactcgacacacggagactgcagggttttagactggaagaatacctgatcggtcagtctatcggaaaagggtgttctgccgcagtttacgaagctactatgccgacactcccacagaacctcgaggtcacaaagagtaccgggctgctgccgggaaggggccctggaacaagtgccccaggcgaaggacaggagagggcaccaggagcaccggctttcccacttgccattaagatgatgtggaacatctctgctgggtcgagttccgaagccatccttaataccatgagtcaggagctggtgcctgcatccagagtcgccctagcgggtgagtacggggctgtgacttataggaaaagtaagagggggccaaagcagctagcccctcatcctaacatcatacgagtattgcgagcattcactagctcagttccactgctccccggtgccctggtagattatcctgatgtcctgccgtccagactccatcctgaaggactgggccatggacggacgctttttttagtgatgaagaactatccctgcaccctgaggcagtatctgtgtgtcaatactccaagtcctcgcctggcggcaatgatgttgctgcaactgttagagggtgtggaccatctggtacaacaaggaatagcacatcgggacttaaagtctgacaatattctggtcgagctggacccggacgggtgtccttggctcgtgatcgccgacttcggatgttgcttggccgacgaatcgataggcctacaactgcccttttcgagctggtacgtggacagagggggtaatggctgtttaatggcaccggaagtctccaccgccagacccggtccgagagccgtgatcgattatagtaaggctgatgcctgggccgttggagcgatcgcctacgagatatttgggttagtcaatccattctacggccaaggtaaagcccatctcgagtcccgctcttaccaggaggctcaattgcccgcactcccggaatctgtgcctcctgacgttcgccagctagtgcgggctttgctgcaacgagaggcgtccaaacgcccttccgccagagtcgcggctaatgtattgcatctcagtctgtggggggagcatattctcgcccttaagaacctgaaactggacaaaatggtcggctggctgttgcagcagtccgcagctacgctgctggcaaacagactgaccgagaagtgctgtgtcgaaactaagatgaagatgttatttctggcgaacttagaatgtgagacactgtgtcaggccgcactgctgctgtgctcttggcgcgcagccctctag

SEQ ID NO: 237428 - DNA, 393 bp, Artificial Sequence
  Description of Artificial Sequence: Synthetic coding sequence
atggctgctgtgctgggcgctttaggggcaacacgtcgattgctggcagcgcttcggggacagtctctcggtctggcagctatgagcagtggaacgcatcgactaaccgctgaggagcgcaatcaagccatcctagatctcaaggcagccggatggagcgaactctccgaacgcgacgcaatctacaaggagttctccttccacaacttcaatcaggcattcggcttcatgtccagagtcgcacttcaggcagagaaaatgaaccatcaccctgagtggtttaacgtctacaataaggtccagattacacttaccagtcacgattgtggcgagctaacaaaaaaagatgttaaactagctaagtttattgaaaaagctgccgcttctgtgtag

SEQ ID NO: 237429 - DNA, 393 bp, Artificial Sequence
  Description of Artificial Sequence: Synthetic coding sequence
atggctgccgtccttggggctttgggcgctaccaggcgactgctggctgcactgcgaggtcaatctctgggcctcgcagctatgtccagcggtacccatcggctgacggctgaggagcgaaaccaagcgatcctggacctgaaggctgctggctggtcggagttatctgaacgggacgccatctacaaggaattctcttttcataattttaaccaggcattcggattcatgtcgcgagtggccctacaggccgagaaaatgaaccaccaccccgagtggttcaatgtttacaataaagtgcagataactttgactagccatgactgtggtgaactgacaaagaaagacgtaaaactggcgaagtttatagaaaaagctgcggcaagtgtgtag

SEQ ID NO: 237430 - DNA, 1041 bp, Artificial Sequence
  Description of Artificial Sequence: Synthetic coding sequence
atggcacttctcaaggtaaagttcgatcaaaagaagagggtgaaactggcccagggcctatggctgatgaactggttttctgtactcgccggaatcattatatttagcctggggttgtttctgaagatcgagttgcgaaagcgcagtgacgttatgaataactcagaaagccatttcgttcccaacagcctgattggcatgggcgtcttgagctgtgtattcaactctctcgcaggaaaaatctgctatgacgcacttgatccggctaagtatgcgaggtggaagccatggctgaagccataccttgcaatctgtgtcctgttcaatattattttattcctggtcgccttgtgttgcttcctgctgaggggcagtttagagaatacactggggcagggactgaaaaacggaatgaaatactatcgggatacagatacacctggcagatgtttcatgaagaaaacaatcgacatgttgcagattgagtttaagtgctgtggcaataacggtttcagagactggttcgagatccaatggatatccaaccgttacttggatttctcctccaaggaggtgaaggatagaattaagtcaaatgtcgacggccgatacctggtggatggcgtgcctttctcctgttgtaatccatcatccccacgcccttgcattcagtaccagattacgaacaactctgctcattactcttatgatcaccagactgaggaattgaatctctgggtgagagggtgcagggccgctctgcttagttattactcctccctcatgaactctatgggtgtagtgacgctgctgatttggctgtttgaggttacaatcactatcggtctccgttaccttcagacctctcttgatggagtcagcaaccccgaagaatctgagtctgagtctcagggctggcttctggagagatccgtccctgaaacctggaaggctttcctcgagtcagtaaagaaattggggaaaggcaatcaagttgaggcagaaggtgccgatgccggacaggctcccgaggcaggctag

SEQ ID NO: 237431 - DNA, 1191 bp, Artificial Sequence
  Description of Artificial Sequence: Synthetic coding sequence
atgccactctttgagccccgagtattcaccgccggatcagaagaaagggttacatgtctgcctcctaaggggctgcccgaacctagcgtctggtgggaacatgcaggcgtgaggctgcctacacatggcagggtctatcaaaagggtcatgaactcgtactagcgaatatcgctgaatcagacgccggagtgtacacttgccatgctgcaaacctggccggtcagcgaaggcaggatgtcaatataacggtagccactgtgccttcatggcttaaaaaaccccaggattctcagctagaggaaggcaagcctgggtacttggattgcctgacgcaggcgacgcccaagccaactgtggtctggtacaggaatcagatgctgatctccgaggatagtcgttttgaagtattccttgctaaggcgcagggcctggaagaaggcgtggccgagaccctagttctggtcaagtccctccagagcaaggacgaacagcaacagttggactttagaagggagctggagatgtttggcaagttgaatcatgcaaatgtggtacggttgctcggactttgtagagaggccgagccccattacatggtgctggagtacgtggacctaggggacctcaagcagtttctacgcatctccaagagtaaagatgaaaagctcaaaagccagcctctgtctacaaaacagaaggttgccctctgcacgcaggtggcccttggcatggaacacctctccaataaccggttcgtgcataaagacctcgctgctcgcaactgtttggtgtcagcccaacggcaggtgaaagtctcagctttgggcttgagtaaagacgtttataacagcgagtattaccattttcggcaggcgtgggtgccactccggtggatgtctccagaagccattctggagggtgattttagtactaaatcagacgtttgggcatttggggtccttatgtgggaagtgtttacacacggagagatgccccatggcggacaagccgatgatgaggtgcttgccgaccttcaggcgggtaaagcccgattgccgcagcccgaaggctgtccgagtaagctgtacagactcatgcaacggtgctgggccctgtcaccaaaggatagaccgagctttagtgagatcgcctccgccctcggggattctaccgtggattccaaaccatag

SEQ ID NO: 237432 - DNA, 3093 bp, Artificial Sequence
  Description of Artificial Sequence: Synthetic coding sequence
atgggagccgctcgcggatcacccgctagaccacgcaggctacctttgttgtcagttttgctgctccctctgttagggggtacccagacagccatagttttcataaagcagccttctagccaggacgctttacaggggaggcgagccctcctccgctgcgaggtggaggcacccggacccgtgcatgtgtactggctgttagacggggctccagttcaggacacagagcgacgcttcgctcaagggtccagtctttcttttgccgctgtagataggttgcaagattccggcacatttcagtgtgtcgctcgagacgacgtgaccggggaggaagctcggtcagcgaacgctagttttaatataaaatggatagaggctgggcctgtcgttctaaaacatcctgcctcagaggcagagatccagcctcagactcaggtcaccctgaggtgccatatcgatgggcatccgagaccaacgtatcagtggtttagggatgggacacctcttagcgatggtcagtcgaatcataccgtcagctctaaggaacgcaatttgaccttacgcccagctggtcctgagcattcaggactctacagttgttgtgcacacagcgcctttggacaggcttgttcttctcagaacttcaccctgtctatagctgatgagtcttttgccagagtcgtgcttgcaccccaggatgtcgtcgtcgcacggtatgaggaagccatgtttcactgccagttcagcgcccaacctcctccgagtctccagtggcttttcgaggatgagacacccattacaaatcgtagtcggccaccccatctgaggcgggctacggtgttcgctaatggttccctgctgctgacacaagttagacccaggaacgctggtatctatcgatgtatcggccaggggcagcgcggaccaccgattatactggaggctaccttgcacctggctgaaatagaggatatgcccctgttcgagcccagggttttcacagcaggctcagaggaaagagttacctgcctgccacccaagggccttccagaaccttctgtttggtgggagcatgccggagtgaggcttcccactcacggaagggtctaccaaaaggggcacgaactggtgctggccaatatagcggagtctgatgctggggtgtatacatgtcacgcagctaaccttgccggacagagaaggcaggacgtcaatataacagtggcaacggtcccatcatggctgaaaaagccccaagatagtcagttagaggagggcaagccaggttatctggattgtttaacccaagccacccccaagcccaccgtggtgtggtacagaaaccagatgctcatttccgaggactctcggtttgaagtattcaagaacggaactctgagaattaactctgtcgaggtgtacgacggtacatggtaccgttgcatgtcctctactcctgctggcagcattgaagctcaggctcgagttcaggtgctagacggttcctccctgcccgaatgggtcactgataacgctgggacactccattttgcacgggttactagagatgatgcaggcaactacacttgcatagcgagcaacggtccacaaggacagattagagcacacgtccagctcaccgtcgccgtatttataacattcaaggtagaaccagaacgtacaaccgtgtaccagggtcatacagctcttctgcaatgtgaagcgcagggggaccccaaaccacttatacagtggaagggtaaagaccgcattcttgacccaaccaaattgggccctagaatgcacatttttcagaacggctccttggtcatccacgacgttgctccagaggatagcggtcggtatacatgcattgctggcaatagctgtaacataaaacacaccgaagctcccttatatgttgtggataaacctgtccccgaagagtcagaggggcctggaagcccacccccatacaaaatgatccagactatcggactttcagtgggggctgccgtggcttacatcatcgctgtcctaggactcatgttctactgtaaaaaacggtgcaaggccaagcgactccagaagcaaccagaaggcgaggagccagagatggaatgccttaacggcggtcccctgcagaatggccaaccctccgctgagatacaggaagaagtagccctcactagcttgggcagtgggccagcagccacaaataagcgccactctactagcgataaaatgcattttccacgcagctctcttcagcctattacgaccctcggcaagtctgaatttggagaagttttcctcgcaaaggcccaaggtttagaagagggagttgctgagactctagtgctagtcaagtctttgcagtccaaggacgaacagcaacagctggattttcgtcgcgagttggagatgtttggaaaattaaaccacgccaacgtagttaggctgctggggctgtgtcgtgaggcagaaccacattacatggtgcttgagtacgttgacctgggagatctgaagcagtttctccgaatctccaagagtaaggacgagaagctcaaatcccagccactatctactaagcagaaggtagctctctgcacacaggtggcgctcggtatggaacacttgtccaataaccggttcgtgcacaaagacttagccgctcgcaactgtctggtttctgcccagcggcaggtgaaggtgtctgctctaggactgtctaaggatgtgtacaacagtgagtactaccactttcgccaggcttgggtgccattacggtggatgagtccggaagctatactggagggcgatttttccaccaaatcggacgtctgggctttcggggtcctcatgtgggaggtcttcactcatggggagatgccccatgggggtcaggccgacgatgaggttcttgccgatctgcaggccggtaaggcacgactgccccagccagagggctgcccctccaaactttatcggttgatgcagcgttgttgggccttgagtccaaaggataggccaagtttctccgagatcgccagtgccctcggcgatagcactgtagacagcaagccttag

SEQ ID NO: 237433 - DNA, 2823 bp, Artificial Sequence
  Description of Artificial Sequence: Synthetic coding sequence
atgggtgcagcaagaggcagtcctgcccgtccaagaaggctccctttgctcagtgtcctgctgttgcccctcctggggggtacacaaaccgcaattgtgtttatcaaacaaccttcatcacaggacgcactacagggccgtagagccctattgcgctgcgaggtggaggcccctggccctgtgcacgtgtactggctgttggatggcgctcctgtgcaggacactgaaagaaggtttgcgcaaggatcctccttgtcttttgctgccgtggacagactgcaggactccggcacattccagtgtgtggcccgtgatgacgtcacgggggaagaagctcgatcggcgaatgcttccttcaatattaagtggatcgaagctggccctgtggtgctcaaacaccctgcttccgaggccgaaatccaaccacaaacacaggtgactctgcgctgccacatagatgggcatcctagacccacgtaccagtggttcagggacggcacccccttgagcgatgggcagtctaaccatacagttagctcaaaggagcggaacctgacactgcggccagccggaccggagcactccgggctctacagctgttgtgcgcattctgctttcggtcaggcttgctcttcacagaattttacactgagtatcgccgatgaatccttcgccagggttgtactggccccacaggacgttgtcgtcgcaagatacgaggaggctatgttccattgtcaattcagcgcccagccacctccctccctgcagtggctgttcgaagacgagactccaataacaaaccgatcccggccaccacacctgcgcagggcaacagtgttcgcaaacggcagtctccttctcactcaggtgaggccgcgtaacgctggcatatacaggtgcatcggacaggggcaacgcggtccccctatcattctcgaggccacgctccacctcgctgagatcgaggatatgccactttttgaacccagggtattcaccgccggatctgaggagagggtgacgtgcctgcccccaaaaggtctccccgaaccctcagtctggtgggaacatgccggtgtgcgcttaccgacacacggaagggtttaccagaaagggcacgagcttgtcctcgccaatatcgcagaatctgatgccggtgtgtacacatgtcatgcagccaacctagctggccaacgtaggcaagatgttaatatcaccgttgcgaacgggagttccctgcctgaatgggttacagacaatgctgggaccctgcactttgcaagggtcacgcgagatgatgcaggaaattatacgtgtatcgcctcgaatggaccacaggggcagatccgcgctcacgtacagctcaccgtggccgtcttcattacattcaaagtggaacctgagcgaaccacagtttaccaggggcatacggcgttgctgcaatgcgaggctcagggtgatcctaaacctctaatccaatggaagggcaaagaccgaatccttgatcccactaagctgggaccccgaatgcacattttccagaacgggagcctggtcattcatgatgtggcaccagaggatagcggaaggtacacttgcattgcaggcaactcttgcaatattaaacacactgaggcacctttatacgtggtggacaaacctgtgcctgaggagagcgaagggccagggtccccccctccatataagatgatacaaaccattggcctctctgtcggcgctgccgtggcgtatataatagccgtgttgggcctgatgttctactgtaagaagcgatgcaaggccaaacgattacaaaaacagccagagggagaagagcccgagatggagtgcctgaatggaggaccccttcagaatggccagccatctgccgaaattcaggaagaggtcgctttgaccagtctgggcagcgggcctgccgctactaataagcgtcacagtactagcgacaagatgcactttccacgctcttcacttcagcccatcactactctcggcaaatctgaattcggagaagtcttcctggccaaggcacagggcctggaagagggggtggcagagacgctggtgctggtgaagtcgcttcagagcaaagacgagcaacagcagttagacttccgacgagagcttgaaatgttcgggaaactgaatcacgccaacgttgtgcgccttctaggcttgtgcagggaggcggagcctcactacatggtcctggagtatgtcgacctgggtgatcttaaacagttcctgcggataagcaagtctaaggacgaaaagctgaagagtcaacccctgagcactaagcagaaagtggccctgtgtacccaggtggccctcggcatggagcatttatccaataacagattcgtccataaagacctggctgcaaggaattgtctcgtgtccgcacagagacaggttaaggttagcgccctgggtctctccaaagacgtgtacaactccgaatattaccatttcaggcaggcctgggtccctctgcgctggatgtctcctgaagctatcctagagggggacttctccacaaagagcgatgtatgggcctttggtgtcttaatgtgggaagtttttactcatggagaaatgccacacggcggtcaggccgatgatgaggtcctggcagatctgcaagccggtaaggccaggctgcctcaaccagagggctgtccttccaaactctataggttgatgcagagatgctgggctctgtctccgaaagatcggccaagcttttcagaaattgcctctgccctgggcgattctacggtggattcgaagccttag

SEQ ID NO: 237434 - DNA, 3045 bp, Artificial Sequence
  Description of Artificial Sequence: Synthetic coding sequence
atgggcgcagccaggggaagccctgccaggccccgacgcctcccactactcagcgttctcctgctaccgctgctggggggaactcaaaccgcaatagttttcatcaagcagccttcttctcaggatgctctgcagggtagacgggcattgctacggtgtgaggtggaggccccaggtcccgtccacgtctactggctgctggacggagcacccgtacaagacacagagaggcggtttgcccagggttcctccctctctttcgctgctgtagataggctccaggactccgggacatttcagtgcgttgcgagagacgacgttactggcgaggaagctagatcagcgaacgcttcattcaatataaagtggatagaagctgggcctgtggtcctgaaacaccccgcatccgaagccgaaattcagccccagactcaggtgacgctgcggtgccatattgacggtcacccccgacctacgtaccagtggttcagggacggaacacccctgtctgacgggcagtccaatcacacagtatcctcaaaggagcggaacctgaccctgcggcctgctggaccagagcattcaggattatatagttgttgtgcccattccgctttcggacaggcctgctcttcgcagaacttcactctgtcaatagctgatgagagcttcgcaagggtggtgcttgcaccccaagacgtagtggtggcacggtacgaagaggccatgtttcactgccagttttccgcccagccaccaccgtcgctccagtggctcttcgaagatgagacgcccatcactaaccgatcccgcccaccacatctcaggagggctacggtttttgccaatggtagcctactactaacgcaggtccgcccacggaatgctggcatatatcgctgtatcggacagggtcagcgcggtcctccgattattcttgaagctactttacacctcgcagagattgaagatatgcccctctttgaaccgcgtgtcttcacagctggcagcgaagaacgggtcacgtgtctcccgcctaaaggtctccctgagccctcggtttggtgggagcacgcgggagtgcgtttgccgacacatggaagagtttaccagaaggggcacgagctggtgctggctaacattgctgagagcgacgccggagtgtacacatgtcatgcagcaaacctggctgggcagaggcgccaggatgtgaacattactgttgctactgtgccttcttggctgaaaaagccacaggactcccagctcgaagagggtaagccaggatacctggattgcctgacacaggccacaccaaaacccacagtggtctggtaccgcaatcagatgctaatcagtgaggactcacgcttcgaggtgtttaagaatgggaccctgaggataaactctgtcgaggtatatgacggcacgtggtacagatgcatgagctctactcccgctgggagcattgaagctcaggccagggtgcaggtgttagagaaactcaaatttacacccccaccacagccccaacagtgtatggagttcgacaaagaggctaccgttccctgctctgctacagggagagaaaagccaaccattaagtgggagagggcagatgggtccagtctcccagagtgggttaccgacaatgcaggcacccttcactttgccagagtgactagagatgatgctgggaattacacgtgtatagcaagtaatgggcctcagggacaaatacgcgctcacgtccaactcactgtggcggtattcattacatttaaggtcgaaccagagcgaacaaccgtgtatcaggggcacactgccttgctgcagtgcgaggcccagggcgaccccaaacctctgattcagtggaaggacaagccagtgccagaagagtctgaaggccctgggagtccccctccgtacaaaatgattcagactatcggtctttctgtgggggcagcagtggcttatatcatagcagtcttgggactcatgttttactgcaaaaagcgttgtaaggctaagcgcttgcagaaacagccagagggggaagagcccgagatggagtgtcttaacggcggacccttgcagaacggacagcctagcgctgaaattcaggaggaagtcgcacttacctcgttgggaagcggcccagccgctacaaacaaacggcactctacaagtgacaagatgcattttcctcggagtagcctgcagcccattacaaccctgggaaagtcggaatttggggaagtattcctcgccaaagctcaaggactggaggagggcgtggccgagacccttgtcctggtcaagagcctacaaagcaaagacgaacaacagcagctggactttcgacgagagctggaaatgtttggaaagctgaatcatgccaacgtggtccgtcttctcggcctgtgcagggaagcagaaccacactacatggtgcttgaatacgtcgatctgggcgacttaaagcagtttcttagaatcagtaaatccaaggacgagaagctgaagagccagcctctatccactaaacagaaggtggctctgtgtactcaggtggctctcggaatggagcatttgtctaacaataggtttgtccacaaagacctagcagcacgaaactgtttggtctccgctcagagacaagtcaaagtgagtgccctcggcctgtctaaagacgtgtacaactctgagtattaccatttcagacaggcatgggtccctttacggtggatgtctccagaagcaattctcgaaggcgatttttccacaaagtccgacgtgtgggcttttggagtgctgatgtgggaggtgttcacccacggcgaaatgccccacgggggacaagccgacgatgaggtgctggcggatttgcaggctggcaaagcccgattgcctcagcctgagggatgcccttcaaagttgtatagattgatgcagcggtgctgggccctttcaccgaaggataggccaagtttcagcgaaatcgccagtgcacttggtgatagcaccgttgattctaagccatag

SEQ ID NO: 237435 - DNA, 1212 bp, Artificial Sequence
  Description of Artificial Sequence: Synthetic coding sequence
atgggctcattcctcagcggcgaaaaaagaccatccgcccctaccgtcggttccgccatggaaaaaaaggagttccctaccccaccagggagagtgggtccaggtacacagaccgccattgtcttcattaagcagcctagctcacaggacgccctccaggggaggcgtgctctcctgaggtgcgaggtggaagcacccggacccgtccatgtgtactggctgctggacggcgctccagtgcaagacacagaaaggaggtttgcccagggcagctccctgtcattcgccgctgttgaccggcttcaggattccggcaccttccagtgcgtggcccgagacgacgttactggagaggaggccaggtctgccaacgcgtcatttaacattaaatggatcgaagccggaccagtcgtgctcaagcaccctgctagcgaggctgaaatccagccacaaacgcaggtgacactgcgctgtcatatcgacggacatcccagacctacctatcagtggttccgggacggaaccccactatccgacgggcagtcgaaccacacggtatcatccaaagagcggaacctcactttacggcctgcaggtcccgaacactcaggactgtactcatgctgtgcgcactccgcctttggacaggcctgcagttcacaaaactttaccctatccatcgcagatgagtcatttgcaagagtggtgttggcaccacaggacgtcgtagtggctagatacgaggaggctatgtttcactgtcagttctccgctcagccacccccatctctgcaatggctatttgaggacgagacccccatcactaaccgctccaggcctccacatcttagacgggcaaccgttttcgccaatggatctctactgctgacacaagtgaggcctaggaacgccggaatctatcgatgcatcgggcaagggcagcgtggccctccaatcattctagaagctactctgcatttggctgagatagaagacatgcccctgttcgagccccgtgtatttacagccggatccgaggagagagtgacctgtttgccgcctatggccggaagtacaagaagagccacaagttggtgctggccgatcctgctgaaggtgatgctggtttcgaccccagcaaccagaccaacctggctggtgagtggcgaccgaatgagtacaagcctgtggcctctgtgtccccctggatag

SEQ ID NO: 237436 - DNA, 810 bp, Artificial Sequence
  Description of Artificial Sequence: Synthetic coding sequence
tttagcgctcagcctcctccttcattacaatggctgtttgaggacgagactccaattaccaaccgttcccgccctccccacctgaggagagcaacagtgtttgcaaatggatcattgttattgacacaggttcgccctagaaatgcgggtatctaccgctgtataggccaaggccagcgaggcccacctatcatcctggaggcaacgttgcatctcgcggaaattgaagacatgcccctgtttgaacctagggttttcactgcaggcagcgaggagcgagtgacctgtctcccgcctaaggggctacccgaacccagcgtgtggtgggagcacgctggagtgcgtttaccaacccatggacgggtctaccagaagggccacgagcttgtgctggcgaatattgccgagtccgacgccggagtgtatacttgccacgccgctaacctggcagggcaaagaaggcaggacgtcaacattaccgttgcgagtgagcatttgtgcccagagggccagggtgaggtggagggtaacacaggcctgggtgtgatggatagggggttcccagccgtcccaagctggctgaagaaaccacaagattcccaactggaggaaggcaaacccggatatctggattgcctcactcaggcaacaccaaagcccactgtggtgtggtaccggaaccagatgctgattagcgaggattcaaggttcgaagtctttaagaacggcactctcaggatcaacagcgtggaggtgtacgatggaacatggtatcgatgtatgtcctcaactcctgctggtagcatctag

SEQ ID NO: 237437 - DNA, 444 bp, Artificial Sequence
  Description of Artificial Sequence: Synthetic coding sequence
atgggagccaccgggctggggtttctgctgtcctggcggcaggataacctaaatgggaccgattgccagggctgtaacatcctgtatttttcagaaaccactgggagcatgtgctcggagctgtccctcaacagaggactcgaggcgaggaggaaaaaagatttgaaggatagtttcttatggcggtacggaaaggtcggctgtattagcctacctctgcgagagatgaccgcctggatcaacccaccacagatctccgagatatttcagggctatcaccagcgtgttcatggggcagacgctctttcattacagacaaatagcctgcgatctagactgtcatctcaatgcctgggacagagcttcctgctgagaacactggagcgcggtagagggtttagggccttgggggatatttgtggtcatgtccatgaggaggattag

SEQ ID NO: 237438 - DNA, 216 bp, Artificial Sequence
  Description of Artificial Sequence: Synthetic coding sequence
atgggggcaaccggcctaggcttcctgttgtcctggcgccaggataacctcaatggcacagattgtcagggatgtaacatcttatatttttccgaaactacaggcagcatgtgtagtgaactcagcctgaaccgtggattggaggctcgcagaaaaaaagacttgaaagactccttcctgtggcgcgacggggtttccccatgtctgccttgttag

SEQ ID NO: 237439 - DNA, 444 bp, Artificial Sequence
  Description of Artificial Sequence: Synthetic coding sequence
atgggggcaacaggcctgggcttcctcttgtcttggcgacaggataaccttaatgggacagattgtcagggctgcaacatcttgtatttctctgagaccaccgggagtatgtgttcagaactgagcctgaatcgtggcttggaagccaggagaaaaaaagacttaaaggattccttcctgtggaggtacggtaaggtgggatgtatctctctgcctctccgcgaaatgaccgcctggattaatcccccacagatctcagagatattccaggggtaccaccaacgcgttcatggggcagatgccttatcattacagacaaatagtcttaggagtaggctgagctctcagtgtctcggccagtcatttctgctacgtactcttgagcgagggcgaggttttcgggcactcggggatatttgcggccacgtccatgaggaggattag

SEQ ID NO: 237440 - DNA, 216 bp, Artificial Sequence
  Description of Artificial Sequence: Synthetic coding sequence
atgggggcaaccggactgggatttctcctcagctggagacaggataatctgaacggtaccgactgtcagggatgcaatatcctatacttcagcgaaaccacagggtccatgtgtagcgagctatccctaaatagaggcttagaagctcgcagaaaaaaggaccttaaggactcctttctatggcgcgatggggtttctccttgtcttccttgttag

SEQ ID NO: 237441 - DNA, 3561 bp, Artificial Sequence
  Description of Artificial Sequence: Synthetic coding sequence
atgtctgtagcctgtgtgctgaaaaggaaggctgtgctgtggcaggattccttcagtccccatttaaagcaccatcctcaggaacccgctaatcctaacatgccagttgtgctgacctccggcacaggttcccaagcacagccacagcctgcagccaaccaggccctggccgctgggacgcactcatctcccgtgccgggatcaattggagtggccggtaggagtcaggacgacgccatggtggattatttctttcagaggcaacacggggagcagttaggtggaggtggttccggtggaggcggatacaacaatagcaagcatagatggcccactggcgacaatattcacgctgaacaccaggtgcgatcaatggatgagttgaatcatgattttcaagctctcgccttggaggggagggccatgggtgagcagttgctcccgggaaaaaagttctgggagaccgatgagagctccaaggatggcccaaagggcatcttcctgggggaccagtggcgtgactcagcttggggcacaagtgatcactcagtctcccaacctattatggtacagcgccgacctggccagtcctttcacgttaatagtgaagtgaattccgttttatccccccgaagtgaatctgggggtttaggtgtctctatggttgagtacgtactgtccagttccccaggcgactcttgtttgcgcaagggtggtttcgggcctcgggacgccgactctgacgagaacgataaaggggaaaagaaaaataaggggacgttcgacggtgataagttgggtgacttaaaggaagaaggggacgtgatggataaaacgaatggtcttccggtacagaacgggattgatgccgatgtcaaggatttcagtcgcacccccggaaattgccaaaacagcgcaaacgaagtggatctcttgggcccaaaccaaaatgggtccgagggcctcgcgcaactcacaagcactaacggggcaaaacccgtcgaagacttctctaacatggagtcacagtcagtccctctcgatcccatggagcacgtcgggatggagcctctgcagtttgactactctggcactcaggtccccgtagatagcgctgctgccacagtgggcctcttcgattacaacagccagcaacagctctttcagcgtccaaatgcgctggcagtacagcagcttaccgctgcacagcagcagcagtacgctctcgctgcagctcaccagccacacatcggcttggcccctgctgcttttgtccccaatccatatatcatcagtgcagctccaccgggtacagatccttacactgccggactcgccgcagctgccaccctgggacctgcagtcgtgcctcatcagtactatggagtaaccccctggggagtttatcccgcttcactgtttcagcagcaagctgccgctgccgctgccgcaacaaactcagccaatcaacagactactcctcaagcacagcagggtcagcaacaggtcctgcgcggaggggcaagtcaacgcccactgacaccaaaccagaatcaacagggacagcagacggaccccctcgtcgcagcagccgcagttaacagtgctctagcgtttggccagggtttagctgctgggatgcctgggtaccccgtgctggccccagcggcatactatgaccaaactggcgcactggtcgtgaacgctggcgcaaggaatggcctgggagcacctgttagactcgtggcccctgctcctgtgatcatctcgtcaagtgctgcccaggcagccgtcgccgcagcagccgctagcgcaaacggcgcagcgggaggtctggctggcaccaccaatgggccattccgaccgctgggaactcagcaacctcagcctcagccgcaacagcaacctaataacaatctggcatctagtagcttttacggcaataattcattgaacagcaactcccagagtagttccctgtttagtcagggctctgcccagcctgcgaatacctccctggggtttgggagctcaagctctctcggagccaccctcggcagcgctctcgggggatttggtacagccgtcgccaattcgaataccggctctggcagtaggcgcgatagtctcacaggaagctccgatctgtataagcggacatcatcctcactcacccccatcggccacagtttctacaatgggctgtctttcagctcctcccctgggccagtggggatgccactgcccagtcagggcccaggacatagtcaaacaccacctccttctctctctagccatggctcatcctcatcactaaatctcggaggcttgaccaatggaagtgggcgatatatatcggctgctcctggtgcagaggccaagtatcgtagtgccagtagtgcttctagcctctttagcccttctagcaccctcttctctagcagtaggttgcgttatggaatgtccgacgtgatgccaagcggcagaagcagacttttagaagatttcaggaacaatcggtatcccaacctgcagctaagggagatcgcgggtcatatcatggaattttctcaagaccagcacgggagtagattcattcagctcaaacttgagagagctactccagcagagaggcagttggtattcaatgaaatactacaggcagcttatcagctgatggttgatgtctttgggaattacgtaatacagaaattctttgaattcggaagcctggaacagaagctagctctggcagagcgtattcgtgggcacgtactaagccttgcgttacagatgtatggatgtcgcgtcatccaaaaggcgctcgagttcatacctagtgaccagcagaatgaaatggttcgggagttggatggacatgtcttgaaatgcgttaaggatcagaatggcaatcacgttgtccagaagtgcatcgaatgtgttcaacctcagtcactccagtttatcatcgatgcatttaaaggccaagtgtttgccctgagcacacacccttacggatgtcgcgtcatccaaaggatcttggagcactgcttaccagatcagaccctccctatccttgaagagcttcatcaacacaccgaacaattggtgcaagatcagtacgggaattatgttatccaacatgtgcttgaacacggcagaccagaggacaagtctaagatagtagctgaaatccgcggaaatgtgctcgtcttgtcacaacataagttcgcttcaaatgtggtagagaagtgcgttactcatgcgtccaggacagagagggccgtcctaattgatgaagtgtgtaccatgaatgatggcccacacagtgccctctacactatgatgaaggaccagtacgcaaactacgtggttcagaaaatgatagatgtggccgaaccgggtcagcgtaagatcgttatgcataagatacgccctcatatcgccactctgagaaaatacacctacgggaagcatatcttagctaaactcgagaaatattatatgaagaacggggtggatttggggccaatatgcgggcctcccaatggcatcatctag

SEQ ID NO: 237442 - DNA, 2781 bp, Artificial Sequence
  Description of Artificial Sequence: Synthetic coding sequence
atgagcgtggcgtgcgtcctcaagaggaaagcagtgctgtggcaggattcctttagccctcacctaaagcaccatcctcaagaacccgctaaccctaatatgccagtggtgctgacatcaggcactggcagccaggcgcagccacagccagctgcaaaccaggctcttgcagctgggactcacagtagccctgtgcccggatcaattggagttgccggacggtctcaggacgacgcaatggtggactattttttccagcgccagcatggcgagcagctgggaggcggtggaagtggagggggaggctacaataattcaaaacatcgttggcccaccacagttgggttgttcgactacaattcacaacagcaactctttcagaggccaaatgccttggccgtgcaacagcttactgctgcccagcagcaacagtacgctctggccgctgcacaccaaccccatataggtctggccccagccgctttcgtgcctaatccctatataatttcagcagccccacccggaaccgacccttatacagccggtctggctgctgccgcaaccttggggccagctgttgtccctcatcaatactacggcgtcaccccttggggagtatatccggcttccctgtttcaacagcaggctgccgcagctgctgccgcaacaaactctgccaatcagcaaaccacacctcaggctcagcaggggcagcagcaagtgctgaggggtggcgcttcacaacggcctttgacccctaaccaaaatcagcaggggcagcagacggatccactcgtggctgccgcagccgtgaacagtgcgttggccttcggccagggactcgccgcaggtatgccgggatatcctgtactggcccctgcagcctattacgatcaaacaggcgctttggttgtgaatgccggtgccagaaacggactcggggcacctgttcgtctcgtagccccagcccctgtgataatctccagcagtgcggcacaggccgcagtggcagcggcagcagccagtgccaatggagcggctggagggttggctggaactacgaacggtccatttagacccctgggcacccaacaaccgcagccccagcctcagcaacaaccaaataataatctggcatcatcaagtttttacgggaataattctttaaactctaactcccagagtagttccctcttttcccagggctccgcccagcccgctaacaccagcctggggtttgggtccagctcttctctgggcgcaacactcggatctgccctgggaggtttcggcaccgcggtggcaaatagcaataccggcagcggcagtaggagagacagtctcactggttcctccgacctatataagcgtacaagcagttccttaactcccattggccatagtttttacaacggacttagttttagttcaagccccggtccagtgggcatgccactacccagccagggtcccggtcactcccagacccccccaccctctctgtcatcacatggatcatcatcctcactcaatctgggcggacttaccaacgggtcaggcaggtatatctctgctgctcccggagccgaggccaaatacaggtctgcctcatctgccagtagtctcttctcgccgtcttcaacccttttctcttctagtcgactccgatacggaatgagcgacgtgatgccatccgggcgaagcagactcctcgaagatttcagaaacaacaggtatcctaacctccagctgcgcgaaattgctgggcatatcatggaattctctcaggaccagcacggcagtagattcattcaactcaagctggagcgagctacacccgcagaacgccaactagtctttaacgaaatattacaggccgcataccagctgatggtcgacgtgtttggtaactacgtgatccagaagttctttgaattcggctctcttgaacagaagttagcacttgcagagcgcatacgtggacacgtgctttctctcgccctgcagatgtacgggtgcagggttatccagaaagccctagagttcatacccagtgaccagcaagtgattaatgagatggtacgagaactggatggtcacgtcttgaagtgcgttaaggaccagaacgggaaccacgttgttcaaaagtgtatagaatgcgtgcagcctcagtctcttcagttcatcattgatgcatttaagggccaagtttttgcccttagcactcacccctacggatgtcgtgtaattcagcggatactggagcattgccttcccgatcagaccctgccaatcctggaagagctgcatcagcatacagagcaactcgttcaagatcagtatgggaactatgtcatccagcacgttctggagcacggtcggccagaggacaagtcaaaaattgtggccgaaatccggggtaacgtattagtactatcacagcataaatttgcatctaacgtagtcgagaagtgcgtcacacacgcgtcacggactgagcgcgcagtgcttattgatgaggtgtgtaccatgaatgatggcccacactccgcattgtacacgatgatgaaagatcaatacgccaactacgtcgttcagaaaatgattgacgtggccgagcccggacaacgtaaaatcgtcatgcacaaaatccgaccccatattgcaacgctgcggaaatacacatacgggaaacacatacttgcgaaattggagaaatattatatgaaaaatggcgtagacctggggccaatctgcggaccacctaatgggatcatctag

SEQ ID NO: 237443 - DNA, 3135 bp, Artificial Sequence
  Description of Artificial Sequence: Synthetic coding sequence
atgtcggtggcttgtgtcctgaaacgaaaggctgtcctatggcaagacagcttttctcctcatcttaagcaccacccacaagagcctgctaatcctaatatgccggttgtgctcacaagtggtacagggagtcaggcccaacctcagccagcagcaaaccaggccctggctgctggaacacactcttctcccgtcccagggtccatcggcgtagctggtcgctcccaggacgacgctatggtggattattttttccaaaggcagcatggcgagcagctcggaggtgggggatccgggggaggtgggtataacaatagtaaacataggtggcctaccggcgacaacattcacgccgaacatcaggtgcgcagcatggatgaattgaaccacgacttccaggccctcgcactggaaggtcgagccatgggagaggggcctagggatgctgattccgacgaaaacgacaagggtgaaaaaaagaataagggcacctttgacggagacaaattaggtgacttgaaagaggagggagacgtgatggacaaaacaaatggtctgcctgtgcagaacggtatcgacgcagacgtgaaagatttctcacggacacccggaaattgccagaattctgccaacgaagtggaccttctgggtcctaaccaaaacgggagtgagggcttagctcagctgacatcaactaatggagcaaaacctgtggaggattttagcaacatggaatctcaatctgtcccgttggatccaatggagcacgttggaatggagcccctgcagtttgattactctggcacgcaggttccggtcgacagcgccgctgctactgtgggcctgtttgattataacagtcagcagcagctgtttcagagaccaaatgccctggccgtgcagcagttgaccgcggcacagcagcagcagtacgcgttggccgctgcacaccagccccacattggtcttgctccagccgctttcgtgcctaacccatacatcatatctgcagccccacccggaaccgatccttacacggctggcctggctgccgctgccaccctgggtcccgcagttgttccccaccaatattacggcgttaccccttggggcgtctatccagcatccctgttccagcagcaggctgcggcagcagccgctgccaccaacagtgcaaaccagcagaccaccccccaggcgcagcagggccaacagcaggttcttcggggaggcgcttcacaaagacccctcacacccaatcaaaatcagcagggacagcaaactgaccctctcgttgctgccgctgctgtgaacagtgccttggcattcggacaaggcttggccgcaggtatgcctgcagtcgcagctgctgccgcatctgctaacggcgcagcgggtggcctggcgggaaccactaacgggccattcaggccacttgggacccaacaacctcagccacagcctcaacagcagcctaataacaacctagcgtccagttcattttacggcaacaactccctgaactccaattctcagtcctcttcactctttagtcagggcagtgcacagcccgcaaatacctcactaggttttggaagctcctcaagcctgggagcgaccctggggagtgccctcggaggctttggtaccgcagttgccaactcaaacaccgggtctggaagtagacgggacagtctcaccggcagcagcgatctgtataagaggacatcatcctctttgacacctattggccacagtttctacaacggcctgagctttagcagttctccgggaccagtcggcatgccactgcccagccaggggcctggccactcacagacgccccctcctagtttaagtagccacgggtcgtcaagcagccttaatctaggcggattgacgaacggcagcggacggtacatttcggccgcaccaggggcagaggccaagtatcgtagcgcaagctcagcatctagcctgttctccccatcaagcacattgtttagtagtagtaggttaaggtacgggatgagcgacgtgatgcctagcggccgaagcagacttctagaagattttaggaacaacagatatcccaacctccagctgagagaaattgctggacacataatggaattctctcaggaccagcacgggagcaggttcattcagctgaagctggagcgggctacacccgctgagcggcagcttgtattcaacgagatactccaagcagcctatcagttaatggtcgacgtcttcggtaactacgtgattcagaaatttttcgagttcgggagcctcgagcagaagctcgcccttgccgaacgcattagggggcacgtgctgtctctggcccttcagatgtacgggtgtagggtgattcagaaagccctcgagttcattccttcagaccaacaggtgattaacgagatggtgcgggagctcgacggacatgtgttgaaatgcgtcaaggatcagaacgggaaccacgtcgtacagaaatgtattgagtgcgtccaacctcaatcccttcagttcatcattgatgctttcaagggccaggtgtttgccttgtctactcatccatacggctgcagagtgatccagagaatcttggaacactgccttcctgaccaaaccctacccattctggaggagctccaccaacatacggaacagctcgtccaggaccagtatggtaattacgtcatacaacacgtcctcgagcatgggagacccgaagataagtcaaaaattgtggccgaaattaggggaaatgtgctcgtgctgagtcaacacaaatttgctagcaacgtggtggagaaatgcgtgacccacgccagcagaactgagcgagctgtactgattgatgaagtctgtaccatgaacgatgggcctcactcagctctctataccatgatgaaagatcaatacgcaaactatgtagtccaaaaaatgatagatgtggctgagcctgggcaaaggaagattgtgatgcataaaatacgcccacacatcgctacccttaggaagtatacctatggcaagcacatcctcgccaagctcgagaagtattacatgaagaatggtgttgacctgggaccaatctgcggccctcctaacggaatcatctag

SEQ ID NO: 237444 - DNA, 3567 bp, Artificial Sequence
  Description of Artificial Sequence: Synthetic coding sequence
atgtccgtggcttgtgtgttgaagaggaaggccgtgttgtggcaagacagcttctctccccacctgaaacatcacccccaagaacccgctaaccctaatatgcccgtagtgctcacatccggcactggttcccaggcacaaccccaacctgcagctaatcaggccctcgctgccggaactcactcatcccccgtgcctggctccataggagtggccggtaggtctcaggacgacgccatggtcgattattttttccagaggcagcacggagaacagctaggcggtggcggatccgggggtgggggatacaataattccaaacacagatggccaactggtgataatattcatgccgaacaccaggtgaggagtatggatgagctgaaccacgactttcaggcgcttgctctggaagggagagcgatgggcgaacaactgttgcccggtaagaagttctgggagactgatgagagcagcaaagacgggcctaaaggtattttcctgggagatcagtggcgggattcagcctggggcacaagcgaccatagcgtgtcccagcccatcatggtgcagagacgacctggccagtcctttcacgtcaattccgaagttaattccgtgctgagcccgcgttcagagtcagggggactgggcgtttctatggtagagtatgtcctcagctcctctcctggggatagctgtctgagaaaaggcggatttggtccacgcgatgctgactctgatgagaatgataaaggggagaagaagaataagggcacgtttgatggcgataagctgggggacctaaaagaagagggcgacgtgatggacaagaccaacggcctgcccgttcaaaatggtattgacgctgatgtcaaagattttagccggacccccggaaactgccagaactctgccaatgaagtagatctgttaggcccaaaccagaatgggagtgaaggacttgctcagcttacctctaccaatggtgcaaaacccgtggaagatttctccaatatggaatcccagtcagtgcccctggatccaatggagcacgtcggcatggaacccctgcaattcgattattcaggtacccaggtcccagtcgatagtgccgctgctactgtggggctcttcgattacaactcccagcagcaactattccagaggccgaacgctcttgccgttcaacagctcacagccgcacagcagcagcagtatgcactggccgcagctcaccagccccatatcggacttgctcccgcagcctttgttccgaatccttacatcatatcagctgcacccccaggcaccgacccgtacacagccggattggcggctgccgcaactcttggacctgctgtagtgccccaccaatactacggggtaactccttggggcgtatatcccgcttctttgttccagcaacaggccgctgcggctgcggcagctacgaatagcgccaaccagcagactaccccccaagcacagcagggacaacaacaggttctgcgaggcggagcttcccaaagaccactcaccccaaaccagaatcagcaggggcagcagacagatcctttggtagccgcagcggctgtgaattcagccctggcattcgggcagggcttggccgctggcatgcctggttacccagtcttggcccctgccgcatattacgaccaaacgggggcactagtggtcaacgcaggcgcacgcaatggcctcggtgcccctgttcgcctcgtggctccggcaccggtgattatatctagctcggctgcacaggctgctgtggccgctgccgcagcctctgctaatggcgcagcagggggtctcgcgggaaccacaaatggccctttccggccactcggaactcaacagccccagccccagcctcagcagcagcctaacaataatctggccagtagcagtttctacgggaacaatagtcttaactctaacagtcagagctcatctctattctctcagggctcggcccagcccgctaatacgtcactgggctttggtagcagctccagcctcggtgcaaccctgggatctgcccttgggggattcggaacggcggtggctaattccaatacaggaagtgggtcacggcgagattcactgaccggcagtagcgatctctataagcgcacctctagctcactgacccccatcggccacagcttttacaatggccttagcttctcctcgtcccctgggcctgtggggatgcccctgcctagccaaggccctggacatagccagactcccccaccatctctgtctagtcacggcagtagctcctcccttaacttgggcggacttaccaatggaagtggtaggtatatttccgcggctcctggcgctgaggcgaaataccgctcagcgtcctctgcctcaagcctctttagcccctctagtacccttttttcaagtagcagactgagatacggcatgtccgacgtgatgccaagcggaagatccagactgttggaggactttcggaacaacaggtatcccaatctccaactgcgagagattgcagggcacattatggagttttcccaggaccagcatgggtcacggtttatccagttgaagctcgagcgggctactcccgctgaacgacagttggtattcaacgaaatcctacaagcagcgtaccagctaatggtggatgtgttcggaaactatgtgattcagaaatttttcgaattcgggtccctcgaacagaaactggctctggccgagcggataagggggcatgtcctctccctagccctccaaatgtatggctgccgggtgatccagaaggcacttgaatttatcccctccgaccagcaggtgattaacgaaatggtgagagaactcgatgggcacgtccttaaatgcgtcaaagaccagaacggcaatcacgttgtgcagaagtgcatcgaatgcgtccaacctcagagcttacagttcatcatcgacgctttcaagggccaagtttttgcgttgtctacacacccctacgggtgcagggtcatacagcggattctcgaacattgcctccccgatcagaccctgcctatcttggaggagttgcaccagcatactgagcagctggtgcaggaccagtacggaaactatgttatacagcacgtgcttgagcatggtcgccctgaggacaaaagtaaaatagtggccgagatcaggggaaacgtactcgtgttaagccagcataaattcgccagcaacgtggttgagaagtgcgtgacacacgcctcgcgaactgaacgcgcagtactgatcgacgaggtctgtactatgaacgacggcccacatagtgccctctacactatgatgaaggatcagtacgcaaattacgtcgtgcagaaaatgatcgatgtggcagagcccggtcagaggaaaatcgtgatgcataagatcagaccccacatagcaacgctgcgcaagtatacatacggtaagcacattcttgcaaaactagagaaatactacatgaagaatggggttgatctcggtcctatttgtgggccacctaacgggatcatctag

SEQ ID NO: 237445 - DNA, 3489 bp, Artificial Sequence
  Description of Artificial Sequence: Synthetic coding sequence
atgagcgtggcctgtgtcttgaagcggaaggcagtgctttggcaggattcattttcccctcacctgaaacatcaccctcaagagccagccaaccccaacatgcctgtggtgctgacgtcggggactgggtcacaggcacagccgcagcctgccgctaatcaggcgctggcggctggtactcattccagccccgtccctggaagtatcggggttgccggacgtagtcaggacgacgctatggtggattatttcttccagcgacagcacggcgagcagctgggcggtggcggttctggcggaggtggctataataactcgaagcataggtggcctacaggcgataatattcacgctgaacaccaggtaagatctatggatgagctcaatcacgactttcaggcactggctctggaggggcgtgcaatgggagagcagctgctgccgggaaaaaagttttgggaaaccgacgaatcttcaaaagatggcccaaagggtattttcctgggggatcagtggcgggactccgcatggggtacctcagaccattcagtgtctcagcctatcatggttcaacgcagaccgggacagtctttccacgtgaactccgaagtgaactctgtgctttcgcccaggtcagaaagcggtggcttgggtgtgtccatggttgagtatgtcctgtctagttcgcccggagatagctgtctccgcaagggtggttttgggccacgggacgccgactcagacgaaaacgataagggcgaaaagaagaataagggtactttcgacggagataaactgggcgatctcaaagaggagggtgatgttatggacaaaaccaacgggctgcccgtccagaacggtattgacgcggatgtaaaggacttttcccggacccccggtaactgccagaattcagccaacgaggtggacttgctcgggccaaaccagaatgggtccgaggggcttgcacaactcacgtctacaaacggcgctaaaccagtggaggatttctctaacatggaaagtcagtctgtgcctctggacccaatggaacacgtgggcatggagcccctgcaatttgattactcaggaacgcaagtgcctgtggattctgcggcagcaacggttgggttgtttgactacaactcacaacagcagctttttcaaagacctaacgccctcgccgtgcagcagctgacagctgcacagcagcagcagtacgcgctggcagctgcccaccaacctcacattgccggtcttgccccagcagctttcgtgcctaacccctatattataagcgcagcccctcccggaaccgacccttacaccgctggtttggccgctgctgccacactgggtccagcagtggtcccccaccagtattatggggtcacaccttggggtgtctatcctgcttccttattccagcagcaggccgcagccgcagcagctgccactaactctgcaaatcaacagacaaccccccaggcccaacagggccaacagcaggtcctgagaggtggcgctagtcagcggccactgactccaaaccagaatcagcaaggacagcagacagacccactggtggctgctgccgctgttaactccgccctggcattcgggcagggactggccgctggtatgcccggttatccggttctggcccctgctgcctattacgaccagacgggcgcactggtcgttaacgctggggcacggaatggattgggggcacccgttagactcgtggccccagcccctgttatcatctccagctcggccgcacaggctggcacacagcaaccccagcctcagccccagcagcagccaaacaataatttggcatcttcatcattttacggaaacaacagcttaaactcaaattcgcaatcatcatccctgttctcacagggatcagctcaacctgccaataccagcttggggtttggctcatctagttcattaggagcgactctaggctccgcactagggggttttgggacggcagtggccaactccaacacagggagcgggagccgtagggattcgcttacagggtcctctgacctctacaagcgcacaagctctagcctcactccaatcggccacagcttttacaatgggttaagtttcagttcttcccctgggcctgttggcatgccacttccttcacagggcccaggccactcacagacccctccaccttccctctccagtcacggctcctcctctagtctgaatctgggcggacttactaacggctcgggcagatatatctccgcagcgcctggggcagaggctaaatatagaagcgccagctctgcatcctcacttttctccccaagtagcacactgttttcttcgtcaaggcttcgctatggtatgtccgatgtcatgccttccggtcgtagtagactcctggaagacttcaggaataaccgttaccctaatctgcagttgagggaaatagccggacacataatggagttttcacaggaccagcatggctcccggtttatccaactgaaactagaaagagcaactccggcagaacgccagcttgtgtttaacgagattcttcaggcggcatatcagttaatggtggacgtgtttggaaactatgtgattcaaaagttctttgaatttggcagccttgagcagaagctggccctggctgagcgcattcgcggacacgttttgtctctggccttacaaatgtatggctgccgggtgatccagaaggccttggagttcatcccttctgatcagcaggtgataaacgagatggttagagagctggatggccacgtgttaaagtgtgtgaaagaccagaacggcaatcacgtggtgcagaaatgcatcgagtgcgttcaacctcagagtctacagttcatcattgatgcctttaagggccaggtgttcgcgctaagtacacacccatatgggtgccgcgttatccagcgtatcctggagcactgcctaccagatcagaccttaccgatcttggaggaactgcaccagcacactgaacaattggtacaagatcaatatgggaattatgtcatacagcacgttctcgagcatggtaggccggaagataagtccaagatcgtggctgagattagggggaacgtgctggttctgtctcagcacaagtttgcctctaatgtggtggagaagtgcgtgacgcatgcctcaagaacggagcgggctgtgctcatcgacgaagtgtgtaccatgaacgatggaccccattccgccttgtataccatgatgaaggatcagtatgctaactacgtagtgcagaaaatgatagacgtggcggagcctggccagaggaaaatcgtgatgcataagatccggcctcacattgctaccctccggaagtatacatatggcaaacacatcttagctaaactggagaagtactacatgaagaatggggtggatttagggcctatatgcgggccaccaaatggcattatatag

SEQ ID NO: 237446 - DNA, 291 bp, Artificial Sequence
  Description of Artificial Sequence: Synthetic coding sequence
atgagtgtcgcttgtgtattgaaaagaaaggccgtcctgtggcaggacagcttcagcccacacctcaaacatcacccccaagagcctgccaacccaaacatgcccgtggttttgaccagtggcacgggctctcaggcacagccccagcccgctgccaaccaagccctagcagcgggaacccatagcagccctgttcccggatctataggtgtggccggacggagtcaagatgatgccatggtggactactttttccaacgccagcatggggaacaattgggcggaggatag

SEQ ID NO: 237447 - DNA, 1551 bp, Artificial Sequence
  Description of Artificial Sequence: Synthetic coding sequence
atgagcgtcgcctgcgtgctcaagaggaaagccgtgctctggcaggattcctttagtccacaccttaaacaccacccacaggagcctgccaatcctaatatgccggtggtccttacatccggcactggcagccaggcccaacctcagccagcagcaaaccaggcgttggccgctggcactcattcctcacccgttccagggtccatcggtgtcgccggaaggtctcaggacgatgcgatggtggattacttctttcagaggcagcatggagaacaactcgggggtggcggttccggcggagggggatacaacaacagcaagcataggtggccaactggagataacattcacgcagagcatcaggtgcggagcatggacgagctaaaccacgactttcaggccctagcactcgaaggtagagctatgggagagcagctgctgccgggaaagaagttctgggagactgacgaaagcagcaaagacgggccaaaaggcatatttcttggcgaccaatggagagactccgcttggggaacttccgatcactcagtgagccagccaattatggtgcaaaggagaccaggccagtcctttcacgtgaacagcgaagtaaactcggtcctgtccccacggtcagagagcggcggactaggcgtgagcatggtggagtacgtcctgtcttctagtccaggagatagctgcttacgtaaggggggttttggacccagagacgccgactcagatgagaatgataagggcgaaaagaagaacaagggaacctttgacggtgacaaactcggggatctgaaggaagaaggtgacgtcatggataaaaccaacggcctgccggttcagaatggtatcgacgccgacgtcaaggattttagcaggacacccggaaactgccagaatagtgccaatgaggtcgatcttcttggcccaaaccagaatggatcggaggggttggcccaactgacgagcactaatggggctaagcctgtggaggacttttccaatatggagagccagtccgtgcctcttgacccaatggaacacgtaggcatggagccacttcaattcgattactcaggaacgcaagtgcctgtcgactcagctgccgcaactgtagggttattcgactacaactctcagcagcagctcttccagaggcctaatgcccttgctgtgcagcagttgactgccgcacagcagcagcagtatgcattggctgctgctcatcagccacacattgggctggccccagcagccttcgtcccaaatccatatattatttctgcggctcctccagggactgacccatacaccgccggattagctgcagcagcgactctggggccagctgtcgtacctcatcaatattatggagtgactccctggggtgtgtaccccgcaagcttgttccagcagcaggctgccgctgcagccgctgccaccaattccgcaaatcagcagacgacaccacaggcccagcaggggcagcagcaaaccgagttttgtttctgctgtcctggctggtccgctatggtgtag

SEQ ID NO: 237448 - DNA, 2964 bp, Artificial Sequence
  Description of Artificial Sequence: Synthetic coding sequence
atgaatcatgactttcaggcactggcattggagagtagaggcatgggagagttgctgcctactaaaaagttttgggagccggatgatagcactaaggacggccagaaaggtatttttcttggagatgatgaatggagagagactgcttggggggctagccaccacagcatgtcgcagcccatcatggtgcagcggcgttctgggcaagggttccacggaaactccgaagttaatgccattctgtctcctaggtccgagtctgggggactcggtgtgagtatggtagagtacgttttatcgtcatctccagctgataagctggacagccggttcagaaaaggtaattttgggacaagggatgcggagacagacgggcctgagaagggcgaccagaaggggaaagcctctccattcgaagaggatcagaacagagatttgaagcagggcgacgacgacgactccaagattaatgggcgaggtctccctaacggcatggatgccgattgcaaggatttcaaccgcacacccggtagtcggcaagctagtccaacagaggtcgtggagagactcggaccgaatacaaatccatccgaaggccttggtccactccccaaccctaccgccaataaaccactggttgaggagttttccaatcccgagactcaaaatctggatgctatggagcaggttggtctagaatcactgcagtttgattaccctggaaaccaagtccccatggatagttcaggcgctacagtagggttgtttgattacaattcacagcaacagctgttccagcgtaccaacgccctgaccgttcagcaattgacagctgcccagcagcaacagtatgcgctggccgcagctcagcagccacacattgcgggtgttttttctgccggtttagctcccgctgctttcgtccctaatccatatattatatcagcagcaccgccagggactgacccttacaccgccgctggacttgctgcagccgcaacacttgctggacctgccgtcgtgcctccacagtactatggggttccatggggcgtgtatccagccaatctctttcagcagcaggcagccgctgccgcaaataacacagcgtcgcagcaagcagccagtcaggcccaaccaggccagcagcaggtgcttcgcgcaggagctggacagcggccactgacccctaaccagggccagcaggggcagcaagctgaatctcttgccgcagctgctgctgcaaaccccaccctggcatttggtcaaggtttagcaacagggatgcccggttaccaggtcttggctcctacggcttattacgaccaaacgggggcactggtggtgggtcccggagcccgaaccggcctgggcgctcccgtgcggttaatggcaccgactcccgtgctcatcagctcagcagccgctcaggccgcagccgcagctgctgctggcggtacagcaagttcccttacgggctctactaacggacttttccggcctattggtacccagccgccacagcagcagcagcagcagccgagcaccaatttacaaagtaacagcttctatggcagcagtagtctaaccaattcgtcacagtcgagcagcctgttctcacacggcccaggtcagccaggaagtactagcttgggattcggtagtgggaattcactgggtgctgctattggttccgccctaagcggctttggttctagcggtggtcttactaacggcagcggtcgttatatctccgccgcaccaggtgccgaagccaagtaccggagtgccagctccacttcttccctgtttagctccagttcgcaactgtttcccccttctagactccgttataaccgctctgatatcatgccgtccggacgctccaggctgctggaggacttccggaataatcggtttcccaatcttcagcttcgagatctgattggtcacatcgtagaattttctcaggatcaacacggctcgagatttatccagcagaagctagagagggccacacccgcagaaaggcagatggtttttaacgagattctccaggcagcatatcagctcatgacggacgtgtttgggaactatgtcattcagaagttcttcgagttcgggagtctcgatcagaaactggctctggctacccgaattaggggccatgttctacctctggctcttcagatgtatggttgtcgggtcatccagaaggcactggagagtattagttcagatcagcaggtgatttcggaaatggtgaaagaactggacgggcacgttctcaagtgcgtgaaagaccagaatggaaatcatgttgttcagaaatgtatcgagtgcgtgcagcctcaaagcctgcaatttatcattgacgccttcaagggacaggttttcgtgttaagcactcatccatacggctgccgggttatccaacgcatcctcgaacattgcaccgcagaacagacgctgccaatcttggaggaacttcaccagcataccgagcagttggtccaagatcaatatgggaattatgtgatccaacacgtgctggagcatggtcgtcccgaggacaaatcgaaaatagtaagcgaaatccggggtaaggtgcttgctctctctcagcataagtttgcttcaaacgttgttgagaagtgtgtcacccacgccagccgggcagaacgcgcactgctgatcgacgaggtatgttgccagaatgatggaccacacagtgcactgtacactatgatgaaggaccagtatgccaactatgtggtgcagaaaatgatagacatggccgagcccgcacagcgcaagatcattatgcataagatcagaccccacatcaccacgctgagaaaatatacgtatgggaagcacatcctcgctaaactggaaaaatactatctgaagaactcgcccgacttgggcccaatcggcggtccacctaatgggatgctttag

SEQ ID NO: 237449 - DNA, 3195 bp, Artificial Sequence
  Description of Artificial Sequence: Synthetic coding sequence
atgaaccacgacttccaagctctggccttggagtctcgcggtatgggcgagctcttgccaaccaaaaagttctgggaaccggatgattcgaccaaggatggacaaaaggggatttttctgggcgatgatgagtggcgggaaaccgcctggggcgcttctcatcatagcatgtcacagcccatcatggtccagcgcaggagcggtcaaggatttcatggaaattctgaggttaatgccattttgtccccgagatccgagagcggaggtctgggagttagtatggtggagtacgtactttccagctcgccagcggataaattggattcacggttccgaaaggggaatttcggcacaagagacgcagagaccgacggacctgagaagggtgatcagaaagggaaggcgtccccttttgaggaagaccagaaccgcgacttaaagcagggcgacgacgacgatagtaaaatcaatggcaggggcctgcctaacggaatggacgccgactgtaaagattttaacaggacacctgggtccagacaggcgtcccctacagaggtggtcgaacggttggggcctaacacgaacccatccgaaggacttggacccctgcctaatcccacagcgaacaagcctctcgtcgaagagttctctaaccctgagacccaaaatctggatgcaatggaacaagtcggactagagtccctgcagttcgattaccctggtaaccaagtgcctatggactcttccggagctaccgtggggctgtttgattacaactcacagcagcaactgtttcagagaacaaacgcgctgaccgtgcagcaacttacagccgctcagcaacagcaatacgcgctcgcagccgcacaacagccccatatcgctggcgtcttctccgcagggttagctccagccgcattcgtgcccaacccatacataatctctgccgcacctcccggtaccgacccttatacggccgctggtctggcagcagcagccactctggcaggtccagctgtggtcccaccacagtattacggtgttccttggggggtctaccctgccaatctgttccaacagcaagctgccgctgccgcaaataataccgcctcgcaacaagctgcctctcaggctcaacctggccagcagcaggtgctgagagcaggagctggacagagacctctcactccgaaccagggccagcaaggccaacaggcagagtcgctggctgctgccgcagctgccaaccccacactggcctttggacagggcctcgccacagggatgccagggtaccaagtgctggcaccaaccgcttattacgaccagacaggtgcactggttgtagggccaggggctagaactggcctgggtgcccctgtgcgactgatggcaccaactcccgtcttgatatcttctgccgcagctcaggccgctgctgctgcagctgcagggggaacggcttcctctttaaccgggtcaactaacggtcttttccggccaatcggcacccagccccctcagcagcagcagcaacagccttccactaacctgcagagtaactctttttatgggagttcaagcctgacgaactcgtcgcaatcatcttccctgttttctcatggcccaggccaacctggtagcaccagtctgggcttcggtagcggcaattctcttggcgcagctatcggcagcgccctgtctggattcggatctagcgtgggcagctctgccagctcatctgccacccggcgagaatccctgtccactagctctgacttgtataagcgatcctcctcctcactggcgcctattggacaaccattctacaactctctggggttcagctcatcaccaagccccataggaatgcctctgccatctcagacaccaggacactctctcacgcctccaccctcattaagttcacatggttcctctagctcactgcatctgggtggattgactaacggcagcgggcgttatataagtgccgctccaggcgctgaagccaagtatcggtcagcttcctctacttctagtctgttctcctcctcctctcagttgttcccgccaagccgactgcgttataaccggagtgacattatgcccagcggtcggtcacgtctgctggaagacttccgcaacaatcgctttcctaacctgcagctccgagacctgattggccacatcgttgagttttcccaggatcagcacggctccaggttcatccaacagaagctcgagcgagccacccccgcagagaggcagatggtctttaacgaaatacttcaggccgcttatcaactcatgaccgacgtcttcgggaactacgtgattcagaagtttttcgagttcggcagtcttgatcagaaactggctcttgctactaggattcgcggacatgtgttgccactggccctgcagatgtacggctgtcgagtcattcagaaagccctggaatctattagttcagaccaacagtcagagatggtgaaagagctcgacggacacgtgctgaaatgtgtgaaggaccaaaatggaaatcacgtggtgcagaagtgcattgagtgcgtgcagccccaaagcctgcagttcatcattgatgcatttaaggggcaagtcttcgtcctcagcacgcatccgtacggctgcagagtcattcagcgaatactggaacactgcacagccgaacagaccctgcctatcctggaagagctgcaccagcataccgaacagctggtacaagaccagtacggcaactacgtcattcagcacgtgctcgagcatggtcgaccggaagacaagtccaagatcgtgtctgaaatcaggggcaaagtcctggccctcagtcagcataaatttgcctcaaatgtcgtggagaaatgtgtgacacacgcctcccgagctgaacgcgcactgctcatcgacgaggtgtgttgccagaatgatggaccacacagtgcgctctatactatgatgaaggatcaatacgctaactacgtggtgcagaagatgattgacatggcagagcccgctcaacgtaagatcataatgcacaagattaggccccatatcaccaccttgcggaagtacacttatggaaaacacattttggccaagttagaaaaatactacctgaagaatagccccgatctgggaccaatcgggggtcccccaaatggaatgctgtag

SEQ ID NO: 237450 - DNA, 3201 bp, Artificial Sequence
  Description of Artificial Sequence: Synthetic coding sequence
atgaatcacgacttccaggccctagcgctagagtcaaggggcatgggcgagcttctacccaccaagaagttctgggaaccagacgattcaaccaaagacggtcagaaggggatatttctgggagatgacgagtggagggagacagcctggggggcatctcaccacagtatgtcacagcccattatggtgcaacgaaggagtggtcagggattccacgggaatagtgaagtgaatgcaattttgtcgccccgatctgaatctggcggacttggagtgtcgatggtggaatacgtgctctcttctagccctgcggataaattagattcgagattccggaagggaaacttcggcacaagggacgcagaaactgatggtccggagaagggcgatcagaaggggaaggcctcgcccttcgaagaggatcaaaaccgtgaccttaaacagggtgacgacgacgatagcaagattaatggcaggggccttcctaacggtatggacgccgattgtaaagacttcaataggacccctggctcaagacaggcctctccgacagaagtggtggagcggctgggaccgaatacgaatccctcagaaggtctggggcctctgcctaatcctaccgctaacaagcccttggtggaagaattttcaaatccggagacacagaatctggatgccatggaacaggtcggactggaatctttgcaattcgactatccagggaaccaggtccctatggacagctctggggctactgtgggcctgttcgactataactctcagcagcagctgttccagcgcactaacgccctgacagtccagcaactgaccgccgctcaacaacagcagtacgctttggctgcagctcagcagccgcatatcgccggtgtgttctcagcaggacttgcccctgccgcttttgtgcccaacccatatataatttccgccgcacccccaggtactgatccatacaccgctgcgggactggcagccgcagctacacttgccggtccagcagtcgtgccacctcagtactatggtgttccttggggggtctacccggcaaatcttttccagcagcaggccgcagccgctgccaataacaccgctagtcagcaggcagctagccaagcccagcccggtcagcagcaggttctaagggctggagccggtcagcgcccattgactcccaatcaagggcagcaaggccagcaagcagaatctctggccgcagcagctgcggcaaaccccacgttggctttcggacagggcctcgccactggcatgcctggataccaagtgctcgcacccaccgcctactatgatcagaccggagcccttgtggtgggaccaggtgcacggaccggactgggcgcaccggtgcgactgatggcccctaccccggtgcttatttcttcagctgccgcacaggctgctgcagccgctgctgcagggggaacagcctcttcacttactggctctaccaacggtctttttcgccctattggaacacagccccctcaacaacaacagcaacaaccctccactaacctgcagtcaaattctttttatggcagctcgagtctgaccaacagcagccagagtagttcactttttagtcacgggcctgggcaaccagggtctacctcattgggatttggatccggtaactcactaggcgctgcaataggctctgcgctgtcaggattcgggtcctctgtggggtcaagtgctagctcaagcgctacccggagagagagcctcagcacttcaagcgatctctataaaagaagttctagcagtttggcccctatcggacagcctttctacaacagtctaggattctcctcctccccgtccccgataggcatgcccctcccatcgcagacacccggtcattcactgactcctcctccatcgctgtcctcccacggctcatctagtagtctgcatcttggtggcttgacgaatgggtctgggaggtatatttcggctgcacctggggcagaggccaagtatagaagtgcaagcagcacctctagcctgttctcaagcagttctcagctctttccgccttccaggctccgctataaccggtccgacatcatgcctagcgggagaagccgactgttagaggattttaggaataaccgattccccaatctgcagctgagagatctcattgggcacattgttgaattctctcaggaccagcacgggagtagattcatccagcaaaagctcgagcgagccaccccagcggaacggcagatggtgttcaatgagatcctgcaggcagcataccagctgatgaccgatgtcttcggcaactacgtaattcagaagttttttgagtttgggtccctggatcagaagctggctttggcaacccgcatccggggacatgtgctgccattggctctgcagatgtacggttgccgggttattcagaaagctcttgagtcgatatcgagcgaccaacaggttatatcagaaatggtcaaagaactagacgggcacgtgcttaagtgtgttaaagatcagaatgggaatcacgtcgtgcagaagtgcattgaatgtgtccaacctcagtccctgcagttcattattgatgcattcaagggacaggtgtttgtcctgtcaacccatccatacggatgtcgagtgatccagcgtatcctggagcattgcacagcggaacagactctgccgatcctcgaagaattacaccaacatacagagcagcttgtgcaggatcagtacggtaattacgtgattcagcatgtactggaacacggacgcccagaggacaaatctaagattgtctccgaaattcggggtaaggtattggcattatcacagcataagttcgcttcgaacgtagttgagaaatgcgtgacacatgcttcacgcgctgaaagagcactgttgatcgatgaggtatgttgccagaatgatggcccacactccgcactgtataccatgatgaaggaccagtacgctaactatgtcgtgcaaaaaatgatcgacatggccgagcctgcccagagaaagattatcatgcataagatacgccctcacattactactctgcgcaaatatacctatggtaaacacattctcgccaagctcgagaagtattacttgaaaaattcacccgacctgggaccaattggaggtcctccaaacggaatgctctag

SEQ ID NO: 237451 - DNA, 3195 bp, Artificial Sequence
  Description of Artificial Sequence: Synthetic coding sequence
atgaatcatgattttcaggctttagccctggagagtcgtggtatgggggagctgctcccaactaagaagttttgggagcccgatgactccaccaaggacgggcaaaagggcatattcctgggggatgacgaatggcgggaaaccgcatggggggcaagccaccactcgatgtcccagcccataatggttcagcggagaagcggccagggctttcatgggaacagtgaggttaatgcaattctgagtcccagaagcgaatctgggggtcttggagtgagtatggtggaatatgttttgtcttcgagccccgcagacaagctggactcaagattccgcaaaggtaactttgggaccagagacgcagagaccgacggccctgaaaaaggcgaccagaaggggaaagcaagtccctttgaagaagaccagaatcgggatctgaaacagggtgatgatgacgactccaaaattaacggacgaggtcttcctaacggcatggacgctgattgcaaggacttcaatagaacccccggatcccggcaggcttcaccaactgaggttgtggaaaggctcggcccaaatactaatcctagtgaggggctggggccactgcccaatccaacagcaaacaaaccattggttgaggagtttagcaatcctgagactcagaatcttgacgcaatggagcaggttggactggagtcacttcagtttgattatccaggtaaccaggtccctatggactcaagcggcgctacagtgggactgttcgactacaactcacagcaacagctcttccaaaggactaatgctctcaccgtccagcagttaacggccgctcagcaacagcagtatgcactggccgcagctcagcagcctcacatcgccggagtcttcagtgccggacttgctccggctgcctttgtgcctaatccatacatcatcagtgctgctcccccagggacggatccctatacagctgcagggttggcagccgcagccacgctggccggacccgctgtagtccccccacagtattacggggtcccctggggggtctatccagctaacctgtttcaacaacaggcggcagccgcagctaataataccgcatcacaacaggctgcatcacaggcccagcctgggcagcagcaggtgcttagagcgggtgccggtcagcggccactgacgccaaaccaggggcagcagggacaacaggcagagtccctagccgctgcagccgctgctaaccctaccctcgcgtttggccagggcctggccaccggcatgcccggatatcaggttctcgctcccactgcttattacgatcagaccggagcccttgtggtgggtccaggtgcacggaccggactgggtgcccctgttaggctgatggcccctacccctgttcttatctcatcggcagccgctcaggcagcagccgcagcagcagccggaggaactgccagcagccttactggaagtaccaatggtctctttagacctataggaacccagccaccccagcagcagcagcagcaaccaagtactaatctgcaaagcaatagcttctacggctcaagttcactgaccaactcgtcacagtcttcaagcctcttctcgcacggtccaggacagcccggatcaaccagcttgggcttcggctcaggtaattccctgggagcagctatcggttctgctcttagtgggttcgggtcctcagtggggtcctctgcgtctagttctgcaaccaggagggaatctctgtccacgtcctcagacttatacaagaggtcttccagcagcctggcacccatcggccagcctttttacaattccttgggctttagttcaagcccttcccctatcggaatgccattaccaagtcagacacccggtcactctctcactccaccaccaagcctgtcctcccatgggtcttctagctcactgcatcttggcggactgactaacggatccggacgttatatatccgcagctcccggtgcagaagccaaatatcgctccgccagctctaccagcagcctttttagctcttcctctcagttatttccaccatcaaggctgcgctacaaccgatcagatataatgccatctggccgaagtagactcctggaagactttagaaataatcggttccccaatctgcagctgcgcgatttgatcggccacattgtagagttcagccaggaccagcatggctcccgatttattcaacagaaactcgaaagagccacccccgctgaacgccagatggtgttcaatgagatacttcaggctgcctatcagctgatgaccgacgtattcgggaactatgtgatacaaaagtttttcgagttcggatctctagaccaaaaattagctctggcaactcgcatacgcggacacgtgttgcctttagcgttacaaatgtacgggtgccgggtcattcaaaaagccttggaaagcatcagcagcgaccagcagtccgagatggttaaggagctggacggtcacgttttaaaatgcgtgaaggaccagaacgggaaccacgtcgtgcaaaaatgcatcgagtgcgtgcagccccaatcgctgcaattcatcattgatgcctttaaggggcaggtcttcgtattatccacccacccatacggctgtagggttatccagcggattctcgagcattgtaccgcagaacagacattaccaatcctggaagagctccatcagcataccgaacagttggtccaggatcagtatggcaactatgtgatacagcatgtccttgaacacgggcgaccggaggataagtcaaagattgtgtctgagatccggggaaaggtcttggctttgtcccagcacaaattcgcgtcgaacgtcgtggaaaaatgtgtcacacacgcatcccgcgcagaacgggctctactgatcgacgaagtatgttgtcagaatgacggacctcattccgcactgtacaccatgatgaaggaccaatatgcaaactatgtcgttcaaaagatgatcgatatggcggaacctgcacagcggaaaattattatgcataagatccgaccccacatcacgacacttaggaagtatacttatgggaagcacatcctggcaaaactcgagaagtattaccttaaaaactcacctgacctgggccctattggcggtccgcctaacggaatgctgtag

SEQ ID NO: 237452 - DNA, 105 bp, Artificial Sequence
  Description of Artificial Sequence: Synthetic coding sequence
atgaatcacgacttccaagccctggctttggagtccaggggcatgggcgagctgttgcctactaaaaaattctgggagcctgatgactcaaccaaagacgggtag

SEQ ID NO: 237453 - DNA, 882 bp, Artificial Sequence
  Description of Artificial Sequence: Synthetic coding sequence
atgaatcacgatttccaggctctcgccctggagtccaggggcatgggcgaactcttaccaaccaaaaagttttgggaacctgatgattcgacaaaggacggtcagaagggcattttccttggcgatgacgaatggcgcgagacagcttggggagcttctcaccacagcatgtcccagcctatcatggtccaaaggcggagcggtcagggattccatggaaacagcgaggtgaatgctattctgagtccccgaagcgagtcaggtggcttgggcgtatccatggttgaatacgtacttagcagtagccccgcagataagctagattccaggttccggaaggggaacttcggtaccagagatgctgagacggacggacccgagaagggcgatcagaaagggaaggcaagtcctttcgaggaggaccagaatagagacctcaagcagggagatgatgacgattccaagatcaatggtagaggcctgcccaatggtatggacgcagactgtaaagatttcaataggacacctggatccagacaggccagcccgaccgaggtcgtggagaggcttggccctaataccaatccgagtgaggggctgggaccccttccaaaccctacagccaacaagcccctggtggaggagttttcaaatcccgaaacacagaacctagacgctatggaacaagtaggacttgagtccctgcaatttgactatcctggcaatcaagttcccatggactccagtggtgccacagtgggcctgttcgactataactcccagcagcaattgttccagcggaccaatgcacttaccgtgcagcagctgaccgctgcccagcagcagcagtacgcactcgccgctgcccagcagccacattag

SEQ ID NO: 237454 - DNA, 3027 bp, Artificial Sequence
  Description of Artificial Sequence: Synthetic coding sequence
atgtcacaaccgataatggtgcaaagacgcagcggccaaggattccatggtaattccgaagttaacgcgatcctgtctccgaggagtgaatcaggaggactcggggtatcgatggtggagtacgtgctctcaagcagtcccgcagacaagctggattcacgatttcgaaagggcaactttggtacccgggatgccgagaccgacggcccagagaagggcgaccagaaaggcaaggcaagcccattcgaggaagatcagaacagagatcttaaacagggtgacgacgacgacagcaaaattaacggacgtggcctcccgaatggtatggatgctgactgtaaggattttaacaggacaccaggatcacgccaagcatctccaaccgaagttgtagagagactgggacccaacacaaacccctccgaagggctcggccctctccccaatcctacggccaataaaccactagttgaggaattcagcaatccagaaacacaaaacctcgatgcgatggagcaggtcggactggagtccctccagttcgactatcctggcaaccaagtgccgatggactcatcaggtgcaactgttggtctgttcgattacaatagtcagcaacaacttttccaacgcacaaacgcactcacggtgcagcaactcacagccgctcaacaacagcagtacgctctcgccgctgcccagcagccccatattgctggggtctttagtgccggattagcacccgctgcgtttgtgccaaacccctacataatctcggcggctcctcccggaactgacccttatacagctgcgggactggcggctgctgccacacttgctggcccagccgtggtacccccacagtattacggcgtcccctggggggtgtatcccgcaaacctctttcagcagcaagctgcggctgcagccaacaacaccgcctcacagcaagccgcaagtcaggcgcagcccggtcaacagcaggtcctgcgggctggcgcaggacagagacccctaacccctaaccaaggacagcagggtcaacaggctgagagcttggccgctgctgctgcggctaacccgaccttagcttttggtcaagggcttgcaaccgggatgcccggttaccaggtgctggcacctacagcctactacgatcaaactggggcactggttgtgggccctggcgcaaggacgggtctcggagcccctgtcagactgatggcacccactcccgttttaatatcctccgctgcagcccaggcagcagccgctgcggctgcgggagggacggcctcctctctgaccgggagtacaaatgggttgttccgcccaattggtactcagcctcctcagcagcagcagcagcagccctctacaaacctccaatccaacagcttttatgggagcagtagtctgactaactctagccaaagcagctcacttttttcacatgggcctgggcagccgggaagcaccagtctgggattcggctccggtaatagcctcggcgcagcgatcgggtctgctttgagtggctttggtagctcagtgggtagcagcgcttcctctagcgctacccgaagggaaagtctgtcaacatctagcgacctgtataagagatcgtcttcaagcctcgcgccaattgggcagccgttctataacagtctcggtttttcctcatctccttctcccattgggatgcctttgccctcacagacccctgggcattcactgacgcctccccctagtctgagtagtcacggatctagttccagtctgcacctagggggtttaactaatggctcaggccgatacatctccgctgctcccggagccgaggcaaaatatcgtagcgcctcttcaacctcttccctattttcaagctcatcacagctcttcccgccatctaggctgaggtacaaccggtccgatatcatgccttcaggtcgaagccgccttctggaagacttcaggaataacagattccctaacctgcagctccgggatctgatagggcacatcgtggaattctcccaggatcagcacggatcgcgtttcatacagcagaaattagaaagggccactccagcagaacggcaaatggtctttaatgagatcttgcaagcagcctatcagctgatgaccgatgtgttcggaaactacgtgatccagaaattttttgaattcggctcgctggatcagaaactggctttggctaccaggatccggggacacgtgctgccactagcgttgcagatgtacgggtgcagggttatccagaaggcactggagagtatctccagcgatcagcagtccgaaatggttaaagaactggatggacacgtgctcaaatgcgtgaaggatcagaacggcaaccacgttgtccaaaagtgtatcgagtgtgttcagccacagtccctacagtttataatcgatgcctttaagggtcaggtgttcgttctctcaactcacccatatgggtgccgcgtgatccagcgaattttggagcactgcacagctgaacagacactgccgatcctggaggagctgcaccaacacacagaacagctggtgcaagaccagtatggtaactatgtgatccagcacgtgttggaacacggcagacccgaagataaatcaaaaattgtctcggaaatacggggtaaggtgcttgcattaagccagcacaaatttgccagcaacgtggttgagaagtgtgtcacacacgcctctagggcagagagggcccttctgatcgatgaagtgtgctgtcagaacgacggccctcacagtgcgctgtatacaatgatgaaagatcagtacgctaactacgttgtacagaagatgattgacatggccgaacccgctcagaggaaaatcataatgcacaaaattagacctcatatcacgaccctgcgcaagtatacgtacggcaagcatatcttggctaagcttgagaagtattacctcaaaaactctccagatctcggcccaataggaggaccccctaatggcatgctgtag

SEQ ID NO: 237455 - DNA, 870 bp, Artificial Sequence
  Description of Artificial Sequence: Synthetic coding sequence
atggagaacggctacacgtacgaagactataagaacaccgccgagtggttgctgtcccataccaaacacagacctcaggtggcaatcatctgcggaagcggcctgggtggcctgaccgacaagctgacgcaggcacaaatatttgattacggggagatccctaattttccacgctctacagtcccaggccatgctggccgattagttttcggtttcctgaacggccgtgcctgtgtaatgatgcaggggcgttttcatatgtatgaaggatatcctctctggaaggtgaccttccctgtgcgggtctttcacctcctcggggtcgacacccttgtggtcaccaacgcagccggagggctgaatcctaaattcgaggtgggagatatcatgctgatacgtgatcacattaacctgccagggttttccgggcagaatcctttgaggggcccaaacgacgagcgatttggagacaggttccctgccatgagcgacgcttacgatcgcactatgagacagagggctttgtcaacgtggaagcagatgggagaacaacgagagctgcaagagggaacatatgttatggtggccggaccctccttcgagaccgtggccgaatgtagggtgctgcagaagctaggagcggatgccgtaggtatgtccacagttcccgaagtgatcgtcgccaggcattgcgggctcagagtctttggcttttccttaattaccaataaggtgattatggactatgaatcccttgagaaggcgaatcatgaggaagttctggccgcaggaaaacaagcagcacagaaattggagcagttcgtgtccatactaatggcctccattccactgcccgacaaggcaagctag

SEQ ID NO: 237456 - DNA, 282 bp, Artificial Sequence
  Description of Artificial Sequence: Synthetic coding sequence
atggaaaacggctacacctatgaagattataaaaatacagccgaatggctgctgtcccatacaaagcacagacctcaagtggcaatcatttgcgggtccggactgggaggacttacggacaagctgacccaggctcagattttcgattatggggagattcctaatttccctcggagcaccgtgcccggacatgcgggtcgcttagttttcgggttcctgaacggacgagcatgtgtaatgatgcagggcagattccacatgtacgaaggatatccactctag

SEQ ID NO: 237457 - DNA, 375 bp, Artificial Sequence
  Description of Artificial Sequence: Synthetic coding sequence
atgagctatataccaggccagccagtcacagccgtcgtgcagcgagtcgagattcataaactgcggcagggcgaaaacctgatcttaggtttttctattggagggggtattgatcaagaccctagccaaaaccctttcagtgaagataaaactgataaaggtatctatgtgacccgggtttcagagggcggtccagcagaaatcgctggactgcaaatcggagacaaaatcatgcaggtgaatggatgggacatgacaatggtcacacacgatcaggctaggaagcgcctgactaaaaggagtgaggaggtggttcgtctgttggtcacacggcaaagtctgcagaaggccgttcaacagagcatgctgtcctag

SEQ ID NO: 237458 - DNA, 1194 bp, Artificial Sequence
  Description of Artificial Sequence: Synthetic coding sequence
atgaattgcattagtgacttctttacatacgaaacaactaagtccgtcgtggtcaaatcctggacaatcggtatcatcaacagagtggtacagctcctgatcatctcttatttcgtggggtgggtctttcttcacgaaaaagcataccaggttcgcgatacagcgatcgagagttctgtagtgacaaaggtcaaaggttccgggttatatgccaatagagttatggatgtgtctgattacgtgacaccaccacaaggtaccagtgttttcgtgattataaccaagatgattgtgactgaaaaccagatgcaaggtttttgccccgagtcagaagagaagtatagatgcgtctcggactcacagtgtggaccagaaagacttcccggaggaggaattctcaccggcagatgtgtcaattatagctctgttctgcggacttgcgaaattcagggttggtgtccaacagaggtggacactgtcgaaaccccaataatgatggaggccgaaaattttactatcttcatcaaaaactcgattagattccccctattcaattttgagaagggcaacctgctgccaaacttgacagcaagagacatgaaaacgtgtcgatttcaccccgataaagaccctttctgcccgattctgagggtgggcgacgttgtgaagtttgcaggtcaggatttcgcaaaactggcgagaactgggggagtcctgggaatcaaaatcgggtgggtgtgcgatctcgataaggcatgggaccagtgtatacctaagtatagttttacaaggctcgatagcgtttcagagaagtcttctgtcagtccaggctacaatttcaggtttgcgaaatattacaagatggagaatggcagcgagtaccgtacgcttctgaaagcctttgggatcaggtttgacgtgcttgtctacggcaacgcagggaagttcaacatcataccaacgataatttctagtgtcgctgcattcacctctgtcggggttggcacagtgttatgcgatatcatcctcctgaatttccttaaaggagctgaccagtacaaggccaagaagttcgaggaggtgaatgagaccacactgaaaattgcagcccttaccaaccccgtctatccttccgaccaaaccaccgcagagaaacagtctaccgatagcggagccttttcaatcggccattag

SEQ ID NO: 237459 - DNA, 1191 bp, Artificial Sequence
  Description of Artificial Sequence: Synthetic coding sequence
atgaactgtatatcagatttcttcacttatgaaaccaccaaatctgtggtggtcaagtcctggaccattgggataatcaacagagttgtacagctcctgattatttcatacttcgtgggatgggtcttcctccacgaaaaagcctaccaggtgagagacaccgccattgagtctagcgtcgttaccaaagtgaaaggctccggcttgtacgctaatagggtcatggatgtgtcagactatgttacgccaccccagggcacttctgttttcgttattattaccaagatgatcgtcacagagaatcagatgcaaggcttctgccctgaatctgaagagaagtaccggtgcgtctcagacagtcagtgtggacccgaacgcctaccaggaggtggcatcttaaccgggaggtgtgttaactacagcagcgttctgcgtacgtgcgagatacaaggttggtgccctaccgaggtggacacggtagaaacacctattatgatggaggctgaaaacttcaccatttttatcaagaattctatccgctttcccctgtttaactttgagaaaggcaatttactccccaacctgactgcaagagacatgaaaacatgtaggtttcatcctgataaggaccccttctgtcccattctgcgagttggggacgtcgtgaagttcgccggacaggatttcgctaagctggccaggaccggaggggtactgggaatcaagattggttgggtatgtgacctggataaggcctgggaccaatgtattcctaagtactccttcactcgcttggatagcgtgtccgagaaaagctccgtgagccctgggtacaactttaggttcgcgaaatattataaaatggagaatgggagtgaatatagaacgctgttgaaggctttcgggatcaggttcgatgtcctctataccggcgctggcaaattcaatataatccctactatcatctcaagcgtcgcagctttcacttccgtgggcgtcggcacagtgctgtgcgacatcatcctcttgaacttcctcaagggggctgaccagtacaaggcaaagaaattcgaggaggtgaacgagaccactcttaagatcgcagccctgactaaccctgtgtacccctccgaccagacaacagccgagaaacaaagcacagattccggggcattcagcatcgggcattag

SEQ ID NO: 237460 - DNA, 1167 bp, Artificial Sequence
  Description of Artificial Sequence: Synthetic coding sequence
atggcagggtgctgcgcagcactggccgcatttctcttcgagtacgatacgccacgcatagtgcttattaggtctcgaaaagtgggcctcatgaacagggccgtgcaactcctaattctggcgtatgtaatcggctgggtgtttgtgtgggagaagggttatcaggaaaccgacagcgtcgtgtcctcggtcacaaccaaagtgaagggggtggccgtcaccaatacctccaagctcggctttcgtatctgggacgtagccgactacgtcatccccgcacaggaagagaacagcctatttgtcatgactaatgtgatcttgacaatgaatcagacacaaggtctgtgcccagaaattcctgatgcgacaaccgtatgcaagagtgatgctagctgcactgccggatctgcaggcactcattctaacggggttagcactggtcggtgtgttgcatttaatggttccgtcaagacatgcgaagtcgccgcttggtgtccagtcgaggacgatacgcatgtcccccagcctgcatttcttaaggccgcagaaaatttcaccctgcttgtaaagaacaacatctggtatcctaaatttaacttttccaaaagaaacatcctcccaaatattacaaccacctatctcaaatcctgcatctatgacgccaagactgatcctttttgtccaatattcagattgggcaaaatcgttgaaaacgctggccattcctttcaggatatggcagttgagggcggtataatggggatccaggtgaattgggactgcaacctcgaccgcgcagcctctctgtgcctccctcggtattcctttagaagactcgatactcgggacgtggagcataatgtgagtcccggatacaatttccgttttgcaaagtactaccgggacctcgcaggaaatgagcagagaaccttaattaaagcctatggcatccgctttgatataatcgtatttggtaaagcgggtaaatttgatattatacctactatgattaacataggtagcggactagcactgctaggaatggccaccgtgctttgtgacatcattgtgctgtactgtatgaagaaacggctatattatcgtgagaaaaagtacaagtacgtcgaagactacgagcaaggcctggctagtgagctggaccagtag

SEQ ID NO: 237461 - DNA, 1215 bp, Artificial Sequence
  Description of Artificial Sequence: Synthetic coding sequence
atggctggatgttgcgctgccctcgcagcattcctcttcgagtatgataccccacgaatagtccttatcagatctcgcaaggttggactaatgaaccgagctgttcagctgctgatactggcctacgtgatcggatgctatcatccccacctggccgaagtggagatggaatcgccacggcgatgggtgtttgtgtgggaaaagggataccaggagactgatagcgtagtcagcagtgtcacaacaaaggttaagggagtagccgtgactaacactagcaaactcggcttccgaatttgggacgtggcagactatgtaatcccggctcaggaggaaaactccttgtttgtgatgacaaacgtgattctgactatgaaccagacacagggcctgtgccccgagatccctgacgccacaaccgtttgcaagagcgacgcctcttgtaccgcgggtagcgcagggactcacagcaatggtgtgtcaacagggagatgcgttgccttcaatggatcggtcaagacttgtgaggttgccgcttggtgtccagtggaggatgacacccacgtgccacagcccgcattcctgaaagctgcagagaactttactctgcttgttaaaaacaatatttggtacccgaaattcaactttagtaagcgtaatattctgcctaacataaccactacatacctgaaaagttgtatttatgatgccaagaccgaccccttctgccccatttttagattgggcaagatcgtggagaacgcgggtcactcctttcaggacatggcggttgaaggtggaattatgggcattcaggtgaactgggactgcaacctagacagggccgcttccctgtgcttgcccaggtatagctttaggcggctagacaccagagatgtggagcataatgtgtcaccaggatacaacttcagattcgccaagtattaccgggacctcgcgggaaatgagcagcgaactctaatcaaggcttacgggattagattcgacattattgtctttggaaaagccggtaagtttgatattattcctacaatgattaacatcggaagcgggctggcacttctggggatggcaactgttttatgcgacataattgtgctgtactgcatgaagaagcgcctgtattaccgcgaaaagaaatacaaatacgtggaggactacgagcagggcctggcttctgaactcgatcagtag

SEQ ID NO: 237462 - DNA, 441 bp, Artificial Sequence
  Description of Artificial Sequence: Synthetic coding sequence
atggctggatgctgtgccgctttggccgctttcttgtttgagtacgacacacctcggatcgtgctcatccgatcgagaaaggtcggcctaatgaacagggctgtgcagctgcttattctggcttacgtgattggatgggtgtttgtctgggaaaaaggttatcaggagacagattctgtcgtctctagcgtaaccaccaaagtgaagggcgtcgcagtaaccaataccagcaagctcggattccgcatctgggacgtggccgattacgtcattcccgcacaggaagaaaatagcctgttcgtgatgactaacgtcattctgacaatgaaccagacacaggggctttgcccggaaattccagatgccactaccgtgtgcaaatccgacgcatcctgtactgcgggaagcgctggaacacactctaatgatctgctgttttag

SEQ ID NO: 237463 - DNA, 1086 bp, Artificial Sequence
  Description of Artificial Sequence: Synthetic coding sequence
atggctgggtgttgcgcagcgcttgcagccttcctgtttgagtatgataccccaagaattgtgctaatcagaagccgcaaagtgggccttatgaaccgggctgtacaacttctcatccttgcttatgtaatcggttgggtctttgtgtgggagaaaggttaccaggaaacagactcagtcgtatcgagcgtgaccactaaggttaagggtgtggcggtgaccaacacttcaaaactgggtttccgaatctgggatgtagccgactatgtaatcccagctcaagaggagaattccttatttgtgatgacaaacgtgatattaaccatgaaccagacacagggcctctgtcccgaaattcctgacgccactacagtgtgcaaaagcgatgcctcatgtacagcaggctctgccggaacgcatagtaatggggtcagcacaggtcggccagcgtttctgaaggctgccgagaactttacattacttgttaaaaataatatttggtatcccaagtttaatttcagcaagaggaatatcctgccaaacatcactactacgtatctgaaaagttgtatttatgacgccaagacagatccattctgtccgatcttccgtcttggaaagattgttgaaaacgccggtcattccttccaggacatggcagttgaggggggtattatgggcattcaggttaactgggattgtaatttagacagggctgcctccctgtgcctgccgcgttatagctttcggcgtctcgatactcgtgacgtggagcataacgtctcccccggatacaactttcgatttgccaaatactatcgggatcttgccggtaacgaacagaggaccctgatcaaggcctacgggatccgatttgacattatcgtgtttgggaaggcaggaaaattcgacatcatccctactatgatcaatatcggctccggcctggcactactaggtatggcgaccgttctgtgcgacataatagtcctgtactgtatgaaaaagaggctatactatcgtgaaaagaagtataagtatgtggaggactacgaacaggggttggcgagcgagctcgaccagtag

SEQ ID NO: 237464 - DNA, 864 bp, Artificial Sequence
  Description of Artificial Sequence: Synthetic coding sequence
atgactaatgtcatcctgaccatgaatcagacccaaggactgtgcccggaaattcccgatgccaccaccgtgtgcaaaagtgatgcgtcttgtacagcaggcagtgccggtactcactcaaatggcgtctccacagggcgatgcgtggccttcaacggctcagtaaagacatgcgaggtggcagcctggtgtcccgttgaggatgacacacatgtgccccagcccgcatttctgaaagccgctgaaaatttcaccctgctcgtcaagaacaacatctggtaccccaagttcaacttcagcaagcgaaatatactgccgaacattacaacgacctaccttaaaagttgcatttacgacgcaaagaccgacccattttgcccaattttcaggctggggaagatcgtggagaacgctgggcattcttttcaggacatggcagtagagggcggtattatgggcatccaagtcaattgggactgtaacctggatagggccgcaagcttatgcttacccagatattccttcaggaggctcgatactagagatgtggagcataacgtgtcccctggctacaatttcagattcgccaaatactaccgcgatttggctgggaacgagcagcgcaccctcattaaggcatacggcatcaggtttgacattattgtgttcggaaaagctggaaaattcgatatcatccctacaatgatcaacattggtagcggactggcactcctgggcatggcaacagtgttgtgtgatattattgtgctgtactgtatgaagaagaggctgtactatcgggaaaagaagtataagtatgttgaagattatgagcagggcttggcaagtgagctggatcagtag

SEQ ID NO: 237465 - DNA, 1278 bp, Artificial Sequence
  Description of Artificial Sequence: Synthetic coding sequence
atggatggtccagccgaacagagaccagcactgctgaactccgcagaaaacttcaccgttctcattaaaaataacattgattttcctggtcataactacaccactagaaatattcttcccggtctgaatattacctgcacgttccacaaaacacagaacccacagtgccccatctttagactgggcgacatttttcgcgagaccggggacaatttctcagatgtcgcaatccaaggagggattatgggcattgaaatttattgggattgcaacctagatcgctggttccaccattgcagacccaaatatagcttcaggcggctcgacgacaagaccactaacgttagcctgtacccaggctacaatttccgctacgctaaatactacaaagagaataacgtggagaagcggactttaattaaagtgtttggaattaggtttgatattcttgtgttcggaactggaggcaagttcgacattattcagctggtagtctacataggctccaccctcagctactttggactggcggcagtttttattgacttcctgattgatacctactccagcaactgctgcagatctcacatttacccatggtgtaaatgctgccagccttgtgttgtaaacgagtactattaccggaagaagtgcgagtcaatcgtagagccgaagccaactctgaagtacgtttcatttgtcgatgagtcacacataaggatggtgaaccaacagctcctgggcaggagtctgcaggacgttaagggacaggaggtgccaaggccagctatggacttcacagacttgagtagactacctttagctctgcacgacacaccgccaatccccggacagccggaagagatacagctgttgcggaaggaggcaacacccagatccagagattcccctgtatggtgtcaatgtggctcctgcctcccaagccagctccctgagagtcacagatgtctcgaagaattgtgttgccggaagaaaccaggcgcatgtatcacaactagtgagctgttccggaaattggtgttatctcgacatgtcctgcagttccttcttctgtatcaagagccgctattggcattagatgtggatagtaccaatagccgcttgagacattgcgcctatcgctgctatgctacttggcggttcggttctcaagatatggctgactttgcaaatctcccctcctgttgccgctggcgcatccggaaagaattccctaagtcggagggtcagtattcgggtttcaaatccccttattag

SEQ ID NO: 237466 - DNA, 828 bp, Artificial Sequence
  Description of Artificial Sequence: Synthetic coding sequence
atgcctgcctgttgttcttgctccgatgtatttcagtatgaaacaaacaaggtgactcgcatacagtcaatgaactatgggaccatcaagtggtttttccacgtgattatcttctcttatgtgtgtttcgctctggtctctgataagctgtatcagcgtaaggagcccgtgatttcttccgtgcatactaaggtcaagggcatcgctgaggtaaaggaggaaatagtggaaaacggggtcaagaaactcgtgcatagcgtattcgatactgcggattacacttttcctttgcaaggaaactcattcttcgtcatgactaatttcctcaagaccgaagggcaggagcagagattgtgccctgagtatccaactagacggaccctgtgttcaagcgatcgcggttgcaagaagggatggatggacccacagtccaaaggtatacaaacaggccgttgcgtcgtgtacgaaggaaaccagaagacgtgcgaagtgtccgcatggtgcccgatcgaagctgtagaggaggcccctcgaccagcactactgaattcggctgagaattttactgttctgatcaaaaataatattgattttccgggacataattacaccacttatgcaaagtattacaaagagaacaatgtggaaaaacggaccctaattaaggtattcggcatccgcttcgacatcctcgtgttcggtaccggcggaaaatttgatatcatccagttagtggtgtatattggctccaccctgagttatttcgggctggtacgtgattcactgtttcatgccctcgggaagtggttcggcgagggatcagactag

SEQ ID NO: 237467 - DNA, 1518 bp, Artificial Sequence
  Description of Artificial Sequence: Synthetic coding sequence
atgactcctggggaccattcgtggggaaacagcttctttgtgatgactaatttcctgaaaacggagggtcaagaacagcggctatgccctgagtacccgactagaagaactctgtgttcatccgatcggggatgtaaaaaaggatggatggacccccagagcaaggggatccagacaggtagatgtgtcgtgtacgaagggaatcagaagacttgcgaggtatctgcttggtgccccatcgaggctgtcgaagaggctccccgacctgcgctgttgaattcagccgagaattttaccgtcttgatcaagaacaacatcgacttccctgggcataactacacgacacggaatattctacctggcctcaatattacatgcaccttccacaaaacccagaacccacagtgccccatctttcgcctgggggacatctttagggagaccggagataacttttctgatgtggcgattcagggagggattatgggcatcgagatctactgggattgcaatctagaccggtggttccaccactgtcggcctaagtattcatttcgccgtctggacgacaaaaccaccaacgtgtccctgtaccccggatataatttcagatacgcgaagtattacaaggaaaataatgttgagaaacgaactttaattaaggtttttgggattcgcttcgatatcctggtattcggtaccggaggaaaattcgatatcattcagctggtggtgtatatcggtagcactctgagctactttggcctcgccgcagtttttatcgacttcctgatcgacacatacagtagcaactgctgcagatctcacatctacccctggtgtaagtgctgccagccttgtgtggtgaacgagtactactacaggaaaaagtgcgagagtatagttgagccaaagcccaccttgaagtacgtttcttttgtggatgaatctcacatccggatggtgaatcagcagcttttgggcaggagtctccaagacgtaaaaggccaggaagtgccccgacccgcaatggatttcactgatctgtcacgcttgccactggccctccacgatacaccccctattccgggacaaccagaggaaattcagcttctcaggaaggaggccaccccaagatcacgggatagccctgtatggtgccagtgtggctcatgtctacccagccagttgcccgaatctcatcgttgcctcgaagagctgtgttgccggaagaaacccggtgcttgcatcacgacgtccgagctgttccgtaagctcgtactgagtaggcacgtgctgcagtttctcttgctctatcaggagcccctgctggctcttgacgtggactccaccaatagtcgcctgaggcactgcgcctaccggtgttatgccacttggagatttggatctcaagacatggctgattttgctaatctgcctagttgctgccgatggcgcatccgcaaagaattccccaaaagcgaaggtcagtactccggctttaagtcgccgtattag

SEQ ID NO: 237468 - DNA, 387 bp, Artificial Sequence
  Description of Artificial Sequence: Synthetic coding sequence
atgccagcgtgctgctcctgttcagatgtctttcagtacgagactaataaggtgactcgcatccagtccatgaactacggcactatcaagtggtttttccatgttatcatattctcatatgtttgtttcgccctggtgagcgacaaactgtatcagcgaaaagaacccgtgatttcttctgtgcatacgaaggtcaagggaatagccgaagtgaaggaagagattgtggagaatggagttaagaaacttgtccattccgttttcgatacggccgattataccttcccgctgcagggcaattcattctttgtcatgacaaactttctgaagactgagggccaagagcagagattgtgcccagaggaattcagaccagagggcgtgtag

SEQ ID NO: 237469 - DNA, 921 bp, Artificial Sequence
  Description of Artificial Sequence: Synthetic coding sequence
atgtggcagttccgatatgcgaagtactacaaagagaataacgtggaaaagaggaccttgatcaaagtattcggcatccggttcgatattcttgtgtttggcaccggtgggaagtttgatattatccagctggtcgtatacattggatctacactgagttactttggactggctgcggtattcatagattttttaatcgacacgtactccagcaattgctgtagaagccacatatacccctggtgcaagtgctgccagccgtgcgttgtcaacgagtactactacagaaaaaaatgtgagagcattgtggagcctaagcccacgttgaaatatgtcagcttcgtagatgagtctcacatccggatggttaaccagcagttactcgggaggtccctgcaggacgtaaaggggcaggaggtgcctcggccagccatggacttcactgatctgtcccgacttcccctcgctctccatgacactcccccaattcctggccagcccgaggagatacagcttctcagaaaggaagctacccccaggtctagggatagtccggtgtggtgccagtgtgggagttgcctgccttcccagttaccagagtcccatcgttgcctggaggaactgtgctgtcgcaaaaagcccggtgcttgcattacgacaagcgaattattccggaaactggttctttcacgtcatgtgctgcagttcctactgctataccaagaaccattgttagcactggacgtggattccaccaacagtagactgcgtcattgcgcataccgatgctacgcaacttggaggttcggtagccaggatatggcagattttgctaacctgcccagctgttgccgctggcgaattcgcaaggaatttcccaaatctgaggggcaatatagcggcttcaaaagtccctactag

SEQ ID NO: 237470 - DNA, 387 bp, Artificial Sequence
  Description of Artificial Sequence: Synthetic coding sequence
atgcctgcttgctgttcttgctccgatgtgttccagtatgagactaataaggtgacaaggatccaatccatgaattacggaacaatcaagtggttctttcatgtgattatattctcttacgtctgttttgccctcgtttctgataagttatatcagcggaaggagcccgtgatctcctcagtgcataccaaagtcaagggtatcgccgaagtgaaggaggagattgtggaaaatggcgtgaaaaagctggtacacagtgtcttcgatactgccgactacacctttcctctgcagggcaattccttcttcgtgatgaccaatttccttaagacggagggccaagaacaaaggctgtgtcctgaggaattcaggcctgaaggcgtgtag

SEQ ID NO: 237471 - DNA, 1788 bp, Artificial Sequence
  Description of Artificial Sequence: Synthetic coding sequence
atgcctgcttgttgcagctgcagcgatgtgtttcagtacgagaccaacaaagttacccgtatacagtccatgaactatggcacgatcaaatggttcttccacgtgatcatcttttcctacgtctgctttgccctggtgagtgataagctgtatcagaggaaggagccagttatctcaagcgtccacactaaagtcaaggggattgctgaagtcaaagaagaaatcgtggagaacggggtgaagaagctggttcacagcgtcttcgataccgcggactacacattccccctacagggcaattcgttctttgtaatgaccaatttcctgaagaccgagggccaggaacagaggttgtgtcctgagtaccccaccaggcgcaccctgtgttccagcgatcgcggatgcaaaaagggctggatggatccccaaagcaaagggattcaaacaggacgctgcgtcgtttacgagggtaaccaaaagacgtgtgaagtgtccgcttggtgccctatcgaagctgtcgaggaggcccctcgacctgccttgcttaactcggcagagaactttaccgtgctgatcaaaaacaatatcgattttccaggccacaattatactactagaaatatccttcctgggctcaatataacttgtacatttcacaaaacacagaaccctcagtgtcctatcttccgcttgggtgacattttccgagagactggggataatttttcagatgtggccatccagggcggtataatgggcattgagatttattgggattgtaacctggaccggtggttccaccattgtcgaccaaagtactcattccgcaggctcgatgacaaaaccaccaacgtatccctgtaccctggctataactttaggtatgccaagtattataaggagaataacgtggagaagcggaccctcattaaagtcttcggtataaggtttgatattctcgtattcgggacaggtgggaaatttgatatcatccagctggtagtctatattggaagcactctgagctactttggcctggccgcagtattcattgactttctgatcgacacttatagctctaattgttgccgctcccatatatatccctggtgtaagtgctgccagccctgcgtcgtgaatgaatactattataggaagaagtgtgaaagcatcgtcgaacccaagccgactctgaaatacgtcagcttcgttgacgagtctcacatcaggatggtgaaccaacagttattgggaagatcactgcaggacgtgaaaggtcaggaagtgcctcgccctgccatggattttacagacctgtcacgcttgccactagctttgcatgatactccacccataccagggcagccggaggagatccaacttctgcggaaggaagctactccacggagccgagattcaccagtgtggtgccagtgtggttcttgtctgccaagccagctacctgagagccaccggtgtctggaggagctatgctgcaggaaaaagcctggggcatgcatcaccacgtctgagctttttcgcaaactagtcctcagtcgccatgtgttacagtttttgctgctgtatcaggagcctttgttggcattggacgttgactccaccaactcacgcctaagacattgtgcttaccgctgctacgcgacttggaggttcggctctcaggacatggcagacttcgcaaatctgccgtcctgttgtagatggcgcataagaaaggagttccctaaatctgagggacagtattctgggtttaaatccccttactag

SEQ ID NO: 237472 - DNA, 1122 bp, Artificial Sequence
  Description of Artificial Sequence: Synthetic coding sequence
atgacagaggttttatggcctgcagtgcctaacggtaccgacgcagctttcctggctggcccaggcagctcgtggggcaactccaccgtggccagcacagccgcagtgtcatcctcctttaagtgcgctctgaccaagacaggcttccagttctactatctgcctgctgtatatatccttgtttttatcattggtttcctgggaaactccgtagcaatctggatgttcgtcttccatatgaagccctggagcgggatatcagtgtacatgtttaacctcgccctcgctgatttcctttacgtgctgacattgcccgctctgatcttctactacttcaacaaaaccgactggatctttggggatgccatgtgtaaactgcaaaggttcatcttccacgtgaatctttatggcagtatcttgtttctgacgtgcatttcagcccacagatatagtggggtggtgtaccctctgaaaagtttgggaaggttgaaaaagaagaacgccatatgcatttctgtcttagtgtggctgattgtggtggtcgccatctctcccatactcttctatagtgggacgggtgtgcgcaagaataaaacgattacgtgctacgacactactagcgatgagtacctcaggagttacttcatctattctatgtgtaccaccgttgccatgttttgcgtgcctctcgtcctaattttgggctgctacggactgatagtcagagccctgatttacaaggatctggacaattcccctcttcgaagaaaaagcatctatttagtcatcatcgttctgactgtcttcgcagtgagctacatcccgttccatgtgatgaagaccatgaacctcagagctaggctggacttccagaccccagcgatgtgcgccttcaacgatcgcgtgtacgctacctaccaggtgacacgcggattggcctccttgaattcatgtgtagacccaatactgtatttcctggcaggggataccttcaggcgcagactaagtagggccaccagaaaggcttcgcggaggtctgaggcgaatttgcagagcaaatcggaggacatgacattgaacattcttcccgagttcaaacagaatggcgatacaagtctatag

SEQ ID NO: 237473 - DNA, 1125 bp, Artificial Sequence
  Description of Artificial Sequence: Synthetic coding sequence
atggctgccaacgtgtccggagccaaaagctgtccggcaaacttccttgcagctgctgatgacaaattgtccgggtttcaaggggacttcctatggcctatccttgttgtggagttcctcgtagccgttgcatccaacggtcttgctctctatcggttttccattcggaagcagcgaccctggcacccggctgtcgtgttttcggtgcaattggcagtcagcgatttgctgtgtgcactgactctccctcccctggcagcatacctgtaccccccaaagcactggaggtacggagaagccgcatgccgcctggagcgatttctgtttacatgcaatctgctggggtccgtcatattcatcacatgtatttcactaaaccgctatctcgggatcgtgcatcccttctttgcgaggtctcatttgagacctaaacatgcctgggcggtatcagcggctggctgggtgttggccgctttgctagctatgccgaccttgagcttctcccacttgaaacggccacaacagggagccggaaattgcagcgtggcaagacccgaggcctgcatcaagtgtctgggaactgcggatcacggactcgctgcatatcgggcttatagcctggtgctggcgggactagggtgcggcctgcccctgttactgaccttggccgcatatggagcccttggtagagccgtgttgagaagccctgggatgaccgtcgcagaaaagctgcgagtggctgctcttgtcgcctcaggcgttgctctctacgccagttcttatgtgccctatcacatcatgagagttctgaatgtggatgcgcgtagaaggtggtcgactcgatgcccgtcattcgccgacatcgcacaggcaaccgcagccctggaactcggaccatacgttggttaccaggtgatgcgcggtctcatgccgttagctttttgtgttcaccccctgctgtatatggcagcggtcccttccctgggatgttgctgtcggcattgtccaggctatagagatagttggaatccagaggatgcaaagagtactggacaggcattgcctctcaatgccacggcagctcccaaacctagcgaacctcagtcgcgggagctgtcccagtag

SEQ ID NO: 237474 - DNA, 1029 bp, Artificial Sequence
  Description of Artificial Sequence: Synthetic coding sequence
atgcaggcagtggacaacctgaccagtgctcctggtaatacgtccctctgtacccgcgattacaagattacacaagtgctgttccctctgttgtacaccgttctcttcttcgttgggctcattaccaatgggctggccatgagaatcttcttccagatccggtccaagtcgaacttcattatatttctaaagaacacagtcatctctgacctgctcatgatcctgacatttccctttaaaattctcagtgacgcaaagttgggaactgggcctttaaggacgtttgtgtgccaggttacctctgtgatcttttactttacaatgtacataagcatctcattcctgggtctgatcacaatcgatagataccagaagactactagaccgtttaaaacttcaaaccccaagaacctgttaggcgcaaagatcctgtccgtagtgatctgggcctttatgtttctgctgagtctgccgaacatgatcctgactaaccgtcagccccgagataagaatgtgaagaagtgttcgtttttgaaaagtgagtttggcttggtgtggcacgagatcgtcaactatatctgtcaggtcattttctggatcaactttctaatagtcattgtctgttatactctgatcacaaaagagttatacagatcttatgttcggacacgaggagtgggcaaggtgcctcgcaaaaaggtgaatgtcaaagtcttcataatcatcgccgttttcttcatctgtttcgtcccgttccacttcgcacggatcccgtacacactgagtcagacacgggatgtctttgactgcactgccgagaacacactgttctatgtgaaagagtctacactgtggttaacttccctgaatgcatgtctggatcctttcatctactttttcctttgtaagtctttcaggaacagcctaattagtatgctgaaatgccctaactctgccacttccctgtcgcaggacaacaggaaaaaggagcaggatggaggggacccaaacgaggaaacccccatgtag

SEQ ID NO: 237475 - DNA, 738 bp, Artificial Sequence
  Description of Artificial Sequence: Synthetic coding sequence
atgcaggctgtcgacaatttgacaagcgctcctggtaacacatccctttgtactagagactacaaaattacccaggtgctcttcccgctcttgtataccgtgttgttctttgtggggctcattacaaatgggttagctatgaggatctttttccagattagaagtaaatctaactttataatatttttgaaaaacaccgtgatctctgatctgttgatgatcctgactttccccttcaagatcctttcggatgctaaacttggcacagggcctctgcgcaccttcgtctgccaggtcatcttttggattaatttcctgatcgtcattgtgtgctataccttgatcaccaaagaattgtatcggtcttacgtgcgtacaagaggagttggaaaagtgccaaggaaaaaggtgaacgtgaaagtcttcataattatcgccgttttttttatctgctttgtaccttttcacttcgccagaatcccatacaccctgagccaaacaagagacgtgtttgattgtaccgcggagaatactttattttatgttaaggaatccacattgtggctgacctcactgaacgcttgcctggatccttttatctatttcttcctgtgcaaatctttccgcaactctctcatctctatgctcaaatgccctaatagcgccaccagccttagccaggataatcggaaaaaagaacaggacggtggtgatcctaatgaggaaaccccaatgtag

SEQ ID NO: 237476 - DNA, 1134 bp, Artificial Sequence
  Description of Artificial Sequence: Synthetic coding sequence
atggccgcagacctgggcccatggaatgatacaataaacggaacctgggacggagatgagctggggtatcgctgcagatttaacgaggacttcaaatacgttttattgcccgtgagctatggggtagtttgtgtgcccggtctgtgcctaaacgccgtggcactgtacatttttctgtgccgactcaaaacctggaatgcctctacaacatacatgttccacctggcagtttccgacgctctgtatgctgctagtcttcccctgctggtgtactattatgctcggggtgaccactggcctttcagcaccgtattgtgcaagctggttcgctttctcttctacaccaatttgtactgctccattctgtttctaacatgcatctctgtccatagatgcttaggggttctgcggcctctccggtccctgagatggggcagggctcggtacgcccgtcgggtggcgggagccgtttgggtgctggtgttggcttgtcaagcacctgtgctatattttgttactacgtcggctcggggtggtcgtgtgacatgccatgatacatcagcccctgagttgttctcgcgctttgtagcctatagcagcgtgatgctgggcctgttgttcgccgtgccgtttgctgtcatcttggtgtgttacgtgctgatggccagacgcttattgaagccggcatacggaacaagcggcggactccccagggcaaagagaaagtctgtgaggaccatcgcagtggtgttagccgtgttcgctctgtgttttctgccttttcatgttactcggaccctgtactattcattcaggtcactggacctaagctgccacaccctgaatgctatcaacatggcctacaaggtaacccggcctctggcctctgcaaattcatgtctggatccggtgctctattttctcgccggacagagactggtgcgcttcgccagagatgccaagccacccaccggaccctcacctgcgacccctgcaagaaggcggctgggccttcgcagatccgataggactgacatgcaacgaatagaagacgttttgggttcctctgaagacagtaggcgaaccgaaagtacaccggctgggagtgagaatacaaaagatatcagattgtag

SEQ ID NO: 237477 - DNA, 1134 bp, Artificial Sequence
  Description of Artificial Sequence: Synthetic coding sequence
atggctgctgacctaggaccctggaacgataccatcaatgggacatgggacggagacgaactcggctaccggtgccgattcaatgaagacttcaaatacgtcctgcttccggtgagctacggcgtagtgtgcgttcctggcctgtgtctgaacgctgttgcactgtatatttttctctgccgactgaaaacttggaacgcaagtacaacttatatgtttcacttggccgtcagcgatgctctctacgcagccagcctgccgcttttggtctactactacgctaggggtgaccactggccattctcaaccgttctctgtaaactggtacggttcctcttttataccaatctgtactgctcaatactgtttttgacctgcattagcgtgcaccggtgtttaggggtcttaaggcctttgcggagtctgcgttggggcagggcgaggtacgcgaggcgagtagcgggagccgtgtgggtcctggtcctggcttgtcaggccccagtgctttactttgtcacaaccagcgctagggggggaagagtcacatgtcatgacacctctgctccagagctgttctctagattcgtggcatacagtagcgtgatgttaggcctgctctttgcagtgccgttcgccgtgattttggtctgttacgtccttatggctcggaggctcctgaaacccgcatatggaacatctggtggcctccctcgcgcaaagcgcaaatcggtgcgtaccatagctgtcgtgttagcagtgtttgcactgtgctttctgccatttcacgtgaccagaacactgtactactcctttcgaagcttagacttgagttgccacaccctgaacgccatcaacatggcttacaaggtcacccgcccactggcctctgcaaactcctgtctggaccctgtcctgtattttctcgccggtcagaggctagtgaggtttgccagggacgcaaagccccctaccggcccttcacctgccacccctgctcgccgtcgattaggacttcgcagaagcgatcgcacggacatgcagcgcattgaagacgtcctgggtagctctgaggattcccgacggaccgagagcacacctgccggatctgagaatacgaaagacatccggctgtag

SEQ ID NO: 237478 - DNA, 1134 bp, Artificial Sequence
  Description of Artificial Sequence: Synthetic coding sequence
atggcagcagatctagggccatggaatgacaccattaacggaacatgggatggggacgagctgggctatcggtgccggttcaatgaggattttaagtacgttctcctgcccgtttcctacggcgtagtgtgtgtgccaggcctctgcttgaacgccgttgctctgtacattttcctttgcagactcaagacgtggaatgcttcgacgacgtatatgtttcacttagccgtatccgatgcactttacgcagcttctcttcccctcttagtctactactacgcacgcggagaccattggccgttttcaacagtactgtgtaaactcgtcagattcttattttacaccaacctgtactgttctatcctctttctgacatgcatctccgtgcatcggtgtctcggggttctgagacctttgcgatcgctgagatggggccgtgcacggtatgcccgtagggtcgcaggagccgtgtgggttctggtgctggcctgtcaggcaccagtgttatatttcgtcacgacaagcgcacgaggaggacgtgtgacttgccacgacacatccgcacccgaactgttctcacgcttcgtagcatattcctcagttatgttgggtcttctgtttgcagtgcctttcgccgtgatcttagtttgttacgtcctgatggctcggaggctcttaaagcctgcatacgggacttccggaggactgccaagggctaagagaaaaagtgtccgtacgattgccgttgtacttgccgtgtttgctctgtgctttcttccatttcatgtgacccgcaccctgtactacagttttaggtctctggacctgtcgtgccataccttgaatgcaattaacatggcgtacaaggtgactagaccactcgcttcagccaacagctgtctcgaccccgtgctgtatttccttgccggtcagagattggttcggttcgcaagagatgcgaaacctcctaccgggccttctcctgctacgcccgctcgacgccgtctaggattgaggcggtcagatcgaaccgatatgcagcggatcgaggatgttcttggctcctctgaggatagtagaagaacagaatctacgccagcgggatccgaaaacactaaggatatccgactgtag

SEQ ID NO: 237479 - DNA, 1080 bp, Artificial Sequence
  Description of Artificial Sequence: Synthetic coding sequence
atgcaggtcccaaactctactgggccagacaacgccacactgcagatgttgcggaatccagccattgctgttgcccttcctgtagtatacagtttagtagccgcagtgagcattccgggaaatctgttttccctgtgggtgctctgtaggagaatgggtcctaggtcccccagcgttatcttcatgattaatctgtccgtcactgatctgatgctggcctccgttctgcccttccaaatttattaccactgcaaccggcatcactgggtgttcggtgtcttactatgcaatgtcgtaaccgtggccttttatgcaaatatgtacagctctattctcaccatgacatgtattagcgttgagcgatttttgggtgtgctgtacccactgtcctctaagcggtggcgcaggcggagatacgctgtggccgcttgcgcgggaacctggctgctgttgcttaccgcgctctctcctctcgcgcgtacagacctgacctatcctgtacatgccctgggcataattacatgcttcgacgttctcaagtggacgatgctgcccagtgttgcaatgtgggcggtgtttctctttaccatttttatcctgctcttcctcataccattcgtgattactgtggcttgctacacagccacgatcctgaaactgctcagaaccgaagaggctcacggaagggaacagagacggagggcagtaggtctggccgctgtggtactgctggcttttgtgacgtgctttgcaccaaataattttgtgctcctggctcacatcgtgtccaggctattttatggaaaatcctactatcatgtgtacaaactgactttatgtctgtcttgcctgaacaactgcctcgatcccttcgtgtactacttcgcatctcgagagtttcagctcaggttacgggagtatttgggatgcaggagagtcccccgtgacacccttgatacacggagggagtctttattctctgctcgtacaacatccgtgcgatccgaggcaggtgcccacccagagggcatggagggagcaaccaggcccggtctacaacgtcaagagtctgtattttag

SEQ ID NO: 237480 - DNA, 189 bp, Artificial Sequence
  Description of Artificial Sequence: Synthetic coding sequence
atgagcgagagacagggagctggagcaaccaatggcaaagacaagacctccggagagaatgatgggcaaaagaaggtccaggaagagtttgatatcgacatggacgccccagagaccgagagagctgcagttgccatccagtcacaatttaggaagttccagaagaaaaaagccggttcccaatcatag

SEQ ID NO: 237481 - DNA, 1914 bp, Artificial Sequence
  Description of Artificial Sequence: Synthetic coding sequence
atggcctcgaacgaaagggatgctatttcctggtatcagaaaaaaatcggtgcgtacgatcagcagatctgggagaagtctatagaacagacacagatcaagggcttaaagaacaaaccaaaaaagatggggcacattaaacctgacctcatcgatgtggacctgatccgtggttctaccttcgccaaggccaagcctgaaatcccttggacttctctaacacgaaaaggtttagtgagagtagtcttttttcccctattttcgaattggtggatccaagtgacaagtttacggatctttgtgtggctgcttctgctctacttcatgcaggtgattgccatcgtcctatatttaatgatgccgattgttaacattagcgaagtgctgggaccactttgcctcatgttgctgatgggaactgtgcactgtcagattgtttctacccagatcacccgcccatccggtaacaatggcaacaggcgtcgtaggaaactccgcaagaccgtgaatggggacggatcccgcgaaaacgggaacaacagcagcgataaagtcagggggattgagacactggagtctgtgcctatcattggaggcttttgggagacaatttttggcaacaggatcaaaagagtgaagctgatcagcaataaagggactgaaaccgacaacgacccttcatgcgttcacccgatcatcaaaagacggcaatgccgccctgaaatccggatgtggcagactagggaaaaagccaaattcagtgatggcgaaaagtgcagaagagaagccttccgaagactcgggaatggggtgagcgacgatctgtccagcgaagaagacggtgaagctaggacgcaaatgatcttactcagacggagcgtggaaggcgcaagctcagataacgggtgcgaagtgaaaaatcgcaagagtattctctccaggcaccttaactctcaggtgaaaaagaccaccacaagatggtgccacatcgtgagggatagcgatagcctcgctgaatctgagttcgagtccgcagcttttagtcagggatctcgcagcggcgtctcagggggttccaggagtcttaatatgtcccgaagagactctgagagcacccggcacgactctgaaactgaggacatgctttgggacgatctcttacatgggccagagtgccgaagttccgtcacttctgatagtgagggggcacatgtgaataccctccactctggtactaaacgggatcccaaagaagacgtgttccagcagaatcacctgttttggttgcagaacagtagtcctagctcggatcgggttagtgcgatcatctgggaaggtaatgagtgtaagaagatggatatgtccgtcctggagatttccggaattatcatgagcagggtgaatgcctaccagcagggtgtgggataccagatgctgggtaacgtggttaccatcggccttgctttctttccattcctgcaccgtctctttcgggagaaatcattggatcagctgaaatcaatatcggcagaggaaatcctgaccctattttgtggagcccctccagtgacccccattattgtcctgagcatcattaatttctttgagcggttgtgccttacctggatgttcttcttcatgatgtgtgtcgctgagcggacctataaacagagattcctctttgccaagttgttctcacacatcacctccgccagaaaagcaaggaaatatgagatccctcatttcaggctgaagaaagtggaaaacattaaaatctggctgagtctccgatcctatctcaagcgaagaggaccccagaggagcgtcgacgtagttgtatctagtgtatttcttttgacactcagcatcgcctttatctgctgcgcccaggtgaaggtatcccatctcctctag

SEQ ID NO: 237482 - DNA, 2130 bp, Artificial Sequence
  Description of Artificial Sequence: Synthetic coding sequence
atggcttctaacgagagggacgctatctcttggtatcaaaagaaaataggcgcttatgaccagcagatctgggaaaaatccatcgaacaaacacagataaaaggcctgaaaaacaaaccaaagaaaatgggccacattaagcctgacctgatcgacgtggacttgattagggtgatcgccatcgtgctgtatctgatgatgcctatcgtgaatattagtgaagtcctaggcccactctgcctcatgctcctgatggggacggtgcactgtcaaatcgtttcgacacagatcacgaggccctcgggaaataatggtaatcggaggcgtcgcaagttgcgcaaaactgttaatggggacggttctagggagaacgggaataactcctccgacaaggtgaggggcatcgaaacattggaatctgtgcccatcatcggaggattctgggagaccatctttggcaaccgtatcaagagggtcaagctgatctcaaataaggggacagaaaccgataatgatccctcatgtgtccaccccatcattaagcgacgccaatgtcgaccagaaatccgcatgtggcaaaccagggaaaaggccaaattttcggacggggaaaagtgtcggcgtgaagcttttagaaggcttggaaacggggttagtgacgacctgagtagcgaagaggacggggaggctcgaacacagatgattctgctgcggcgatcagtcgaaggcgctagcagcgacaatgggtgtgaggtaaagaacaggaagtctatactatcccgacacctcaactcacaggtcaaaaagacgaccacaagatggtgccatatagtgcgagacagcgactcactcgccgagagtgagttcgagtccgccgctttctctcaaggctcacgttcaggagttagcggaggtagtcgttcacttaatatgtctaggcgggactctgagagtaccaggcatgattctgagaccgaagacatgctgtgggacgatcttctgcatggtcccgaatgtcggtcaagcgtaactagcgatagcgaaggggctcacgtgaacactctgcactctggaacaaaacgagaccccaaggaagatgtgtttcagcagaatcatttattttggttgcaaaattctagcccgtcaagtgatagagtctcagccatcatttgggagggaaatgaatgcaagaaaatggatatgagtgtccttgaaatttcaggcattattatgtctagggttaacgcctatcagcagggggtgggctatcagatgctgggtaacgtcgtcacaatcggcttggctttcttcccgtttcttcaccggctgtttcgggagaaatccttggatcagctgaagtccatcagtgccgaagaaatccttactctattctgtggagctccccctgtgacaccaatcattgtgcttagcatcatcaacttctttgagaggctctgcctcacgtggatgttttttttcatgatgtgcgtggctgagcgtacctacaaacaaagatttctgtttgctaaactgttctcccacatcacatctgctcgcaaggcaaggaagtatgagataccccacttccggttgaaaaaagtggaaaatatcaagatatggctttccctacggtcctaccttaaacgcaggggcccacaacgatcggtggatgtggtggtgtcttcagtgttcctgctgactctgtcaatagccttcatttgctgcgcgcaagtgctgcaaggccataagaccttcctgaatgacgcgtacaattgggaattcctgatttgggaaaccgctttgctgctgtttttactgcggttggcctccctgggaagtgagactaacaaaaagtacagcaacgtgagcattttgctgacagaacagatcaatctttacctgaagatggaaaagaagcccaacaaaaaagaacaacttacactcgtgaacaacgtgctgaagctatcaacgaagctgcttaaagaactggacacaccatttagactctacggcttaaccatgaatcctctcatctacaatatcacacgcgtggtaatcttgagcgctgtgtcaggtgttatttctgatcttctaggcttcaacataaggctgtggaaaatcaagtcgtag

SEQ ID NO: 237483 - DNA, 2154 bp, Artificial Sequence
  Description of Artificial Sequence: Synthetic coding sequence
atggcctccaatgaacgggatgcaatctcttggtatcagaaaaagatcggggcttacgaccaacagatctgggagaaaagtattgaacagacccaaatcaagggtctgaaaaacaagcccaagaaaatgggccacatcaagcccgacctaatcgatgtggatctgattagaggctccacatttgctaaggctaagcctgaaatcccctggacctcattaacgcggaaaggcctggtgcgcgttgtattcttccccctgttctcaaactggtggatacaggtgaccagtctgaggatctttgtctggctgctccttctttatttcatgcaggttattgccattgtactctacctgatgatgcctattgtaaatattagcgaagttcttggtccgctctgcctgatgttgctgatgggcacagttcactgccagattgtgtctactcaaatcacccgcccatcaggtaacaatggcaatagacgaaggcgcataaagagggtcaaactgatctccaacaaaggcacggaaaccgacaacgatcccagttgtgtgcatcccattatcaagcgcagacagtgccgcccagagattcgcatgtggcaaacacgagagaaagccaaattcagcgacggggaaaagtgccgcagagaggcctttagacgcctgggcaatggggttagcgacgatttaagctcggaagaggatggagaggcacgaacccagatgatcctgctgagacgctccgtcgaaggcgctagcagtgataatgggtgtgaggttaagaatcgcaagtctatcctgtccagacacctgaattctcaggtgaaaaaaaccacaacacgttggtgtcacattgtaagagacagtgactctctcgcagaatccgaattcgagagtgcagccttctcccagggaagccgcagcggcgtatctggtggatcccgcagtttaaatatgtctcggagggatagcgaaagcacccgacacgacagcgaaactgaggacatgctgtgggacgatctgttgcacggccctgagtgcagaagttcagtaacgagcgactctgaaggtgcccacgtaaacaccctccacagtggtacaaagcgtgatcctaaggaggacgtcttccaacaaaatcatcttttctggttacaaaatagctccccttcctccgaccgggtatctgctattatttgggagggtaacgaatgtaagaaaatggatatgtccgtcctagagatctccgggataattatgtcgagggtgaacgcttaccaacagggggtcggttaccagatgttgggcaatgttgtcactattggactggcttttttcccatttctccaccgcctgtttcgggaaaagtcactggaccagctgaagtccatatccgcagaggaaattctcactctgttttgcggagctccacccgtgacccctataatagtcctctccataattaactttttcgaaaggctgtgtctgacttggatgttcttttttatgatgtgtgtggccgagagaacttataagcaacgattcttgttcgccaagctgttctcacacataacttctgccaggaaagctcgcaaatacgagatccctcacttcagactgaagaaggtggagaacatcaagatctggctcagcctgcgcagttacctgaagcggaggggaccacagaggtccgtggatgtcgtcgtttccagcgtttttcttctgacactcagcattgctttcatctgttgtgcgcaggtgctgcagggacacaagacttttttgaacgacgcttataattgggaattcctgatttgggagaccgccctgctgcttttcctgttgcgcttggccagccttggctctgagactaataaaaagtacagcaatgtgagcattctgttgacggagcagatcaacctatacctaaagatggagaaaaaaccaaacaaaaaagaacagttgacactggtgaacaacgtgctgaagctgtctaccaagctgctgaaagaattggacactcccttccggctgtacggcctaactatgaaccctctgatttataacattacacgggtggttatcctgtctgccgtaagcggagtcatcagcgacctgttgggcttcaacattcggatttggaagcactcctcttag

SEQ ID NO: 237484 - DNA, 2154 bp, Artificial Sequence
  Description of Artificial Sequence: Synthetic coding sequence
atggcttcaaacgagcgtgacgctatctcctggtaccagaaaaagatcggagcctacgaccagcaaatatgggaaaagtccatcgagcaaacacaaatcaagggcctcaagaacaagccaaagaagatgggacacataaaacccgatctgatcgacgtggacctgatccggggaagcacatttgcaaaggccaagccagaaatcccatggacgagtttaacccggaaggggcttgtgcgcgtggtgttcttccccctgttctccaactggtggatacaagtgactagtttaagaatcttcgtctggctcctcttgttatatttcatgcaggtaatcgctatagttctttatctcatgatgccaatcgtaaacatttcagaagtactcgggcctttgtgcctgatgctgctgatgggaacagttcactgccagattgtttccacgcagattacacgcccttccggcaacaatggtaacagacggcgaagaatcaagcgggtcaagcttattagtaacaaagggacggaaacggataatgatccttcatgtgtgcacccaatcatcaaaagacgacagtgccgacctgagatcaggatgtggcagacacgcgagaaggcaaagttttctgatggagagaaatgtaggcgggaagccttccggcgactcggcaacggtgtcagtgatgacctgagctcggaagaagatggagaagcaaggacgcaaatgatcttgctgcgaaggtctgtcgaaggcgcatccagcgataacggttgtgaagtaaaaaatcgcaagtccatactcagtagacatctaaacagccaagtgaagaagaccaccactagatggtgtcatattgtgagagatagtgatagcctcgccgaaagcgaattcgagagcgctgccttctctcaaggctctagaagcggcgttagtggtggatcccgctcgctaaacatgagccgacgtgactctgagtccacacggcacgattcagagaccgaggatatgctctgggatgatctcctgcacgggccagagtgtcggagttcggtgacatctgactctgaaggcgctcatgtgaacacccttcattccggtacgaaacgcgaccccaaggaggacgtgtttcaacaaaatcatctcttttggttgcagaattcttcccccagtagtgaccgtgtctccgccattatttgggagggtaatgagtgtaagaagatggacatgtcagtgttggagatctccgggatcattatgtcacgtgttaatgcgtatcagcagggtgtcggctaccaaatgctgggaaatgttgtcaccataggactcgcttttttcccctttctgcacaggctgtttcgggaaaagagtctagatcagttgaagtctatcagcgccgaggaaattctaaccctcttctgcggagccccaccagtcaccccaattatagtgctgtccattataaacttctttgagcggctgtgtctcacttggatgttttttttcatgatgtgtgtagccgaaagaacctataagcagcgttttttatttgccaagctgttcagccacataacatcagccagaaaagcgaggaaatacgagattccgcacttccgactgaaaaaggtggagaatattaagatttggctttccctcaggtcgtacttaaagaggagaggcccacagcggtccgtcgatgtcgtggtgtcttccgtgttcctcctcaccctttctatcgcgttcatctgttgcgctcaggtgctgcaaggccacaaaacgtttttaaatgacgcatataattgggagttcttgatctgggagactgcactcctactgtttttgctgaggctcgcatcactaggctccgaaaccaataagaagtactctaacgtgagcatcctgctcacagaacagatcaacctctatctcaaaatggagaagaagccaaacaagaaagagcagttaacactcgtgaacaatgttctgaaactgtcaacaaaactcctaaaagaacttgataccccattcaggctttatgggctgactatgaacccactcatttacaatataacaagagttgtcatccttagcgccgtgtccggggtaatttcggatctgctcgggttcaacattcgtctgtggaagattaagagctag

SEQ ID NO: 237485 - DNA, 2130 bp, Artificial Sequence
  Description of Artificial Sequence: Synthetic coding sequence
atggcatcaaacgagcgtgacgccatatcatggtatcagaagaagatcggggcatacgatcagcagatctgggaaaagagcatcgagcagactcagatcaagggactgaaaaacaagcccaagaaaatgggtcacatcaagcctgatttgatcgacgtggacctcatcagagtgatcgcaatcgtcctgtacttgatgatgcccattgtcaatatttcggaggtcctggggcctttgtgcttgatgcttcttatgggtacagtccactgccaaattgtatcaacgcaaatcacgagacccagcggtaataacggaaatcgacgacgcagaaagttgcggaaaaccgtgaacggggacggttcaagagagaacggaaataatagttccgacaaggtgcgaggcattgaaaccctagagagcgtccccatcattgggggattttgggaaaccatcttcggaaaccgtattaagagggtgaagctaatctcaaacaagggaaccgagactgataatgaccccagctgcgttcacccaatcattaaaaggagacagtgtcgaccagagattagaatgtggcagacaagggaaaaagccaaatttagcgatggcgagaagtgtagacgggaagcattcaggcgcctggggaatggcgtgtccgacgacctgtcctctgaggaggacggggaggcgagaacacagatgatcctcctgcgtcgatctgtggagggagctagtagcgataatggctgtgaggtgaagaatcggaaatcaattttatcgagacacttaaactcacaagttaagaagacaaccaccagatggtgccacatcgtgcgtgacagtgacagtctcgcagagtctgagtttgagtctgccgcattcagccagggctctcggagtggggtatcaggaggctcacggtcactgaacatgtcaaggagggatagcgaatctacgcgacacgactcagagacggaagatatgctctgggatgacctgctgcatggccctgaatgcaggagcagtgtgacctcggattccgaaggggctcacgtgaacaccctgcactcaggaacaaaaagagatccaaaagaggatgttttccaacagaaccatctcttctggcttcagaatagcagtccgtcaagtgatagagtgtctgccatcatctgggaggggaacgaatgtaagaagatggatatgtccgtcctggagatatcagggattattatgtctcgcgtgaatgcatatcagcagggtgtggggtatcagatgctaggtaacgtcgttaccattggcctcgccttttttccattcctgcaccgtttatttagggaaaagtccctagaccaactcaagtcaatctcagccgaagagatactcactttattttgtggggctcccccagttactcccattattgtcctcagcatcatcaatttctttgagcggctttgtctgacttggatgttttttttcatgatgtgtgtggccgaacgcacctacaagcagcgctttctgtttgccaagttgtttagccacatcacctccgctcggaaagctcggaagtatgagatccctcattttaggttgaagaaagtggagaatatcaagatctggctttcactgaggagttatctcaagcgccgaggaccacaacgcagcgtggatgttgtggtcagctcagtgtttctgttgacactgtcaattgccttcatctgctgtgcccaagtattgcaagggcacaagactttcctcaacgacgcctacaactgggaattcctaatatgggaaactgcattgttactgttcctcttacgcctcgccagcctggggtcagagacaaataaaaagtattctaacgtgtccatcctactgactgagcagatcaatctttatctcaaaatggaaaagaagcccaacaaaaaggaacagcttaccctcgtgaacaatgtccttaaactgagcaccaaacttctcaaagagctggacacccctttcagactctacggactgacaatgaaccccctcatctacaacataactcgagtcgtcatactcagcgcggtgtctggcgtgattagcgaccttcttggtttcaacatacgtctgtggaagattaagtcctag

SEQ ID NO: 237486 - DNA, 2289 bp, Artificial Sequence
  Description of Artificial Sequence: Synthetic coding sequence
atggcctccaacgaaagagacgcaatatcatggtaccagaagaagattggtgcatacgaccagcagatttgggagaaatccattgaacaaacacagatcaaaggcctgaagaataagcccaaaaagatggggcatattaagccagatctcattgatgtggacctcatccgtggcagcactttcgcaaaggctaagcccgagattccctggacctcattaacaaggaagggcctggtgagagtggtgttcttccccttattcagcaattggtggattcaggtcacctccctccgcatcttcgtttggctgcttctcctgtatttcatgcaggtgattgctattgtgttgtatctgatgatgcctattgtgaacattagcgaagttctcggtccactttgcctcatgcttctgatgggaaccgtccattgtcagatagtttctacacagatcaccaggcccagcggcaacaatgggaacagaagaagaaggaaacttcgaaagactgtgaacggagatgggagcagagagaatggtaataactcttcagacaaagtgcgcggaatcgagactctcgaatcggtgcccattattggagggttttgggagacgatctttggaaaccggataaaacgggttaagttgatcagcaacaaaggcacagaaacagataacgatccctcatgtgttcacccaatcattaagcgcagacagtgtagaccagagataagaatgtggcagaccagggaaaaggctaaattcagcgacggagaaaaatgccgcagggaggcattccgaagactcggaaatggcgtcagcgatgatctgagctcagaggaagacggagaggccaggacccaaatgattttgctaagacggtccgtggaaggagcgtcatctgacaacggctgcgaggtaaaaaaccgcaagtcaattctctcccgacatctgaactcccaggtgaaaaagacaaccactcgctggtgccatatagtacgtgatagtgactccctggccgagagcgaatttgagtctgcagcattcagtcaggggtcgcgctcaggcgtgtcaggagggtccagatctctgaacatgagcagacgcgactccgagagcacgcgtcacgactcagaaacggaggacatgttatgggacgacttactgcatggccctgagtgccgcagttccgtgacttccgatagcgagggcgctcatgtcaacacgttgcactctggcacgaagcgggatccaaaagaggatgtttttcaacagaaccacctattctggcttcagaatagctcaccttcttccgaccgagtgagtgctatcatttgggaggggaacgaatgcaagaagatggatatgtccgtgctggaaatttccggcattatcatgagccgtgtcaacgcctatcagcaaggagttgggtaccagatgctgggtaatgtggtcactatcggactagcgttttttccgtttctgcatcggctcttccgtgagaagagcctcgaccaactaaagagtatctccgccgaagaaatcctcactttgttctgtggtgctcctcctgttaccccgatcattgtgttgagcattattaattttttcgaaagactgtgcctgacttggatgtttttcttcatgatgtgcgtggcggaacggacctacaaacagcgcttcctctttgccaagttgttttcacatattacgagtgctagaaaagcccgtaagtacgaaattccgcattttcggctgaagaaggtcgaaaatattaaaatttggctatctctgagatcctatcttaaaaggcgcggacctcagagaagtgtcgatgtcgttgtttcatcagtttttctgttaacactatcaatcgccttcatatgctgcgcacaggtgctgcagggccacaagacatttctcaacgacgcctataattgggagttcctcatctgggagactgcgctgctcctgtttctgctccggctggcttctcttggtagcgaaacgaacaagaagtactcaaatgtgtctatcttactcactgagcagatcaatttgtacttgaaaatggaaaagaagcctaataagaaggagcaactcaccctcgtcaacaacgtgcttaagctgtctacaaaattgctcaaagaacttgacacaccatttagactttacggcctcacgatgaaccctctgatttacaatattacacgagtcgttattttgtctgccgtgagtggagtcatctccgacctcctcggattcaatattcggttgtggaaaatcaaatcttag

SEQ ID NO: 237487 - DNA, 2289 bp, Artificial Sequence
  Description of Artificial Sequence: Synthetic coding sequence
atggctagcaatgaacgcgatgcaatttcctggtatcagaagaagataggagcatatgatcagcagatttgggagaagtctattgaacaaacacagatcaagggcttgaagaacaaacccaagaaaatgggtcacatcaagccggacctgattgatgtggacctgatcagggggtctacgttcgccaaagccaagcctgaaatcccatggactagtctgactaggaagggattggtgagggttgtgttctttccactgttcagcaactggtggatccaggttacttcgcttaggatcttcgtgtggttgctgctcctatactttatgcaggtaatagcaattgtcctgtacttgatgatgccaattgtgaacattagcgaggttctcggaccactctgcctcatgctgctcatgggcaccgtgcattgccagattgtgtcgacacagattacacgtccctccgggaacaacggcaatcgcaggaggcggaaactcagaaaaaccgtaaatggagatggcagtcgcgagaacgggaataacagttccgacaaggtccgcggaattgaaacactggagtcggtgccaattataggcggattctgggagacaattttcgggaatcgcatcaagcgcgtgaaattaatttctaacaaaggaaccgagactgataatgacccttcttgtgtgcatcccatcatcaagaggcggcaatgccgacccgagatacgcatgtggcagacgagggagaaagcaaagttctcagacggagaaaagtgtaggagagaggcatttcgacgattaggtaacggggtgagcgacgatctcagctccgaagaagacggggaggccaggacccaaatgattctcctaagaagaagcgttgagggtgcctcgtctgacaacggctgtgaggtgaaaaaccgcaaaagtatcctgagcagacaccttaatagccaagtgaaaaaaactaccaccaggtggtgtcacattgtccgcgattccgattcacttgccgaaagtgagttcgaaagtgctgctttctcacagggcagtagatcgggcgtgagcggcggaagccgctcattgaatatgtcccgcagggatagcgaatcgacaaggcatgactctgagaccgaggacatgctgtgggacgatctcctccatgggcctgagtgtcggtccagtgtgacaagcgattccgagggtgcccacgtcaacaccctgcattcgggaaccaaaagggatcccaaggaagatgtgttccagcagaatcatctcttttggctccagaatagcagcccctcatccgatagggtctctgcaatcatctgggaaggtaacgagtgcaaaaaaatggacatgtctgtgttagaaattagtggaatcattatgagcagggttaacgcctaccagcagggagtaggttatcagatgttgggaaatgtcgtgacgatcggtcttgccttcttcccgttcctgcacaggctttttagagagaagtcgctcgaccagctgaagtcgattagtgcagaggaaatcttgaccctgttctgcggcgcacctccagtaacaccaataatagtgctctccattattaattttttcgaaaggctgtgcttgacctggatgttttttttcatgatgtgtgtagccgagcgcacatataagcagagatttcttttcgcaaaactgtttagtcacatcacatcagcccgtaaggctcggaagtatgagataccgcactttcgtctgaaaaaggttgaaaacattaaaatctggctgtcattgaggtcctatctgaagcgccgaggtcctcaaagatctgtggatgtagttgtaagctcagtatttctgctgacactgtcaatcgcctttatctgttgcgcacaggtactccagggccataagacttttctcaatgatgcatacaattgggaatttctgatttgggaaactgcgttattgctgtttctgctgcgcctggcatccctgggatctgagacaaataaaaaatattctaacgtctccattctgctcaccgagcagattaacctctacctgaagatggagaagaaacctaacaagaaagagcagctgacgctagtgaataacgtgcttaagctgtcaactaagctgctaaaggaattggacacacctttcagactttacggtctaactatgaatcccctcatttacaacattaccagggtggtgatcctgtccgctgtgagcggagtgatttcagatctgctcggctttaatattcggctgtggaagatcaaatcctag

SEQ ID NO: 237488 - DNA, 996 bp, Artificial Sequence
  Description of Artificial Sequence: Synthetic coding sequence
taacagactcgtgagaaagccaagttttccgacggggaaaaatgtaggcgcgaagcctttagaagactgggcaacggtgtttctgacgacctctcctccgaagaggatggcgaggcccgtacacaaatgattctgctccggcgtagcgtcgagggtgcttcatctgataatgggtgcgaggtgaagaaccgcaaatctatccttagccgtcatctcaattctcaagtgaagaaaacgactacccgctggtgccacatcgtgagagactctgattctttggcggaatcagagtttgaatccgctgcctttagccaaggctcccggagtggcgttagcggcggatcacggtcccttaacatgtcacggagggattcggaatcaacacgacacgacagcgagactgaggatatgctgtgggacgacctgctgcatgggccagagtgccggagctcagtgacgtctgatagtgaaggagcacatgtgaacacactgcacagcgggactaaacgagatccaaaggaagatgtcttccagcagaaccacctattctggcttcagaatagctccccaagctccgatcgggtaagcgccattatctgggagggtaacgagtgtaagaagatggacatgtctgtgcttgagataagcgggattattatgagccgtgtaaacgcataccagcagggtgtgggatatcaaatgctcggtaatgttgtcacaatcggcctggccttttttccatttctacatagactgttccgggaaaagtccttggatcaattgaagtccatttccgctgaagaaatactcaccctgttctgcggagccccacctgttaccccgataatagtgctatcaatcatcaatttctttgagagactctgtctgacctggatgttcttttttatgatgtgtgtcgccgaaagaacctataaacaggtgagtggagaaatacgtaaaatattttacctgtttttgtatatgatcttccactag

SEQ ID NO: 237489 - DNA, 318 bp, Artificial Sequence
  Description of Artificial Sequence: Synthetic coding sequence
atggcttctaatgaaagggacgccatttcttggtaccagaaaaaaatcggagcctacgatcagcagatctgggaaaagtccatcgagcagacccagatcaaggggctgaagaacaaacctaagaagatggggcacatcaagccagacctgattgatgtagacttgattagaggatcaacgtttgcaaaagccaaacctgagattccctggacctcccttacccgtaaaggactcgtgcgcgtcgtattctttccgcttttttctaattggtggatccaggtgacatccctgagaattttcgtgtggctgctgttgtag

SEQ ID NO: 237490 - DNA, 702 bp, Artificial Sequence
  Description of Artificial Sequence: Synthetic coding sequence
atggcaagcaacgagagagacgcgatttcctggtaccagaaaaaaatcggcgcttacgaccaacaaatatgggagaaatccatcgaacaaacacaaataaaaggtctcaaaaataaacccaagaagatgggacatattaagcctgatctaatcgatgtggacctcatccgcggaagtacattcgccaaagccaagcccgaaattccatggacttcgctgactagaaaaggactggtgcgggtggttttcttccccctgttcagcaactggtggatacaggtgacctccttgagaattttcgtgtggttgttactgctgtacttcatgcaagtgatcgcaatcgttctctatctcatgatgcctatagtcaatatcagcgaagtcctgggccctctgtgtcttatgttattgatgggaaccgtgcactgccagatcgtgagtactcagattactcggcctagcggcaacaacgggaatcgaaggagaagaaaacttcgcaagaccgtgaatggtgacggctcccgcgaaaacggcaacaattcttcagataaagtgagaggtatcgagaccttggagtcggtcccgataattggtgggttttgggaaacgatatttggcaacaggcggttactcggagtgtgggttatgggctgtctgatgacctgtcaggtgaagaagatggtaaaacatgggcacaggtag

SEQ ID NO: 237491 - DNA, 2760 bp, Artificial Sequence
  Description of Artificial Sequence: Synthetic coding sequence
atgaaattcgcatataggttttcaaacctgctagggacagtgtatcggaggggcaatctcaattttacctgcgacggaaatagcgtgattagccctgtggggaaccgagtaacggtatttgacctgaaaaataacaaatcggatacattgccgttggcaaccagatacaatgtgaaatgcgtgggtctctctcccgacggaagactggctatcattgttgatgagggtggggacgctctgctggtctctctggtctgtagaagtgtgctgcaccatttccattttaaagggagcgttcactctgtctctttcagtcccgacggcagaaaatttgttgtgactaaaggcaacatagcccagatgtatcacgctccagggaaaaagcgcgagtttaacgcattcgtcttggataaaacatactttggcccttacgacgagaccacctgcattgactggaccgacgattcccggtgttttgtcgttggttcaaaggacatgtcaacttgggtgttcggcgctgagcgatgggacaatttgatctattacgcattgggaggtcataaggacgccattgtcgcttgcttctttgaatccaattcacttgacctgtactccctctcccaggatggggtactgtgcatgtggcagtgcgatacccccccagaagggttgaggctcaagccgccagcaggatggaaggcggacttactgcagcgtgaagaagaagaagaggaggaagaagaccaagagggggacagagagaccacaattagggggaaagctacccccgcagaagaagagaaaaccgggaaggttaagtattcacggctggctaaatatttctttaacaaagagggggactttaataacctgacagcagcggcatttcataagaaaagtcatctcctcgtgacaggattcgcgagcgggattttccatctgcacgagctgccagaattcaatttgatccattccctctctatctccgatcagtccatcgcaagcgtcgcgataaacagttccggggattggatcgctttcggctgttcagggctcggccagttgttggtctgggagtggcaaagcgagtcctacgtcctcaagcaacagggtcacttcaactccatggtggcattagcatactcacccgatgggcagtatatcgtgaccgggggtgacgacggcaaagtcaaagtgtggaacactctctctggcttttgtttcgtgacattcactgagcattcttctggcgttactggcgtaacatttacagccactgggtatgtcgtggtgacctcctctatggatgggaccgtgagggcttttgaccttcaccgttatcgaaattttcggaccttcacatcgcccagacccacacagtttagctgcgtggccgtggacgccagcggagagattgtatctgccggagctcaggacagcttcgagatcttcgtttggtcaatgcagactggacggctcctggacgtgctgtcgggccacgagggccctatttctggactgtgcttcaatccaatgaagtcagtactcgcaagtgcttcctgggacaagactgtccgcctctgggatatgtttgattcttggcgcaccaaagagactctcgctttgactagcgatgcccttgctgtgacattccggccagacggggctgagctcgcagtcgccactctcaacagccagatcactttctgggatcccgagaacgccgtccaaacaggtagcatagagggaaggcacgatttgaagaccggtcgcaaggagctcgataagataacagccaaacatgctgccaaggggaaagcattcacagcactgtgctatagtgccgatgggcattcaattctggctgggggtatgtcaaagtttgtctgcatctaccacgtgcgcgagcagatcctgatgaaaaggttcgaaatctcctgtaacctgagcctcgatgccatggaagagttcctcaatcgccgaaaaatgacagaatttggtaatttggccttaatcgaccaggacgccggtcaagaggatggtgtcgccatccccctcccaggcgtgcgaaaaggggatatgtcttcccgacacttcaagccagagatcagagttacaagtctgcgatttagccccactggccgttgttgggctgccacgacgacagaaggactgctcatctactccctggacactcgggtgctgttcgatccctttgaactggatacatctgtgactccaggaagagtgcgggaggccctgcggcagcaggactttactagagcaatccttatggccttgcggctgaacgaaagtaaactggtccaagaggcccttgaggcggtaccaagaggggaaatagaggtagttacttcatcgttaccggagctttacgtcgaaaaggttctggaatttctggctagttcttttgaggtctctagacaccttgagttttacctcctgtggacacacaaacttctgatgctgcatggtcagaagctgaaatctcgtgccggaacattactgcctgtcatccagtttctccaaaagtctattcagagacatctcgacgacctgtcgaagttgtgttcttggaaccactacaatatgcagtatgccctcgcagtctcgaaacagagaggcaccaaacggagtctcgaccccctcgggtctgaggaagaggcagaggcctccgaggatgacagcctgcaccttctgggcggagggggtcgcgacagtgaagaggagatgctcgcctag

SEQ ID NO: 237492 - DNA, 1686 bp, Artificial Sequence
  Description of Artificial Sequence: Synthetic coding sequence
atggcatttatggaaaagcctcccgcaggcaaggtgttgcttgatgatacagttcccttgaccgctgctatcgaggccagtcaatctttgcagagccatacaattgtcagaagatacagtgactttgacctgcttaataactctctccaaatcgcaggcctttccctccctctcccgccaaaaaaactcataggaaatatggatcgggagtttatagccgaacgccaaaagggactacagaactacctgaacgtgattactacaaaccacatcctatcgaactgcgaactcgtgaaaaagttcctcgaccccaacaactactccgcaaactacacagagatagctctccaacaggttagcatgttcttcagatccgagcccaagtgggaggtcgtcgaacctctgaaagatatcggatggcgaatcagaaagaagtatttccttatgaaaattaaaaatcagccgaaggaacggttagtgctttcatgggctgacctgggcccagataagtacctatctgataaggactttcagtgtctgatcaaacttctacctagctgtctgcacccttacatctaccgggtgacctttgcgaccgccaatgagagctccgccttgctgattcggatgtttaacgagaaggggactctaaaggatcttatttataaagctaagccaaaggatccatttttgaagaaatactgcaacccaaagaagatacagggattggaactgcagcaaatcaagacttatggtagacagattttagaggtcctgaaattcctgcacgacaaaggtttcccatacggacacctgcacgcaagcaatgtaatgctggatggagacacttgtcgactgctggatttggaaaatagtcttctagggctgccaagtttctaccggagctacttcagtcaattccggaaaatcaacaccttggaaagcgtcgatgttcattgctttgggcaccttttgtatgagatgacatatgggaggccccctgacagtgtccccgtcgatagttttccaccagcaccatcaatggccgtggttgcagtcctggaatccacactgtcgtgtgaggcctgtaagaatggtatgcctaccatcagtaggttattgcaaatgccactgttctcagacgtgctgctgacgacctccgaaaagcctcagtttaaaataccaaccaaattaaaggaagcccttaggattgctaaggagtgtatcgaaaaaaggctaattgaggagcaaaaacaaatacaccagcacaggcggctgacccgcgcacagtcccaccacggatctgaagaggaacgaaagaagaggaagatccttgcacgtaaaaagtcgaaacggtccgcccttgaaaatagcgaagaacacagcgcaaagtactctaacagcaacaatagcgcgggaagtggggcatcgagtcccttgacgagccccagcagccccactccgccttcaacttctggtatcagcgcactacctccgccaccaccgccaccccctcctccggcagctcccttaccacccgcttctaccgaagctcctgctcagctgagttctcaggccgttaacggaatgagccgcggtgccctgttgtcaagcatccagaattttcagaaaggcactctgcggaaggccaaaacatgtgaccacagcgctcctaagattggttag

SEQ ID NO: 237493 - DNA, 1737 bp, Artificial Sequence
  Description of Artificial Sequence: Synthetic coding sequence
atggcattcatggagaaaccacccgcagggaaagtccttctggatgatacggttcccctaacagcagccattgaggctagtcaatccttgcaaagtcatacagaatatatcataagggtccagcgaggaatcagtgtggagaattcatggcagatagtgcgacgttatagtgatttcgatctgctaaacaacagcttgcaaattgctggtctcagtctgccgctgccgccaaagaaactgatcggcaatatggatagggaattcatcgcggagcggcaaaaaggtttgcagaattatctgaatgtgatcaccacgaatcacattctgagcaattgtgaactggttaagaaatttctggaccctaataactatagcgctaattacaccgaaatcgctctacaacaggtgtcgatgttcttccggtctgagcctaaatgggaggtagttgaacctctgaaggatattggatggcgtattcgaaagaaatacttcttaatgaaaatcaaaaatcagccgaaagagagactcgtactgtcttgggccgacctcggccctgataagtacctttctgataaagacttccaatgcttaattaagcttcttcccagctgtctgcacccctatatttatcgtgtgacctttgctaccgccaatgaaagctccgcactacttatcaggatgtttaacgagaagggtacacttaaggatctgatttataaagctaagcccaaggacccgttccttaaaaaatactgcaaccctaagaaaatccagggtctggagctgcagcaaattaagacatacggaagacagattctggaagtgctgaagtttctccacgataaaggatttccctacgggcacctccacgcttccaacgttatgctggacggcgacacctgccgactgctagacctggagaactcactgctggggcttccttctttctatagaagttacttctcccagttcaggaaaattaatacacttgaatctgttgatgtgcattgctttggtcatctgttgtatgaaatgacgtacggccgaccacccgactccgtgccggtagattcttttccacccgcacctagcatggctgtggtggctgttttggagtccaccctgtcttgcgaggcttgtaagaacggtatgcctactatctcgaggcttctacagatgcccctgttcagtgacgtgctgctgacaacgtcagagaagccacagttcaagattccaaccaagcttaaggaggcccttcggattgctaaggaatgcatcgaaaaaagactgattgaggaacaaaagcagatccatcagcacagaagacttacccgcgctcagagtcaccatggaagcgaggaggagcggaagaaaaggaagattcttgccaggaaaaagtccaaaaggtccgcccttgaaaactctgaagaacacagcgccaaatactctaattctaataactccgctggcagcggcgctagtagccccttgacgtcgccctcttcacctactccaccgtctacgtcaggcattagtgccctcccgcctccccctccacctccacccccaccagctgcccctctgccgccagcctccactgaggcccctgcccaactttcttcgcaggccgtgaacggaatgtctaggggggctttactgtcatctattcagaactttcaaaagggcacactgcggaaggctaaaacctgcgatcacagcgcgccaaaaatcggatag

SEQ ID NO: 237494 - DNA, 1638 bp, Artificial Sequence
  Description of Artificial Sequence: Synthetic coding sequence
atggcctttatggagaaacctcccgctggcaaagtcctgctggatgacacagtacctctcaccgccgctatcgaggcttctcaatctctacagtctcacacgattgccggactgtccctccctcttcctcctaaaaagctgatcgggaatatggaccgggaatttattgccgagcgccagaagggacttcagaactatctgaatgtgattaccactaaccatatcctctccaactgcgaacttgtgaaaaagttcctggaccctaacaattattcagcgaactataccgagatcgccctgcagcaagtttctatgtttttcaggtccgagcctaagtgggaggtagtggaacctctgaaagatatcgggtggcgcattagaaaaaaatacttcttaatgaagattaagaatcagccaaaagagagattagtgttgagttgggctgacttgggaccagataaatatctctcagacaaagacttccagtgtctgattaagttactccctagttgtctccatccctatatctacagggttacttttgcaacagctaacgaatctagcgctttactgattcgcatgtttaacgaaaagggcaccctaaaagatctgatttataaagcaaaacccaaggacccttttctaaaaaaatattgcaaccccaagaaaattcagggcctcgaactgcagcaaatcaaaacctacgggaggcagatactcgaggtcctgaagttcctgcacgataagggttttccctacgggcatctgcacgcttcaaacgtgatgcttgacggcgatacttgcagactgcttgatctggagaactcactcctgggcctgccctcattctatagatcttacttttcccagtttaggaagataaacaccttagagtcagttgacgttcactgttttggacacctgttgtacgagatgacatatggccgtccaccggacagcgttcctgttgacagcttcccccctgccccatccatggcagtcgtagccgtcctggaatctactctgagttgtgaagcatgcaagaatggaatgccgaccatctctagactgctccagatgcccctgtttagcgatgtgctccttaccacatccgaaaagccacaatttaaaatccccacaaaacttaaggaagctctaagaatcgccaaagaatgcatcgaaaagcgcttgatcgaggagcagaaacagattcatcagcatcggcgactcacccgagcccagagtcatcacggttcagaggaagagcggaagaagaggaagatcctggcaaggaagaagagtaaacgcagtgcactggaaaacagcgaggaacattccgctaagtattctaactctaataatagtgccggaagcggagcttcctcccccctaacgtccccttcatctccgaccccgccaagcacatccgggatctcagccctgcctcccccaccacctcccccacccccacctgcggcacccctgccacctgcttccacagaagcccctgctcaattgtcgtctcaagcagtaaacgggatgtctcggggtgcacttcttagttccattcagaatttccaaaagggcactcttaggaaggccaagacatgcgaccatagcgctcctaaaattggctag

SEQ ID NO: 237495 - DNA, 1548 bp, Artificial Sequence
  Description of Artificial Sequence: Synthetic coding sequence
atggctttcatggaaaagccccctgcagggaaggttctgctcgatgacactgtccctctgacagcggcaatcgaggcttcccagagtttgcagtctcatactgagtacatcatacgcgtgcagcggggaatcagcgtggagaactcctggcagatcgttagaagatatagtgactttgatctcctgaataattccctgcagattgctgggttgtctcttccgctccctcccaaaaagctcattggcaacatggaccgcgaattcatcgcggaacgccaaaagggtttacagaattatttgaacgttatcaccaccaaccatattctttcgaactgcgagctggtgaaaaagtttttagacccaaataactattctgcaaactacacagaaattgctctccagcaggtgagcatgtttttccgctctgagccaaaatgggaggtggtggagcccctaaaagacatcggatggcggatcaggaaaaagtacttcctaatgaaaatcaagaaccaacctaaggagcgcttagtcctctcctgggccgacctcggtcctgacaaatacttgagtgacaaagatttccaatgcttgatcaaactgttgcccagctgtctgcacccatacatttaccgcgtgacctttgccacggcaaacgagagctcagccctgctcatcaggatgttcaatgaaaagggcacactgaaggacctgatatacaaggccaaacccaaggacccattcctgaaaaagtattgtaatcccaagaaaattcagggcctggaactgcagcagatcaaaacttatggcaggcagatcctcgaagttctcaagttcttacatgacaagggctttccttacggccacctgcatgcaagcaatgtgatgctggacggagatacatgccggcttctcgaccttgagaatagcctgctgggtttgccaagcttctaccgaagctactttagccagtttcggaagatcaacaccttagaatcagtggacgtacactgcttcgggcacctgctttatgaaatgacctatgggagaccacccgacagtgtacccgtggattctttcccccctgccccatctatggctgtggtggctgtgttagagtccaccttaagttgcgaggcctgtaagaatggtatgccaacgatatccaggctcctgcaaatgccgctcttttccgatgtgctacttaccacgagtgaaaaaccccagttcaagattcctactaagctgaaggaggccctcaggattgccaaagagtgtatcgaaaaaagacttatcgaagaacaaaaacagattcaccagcacagaagactcacccgtgctcagagtcatcacggatcggaagaggagcgaaagaaacgcaagatcctggccagaaaaaagagtaaacgaagtgcgctggagaattccgaggagcattccgccaagtattcaaacagcaacaattccgccggaagcggtgcctcttcgcctcttacgagcccgtccagtccaaccccgccttccacctctgtggaacacgccccattctag

SEQ ID NO: 237496 - DNA, 1326 bp, Artificial Sequence
  Description of Artificial Sequence: Synthetic coding sequence
atgttcttccgctctgagccgaagtgggaagtggtcgagcctctgaaggatattgggtggcgcatcaggaaaaagtacttcctgatgaaaatcaaaaaccagcccaaggagcgactggtcttgtcttgggccgatcttggcccagacaagtatctctcagataaggattttcagtgcttgatcaagctcctgcctagctgtctccatccttacatttatcgcgtaaccttcgccacagcgaacgaaagttcggccttgctcatcagaatgttcaacgagaagggaactctgaaggacctcatatataaagctaaaccaaaagatcccttcctgaaaaaatactgtaaccccaaaaagatacaaggtcttgagttgcagcagataaaaacctatggtcggcagattctggaggtactaaagtttctgcacgacaaaggctttccctacggtcatctgcacgcctccaacgtcatgttagatggagacacttgcaggctgctggacctggagaatagcttgctgggtctcccgagcttttatcggagttactttagtcagttccggaagatcaacactctggaaagcgtggacgtgcattgttttgggcacttgctgtacgagatgacctacggcagaccccctgacagcgtgccagtcgactcctttccaccagccccatccatggccgtcgttgccgtactcgagtctacattgtcttgcgaggcgtgtaaaaatggaatgccgactatctccagactgttgcagatgccgctgtttagtgacgtgctgttaaccacaagcgagaagccccaatttaagataccaacaaagctgaaagaggctctccgaattgcaaaagaatgcatcgagaagagactgattgaggaacaaaaacaaattcatcagcacaggcgcctgacacgcgcacagagccaccacggaagcgaggaggaacggaagaagagaaagatcctcgctaggaaaaagagcaagcgatcggcgctcgagaacagcgaagagcacagtgctaaatatagcaattctaataacagcgcaggatccggggcttcctccccactgacttccccatcttcaccaaccccaccatccacttctggtatctccgctctgccaccccctccgcctccgcctccgcctcctgcggctccgctgcctcccgcttcgacggaggcacccgctcagttgagcagccaggctgtcaatggaatgtcacggggagctctgttgtcttctatacagaattttcagaagggcacgctcaggaaggctaaaacgtgtgatcactccgcacctaaaattggctag

SEQ ID NO: 237497 - DNA, 1005 bp, Artificial Sequence
  Description of Artificial Sequence: Synthetic coding sequence
atgttcttcagaagcgagccaaaatgggaggttgtggaacccttgaaagatatcggttggagaatacggaagaaatactttctgatgaagattaagaatcaacccaaagagcgcctcgttttgtcatgggccgatctcgggccagataagtacctgtctgataaagatttccaatgtctaatcaaactgctgccatcttgtttgcacccttatatttatagagtaactttcgcaaccgccaatgagtcatcggccttgctgataagaatgtttaatgaaaaaggcactttaaaggacttgatctataaagcaaagcctaaagatcccttcctgaagaaatactgtaatcccaagaagattcaaggcctcgaactgcagcagatcaaaacatatgggaggcagattttagaggtcctgaagtttttgcatgacaaggggtttccttacggccaccttcacgcatccaatgtcatgctcgatggagacacctgtaggctgcttgatttggagaactccctgttgggactacccagcttctatcgctcgtacttctctcagtttagaaaaatcaacaccctcgagagtgtagatgttcactgctttggacaccttctatacgagatgacctacgggaggcctccagactctgttcccgtggatagtttcccaccggctcctagtatggcggttgtggccgtgctcgagtcaacgctgagctgtgaagcttgcaagaacggaatgccgacaatctcccggctcctgcaaatgcccttattcagtgatgtcttgcttaccacgtcagagaagcctcagtttaaaataccaacaaagttaaaggaggctctccgaatagcaaaggagtgcatagagaagcggctgatcgaggaacagaagcagatccatcagcacaggcggttaactcgagcgcagtcccaccatggcagtgaggaggagcggaagaaaaaagatttttcatccaaggaggtgaagacaatctgctcctag

SEQ ID NO: 237498 - DNA, 1110 bp, Artificial Sequence
  Description of Artificial Sequence: Synthetic coding sequence
atgaagtcgccagagaagaaaaggcggaaaagcaacacccaggggcctgcttattcccatctcaccgaatttgccccaccccctactcctatggtggatcacctggtggcgtcaaatccctttgaggacgatttcggagcgcctaaggtgggcgttgccgcacctccttttctggggtcgccagttccatttggtggcttccgtgtccagggcggtatggcagggcaggtgccccctgggtacagtaccggcggtggaggcggaccccagccactccgcaggcagcctccaccctttcccccaaatcctatggggcctgcttttaacatgccccctcagggtcccggatacccacctcccggaaacatgaactttccttctcagccgtttaaccagccactcggccaaaatttctcccccccatccggccaaatgatgcccggacccgtgggtggttttggcccaatgatcagccctactatgggtcaaccccctcgagctgagctaggacccccatccttgtcacaaagattcgcacaacccggtgccccatttggcccatcccctctgcagcggccaggccagggtctgccttcattacctccaaacacttcaccgtttccgggacctgaccccggttttcccggacctggaggagaagatgggggaaagcccctgaacccacctgcttctacagccttcccccaggaaccacattcaggcagcccagcagccgctgtcaatggcaaccagccaagttttcccccaaacagttccgggaggggaggaggcactccagacgcgaattccttagcccctccaggaaaagccggtggcggatccggacctcaaccaccaccgggactcgtttatccctgtggcgcttgccgttcagaggtcaatgatgatcaagacgcaatattatgtgaagccagctgtcaaaaatggtttcacagagagtgcactggcatgacagagtcagcatacggccttctaactacagaagcatcggccgtgtgggcgtgtgacttatgccttaaaacaaaggagattcagagtgtgtatatccgggaaggcatgggtcaactggtcgccgctaatgacggctag

SEQ ID NO: 237499 - DNA, 1221 bp, Artificial Sequence
  Description of Artificial Sequence: Synthetic coding sequence
atggcagcttctgcccctcctccacccgataagctggaggggggagggggacccgctccccctcctgccccaccatctaccggaaggaaacaaggtaaagccggactccaaatgaaaagccctgaaaagaaacgaagaaagtccaacacacaggggcctgcctactctcatctcacggaatttgcacccccacctacacctatggtggatcatcttgtagcctcaaacccctttgaagatgactttggggcacctaaggtgggggtggccgcacccccttttctgggcagtccagtgccctttgggggttttcgggtccagggcggaatggctggccaagtcccgcctgggtacagtaccgggggtggaggtggacctcaacctctcagaagacagcctcctcctttcccaccgaacccaatgggtccggcttttaatatgcctccccagggcccaggatatcccccacccggaaacatgaatttcccatcccaaccgtttaatcagcctcttgggcaaaatttctcgccccctagtgggcagatgatgccagggccagttggtggcttcgggcctatgatttcaccaacaatgggtcaaccacccagagccgagctgggtccacctagtctgagccagcggttcgctcagcctggagcgccatttggaccatctcctctgcaaaggcccggacagggactcccctcgctaccccctaatacctctccctttcccggacccgatccaggttttccaggtcctggcggagaggacggcggaaagccgctcaaccctcccgcttcaaccgccttcccccaagagccccatagtggtagccctgctgcagctgtgaacggtaatcagccttcttttccacccaattccagtgggcgagggggtgggacccccgacgcaaactccctggcaccccctgggaaagcaggaggagggagtggaccccagcctccacccggactggtttacccttgtggcgcatgtcgatccgaagtgaatgacgaccaagacgccattctttgtgaggcctcctgccagaaatggtttcaccgcgagtgcacagggatgaccgaaagtgcctatggactattgaccaccgaggcgagcgccgtgtgggcctgcgacctatgtctgaagaccaaagagatccagtccgtgtacataagagagggcatgggccagctcgtagcagctaacgatggatag

SEQ ID NO: 237500 - DNA, 939 bp, Artificial Sequence
  Description of Artificial Sequence: Synthetic coding sequence
atggaggaagaatgcagagtcttgagtattcagtcccatgtgatcagaggatacgtgggtaatcgtgcggctacttttcccctccaagtcctcggcttcgaaattgatgcagtgaacagcgtacagttttctaatcacacaggatacgcccactggaaaggccaggtcctgaattccgacgagttgcaggagctctacgaaggcttgcggctgaataacatgaacaagtatgattacgtactgacagggtacacaagggacaaatcgtttctggccatggtggtcgacatagtccaggaattaaaacagcagaacccgcgtctcgtctacgtctgcgatcccgtcctgggcgacaaatgggacggagaaggctcaatgtacgttcctgaggacttactccccgtgtataaggaaaaggtagtgccccttgccgatataatcacacctaatcagtttgaagcggagctgttgtccggaaggaaaatccactcgcaggaagaggccttgcgtgtcatggacatgctgcatagcatgggtccagacaccgtggtgattacctcctcagaccttccctcgcctcaaggtagcaactatctaattgtcctgggatcacagcggaggaggaacccagctgggagtgtggtaatggagagaattagaatggatatcaggaaggtggacgctgtttttgtgggcacaggggatctgttcgccgctatgctgctggcttggacccacaagcacccaaataacctgaaggtggcttgcgaaaagacagtctccacactgcaccacgtgctgcagcgcactatccagtgcgcgaaagcccaggcaggggagggagtgagacccagccctatgcagttagaactgcgaatggtgcagagtaaacgagatattgaagatccagaaattgtcgtccaggctacagttctctag

SEQ ID NO: 237501 - DNA, 855 bp, Artificial Sequence
  Description of Artificial Sequence: Synthetic coding sequence
atggaggaggagtgtcgcgtactctcaatccagtcccacgtaatcagggggtacgttggaaacagagctgccacatttcccttacaggtgctgggattcgaaattgacgcggtgaactcagttcagtttagcaaccatacagggtacgcgcattggaagggccaagtgctgaatagcgatgagcttcaggagctctacgaaggtctgaggctcaacaacatgaacaaatacgattatgttctaaccgtgtgcgatcccgtcctgggcgacaaatgggacggtgaaggttccatgtatgttcccgaagacctgttacccgtgtacaaagagaaagtagtgccactggcagacattattacccccaatcaattcgaagccgaactattatcagggcgtaagatccattctcaggaagaggctctgcgggttatggacatgctacatagcatgggccctgacaccgtcgttataacctctagtgaccttccatctccacagggatcaaactatctgatagtcctgggttctcagcggcgtcgcaatcccgcaggatcagtcgtcatggagaggataaggatggatatcaggaaggtcgatgctgtttttgtgggaaccggcgacctgttcgcggctatgctgctcgcgtggactcacaagcaccccaataatctcaaggtggcttgcgagaaaaccgtaagcacactccaccatgttctgcagaggaccattcagtgtgccaaagcccaggccggagagggagtcaggccatccccaatgcagctggagctgagaatggtccaatcaaagcgtgacatcgaagaccctgaaatcgtggtacaggctacagtgctttag

SEQ ID NO: 237502 - DNA, 2322 bp, Artificial Sequence
  Description of Artificial Sequence: Synthetic coding sequence
atgggcaagaacctgaaggaggccgttaagatgctggaggacagtcagcggcgtacagaggaggagaacgggaagaagctgatctctggtgatattccaggacccctgcagggcagcggccaggacatggtgagtatcctccagctggtgcagaacctcatgcatggtgacgaagatgaagaaccgcaatccccacgcatacagaatattggcgaacagggacatatggcgttgttaggccattcactcggcgcttatatctcgactctcgacaaagaaaaattgaggaagttaacgacacggatcctgagtgataccacgctttggctttgtcgaatcttcaggtacgaaaatgggtgtgcctactttcatgaggaggagcgagaaggtctagcaaagatctgccgcctcgcaattcactctcgctacgaggacttcgtggtagacggcttcaacgttttgtataataagaagccagttatctacttgtccgccgctgcccgtcctggcctcgggcagtatctgtgtaatcagttgggactgccctttccttgtctttgccgggtgccgtgtaatacagtgtttggcagccaacaccagatggacgttgcttttctggaaaagcttataaaagatgatatcgagcgcggtcggctccccctgcttctagtggcaaatgccggaactgcagccgtgggccacacggacaaaatcgggagactgaaagagctgtgcgaacagtacgggatctggctccacgtggagggtgtgaacctcgcaacccttgctcttggctacgtgagttcttcggtgctcgcagctgctaagtgtgactccatgacaatgaccccaggaccatggctgggccttcccgctgtgcccgctgtcactctgtacaagcatgacgaccctgccctgactctggtcgcgggactgacatcaaacaaacccacagataagctgcgtgccttacctctgtggctctctcttcagtacctggggttggatggctttgtagagcgaattaaacatgcttgtcagctcagtcagaggctgcaagagagtctcaagaaagtgaattatataaagatcctcgtggaagatgagctctccagtccagtggtcgtgttcagattctttcaggaactgcccggttccgatcccgtttttaaagccgtgcctgtcccgaacatgacccccagcggggttgggagggagcgccactcatgtgatgcgctgaaccggtggctgggggaacagctcaaacagcttgtccctgcttctggcctgactgtcatggacttagaggctgaggggacatgtttgagatttagccccctgatgaccgcggcagtgctcggcacaaggggtgaggacgtcgatcagctggtggcttgtatagagtcaaagctcccggtcctctgttgtacattgcaactgcgggaggagttcaagcaagaggtggaagccaccgcaggactgctctacgtggatgacccaaattggagcggtatcggggtagtgaggtacgaacatgccaacgacgataaaagtagcctgaagtccgatcctgagggagaaaacattcacgcaggcttgctgaagaagcttaacgagctggaatcggaccttacgtttaaaatcggccctgaatataaaagtatgaagagttgtctttatgtggggatggccagtgataacgttgatgccgctgaattagtggaaacgatcgccgctactgctcgcgagatagaagaaaacagtagactgctggaaaacatgaccgaggtggtgcgcaagggaatccaggaggctcaggttgaactccagaaggcaagcgaggaaagactgctcgaggaaggggtgctgaggcagatcccagtggtgggcagcgtgctgaactggttcagcccagtacaggccctgcagaagggaaggacattcaacctcacagcaggtagcttggagtctaccgagccaatctacgtttacaaggcacagggagccggagtgacacttccacccacgccctcaggaagccgaaccaagcagcgactccctggccagaaaccctttaagcgcagccttcgtggaagcgacgctctcagtgagacatcttccgtatctcatattgaggatctggaaaaggttgagcgattgagcagcggccctgaacagattactttggaggccagctccaccgaaggccacccgggtgcgccatctccgcaacacaccgaccagacagaagcattccagaagggggtcccacatcccgaggacgatcacagccaggtcgagggccctgagagtttgagatag

SEQ ID NO: 237503 - DNA, 2367 bp, Artificial Sequence
  Description of Artificial Sequence: Synthetic coding sequence
atggacgcttccctggaaaaaatagcagacccaaccctcgctgagatgggaaagaacctgaaggaagcggttaagatgctagaggactcccagcgaaggactgaagaagagaatggaaagaagctgatctccggcgacatccctgggccactccagggctctggccaggatatggtttcgattctacagctggttcagaacctgatgcacggagatgaggatgaggaaccgcagagccccaggattcagaatattggagagcagggacatatggcgctgctgggacactccctgggtgcctacattagcaccctagataaagagaaactccggaaattgaccacaagaattttatcagacacaactctgtggctgtgtaggatcttcaggtacgaaaacggttgtgcctactttcatgaagaagaacgcgaaggtttggctaagatttgtcgtctggccatccactcacgatacgaagacttcgtggtcgacgggtttaacgtcctgtataataaaaagcccgttatctacctctcagccgctgccagacctgggctggggcagtacctgtgtaaccaactcgggctgcctttcccatgcctctgtcgtgtgccgtgcaatacagtgtttgggagccagcaccagatggacgtagccttcctggagaagctaataaaagatgacatagagcgcggtagactgccacttcttctggtcgcaaacgctgggactgccgctgttggacataccgacaaaatcggacggctgaaagagttgtgtgaacagtatggcatttggttgcacgtagaaggtgtaaacctggcaaccctcgccctaggctatgtgtcatctagcgtactggccgctgctaagtgcgactctatgacaatgacacctgggccatggctagggctgcccgcagtccctgcagtcacactgtacaaacacgatgaccctgccctcactctggtggctggcctcacatctaacaagccaaccgacaaactcagggcactcccactatggctgagtctgcagtatctcgggctggatggattcgtcgaaagaattaagcatgcctgtcagctctcccagcggctacaagagtctctgaagaaggtcaattatatcaagattctggtcgaagatgagttgagtagtccggtggtcgttttcaggttttttcaggaacttccaggctcagatcccgtattcaaggccgtgcccgtgcctaacatgacaccctcgggggtgggtcgggaaagacactcatgtgacgcacttaatcgctggctgggggagcagctaaagcagctggtaccggcatccggccttaccgttatggatctcgaggccgaaggtacatgtctgaggttttccccactcatgacggccgctgttttaggcacccgcggagaggatgtggaccaattagtggcttgcattgaatccaaattgccggtgctgtgctgcacactccagctgagagaggaatttaagcaggaggtcgaggctaccgctgggctcctgtatgttgatgaccccaactggtcaggcattggcgtggtgcgatacgagcacgccaatgacgacaagtccagtctcaaatctgaccctgagggagagaacatacacgcgggactgctcaagaaactgaacgagctggaatccgacctgacatttaaaataggcccagaatataaatcaatgaagagctgtttatacgtcggcatggccagtgacaatgttgacgccgcagagctcgtagagactatcgctgctactgcacgggaaattgaagaaaatagccgcctcctggagaacatgactgaagtggtcaggaaaggcattcaagaggcacaggtggagctccagaaagcgagcgaggagcgattactcgaagagggggtgcttcggcaaatcccggtcgtggggtctgtcctgaattggttctctccggtccaagccctgcaaaaagggcgtacattcaacctaactgctggatccctcgaatctaccgaacctatctatgtttataaggcccaaggggcaggcgtgacccttccacccaccccaagtggctcaagaactaagcagcggctgccgggacagaagccattcaagaggtctctgagaggctctgatgccctgagcgaaacttcatcagtgtcccacattgaggacctggagaaagtggaaaggttatcttcaggcccagagcagattacactcgaggcttctagcacagagggacatcccggtgctccatcaccgcaacacactgaccaaacagaagcgtttcaaaagggagttccacacccagaagatgaccatagtcaggtagaggggccagaaagcctaagatag

SEQ ID NO: 237504 - DNA, 2094 bp, Artificial Sequence
  Description of Artificial Sequence: Synthetic coding sequence
atggggaagaacttgaaggaggctgtgaagatgctagaggactctcagagacggacggaggaggagaacgggaagaagttaatcagtggcgatattcccggaccgctacagggcagatacgaaaatggatgtgcttactttcacgaagaagaacgggaaggactcgccaaaatatgcaggttagcgatccacagcagatatgaggacttcgtggttgacgggttcaacgtgctttataacaaaaaacctgttatttatttatcagctgccgcacggccaggactcggccagtatttgtgtaatcagctgggactgcctttcccttgcctctgtcgtgtaccatgcaatacggtgttcggctcccaacaccagatggacgtagcctttttggagaagttaataaaggacgacattgagcgtgggcgtttgcccctcctgctggtagcaaatgcaggtaccgccgctgtcgggcacaccgataaaataggtcgcctaaaagagctgtgcgagcaatatggaatctggttacatgtggaaggcgttaatctggcgacactcgcattggggtatgtaagcagcagtgtgctggccgctgctaagtgtgattctatgacaatgacccctggtccctggcttggccttccggcagtaccagcggtcactctgtacaaacatgacgaccccgctctgaccttagttgctggactcaccagcaataaacctacagacaagttgcgggcactgcccctgtggctgtccctccagtacctcgggcttgacgggttcgtggagaggattaaacacgcctgtcagttgagccagcgcctgcaggaatctttgaagaaagtgaactatattaagatccttgtggaagatgaactcagttccccggtggtggtctttcgcttcttccaggagctgcctgggagtgatccagtgtttaaggctgtgccagtcccaaatatgacaccttccggtgtcggaagggagcgccattcctgtgacgccctgaataggtggctcggcgagcagcttaaacagctagtgcccgctagtgggttgactgtcatggatctggaggctgagggaacctgtttgcgattttcacccttaatgactgcagcagtgttggggacacggggtgaagacgtggatcagttggttgcttgcatcgagtccaaactccctgtactttgttgcaccctgcagctgagggaggagtttaagcaggaagtggaggctactgcgggattactgtacgttgatgatccaaactggtcaggaataggggtggtgaggtacgagcatgccaatgacgacaaatcatcactcaagagcgacccggaaggtgagaacattcacgcgggactccttaagaaactgaatgaattggagagtgacctcacttttaagattggacccgagtacaagagtatgaagtcatgcctgtatgtaggcatggcaagcgacaatgttgacgctgcagaactggttgagaccatcgccgctacagccagggaaattgaggagaatagtaggctgctggagaatatgacagaggtggttagaaaaggaattcaggaagctcaggtcgaactccagaaagctagcgaagagaggctgctcgaggagggagtgctgcgacagatcccggtggtggggagtgttctcaattggttcagtccagtccaggcactgcagaaaggacggaccttcaacctgactgccggaagcttggaaagtacggagcctatctacgtgtataaggcacagggagcaggggttaccctgccgccaactccctcaggctcacgcactaagcaacggttgcccggacagaagccttttaagcgcagtctccggggttctgacgccctctctgagaccagcagtgtctcgcatatcgaggatttggaaaaagtggagcgcttgtccagtggacctgaacagatcacccttgaagcaagctcaactgagggacatcctggagctccgagccctcagcacacagaccagacggaggcttttcagaagggtgtaccgcacccagaggacgaccactcccaagtcgaaggaccagaaagcttacgctag

SEQ ID NO: 237505 - DNA, 2283 bp, Artificial Sequence
  Description of Artificial Sequence: Synthetic coding sequence
atggatgctagcttagagaagatagccgaccctactctggctgaaatggggaagaaccttaaagaagccgtgaaaatgctcgaggattctcagcgaacagaggaggagaacggcaagaagctgataagtggggatattcccggacccctgcaggggaggattcaaaatataggcgaacagggccacatggcgttgctgggacactcattaggcgcatacatctctacattggataaggagaaactccgcaaattgaccacacgaatccttagcgacacaacattgtggctctgtcgtatctttcgatacgagaatggctgcgcttacttccatgaggaggagcgcgaggggcttgccaaaatctgccgcctagccattcacagccgatatgaggacttcgttgtagacgggttcaacgtgctctacaacaagaaacccgtaatatatttgagcgctgcggctcgtccgggtctgggacagtatctctgcaatcagctcgggcttccatttccctgtctctgcagggtcccttgcaacaccgttttcggctctcagcatcagatggatgtagcctttttagagaagttaatcaaggacgatatcgagagaggtcggttgccactgctactggttgcaaatgctggcactgctgctgtcggccacacagataagattggaaggctcaaggagttgtgcgaacagtatggaatctggctgcacgtagaaggcgtcaacctggctaccctggcgttgggctacgtgagctcctcagtgctagcggcagccaaatgtgattccatgactatgacacctgggccttggttgggcttgcctgcagtcccggcagttaccctttataagcatgacgaccccgcactcacgctggtggccggtctgaccagtaacaagccaactgacaagctgcgggctctcccattgtggctgagtctgcagtatttggggctcgacggattcgtagagcggatcaaacatgcttgccagctcagccagagattgcaggaatctcttaagaaggttaattacattaagatactcgtggaggacgagctctcttcaccagtggtcgtctttcgatttttccaggaactgccaggtagtgatcctgtctttaaggccgttcccgtacccaatatgacacctagtggagttggaagggagcgacatagttgcgacgccctgaacaggtggctgggggaacaactgaagcagctcgtgcctgcatccgggctgactgtgatggatctcgaagcagagggaacctgtctgagattttctcccctcatgaccgccgcagtgctggggacaagaggagaggatgtggaccagcttgtggcatgcatcgagtcaaagttacccgtgctctgctgtaccctccaattgcgggaagagttcaaacaggaggtagaggctaccgcaggccttctctatgtggatgaccccaactggtctggaatcggagtggttaggtatgaacacgccaatgatgacaagtcgtcattgaagtccgaccctgaaggtgagaatatacatgcaggactgctgaagaaactcaatgagctcgagagcgatctcacattcaagatagggccagagtacaaatcaatgaaaagctgcctctatgtggggatggcctcagataatgtagacgcagctgaactggtcgaaaccattgctgccactgctcgggagatcgaagagaatagccgcctgctggagaatatgaccgaggtagttcggaaaggtatccaagaggctcaggtggaattgcagaaggcctcggaagaaaggctcctggaagagggagtgctccgtcaaatccctgttgtaggctccgtgttaaactggttcagtcccgtccaagccctccaaaagggccgaacgtttaatctgactgctggatctctcgaaagcactgagcctatctacgtgtataaggcgcagggagcaggggtgaccctcccacctactcccagtgggagcaggacgaagcaaagactgcctgggcagaaacccttcaagcgctctctaaggggatctgatgctctatccgaaacatccagtgtgagccacattgaggacctggagaaggtggaaaggcttagctctggacctgagcagatcacacttgaagcttcaagtacagagggtcatccgggagcgccatctccacagcacactgatcaaactgaagccttccaaaagggcgtccctcaccccgaggatgaccattcccaggtggagggccctgagtcccttagatag

SEQ ID NO: 237506 - DNA, 1290 bp, Artificial Sequence
  Description of Artificial Sequence: Synthetic coding sequence
ctctccagcaccctgagacggattgctgacccaacactggcagaaatggggaagaacttgaaagaggccgtcaagatgctggaagacagtcaacggaggacagaggaggagaatggaaagaaactgatctccggcgatatacccggtcctctgcaggggtctggacaagatatggtttctattctacagctggttcagaatctgatgcacggtgatgaggacgaagagccgcagtcaccgaggattcagaatataggggagcagggtcacatggctctcctgggacactcactcggggcttacatcagcacactggacaaagaaaaacttcggaaattgaccaccagaatactttcggataccaccttgtggctctgtcgcatttttcgctacgaaaatgggtgtgcctattttcatgaagaggagcgcgagggcctggccaaaatctgccggctggcaatccacagccgatacgaggactttgtagtagatggctttaacgtgttatacaataagaaacccgtgatttatctaagtgctgcagcaagacctgggctcggacaatacttgtgcaaccaggatgtggctttcctggagaaactgatcaaggatgatattgagcggggaagactcccactgctcttggtcgctaacgccggaacagccgctgtgggacatacagacaagataggcagattgaaagagttgtgcgagcagtacggtatttggctgcacgtcgagggcgtgaatctagctacactcgctttgggatacgtcagcagttccgtgctggcagctgcgaagtgtgactcaatgaccatgactccaggcccttggctcggcttgcccgcagtcccggcagtcacactttataaacatgacgaccccgctctcacactggtcgccggactcaccagcaataaacccactgacaaactgcgcgcactgcccctctggctgagtctgcagtacttaggcctcgatggttttgtggagaggattaaacatgcttgtcagctaagtcaaagactgcaggaaagcttaaaaaaagttaattacataaagattctggtggaggacgagctgagtagtcccgttgtcgtgttcaggttcttccaggaacttccaggatcagatcctgtgttcaaggcagtgcccgtgcccaacatgaccccaagcggtgtggggagggaacggcattcgtgtgacgcactcaaccgctgggtgcgcatggcagttacaccgttgagcttccaggtcccagttcatcaccatcccacctgttggtag

SEQ ID NO: 237507 - DNA, 1497 bp, Artificial Sequence
  Description of Artificial Sequence: Synthetic coding sequence
atggacgccagtctcgagaaaattgccgatccgaccttggctgaaatggggaaaaacctgaaggaggcagttaagatgttagaagactctcaacggaggacagaagaagaaaatggaaaaaaactgatttccggagacatacccggacctctgcaggggagcgggcaggacatggtttccattctccagttggttcagaacttaatgcacggtgatgaggatgaagaaccccagtctcccaggatccagaacatcggagaacaggggcacatggccctgctgggtcattccctgggagcatacatcagtacgctggacaaagaaaagttgagaaagcttacaacaaggattctttctgacacaactctgtggctatgcaggatctttcgctacgaaaacggatgtgcttacttccatgaggaagaacgggaaggcctggctaaaatctgcagactggccatccactcccgctacgaggatttcgtggttgatggcttcaatgtcttgtacaacaagaagccggtaatctatctgtccgcagccgctcgccctggacttggccaatatctttgtaatcagttgggcctgccattcccctgcttgtgtcgggtcccttgtaacaccgttttcggtagccagcaccagatggacgtcgcctttctggaaaaactgattaaagacgatattgaacgcggtcggctgccactgttactggttgccaatgcaggcacagctgccgtgggccacacggataagattgggagattgaaggaactgtgcgagcagtatgggatctggctgcatgtcgaaggtgtcaatctggctacccttgcgctgggatacgtgtcttcctccgttcttgccgctgccaagtgcgattcgatgaccatgacacctggcccatggctcgggctgccggcagttcctgcagtgactttgtacaagcatgacgatccagccctcactctggtggctggtctgacctccaataaaccaaccgacaagcttcgtgctttaccactgtggctgtctctgcagtatctgggattagacgggttcgtggaacggataaagcatgcatgccagctgagccagcggctgcaggaaagtctgaaaaaagttaattacatcaagatcctggtcgaagacgagctgtcctccccggtcgtggtgtttagattttttcaggagctgcccggaagcgacccagtgtttaaggctgttccagtccccaacatgacgccttccggagtgggtagggagcgtcacagttgtgacgccctgaaccgatggttgggcgaacaactgaagcagctggtgccggcatcgggacttacagtgatggacctggaggcagagggcacgtgcttacggttttcaccgttgatgaccgctgctggttggtctcattgtggaacaaccactaggtatgattgtgttaggtcacgcctgactacacgactgccagggagtactggcgagcaggctccaccatag

SEQ ID NO: 237508 - DNA, 615 bp, Artificial Sequence
  Description of Artificial Sequence: Synthetic coding sequence
atgacaatgacccccggaccttggctgggcctgcccgctgtgcctgcagttacattgtataaacacgatgaccccgctctcacactcgtggcagggcttaccagtaataagcccacagataagcttagggcgctccccctgtggctctcgcttcagtacctcggcctcgacgggttcgtcgaacggattaaacacgcatgccagttgagccagaggctgcaggagtccctgaagaaagttaattatattaagattctggtcgaggacgagctgagttcgccagtggtggtgttcaggtttttccaagagttgcccggaagtgatcccgtgttcaaggctgtccctgtgcccaacatgactcctagtggcgtaggcagagaacggcactcgtgtgatgccctcaatcggtggctgggagagcagttgaaacaactggtgcctgcttctggattaactgtgatggacctggaggcggagggaacctgtttgcggtttagtcctctgatgactgcggcaggctggtcccactgtggcacaacaacccgatacgactgcgttagatccaggctcacaactcggttacctggaagcaccggcgagcaagctccaccttag

SEQ ID NO: 237509 - DNA, 642 bp, Artificial Sequence
  Description of Artificial Sequence: Synthetic coding sequence
atggatcctctctttcaacaaacacacaagcaggttcacgagatccagagctgcatgggtcgactggaaactgcggacaaacagtcagtacatatcgtggaaaacgagatccaagcatctatcgaccaaatattctcacggttggagagattggagatcctgagctccaaggagccgccaaataaacggcagaacgctagattacgagtcgatcagctgaaatatgacgtccagcaccttcaaaccgcgctgaggaatttccagcaccggcgacacgccagagagcagcaagagagacagcgcgaggaactgctgtcccggacatttacaaccaatgattctgacactacgattcccatggatgaaagtttgcaattcaacagcagtctccagaaagtgcataatggcatggacgatctgatcttagacgggcacaatattctcgatggccttagaactcagcgcctcacactgaaggggactcaaaagaagatcttagacattgctaatatgctcggcctgtcaaacactgtcatgcgactgatcgaaaaacgagccttccaagacaaatacttcatgatcggaacccaggggtcctgtcagacggcccattttggtggcaggagtgctggctcatcctag

SEQ ID NO: 237510 - DNA, 657 bp, Artificial Sequence
  Description of Artificial Sequence: Synthetic coding sequence
atgacctgttggttgcgaggtgtcactgctacattcggacggccagcagagtggcccggttatctatcacacctttgcggcagatccgctgccatggatttgggcccaatgagaaagtcttaccgcggagaccgtgaagctttcgaagaaactcatctgacatcgctcgacccggtgaaacaatttgcggcatggttcgaagaggctgtacagtgccctgacattggcgaggctaatgcaatgtgtctcgctacctgcactcgagatggaaaaccgtctgcccgtatgctgctcctgaagggctttgggaaggacggatttcggttcttcacaaattttgaatcaaggaaaggtaaagagctagattctaatccgttcgcgagtctggtcttctactgggagcccctgaatcggcaatacctgaggaaaaagaacgaggaattggaacagctgtaccaggatcaagaggtgcctaaacccaagagctgggggggatacgtgctctatccccaggtgatggagttctggcaaggccagaccaacaggcttcacgataggatcgtattccgcaggggtctccccaccggcgattctcctctggggcctatgactcatcgcggagaggaagactggctgtacgagcgactcgcgccttag

SEQ ID NO: 237511 - DNA, 501 bp, Artificial Sequence
  Description of Artificial Sequence: Synthetic coding sequence
atgctgctgctgaagggattcggtaaggacgggtttagattcttcactaatttcgagtcccggaaaggaaaggagctggacagcaatccctttgcctcgctagtgttctactgggagccattgaataggcaggtaagagtggagggacctgttaagaaactccctgaggaggaggcagagtgttacttccactccaggcccaaatccagtcaaatcggggcagtggtctcacaccagtcttctgtgatacctgatagggaatacttaaggaagaaaaatgaagaactcgagcagctctaccaggaccaggaagtaccgaagcctaagtcttggggaggttacgtcttgtatccacaagttatggaattctggcaggggcaaaccaatagattgcatgaccgtattgttttcaggagagggctacccactggggactctccactggggcctatgacgcaccgcggagaggaggattggttatacgagcgactggcaccatag

SEQ ID NO: 237512 - DNA, 732 bp, Artificial Sequence
  Description of Artificial Sequence: Synthetic coding sequence
atgacttgctggctgagaggcgtgaccgcaacattcgggagacctgccgaatggcccggttatctatcacatttgtgtggtagaagcgccgcaatggatttggggcctatgagaaaatcatacaggggagacagggaggcttttgaggaaacccatttaacctcccttgatccggttaaacaatttgctgcttggttcgaagaggcagtccagtgtccagacatcggcgaggccaatgctatgtgtctagcaacgtgcactcgcgacggcaagccctctgctaggatgttgctcctgaagggctttggaaaagatggattccggtttttcacaaacttcgagtcaagaaagggaaaggaactagttcgcgtggagggaccggtgaaaaaattacccgaagaggaggcagaatgttactttcacagcaggcctaaaagctcgcaaatcggtgctgtagttagccaccaatccagtgttattcccgatcgcgaatatcttcgaaaaaaaaacgaggagctcgagcaactctaccaggatcaggaggtaccgaagcccaaatcttggggagggtatgtgctgtatccgcaggtaatggaattttggcagggccagacaaatcggcttcacgacagaatagtatttaggagggggctcccaaccggagactcccctctgggcccaatgacccacaggggagaagaggactggctctacgaacgcctggcaccttag

SEQ ID NO: 237513 - DNA, 1098 bp, Artificial Sequence
  Description of Artificial Sequence: Synthetic coding sequence
atggccagtactgaaagcagcctgttgaggtcccttggcctcagccccggacccggttcatctgaagtggaactggattgctggtttgacgaagatttcaagttcatcctgcttcctgtgagttacgcagtagttttcgtgttgggactgggcttgaacgccccaactctctggctgtttatttttagactgcgaccgtgggacgcaacagccacctatatgttccaccttgctctgtcggacaccctgtatgtcctgagcttgccaaccctgatctactattacgctgcccataatcactggccattcgggacggagatctgcaagttcgtgcggttcctgttctactggaacctctattgttcagtgctcttcctcacatgtatcagtgtccacaggtatcttggcatctgccaccccctacgggcactgagatggggcagacctcgtctggccggactcctctgcttagctgtttggctggtggtggctgggtgccttgtgcctaacctgttcttcgtgaccacatcgaataagggaacgactgtgctgtgtcatgataccaccagaccagaggagtttgatcactatgtgcatttttcgtctgccgtgatggggctgctcttcggagtgccctgcttagtgacactggtctgttacggtctgatggcgcgtcggttataccagcctctgcctggatccgctcaaagtagcagccgccttaggtccctccgaactattgctgtcgtgctcacagtttttgccgtctgcttcgtcccattccacataaccagaactatatactatctggccagactgcttgaagctgattgcagagtcctgaacattgtaaatgtggtgtataaggttactcggcctctcgcttctgccaacagctgcctggatcctgtcttatatcttttgaccggtgataagtaccgccgacaattgagacaactgtgtggcggtggtaagccgcagccaaggacggcagccagctccttggccctcgtcagtctgcctgaagacagcagctgtcgctgggctgcaacgccccaggacagctcgtgcagcacgccgcgagcagatcgcctgtag

SEQ ID NO: 237514 - DNA, 987 bp, Artificial Sequence
  Description of Artificial Sequence: Synthetic coding sequence
atggaatgggataacgggaccggccaagcgttgggtttgcctccaaccacttgtgtgtaccgcgagaacttcaagcagctcttactacctccagtgtattctgcggtactggccgctgggcttcctctgaacatttgcgtcatcacccaaatctgtacatcccgtagagctctcacccgaacagcggtatatacactgaatctcgccctggcagaccttctttatgcttgctcgttgccactgctgatctacaactatgctcagggagatcattggccatttggcgacttcgcctgccgactggtgaggtttttgttctacgcaaatttgcatggcagtattctcttcttgacgtgcatttcatttcagaggtacctgggcatctgtcaccccctcgcaccatggcacaaaagagggggacggcgtgcagcttggctggtgtgtgtggccgtgtggctggccgtcactacacagtgcttaccaacagcaatcttcgcggcaaccgggatccagcgaaatcgaaccgtttgttatgacctgtccccacctgccttggctacccactacatgccatacggcatggccctgactgtcataggcttcctactgcccttcgctgcgctgttagcctgctattgcctgctcgcttgccgcctttgtcgtcaggatggccctgcagagcctgtcgcccaagagcgaagaggcaaggccgctagaatggccgttgtcgtggcggctgccttcgccatctcctttttgccattccacatcacaaaaaccgcctacctcgctgtacggagcacacccggagtcccatgcaccgtcctcgaggcttttgctgcagcctacaaaggaacacggccttttgcctctgccaattcagtgctggatccaatccttttctactttacacagaaaaaattcagaaggcgcccacatgagttgcttcagaaactgactgcgaaatggcagcggcagggacggtag

SEQ ID NO: 237515 - DNA, 987 bp, Artificial Sequence
  Description of Artificial Sequence: Synthetic coding sequence
atggagtgggacaatggcactggtcaagctctcggactcccgccaaccacgtgtgtttacagagagaattttaaacagctgctgctgcctcctgtctatagcgcggtgctcgcagccggtctgccactcaacatttgcgttatcacccagatctgcacctctcgccgagccctgacaagaactgccgtgtacaccctgaaccttgcacttgcagacctcctgtatgcctgctcattgccactccttatctataattatgcccagggtgatcactggcccttcggcgattttgcttgccggctggtcaggttccttttctatgcaaacttgcatggttcaatccttttcctgacttgcatctccttccagcgttatttgggcatctgtcatcccctggccccatggcacaagcggggagggaggagagcggcatggctcgtttgcgtagcagtctggctggctgtcaccactcaatgcctgcccactgccatatttgccgcaaccgggattcagagaaatagaactgtgtgctacgatctgtcccctccagcccttgcgacgcattatatgccttacggaatggccttgactgtgatcgggttcctcttaccttttgccgcactgcttgcttgttactgtctactggcctgccgcctctgcaggcaggacgggccagcggagcccgtagcacaagagaggcgtggcaaagccgcaaggatggcagtcgtcgtagccgctgcattcgcgatttcttttctgcctttccacatcacgaagacagcttacctggccgtgcgctctaccccgggagtcccttgtaccgtactggaagccttcgccgctgcttataagggcacaaggccctttgccagcgcgaactctgtgctcgaccctatcctcttctactttactcagaagaagttccggcgacgaccgcacgagcttctccagaagcttactgcgaaatggcagcgacaagggcgatag

SEQ ID NO: 237516 - DNA, 987 bp, Artificial Sequence
  Description of Artificial Sequence: Synthetic coding sequence
atggagtgggacaatggaacagggcaggccttgggattgccccctaccacctgtgtgtatagagagaattttaaacaactcctcctcccaccagtgtacagcgccgtgctggccgcaggcctgcctcttaatatatgcgttatcactcagatatgtacttctaggcgcgctctgactcgcaccgcagtttatacccttaacctggccctcgcagatctcctttacgcgtgtagcctcccgcttctgatctacaactatgcacagggagaccattggccatttggcgattttgcctgcagactggtgcgatttctcttttatgctaatcttcacggcagtattttgtttttaacttgtatctcattccagcggtaccttgggatctgccaccctcttgcaccttggcataagagaggaggccgaagggctgcctggctagtctgtgtggcggtatggttagctgtgactactcagtgtttgcccacggcgatattcgcggctaccggcatccagaggaatcgcactgtatgctatgacctgtcacccccagctcttgccacacattacatgccgtacggcatggccctcactgttatcgggtttttgttgcccttcgccgctctccttgcttgctactgccttttagcttgtagattgtgtcgccaggatgggccagcagagcccgtggcccaagagagacgtggaaaggccgctcggatggcagtggtagtggccgcagcattcgcaatctctttcctgcccttccatattacgaagaccgcttacctcgccgttcggtccacccctggcgtcccctgcacagttctagaggcctttgcggcagcctataaaggtacccgcccattcgcatcagccaactctgtgctggatcctatattgttttattttacccaaaagaaattccggagacgtcctcacgaactgcttcagaagctcactgctaaatggcaacgacaaggaaggtag

SEQ ID NO: 237517 - DNA, 987 bp, Artificial Sequence
  Description of Artificial Sequence: Synthetic coding sequence
atggagtgggacaatggcacaggccaggcgctggggctgccccctacaacatgcgtataccgagaaaacttcaagcaactactcctgccgcctgtgtattccgctgtgctggcggctggcctacccctaaacatctgtgtaattacacagatctgtactagccggagagccctcacaagaaccgccgtgtacactctgaatctggccctcgccgacctgctttatgcttgttccctgcccctgctgatttacaattatgctcagggcgaccactggccatttggggacttcgcatgtcgcctagtgagattcctcttctatgccaacttacatggatccatcctgttcctaacctgcatctcattccagcgctatctgggcatctgccatccacttgcaccttggcacaagaggggcggaaggcgcgctgcctggcttgtgtgcgtcgctgtctggctcgcagtcacaacccaatgcctgcccaccgctatctttgccgctactggcattcaacggaatagaaccgtgtgctacgatttatccccgccagcccttgccactcactacatgccctacgggatggcgctgacagtgattggatttctgctgccgtttgcagcacttttggcctgctactgcctcctggcctgccggttatgcagacaggacggtcccgctgaaccggtagctcaggagaggagaggtaaagccgctcgcatggcagtggtggtggccgctgcattcgccatctcctttctaccatttcacatcactaagacagcctatctggcagtccggtctacccccggagtgccttgtacagtccttgaggccttcgccgctgcctataagggtacccgaccctttgcaagtgccaacagtgtcctggacccaatcctgttctattttacacaaaaaaagttcaggcggaggccacacgagttacttcagaagttaacagcaaagtggcaaaggcaggggagatag

SEQ ID NO: 237518 - DNA, 738 bp, Artificial Sequence
  Description of Artificial Sequence: Synthetic coding sequence
atggagtgggataacggaaccgggcaggctctcggattacctcccacaacctgcgtgtaccgggaaaactttaaacagcttctattaccgcctgtgtacagcgccgtactggcggctggtttgcccctgaacatttgcgtgattacacagatatgcacctctaggcgagcactcaccaggacagcagtgtatacccttaatctcgcattagctgatctgctctacgcgtgttcgctgcctctgctaatctacaactatgctcagggagatcactggcccttcggcgacttcgcctgtagattagttcggttcctattctacgccaatttgcatggctccatcctcttcctgacgtgcataagcttccagcgctatctgggcatctgccacccactggcgccatggcataagcgcggaggaaggagagcagcatggctggtgtgcgtggccgtctggttagcagtcacgacgcagtgcctgcctacagctattttcgctgccaccggtatccagagaaacagaaccgtgtgctatgatctcagcccacctgccttggccacccactatatgccttacgggatggcactgactgttatagggttcctgttaccatttgccgctctcctggcatgctactgtctcctggcctgtaggctgtgccggcaggatggtccagccgaacccgtcgcacaggagaggcgcggaaaagctgcacggatggccgtggtggtcgcatag

SEQ ID NO: 237519 - DNA, 987 bp, Artificial Sequence
  Description of Artificial Sequence: Synthetic coding sequence
atggaatgggacaatgggaccgggcaggcactcggtctcccacccacaacctgcgtataccgggagaacttcaagcagctactcctccccccagtgtactcagctgtgttagcggcaggacttcctttgaatatctgcgttatcacacagatatgtacgagccggcgagccctgactagaacagccgtctataccctgaacctggctctggctgacttgctttacgcctgcagcctccccctgctgatctacaattacgcccaaggtgatcattggcccttcggcgactttgcatgcagactcgtacggttcctcttttatgctaacctccacggctccattcttttcttaacttgtatctcctttcagagatatctgggcatatgtcatccattggctccatggcacaagcgaggaggcagacgcgcagcatggctggtgtgcgtcgcagtgtggctagccgtgacaacgcagtgtctgcccacagcaatcttcgcggctacaggcattcagcgaaatcggaccgtgtgctatgatctgtcccccccagctctggctacccactacatgccatacggcatggctcttacagtgattggctttcttttgccctttgccgctctgttggcgtgctattgcttactcgcatgccgcttgtgccggcaggacggccctgccgagcctgtggcccaggagaggcgcggtaaggcggctcgcatggcggtggtcgttgctgccgctttcgccatctcattcctgccctttcacattacaaaaacagcatacctcgccgtcagatctactcccggagtgccatgtaccgtgctcgaagcatttgcggctgcgtacaaaggcacaaggcctttcgctagcgctaactccgtcctcgatcccatcctattttattttacccagaagaagttccggcgacgacctcatgagcttctgcagaagctgaccgcaaagtggcagaggcagggcaggtag

SEQ ID NO: 237520 - DNA, 987 bp, Artificial Sequence
  Description of Artificial Sequence: Synthetic coding sequence
atggaatgggacaatgggacaggccaggcacttggccttcctccaaccacttgtgtgtatcgagagaacttcaaacagctgttgcttccacccgtgtatagcgcagtgctggctgcgggtctcccgttgaatatatgtgtgatcactcagatctgcacatccagaagggccctgactcggacagcagtgtatactctcaacctagctctggcggatttactgtatgcatgcagcctgcctttactgatctataattacgctcagggcgatcactggccattcggtgactttgcatgcaggttggtgagattcctgttttacgcaaacctgcatggctctatcttattcctcacatgcatcagtttccagcggtaccttgggatttgccaccccctcgccccatggcataagcgcggaggcaggagggccgcttggctcgtgtgcgtagctgtgtggctcgccgtcactactcagtgcctccctacagcaatcttcgcagctactggcatccagagaaacagaactgtctgttacgatttgtcaccacccgcactggcgacacattatatgccctacggcatggctctaactgtcattgggttcctgctcccctttgctgctttgctggcctgttattgcctgttagcgtgtcgcctctgccgccaggacgggcctgccgaacccgtcgcccaagagagacggggaaaggctgcacgcatggcagtcgtggttgccgcagctttcgctatttctttccttccatttcatatcaccaaaactgcctatcttgcggtccgctccacaccaggagttccttgcactgtactagaggctttcgctgccgcttacaaaggaaccaggccattcgccagtgcaaattccgttctcgaccccatactgttttactttacccagaagaaatttagacggaggccccacgaacttctacagaaactaactgccaagtggcagaggcagggtaggtag

SEQ ID NO: 237521 - DNA, 987 bp, Artificial Sequence
  Description of Artificial Sequence: Synthetic coding sequence
atggagtgggataatggtactgggcaagcattgggactacccccaacaacctgtgtgtaccgagagaattttaagcagttgctcttaccacccgtctacagcgccgttctagcagcagggttgcctctgaacatctgtgtcatcacacaaatatgcacctccagacgcgcactgacacgcacagccgtgtatacgctcaacctggctctagcggatctcttatatgcatgttccctccctctgttaatctacaactatgctcagggagatcattggccgtttggagacttcgcatgcaggttagtgaggttcctgttctatgccaacctgcatgggagcatattgttcctgacttgcatcagcttccagcggtatttgggtatctgtcatccgctggccccttggcataagcgcggaggcaggcgggcagcctggcttgtctgcgtggcagtttggctggccgtcactactcaatgtcttccaacagccattttcgcggctaccggaatccagcggaatcggactgtatgttatgacctcagtccccctgcactcgccacacactatatgccgtatggcatggctcttactgtaattggcttcttgctcccatttgcagcgttattggcctgctattgcttgttggcctgtagactgtgccgacaagatggaccagccgaacccgtagctcaagagcggcgagggaaagcagccagaatggcggtggtggtggctgcggcattcgctatcagcttcctgccatttcatatcaccaaaacagcgtatctggccgtgcgatctacaccaggcgttccttgcacggtcttggaggccttcgctgcggcatacaagggcacccgcccttttgcatccgctaactcagttttagaccccattttattctacttcacgcaaaaaaagttcagacgcagaccacatgagctgttacagaaactgacggccaaatggcagcggcagggcaggtag

SEQ ID NO: 237522 - DNA, 987 bp, Artificial Sequence
  Description of Artificial Sequence: Synthetic coding sequence
atggagtgggacaacggaacagggcaagctctgggtctgcctcccactacttgtgtctacagggaaaacttcaagcagctcctcctgcctccagtttatagtgctgtgctcgctgccggtttacctttaaacatttgtgtgatcactcagatttgtacgagccggagagccctgacaaggactgctgtgtatactctaaatttggctcttgccgacctcctctacgcttgcagtctgcctctcctgatttataactatgcccagggtgaccactggccattcggggatttcgcctgccgacttgtccgctttctattttacgctaatctccacggatctatcctgttcttaacgtgcatctccttccagcgctacctagggatctgtcatcctttggccccttggcacaaacgcggaggcagacgcgctgcatggcttgtctgcgttgctgtttggttggcggtcacaacacagtgtctcccgacagccatattcgccgctactggaattcagcgaaacaggactgtctgctacgatctttctccacccgcactggctacacactatatgccctacggaatggcattaacagtgattgggttcctgctgccattcgccgctttactcgcatgctactgcctcctggcctgcaggctctgtcgacaggacggtccagccgagccggtcgcccaggagcggagaggcaaggctgcaaggatggctgtcgtcgtggctgcagcatttgccatctcgttccttccattccatatcactaagacagcctatttagctgtgaggtccactccaggcgtgccttgcacagttctggaggcatttgctgcagcatacaaaggaacccgaccctttgcctcggccaattctgtgctcgaccctattctgttctactttacgcagaagaagttccgcagaagacctcatgaattactccagaagttgacagctaaatggcagcggcagggaagatag

SEQ ID NO: 237523 - DNA, 387 bp, Artificial Sequence
  Description of Artificial Sequence: Synthetic coding sequence
atggaatgggacaacgggacgggccaggctcttggtcttcccccaacaacatgcgtttacagggagaatttcaaacagctgctcctcccccctgtgtacagcgccgttttggcagctggcctgccacttaatatatgcgtgatcacccagatttgcaccagccgcagagccctgacaaggactgcagtgtacaccctgaacctggcattggccgacttgctctacgcttgcagcctcccattgctaatctataactatgcccagggcgaccattggccattcggtgacttcgcatgtaggctcgtgcggtttctgttctacgctaatctgcatggttctatattatttctgacctgtatttctttccagagatatctggggatatag

SEQ ID NO: 237524 - DNA, 738 bp, Artificial Sequence
  Description of Artificial Sequence: Synthetic coding sequence
atggccaacaactataagaagatcgtgctcctcaagggattggaggttatcaacgattatcacttcagaatagtgaaatcgttgctctccaacgacttaaaactgaaccccaagatgaaagaagaatatgacaagatccagattgcagatctgatggaagaaaagtttcctggggatgccggactaggcaagctgatcgaattctttaaggaaatcccaacattaggagatcttgccgaaactctgaagcgcgagaagttaaaagtcgcaaataagatcgagtccattcccgttaaagggatcattccttcaaagaagacaaaacagaaagaagtgtacccagccactcccgcttgcacaccatctaatcggcttacagccaaaggcgcagaggagacacttggtccccagaaacgcaagaagccgtccgaagaagagacaggaacaaagcggagcaagatgagtaaagagcagacacggccttcttgttcggctggtgcatcaacctccaccgctatggggagaagcccgcctccccagaccagctctagtgctccccctaacacatcatcaactgaggcctatctgatgaatttgactctaagcctaaccgccggaagctttcttagttgcgcagtgtggggaagagatcgtgagctgagaaaccttgagctcagcgctacagatagcctgtcgacggcacccatctactatacacctattcctttcgcacattag

SEQ ID NO: 237525 - DNA, 1452 bp, Artificial Sequence
  Description of Artificial Sequence: Synthetic coding sequence
atggctaataactacaagaagatagtcctgctgaaggggctcgaggttatcaacgattaccacttccgcatcgttaaatccttgctgagcaacgatctgaagctgaaccctaagatgaaagaggaatatgataagatccagatcgcggacctgatggaggagaaatttccaggagatgccggtctggggaagctcatagagttcttcaaagagatcccaaccttgggcgacctggccgaaacactgaagcgcgagaagctgaaggtcaaaggtattataccgagtaagaagactaaacagaaagaggtatatcccgcaacccctgcctgtacccctagtaatcggctcaccgccaaaggagccgaggaaactttggggccacaaaaaaggaagaaaccctccgaggaagaaactggcacaaagcggagcaaaatgagtaaagaacaaaccagaccaagctgttccgcaggagcttcaacttctaccgcaatgggcagatcccctccgcctcagaccagttccagcgcaccccctaacacgtcttccaccgagtcccttaaaccactggccaatcgccacgccaccgccagtaaaaacatttttcgtgaagaccctattattgcaatggttctcaatgcgaccaaagtcttcaagtacgagtccagtgagaacgagcagcgacgcatgttccatgccacagtcgccacacagactcagtttttccatgtgaaggtcctcaacatcaatctgaagcgaaaattcattaagaaacgcataattattatcagcaactactcgaagcggaatagtttgctcgaagttaacgaggccagttccgtctcggaagccggacccgaccagaccttcgaggtgcctaaagacattatccgaagagctaagaagatcccgaagataaatattttgcataagcagaccagcgggtatatcgtgtatggcttatttatgctgcatacgaagatcgtcaatcgcaagaccacaatatatgaaatacaggacaaaactgggtctatggccgtggtgggaaagggcgagtgccacaatatcccatgcgagaagggcgataagcttcgcctgttttgttttaggctgcggaagagagagaatatgtctaagcttatgtcggagatgcattcttttatccagatccagaaaaataccaaccaacgatctcatgatagtagatctatggcccttccacaggagcagtcccagcatccaaagccctccgaagccagcacgacactgcccgaaagtcaccttaagaccccacaaatgcccccaactactccctccagttctagctttaccaagaaagatgagacccatccaggcgcacagagctcccctgctaatttccgcattacatcacccactgtggcgccaccattgtcctctgacacctcaaccaatagacaccccgctgtgccatag

SEQ ID NO: 237526 - DNA, 1479 bp, Artificial Sequence
  Description of Artificial Sequence: Synthetic coding sequence
atggcaaataattataaaaaaattgtgctcctgaaggggctggaagtcatcaatgactatcattttagaattgttaaatcacttttgagcaatgatttaaagctgaaccctaaaatgaaagaggagtacgataaaatccagattgccgacttaatggaggaaaagtttccgggagatgcaggcttaggcaaacttattgagtttttcaaagagatacccacactcggagaccttgcggagacgttgaagcgcgaaaaactgaaagtggccaacaagattgagtctatacccgtcaaaggcatcataccgagtaaaaagaccaaacaaaaagaggtctaccccgcaacgccagcctgtactccctcaaatagattaacagccaagggagccgaagagacactcggtccccagaagcgaaagaagccttcagaagaagaaaccggaacgaaacggagtaagatgtctaaggagcaaacaagacccagctgcagcgctggggcttccacaagcacagccatgggtaggagtccccctccacagaccagcagcagtgccccaccaaacacatccagcaccgagagtctaaaacccctggccaacagacacgcaacagcgagcaagaatattttccgcgaggatccaattatcgctatggtgctcaacgcgactaaggtgtttaaatatgaaagttccgagaacgagcagcggagaatgtttcacgccaccgtggctacccagacccaattcttccatgtgaaggtcctgaacatcaacttaaagcggaaattcataaagaaacgaatcattatcatcagtaattacagcaagcgtaactccctactcgaagtcaacgaagcttcctctgtgtccgaggcagggccagaccagacctttgaagtacctaaggacataattcgaagagcgaagaaaattcccaagattaacattctgcacaagcagacaagcgggtacatcgtgtatggccttttcatgctgcataccaaaatcgtgaacagaaagacaaccatttatgagattcaagataagacaggctctatggctgttgttgggaaaggggaatgccacaatatcccatgcgaaaaaggagacaagctgcggctgttttgtttccgcttgcggaagcgggagaatatgagtaagctcatgtcagaaatgcactcattcattcagatccagaaaaacactaatcagcgctcccatgactcccggagtatggctttgccacaggaacagtctcagcatccaaagccatctgaggccagcactaccttgccagagtcacatcttaagactccacagatgcctcctaccacccccagctccagttctttcacaaagaaagacgagacgcacccaggagctcagagcagcccggctaatttccggattacttctcccactgttgcgcctcctctgtcaagtgatacctccacaaataggcatccagctgtgccctag

SEQ ID NO: 237527 - DNA, 1359 bp, Artificial Sequence
  Description of Artificial Sequence: Synthetic coding sequence
atggccaacaactataagaaaatagtgctcctgaaagggttggaggtaatcaacgattaccattttaggattgtgaaaagcctcttatcaaacgacctgaagttgaatccgaaaatgaaggaggagtacgataagatccagatcgccgatctgatggaggaaaagtttcctggggacgccggtcttggaaagttgatcgagttttttaaagagataccaactctcggcgacctggctgagaccctgaaaagagaaaagctgaaagttaagggcataattccatccaagaagacaaagcaaaaggaggtttatccagctactccggcatgtacaccttccaacagacttaccgccaagggtgctgaggagaccctgggcccacagaagagaaaaaagccttcagaagaagagacagggactaaacggtctaagatgagcaaagagcagaccaggccgtcgtgctccgctggagcctccacatctaccgccatgggacgaagcccccctcctcagacctcaagtagcgctcctccgaacacctcttcaaccgagtccctcaagccactggccaatcgtcatgccaccgcatcgaaaaacatcttcagggaagacccaataatcgcaatggttcttaacgcgacaaaggtgtttaaatacgagtcttctgagaatgaacagcgtcggatgttccacgcgacagtagcaactcagacccagttctttcacgtcaaggtcctgaacatcaacttgaagagaaaatttattaagaaaagaattatcattatttccaactactccaaacgaaactcactgttagaagtgaacgaagcctcctctgtgagtgaggctggacccgatcagacatttgaggtccccaaagatatcatccgcagagctaagaagatacctaaaataaacatcctccataagcagaccagtggttacatagtgtacgggctgttcatgctgcacacaaagatcgtgaatcgcaagaccactatttatgagatccaggacaagactggtagcatggctgtcgtgggcaaaggtgaatgccacaatattccttgcgagaagggagataagctgcgtctgttttgctttaggctccgaaaacgtgaaaatatgagtaagctgatgtcagaaatgcacagcttcatccagatacagaagaacactaatcaaaggtctcatgatagcaggtctatggctcttccccaagaacaatcccaacacccgaagccgagcgaggcgagcactaccctcccagaaagccatctgaaaaccccgcagatgcctcccacgacaccttcttcgagcagttttaccaaagtgacgaaggataaagacatcaagtag

SEQ ID NO: 237528 - DNA, 1386 bp, Artificial Sequence
  Description of Artificial Sequence: Synthetic coding sequence
atggccaacaattataaaaagattgtgctgctgaaaggactcgaggtaatcaatgactaccattttcggatagtgaagagtttactctctaacgatttgaagctgaacccgaagatgaaagaggagtacgacaaaatacaaatcgccgacttaatggaagagaaatttcctggagacgccggtctgggcaagcttatcgagttttttaaggagatccccacactcggagaccttgctgagaccctgaagagggaaaagttgaaggtggcaaataagatcgagtcgattcccgtcaagggtatcatcccgagtaagaagacgaaacagaaggaggtgtacccagccacaccagcctgcaccccttcaaaccgcctcaccgcaaagggcgctgaggaaacactgggaccccagaagcggaagaagccttcagaggaggagactggcacgaagaggagtaaaatgagcaaagaacagacgcgcccaagctgttctgccggagcctccacctccactgccatgggaaggtctccccctccacagacttccagttcagctcccccaaacacctcctccacagaatcactgaagccactcgctaacaggcacgctacagcatccaagaacatttttcgggaggaccccattatcgctatggtgcttaacgccaccaaggtgttcaaatacgaaagttccgagaacgagcaaagacgcatgtttcacgcgacggtagctactcaaacacagtttttccatgtgaaggtactgaatatcaatctcaaacgcaaatttattaagaagagaattatcatcatttcaaattactcaaaacggaactctttattagaggtgaatgaggcctcaagcgtctctgaggctggacctgaccaaaccttcgaagtgcctaaggatattatccggagagccaagaaaatccccaaaattaacatcctccataaacagacatccgggtatattgtgtatggtttattcatgctgcacaccaagatcgtcaaccgaaagacgactatatatgagatacaggacaagaccggaagcatggctgtagtggggaaaggggagtgtcacaacataccgtgcgaaaaaggagacaagctccgattattttgttttcggctgcgtaaacgtgagaacatgagtaaattgatgagcgagatgcacagcttcattcaaattcagaagaatactaatcaacggtcccacgatagccgcagtatggccctcccacaggagcagagccagcatcctaaacctagtgaggcttcgaccacgctccccgaatcacaccttaaaacacctcaaatgccaccaactactccctcttctagctcgtttacaaaggtaaccaaggataaggacattaaatag

SEQ ID NO: 237529 - DNA, 453 bp, Artificial Sequence
  Description of Artificial Sequence: Synthetic coding sequence
atggctaacaattataagaagattgtgttgctaaaggggctcgaagtgatcaatgactaccatttcagaatcgtaaaatctctcctgagtaatgatctcaagcttaaccccaagatgaaggaggagtatgacaagatccagatcgccgatctgatggaggagaaattcccgggagatgcgggactagggaaattaatcgagttcttcaaggagattcctacgctgggcgacctcgccgagactctgaaaagggagaaactcaaagtggcaaacaagatcgaatccatcccagttaagggaattattccttccaagaagaccaagcagaaagaggtttatccagccacaccagcttgcacaccctcaaaccgactgaccgccaaaggcgcagaagaaactttgggcccacagaagagaaaaaagcccagcgaggaggagaccgggactaaatag

SEQ ID NO: 237530 - DNA, 399 bp, Artificial Sequence
  Description of Artificial Sequence: Synthetic coding sequence
atggccacaacagtgaccctggaaaagtgtgggcataataagggttataagggattggacaactgtagattttgcccaggctcccaatgttgcgtcgaagacggtcctgagtctatagattcgattattgatatggacgctgtgtgcaaaagggtgaccactttgggtctcgatgtgtctgttactatttctcaagatgccggacgttacctgtgtgattttacttattacacatctctgtaccagagtcatggaaggtcggccttcgtgcacgtccctccattgggcaagccttataacgcagaccagctggggagagccctgagggccatcatagaagaaatgcttgatctcttggagcagtctgaggggaaaatcaattattgtcataagcattag

SEQ ID NO: 237531 - DNA, 630 bp, Artificial Sequence
  Description of Artificial Sequence: Synthetic coding sequence
atggagcagccacggaaggcagtcgtggtgactggctttgggccttttggcgagcacacagtgaatgccagttggatcgccgttcaggaactagaaaaactcggactgggagacagcgtcgacctgcacgtttacgagatacctgttgagtaccagaccgtgcagcggctgatccccgctttgtgggagaaacactcgccgcaacttgtagtacatgtaggggtgagcggaatggctaccactgtgaccctcgagaagtgcgggcacaataaaggttataaaggcctcgacaactgtaggttttgtcccggatcgcagtgctgtgtggaggatggccctgagagtatcgacagcattatagacatggacgcggtgtgtaaaagggtcacgaccctcggcctagatgtgtccgttaccatctcccaagatgccggacgttacctgtgtgatttcacttactacacctcactgtaccagagccatgggaggtctgccttcgtgcacgtcccacccctgggcaaaccctataacgccgaccagctcgggagagccctgcgggctatcatagaagaaatgctggacctgttagaacagtcagaaggtaagatcaactactgtcacaagcattag

SEQ ID NO: 237532 - DNA, 609 bp, Artificial Sequence
  Description of Artificial Sequence: Synthetic coding sequence
atgaaaaaggcacgcaatgatgagtacgagaatcttttcaatatgatcgtagaaattccgcgttggacaaacgcaaaaatggagatcgcgacaaaagaaccaatgaacccaatcaagcagtatgtgaaggacggcaaactgaggtatgtggctaatatattcccttacaaaggttacatatggaattatggcacactcccccagacctgggaagacccccatgagaaagacaagagcaccaactgcttcggtgacaatgaccctatcgacgtgtgcgaaataggatcgaaaatcctgtcctgtggggaagtgatccacgtgaagatactcggcattctggctctgatcgacgagggtgagaccgactggaagctaattgccataaacgccaacgatcccgaagcatccaagttccatgggctccggaacataccagtgtatacaataaatcggattgttatcctccctagcctggatagatcccagacaagctctctatcatatctccccgcacaccaggactcctgtgttccactcgatgccgcacttcacgtagtattatacttctgctcgctgctggggttacagtcctatctgagctgcttttag

SEQ ID NO: 237533 - DNA, 1005 bp, Artificial Sequence
  Description of Artificial Sequence: Synthetic coding sequence
atgtccgctcttctgaggcttcttagaactggcgctccggctgcagcatgcctgcggctgggaacaagcgccggtactggcagtcgcagagccatggccctgtaccatacggaggagagaggccagccctgtagccaaaattataggttattctttaagaatgtgactgggcactacatcagccccttccacgacatcccactgaaggtcaactccaaagaggagaatggaatacccatgaagaaagccaggaatgatgagtatgaaaacctgtttaacatgattgtggaaatccctaggtggacaaatgccaagatggagatcgccacaaaagagcccatgaacccaatcaaacagtacgttaaggatggcaaactaagatacgttgccaatatcttcccttacaaggggtacatttggaactacggtacattgccgcaaacttgggaagacccacacgagaaggataagagtaccaattgcttcggggacaatgaccctatcgatgtgtgcgaaatcggtagcaaaatcctgtcatgcggagaggtgatccatgtgaagattctgggtatcctggcccttatagacgaaggcgaaactgattggaagttgatcgcaatcaacgccaacgaccctgaagctagtaagtttcacgatatcgatgacgtgaaaaaatttaaacctggctacctcgaggcaaccctgaactggttcagactttacaaggtgccagacggcaaacctgagaaccagttcgccttcaacggggagttcaaaaacaaggccttcgctcttgaagtcattaaatctacccaccagtgctggaaggccctgctgatgaaaaagtgcaatggtggagcaataaactgcacaaacgttcagatctctgatagcccttttcgctgcacccaggaagaggcgcgatctctggtggagtccgtaagctcatcccctaacaaagaaagcaacgaagaggaacaggtgtggcatttcttaggcaaatag

SEQ ID NO: 237534 - DNA, 918 bp, Artificial Sequence
  Description of Artificial Sequence: Synthetic coding sequence
atgagcgccttattgcgtctgttgcggactggcgctcccgctgctgcctgtttgcggttgggtacgagcgctggtacaggcagccgccgtgccatggctctgtatcacacggaggagaggggacagccatgttctcagaactaccggttgttctttaaaaatgtgacgggacattatatctcgcctttccacgacattcctttaaaggtgaactcgaaagaagagaacggaatccccatgaaaaaggccagaaacgacgagtacgagaatttgtttaatatgatcgttgagatccccaggtggaccaacgcaaagatggaaatcgccactaaggaaccaatgaatcccattaaacagtacgtgaaggatggaaaactccggtacgtggctaacatcttcccctataaaggttatatttggaactacgggacccttccccagatactctcttgcggcgaagttattcacgtgaagatactagggattttggctcttattgatgagggcgagactgactggaagcttatagcgatcaacgctaatgatccggaggcctcaaagtttcacgacatagacgatgtcaagaaatttaagccaggctatttggaagcaacgctcaactggttccgcctgtataaggtccccgacggcaaacccgaaaaccagtttgcattcaatggagagttcaaaaacaaagcgttcgcactggaagtgattaaatcaacccaccagtgttggaaggcacttctgatgaagaagtgtaacggcggagctatcaactgcactaatgtccagatctcagattctccttttcggtgcactcaggaggaagctaggtccctggtcgaaagcgtgagcagctcaccaaacaaggagagtaacgaagaagagcaagtgtggcatttcctggggaagtag

SEQ ID NO: 237535 - DNA, 507 bp, Artificial Sequence
  Description of Artificial Sequence: Synthetic coding sequence
atgtctgcactgcttagattgttacgcaccggagctcccgcagcggcttgcttgagactaggcacttccgctggtacgggcagtcggcgtgctatggcattatatcatactgaggagcggggtcagccgtgctctcagaactaccgactgttctttaacatagacgatgtgaagaagtttaagccgggatacttagaggccactctgaattggttccgactgtacaaggtgcctgatgggaaacccgagaatcagttcgcgtttaatggcgagtttaaaaacaaggcctttgcactggaggtcataaagtctacccatcagtgttggaaggcgttactgatgaaaaagtgcaacggaggcgctatcaattgtactaacgtgcagatttctgactcacccttccgttgcactcaggaggaagcacgttcattggtagaaagtgtatcctccagcccaaacaaagaatctaacgaggaagaacaagtctggcattttctggggaaatag

SEQ ID NO: 237536 - DNA, 1050 bp, Artificial Sequence
  Description of Artificial Sequence: Synthetic coding sequence
atgagtgctctacttaggctgttacgaacaggggctcctgccgctgcttgccttagacttgggacatccgctggaacgggttcgcgaagggccatggcactttaccatacggaagagcggggtcagccctgctcccagaactaccggctcttctttaagaatgtgaccggccattatatctcaccctttcatgacatccccctcaaagtgaactctaaagaggacaccgaggcccaaggcatatttatcgatctctctaaaatttgggagaacggcatccctatgaaaaaagcacggaacgacgaatacgagaacctgttcaacatgatcgttgaaatacccagatggacaaacgctaaaatggaaatcgcaactaaagaacccatgaatcccattaaacagtacgtcaaggacggcaagctccgatacgtagcaaacattttcccttacaagggctatatttggaactacgggacactgcctcagacatgggaggacccccacgagaaagataaatctactaactgcttcggtgacaatgatccgatagatgtctgtgaaattgggtccaaaatcctgtcatgtggagaggtgatccatgtcaaaattctgggaatactcgcattaattgatgaaggcgagacagattggaagctcattgccatcaatgcaaacgaccccgaagcctccaagtttcatgatatcgacgacgtgaaaaagtttaagccgggttatttagaagctacccttaactggttcagactgtacaaggtgcccgacggcaagcccgagaatcagttcgcttttaacggggagttcaaaaataaggcattcgccttagaggtcattaagtccacacaccaatgctggaaagccctgctgatgaaaaagtgtaacggaggagccattaattgtacaaatgtgcagatctctgactcccctttccggtgcactcaggaggaggctcgtagcttggtcgagtccgtgtctagtagccccaataaagagtcaaacgaggaggaacaggtttggcacttcctgggcaagtag

SEQ ID NO: 237537 - DNA, 951 bp, Artificial Sequence
  Description of Artificial Sequence: Synthetic coding sequence
atgtcggctctgctgagattgttgagaacgggcgcacctgccgctgcctgcctgcggctgggcacctctgcaggcaccgggagtaggagagctatggcgctgtaccacactgaagaacgcggtcaaccatgttcccagaactataggctttttttcaagaatgttaccgggcattatatcagtccatttcatgatattcctctgaaagtcaacagcaaagaagagaacggcattccgatgaaaaaggcgaggaacgatgaatacgagatagctacaaaggaacctatgaaccccatcaagcagtatgtcaaagacggcaagctacggtacgtggccaacattttcccttataaaggctacatatggaactatgggaccctcccacagacatgggaggatcctcacgagaaggacaagtcaacaaactgcttcggcgacaatgacccgattgacgtttgtgagattggcagcaagatcctatcttgcggagaagtgatacatgtgaagatccttggcatactagcgctaattgatgaaggggaaactgactggaagctaattgccattaacgcgaatgacccagaagcgtcaaaattccacgacatcgacgacgttaagaaatttaagcccggatacttggaggctacactcaattggtttcggctgtataaggtccccgatggcaaacctgaaaatcagtttgcctttaacggggagttcaagaacaaggcatttgcattggaggttatcaagtctacacatcaatgctggaaggcactgctgatgaaaaagtgcaacggtggggcaatcaattgcacgaacgtccagatttctgatagtcccttccgctgtacgcaagaagaggctcggtcgctcgtggaatccgttagctcgagccccaataaggagtctaatgaggaagaacaagtgtggcacttcttgggtaagtag

SEQ ID NO: 237538 - DNA, 699 bp, Artificial Sequence
  Description of Artificial Sequence: Synthetic coding sequence
atgtcagcactgcttcgtctgctgcgtaccggggcaccggctgcggcatgtctcagattgggtacctcagccggtacgggctccaggcgcgcaatggccctgtatcatactgaagaaagaggccaaccctgtagtcagaattacaggttattttttaagaacgttaccggtcattacatctctccttttcacgatattccccttaaggtgaacagcaaggagatactgagctgcggcgaggtgatccacgtaaaaattttagggatactggcacttatcgacgagggagagaccgattggaaattaatcgccattaatgctaatgatcctgaggcctcaaaatttcacgacatcgatgacgtcaaaaaatttaagcccggttatctcgaggccactctcaattggtttaggctgtacaaggtgccagacggcaaaccagagaatcagtttgccttcaacggcgaatttaaaaacaaggcatttgcgttggaagttattaagtccactcaccagtgctggaaagccctcctgatgaagaaatgcaacgggggtgctatcaattgcacaaacgtgcagatttccgactcacctttccgctgtacacaggaggaggcaaggtctctagtagaatctgtgagctctagtcccaataaagagtccaacgaggaagagcaggtatggcactttttgggcaagtag

SEQ ID NO: 237539 - DNA, 960 bp, Artificial Sequence
  Description of Artificial Sequence: Synthetic coding sequence
atgtcagttggatttatcggcgcaggacaactggcctttgcacttgctaaaggcttcacagcggcaggcgttctggctgcccacaagattatggccagcagccccgatatggacctcgccactgtcagcgcactgaggaagatgggcgtgaaattgaccccccataacaaggaaaccgtgcagcacagtgatgtgctgtttcttgcagtaaagcctcatatcattccctttatacttgacgagatcggcgcagacattgaggatagacatatcgttgtatcatgtgcagccggtgtgacaatttcatcgatagaaaaaaaactttctgcgttcagaccagctccccgagttattaggtgcatgaccaacacgccagtagtggtgagagaaggggctaccgtgtacgccacaggaacccacgcccaagttgaggatggccgtctgatggagcagctgttgtcaagcgtgggattctgcaccgaggtggaagaggatttaatagatgccgtcaccggcttgtctgggtctggacctgcctacgcgttcactgccctcgatgccctggcagatggcggtgtgaagatgggcttgccacgtcgactcgctgttaggctcggagcccaagcattgctgggagcagccaagatgctactccacagtgaacagcatcccggtcagttgaaggacaacgtttcctcacctggaggcgctactatacacgcattgcatgttctagagtctgggggtttccgcagcctgttaataaacgccgttgaagcaagctgtatcagaaccagagagctgcaatctatggcagaccaggagcaggtgagccccgcagctattaagaagactatactggacaaggttaagctagacagccccgcaggcacagctctgagcccttccggccacacaaaattgttacccagatcgcttgcgcctgctggcaaggactag

SEQ ID NO: 237540 - DNA, 951 bp, Artificial Sequence
  Description of Artificial Sequence: Synthetic coding sequence
atgtctgttggtttcattggtgcgggacagttggcattcgccttagcaaaaggcttcactgctgcaggagtgcttgccgcacataagatcatggcctcaagccctgatatggaccttgccacagtctctgcattgagaaagatgggagtcaaattgacaccccataataaggaaacagttcagcactccgacgtacttttcttggcagtgaagcctcacatcattcccttcatcctggacgagatcggggcagatatcgaagaccgccacatcgtagtgtcctgtgctgcgggtgtcacaatttcgtccatcgaaaagaagctctcagccttccgtcccgctccgagggtcattaggtgtatgactaataccccagtggtggtgcgagagggcgcaacagtatacgccacgggaacacacgcgcaggttgaggatggacgtcttatggaacaactgctctctagtgtgggcttctgcacagaagtcgaagaagatttgatcgacgcagtcaccgggttgagcggatccggacccgcttacgccttcacagccctggacgcattggctgatggaggcgtgaagatgggactccccaggaggttggccgtgagactgggcgcacaggcacttcttggtgcagcaaagatgctattgcatagtgaacagcaccctggccagctcaaggataatgtcagttctccgggaggcgcaacaatccacgcattgcatgtcctcgaatccggtggattcagaagcctacttatcaacgcagtggaggccagctgcatccgcactagagagcttcagagcatggcagatcaagaacaagtgtcccctgctgccatcaaaaaaacaatactggataaggaccacctgcccctcgaattgggaagccccgagggtttgcaccctctgctgttgcagtatcagcttgccagagccccttcgtag

SEQ ID NO: 237541 - DNA, 1041 bp, Artificial Sequence
  Description of Artificial Sequence: Synthetic coding sequence
atggtgggcggagggagacgcgtagggagggatgaaccggtcccctcggtgggggctctgggccaggggagtccagattctatgagcgttggatttataggagccggacagctggccttcgccctggctaaagggttcacagcagctggtgttttggccgcacataagatcatggcatcctctccagacatggacctggccacggtgtctgctctgcgaaaaatgggcgtgaaactcacccctcataacaaagagactgtccaacactcggacgtgctgttcctggcagttaagccccatattatcccattcatcctagacgaaataggcgcagatattgaagaccgccatattgtcgtgtcttgtgcagccggtgtgaccatctcttcaatcgaaaagaagctcagtgctttccgcccagcccctagggtgatacggtgtatgaccaatactccagtcgtggtgcgtgagggcgcaaccgtctacgcaaccggcacccacgcacaggtcgaagacgggagactgatggaacagctgctgtcgtccgttggattttgtaccgaggtcgaagaggacctgatagacgctgttactgggttgtccggaagcggcccagcttatgcctttacagcactggatgccctagcggacgggggagtgaagatgggcttgcctcgacggctcgccgttcggctgggggcacaggcccttctgggggctgcaaagatgctactgcacagcgagcagcacccaggccagcttaaggataacgtgtcctcgccaggtggtgccactatccatgcattgcacgtgcttgaatcaggtggcttccgctcccttttgattaacgccgtcgaggcgtcatgcattcgcacgcgtgaactgcagtctatggccgaccaggagcaagtgtcacccgcagctatcaaaaagacgatcctggacaaagtcaagttggacagtcccgcaggcacggctttgtcacctagcggtcatactaagctcttgcccagatccttggcacccgctggtaaggactag

SEQ ID NO: 237542 - DNA, 819 bp, Artificial Sequence
  Description of Artificial Sequence: Synthetic coding sequence
atgtccgttggattcatcggggctgggcagttggctttcgcgttggccaaaggcttcaccgccgcaggggttctagcggcacataaaataatggctagctccccggatatggatcttgccaccgtgtctgccttgagaaagatgggcgtgaaactgacaccccataataaagaaactgtgcagcatagcgacgttctcttcctggcagtgaaacctcacattatccccttcattttagacgagattggagcagatatagaggaccgccacattgtggtcagctgtgctgcaggcgttacaatttcttcaatcgaaaaaaaactcagcgccttcaggcccgctcccagagttatccgctgtatgaccaacactcccgtggtcgttcgagagggtgccactgtctacgccactgggacacatgcccaagttgaagacggtagactgatggagcagctcttgagttccgtgggattctgtacagaggttgaggaagaccttatcgacgccgtgacgggcctatcaggatctggtcccgcttatgcatttacagccctagacgccttagcagacggtggggttaaaatggggctccccagacgattagctgtaaggctcggcgctcaggcattactgggcggttgtcaggatgccgctgccctgcgcaccgcacctagacccgcacagggtcagcgacaattgtcatggtggggccatcatccctgtctggcttgtgcgggtgaatgggggctgccattgccggctcatcaacgctgcggaggtctcttgcatcctcacacaggcgctgcagttcatgggtag

SEQ ID NO: 237543 - DNA, 723 bp, Artificial Sequence
  Description of Artificial Sequence: Synthetic coding sequence
atgtccgtggggtttatcggcgcagggcagctcgcattcgcactcgctaagggcttcaccgccgctggcgtgctagccgcacataagattatggcctcttccccagacatggacctggcaacggtatccgccctacgcaagatgggcgtaaaacttactccccacaataaagagacagtacagcacagtgacgttcttttccttgccgtgaagccacacataatatcaatcgaaaaattatcagcctttcgcccagcacctcgtgtgatccggtgcatgactaacactccagtggtggtgagggaaggtgccactgtctatgccacgggtacacacgctcaggtcgaggacggacggctgatggagcaactgttaagttccgtgggcttttgcaccgaagtggaggaggatctcatcgatgctgttactggactgtcgggatccggacctgcatacggggctgccaagatgctcctgcatagcgaacagcacccaggacagctaaaggacaatgtgtccagccctggcggagccaccattcacgcactccatgtgctggagtccggagggttccgatcgttgctcattaacgcggtggaggcttcatgcattcgtactcggtgggccccagccttgccggcatcactggtaagctccccctgcatggccgaagcttctttgacccatatctgctcattcacccactcagccgacacctactag

SEQ ID NO: 237544 - DNA, 1590 bp, Artificial Sequence
  Description of Artificial Sequence: Synthetic coding sequence
atgctgaaattcaggaccgttcatggaggtctgagacttttagggatccgacgaaccagcacagcccctgcggcaagtcccaacgtgcgtagactcgagtacaagcccatcaagaaagtaatggtcgcaaacaggggcgagatcgcgatccgtgttttccgggcttgtaccgagctggggattcggacggtggcgatatacagcgagcaggatactggacagatgcaccgacaaaaagcagacgaggcctatctgatcggtcgtggcctggcacccgtgcaggcttacctacatatccctgatattatcaaggtcgctaaggaaaacaacgttgacgcggtccaccccggttatggattcctgagcgagcgggctgacttcgcacaggcatgtcaagatgctggcgtccgcttcattggaccctctccggaggttgtccgaaaaatgggtgacaaagttgaggcaagggccatagcaatcgctgcaggtgtaccagtggtccccggtaccgacgccccaatcacgtcacttcacgaggcccacgaattcagcaacacttatgggttccccattatctttaaggccgcatacggcggagggggtcggggaatgagggtggttcacagctacgaggagttggaggaaaattatactcgcgcatactctgaggctctagcggcatttggaaacggagcactctttgtcgagaaattcatagaaaaaccaagacatatagaggttcagatcttgggggaccagtatggaaacatcctccatttgtacgaacgagactgcagtattcagcgcaggcatcagaaggttgtagaaattgctcctgccgctcatttggatccccagctgcgcactcggctaacttctgattccgtcaagcttgcgaagcaggtgggctacgaaaacgccggaacagttgagtttctggtcgacaggcacgggaaacactacttcatagaggtaaacagtcgcttacaggtcgagcataccgtgaccgaggagatcactgacgtggacctggttcacgcacagatccacgtcgctgagggaaggagcctgccagatctgggtcttcggcaagagaatatacgtattaatgggtgtgctatccagtgccgggtcacaaccgaggaccctgctcggagtttccagcctgataccggtagaatcgaagtctttagatccggcgaagggatggggatcaggctggataacgccagcgccttccagggcgctgttatctctcctcactatgattccctgctggtgaaggtgatcgcacacgggaaggaccatccgactgctgcaaccaagatgagccgggcactcgccgagtttcgtgtgagaggagtgaaggtgcgcaggcaccaggctcagcccctggccgctgctttaggtcgcccttgtggccaggaagcccgtcgccctcaggccgcagtaaccgctcctaccggacccggatcccccaccttggttcgcgtccctcccgctgccagggtactgagctctcgcctcggaggaccttctcaaaccacacccgagaccagtacagaagtgtcgcctacaatccttctctag

SEQ ID NO: 237545 - DNA, 3537 bp, Artificial Sequence
  Description of Artificial Sequence: Synthetic coding sequence
atgcttaagtttaggacagtccacggcggactacggcttctcgggatacgtaggacctccaccgcacccgctgcctcacccaacgtaaggaggttagaatataaaccgatcaaaaaagtcatggtggctaaccggggagaaatcgcaattcgcgttttcagagcctgtacagagctggggatcagaacagttgccatctacagcgaacaggatacaggccagatgcacaggcaaaaagcagatgaagcttacctgataggtcggggtctcgctccagtccaggcctacctccacatccccgatatcattaaagtggccaaggagaataacgtggatgcagttcatcccggatacggattcctgtctgaacgcgcagactttgctcaggcgtgtcaggacgcaggtgtccgcttcatcgggccatcccctgaagtagtgcggaagatgggcgataaagtggaggcaagggcaatcgcaatagcagccggagtccccgtcgtccccggaacagatgccccaatcacttccctacatgaagctcacgagtttagtaacacttacggctttccaatcatatttaaggctgcctacggaggtgggggtagaggtatgcgggtggtgcacagttacgaggaattggaggagaactataccagggcttactccgaggctctagccgctttcgggaacggggcactgtttgttgagaaattcattgaaaaaccaaggcatattgaggttcagatccttggggaccaatatggtaatatcctgcacctgtatgagagggactgctcgattcaaagacgacaccaaaaggtggtggaaatcgctcccgcagcacatctcgatccccaacttcgtacacggctaacaagcgactccgtaaaactggctaaacaagtaggatacgaaaatgccggaacagtggaattcctcgtcgaccgtcatgggaaacactactttattgaggtgaactctagactccaggtcgagcacacagtgaccgaggaaattacagacgttgatttagttcatgcccaaatccatgttgccgaaggacgttcccttcccgatttgggtctccgacaggaaaacattagaataaacgggtgtgctatccaatgccgggtgacgaccgaagacccggcacgatcattccagccagacaccgggagaatcgaggtgtttcgatcaggcgagggtatgggaatccggcttgataacgcctccgcatttcagggagcggttatctcaccccactacgattcattgctggtgaaggtgattgcccatgggaaggatcaccccaccgctgcaaccaagatgtctagagcgctcgcagagttccgtgtcaggggagtgaaaacgaatatcgcttttctccagaacgttctcaataaccagcagtttctcgctggaaccgtggacacacagtttatcgatgagaatccagaactcttccagctccggccagcacagaacagggctcagaaactacttcattatcttggccacgtgatggtgaatggacctacaacccccatacctgtaaaggcaagtccttcacctactgatccagtagtgccagccgtgcctatcggcccaccgccagccggttttagagacattctactccgtgagggccctgaggggttcgctagggccgtgcgtaaccatcctgggctgctcttgatggataccaccttcagagatgcccaccaaagcttgcttgcgacacgagtgagaacacacgacctgaaaaaaattgctccctacgtggctcacaatttctcaaagcttttttcaatggagaattggggtggggctacttttgacgtggcaatgcggtttctgtacgaatgcccatggagaaggctgcaggagctgcgagagttaattccaaatattccgtttcaaatgctactgaggggagccaacgcggtgggctacaccaattaccccgataacgtcgtgttcaagttttgcgaggtcgccaaggaaaatggtatggacgtcttcagagtatttgactctttgaattaccttccaaacatgctgttgggcatggaagctgctggttctgcaggcggtgtggtggaggcggcaatttcttataccggagacgtagccgatccaagccgcacaaagtatagtttgcagtattatatgggtcttgctgaggaactggtgcgcgctgggactcacattctgtgtatcaaagatatggccggactcctgaagcctactgcatgcacaatgctggtgagcagcctcagagaccggttccctgatttaccattgcacatacacacacatgacactagtggtgccggtgtggcagctatgttggcttgtgcccaggccggagctgatgttgtggacgtggcggctgacagcatgtccgggatgacttctcagccctcaatgggggcactcgtggcttgtacccgagggactcctctggataccgaggtacccatggaacgggtgtttgactattccgagtattgggagggagctcgtgggctgtatgctgccttcgattgtacagccaccatgaagtccggaaactccgacgtgtacgaaaacgagattccgggaggccagtataccaacctccatttccaggctcattctatgggcctgggctccaaatttaaagaggttaaaaaagcctacgttgaagctaatcagatgctgggggacctgataaaggtgacaccgagtagcaaaatcgtcggcgatcttgctcagttcatggtgcaaaatggcctgagtcgagccgaagcagaggctcaagcagaggagcttagttttccaaggagtgttgtggagttccttcaggggtatatcggagtacctcatggtggctttccagaacctttccggagcaaagtactgaaggatctgccacgcgttgagggcagaccaggggcaagtctcccgccattggatctgcaggccttggagaaagagctcgtggataggcatggagaggaagttacgcctgaggatgtcttatcagccgctatgtacccagacgtatttgcccactttaaggatttcacagcaacatttgggcctctggactctcttaacacccgcctgtttcttcagggcccaaaaatcgctgaggaattcgaagtggagctggagcggggaaaaaccctacatatcaaagctttggccgtgtccgacctgaatcgagccggacaacggcaggtcttcttcgagttaaacgggcagcttcgcagtattttggtgaaagacacccaggctatgaaagagatgcattttcatccaaaagctttgaaagacgtgaaaggccagattggggcacctatgcccggaaaggttattgacatcaaggtggtggccggtgccaaagtagctaaaggccaaccattgtgtgtactgtcagcgatgaaaatggagactgtggtgacctcccccatggaggggaccgtacgaaaagtgcacgtgaccaaggatatgaccctcgagggtgacgatttaatcctggaaatcgagtag

SEQ ID NO: 237546 - DNA, 3537 bp, Artificial Sequence
  Description of Artificial Sequence: Synthetic coding sequence
atgctgaaatttcggacagttcacggaggcctccgcctccttgggattcgcagaaccagcactgcccctgccgctagtccgaatgtgagacgcctcgagtacaagccaattaagaaggtgatggtggcaaaccgcggagaaattgccattagggtgtttagagcctgcactgaacttggtattagaaccgtggctatctactcagagcaggacaccggacagatgcatagacagaaggcagacgaagcctatctgatagggcgaggcctggcccctgtacaagcttacttacacattcccgacatcattaaggtggccaaggagaacaacgtggatgcagtccaccctggctacggtttcctatcagagcgagcggattttgcgcaggcttgccaggacgctggtgtgcgatttatcggccctagccccgaagtggttcgaaaaatgggcgacaaggtcgaagccagagccatagccattgcagcgggagtgccagtcgtgcccggaaccgatgcgcctattacatccctgcacgaggcgcatgagttctccaacacctacggattccccatcatcttcaaagccgcttatggaggcggtggcaggggcatgagagtagtacatagctacgaagaactggaagagaactacactcgggcatactccgaggccctggccgcattcggtaacggcgctttgtttgtcgaaaaattcatcgaaaagcctcggcacatcgaggtgcagatcctgggagatcagtacggaaatattcttcatttatatgagagagactgctcgattcagagacgccaccaaaaggtcgttgagatagcccctgcagctcatctcgacccacagctgcgcactaggctgacaagtgacagtgtaaagctcgccaagcaggtcggctatgaaaatgccggaactgttgagttcctggtggaccggcacggcaagcattatttcatcgaggtaaattcccgcttgcaggtggagcacacggtgactgaagaaatcacagatgtggatctggtgcatgcacaaatccacgtggccgaaggaaggtctctgccagacttaggattacggcaggaaaacatccgcataaacggatgcgctattcagtgtagggtaaccacggaggacccagctcggtcatttcagcctgatacaggacgcatagaggttttccggagtggcgagggaatggggatccgccttgataatgcaagcgcctttcagggtgctgttatatctccgcactacgactcattgctcgtgaaagtgatcgcccacggcaaagaccaccctacagcagccacgaagatgtcccgcgcactcgcagagttcagggtgcgaggcgttaaaacaaacatcgccttcctccagaacgttctcaacaatcagcagtttttagcaggcaccgtggacacacagtttatcgacgaaaatccggagttgtttcaacttcggccagctcagaacagagctcagaaactactgcactaccttggccacgtaatggtgaatggccctactacaccgattccagtgaaggcctcccctagccctaccgacccagtggtacctgcagttcccattggccctcccccagccggttttcgcgacattctcctgagagagggccctgagggctttgccagggccgtccgcaaccacccgggactgctcctcatggataccacctttagagatgcccaccaaagcctgctggcaactagagtacggactcatgatcttaagaagattgcgccttacgtggctcacaacttctccaaactttttagtatggagaattgggggggagcaacctttgacgtcgcgatgcgatttttatacgagtgcccgtggagaagactgcaagagctgcgggagctgattccgaatatacctttccagatgctgctccggggtgctaacgctgtcggctacactaactatcccgataatgtcgtgtttaagttctgcgaggtcgccaaggaaaacggaatggatgtgttccgcgttttcgactctctgaactacttgcctaacatgcttctgggcatggaggctgccggaagcgccggaggagttgtagaggccgctatatcgtatacgggcgatgttgcagatcctagtcggaccaagtattccctgcaatattatatgggtctcgctgaagagctggttcgggcaggtacgcatatcttgtgtattaaggacatggcgggtttgcttaagcctactgcatgcaccatgctcgttagctcactgagggacaggttccccgaccttccattacatattcacactcacgacaccagcggggcaggggtggcagcgatgctggcttgtgcacaagcgggagctgatgtcgtggacgtggcagccgacagcatgtctgggatgaccagccagccctccatgggcgctctggtcgcttgcactagaggtacgccactagatactgaggtgccaatggaaagagtgttcgactattctgaatattgggagggtgctcgcggactgtatgctgccttcgactgcaccgctacaatgaagagcgggaattcagacgtctatgagaatgaaattccaggaggccagtatacaaatttgcacttccaggcccattctatggggctcgggagcaagttcaaagaggtcaagaaggcctatgtggaggccaatcagatgctcggggacctcatcaaagtgacgccatctagcaagatcgtcggggacttagcacagtttatggtgcaaaacgggttgtcacgagccgaggccgaggcccaggccgaagagctctctttcccacgaagcgttgttgagtttctgcaggggtacattggcgtacctcacggcggatttcccgaaccattccggtccaaggtgctgaaggatttgcccagggtcgaggggcgacctggcgcttcactgccgcctttggacctgcaggcgctggagaaggaactcgtggataggcacggcgaagaggttactcccgaggacgtcctgtctgctgctatgtacccagatgttttcgcccattttaaagatttcactgccactttcggcccacttgattccctgaacacacgactgtttcttcagggacccaaaatcgcagaagaatttgaagttgagttggagagggggaagactctgcacatcaaagcgctagctgtatctgatctgaaccgggcaggacagaggcaagtcttcttcgaactcaacggccagctgcggtctatcctcgtaaaagacacccaagccatgaaggaaatgcacttccacccaaaagccctgaaggacgtcaaaggccagatcggagcccctatgccaggaaaagtaattgatataaaagtagtcgctggggctaaggtggccaaaggccagccgctatgcgtgctctccgcgatgaaaatggaaactgtcgtgacgtcaccaatggaaggtactgtgagaaaggtgcatgtgactaaagatatgaccttggaaggggacgatttgattttggagattgaatag

SEQ ID NO: 237547 - DNA, 3537 bp, Artificial Sequence
  Description of Artificial Sequence: Synthetic coding sequence
atgctgaaattcaggacggtacacggcggactgagactactgggaatccgcaggacctcaactgctcctgctgcttccccgaacgtccgcagactcgagtacaaacccataaagaaggtgatggtggccaataggggtgagatcgcaattagagtatttcgtgcttgcaccgagctgggaatcaggactgtcgccatttactccgaacaggacacgggccagatgcatcgtcagaaagcagatgaggcctatctgatcggccgtggtcttgctccggtgcaggcatacctgcacattccagatatcatcaaggtagcaaaagagaacaatgtagatgctgtgcacccaggatacggctttctgtccgaaagggccgacttcgcgcaggcctgccaggatgccggtgtgaggtttatcggaccaagcccagaggttgtaagaaaaatgggtgataaagtcgaagccagagcaatcgccatcgctgctggcgtgccagtggtgcctgggacagacgccccaattacaagcttgcacgaagcccatgagttctccaatacctatggtttccccatcatatttaaggccgcatatggtgggggaggtcgaggtatgagagtcgtgcacagctacgaggaactagaggagaattatacgagggcatactccgaagcgttggccgcattcggaaacggagctctgttcgtggaaaaattcatagagaagcccagacacatcgaggtgcagatcctcggggaccagtatggaaatattctgcacctgtatgagcgggattgctcgattcaacggcgtcatcagaaggtcgtcgagattgccccagcagcccacctcgatcctcagttaaggaccaggctcactagcgacagcgtcaagctcgccaagcaggtcggatacgagaacgccggaaccgtggagttcctggtcgatcggcatggaaagcattactttatcgaggtgaatagccgcctgcaagtcgagcacaccgtcaccgaagagatcacggacgtcgacttagtccatgcacagatccacgtggcagagggaaggagtctgcctgatctgggactgagacaggaaaacatcagaataaacgggtgtgccattcaatgccgggtgaccacggaggatcctgcaagatccttccagccagacactggacgcatcgaagtatttaggagtggcgaggggatgggtatccggcttgataacgcatccgccttccagggggcagtgatcagtcctcactatgactctctcctcgtcaaggtcatcgcacatggcaaagatcatcctacggccgctacgaagatgagtcgcgcacttgctgagttccgagtgaggggcgttaagactaacattgcattcttacaaaatgtcctgaataaccaacagttcctagctggtacagtggatacccagttcatcgatgaaaacccagagttatttcagctgcggcctgctcaaaaccgcgctcagaaactcctccactatcttggccatgtaatggtgaacggaccaaccacccccatccccgttaaagcatccccaagtcccaccgaccctgtagtgcccgctgttccgattggcccacctcctgccggtttccgagacattctactgcgagaaggacctgagggattcgctcgagcggtgcgaaaccatcccggactgttgctgatggacacaacattccgggacgcccaccagtctctgttggcgaccagggtgagaactcatgacttaaagaagatcgctccttatgtggctcacaattttagcaaattgttttccatggagaattggggtggtgcaacctttgacgtcgccatgaggtttctgtatgagtgtccatggcggaggctgcaagagctgcgggaactgattccaaatattcctttccaaatgctgttacgcggtgctaacgccgtggggtacaccaactacccagacaacgttgtattcaagttttgtgaagtcgccaaggaaaacggcatggatgtgtttagagtgtttgatagtctgaactatctcccaaacatgcttttggggatggaagccgctggatccgcaggtggcgtggtcgaggctgccatctcctatacaggcgatgttgctgatccatctcgcaccaaatacagccttcagtattacatggggctcgcagaggagcttgtgagagcaggcacacatattctttgcatcaaggacatggccggattgcttaaacctactgcctgtaccatgctggtgagctcactaagagatagattcccggatctgcctttgcatattcatactcacgataccagcggagctggggtggcagcaatgttggcgtgtgctcaggcaggcgcagatgtggttgacgtggcggctgactctatgtccggaatgaccagtcagccttcaatgggcgcactggtggcttgcacgcgtggaactccacttgacacagaagtgccgatggagcgggtctttgattactctgaatactgggagggggctagagggttgtatgcggcatttgactgcaccgcaacaatgaagagcggcaatagtgatgtgtatgaaaacgagatccctggaggacaatacactaatctgcacttccaagcgcacagcatgggactaggaagtaaattcaaggaggtgaagaaggcatatgtggaagcgaaccagatgctgggagatctcatcaaagtgacaccttctagtaagatcgtcggcgatctggcccagtttatggtccaaaacgggttgtccagagctgaagctgaggcccaggccgaggagctgtctttcccgcgatctgtggtggaatttctccaagggtacatcggcgtgccacatggagggtttccagaacccttcagaagcaaggtcctcaaagacctcccacgagtcgaaggaaggcccggtgcatcactacctcccttggacctacaggcccttgagaaagagttggtggacagacatggagaggaggtgactcccgaggatgtattgagtgcagctatgtaccctgacgtgttcgcccattttaaggattttactgctacgttcgggccactggactcactgaatacccgcctgtttcttcaaggccctaagatcgccgaggaattcgaagtggagcttgagcggggaaagacactccacattaaggccttggccgttagtgacttgaaccgggctgggcagcgccaggttttcttcgaacttaacggacagcttaggagtattctggtgaaagatacacaggccatgaaggaaatgcactttcaccctaaggctctgaaagatgtcaaaggccagattggcgctcccatgcccggtaaagtgattgacattaaggtggtagccggtgctaaagtagctaaagggcaaccactctgcgtgctcagtgcgatgaagatggagaccgtagtcacatcccccatggagggcacggtccgcaaagtgcacgtaaccaaggatatgacactggagggtgacgacttaattcttgagatagagtag

SEQ ID NO: 237548 - DNA, 615 bp, Artificial Sequence
  Description of Artificial Sequence: Synthetic coding sequence
atgcggaagatgcttgctgccgtctcacgcgtgctgtcgggcgctagccagaagcctgcttccagggtgctggtagcttcgaggaattttgccaacgatgcgacgtttgaaattaagaagtgcgacctgcacaggctggaagaaggaccccctgtgacaacggtgctcacccgggaggatgggctaaagtattacaggatgatgcagactgtgaggcgcatggaattgaaggccgaccagctgtataagcagaagatcatccgcggtttttgccacctgtgtgacggccagttcctactgcccctgacacaagaggcatgctgtgtaggtctggaggcagggataaacccgacagatcatctgataacagcttaccgggctcatggcttcacatttaccagggggctgtcggtgagggagatcctagccgagctgaccggcagaaaagggggttgtgctaaaggcaagggcggatccatgcacatgtatgccaagaacttctacggagggaacggcattgtcggtgcccaagtccctctgggggctggtattgcactggcatgtaaatataacggtaaggatgaagtctgcctaacactctatggagatggttag

SEQ ID NO: 237549 - DNA, 330 bp, Artificial Sequence
  Description of Artificial Sequence: Synthetic coding sequence
atggaactccagacatacaggtaccacggccacagtatgagcgaccctggggtctcttatagaaccagggaggagattcaggaagtaaggtccaagtcagaccctattatgctcttaaaggatcgcatggtcaacagcaatctcgcttctgtcgaagagctgaaggagattgatgtggaggtacgcaaagaaatcgaggacgccgctcagttcgctaccgctgatccagaacctccgcttgaggaactaggatatcatatttactctagtgatcccccattcgaggtgaggggcgctaatcagtggatcaaattcaagtcagtctcttag

SEQ ID NO: 237550 - DNA, 543 bp, Artificial Sequence
  Description of Artificial Sequence: Synthetic coding sequence
atgcggaaaatgctcgctgctgtgagcagggtgctctcaggagcgtcccaaaagccagcatcacgggtgctagtagcctctagaaactttgccaacgatgcgaccttcgaaatcaaaaaatgcgatctccatcggttagaagaggggccacccgttactacagtgcttaccagagaggacggcctcaagtactatcggatgatgcagacagtccgcagaatggagctaaaggcagaccaattgtataagcaaaaaatcatccgcggtttctgtcacctctgtgacggacaagaagcatgttgcgttggtctagaggccggtataaacccaacagatcacctgattacagcttatcgggcacatggattcactttcacccggggacttagcgtacgggagatcctcgcagaattaactggacgcaaggggggatgtgccaagggcaaaggaggctctatgcatatgtatgctaaaaacttctacggtgggaacgggatcgtaggcgcacaagtggtcaaggacgaggactgtgtcttattatag

SEQ ID NO: 237551 - DNA, 1287 bp, Artificial Sequence
  Description of Artificial Sequence: Synthetic coding sequence
atgagaaagatgctggctgccgtctccagagtactgagcggggcttcccaaaaacctcgtcacgggctggcaactctgccaagtcttgtaagcatctccaggctgaaacagagtagccatctcgggctgcctaaatgttgggactattcccactccctgaaaacacggcaggccagcagggtccttgtcgcctctaggaatttcgccaatgacgccactttcgagatcaagaagtgcgacctgcataggttagaagagggccctcctgtgacaactgtgctgacacgcgaagacggactaaaatattataggatgatgcagaccgtgcgacggatggaactaaaagccgaccaactgtacaaacagaagatcattcggggtttctgccacctctgcgacgggcaggaagcgtgttgtgtcgggttggaggcaggcataaacccaaccgatcatctcataaccgcctacagagcacatgggttcacattcacccggggactctcagtccgggagattctggccgagctgaccggcaggaagggtggatgcgctaagggtaaaggaggctcaatgcacatgtatgcaaagaacttttatggaggcaacggcatcgtgggcgcacaggtgcccctgggggctggcatcgctctggcctgtaagtacaatgggaaagatgaggtgtgccttaccctctacggcgacggagctgccaaccaagggcagatcttcgaagcatacaacatggctgccttgtggaagcttccttgtatttttatttgcgaaaacaaccgatacggaatgggtacaagcgtcgaacgcgcagctgccagcactgactactacaaacgtggggacttcatacccggactccgggtggatggaatggacattctctgcgtcagggaagctacccgtttcgccgcagcctactgcagatcaggtaaggggcctattttgatggaactgcagacttatcggtaccatgggcactccatgtctgacccaggcgtgtcttaccgtactagggaagagattcaggaggtgcgtagcaaatctgacccaatcatgctcttaaaagatagaatggttaattccaatctcgctagtgtggaagagctgaaagagatcgacgtagaggttaggaaggaaattgaggatgctgcgcagttcgcaactgctgaccctgagccgcctctggaggagctcgggtaccatatctacagctcagaccctccgttcgaggtcagaggagctaatcagtggatcaaattcaagtctgtttcctag

SEQ ID NO: 237552 - DNA, 366 bp, Artificial Sequence
  Description of Artificial Sequence: Synthetic coding sequence
atgcgcaagatgctcgccgctgtctctagggttctgtccggcgcatctcagaagccttttgccggttcacctccaccccgtcatcttaccgtaggcaggaagctgagctccaggtacgaggtgacatttgagtctgctcaagcaagtcgagttcttgtggcctccagaaactttgccaatgatgctaccttcgaaatcaagaaatgcgatcttcacaggttggaggaagggcctccagtgaccacggtgttgactcgggaagacgggctgaaatattatcgtatgatgcagactgtccggagaatggagttgaaggcagatcaactgtataagcagaagattatccgcggattttgccatctgtag

SEQ ID NO: 237553 - DNA, 366 bp, Artificial Sequence
  Description of Artificial Sequence: Synthetic coding sequence
atgagaaagatgcttgccgcagtctccagagtcctcagcggagcttcacagaaaccatttgcgggatctcctcctccacgacacctgactgtgggtcggaagctttcgagtaggtatgaggtgacctttgagagtgctcaggcttcccgagtgttggtggcttcccgcaatttcgctaatgatgctacattcgaaatcaaaaaatgcgatttgcatcggctggaggaagggcctccagtgacaaccgtgctcacacgcgaggacggcttgaaatactataggatgatgcagactgtgcgacggatggagctgaaggcagatcagctttataaacaaaagatcatccgcggtttttgccacctctag

SEQ ID NO: 237554 - DNA, 1173 bp, Artificial Sequence
  Description of Artificial Sequence: Synthetic coding sequence
atgaggaagatgctggcagcggtcagcagagtgctgtcaggtgcttcacaaaaaccagccagtagagtcctcgtggcgtcccggaatttcgcgaacgacgcgacttttgagataaagaaatgtgacctgcatcggctggaggagggtcctcccgtaactaccgtgttgacacgggaggatgggctaaagtactatcgaatgatgcaaacggttcggaggatggaactgaaagccgaccaattgtacaaacaaaagattatcaggggtttctgccacttgtgcgatggccaggaagcgtgctgtgtcggcctggaggctggtattaatccaaccgaccacttgattaccgcctatcgtgcccatggattcactttcacgcgcggacttagcgtgagagaaatcctggccgagctcactgggagaaaggggggatgcgccaagggcaagggtgggagcatgcacatgtatgcaaagaacttttacggtggaaacggcatcgtgggggctcaggttcctctgggcgcaggcattgctctggcgtgcaaatataacgggaaggacgaggtgtgcctgaccctctatggcgacggcgcagccaatcagggccaaatatttgaggcctacaacatggctgcactgtggaagttgccctgtatcttcatctgcgaaaacaatcgctatggcatgggcactagtgtggaaagagctgccgctagcacggactattacaagcgcggagacttcattcctggactgcgcgtagatgggatggacatcctgtgcgtgcgcgaggctacacggtttgctgccgcttactgtaggagtggcaaaggtcctattctgatggagcttcaaacatataggtaccacgggcattcaatgtccgatccgggtgtgtcttatagaactcgcgaggagatccaggaggtgaggagcaaatctgatcctattatgttactcaaagacaggatggtgaattctaatttggcgagcgtagaggaactcaaagaaatcgatgtcgaggttcgcaaggagatagaggacgccgctcagttcgccaccgcagatccagagccgcctctagaggagctcgggtaccacatttattctagtgacccccctttcgaggtgcgcggagccaatcagtggattaagtttaaaagcgtttcctag

SEQ ID NO: 237555 - DNA, 618 bp, Artificial Sequence
  Description of Artificial Sequence: Synthetic coding sequence
atgagaaagatgctggccgctgtatctcgggtcctgtcgggcgcaagtcagaagcccaggcatggccttgccacactgccctctctggtttccatctctcgcttaaagcagtcttcccacttgggcttgcctaagtgctgggactattctcacagtttaaagacccgccaggcctcccgagtgctcgtggccagccggaatttcgccaatgatgccaccttcgagattaagaaatgcgacctccatcgactggaggagggcccaccagtgaccacagtccttactcgggaagacggcctcaagtattaccggatgatgcagactgttcggaggatggaactcaaagctgaccagctgtataaacagaagattattcgcggattttgccacctctgtgatgggcaagaggcgtgttgtgtcggacttgaagccggaatcaacccaacggatcatttgatcaccgcctatagggcacatggtttcacttttaccaggggcctctcagtgcgggagattttagcagagttaacggggcgaaaggggggttgtgctaagggtaaaggcggatctatgcacatgtatgcgaagaatttttatggcggtaatggcatcgtatag

SEQ ID NO: 237556 - DNA, 1080 bp, Artificial Sequence
  Description of Artificial Sequence: Synthetic coding sequence
atgcgcaagatgctggcagccgtgagccgggtcttgtccggagcgtctcagaagccggctagtagagtactcgtcgcgagccggaactttgcaaacgacgccacgtttgagattaaaaaatgtgatctgcacagacttgaggaaggtcctcccgtcaccaccgtgcttacccgagaagacggcctaaaatactatagaatgatgcagacagtccggaggatggaactgaaagccgaccagctctataagcaaaagattattcggggtttctgtcatctatgtgacggtcaagaggcttgctgtgtggggcttgaggcgggaatcaatcccacggaccacttgatcactgcctatcgtgcccacgggttcaccttcacgcgcggactgtccgtcagggaaatcctggctgagctgacaggccgtaagggcggatgcgccaaagggaaggggggttccatgcacatgtatgccaagaatttttacggaggcaatggaatcgttggtgctcagggtcagatttttgaggcttacaacatggccgctctgtggaaacttccctgtatttttatctgcgaaaacaaccgatatggcatgggaacttccgtggaacgggctgccgcaagcactgattattataagagaggggatttcattccgggattgagagtcgatggaatggatattctgtgtgtgcgggaggccacaaggttcgcagcagcttactgtcgatctggcaaaggtcctatcctgatggagctgcagacatacagatatcacggccactcaatgagcgaccccggagtttcataccgtacacgggaggaaattcaggaggtgcggagcaaatcggaccctatcatgctgcttaaagacagaatggtgaatagcaacctggcctccgtcgaggaactgaaggagattgacgttgaggtgaggaaggagatcgaggatgcagcccagttcgccaccgcagacccggaacctcctttggaagaactggggtatcatatttattcctcggatcccccatttgaggtgaggggcgcaaatcagtggattaagttcaagagcgtttcatag

SEQ ID NO: 237557 - DNA, 129 bp, Artificial Sequence
  Description of Artificial Sequence: Synthetic coding sequence
gcaaatcaatggatcaagttcaagtctgtgaagggcaggagacgcaggggctacacattccgcggactgcctgattctgtgctcaatctcgtcaaggaggaggaaaacccggtgaacgagatccagtag

SEQ ID NO: 237558 - DNA, 1194 bp, Artificial Sequence
  Description of Artificial Sequence: Synthetic coding sequence
atgcgcaaaatgcttgcagccgttagccgcgtgctgtctggggcttcacaaaaacctgctagcagagttttagttgcctcacgaaattttgctaacgacgcgacttttgaaatcaagaagtgcgatctgcaccggctggaggaggggcctccggtaactactgtgctcactagagaagatgggctgaagtactaccggatgatgcagaccgtgcgtcgaatggaactcaaagccgaccagctctataaacagaagataattcggggtttctgtcacctctgcgatggtcaatttttgctgcccctcacacaggaagcctgttgtgtgggactggaagcaggaattaatcctaccgaccacctgattactgcctatagggctcatgggttcacttttaccagggggctgagcgtgagggagatcttggctgaactgactgggaggaagggtggctgtgctaaagggaagggcggatccatgcacatgtacgcaaaaaacttttacggcggtaatggcattgtgggtgctcaggtgcccctcggcgcagggatcgctttggcttgtaagtataacggaaaggacgaggtttgtttgactctgtacggagacggggcagccaaccagggacagatatttgaggcgtacaacatggccgctctttggaagctgccttgcatcttcatttgtgaaaacaataggtatgggatggggacgtcggttgagagagctgctgccagtaccgattactataagcgaggagattttatccctggtttgcgagtcgacgggatggatatcttgtgcgtgagggaggctacacgctttgctgccgcttattgtcggtccggaaagggaccaatcttgatggaattacagacttaccggtaccatggacatagcatgagtgacccaggagtgtcctataggacaagggaagaaatccaagaagtcaggtccaagtcagaccctatcatgctcctgaaggaccgaatggtgaatagcaacctggctagtgtcgaggagctgaaagaaattgatgtcgaagtgaggaaggagattgaagacgccgctcagtttgcaactgcagaccctgagcctcctctagaggaattagggtaccacatctacagcagtgatcctcctttcgaggtcagaggcgctaatcaatggatcaagtttaagtcagtctcctag

SEQ ID NO: 237559 - DNA, 1167 bp, Artificial Sequence
  Description of Artificial Sequence: Synthetic coding sequence
atgttagccgctttcattagcagagtattgcggagggtggcgcagaaatcggctaggcgggtgttggtggccagtcgaaattcgagcaacgatgcaacttttgaaatcaaaaagtgtgatctgtatctcctggaggaaggtccaccagtgactacagtgctgacccgagcggaagggttaaagtactatagaatgatgctgaccgtcaggagaatggagctgaaggctgatcagctgtataaacagaaattcattcgaggattttgtcacctctgcgatggtcaggaagcctgttgtgttggcctggaagcagggatcaacccctccgatcacgtcatcacttcttatagagcccacggggtctgctacacgcgagggctttctgttaggagcattctggcagagctgacaggcagacggggtggatgtgcgaaagggaaggggggatccatgcatatgtacactaaaaatttctacggcggaaacggtatagtcggagctcaagggcctctgggggcaggcatcgccttggcatgcaaatataagggtaacgatgagatttgtctgacactgtatggtgatggtgcggctaaccagggacagattgctgaggccttcaacatggccgctctatggaagctcccttgcgtcttcatctgtgaaaataatttatatgggatgggaacctccacagaacgggctgccgcatctcctgactactacaaaaggggcaacttcataccaggcttaaaggtggatggaatggacgtactgtgcgtccgcgaggcaaccaagtttgccgcaaactattgccgaagtggaaagggccctatactgatggagcttcagacatacagataccatgggcattcaatgagtgatcccggtgtgtcatacagaacccgagaggaaatccaagaagtgcgctctaagcgggatcctatcatcattctccaggatcgaatggtcaactccaaattggccaccgtggaagaactcaaagaaatcggtgcagaggtgcgaaaggagatagatgacgccgcacaattcgccactacagatcccgagccacacttggaagaactcggccatcatatctacagctcagattccagcttcgaggtgagaggggcaaatccttggatcaagttcaagtcagtctcttag

SEQ ID NO: 237560 - DNA, 1080 bp, Artificial Sequence
  Description of Artificial Sequence: Synthetic coding sequence
atggcggctgtgagtggattagtacgccgacctctccgagaggtttccggcttgctgaagcgcaggttccattggaccgccccagctgcgcttcaagtgacagtccgcgacgctatcaaccaagggatggatgaggagctcgaacgcgacgagaaggtgtttctgcttggcgaagaagtagctcagtatgatggtgcctacaaggtgtcccgcggtctctggaagaaatacggggataaacgcattatcgacacacccatcagcgagatgggattcgctgggatagcagtgggggcagccatggccggtctgcggcctatttgcgagttcatgacttttaactttagcatgcaggccatcgatcaggtcatcaatagtgcagccaagacctattatatgtccggtggcttacagccagttcccattgtgtttcggggtcccaatggcgcaagcgctggagtcgctgcccagcactctcagtgtttcgccgcatggtatggccattgtcccggactaaaggtggtgtctccgtggaactccgaggatgctaagggactcatcaagtccgctatacgggacaacaatcccgttgttgtactggagaacgagcttatgtacggcgtgccatttgagttccccccagaggcccaatctaaagactttctcatcccgataggcaaggcaaagatagagcgccaaggaacgcatataacggtagtatcacactccagacctgtcggacactgtctagaggcagctgccgtgctctccaaggagggcgtggagtgtgaggtgatcaatatgcgcacgatcagacccatggatatggaaacgatcgaggcttccgtcatgaagacaaatcacctcgtcaccgtggagggcggatggccccagttcggagttggggcagaaatatgcgcacggattatggaaggacctgcattcaatttcctcgatgccccagcggtgagggtaacgggcgcagatgttcccatgccttacgctaagattctagaagacaacagtattccacaagttaaggatattatttttgctatcaaaaagacactcaacatctag

SEQ ID NO: 237561 - DNA, 1026 bp, Artificial Sequence
  Description of Artificial Sequence: Synthetic coding sequence
atggcagccgttagtggcctggttagacggccactgcgggaggtgaccgtacgagacgcaatcaaccagggcatggacgaggaactggagagagacgaaaaggtatttcttttgggtgaggaagtggcccagtacgacggggcttataaggtctcaaggggcttatggaagaaatacggggataagcgaatcatcgacactcccatcagcgagatgggattcgcgggaatagctgttggcgctgctatggccggactgcggcctatctgcgaatttatgacattcaacttctcgatgcaggctattgatcaggttattaacagcgcggcaaagacctactacatgagtggcggattgcaacccgtgccaattgtgtttaggggaccaaacggcgcttctgctggcgtcgccgctcagcactctcagtgtttcgccgcatggtacggccattgccccggactgaaagtggtctcaccgtggaacagcgaggacgctaagggactgatcaagagtgcaattcgagacaacaatcccgtcgtggtccttgagaacgaactgatgtacggggtcccattcgagttcccccctgaggctcagagtaaggattttctaattcctattggcaaggccaaaatcgagcggcaagggactcacattacagtggtgtcacattcgagacccgtgggccattgtttggaggccgctgctgttctgtccaaagaaggcgtagaatgcgaagtgatcaacatgcgaaccattagaccaatggacatggaaacaatagaggcttcagtgatgaagacaaaccacttagtgaccgtggagggcggatggccacagtttggcgtcggggcagagatttgcgcgcgtatcatggagggccctgccttcaactttctcgatgcaccggcagtgcgagtgactggggcagatgtgcctatgccctatgcaaagatactggaggacaattcgattccgcaggtcaaggatataatttttgccatcaagaagaccctgaatatttag

SEQ ID NO: 237562 - DNA, 1026 bp, Artificial Sequence
  Description of Artificial Sequence: Synthetic coding sequence
atggcggcagtctccggtctggttcggagacctcttcgggaggtcagcggtctgctgaagcggcgttttcactggaccgctccggctgcccttcaggtgacagtccgggatgcaatcaatcaaggtatggacgaggagctggagagagacgaaaaggtgttcctgctaggggaggaagtggcccagtacgatggcgcttacaaggtgtccaggggcctgtggaaaaaatacggtgataagcgcatcatagacaccccaatctccgaaatggggttcgccggaattgcagtgggagctgccatggccggtctccggccaatctgtgagtttatgacattcaatttcagcatgcaggcgattgaccaggttataaattcagctgcgaaaacctattatatgtcaggcgtcgcagcacagcatagtcagtgctttgcagcgtggtatggtcattgcccgggactcaaggttgtctccccttggaactctgaagacgccaaaggcctgattaagtctgccatccgcgacaacaatccggtggtggtgctggaaaatgaattgatgtacggcgtgccttttgaatttccccctgaggctcaaagcaaggacttcctcatccccatcggcaaggccaaaatcgaaaggcagggcacacacatcacagtggttagccatagcaggcccgtgggccattgcctcgaggccgcagctgttctgagcaaggaaggggtagaatgtgaagtgattaatatgcgcaccattcgccctatggacatggaaacaatcgaggcttcagtaatgaaaactaatcacctggtcaccgtcgagggcggttggccacaatttggcgttggcgctgagatctgtgcacgaattatggagggacctgccttcaactttctggacgccccagccgtaagagttacaggcgcagacgtaccgatgccctacgcgaagattctggaggataattcaatcccacaggtcaaggacatcatctttgctattaaaaaaacactgaacatctag

SEQ ID NO: 237563 - DNA, 1236 bp, Artificial Sequence
  Description of Artificial Sequence: Synthetic coding sequence
atgaaagccgctaggtttgtgctgcgcagtgccggtagcctgaatggagccggtctcgttcctcgggaagtcgagcatttctccagatacagtcctagtccactaagtatgaaacagctgctggatttcgggtccgagaatgcatgcgagagaacgagctttgcatttttgcggcaggagctccccgtccgactagccaacattctgaaagagatcgacatcctacctacccaactggtcaacacatcctcagtccaactagtaaagtcctggtatatacagtccctgatggacctcgtggaatttcacgagaagtctccagacgaccagaaggctctgtccgacttcgtggataccttaataaaagtcaggaaccgtcatcacaacgttgtcccgacaatggctcagggtatcatcgagtataaagacgcctgcactgtggatccagtgacaaaccaaaatctgcagtattttctggacagattctacatgaacaggataagcacccggatgctgatgaaccaacatatattaatcttcagcgactcccagaccggaaatccaagtcacattgggtcgatagacccaaactgtgacgtcgtagctgtcgtgcaagacgcgttcgaatgttcacgtatgctgtgcgaccagtactacctatcatctcccgaactcaaactgacccaggttaacggcaaatttccggaccagccaatccatatcgtgtacgtcccatcccatcttcatcacatgctctttgagttgtttaaaaacgctatgcgcgcaaccgtggagcaccaggagaatcaaccttccctcactccaatcgaagtgatcgtagtcctcggcaaggaggacctaactatcaagataagcgatcgagggggaggggtgcccttgaggatcattgatagactattctcttacacctacagtaccgcgcctacacctgtgatggacaattcaagaaacgcacctctggccggttttggctatggactcccaatcagtcggttgtacgccaagtactttcaaggcgacctgaacctgtactccctgtcaggctatggcaccgatgctattatctatctcaaagcactgagttctgaaagtatcgaaaaactgcccgtgtttaacaagtccgctttcaaacactaccagatgagctctgaggcagacgactggtgtatcccatctcgagaaccaaaaaatctcgctaaggaggtagcgatgtag

SEQ ID NO: 237564 - DNA, 1128 bp, Artificial Sequence
  Description of Artificial Sequence: Synthetic coding sequence
atgaagcagcttctcgattttggctcagaaaacgcttgtgagcgcactagcttcgcctttctgagacaggagttgcctgtccgccttgctaacattctcaaagaaatcgatattctgccaacacagctcgtgaatacaagctctgttcagctggtcaaatcatggtatattcagtcactgatggacctggttgagttccacgagaagagccccgacgaccagaaggccctgtctgacttcgtcgatacgttgatcaaggtgcgcaaccggcatcacaatgtggtgccaacaatggcacagggaatcatcgagtacaaagacgcgtgtactgtggaccccgtgactaaccagaatctacagtatttcctggataggttttacatgaatcgtatttccacacgcatgctgatgaatcagcacatcttaatcttttccgacagtcagaccggtaatccgagtcatataggcagtattgacccgaattgcgatgttgtggctgtcgtgcaggatgcatttgagtgtagccggatgttgtgtgaccagtattaccttagtagtcccgaactgaagttaactcaggtcaacgggaagttcccggatcaaccaattcatattgtatatgtgccttctcatctgcaccacatgttgtttgagctgttcaaaaacgcgatgcgggcaactgtcgagcatcaggagaatcaaccttctctgactcccattgaggtcatcgtggtactgggcaaggaagatttgacaattaagatatctgaccgcggagggggtgtccctctgaggataatagatcgtttattttcctacacttattctaccgcacccacccctgtcatggacaactcacggaacgcacctctcgctggattcggatatggactgcccatttctaggttgtacgccaaatatttccagggcgaccttaacctctactcgctgtctggatacggcacggacgcaataatctacctgaaggccttatcttcagaatccatcgaaaaattgccagtctttaataaatcagccttcaaacactaccagatgagttctgaagccgacgattggtgtatcccctctagggagcctaaaaatctggcgaaagaggtcgcaatgtag

SEQ ID NO: 237565 - DNA, 1614 bp, Artificial Sequence
  Description of Artificial Sequence: Synthetic coding sequence
atgccagcccctacacaactgtttttcccattgattcggaattgcgagctctccaggatttacggcacagcctgctactgccaccacaagcatctctgttgctcctcctcttatatcccgcagtctcggttgaggtacaccccccaccccgcttacgcaactttctgcagaccaaaggaaaattggtggcagtacactcagggcagaagatacgcttccactccccagaaattctatctgactcccccacaggtcaattctatattgaaagccaacgagtatagcttcaaagtgccagagtttgatgggaagaatgtctcatctatcctgggatttgacagtaaccagcttccagccaacgccccaatcgaagacaggcgctccgcagcaacttgcctccagacccgcggtatgctgttaggcgtgttcgacggccacgctggatgcgcgtgttctcaagctgtgagcgagcgcctcttttactacatcgctgtgtcactccttccccacgagacactgctagagatagagaatgccgtcgagtcaggacgagccctcctacctatcttacagtggcacaaacaccctaacgattatttcagtaaggaggccagcaagctgtactttaatagcctccgaacctactggcaggagttgatcgacctgaacactggagagtcaactgatatagatgtcaaagaggccttgatcaacgcgttcaaaaggttggacaacgacatctctctggaggctcaagtgggcgatccaaacagttttttaaactacctggtcttgagagttgccttctcaggggctaccgcttgtgtggcacacgttgatggcgttgatctccacgtggcaaatacaggcgattcccgggcaatgcttggggtgcaggaggaggacggctcctggagtgccgtgacactttctaacgatcataacgcccagaacgagcgggagctcgagaggttaaagcttgaacaccccaagtcagaggccaagagcgtggtgaagcaggataggttacttggtctgttgatgccctttagggcattcggcgatgttaagttcaaatggagtatagacctgcaaaagcgagtgatcgagagcggcccagaccagcttaacgacaatgaatacaccaaattcatcccgccaaactaccacacccccccatatctgacggctgagccagaagttacgtatcatcggctgcgcccacaagataaatttctggtattggccaccgatgggctgtgggaaaccatgcatcgccaagatgttgtacggatcgtaggggagtacctcactggcatgcaccatcaacagcctatcgcggtgggcggatataaagtgacgctgggtcagatgcatgggcttctaaccgaaagaaggaccaagatgagttcagtttttgaggatcaaaatgcagccacccatctaatcagacacgcggtggggaacaacgagttcggcaccgtcgatcacgagcggctgagcaagatgctctctctgcctgaggaactcgcccgaatgtaccgagacgacattacgatcatcgtagtccaatttaacagccacgtggtcggagcatatcaaaatcaggaatag

SEQ ID NO: 237566 - DNA, 1689 bp, Artificial Sequence
  Description of Artificial Sequence: Synthetic coding sequence
atgtgtgtctgtccaggacccaggcggattggcatccctgtgagatccagctccttgccactgttctccgatgccatgccggctccaactcagctattcttccccttgattaggaattgcgagctgtcccgcatttatggcactgcctgttattgccaccacaaacacctgtgttgctcatcctcttatatacctcaatccagattgagatacacaccccatccggcttacgccaccttctgcaggccgaaagagaattggtggcagtatacccaaggtcggagatatgccagcactcctcaaaaattctatctaactcctcctcaagtaaattcaatcctgaaagcgaatgaatactcttttaaggtgcccgagtttgatggaaagaacgtatcttcaatcctcggctttgacagcaatcaactccccgcaaatgcccctatcgaggatcgcaggtccgctgctacgtgcctgcaaaccagggggatgcttttgggtgtgtttgacggacatgctgggtgtgcctgctcacaggctgtgagtgagaggctgttttattatatcgccgtgtcgctgctgccccatgagaccctgctagaaatcgagaatgcagtcgaatcagggagggccctccttcccatcctacagtggcacaaacaccctaatgactacttttccaaggaagcttctaagttgtactttaactctctgaggacgtattggcaggaacttatcgatctgaacaccggagaatcaaccgacattgacgtcaaggaagcactgattaacgcatttaagcgtctggataatgacatttccttagaggcccaagtgggcgatcctaacagttttctgaattaccttgtacttcgcgtcgcattctccggagccacagcctgtgtggcccacgtcgacggcgtcgacctgcatgtcgccaacactggtgactcccgagcaatgctgggagtgcaagaagaggatggctcctggtcggctgtgactttgtctaacgatcataatgcccagaatgaacgcgaactagaacggctgaagttagagcatcctaagagtgaagctaagtccgtggtgaagcaggatagactactcgggctgctcatgccctttcgggcatttggcgatgtgaaatttaaatggagcattgatttacagaagagagtgattgagagtggcccagaccaactgaatgataatgagtatacaaaatttatcccacctaattatcacacccctccatacctaacggccgagcccgaagtgacgtaccatagactgcgaccccaagataagttcttagtgctggctacggacggcctctgggaaactatgcaccgccaagacgtcgtgagaatcgtaggcgagtatcttactggaatgcaccatcaacagccgatagcggtgggaggatacaaggttaccctggggcaaatgcatgggctgcttacggagagaaggaccaaaatgtcttccgtgtttgaggaccaaaatgccgcaacccacctgatccggcacgccgttggcaacaacgagttcggtaccgtcgaccacgagagactttctaaaatgctatctctgcctgaggaactcgcccgtatgtatcgggacgatataaccataattgtggtacagtttaatagccatgtcgtcggggcttaccagaaccaggaatag

SEQ ID NO: 237567 - DNA, 1614 bp, Artificial Sequence
  Description of Artificial Sequence: Synthetic coding sequence
atgccagctcctactcagcttttctttccactgattagaaactgtgaactgtctcggatctacggcacagcctgctattgccaccacaagcatttgtgttgttcgagttcctacattccacagtcgcgattacgatataccccacatcccgcttacgccacattctgccgaccaaaggaaaactggtggcagtatacgcaaggtcggagatacgcatcaacccctcaaaaattttatctcacccctccacaggtgaattccatcctgaaagcaaacgagtattctttcaaggtcccggagtttgatgggaagaatgtgagctccattttggggttcgatagtaaccagctcccggctaacgctcccatcgaagacagacgctctgccgctacctgcttgcagacaagaggaatgttactgggtgtttttgatgggcatgcaggatgcgcctgttcccaggcggtcagcgaaagactgttttactacatcgcggtgtcgctgttgccgcacgagaccctcctggaaatcgagaatgcagtggagtcaggtagggctttgctgccaatcctgcagtggcataagcaccctaacgattacttctcaaaagaggccagcaaactgtacttcaacagcctgagaacatactggcaggagctcattgatcttaatactggcgagtccaccgatatcgatgtgaaggaggcgcttataaacgcttttaagcgcttggataatgacatctcattagaagctcaggtgggggaccctaattctttcctgaactacctggtgctgagggtagcgttttccggagcaaccgcttgtgtggcacatgtggatggggtggacctccacgtggctaatacaggtgactccagagcaatgctcggcgtgcaggaggaggatggctcctggagtgctgttaccctttctaacgaccataatgcacagaatgagagagaactggagcgtctgaagctggagcatcccaaatcagaagccaaatcagtcgtcaaacaggaccggctcctcggcctgctaatgccctttcgggctttcggcgatgtaaagttcaaatggagcatagatttgcagaaacgggttattgaatccgggcctgaccaactgaacgataacgagtacacaaaatttatcccacccaactatcataccccaccttacctcacggccgagcctgaagtaacttaccacagactgaggccgcaggataaatttctcgtgcttgccacagacggactttgggaaactatgcacagacaggatgttgtgagaatcgtgggggagtacttaaccggtatgcatcaccagcagcccattgcagtgggcggttataaagttactctgggccagatgcacggactgctgaccgaacggaggaccaaaatgagcagcgtcttcgaggaccagaatgcggctactcacctgattcgccatgcagtcgggaataacgagttcggaacagtggatcatgagagactgagcaagatgctctcacttcctgaggaactggcccgtatgtaccgcgatgatataactataatcgtggttcagtttaactctcatgtggtgggggcataccagaatcaggagtag

SEQ ID NO: 237568 - DNA, 231 bp, Artificial Sequence
  Description of Artificial Sequence: Synthetic coding sequence
atgcctgcccctactcagctgttttttcctctgataaggaattgtgaactttcacgaatctatggcacggcctgttactgccaccacaaacatctgtgttgctccagctcctacatacctcaatcaagactgcggtacacgccacacccagcctatgctacattctgtagaccaaaagagaattggtggcagtatactcagggcaggagatacgcaagcaccccacagtag

SEQ ID NO: 237569 - DNA, 387 bp, Artificial Sequence
  Description of Artificial Sequence: Synthetic coding sequence
atgcctgctcctacccagcttttctttccattgatcagaaactgtgaactatcgaggatttatggtactgcgtgctattgtcaccacaaacacctgtgctgctctagctcgtatataccacagtcaaggctgaggtacacccctcatcccgcatatgccactttttgccggcctaaagagaactggtggcagtatactcaaggacgcagatacgcttctactcctcagaaattttacctgaccccacctcaggtaaattcgattctcaaagctaatgaatatagcttcaaggtgccagaattcgatggcaaaaacgtgagtagcatccttgggttcgattccaaccaactgccagccaacgcccctatcgaagaccgaaggagctag

SEQ ID NO: 237570 - DNA, 699 bp, Artificial Sequence
  Description of Artificial Sequence: Synthetic coding sequence
atgccagctcctactcagctgttttttccactgattcgcaactgcgagctgtccaggatctacggaaccgcctgctactgccaccacaaacatctgtgttgttcttccagctacatccctcagtctagactgagatacaccccccaccccgcatacgccaccttttgtcgtccaaaggagaactggtggcaatacacacagggacggcgatacgcaagcaccccccaaaaattctacctgacaccacctcaggtcaactccatcttgaaggctaacgaatactcgtttaaggtcccggaattcgatgggaagaatgtgagctctatcctaggcttcgacagtaaccagctgcccgcaaatgcgccaatagaagaccgtcgatcagcagccacctgtctgcaaacccggggtatgcttcttggtgtgttcgatgggcacgcgggatgcgcctgttctcaggccgtatccgaacgtctattttactatatcgcagtctccttattaccccacgaaaccttattggagatagaaaacgccgtcgagtcaggtcgagccttactgcccattctccagtggcacaaacatcctaatgattacttctcaaaggaggcaagcaagctgtatttcaacagtctcagaacatactggcaggaacttattgacctgaacactggagaatccacagacatcgacgtgtag

SEQ ID NO: 237571 - DNA, 219 bp, Artificial Sequence
  Description of Artificial Sequence: Synthetic coding sequence
atgcctgccccaacccagctcttcttcccactgattagaaactgtgaactgtccaggatctacggcaccgcctgttattgccaccataaacacctctgctgctcctcctcgtatatcccgcagtctaggctgcggtacactccccatcccgcatatgccacgttctgcagaccaaaagagaactggtggcagtatacgcaggggcgtcgatacgcatag

SEQ ID NO: 237572 - DNA, 1614 bp, Artificial Sequence
  Description of Artificial Sequence: Synthetic coding sequence
atgccagcccctactcagcttttcttccctcttatccgcaattgtgaactgtccaggatatatggaacggcttgctactgtcaccataaacacctgtgctgttcctcctcatacatcccgcagagcaggctcagatacactccacatccggcatatgcaacattctgccgacctaaggagaactggtggcagtacacacagggcagaagatatgcgagtaccccacagaagttttatcttacaccccctcaggtgaactcaatattaaaggcaaacgaatactcattcaaggtgcctgagtttgacggcaagaatgtgtccagtatactaggtttcgattcgaaccagctgccagcaaacgcaccaattgaggaccggcgtagcgccgctacatgtttgcagacaaggggaatgctgctcggagtgttcgacgggcacgccggatgtgcttgcagccaggcagtctccgagcggctgttctattacatagcagtgtccttacttcctcacgaaacactcctagaaattgaaaatgccgtcgaatccggacgggcactcctccccattctgcagtggcacaagcatcccaacgattatttttctaaggaagccagcaagctatacttcaattccctacgaacgtactggcaggaattgattgacctgaatactggggaaagcacagatatcgacgtgaaagaggccctcataaatgcctttaagagacttgataacgacatttctttagaagctcaggtcggagatcctaattcattcctgaattatcttgtgctgagagttgccttttccggagcaaccgcttgtgtcgctcacgtggatggggtggacttgcacgtcgccaacacaggagatagccgggcaatgctgggagtccaagaggaagacgggtcatggtccgcagtgactctctcaaatgaccacaacgctcaaaacgagcgggaactggaaagactaaagctcgagcatccgaaaagtgaggcgaagtccgtagtcaagcaagatcgtcttctcggtttattaatgcccttcagagcgtttggcgatgtcaaattcaaatggagcatcgacctacaaaaacgtgtgatcgagagtggccctgatcagcttaacgataatgaatataccaagtttatcccccctaattatcatacaccgccttatttaaccgccgagccagaggtgacctaccaccgactgagaccccaagacaagttcctcgttctggcaactgatggcctgtgggagacaatgcaccgacaggacgtggtgagaatagtgggggagtacctgacgggtatgcatcaccagcagcccattgcagtcgggggttacaaagttaccctcggccagatgcacggcttgcttacggagcggcgaactaaaatgtcctctgtctttgaggatcagaatgccgctacgcaccttattaggcatgcagttggtaataatgagttcggaacggttgatcatgaaaggctttccaagatgctgtctctgccggaagaactggctcggatgtaccgggatgacataacaatcatcgtcgtgcaattcaactcacatgtggtcggcgcatatcagaatcaagaatag

SEQ ID NO: 237573 - DNA, 444 bp, Artificial Sequence
  Description of Artificial Sequence: Synthetic coding sequence
atgccagccccaacacagctgttttttcccctgattcgaaactgtgagctgagtcggatctatgggacagcctgttactgccaccataaacacctgtgctgcagctcaagctacattccgcagagtcgccttagatacaccccccaccctgcttacgctacattttgcaggcctaaggagaactggtggcagtacacacagggcaggcggtatgcctcaactccacagaagttctacctcacccccccacaggtgaacagcatactgaaggccaatgaatacagcttcaaggtccccgaatttgatggcaagaacgtctcctcaattctgggctttgactctaatcagttaccggctaatgctcccatcgaagaccgacgctccgcagccacctgtttgcaaactaggggtatgctcctgggcgtctttgacggtcacgcgtag

SEQ ID NO: 237574 - DNA, 1467 bp, Artificial Sequence
  Description of Artificial Sequence: Synthetic coding sequence
atggcagatacgtttctcgagcatctgtgcttgctggatattgattcagagcctgttgcggctagatccacttcaatcatcgcgacgataggccctgctagtcgtagcgttgagcgcctaaaagaaatgatcaaggctgggatgaacatcgctcgacttaattttagtcacggctcacatgagtatcacgccgagtctatcgcattggatacgaagggtcctgaaatcagaactgggatcttgcagggcggtccggagagcgaagtggaactcgttaagggctcacaggtgctggtgactgtggaccccgctttccgcacccggggaaacgccaacaccgtttgggttgactatcctaatatagtgcgcgtggtgcctgtcggaggacgtatatacatagatgacggattaatttctcttgtggtccagaagattggacccgagggcctcgtgacccaggtggagaatggcggtgtgctaggcagtagaaagggagtaaacctgccaggggctcaggtggacttacccggactaagcgagcaggatgtccgcgacctgcgcttcggcgttgaacacggggtggatatcgtgttcgcatccttcgtcagaaaagcatccgacgtggcggcagtgagagcagccctgggccctgagggacatggaataaaaattatttccaaaatagaaaatcacgaaggtgtgaagcggtttgacgaaattctggaggtctccgacggtatcatggtggcacggggtgatttaggtatcgaaataccggcagagaaagtatttctcgctcagaagatgatgatcggcagatgtaatctcgcaggtaagccagttgtgtgcgcaacccagatgctcgagagcatgattaccaagcctagaccgacaagagcagagaccagtgacgttgcaaatgctgtactggacggcgctgattgcatcatgcttagtggcgagaccgccaagggcaatttccccgttgaggcagtgaagatgcagcatgcaatcgctagggaggctgaggcagccgtgtaccacaggcagctttttgaggaactcagacgggctgcacccctgtcacgggatccaaccgaggtaaccgccatcggcgcagtcgaagctgcctttaagtgctgcgctgctgctatcatagtgcttacaaccacagggagatccgctcagctcctgtctagatatagaccacgcgcagctgtcattgccgtcacgagatccgcacaggctgctcgacaagtgcacctgtgccgaggtgtctttccactgctctatagagaacctcccgaggctatatgggccgatgacgtcgacagaagggtgcagtttggtattgaatctggcaagctgcggggttttctgcgagtgggggaccttgtcatcgttgtgacagggtggcgccctggcagcggatacactaacataatgagggtgttgtcaatttcctag

SEQ ID NO: 237575 - DNA, 1725 bp, Artificial Sequence
  Description of Artificial Sequence: Synthetic coding sequence
atgagtattcaggagaatataagcagtctgcaattgagatcttgggtgtctaagtcccagcgcgatctggccaagtctatcctcatcggcgcaccgggaggaccagcaggatacctgcgacgggcttcagtggcccaacttacccaggaactgggcaccgccttcttccagcaacagcagctgccagcggcaatggccgacacgtttctcgagcacttgtgcctactggacattgattccgagcccgtggccgctaggtctactagcatcatcgccacaatcggaccggcatctagaagcgtagagcggctgaaagagatgattaaagctggtatgaacatcgcaaggctcaatttttcacatggatcgcacgaataccatgctgagtccatcgccaacgttcgcgaggcagtcgagtccttcgccggttcccctctcagctatcgtcccgtcgctatcgccttggacacaaaaggacctgaaatccgaacaggaatcctgcaaggcggtcccgagagcgaggtggagctcgtgaaaggttcgcaggtgttagtgacggttgatccagcctttagaaccaggggcaatgccaacactgtgtgggtggactatcccaacatcgtgcgcgtcgtaccagtaggcggaaggatttacatcgacgatggactgatctctcttgtcgtccagaagattggaccggagggcttggtcactcaggtcgagaacggcggagtgctcggatcccgaaaaggcgtgaatctccccggtgcccaggtggacctgccgggactgtcggaacaagatgtcagggacttgcggttcggagtcgagcatggagttgatattgttttcgcctccttcgtaagaaaggctagcgacgtggctgcagtccgagcagccctcgggcctgaagggcacggcatcaaaatcattagcaagattgagaaccacgaaggtgttaaacggtttgacgagatactggaagtgtctgatgggatcatggtggccaggggcgatcttggaattgagatacctgcagagaaggtttttttggctcaaaagatgatgatcggaaggtgcaatctggctggcaagcctgtcgtatgcgcaacacaaatgctagagtccatgattacgaagccccgacccacccgagccgaaacctccgatgtggcaaatgccgttctggacggagctgattgcatcatgctttccggcgagaccgcaaaaggaaattttccagtggaggccgtcaaaatgcagcatgcaatcgcgagggaggccgaagcagccgtgtaccatagacagttgttcgaggagctgaggcgcgctgctcccttatcccgggatccaactgaggtgactgcaatcggagccgtggaagcagcttttaagtgttgcgcagctgctattattgtcctgactaccacaggacgatcagcacaactcctctctcggtatcgacccagagccgctgttatcgctgtcaccagatcagcacaagcagccagacaagtgcacttatgcagaggcgtgtttccgctcttatatagggagccccctgaagccatctgggcagacgatgtcgataggcgtgtgcagttcggtattgaatccggaaagctgcggggattcttaagggtcggagacctcgtgatcgtcgtcactgggtggagaccagggtctgggtataccaacataatgagggtactgtctataagttag

SEQ ID NO: 237576 - DNA, 1632 bp, Artificial Sequence
  Description of Artificial Sequence: Synthetic coding sequence
atggaaggcccagccggttacctacgcagggcttctgtggcacaactgacccaagaactgggcacagctttttttcagcagcagcaactgcctgccgcaatggcagacaccttcctagagcatctgtgtcttctggacattgacagtgagcccgttgccgctagaagcacatcaattatagccacgattggaccggctagcagatccgtggagcgtctgaaggagatgattaaagctggaatgaatatcgccaggcttaacttttcacacggctcacacgagtaccacgccgagtctatcgccaacgtgagggaggcagtagagtcattcgcaggctcccccctgtcataccgccctgtggctattgccctagacaccaagggcccagagatacggaccggaatcctccagggcggtccagaaagcgaagtggaattggttaagggctcccaggtcctggtgacggttgaccctgctttcaggacaagaggcaacgcaaatacggtgtgggtggattaccccaatatcgtgcgtgtggtcccggtaggcggaagaatctatatagatgatggactgatcagtctggtcgtacagaaaatcggccctgagggcctcgtcacccaggtggagaatggcggtgttctcggaagccgcaagggagtaaatcttcctggagcccaggtggatctgccgggtttatccgagcaggatgtaagggatctgcgctttggggtcgagcacggggtcgatattgtgtttgcgagtttcgttcgcaaggcctccgacgtggctgctgttagagctgccctgggaccggaagggcacgggattaagatcatctcaaaaatcgaaaaccacgagggggtgaagagattcgatgagatcctcgaagtatccgacggcataatggtggcaaggggcgatctaggtatagaaatccctgcagagaaggtgtttctcgcacagaaaatgatgatcggacggtgtaacttagccggtaagcccgttgtttgcgctacccagatgcttgaatcaatgataactaagccacgccctacgagggccgagacaagcgatgtcgcaaatgccgttctcgacggggcagactgtataatgctctcaggagagaccgcaaagggaaattttcccgtggaggctgtgaaaatgcaacatgcgatcgcacgagaagctgaggccgcagtgtaccaccgccaactgttcgaggagcttaggcgggctgctccattgtcccgcgaccccacagaggttacagctattggagctgtggaagccgcatttaagtgctgtgcggctgccataatagtcctcacgactacagggaggagtgcgcagctgttgagccgttacaggccccgtgctgctgtgattgccgtgaccagatccgctcaggcagccagacaagtccatctttgccgcggtgtttttccgcttctgtacagggagcctcctgaagcaatttgggctgacgatgttgaccggagggtacagtttgggatcgagagcggtaagttacgagggtttctgcgcgtcggggacttggtgattgttgttactggctggcgtccaggatcggggtatacgaacatcatgagggtgctgtcaatatcatag

SEQ ID NO: 237577 - DNA, 1800 bp, Artificial Sequence
  Description of Artificial Sequence: Synthetic coding sequence
atgtccatccaggaaaacatatctagcctgcagctcagaagctgggtttctaaaagtcagagggatttagccaagtccatcctcatcggtgcgccaggggtgccacttacgacacagcagtgtggggctgacccacagcgtggcagacctcgcgaagtatgttctggaatggaaggacctgcaggatatctcaggagagcatccgtggcacagctcacccaggaattagggactgcctttttccagcagcagcagctccccgctgccatggctgacacctttctcgagcacctgtgcctgctggatatcgattcggaacctgtggccgctagatccacttccattatcgcgaccattgggcctgcctccagaagcgtcgagagactgaaagagatgataaaggcagggatgaacatagctagactcaattttagccacggctcccatgagtatcatgccgaatccattgcgaacgttagagaagcagttgagagcttcgctggcagtcctctctcatataggcctgtggcgattgctcttgataccaagggcccagaaattaggacgggcatcctccaggggggacctgaaagcgaggtggagctggtgaaaggctcacaggtactggtgacagttgatcccgctttcagaactagagggaatgcaaatacggtgtgggtggattaccccaacatagttcgggtcgtccctgtgggtgggcgtatctacattgatgacggactcatttcgctggttgtgcagaaaataggccctgaaggtctcgtcacacaggtggaaaacggcggtgttctgggatccagaaagggggtgaatctccctggagcccaagtggatttgccgggactgtccgaacaggacgtcagagacctgagattcggagtagagcatggggtggacatcgtatttgccagcttcgtgagaaaggcaagcgacgtcgcggcagtgcgggctgctctgggtcccgagggtcacggcattaaaataatctccaagatagagaatcacgagggggtcaagagatttgatgaaatcttggaggtctccgatggaatcatggtggctcgcggagatttagggatcgagattcccgcagaaaaagtgttcttggcacagaagatgatgattggtcgttgtaacttagcaggaaagcccgtggtgtgtgctactcagatgctagagtcgatgatcaccaaaccccgtccgacccgcgctgagacttccgacgtcgctaacgcagtgctggatggcgctgattgcattatgttgtcgggcgagaccgccaaagggaattttccggtggaggctgtcaaaatgcagcatgcaatcgcgagagaggccgaggccgctgtctatcaccggcagctttttgaggagctgcggagagccgctcccctgtcccgcgaccccaccgaagttactgcgatcggtgctgtggaggccgctttcaagtgctgcgccgctgccataatcgtgctcacaacgactggtagatcggcccaactcctttccaggtacaggcctagggcagccgtgatagctgtgactagatcagctcaggcggcacgtcaggtgcatttatgccgaggtgtgttccccctcctgtacagggagcctcctgaagccatctgggcagatgacgttgatcgtagggtccagtttggtattgagtctggcaagctccgtggcttcttgagggtgggcgatttagtcatcgtcgtcacaggctggcgtcccggttccggttatacgaacatcatgagggtgctctccatttcttag

SEQ ID NO: 237578 - DNA, 1596 bp, Artificial Sequence
  Description of Artificial Sequence: Synthetic coding sequence
atgagcaaaccgcactctgaggcaggaaccgcttttatacagacccagcagctccacgcagcaatggctgataccttcttagagcacatgtgtaggctggacattgatagtccccctatcactgccagaaacactggcatcatttgcaccatcgggcctgcctccagatcagtcgaaactctcaaggagatgataaaatctggcatgaacgtcgcccgactgaactttagccacgggactcacgaatatcatgcggagacaataaagaacgtgaggacggctaccgagtcctttgccagcgatccaatactctatcgcccagtcgctgtggcacttgacacgaagggacctgagataagaacaggcctgattaaaggatcgggtacggcggaagtggagctgaaaaagggagctaccctgaagattaccctcgataatgcttacatggaaaagtgtgacgaaaacatcctctggctcgattataagaatatttgcaaagtggtcgaagttggctcaaagatatatgtcgatgacggcctgatttctctgcaggtgaaacagaagggagccgatttcctggtgaccgaggtcgaaaatggcggtagtttgggatcaaaaaaaggagtgaatctcccgggagccgctgtggatctaccagccgtgtccgagaaggatatccaggacctgaagttcggcgtggaacaggacgtggacatggtgtttgcctcctttattcgaaaggccagcgatgtgcacgaggtgagaaaggtactgggtgagaaaggcaagaacatcaaaatcatctcgaagatcgagaatcatgagggagtccgtcggttcgatgaaatactggaggcctctgacggaataatggtagcacgaggggacctggggatcgagataccagcagaaaaggttttcttggcccaaaaaatgatgatcgggcgttgcaatcgggcaggcaaacctgtgatttgcgccacccagatgttggagtcaatgataaaaaaaccccgtcctacgcgggctgagggcagcgacgttgcgaatgcggtgctggatggagcagattgtatcatgctcagcggagagactgcaaagggagactatcctctggaggcagtgagaatgcagcacctgatagcccgagaggccgaagcagccatgtttcaccgaaaactttttgaagaactggtcagagcttcaagccacagtactgaccttatggaggccatggccatgggcagcgtcgaagcgtcctacaagtgtcttgccgctgctttgatcgtcctcacggaaagtgggcgttcagcacaccaagtcgccagatataggcccagggcgccaataatcgccgtcacccggaatccacagactgcaagacaggcccacctttatcggggaatattccctgtgctctgtaaagatcccgtgcaagaggcatgggctgaggacgtcgacttacgcgtcaacttcgcaatgaatgttggcaaagccagaggcttttttaaaaaaggtgacgtggttatagttctcacaggctggcgccctggctcgggattcacaaacaccatgcgtgtcgtcccagtgccttag

SEQ ID NO: 237579 - DNA, 1101 bp, Artificial Sequence
  Description of Artificial Sequence: Synthetic coding sequence
atgtctaaaccacactcagaagccggaactgcatttatccagacacaacagttgcacgccgctatggcagacacattcttggagcacatgtgccggcttgacatcgatagccctcccataaagaaaggcgttaacctccccggtgccgctgtggacctgccagctgtatctgaaaaggacattcaagacttaaagtttggcgtggaacaggacgtcgacatggtgttcgcttcattcatccgtaaagcctctgacgtccacgaggtgaggaaggttcttggcgagaagggcaagaatatcaagattatcagcaagatcgagaatcacgaaggcgtgaggcgcttcgacgaaatactggaagcctcagatgggattatggtagccaggggagaccttggaatcgagattcccgctgagaaagttttcctagcacagaaaatgatgatcggtcggtgtaatagggcaggcaagcctgtcatctgcgctacacaaatgctcgagtccatgatcaagaagccaaggcctactagggccgagggctcagacgttgcaaacgcggtgttggacggcgcagattgcatcatgctttccggcgagaccgccaaaggggactatccgctggaggctgtgcgaatgcaacacttgatcgcacgcgaggctgaagctgctatgttccatcgcaagttattcgaggaactggtacgagccagctcgcattccacagatctgatggaggccatggccatgggatccgttgaggcctcctataagtgtctggcagcagccctcatagtactcaccgagagcggcaggtccgctcatcaagtcgcacgctatcgaccacgtgccccaatcatagcagttacccgtaatccacagacagccagacaggcccatttataccgtgggatctttccggtcctatgcaaagatcccgtgcaggaggcctgggctgaggacgtagaccttagggtgaattttgcgatgaatgttgggaaagccagaggatttttcaagaagggagacgttgtgatagtgcttaccggctggcgacccggatccggatttactaacactatgagagttgtcccagtgccgtag

SEQ ID NO: 237580 - DNA, 1596 bp, Artificial Sequence
  Description of Artificial Sequence: Synthetic coding sequence
atgtcaaagccacattccgaggccggtaccgctttcattcaaacacagcagttgcatgcagccatggccgacacctttttggaacacatgtgtcggttggacatagactctcccccaatcacagcccgtaataccgggatcatctgtacgattggaccggcttcccgatccgttgaaaccctgaaggaaatgatcaagagcggcatgaacgtggcacgccttaactttagtcacggcacccatgaatatcatgctgaaaccataaagaacgtcaggaccgctacggaatcattcgctagtgaccccatcctctaccgccctgttgcagtcgctcttgatactaaaggccctgaaatccgcaccgggctaatcaagggcagcggtacggcggaagttgagctcaaaaagggagcaacactgaagatcacacttgacaacgcctatatggagaaatgcgacgaaaatattttgtggctcgattacaagaatatatgtaaggtggtggaggtgggcagcaaaatttacgtggacgacggattgattagccttcaagttaagcagaagggggctgactttctcgtcactgaggtcgagaatggtggatcgctgggtagcaaaaaaggtgtcaacctgcccggagcagccgtcgatcttcctgccgtatccgagaaagatatacaggatctgaaatttggagtggagcaagacgttgatatggtgtttgcatcattcattaggaaggcctctgacgtgcatgaagttcgtaaggtcctgggtgagaaggggaaaaacattaagattatctctaagatcgaaaaccacgagggcgtaagacgcttcgacgagatcctggaagccagtgacggaataatggtagcacggggtgacctggggatcgagattccggctgaaaaggtctttctggcccaaaagatgatgattgggagatgcaatcgcgcaggaaagcccgttatctgtgcaacgcagatgctggaatcaatgatcaaaaaaccaagacccacgagggccgaaggcagcgacgttgccaacgccgtattagatggggcagactgcatcatgctgtcgggtgaaacagccaagggagactaccctctcgaggccgtgcgaatgcagcatctgatcgctcgcgaggcagaggccgctatttatcacctccagctctttgaagagttgaggaggttggcaccaattacgtctgaccctacagaagccacagcggttggggcagtggaggcttctttcaaatgctgttctggtgcaatcatagtactgaccaaaagcgggcgaagcgctcaccaggtagcgaggtaccggccaagagcccctattattgcagtgactcggaatccccaaaccgcgcgacaggcacacttatatcgtgggatattccccgtcctttgcaaagatccggtacaagaggcctgggctgaagatgtggatctccgcgtaaatttcgcgatgaacgtgggaaaggcacgcggattctttaaaaaaggcgatgttgtgatcgttctgaccggttggcgcccaggcagcggttttactaatactatgcgagtcgtcccggtcccctag

SEQ ID NO: 237581 - DNA, 1596 bp, Artificial Sequence
  Description of Artificial Sequence: Synthetic coding sequence
atgagcaaaccccattctgaggctgggacagcatttatccagacacagcagctccacgccgctatggccgacacatttctcgagcatatgtgtagattggacatcgatagtcctccaataactgctagaaacactggtattatctgcaccatcggaccggcaagtaggagtgtggaaaccctcaaggaaatgatcaagagcggtatgaatgtcgcacgacttaatttctcccatggaacacacgagtaccatgcggagactatcaaaaacgtgcggactgccaccgaatcattcgcaagtgaccccatcctgtatcggccagttgcggttgccctggatactaaaggacccgagatccgcacaggcctgattaaagggagcggcacagctgaggttgaattgaagaagggcgcaacactcaagatcacactcgataatgcttacatggagaagtgcgatgaaaatatcttgtggctggactacaaaaatatctgcaaggtcgtagaagtgggtagtaagatttacgttgatgacggcctgattagcttgcaggtgaaacagaaaggcgctgacttcctggtaaccgaagttgagaatggtgggtcattgggttccaagaagggagttaatttgcctggagctgccgtcgacctaccagcagtgtctgaaaaggacatccaggacctgaagttcggggtggagcaggatgtcgacatggttttcgcctctttcatcaggaaagcctctgacgtccatgaggtgagaaaagtgctcggcgagaagggcaagaatatcaagatcatcagcaagatcgaaaatcatgaaggggtgcgacgcttcgacgaaatattagaagcatctgacggaattatggtcgccaggggcgacctgggcatcgaaatccccgcagaaaaggtgttcctcgcccagaagatgatgattggtagatgtaatcgagccggaaaacccgtgatctgtgcaactcaaatgctcgagagcatgattaaaaaacctcggcctacgcgggcagagggatccgacgtcgctaatgctgtgctggacggagcagactgtattatgttatcgggcgagactgcgaagggtgattacccccttgaggccgttcgaatgcagcatctaatagcacgggaggccgaggcggcaatgttccatcggaaactcttcgaggaactcgtccgagctagttcacatagcaccgacctcatggaagccatggccatgggtagcgtcgaagcatcttacaagtgccttgctgcagcactaattgtccttactgaaagtggacgtagtgcccaccaggttgccaggtaccggcctagggctcccattattgcggtcaccagaaatccccagacagcacggcaggctcacttatatcggggtatcttcccagtgctgtgcaaagacccagtgcaggaggcgtgggcagaggacgtggacctgcgcgtgaacttcgctatgaacgtgggaaaggcaaggggatttttcaagaagggtgacgtggtcatcgtactgacgggctggagaccgggaagtggcttcaccaataccatgcgagtggtccctgttccatag

SEQ ID NO: 237582 - DNA, 1377 bp, Artificial Sequence
  Description of Artificial Sequence: Synthetic coding sequence
atgtcaaagcctcattcagaagcaggaacagcctttattcaaacccaacaactccacgctgccatggctgacacatttctggagcacatgtgtcggctagacattgacagtccacccatcacagcccgaaataccgggatcatctgtaccatcgggcctgcaagtcgttccgaggtggagctcaagaaaggagccaccttaaagattactctggacaacgcttacatggagaaatgcgacgagaatatactctggctggattataaaaatatttgcaaagttgtcgaagtcgggagtaagatttatgtggatgacggactgatctccctgcaagtgaaacagaagggagccgactttctggtgacagaggtcgaaaatggtggatcgctcggaagcaaaaagggggtaaacctgcccggagccgctgtggatctgcccgcagtcagtgagaaagacattcaagatctgaagttcggagtggagcaggatgtagatatggtcttcgcatctttcatccgaaaggcgtccgatgttcatgaagtacgcaaagtcttaggagagaaggggaagaatattaaaatcattagcaaaattgaaaaccatgagggagtgaggcgatttgacgaaattctagaggcgtctgatggcataatggtggcaaggggtgatctaggcattgaaattccagctgagaaagtatttcttgctcagaagatgatgatcgggagatgcaatcgcgcaggtaaacctgtcatctgcgctacacagatgctcgagagtatgataaaaaagccccgtcctactcgcgctgaagggtctgacgtcgcaaacgctgtattggatggggcagattgtattatgctttcaggcgaaacagcaaagggcgattaccccctggaagctgtccgcatgcagcatctgattgcaagagaagccgaggcagcaatttatcatttgcagttattcgaagagttgagacgccttgcccctatcacctctgatccaaccgaggccaccgccgtaggggctgttgaagcaagctttaagtgttgctctggagctattatcgtcctgaccaaaagcggcagaagcgcccaccaggtggctagatacaggccaagagcaccgatcatcgccgtaacaagaaacccacagacggccaggcaggcacacttgtatcgaggcatctttcccgtattgtgcaaggaccccgtgcaggaagcctgggcggaagacgtggacctgagagtaaacttcgccatgaacgtgggaaaggctcggggtttctttaagaaaggtgacgttgtgatcgtattgacagggtggcgacctggctcgggatttaccaacactatgcgagtcgtgccagtgccatag

SEQ ID NO: 237583 - DNA, 1551 bp, Artificial Sequence
  Description of Artificial Sequence: Synthetic coding sequence
atgagcccagaagcccagccacagcgtactaagggcccacagcagccttgccggagccccatcgtgaagcccggtctgcccagcttccgacctagcagttgtacccagccctggctgacgcattcttggtccacttgtgctgcatggaccctcatccaccacccatcccaacccggaacattggcttcgtccgtgccgctataccacgctgagaccatcaagaacgtgaggacagccaccgagagcttcgctagtgatccaattctgtatcgccctgtggccgtggcacttgacaccaaagggccagagattaggactgggctgattaaaggaagtgggaccgctgaggtggagctgaagaaaggggcaacactaaagatcaccttggataacgcatacatggaaaagtgcgacgaaaacattctctggctcgactataaaaacatctgcaaagtggtggaggtggggtccaaaatatacgtcgacgatgggcttattagtctgcaggtcaagcaaaagggcgcagacttcctggttactgaggtagagaacggtggttccctaggcagcaaaaaaggggtgaatcttccaggtgctgcggtggatctgcctgcggtcagcgagaaggacattcaagatttgaaatttggagtcgagcaggatgtggatatggtgttcgcctcattcattcggaaagccagcgatgtacacgaagtgcggaaagtccttggtgagaagggtaaaaacatcaagatcatatccaaaatagagaatcacgagggcgtgaggcgcttcgatgagatacttgaagcttctgacggaatcatggtggcacgtggcgacctggggatcgagataccggctgagaaggttttcctcgcacagaagatgatgatcggtcggtgtaaccgggctggaaagcccgtgatttgcgctacccagatgctcgagagtatgataaagaaaccccgacctacgagagctgaggggagcgacgtggccaatgcagtgctggacggcgcagattgcatcatgctctcaggggagaccgccaagggcgattacccattggaggcagtccgaatgcagcacctgatcgctagagaggcagaagctgccatttaccatcttcagctttttgaggagttgcgtcgcctcgctcccattacctctgatccgacagaagctaccgctgtgggtgccgtggaggcatcatttaaatgctgctccggggctatcatcgtgctgaccaaaagcgggaggtcagctcaccaggtcgccagatatcgccctagggcccctataatagcagtgacgcgcaacccacagacagccaggcaggctcatctgtaccggggaatcttccctgtcctctgcaaggatccagtgcaggaggcctgggctgaggacgtagatttgcgagtgaacttcgccatgaacgtgggcaaagccaggggtttcttcaagaagggcgatgtagtgattgtcctgacggggtggcggccagggtcggggttcactaatacaatgagggtagtccccgtcccttag

SEQ ID NO: 237584 - DNA, 1212 bp, Artificial Sequence
  Description of Artificial Sequence: Synthetic coding sequence
atggccggtgcggctacccaggcgtcactggaaagcgcccctcggattatgcggctggtcgctgagtgcagtcgatctcgggctagagccggtgagctttggctgccacacggcaccgtcgccaccccagtctttatgccagtcggcacccaggctactatgaaaggaatcacaacggagcagctcgatgccttaggttgtaggatttgtcttggcaatacctaccatctggggctgcggccaggcccagagctcatacaaaaagcaaatgggctgcacggctttatgaactggccccacaatctgcttacggattctggtggcttccagatggtgtccctggtttcactgagcgaggtgaccgaagagggtgttcgcttccgctctccttatgatggcaacgaaaccctgttgtcccccgagaaaagcgtccaaatacagaacgcgctgggtagtgatatcatcatgcagcttgatgacgttgtgagcagtaccgtaacgggtccaagagtggaagaggctatgtacagatccattcggtggcttgataggtgtatcgccgcacaccaaaggccagataaacagaatctattcgctattattcagggaggtcttgacgccgatctgcgagcaacttgtctggaagaaatgactaagcgcgacgtcccgggattcgccattgggggtttgagcggcggagaatctaagagtcagttttggaggatggtcgctctcagcacctctcggctgccgaaggataagccacgctatctgatgggcgtcggatatgccaccgatctggtggtgtgtgtagcactaggatgcgatatgttcgactgcgtcttcccaacccgtaccgcgaggtttggatccgctctagtgccaacaggcaacctgcaactacgaaagaaggttttcgaaaaggattttggacctattgatccagaatgcacatgtccaacgtgccagaagcactctcgagcatttttacacgctctcctccactccgataacacagctgctctgcaccatctcacggtgcacaacattgcatatcagttacagcttatgagcgccgtgcggacatccattgtagagaagcgatttcccgattttgttcgtgatttcatgggtgccatgtatggagaccccaccctttgccctacatgggctaccgacgcgctcgcctctgtggggatcacgttgggctag

SEQ ID NO: 237585 - DNA, 678 bp, Artificial Sequence
  Description of Artificial Sequence: Synthetic coding sequence
atggctggcgcagcgactcaggcctcactggagagcgcccctcgaattatgcgcttagtcgctgagtgcagtagatcaagggccagggcgggagagctgtggttgccccacggaactgtggccacaccagtgtttatgcccgttggaacccaggccaccatgaaggggatcacgaccgagcagctggatgctttggggtgcagaatctgtctcggaaacacctatcacctggggctccgtccagggcctgagcttatacagaaggctaacggcctccatggctttatgaactggccacacaacctcctaacggacagcgggggatttcagatggtttccctggtcagcctcagcgaggtgactgaggaaggtgtcagattccgcagcccctatgacggcaacgagaccctgcttagccctgagaagagtgtccagattcaaaacgctcttggttcagacatcattatgcagctggatgatgttgtcagctccacagtaacaggccctcgggtcgaagaagctatgtatagacccctgggactagtgaccggggctctccttcaagtgaacccattggccggaccggttcactgttcaccttccgcggctggacaggccgagccactgcgccattacccaggttgggccggaaggagatctccaggtcatctgccttag

SEQ ID NO: 237586 - DNA, 2097 bp, Artificial Sequence
  Description of Artificial Sequence: Synthetic coding sequence
atggccgctgctggcgctgccgtcgccagatccccaggtatcggggctgggcctgcccttcgtgcaaggagatcaccacctcctcgagccgctcgcctgcccagactcctggtcttattagcagctgcggctgtagggcctggtgcgggtggggcagcacgattgtatagggctggcgaggacgctgtttgggtgctggattcaggctcagtgcggggtgccactgctaactcctcagcagcgtggctcgtgcagttttattccagctggtgtgggcactgcatcggctacgccccaacttggcgcgctctggccggagatgtgagagattgggcctctgccattagggtagcagccctcgattgcatggaggaaaagaaccaagcagtctgtcatgattatgatatccatttttacccgacctttcgatacttcaaggctttcacaaaggagtttacaaccggtgagaattttaagggtccagaccgagagctgaggacagtgagacagacaatgatcgactttctgcagaaccacacagaaggctcacgtcccccagcctgccccagactcgatcccattcaaccttcggacgtgctgtctctcctggataatagagggtcacattacgtcgctatagttttcgagtctaattcctcatatctgggtagagaagtgattctcgatctgattccatacgaaagcatagtggtaacacgagcgttagacggagataaggctttcctggaaaaactcggcgtgtcttccgttccatcgtgttatctgatttatcctaacggcagccacggcctgatcaacgttgtaaaacccctcagagctttcttcagtagctatctcaaaagtctgccagatgtcagaaaaaaatccttgccccttccggagaaaccacataaggaagaaaactcagagatagtggtttggagagagttcgataagtccaagctctacaccgtggatctcgaatccgggctgcattacttgctgagagtggagctcgcagcacacaagtcacttgccggtgcggaactgaagacactcaaggactttgtaaccgtcctggctaagctctttcccggacggccacccgtaaagaagctcctggaaatgctccaggagtggctagcatccttgccactcgacagaatcccttataacgcagtactggacttggtgaataacaagatgaggatctctgggattttcctgaccaaccacattaagtgggtgggatgtcagggcagtcggagcgaactccgaggttatccatgcagtttgtggaagctgtttcacacactgaccgtggaggcgtccacacaccctgacgccctagttgggacaggcttcgaagatgatccccaggcggtactgcagactatgcggcgttatgtgcatacgtttttcggatgtaaagaatgtggcgaacacttcgaggagatggctaaggagtcaatggattccgtgaaaaccccggaccaggccatcctatggctgtggaagaagcataatatggtgaatggtcgcctagctggccacctatccgaggaccctcggttcccaaaactgcagtggccaaccccagatttgtgtcccgcatgccatgaagagataaaaggcctggcctcctgggacgagggtcacgtcctaacctttctcaaacagcactatggccgtgacaacctgctcgacacctactcagcagatcagggggacagttccgaaggaggcacactggccagaggggaggaggaagaaaagagattgactccaccagaggtcagccatggtgatcgggacacacagagcgtcagacctccaggagcactcgggcctcgccctgctctgcctgaatctctccaccattctctggacggaaaactgcaatctctggacgggcctggcgctcataaagaagtcggaggggcagctccattcctgggtgtcgacttcagcagcctggatatgtcattatgtgtggtgctgtacgtggcgagttcacttttcttgatggttatgtatttctttttcagagtacgcagccgacggtggaaagttaagcatcaccacccagccgtgtag

SEQ ID NO: 237587 - DNA, 948 bp, Artificial Sequence
  Description of Artificial Sequence: Synthetic coding sequence
atggaggagaaaaaccaagcagtgtgtcacgattacgatattcacttctaccctacgtttagatactttaaagccttcacaaaggaatttactactggagagaatttcaaagggccagatcgagagttgcggacggtcaggcagacaatgattgattttcttcagaatcatacagaagggtcacgcccacccgcttgccccaggctcgacccaattcacgtgaaaccgctgcgagcttttttctctagctacctgaagtcattgcccgacgtgagaaaaaaaagccttccccttcccgaaaagccccataaggaagagaactctgaaatagttgtatggcgcgagtttgataagagtaagctttatacagtggacctagaaagcggtttgcactacctgttgagggtcgaactagcggctcacaaaagtctagctggtgctgagctgaaaacactgaaggatttcgtaacggtcctggccaagctctttccgggaaggccgcctgtcaagaagctgcttgaaatgctgcaggaatggctggcttccctgcccctggaccgaattccatataatgccgtgctcgacctggttaataataagatgaggatctccggcatcttcttaacaaatcacataaagtgggtggggtgccaaggctcccgctccgagttaagaggctacccatgttctctttggaaactatttcatactctgactgtcgaggccagcacccatccagatgcccttgttggaacaggcttcgaggacgacccacaggctgtgctccagaccatgcggcgttacgtacacaccttcttcggatgtaaggagtgcggcgagcacttcgaggagatggccaaggaatcgatggacagcgtaaaaacaccagaccaggcaatcctatggttgtggaaaaaacataacatggtgaatgggaggctcgcatag

SEQ ID NO: 237588 - DNA, 735 bp, Artificial Sequence
  Description of Artificial Sequence: Synthetic coding sequence
atggctgccgctgcagctgcaggagaagctcgtcgagtattggtgtacggcggacgcggagctttgggatcacgctgtgtccaggcatttcgtgcacgcaactggtgggtcgcgagtgtggacgttgttgagaatgaggaggcgtctgcctccataatcgttaaaatgacagattcttttactgagcaagcggatcaagtaacggccgaggtgggaaaattacttggggaggaaaaggtagatgccatcctctgtgtagctggcggatgggccggaggaaacgctaagagcaagtcacttttcaagaattgtgacctgatgtggaagcagtcaatatggaccagtaccatctcctctcaccttgctactaagcacctcaaggagggcggactgctcaccctggccggagcgaaggcagcactggatggcacccccggtatgatcggatacgggatggccaaaggagcagtccatcaactgtgccagtcactcgctgggaagaatagcgggatgcccccaggagccgcagcaatcgccgtcctgcccgtgacgctggatacacccatgaatcggaagtccatgcccgaagccgacttttccagctggacccctctggagtttctggtcgagacctttcacgattggatcacggggaagaaccggccatctagtggatctcttatccaggtcgtgaccacggaggggaggacagagctgacccctgcctatttctag

SEQ ID NO: 237589 - DNA, 681 bp, Artificial Sequence
  Description of Artificial Sequence: Synthetic coding sequence
atggctgccccactgctccacacccgactgcctggggatgctgccgcttctccaagcgcagtgaagatgttgggagctagccgaacaggcatctcaaatatgagagctctggaaaatgatttttttaactctcctcccagaaaaacagtacaattcgggggaaccgtaactgaagttctgctcaagtataaaaccggagagacaaacgatttcgagctccttaaaaatcagctcttggacccagacatcaaggatgaccaaattatcaattggctattagagttccggagctctatcatgtacctgacgaaggatttcgagcagctcatttctattattctgcgcctcccttggctgaatagatcccagacagtggtggaggagtatcttgcttttcttggtaacctggtgtctgcccaaacagtttttttgcgaccctgcctgagtatgatcgctagtcattttgttcctcccagagtaatcattaaagagggggacgtcgacgtgagcgactccgatgacgaagatgataacctgccagcaaacttcgacacaagtcagagcctcgctaacaactccaagatctgtacaatcgataccgtagtaagccacgcaaataccggaggcaagatcagcatctgttcgaagataagggagaataccggcatgttgaggagctag

SEQ ID NO: 237590 - DNA, 894 bp, Artificial Sequence
  Description of Artificial Sequence: Synthetic coding sequence
atggatgctgaaggattggcacttctgttgcccccagtcactttggccgctctagtggattcctggctgcgagaggactgtcctggactgaattacgcagctttggtgagcggggctggcccttctcaagcagccctctgggcaaagagtccaggggtcttagccggacagcccttttttgatgcaatttttacccagctaaactgtcaggtgtcttggtttctgccagagggctctaaactggtgcctgtggcccgtgtcgctgaggtgcgaggccctgctcattgccttctgcttggtgagagggtggcccttaataccttggctagatgcagcggcattgctagcgcagccgcagcagctgtggaggcggcacggggtgcgggttggacaggacatgtagcaggtacccggaagactacccccggtttccgtctcgtggaaaaatatggcctcttggtcggcggagccgcatcccacaggtatgatctggggggattggtaatggtgaaggataatcacgttgtcgcagcgggaggagtggaaaaagccgtgagagccgcaagacaggccgcagacttcactctgaaggtggaggtcgaatgcagtagtctgcaagaagctgtgcaggcagctgaagccggtgctgatctcgtgttgttggacaacttcaagccggaagagctccacccaaccgccacagttctgaaagcgcagttcccaagtgtggcggttgaggcttccgggggaattacattagacaacctcccacaattctgtggtcctcacatcgacgtaatcagcatgggaatgctcacacaggctgcccctgccctggacttctccctgaagcttttcgcaaaagaagtcgcacctgtgcctaagatccactag

SEQ ID NO: 237591 - DNA, 498 bp, Artificial Sequence
  Description of Artificial Sequence: Synthetic coding sequence
atggatgctgagggccttgctcttcttctgccacctgtgactctcgcggctctcgtggactcgtggctcagggaagattgtccagggctcaactatgccgcactagtgtcaggcgctggtcctagccaagcggcattgtgggccaagtctccgggagtattggctggccagcccttcttcgacgccatctttactcagctgaattgccaagtttcttggttccttccagaaggaagtaagttagtacccgttgccagggttgctgaagtaagagggcctgcacactgtttattactcggggaacgagtcgccttaaacacgcttgcccgttgcagcggtatcgcatcggccgcagctgccgctgtcgaggccgctcgcggagccggatggaccgggcacgtggccggtaccaggaaaaccaccccgggtttcagactcgtggaaaagtatgggcttctcgtgggcggtgcggcatcccaccggtacgatctcggatag

SEQ ID NO: 237592 - DNA, 2154 bp, Artificial Sequence
  Description of Artificial Sequence: Synthetic coding sequence
atggcagtagccgtacggaccctccaagagcaactcgaaaaagccaaagagagcttaaaaaacgtcgatgaaaatattcgcaagctgaccgggcgtgatcctaacgatgttcggccaatccaagcaaggcttctggccctctcaggcccagggggtggacgcggacgcggtagtttactcctcagacgaggattttctgattctggagggggtcctcctgccaagcaaagggatctggagggagcagtgagcaggctagggggtgagagacggactagaagagagtcaaggcaggagagtgatcctgaggatgacgatgtgaagaagcctgcccttcaaagcagtgtagtcgcgacaagcaaggagcgaacacggagggacctcattcaagaccagaatatggacgagaagggaaaacagagaaatcgtcgtatattcggtcttctaatgggtaccctccagaaattcaaacaggaatccaccgttgcgaccgagcggcagaaacgtcggcaggaaattgagcaaaagttggaggttcaggccgaggaggagagaaagcaggtagagaatgaaaggcgggagctgttcgaggagaggagggccaaacagaccgagctccggcttctggagcagaaagttgaactagcacaactgcaggaagagtggaacgaacataacgcaaaaatcatcaaatatatccgaacgaaaaccaagcctcacttgttctatattcctgggaggatgtgccccgctactcagaagcttatcgaagaatctcaacggaagatgaacgctttgtttgaagggagacgtatagagtttgccgaacagatcaataagatggaggcccgacccagacgacagtctatgaaagaaaaggagcaccaagtggttaggaacgaagaacagaaagctgaacaggaagaggggaaggtggcccagcgtgaagaagagttggaggaaacaggcaaccagcacaatgacgtggagatcgaagaagctggtgaggaggaagagaaggaaatcgccatcgtgcacagtgacgcagagaaggagcaggaggaggaggagcaaaagcaggagatggaggttaagatggaggaagaaacagaagtgcgggagagtgagaaacagcaggactcgcagccggaggaagtcatggacgttttagaaatggtcgaaaacgtaaagcatgtgatcgccgatcaagaggtgatggagacgaatcgagttgagtccgttgagccgtctgagaatgaagctagtaaggagcttgaacccgaaatggaatttgaaatcgagcccgacaaggaatgtaagacactttctcctgggaaggagaatgtctcggccctcgatatggagaaggagtccgaggagaaggaggaaaaggagtcagaaccgcagccagagcctgttgcccaacctcagcctcaatcccaacctcagcttcagctgcagtcacagtcgcagcccgttctgcagtcccagcccccatcacaacccgaggatctgtcattggccgtgttgcagccaaccccccaagtgacgcaagaacagggccacctgctacctgaaaggaaggacttccctgtggagtctgtcaaactgaccgaggtgcctgtggagcccgtgctgaccgttcaccccgagtcaaagtctaagactaagactcgctctagatcacgagggcgtgcccgaaataaaacctccaaaagccgatcccgctcttcttcatcctcatccagcagctcatcgagtacttcaagcagctcgggatcatcctccagtagcggaagcagttcctccagaagctccagtagttcatcctcttctacctctgggtcttcctcccgggactctagttccagcacctcatcctcatcagaatctcggtcaagaagccggggacgtggtcacaatagagatcggaagcacaggcggtctgtggaccggaagcgacgggatactagcggcctggaaaggagtcataaaagctctaaaggaggttcctcccgggacaccaaaggcagcaaggataaaaactcaaggtccgaccgaaaaagatcgatctctgagtcgagcagaagcggcaaacggagcagcagatccgagagggatcgaaaatccgataggaaggacaagcgcagatag

SEQ ID NO: 237593 - DNA, 1704 bp, Artificial Sequence
  Description of Artificial Sequence: Synthetic coding sequence
atgcacggcaggttaaaggtgaagactagtgaggaacaggccgaagcaaaacgcctcgagagagaacaaaaattgaaattgtatcagtctgcgacgcaggccgtttttcagaagcggcaggccggagagcttgacgagtcagtccttgagttgacaagtcaaatacttggcgcaaatcctgatttcgccacactctggaattgcagacgagaagtgttgcagcagctggagacccagaagagcccggaagagctggctgctctggtaaaggcggagctcggttttctggagagctgcctacgcgtgaaccccaagagctacggcacgtggcatcaccgctgttggctgctgggcaggctgccagaacccaattggactcgtgaactggagctgtgcgcccgatttctcgaagtggatgagaggaatttccattgctgggattaccgaaggttcgtggccacccaggctgctgtcccacccgctgaggagttagcttttactgattctctcatcaccaggaatttttcgaattattcttcctggcattataggtcttgtttgcttccacaactgcatccccagcctgattcaggcccacaaggacgactgcccgaagacgttctgctcaaggaattagagctggtacagaatgccttttttacagatcccaatgatcagtcggcctggttctatcacaggtggttactcggtagagctgacccccaggatgcactgagatgtttacacgtgtcacgagatgaagcctgcctgaccgtgtcattttctaggccgctcctggtgggctcccgcatggagatcctgctgctcatggtcgatgactcacccttgattgttgagtggcgcacccccgatggtcggaaccgtccttctcatgtgtggctgtgcgatctcccagctgctagcctgaatgaccaactgccccaacacacgtttcgagtcatctggacagccggagatgtgcagaaggaatgcgttttactgaagggaagacaggagggatggtgcagagacagcactaccgacgagcagctgttcagatgtgaactctccgtggagaaatcaaccgtgctacagtccgagttagagtcatgcaaagagctgcaagagttggaacctgagaacaagtggtgtttgttaacaataatactccttatgcgggctcttgaccctctcctgtacgagaaggaaaccctgcagtatttccagacattgaaggcagtggacccgatgagagcaacctatctggatgacctgaggagcaagttcctgcttgaaaactctgtactgaagatggagtatgcggaggtgagggtgctgcacctggcccacaaagacctgaccgtgctgtgccatctcgaacaattgctgctcgtcacacacctcgatttatcacacaatcgcctacgcacattacctccagcgttggccgcattgcgctgcctcgaggtgctgcaggcatctgacaacgccattgagagcctggatggggtaacgaacctgcccaggttgcaggagctgttgttatgtaataaccgcctgcagcagcccgcagtgttacaacctcttgcgtcgtgcccacggttagttctgctgaacctgcagggaaaccccctctgtcaggcagtgggcattcttgaacagcttgcagagttgcttccaagcgtctccagcgtgctcacatag

SEQ ID NO: 237594 - DNA, 996 bp, Artificial Sequence
  Description of Artificial Sequence: Synthetic coding sequence
atggggacacctcagaaggacgtcataatcaaatccgatgctcccgacacgctcctactcgagaaacacgccgattatattgcttcctacggcagcaagaaagacgattatgaatactgcatgagtgagtatctgcggatgtctgggatctactggggtctgacagtgatggatctaatggggcagctgcataggatgaatagggaggagatcttagcatttatcaaatcttgtcagcacgagtgcggaggcatcagcgcttctataggccacgaccctcacctgctctacacgttaagcgctgtccagatccttaccctatatgacagcatcaacgtcattgatgttaataaggttgtggagtacgtgaagggacttcagaaggaggacgggagcttcgccggagacatctggggagagatcgacacacgatttagtttttgtgccgtagcgactctcgcactgctgggcaaactggacgccattaacgtggaaaaggcgatcgaatttgtgttaagttgtatgaattttgatggagggttcgggtgccgccctgggagcgagtcccacgcgggacaaatttactgctgtactggttttctagctataacctcacagctccaccaagtgaactcagacctcctgggatggtggctgtgtgagcggcagctgccctcaggaggcctgaacggaagaccagaaaagctgcccgatgtgtgctatagctggtgggtactggctagcctaaaaatcatcgggcgattgcactggatagacagggagaaactcagaaatttcattctggcatgtcaggacgaagaaacaggcggtttcgctgaccgtcccggtgacatggtggatccattccacacactgttcggcattgccggtctgtcattgctcggagaagagcagatcaaaccagttaaccccgtgttttgcatgcccgaagaagtacttcagagagtgaacgtgcagcctgagctggtttcctag

SEQ ID NO: 237595 - DNA, 963 bp, Artificial Sequence
  Description of Artificial Sequence: Synthetic coding sequence
atgggcaccccccagaaggatgtgatcatcaaatccgatgcgccagacaccctgttgctggagaagcacgctgattacatagcgagttatggcagtaaaaaagatgactatgaatactgcatgtctgaatatctgcgtatgtccggcatttactggggtctgaccgtcatggacctaatgggtcagctgcacaggatgaaccgagaggagattttggccttcattaaaagctgccagcacgagtgtggcggtatttctgcctccatcggacacgacccccatttgctgtacaccctcagcgccgtgcagattttgacactctacgatagcatcaacgtgattgatgttaacaaggtggtcgaatatgttaaaggcctgcagaaagaggatggttcatttgcgggagacatctggggagaaatcgatacaagattctccttttgtgctgtcgccacactagctctcttgggaaagcttgatgccatcaacgtcgaaaaagcaatagaatttgtgttatcgtgcatgaacttcgatggcggattcggctgtcgccctggttcagagagccatgcaggacagatctattgctgtaccgggtttctggcgatcacatcccagctgcatcaagtgaactcagatctactaggctggtggctgtgcgagcggcagttaccaagtggcggactgaatggacgcccagagaagctgcctgacgtctgttacagttggtgggtgctagccagtctgaaaatcattggtcgtctgcattggattgaccgggaaaaactgcggaactttattcttgcctgtcaagacgaagagaccggagggttcgccgaccgcccaggtgacatgcactttatataccagaattatcctaagaaagaactgtcaagtaacaaggagacgctgaccgagtcgttgttacctaggctcgaaaggtcctctacgattagtgcatag

SEQ ID NO: 237596 - DNA, 459 bp, Artificial Sequence
  Description of Artificial Sequence: Synthetic coding sequence
atgggcaccccgcaaaaggatgtgatcatcaaaagcgacgcccctgataccttgctccttgagaaacatgcagactacatcgcttcctacggcagtaaaaaagatgactacgagtattgtatgagcgaatacttacgcatgtccggcatatattgggggctgaccgtgatggacttaatgggccagcttcataggatgaatagagaagagattctcgcttttattaaatcttgtcaacatgaatgcggcggtattagcgcatccattgggcacgacccccatctgctgtatactttatccgcagttcagattctcacattgtatgactctatcaatgttatcgacgtgaacaaagtagtggaatacgttaagggcttgcagaaagaagacggctccttcgccggagacatttggggcaacgtgagattcagccctttctaccctaagtaccagtactag

SEQ ID NO: 237597 - DNA, 474 bp, Artificial Sequence
  Description of Artificial Sequence: Synthetic coding sequence
atgaacttcgatggtggtttcggatgtcgaccaggatccgaaagtcatgccggtcagatctactgctgcactggctttctagccattacatctcaactgcatcaagtcaactctgatctcctgggttggtggctgtgcgaaaggcagctacccagcgggggtctgaatggtagaccagagaagctccccgacgtgtgctacagctggtgggtcctcgccagtctgaaaatcatcggtcggttacactggattgatcgcgagaagctgaggaacttcattttagcctgtcaggatgaggagaccggcggattcgctgatcgcccaggggacatggttgacccattccatacactctttggaatcgcgggtctgtcactgctcggcgaagagcagatcaagccggtaaatcccgtgttctgtatgcccgaagaagttctgcagagggtgaacgtccaacccgaacttgtgtcttag

SEQ ID NO: 237598 - DNA, 1476 bp, Artificial Sequence
  Description of Artificial Sequence: Synthetic coding sequence
atgtcattgaaatccgaaaggcgtgggatccacgtggaccagagtgacctgctttgtaagaagggatgcgggtattatggcaaccctgcatggcagggattctgttctaaatgttggcgggaagaataccataaagcccgtcagaagcagatccaagaagactgggagttagccgagaggctgcaaagagaagaggaagaggcgttcgcttccagccagagcagtcagggcgctcagtccctgacattctctaagttcgaggagaaaaaaactaacgagaaaaccaggaaggtgaccacagtaaagaagttcttctctgccagctcccgtgtgggaagcaaaaaggagatacaagaagccaaggctcctagtccgtctatcaatcgccagacctctattgaaactgacagggtgtccaaggaatttatagagtttctcaagacctttcacaagactggtcaggagatctataagcagaccaagctcttcctggagggcatgcactacaagcgcgatctgtctatagaggagcaaagcgagtgcgcacaggacttctaccataacgtagccgagaggatgcaaacccggggtaaggtgcctcctgaacgagtggaaaagatcatggatcagattgagaagtatatcatgacgcgcctctataaatacgtcttttgtcctgagaccacagatgacgagaagaaggacctggccatccagaagaggatcagggcgttacgttgggtcacaccacagatgctttgcgtccccgttaatgaagatatcccagaggtctcggatatggtggtgaaggcaatcaccgacatcattgagatggacagtaagcgcgtgccaagggataagttagcttgcatcacgaaatgcagcaagcatatcttcaatgctattaagattacaaaaaatgagcccgcttcagccgacgacttcttgcctacgctgatttatatcgtactgaaagggaaccctccccgactgcagagcaatatccagtatattacaagattctgtaacccaagtaggttgatgactggcgaggacggctattacttcacgaatctctgttgtgcagtcgcattcatcgaaaagctggacgcacagagcctgaatctgtcccaggaggattttgataggtacatgtcgggccaaaccagtcctcggaagcaggaggcagagtcttggagcccagacgcgtgcttgggtgtgaagcagatgtacaaaaacttggacctcctttcacagctgaacgaaaggcaagagagaatcatgaatgaggccaagaagttagagaaggacttgattgattggacagatggaattgccagggaggtgcaggacattgttgaaaagtacccattagaaattaagcctccaaaccaaccgttagcggcaattgatagtgagaatgtcgaaaatgacaagcttccgccacccctgcagccccaagtctacgcagggtag

SEQ ID NO: 237599 - DNA, 1518 bp, Artificial Sequence
  Description of Artificial Sequence: Synthetic coding sequence
atgatggcttcttcttaccatgaggtggtctcaaggaagaagatgagccttaaaagcgagcgacgcggaatccatgtagatcagtctgacctgctgtgcaaaaaaggctgcgggtactatgggaatcctgcctggcagggattttgctctaagtgctggcgggaggaatatcacaaagccaggcagaaacagatccaggaggactgggagctggccgaacggttgcagcgggaagaagaggaggccttcgccagttcccagagttcccaaggagcccaatccttgaccttctccaaatttgaggagaagaagaccaatgagaagacccggaaggtgacaacggtaaaaaagtttttcagcgcctcctcaagagtaggcagcaagaaggaaatccaggaggctaaggcgccttctccaagtatcaatcgtcagacttccattgagaccgacagggtatcaaaggagtttatagagtttctgaaaacatttcataagacagggcaggaaatctacaaacaaactaagttatttctcgaaggaatgcactataagagggatctctctatagaggagcaatcagaatgtgcgcaggatttttatcataatgtagccgaacgcatgcagacacgtggcaaagtgcctccggaacgtgtggaaaaaattatggaccagattgagaagtacattatgacacgactgtataaatatgttttctgccccgaaactaccgacgacgagaagaaggacctggccatccagaaaaggatcagagcactacgatgggtgacaccacaaatgctgtgcgtgccagtaaatgaagacatccccgaagtgagcgatatggttgttaaagccatcacagacatcatcgaaatggatagtaaacgtgttccgagagacaagcttgcctgtattacaaagtgcagcaaacatatttttaatgccatcaaaatcactaagaatgaacccgcttctgctgacgactttttgccaacactgatatacattgtgctgaaaggcaaccctcccaggttgcagagcaacattcagtatatcacccggttttgcaacccaagcaggctgatgactggcgaagatggatattactttactaatctctgctgtgctgttgctttcatagagaaacttgatgcccagtcacttaacctaagtcaggaggactttgacagatacatgagtggccagacatcacccaggaagcaggaagccgagtcttggagccctgacgcctgcctgggcgttaaacaaatgtacaaaaatcttgacctactgtctcagttgaacgagagacaggagaggatcatgaacgaagcgaagaaactagagaaggacttaattgattggacagatggcatcgctagagaggtgcaggacatcgtggagaagtaccctctggagattaaacccccaaaccagcccctcgcagctattgattccgaaaacgttgaaaatgacaagcttcccccaccgctccagccgcaagtgtatgccggatag

SEQ ID NO: 237600 - DNA, 138 bp, Artificial Sequence
  Description of Artificial Sequence: Synthetic coding sequence
atgtccctgaagtcggaaagacgcggaattcacgtagaccagtcagacctgctgtgcaagaaggggtgtggatattatggtaatcccgcatggcaaggattctgttccaagtgctggcgcgaggaataccacaagtag

SEQ ID NO: 237601 - DNA, 1476 bp, Artificial Sequence
  Description of Artificial Sequence: Synthetic coding sequence
atgtctcttaaatcggagaggcggggtatccatgtggatcagagtgacctcctctgcaagaagggctgcggatactacggcaatccggcttggcaagggttctgcagcaagtgctggcgggaggagtaccacaaggccaggcaaaaacagatccaggaggactgggagctcgctgagaggctccaaagggaggaggaagaagcctttgcaagcagccagtcctcccagggagcccagagcctgactttttctaagttcgaggagaagaaaacaaatgagaaaacaagaaaggtcaccacggtgaaaaagttcttttcggcaagttcccgagttgggtccaagaaagagatccaggaagcaaaagccccttcccccagtattaataggcaaaccagcattgaaacagatcgcgtgtccaaagaattcatcgagttccttaagacttttcacaagaccgggcaagagatttacaagcaaaccaagctttttctggaggggatgcactacaagagggatctgagcatcgaggagcaatcagagtgcgcccaagacttctaccacaacgttgccgaaaggatgcaaacaagagggaaggtgccacctgaaagagtagagaagatcatggatcaaattgagaaatatattatgacgcgactttacaagtatgtgttctgccccgagaccaccgacgacgagaaaaaggatcttgccatccagaagcggatacgcgctctacgctgggtaacgccccagatgctctgcgtccctgtcaacgaggatataccagaggtgtccgatatggtcgtcaaggctatcactgatattattgagatggatagcaagcgcgtgcccagagacaaactggcatgcattaccaagtgttcaaaacatatattcaacgctataaaaatcacaaaaaacgagccagcatcagcagacgatttcctgcccacgctgatttatattgtcttgaaggggaatcccccacgattgcagagcaatattcagtatattactcggttctgtaacccgtctcggctcatgaccggagaagacggttattattttacgaacctgtgctgtgcagtagcattcatagaaaagcttgacgcgcaatcactaaatttatctcaagaagatttcgatcgttatatgtcaggacagacctctcctcggaagcaagaagcagagagctggtcccccgacgcttgtttaggcgtgaagcagatgtataagaatctggacttgctgtctcaactaaacgaacgacaggagcgcattatgaatgaggctaagaagctcgaaaaggatcttatcgactggactgacggaatcgcccgagaagtccaggatattgtcgagaagtaccccctcgagatcaagcccccaaaccagccacttgcagccattgactcggaaaacgtggagaatgacaaactccctcctccactgcagccacaggtgtacgcaggctag

SEQ ID NO: 237602 - DNA, 372 bp, Artificial Sequence
  Description of Artificial Sequence: Synthetic coding sequence
atggaaccagcggagcaaccctccgagttggtttcagccgaaggccgtaaccggaaggccgttctttgtcagaggtgcggatctagagtgctgcagccgggtaccgccctcttcagccggaggcagctgtttcttcctagtatgcgtaagaagccagctctgagcgacggctcaaacccagacggggacctacttcaggaacattggctggtcgaggatatgttcatcttcgaaaatgtaggcttcactaaggacgtgggaaatattaaattcctcgtgtgcgctgactgcgagattggcccaattggatggcattgcctggacgataagaactccttctatgtagctctggaacgagtgtctcacgagtag

SEQ ID NO: 237603 - DNA, 1206 bp, Artificial Sequence
  Description of Artificial Sequence: Synthetic coding sequence
atggaaccgcgacgtgccgctccgggagtccccggttggggatcccgtgaggctgcgggtagtgccagcgccgctgagttagtgtaccatctcgctggagcactggggacggagctccaggacctggcccgaagattcggtcctgaagctgccgctggtctggtcccgctggtggtgagggcgctggagctgttggaacaagctgctgtgggtccagctcctgactccctgcaggtgagtgcccagcctgcagagcaggagctgcgtcggctgagagaagagaacgaacggctccgacgagaactgcgcgcagggccacaagaggagcgcgctttgttgaggcagctgaaagaagtaaccgaccggcagagagatgagctgagggcacacaacagggacctgaggcaacgcggtcaagaaacagaggcgcttcaggaacaactgcagcgtctgctgctggttaatgccgaacttcgccataaactggccgctatgcagactcagcttagggccgctcaggaccgagaacgcgagcgccaacagcccggagaagctgcaacccctcaggccaaggaacgggcacgaggacaagcgggaaggccgggacaccagcacgggcaggagccggagtgggccaccgccggtgccggagcgccaggaaatcccgaggatcccgctgaggccgcacagcagctgggaagaccttccgaagcaggccaatgccgattctcacgggaggagttcgagcagatactacaggaaaggaacgagctaaaggcaaaagtatttctattgaaggaggagctcgcctattttcagagagagctcctgacagatcatcgggtacccggactcttgctcgaggcgatgaaagtggcagtgaggaagcagcgaaagaagatcaaagctaaaatgctgggaacacctgaagaggccgaatcttccgaagatgaggctggaccatggattctcctgagtgacgacaagggcgaccacccgccacctcctgagagcaagattcagtctttctttggtctgtggtataggggcaaggcagaaagctctgaggatgagactagttcccccgctccctctaagttaggcggagaggaagaggcccaacctcagtccccagctcccgatccaccctgttccgccctgcatgagcacctgtgtctgggagcgtctgcagcacccgaggcttag

SEQ ID NO: 237604 - DNA, 1212 bp, Artificial Sequence
  Description of Artificial Sequence: Synthetic coding sequence
atggaagaggagaggggaagcgccctcgccgctgaaagcgccctggagaaaaacgtggccgagttgaccgtaatggacgtctacgacatagcttctctcgtggggcacgagttcgagagggtgatcgaccagcatgggtgtgaggccattgctaggctgatgcccaaagtggtcagggtgcttgaaattctggaagtgcttgtcagtcgacatcacgtagcaccagagctagacgagttaaggctggaacttgatcggctgaggttggagcgcatggatcggatagaaaaagaacgcaagcatcagaaggagctggagctcgtcgaagacgtgtggcggggagaggcacaagacctgctgagccagatcgcacagctccaggaagagaacaagcagctcatgaccaacttgagtcacaaagatgtgaatttctccgaagaagagttccagaaacatgaagggatgagtgaaagggagcgacaagtaatgaaaaaactaaaagaggtagtcgacaagcaaagggacgaaatcagggctaaggacagggagttgggcctcaaaaacgaggacgtggaggcattgcaacagcaacagacacggctgatgaagattaatcatgatctgaggcaccgtgtgacggtagtggaggctcaggggaaagcactgatcgagcaaaaggtggaactggaggctgacctccagactaaagaacaggagatgggcagccttcgcgctgagctgggcaagttgcgggaacgcctccagggtgaacattcacagaatggtgaggaagaacctgagactgagccggtaggggaagagtccatttctgatgccgagaaagtggccatggatttgaaagaccctaaccgaccaaggttcacgctgcaggagctgcgggatgtgctccacgagaggaacgagctgaagagtaaggtgtttctgctgcaggaagagctcgcctactacaagtcagaagagatggaagaggagaatcgcatcccacagcctcctccaatagctcacccaagaactagcccccaaccagagtcaggtataaagagactgttcagcttcttttcccgggataaaaagagactagccaacacccagcggaatgtacatattcaggagtccttcggacagtgggcaaatacacaccgagacgatggctataccgaacagggacaggaggctctacagcatctatag

SEQ ID NO: 237605 - DNA, 636 bp, Artificial Sequence
  Description of Artificial Sequence: Synthetic coding sequence
atggaggaacctccagtgagagaagaggaggaggaagagggcgaagaggacgaagaacgggatgaggtcggacccgagggggctctcggcaagtctcccttccagcttaccgctgaggatgtctacgatatatcttacctcctcggtcgggagctgatggctctaggttctgatcccagagtgactcagctgcaatttaaggttgtgcgcgttctcgaaatgttggaagcattggtgaacgagggctcactggccctggaggaacttaaaatggaacgagatcacctgcgaaaggaagttgagggactgaggaggcagagtccaccggcatctggggaagtgaacttaggccctaacaagatggttgtagatcttaccgatcccaaccggccaagatttaccctgcaggagctgagagatgtcctgcaagaacggaacaaactcaaaagtcagcttctggtggtccaggaggaactccagtgttacaagtcgggcctcatacctcctcgcgagggcccaggcggtcgtcgcgaaaaggatgccgtggtgacctcagccaaaaatgccggtagaaacaaggaggagaaaaccatcatcaaaaagctgttttttttccgctcaggcaaacagacatag

SEQ ID NO: 237606 - DNA, 717 bp, Artificial Sequence
  Description of Artificial Sequence: Synthetic coding sequence
atggcagaagacaagaccaaaccttcagagctggatcaaggaaaatacgatgctgatgataacgtaaaaatcatttgtctcggcgattcagcagtgggcaaatcgaaactgatggagcgcttcttaatggacggcttccagccgcagcagcttagtacctacgccctgacactgtataagcatactgccacggtggatgggaggaccatcctggtggatttctgggacacagctgggcaggaacgattccagtctatgcatgcttcttattaccacaaagcgcacgcctgcatcatggtgttcgatgtgcaacgcaaggtgacgtaccgcaacttgagcacatggtacactgagcttcgcgagtttagaccagagattccctgtatcgtggttgccaacaagatagatgatattaacgtcacacagaaaagtttcaacttcgccaaaaaatttagtttgcctttatacttcgtcagcgccgctgatggcacaaacgtggtgaaagtttggctgactgctgaggtcgccagcaaactgtttaatgatgctatcagactcgctgtttcttataagcagaattctcaggacttcatggacgagatatttcaggagttggagaacttttctttagaacaggaagaggaagacgtgccagaccaggaacagtccagctccatagaaacaccttcagaagaggcagccagtccccattcctag

SEQ ID NO: 237607 - DNA, 498 bp, Artificial Sequence
  Description of Artificial Sequence: Synthetic coding sequence
atggccgaagacaaaaccaaaccctcagagctggaccaggggaaatacgacgctgacgataatgtgaagatcatttgtctgggagacagcgccgtggggaagagcaaactgatggaacgatttcttatggatgggtttcagccccagcagttatctacctatgcacttactctgtacaagcatacggccaccgtggatgggaaaacgatactggtggcagatatcaatgtcacacagaaatcctttaattttgccaagaaattttcactccccctttacttcgtgtccgcggcagacgggaccaacgtagtgaagttattcaatgatgccatacggctggccgtgagctataagcagaactcacaagatttcatggatgagatcttccaggaacttgaaaatttcagtttagaacaggaggaagaagatgtgcctgatcaggagcagtcaagcagcatagagacaccaagcgaggaagtggcctcaccccattcgtag

SEQ ID NO: 237608 - DNA, 690 bp, Artificial Sequence
  Description of Artificial Sequence: Synthetic coding sequence
atggccgaggacaaaaccaagcctagcgagctggaccagggcaagtatgacgctgacgacaatgtaaagatcatatgtctgggggattccgccgtcggcaagagtaaactgatggagcgtttcctaatggacgggttccagccacagcagctgtcaacctatgccctgacactgtataaacacaccgccaccgtcgacggaaaaacaattctggtcgacttctgggatacagctgggcaagagcgattccagtctatgcacgcaagttattatcacaaagcccacgcgtgtataatggtgttcgacatccaacgcaaagtgacgtaccgcaacctcagtacctggtacaccgaattacgagagttcaggcctgagattccctgcatcgtggtggccaataagatcgatgctgacatcaatgtgacgcagaagagttttaactttgctaagaagttcagtctgccactgtacttcgtgtctgccgctgatggaaccaatgtcgtgaaattatttaacgatgccatacgtctggcagtgtcctataaacaaaacagtcaggatttcatggacgaaatctttcaggagcttgaaaacttcagcctggagcaagaagaagaggatgtgcccgaccaggaacaaagttcatctattgagaccccttcggaggaggttgcctcaccacattcctag

SEQ ID NO: 237609 - DNA, 687 bp, Artificial Sequence
  Description of Artificial Sequence: Synthetic coding sequence
atggcagaggataaaactaaaccgtccgagctggaccaggggaagtacgacgcggacgataacgtgaaaattatttgtctgggggacagtgccgttggaaagtccaaactgatggagaggttcctgatggacggattccagccccagcaactgagcacctacgccctgaccctctacaagcacacagccactgtggatggcaaaaccattttggtggacttttgggacactgcgggtcaagaacgctttcagtcaatgcatgcctcctattatcacaaagcacatgcttgcattatggtgtttgacatccaacgcaaggtaacatacagaaacctgtctacttggtacacagagctccgagagttccgaccagagatcccgtgcattgtggtggccaataaaatagacgatataaatgttacacagaagtccttcaacttcgccaaaaagttctcactgcccttgtactttgtcagcgctgccgacggcaccaacgttgtgaagctgtttaacgacgccataaggctggccgtgtcctataaacagaacagtcaggactttatggacgaaatctttcaggagttagagaacttctccctggaacaagaagaggaagatgtgcccgatcaggaacagtctagttccatcgaaacaccctccgaggaagtagcaagtccacattcctag

SEQ ID NO: 237610 - DNA, 687 bp, Artificial Sequence
  Description of Artificial Sequence: Synthetic coding sequence
atggctgaggacaagacgaagccctcagaacttgaccagggcaaatatgatgctgacgacaacgtgaagatcatctgtcttggcgacagtgcggtgggcaaatctaagctgatggagcggttcctgatggatggtttccagccccagcagctgtcaacctacgccctcacgctctataaacacaccgcaactgttgacggaaaaacgattctcgtcgatttttgggacaccgctggacaggagcgtttccagtccatgcacgctagctattatcataaggcgcatgcgtgtatcatggtttttgatatacagagaaaagtgacttatagaaatctgtcaacctggtacaccgaattacgcgaattcaggccggagatcccctgcatcgtcgtggcgaacaaaattgacgatattaacgtgacacagaagtcattcaatttcgccaagaagttctcccttcccttgtattttgtgtctgccgctgatggcacaaacgtcgtcaagctgttcaacgacgcaattcgcctggccgtgagttacaaacagaatagccaagacttcatggacgaaattttccaagaactcgagaatttctcactggaacaggaggaagaagatgtccctgatcaggaacagtcttcgtctattgagaccccgtcagaagaggtggcatccccacacagttag

SEQ ID NO: 237611 - DNA, 717 bp, Artificial Sequence
  Description of Artificial Sequence: Synthetic coding sequence
atggcagaagataagaccaaaccgagcgaactggatcagggaaagtatgatgccgatgataacgtgaagatcatctgcttgggggattctgctgtaggcaagtctaagctgatggagcggttcttgatggatggattccagccacaacagctatccacatatgctctaacattgtacaagcacaccgcgaccgtcgatggtaagaccattcttgtggacttctgggacacagcgggacaggagagattccaaagcatgcacgcctcgtattatcataaggcacacgcatgcatcatggtgttcgatatacaaaggaaggtgacctatagaaacctaagtacttggtataccgagctccgggagttccggccagagataccttgcatagtcgtggctaataaaatcgatgacataaacgttacccagaagtctttcaattttgccaagaaattctcccttcccctgtatttcgtatctgccgcagacggaacaaacgtagtaaaggtgtggctaactgctgaggtggcatctaagctcttcaatgacgccattcggctggccgtcagctacaaacagaactctcaggatttcatggatgagattttccaggagctcgaaaacttcagtttggagcaggaagaggaagacgtgcccgaccaggagcagtcttctagcattgaaaccccctcggaggaggtggcctcgcctcattcatag

SEQ ID NO: 237612 - DNA, 345 bp, Artificial Sequence
  Description of Artificial Sequence: Synthetic coding sequence
atggctgaagacaagactaaaccctctgagctggaccagggtaagtatgacgcggacgataacgtgaagatcatctgcctgggagactcagccgtcgggaagagcaagttaatggagcgattccttatggacggatttcagccccagcagctgagcacctatgccctgacattgtacaaacataccgccaccgtcgacggcaaaacaattctcgttgacttttgggataccgccggacaggagcgatttcagtcaatgcatgcttcctattatcacaaagcccacgcatgcatcatggttttcgacattcagcggaaggtcacctacaggaatctgagcacgtag

SEQ ID NO: 237613 - DNA, 306 bp, Artificial Sequence
  Description of Artificial Sequence: Synthetic coding sequence
atggctgaagataagactaaacctagtgaactcgaccagggaaaatacgacgcggacgacaacgtgaagatcatctgtttgggggattctgcagtgggtaaaagtaagctgatggagcggttcctgatggacggttttcagccccagcagctatcaacatacgccttaacactctataaacacacggcaactgtggacgggaagactatcctggttgacttctgggataccgctgggcaggagcggttccaatcgatgcatgcttcctactaccacaaagcccacgcatgcatcatgcagacctag

SEQ ID NO: 237614 - DNA, 690 bp, Artificial Sequence
  Description of Artificial Sequence: Synthetic coding sequence
atggcagaagataagacgaaaccttctgagctggaccagggaaagtatgatgccgacgataatgttaaaattatttgcctgggagacagtgccgtgggaaagtctaagctgatggagagatttctcatggatggttttcagccccaacagctttcaacctatgctctgactctgtataagcatacagccaccgtggatggcagaacaatcctggtcgatttctgggatacagccggacaagaaaggtttcagtctatgcacgctagctactatcacaaagctcacgcctgcatcatggtttttgacgtccaaagaaaagtgacttacaggaacctctccacctggtacacggagctccgtgaatttaggccggaaattccttgtatcgtggtggccaacaaaattgacgcggacattaatgttacacagaaatcttttaactttgcaaagaaattcagtcttccactgtacttcgtctccgccgctgatgggacaaacgtggtaaagttgtttaatgacgctattcgtctggctgtgtcctataaacaaaactctcaagatttcatggacgagatttttcaggaattagagaatttcagtttggagcaagaggaggaagatgtccctgatcaggagcagtctagcagcatcgagacaccctccgaagaggccgcttcaccccattcctag

SEQ ID NO: 237615 - DNA, 690 bp, Artificial Sequence
  Description of Artificial Sequence: Synthetic coding sequence
atggcagaggacaagactaagccctcagagctggatcagggaaaatatgacgcagatgataacgtaaagattatctgtctgggcgacagcgcagtggggaaaagcaaactcatggagagatttctcatggacgggtttcagcctcaacagttgagcacttacgccctcaccctgtacaagcacaccgctactgttgacgggagaaccattctggtagacttttgggacacagccggtcaagagcggtttcagtcgatgcatgcctcctattatcataaggcgcacgcctgcattatggtgtttgacgttcagaggaaggtgacctacagaaatctctcaacttggtatacggaactaagggagttccgtcccgagatcccctgcattgtggtggcaaataagatcgacgcggacattaatgtgactcaaaaaagttttaacttcgcaaaaaagttctcgttgcctttgtatttcgtgagcgctgccgacggcaccaacgtggtgaaactatttaacgacgctattcggttagccgtcagctacaagcagaactcccaggatttcatggatgaaatcttccaggagttggagaacttctcgctcgaacaggaggaagaggacgttccggaccaggaacagtcctccagtatcgagacaccttcagaagaagccgcaagcccccattcttag

SEQ ID NO: 237616 - DNA, 687 bp, Artificial Sequence
  Description of Artificial Sequence: Synthetic coding sequence
atggcagaagataaaactaagcccagcgagcttgatcaagggaagtatgacgctgacgataacgtgaagataatatgtcttggggactctgccgtgggaaagtctaaactcatggaaagattcctgatggacggatttcagccacagcaactctccacgtatgccctcaccctctacaaacacaccgccacagtggatgggagaactatcctggttgacttttgggatacagccggacaggaaagatttcagtcgatgcatgctagctactatcacaaagcgcacgcctgcatcatggtgttcgatgtgcagcgaaaggtgacatataggaatctgtccacctggtacacagaattgagggagtttcggcctgaaattccgtgtattgttgtggcaaacaagatagatgacatcaatgtaacccaaaaatcattcaatttcgcgaagaagttcagtctccccctgtacttcgtgtctgccgctgatgggactaatgtggtgaaactctttaatgacgcaataaggcttgcagtctcctataaacagaattcccaggatttcatggacgaaatttttcaagagctggaaaacttctccttggagcaggaggaggaggacgtccccgatcaggaacagtcaagtagcatcgaaactccatccgaagaggccgcaagtccccactcctag

SEQ ID NO: 237617 - DNA, 63 bp, Artificial Sequence
  Description of Artificial Sequence: Synthetic coding sequence
atggcggaagacaaaacaaagccctccgagctggatcaaggaaaatatgatgcagacgactag

SEQ ID NO: 237618 - DNA, 687 bp, Artificial Sequence
  Description of Artificial Sequence: Synthetic coding sequence
atggctgaggataagacaaagccctcggagctggaccaaggaaagtacgatgcagatgataacgtgaaaattatctgcctgggagactcggctgttggcaagagcaagctgatggagagattcctgatggatggcttccaaccgcaacaactgtctacctacgctctgacactgtacaaacatacagcgaccgtggacggacgcaccatccttgtggacttttgggacacagcaggtcaggagcgtttccagtccatgcacgcctcttactaccacaaggcacacgcctgcattatggtatttgatgtgcagaggaaagtgacatatcgcaacttgtctacctggtacactgagctgcgcgagtttcggccagaaattccctgcattgtagtggcgaacaaaatcgatgacattaacgtgacccagaagagcttcaactttgcaaagaaattcagtctccctctgtactttgtttctgcggcagacggtactaacgtggtcaagctgttcaatgacgctatcagactggccgtatcgtacaaacagaatagtcaagacttcatggacgaaatttttcaggagctggagaatttctctctggagcaggaagaagaggacgtcccggaccaggaacaatcctcgagcattgaaactcccagcgaagaggcggcatccccacatagctag

SEQ ID NO: 237619 - DNA, 603 bp, Artificial Sequence
  Description of Artificial Sequence: Synthetic coding sequence
atggccaaaaaaacatacgacttactgtttaaattgctgctgatcggcgactcgggggtcggcaaaacatgtgtcctgtttagattctccgatgacgctttcaacacgacctttatcagcacaattggcatcgacttcaagatcaaaaccgtcgagctccaggggaagaagatcaaactgcaaatttgggacacagctggacaggaacgatttcatactatcaccacgagttattacagaggggctatggggattatgctggtgtatgacatcaccaacggaaaaagctttgagaatattagcaaatggttaaggaacatagacgagcacgcgaacgaggatgtcgaaaggatgctgctgggcaataaatgcgatatggatgacaaacgcgtcgtgcccaaaggtaagggcgaacagatcgctagggaacacggaattaggttcttcgagaccagcgctaaggcaaatattaacatcgagaaggcatttctgactctcgccgaagacattctccgaaaaactcccgtaaaagaacccaatagtgaaaacgtggacatctcatctggcggaggagttactggctggaagtccaagtgttgctag

SEQ ID NO: 237620 - DNA, 1950 bp, Artificial Sequence
  Description of Artificial Sequence: Synthetic coding sequence
atgtctctgatggttagtgccggtcggggtctgggcgctgtgtggagtccaacccacgttcaggtcaccgtgctccaggcgcgtggattgcgagcaaaaggtcctggaggcacgagcgacgcatacgcggtgatacaggtgggcaaagagaagtacgccacaagtgtgagtgagaggtccctcggggctcccgtttggagggaggaggccacgttcgaactcccaagcctgctgtcatctggcccagccgcagcagccactctccagctcaccgtcctccatcgcgcattgctcggcctcgacaaatttctgggtagagccgaagtagacctcagggatctgcatcgggaccagggtagacgaaagacacagtggtacaagctcaagtcgaaaccaggcaagaaagacaaagaacgtggcgagatagaggtggatattcaattcatgagaaataatatgactgcatcaatgtttgacctcagtatgaaggacaagtcgaggaatccatttgggaaacttaaggataagatcaagggaaaaaataaagactcgggctccgataccgcatccgccatcattcctagtacaaccccgagcgtcgactccgacgacgagagtgtggtgaaagataagaaaaagaagagcaagataaagacactcctctccaagtccaatctccagaagacccctctcagccagagcatgtcggtgctcccaacatcaaagccggaaaaagtgctgcttcgtccaggcgacttccaatcccagtgggatgaggacgacaacgaggacgagtcgtcatctgcaagcgacgtgatgtcacacaaaagaaccgcttcaacagacctcaaacagctcaaccaggtaaacttcaccctgcccaaaaaagaaggtctgtcctttctgggcggactccgctccaagaacgatgttctcagcagatcgaatgtctgtatcaatgggaatcacgtgtatctggaacagccagaagccaaaggtgaaattaaagactcctctccgtcctcctctccttcaccgaaaggatttcgtaaaaagcatctcttcagctcaaccgagaaccttgccgcagggagctggaaggaacccgcagagggcggtggattgagttcagacaggcaactgagcgagtcctccaccaaggactccctcaagtctatgacactgccatcttacagacctgccccactggtaagtggggaccttcgagagaatatggcgcctgcaaattccgaggccactaaggaggcaaaggaatccaaaaagcctgagtcaagacggtcctctttattatcacttatgaccgggaagaaggacgttgccaagggctccgaaggggagaaccccctaaccgtgcccggtcgggagaaggaaggtatgctgatgggtgtcaagcctggggaagatgccagtgggccagccgaggacttggtgaggaggagtgagaaagacacagcagccgtagtgagccggcagggcagcagcctcaacttattcgaggatgtgcagatcaccgagcctgaggctgagcctgaaagtaagagcgagcctcgccctccaatatcttctccacgggctcctcaaacaagagccgtcaaaccacgattacatcctgtgaaaccgatgaatgcaatggctacgaaggtggcaaactgctctctgggcacggcaacaataatctccgaaaacctcaacaacgaagtgatgatgaaaaagtacagtccatctgaccctgccttcgcttatgctcagctgacacacgacgagctgatccagctcgtattaaaacagaaggaaacgattagcaagaaagagttccaggtgcgcgagctggaagattacattgataacctgctagtgagagtcatggaggagacaccaaatatcctgcgcatacccacccaggtgggaaaaaaggccggtaaaatgtag

SEQ ID NO: 237621 - DNA, 3852 bp, Artificial Sequence
  Description of Artificial Sequence: Synthetic coding sequence
atgtccctgatggtgtccgcaggtcggggtctcggagccgtatggtctccaacacatgtccaagtgaccgtcctccaggctcgcggtctgcgagctaaaggacccggtggaacaagcgacgcctacgcggtgatccaagtaggcaaagagaagtacgctacaagtgtcagcgaaaggtctctgggagctccagtgtggagggaagaggcgaccttcgagcttccgtccttgttatccagcgggcctgccgctgccgcaacactgcagttgaccgtgctacatcgtgctctgctgggacttgataagttcctggggagagccgaggtggatctcagagacctgcatagagaccaaggcaggaggaagactcagtggtacaaacttaaaagtaaacccggaaaaaaagataaggagaggggggagatcgaagtggatatccagtttatgagaaacaatatgaccgcatccatgttcgaccttagtatgaaggacaagtccaggaatccctttggaaaactgaaagataagatcaaaggcaagaataaagatagcggaagcgacacggccagtgcaatcatcccatcaacaacccctagtgtagatagcgatgatgaaagcgtggtaaaggacaaaaagaaaaaaagcaaaatcaaaaccctgctttcaaagtcgaaccttcagaaaaccccgcttagccagagcatgtccgttctcccgacaagtaagcctgagaaggtgttgctgagaccgggtgactttcagtctcagtgggatgaggatgataacgaggatgagagctctagcgccagcgacgtgatgtcccataaacggaccgcttcgactgacttaaaacaactaaaccaggtgaattttactctgcctaagaaggaggggctatccttcctgggaggccttagaagcaagaatgatgtgctctctagatctaacgtatgcatcaatggcaatcatgtttatcttgaacagcccgaggctaaaggtgaaatcaaggattcatccccttcctcctccccttcacccaagggattccgcaagaagcacctgttctcaagcactgagaacctggccgcaggtagctggaaggaacccgctgaaggagggggtctcagtagcgatcgccagctgagtgagtcaagcacaaaggacagcctgaagtctatgaccttgccaagctatcgcccagccccactggtgtccggcgatctgcgagaaaacatggcacccgctaatagtgaagcaacgaaagaagcgaaagagagcaagaagcctgagtcaagaagatcttctttgttatcactgatgaccggaaagaaggacgtggctaaaggcagcgaaggcgaaaatcccctcaccgtaccagggagggagaaggaggggatgctgatgggagttaagccgggagaagatgcatctggacccgcagaagatttagtgagacgcagcgaaaaagacaccgccgcagtggtgtcccggcaaggatcatctttaaatctttttgaggacgtgcaaatcacagaacccgaagcagagcccgagtctaaatccgaaccccgtccacctatctccagtcccagagccccacagacacgggcagtcaagcccagactcgaggttagcccagaggctcagccaaccgctagattaccatcacctaccgacagcccaagctcattgccccctcttccaagtagcagcgggcaggcaagcgtccctagcgaattgggccatggcgctgacacacaaagctctgaaagtccttccgtgttctcctcgctgtcctcccccattgctgcccctatctccacctccactcctatcgagagctggcctctggtcgatcgtggccaggccaaatcagaaggcccaccattacttcctaaggccgaactgcagactgagtctctgacaccagtccccaacagcgggtcttcggcactggggagcctttttaagcagccaagtttccccgctaataagggcaccgaagatagcctcatggggagaacccgggagaccggcactgagaagaatacgtccagcttggagcttgaggagagtctgcctgagcaaccggagaccggcaggcaggaggaagagcttcctagattcccttgcaaaaagcaggattatagtcctagtagcggtgaagcacaggaggttcccttcgccctgtccctaagctcagacggggcagtgtcccccgttggcgagctcgcagccggtggggaccgggatctggaatctcaggccggatcactggtggagtctaaagcaagagacgcagctgaggaagttgccccaccactgcctatgggggcatcagtgccatccatagatagcatgatgaggaagctggaagaaatgggcctgaatctgcgaaaagatcagaaaaagacaaagaagagagtctcattttcagagcagctgttcaccgaagaggccgtggcaggggcagccctgttagtcgaaggccatagcagctgcccgcaggagctgaacccagcatggtcagtagccggaaacgcgagcgatggtgagccacccgaaagtcctcacgccgaggattccgaacgggagtccgttacaaccccgggaccagccacgtgcggcgcaccggcaagcccagcggaccatctgctcttgcctagtcaggaagagtcgttcagtgaggttcctatgagcgaggcctcatctgccaaagatacacccctatttaggatggagggtgaggacgctctggtgacccaataccagagtaaggcttctgaccacgagggcctcttaagcgatcccttgtcagaccttcagctggtctccgatttcaaaagcccgatcatggcagacctaaacctgagtttaccatctatcccagaggtcgcctccgatgatgaacggatcgatcaagtcgaagatgatggcgatcaagtggaggacgacggcgaaactgcaaagagcagcacccttgatatcggtgctctgtcgctcggattggtggtcccttgtcccgagaggggcaaggggcctagcggtgaggccgacagattggtgttgggcgagggactgtgcgactttaggctccaggcccctcaggcctctgttaccgcaccaagcgaacagacaacagaattcgggattcacaagccccacctcgggaaaagcagtagcttggacaaacagctgcccggtccgtcgggaggggaggaggaaaagccaatgggaaatgggagccctagcccccctcctggaaccagcctcgataatcctgtgccatcaccatctccaagtgagatattccctgtgactcattctttccctagttctgcccattcagacacacaccacaccagcaccgccgagtcccagaaaaaggccacagctgaaggaagtgctggccgtgtcgagaattttggaaagagaaaacctctgctccaagcctgggtgtccccctctgaaacacatcctgtgtctgctcagcctggcgcaggcacaggcagtgctaaacaccgactacaccctgtgaagcctatgaacgctatggccacaaaggtggctaactgttctcttgggactgccacaataattagcgagaacttgaataatgaagtaatgatgaaaaagtacagccccagcgacccagccttcgcttatgcacagctgacgcatgacgagctgatccagttggtactgaagcaaaaagagacaatctccaagaaagagttccaggtgcgcgagctagaggattatatagataatctgctcgttcgagtaatggaagagaccccaaatatattaaggattccaacccaagttggaaagaaagcaggaaagatgtag

SEQ ID NO: 237622 - DNA, 429 bp, Artificial Sequence
  Description of Artificial Sequence: Synthetic coding sequence
atgagccttatggtgtcagccggacggggactgggagcagtctggtctcctactcatgtccaagtcactgttctccaggctcgtgggcttagggctaaagggccaggcggtacctcagatgcctacgctgtgattcaggttggcaaagagaaatacgcaacgtcggtttctgagcgtagccttggcgctccagtgtggcgtgaagaggcgacgtttgagcttccttccctcctgtcttccggaccagcagcggctgccacattacagctaaccgtactgcatcgcgctttgctaggactagacaaattcctcgggcgtgcagaggttgacctacgggacctccatcgtgatctgggtaagtcctttttcaaaactttaaagaagagagcctgggctatttttctacgcctgtgtctaaaaaagaattag

SEQ ID NO: 237623 - DNA, 1320 bp, Artificial Sequence
  Description of Artificial Sequence: Synthetic coding sequence
atgagaaacaatatgactgcctcgatgtttgatctgagcatgaaagacaagagccggaatccctttggaaaactgaaggacaagataaaaggcaagaataaagatagcggctcagatactgcctccgccatcatcccttccactactccttcagtggactctgatgacgaatctgttgtgaaggataagaaaaagaagagcaagattaagaccctgcttagtaagtccaatctgcagaagacaccactcagtcagtccatgtctgtgctgcccacctcaaagccggaaaaggttctgctgcggccaggagatttccagtcacagtgggacgaggatgataatgaggatgaaagttcctccgccagcgatgtaatgtcccacaagcgcacagcatccaccgatctcaaacagttgaatcaagtgaacttcacacttccaaaaaaggagggccttagcttcttaggcggacttaggtctaaaaatgatgtgctgagccgctcgaatgtctgcatcaacgggaaccacgtttacctagagcagcctgaggccaagggtgagatcaaggatagcagcccatcatccagccccagccccaagggtttccgcaagaagcatctcttctcgtccactgaaaatcttgccgctggcagttggaaagaaccagctgaaggaggcggattgtcaagcgatcgacagcttagcgagtcgagtaccaaagacagtctgaaatctatgacgcttcccagttaccgtcccgcaccactcgtttccggtgatctgcgagaaaacatggcccctgctaactcagaggctactaaggaggcgaaagaaagcaagaaaccagagtctcgacgatcatcacttctgtccctcatgacgggcaaaaaggatgtggccaagggctctgagggagaaaatccactgaccgtgcctggccgtgagaaggaaggcatgctcatgggagtcaagccgggtgaggatgcctcagggcctgctgaggatctggtccggagaagcgagaaggacaccgcagcagtcgtcagtaggcaagggagctctctaaatctttttgaagacgtgcaaattaccgaaccggaagcggaaccagagtctaagtctgagccgcgtcctccaattagttcacctagagccccacaaactcgtgccgtgaaaccgagattgcacccagtaaaacctatgaatgccatggcaacgaaagtcgccaactgcagcttgggcacagcgacaataatctccgaaaaccttaataatgaggtgatgatgaaggtatgccctctgagatcttggtgtgtaagatag

SEQ ID NO: 237624 - DNA, 1539 bp, Artificial Sequence
  Description of Artificial Sequence: Synthetic coding sequence
atgatgctttcagaacaagcccagaagtggtttcccactcacgtccaggttacagtgttgcaggccaaggatctcaaaccgaagggaaaaagcggaacgaacgatacatatactattatccagctgggaaaggaaaagtacagtactagcgtggccgaaaagactctggagcccgtatggaaagaggaggcctccttcgagttacccggactgctcattcaaggctctcctgagaagtacatccttttcctgatcgtgatgcaccgctccttagtgggacttgacaagttcctgggccaggtagctatcaacctaaatgacattttcgaggataagcagcgacgtaagacagagtggttccgccttgagagcaaacaaggaaagcgcatcaaaaataggggagaaatcaaagtgaatatccagtttatgcggaacaacatgactgcaagcatgtttgatctgtctatgaaggataagacccgatcaccctttgccaagcttaaggataagatgaaggggaggaaaaatgacggcacatttagtgacacttcctccgctataataccatctacgcacatgcctgatgctaacagcgagttttcctcgggagaaatccagatgaaatctaagccgaaaaaacccttcctgttgggcccacagaggctgagctccgcccattccatgagcgacctgagtggatcccacatgtcttccgagaagttgaaagccggaacgattgggcagacacatctcctcggacaccagctggacagtttcgggacggtacctgaatctggatctctcaaaagccctcatcgaaggacgctcagcttcgatacgtcaaagatgaatcagcccgacagcattgttgacgaaggtgagctatgttttggaaggcaaaacgacccatttaccaacgttaccgcctctctgccgcagaaattcgccaccttgccaaggaagaagaacccctttgaggaaagcagcgagacatgggatagctctatgaacctgttctcaaaacccatcgaaatcagaaaagagaacaagcgtgagaaacgggagaaggtgtcactatttgaacgggttacaggcaaaaaggactccaggcgtagcgataagttgaacaatgggggatcggactccccttgcgacctgaaaagccccaatgccttcagcgagaataggcaagactatttcgattatgagtctacaaatccatttacagccaaattccgcgctagtaatataatgccaagttcctcgttccatatgagccccacctcaaatgaggatctgcgtaagattccagattccaacccgttcgatgccacggctggttacaggagcctaacatacgaagaggttctccaagaacttgtcaaacataaagagctgctgcgccgtaaagatacacacattagggagttagaggactacatagacaatttgttagtccgggttatggaggaaactcccagtattctaagagtcccttacgagccaagccgtaaagctggcaagttctcaaactcttag

SEQ ID NO: 237625 - DNA, 1599 bp, Artificial Sequence
  Description of Artificial Sequence: Synthetic coding sequence
atgatgctgtccgaacaggcccagaagtggttccccacccacgtacaagtgactgtgctgcaggccaaggacctgaagcccaagggaaagagcggtaccaacgacacatacactattattcaattgggcaaagagaaatatagcacgtcagtcgctgagaaaaccctggaacctgtgtggaaagaagaggcgtcgtttgaactgccaggtctgcttatccaaggatcaccagaaaagtacatcctgttccttattgtcatgcaccgctctctggtcggcctagacaagtttcttgggcaggtcgccattaacctcaatgacatatttgaagacaagcagcgccgaaagactgagtggtttcggcttgaatcgaagcagggcaagcggatcaaaaacagaggcgagatcaaagtcaacatccaattcatgcgcaacaacatgactgcctcgatgtttgacctgtcaatgaaggacaaaacccgatcgcctttcgctaagcttaaagacaaaatgaaggggcgaaagaacgatggaacgttttcagacaccagctccgcaatcattccctcgacacatatgccagatgcaaacagcgagttcagctcaggtgagatacagatgaagagtaaacccaagaagccattccttctcgggccacagaggctgagctccgcccactctatgagcgatctttcgggaagccacatgtccagtgagaagctgaaagccggaaccattggccagactcatctccttggtcaccagctagattcgttcggaactgtacctgaatcgggttctctgaagagccctcaccggcgtaccctgagcttcgatacatcgaagatgaaccaacctgattcaatcgtggatgaaggtgaattatgttttggacgccaaaacgacccattcactaatgtcacagcatcgctgccccagaagtttgctacgctacctagaaagaaaaaccccttcgaggaaagcagcgagacttgggactcctccatgaatctttttagcaagcctatagagatacgtaaggaaaacaagagggaaaagagggagaaagtctcactcttcgagagagttacaggcaagaaagacagccgaagatccgataagctgaacaatggcggttccgatagcccctgtgatctcaaaagtccaaacgctttttccgaaaacagacaagactatttcgactacgaatcgacgaacccatttacggccaagttccgggcttccaacattatgccgtcttcacgcaatactttactgacccctgcagtcgcagaatggcggggttctctgagatgggctgagctgtttcatatgtcaccgacaagcaacgaagatctcaggaagatcccagactctaaccctttcgacgctacggcaggatatcgcagcttaacctacgaagaagtgctccaggagttggtgaaacataaggagttgctccgacggaaggatacacacatccgagaactggaggactatattgacaaccttctggtccgggtgatggaggaaacaccttcaatcctgcgagtaccctacgaacccagtcgcaaggcaggtaaattttcgaacagctag

SEQ ID NO: 237626 - DNA, 2271 bp, Artificial Sequence
  Description of Artificial Sequence: Synthetic coding sequence
atggcaagtgcccctccagcctcaccaccgggatccgagccgcctggccctgatcccgagcccggagggcctgacggcccaggcgcagcacagctagcccctggacctgctgagctaaggctgggagccccagttgggggtcccgaccctcaatcaccaggtttggacgaaccggcacctggcgctgcagcagacggtggggcacgctggtcagcgggaccagcacccggtctggaaggaggaccacgtgaccccggtccaagcgctcccccacccaggtccggtccacggggacagctcgcttctcccgacgcacccggacctggtcccaggagcgaggctcccctgcccgagctggaccccctcttctcctggaccgaggaaccggaagagtgcggccctgcctcatgtccagagtcagcccctttccgtttgcagggatcttcctctagtcacagggccagaggtgaggtggacgttttctcaccgttccctgcacccacagcgggtgaactcgcgctcgagcagggacccggatcacctcctcagccttctgatctctcacaaactcaccccctccccagcgaacctgtggggtctcaggaggatgggcctcgtctgagggccgtctttgacgctctggacggggacggggacggttttgtgcggatcgaggattttattcagttcgctactgtgtacggagcagagcaggtcaaagacttgacgaagtatttggacccttccggactgggggttatctccttcgaagatttctaccaagggatcaccgctattagaaatggagatcccgatggccagtgttacgggggagtggccagtgcgcaggatgaagagccactagcgtgcccagacgaattcgatgacttcgtgacctacgaagccaacgaggttaccgactcagcctacatggggagcgaaagcacgtatagtgagtgcgaaacatttactgacgaggataccagcacgttggttcatcccgaactgcaaccggaaggcgatgccgatagcgcaggtggatctgcagttcccagtgaatgcctcgacgctatggaggagccggaccacggcgcactgttgcttttgcccggacggcctcatccacacggccaatcagttatcactgttattggcggagaggagcatttcgaagattacggggaaggctcagaagccgaactgtctcccgagacgctttgtaatggacagctgggatgtagtgaccctgcatttcttacaccctcaccaacgaagcgtctgagctccaaaaaagtggctagatatctgcaccagtctggcgctttaaccatggaagcgttagaggacccctcccctgagctgatggagggccctgaagaggatatcgcagataaagttgtcttcctggagcgtcgcgtgcttgagctggagaaggataccgcggctaccggggaacagcactctagactgcggcaggaaaacctccagctggtgcacagggctaatgcactggaggagcagctcaaggaacaggagttgcgggcttgtgaaatggtccttgaagagaccagacgacaaaaggagctcttgtgtaaaatggaacgtgagaaaagtattgaaatcgaaaatcttcagaccagattacagcagctggacgaagagaattcagaactgaggagttgtactccttgtttaaaggctaatattgagcgtcttgaagaggagaagcaaaagctgttggatgagatcgagtccctcaccttaaggttatctgaagagcaggaaaacaagagaagaatgggcgacaggctcagccacgagcgccatcagtttcagagggataaagaggccacacaagaactcatcgaggatctgaggaaacagttggagcaccttcaactcctgaagctcgaagccgagcagaggcggggtaggtcaagctccatgggactccaggagtaccacagtcgggctagggagtcggagctggagcaggaagtgcgacgactcaaacaggataacagaaatcttaaagagcagaacgaggaacttaacggccaaattattacactgtcaattcagggggcaaagagtctgttctctactgcgttctcggagagcctggcagcagaaatttcttcagtctcccgggatgagctgatggaggccatccagaaacaagaagagataaattttaggctccaggactacatcgacagaattatcgtcgccatcatggaaaccaatccatctatcttggaggtgaagtag

SEQ ID NO: 237627 - DNA, 1383 bp, Artificial Sequence
  Description of Artificial Sequence: Synthetic coding sequence
atgagcctcctgagggccaatgaggtcaccgatagcgcgtacatgggcagcgaatccacatactccgagtgtgaaacatttactgatgaagacaccagtacactggtgcaccctgaattgcagccagaaggcgacgccgactctgcagggggatcggctgtgccatctgagtgtctcgatgctatggaagagccagatcacggtgcactgttgctccttcctggtcggcctcaccctcatggccagagcgtaataacagttataggtggagaggaacacttcgaagattacggggagggatccgaggctgaactgtctcctgaaacgctgtgtaacggtcagctaggctgttccgatcctgcgttcttgactccgtcccctacaaaaaggttatcgtccaaaaaagtggcccgatatctccatcagagtggggctttgaccatggaagccctggaggacccatctccagaactaatggaaggtccagaggaggatatcgctgataaggtcgtgtttctcgagcgaagagtgttggagctggaaaaagatacggcagctaccggagaacagcattccagactgagacaagagaatctgcaattggtacaccgcgctaacgcccttgaggagcaactgaaagagcaagaactgagggcgtgcgagatggtgctggaagagaccaggcggcagaaggagctgctctgcaaaatggaacgagagaagagcatcgagattgaaaacttgcaaacccggttacaacagctggatgaggagaatagtgagctgagatcctgcacaccctgcttgaaagccaacattgaacgtctggaagaggaaaagcaaaagctgctggatgagatagagtcactgactctaagactctccgaggaacaggaaaataaacgacgcatgggggatagactgtcgcatgaacgtcatcagtttcagagggacaaggaggctacccaagagctcattgaggatttgaggaagcagctggagcatctgcagttattgaaactggaggccgaacagcgcagagggcgttcctccagtatgggtctgcaggagtatcattctagggcacgtgagagtgagttggagcaagaggtgcgcaggctgaagcaggataatcgaaacctgaaggaacaaaacgaggagctgaatggtcagatcattaccctgtcaatacagggggcaaagtctctcttttctactgcctttagcgagtctcttgccgctgagatttcatccgtgagtagggacgagctcatggaggccatacagaagcaggaagagataaactttaggctacaagactacatcgatagaatcattgtcgccatcatggagactaatccctccattttggaggttaagtag

SEQ ID NO: 237628 - DNA, 1383 bp, Artificial Sequence
  Description of Artificial Sequence: Synthetic coding sequence
atgccctttctgaaagccaatgaggtgaccgatagcgcctacatgggttctgaaagtacatactccgaatgtgagacatttaccgacgaagatactagcaccttggtgcaccctgaactccagcccgaaggtgatgccgactctgccggtgggagtgccgttccatcggaatgccttgatgcaatggaagaacccgaccacggggctttactcctgctcccagggaggccccatccccacggccagtctgtcatcacggttatcggtggcgaagagcatttcgaggattatggcgagggctcggaagccgaacttagcccagagacactgtgtaacggtcagctggggtgtagcgacccagcctttctgacaccgagtccaactaagcgcctgtcttccaaaaaggtggccaggtatctgcatcaatccggcgctctgactatggaggcccttgaggatccttccccagaacttatggaagggccagaagaggatattgcagacaaagtggtgttcttagaacgtagggtactggaacttgaaaaagacaccgccgcaacaggtgaacagcacagtcgattgcggcaggaaaacctgcagctggtccaccgcgctaatgccctggaagagcagctcaaagagcaggagctccgtgcatgtgaaatggttctggaagagacccgacggcagaaggagctgctctgtaaaatggaacgggaaaagagcatcgagattgagaatctgcagaccaggctgcagcaactcgacgaggaaaattcggagctgagatcttgtacaccgtgtctgaaagcaaatatcgagcggttagaagaggagaaacagaagttactggacgagatcgaatcacttacactgcgcctgagcgaggaacaggaaaataagcgccgaatgggtgataggctttcccacgagaggcaccagtttcaacgcgataaagaggccacacaagagctgatagaggatcttcggaagcaactggaacatctgcagcttctcaagttagaggctgagcaacgacgaggccgatctagttctatgggtcttcaggaatatcactctcgggctagggagtctgaattagagcaggaggtgcgtagactgaaacaagacaataggaatctgaaggagcagaatgaggaactgaacggccaaattatcaccctgtctatccagggggctaaatccttgttcagtaccgctttctcagaaagcctggctgcggaaataagctctgttagcagagacgagttaatggaagctattcagaagcaggaggagatcaactttcgcctgcaagactacatcgatagaattatcgttgctatcatggagacaaacccctctattctggaagtcaagtag

SEQ ID NO: 237629 - DNA, 549 bp, Artificial Sequence
  Description of Artificial Sequence: Synthetic coding sequence
atggggtccgagtctacctattcagagtgcgagaccttcacagatgaggacacaagtacactcgtccaccctgagttgcagcccgagggggatgctgatagcgcagggggtagtgccgtgccctctgagtgtttggatgcgatggaagagcctgaccatggggctctgctcctcctcccaggtagaccacacccccacgggcaaagtgtaataactgtgatcggcggagaagaacactttgaagattacggcgagggcagtgaggcggagctctctccagaaacattgtgcaacggacagttgggatgttctgaccccgcatttctaaccccttctcccacaaagcgcctgtctagcaaaaaggtggcacggtacctgcaccaatcaggagctctgaccatggaggcactcgaggacccatcccctgagttaatggaagggccagaagaggacatcgcggacaaagtcgtgtttctggagcgtcgagttcttgaactggagaaggacactgcggcaacaggagaacagcactctcgcttgcgacagtag

SEQ ID NO: 237630 - DNA, 2406 bp, Artificial Sequence
  Description of Artificial Sequence: Synthetic coding sequence
atggccagcgccccaccagctagccccccaggaagtgagcctcctggtccagatcccgagcccggaggaccggatggtccaggcgcagcgcaattggctccaggacctgccgagttgagactaggcgcacccgttgggggtccggacccccagagccctgggttagacgagccagcccctggggctgcagcagatgggggtgctcggtggtcagccggaccggcacccggactggagggaggcccacgggatcctggcccaagcgctccacccccacgtagcggcccaaggggccagctggcttctcccgacgcaccaggtcctgggccacgatccgaagcgcctctgccagagttggatccactgttttcttggacagaggaacctgaagagtgtggtcccgcaagctgtcccgagagcgctcccttccggctgcagggatctagctcctcgcaccgagctcgcggagaagtcgacgtgtttagtccctttcccgcaccaaccgccggtgagctggcactcgagcagggacccggatcaccaccccagccttccgatctatcccagactcacccattgcccagtgaacctgtgggcagccaggaggacggacctagactgcgagcggtgtttgacgcccttgacggggacggtgatggtttcgtccgaatcgaggactttattcaatttgctaccgtttatggcgcagagcaggtcaaggaccttacgaagtacttagatccctccgggttgggagtcatcagcttcgaggatttctatcagggcattacagccatcaggaatggggacccagacgggcaatgttacggtggcgtggcatctgcccaggacgaggaacccctcgcctgccccgacgagttcgatgattttgttacctacgaagcgaatgaagtgactgactcagcgtatatgggaagcgaatctacttactccgaatgcgaaacttttacagatgaagacacctccactctggtacaccccgaattgcaaccggagggcgacgcggactccgctggcggaagcgctgttccttccgagtgccttgacgctatggaagaacctgatcatggggctctgctgttgttacctggccgaccacacccccatggccagagtgtcatcactgtgatagggggtgaggaacatttcgaggattatggagagggatccgaagcagaattatctcccgagactctctgcaatgggcagcttggttgctccgatcccgcatttctcacaccttctacagatccactggctgccaagctgcactctattctgactgacgaagccttcgagttttactgcagtcagtgtcacaagcagatcaaccgtcttgaggatctgagcgcccgactgtccgacctcgagatgaattcccctaccaagcgcctttcatccaaaaaggtggcccgttacctgcaccagtctggcgctttgacaatggaagccctggaggatccgagccctgagctgatggaggggccagaagaggacatcgctgataaggttgtgtttcttgaaaggcgggtgcttgagcttgagaaagacactgcagccaccggagagcaacattctcgcctgagacaagagaacctgcaacttgtgcacagagccaatgctttagaagaacagctcaaggaacaagagctgcgagcttgtgaaatggtcctcgaggaaactagacgtcagaaggaattgctgtgtaagatggaaagagagaaatccatcgagatcgaaaatctgcaaacgcgccttcagcagcttgacgaggaaaactcagagcttaggtcttgcactccttgcctcaaagctaacatagaacgcctcgaagaagagaaacagaaactgctcgacgagatcgagagcctgacactccgactctcagaggagcaagaaaacaaaaggcgcatgggggaccggctgtctcatgagagacaccagtttcagagagacaaggaagctacacaggaacttatcgaggacctccgcaagcagttggaacacctgcagctccttaagctggaagccgaacagcggagagggaggtccagtagcatgggtctgcaggaataccactcccgggctcgagaatccgagctggagcaggaagtgcgaaggctgaagcaggataatcgtaaccttaaggaacaaaacgaggagctgaacggccagatcatcactctgagcatccagggagccaagtccctgttctctactgccttttcagagtctcttgccgctgagatcagtagcgtgagcagggacgaactgatggaggctatccagaaacaggaagagattaactttagacttcaggactacatagacagaattatcgtagccattatggagacgaacccctccatcttggaggtaaagtag

SEQ ID NO: 237631 - DNA, 1914 bp, Artificial Sequence
  Description of Artificial Sequence: Synthetic coding sequence
atggcaggcggagccggatggagcggggcacctgccgctctcctgaggagcgttcgccgactgcgtgaagtttttgaggtgtgcgggagggaccctgacggtttcctgcgggtagaacgcgtggctgctcttggtttgaggttcggccagggggaagaagtggaaaagctggtgaagtacctggaccccaacgatttgggacgcatcaatttcaaggatttctgtaggggggtgtttgcaatgaagggatgtgaagagcttttgaaggacgtgctatcagtggaatccgccggtacgctgccctgcgcccctgaaatcccagattgcgtcgaacagggttccgaagtaacaggtccaacttttgcagacggagagctgatcccacgggagcccggttttttcccggaagacgaggaggaagcaatgacgctggcacctcccgaagggccacaggagctgtataccgattctcctatggaatcgacccaaagccttgaggggtcagtgggcagtccagccgagaaagacgggggactgggcggtctgttcctccctgaggataagtcactcgtgcacaccccctctatgactacgtccgaccttagcactcactcaacgacatccctgattagcaatgaagagcagttcgaggactacggggaaggagacgatgttgattgtgccccttccagcccgtgcccagatgatgaaacaagaaccaatgtttactccgatcttggttcttcagtctcatcatccgctggacaaacacctagaaagatgagacatgtgtacaatagtgagctgctcgatgtgtactgctcccagtgctgtaagaagatcaacctgttgaatgatctagaggcgaggctgaaaaatctaaaggccaattctccgaacaggaaaatctcatcaacagccttcggcagacagctcatgcatagttctaatttcagttccagcaacggtagcacggaagacctgttccgcgattccatagactcctgcgataacgatataaccgagaaggtgtcttttcttgagaaaaaagttaccgagttggaaaatgattccctgactaatggcgacctgaagagtaaactcaagcaagaaaatactcagctggtgcaccgcgtgcatgaattggaagagatggtcaaggaccaagagaccaccgcagaacaagctcttgaggaagaggctagaaggcatagggaggcgtatggcaagctggagcgggagaaggccacagaggtcgagctgctgaacgcaagggttcaacaactcgaggaggaaaataccgaactccggacaacagtgactaggcttaagtcccaaaccgagaagctggatgaagaaagacagaggatgagcgataggctagaggacaccagcctacggttgaaagatgaaatggacttatataagaggatgatggataagctgcgccagaatcgccttgagtttcaaaaggagagggaggctactcaagagctcatcgaggacctgaggaaggagctggagcacctgcagatgtataaacttgattgcgaaagacccggtagaggacggtccgcaagtagcggactcggtgagttcaacgcccgagctagggaggtcgagctggaacacgaggtcaagcgtctgaaacaggaaaactataagttgagagaccagaacgatgacctgaacgggcagatcctgagcttgtccctgtatgaggctaagaacttgttcgccgcacagaccaaagctcaatcccttgcagcggaaatagataccgccagcagggatgaactgatggaggcactcaaagaacaggaggaaattaattttcggctccgtcagtatatggacaagattattttagctattttggaccacaatccaagcatcctcgaaattaagcactag

SEQ ID NO: 237632 - DNA, 1914 bp, Artificial Sequence
  Description of Artificial Sequence: Synthetic coding sequence
atggctgggggagcaggctggtctggggctcccgcagcgctcctgcgatctgtccgcagattgagagaagtctttgaggtgtgcggcagggatcccgacggcttcctaagggttgagcgagtggcggcattgggattaaggtttggacagggtgaggaggtagaaaagctcgtcaagtacctggatccaaacgacctaggccgaataaattttaaagatttttgccgtggggtctttgcaatgaagggctgtgaggagttgttaaaggatgtgctgtcagtagagagtgctgggacactgccctgcgcacccgagattcccgactgtgtggagcaggggagtgaagtaacaggcccaacttttgcagacggggaactgatacccagagagccagggtttttccccgaagatgaggaagaggcaatgacattggcgcctcccgagggaccacaggaactgtacacagattcccccatggagtccacacaaagtctcgagggaagcgttggttccccagctgagaaggatggaggcctcggagggctgtttctcccagaagataaaagtctcgtccacaccccatccatgactacttcggacctttctacccatagcaccacatccctgattagcaacgaggaacaattcgaagattacggcgaaggagacgacgttgattgtgctcccagcagtccatgccctgatgatgaaacacgtacaaacgtatattccgaccttggaagtagcgtcagtagctctgccggtcagacaccgcgtaaaatgcgacatgtttacaactcggaactgcttgatgtgtactgctctcagtgctgcaagaaaattaatctgctcaatgatctggaggcgagactgaagaacctcaaggccaatagtcctaacagaaagatatcaagcacagccttcggcagacagctgatgcactcaagcaatttctcgtctagcaacgggtctacagaggatctttttagagactccatcgatagctgcgataacgatatcacggagaaagtatcctttctggagaagaaggttaccgagttggaaaacgacagccttaccaatggcgacctcaagtcaaagttgaaacaggaaaatacgcagttggtacatcgcgtacacgaactggaagagatggtgaaggaccaggaaacaaccgctgaacaagctctggaggaagaagctcggaggcatcgagaggcgtacggaaaactagagagagagaaggccactgaggtcgagttattgaatgcgagggtgcagcagctggaagaggaaaacaccgagctgcgtaccaccgtcacccggttgaaatcacaaactgagaaactcgacgaggagagacaacggatgagcgatagactcgaagatacttccttgcggctcaaggacgaaatggatctgtacaagcggatgatggataagctgcgacagaataggctggagtttcagaaggagagggaagctactcaggaattgatcgaagatctacggaaagaactggagcatttacagatgtacaaattggactgtgagaggcctggcagaggacggtcagccagctctgggttgggagagtttaatgcccgtgcacgtgaggttgaactggagcatgaggtcaaacgattgaaacaggaaaactacaaactgagagatcagaatgatgatctgaatggccagattttgtcactgtccctgtacgaggcaaagaatctttttgcggcacagacaaaggcacaatcccttgccgcagagatagacacggcctctagagatgagttgatggaggctttgaaggagcaagaggagattaacttccgcctcagacaatacatggataagataattttagccattctcgaccacaatccctccatcctggagattaagcattag

SEQ ID NO: 237633 - DNA, 651 bp, Artificial Sequence
  Description of Artificial Sequence: Synthetic coding sequence
atggggacgcgcgatgatgagtacgattacctgttcaaagtggtactgatcggggattccggggttggaaagtcaaacctgttgtcccgattcacaaggaatgaattcaatctggagtctaagagcactattggagttgaatttgccaccagaagcattcaggtagacggtaagactatcaaagcacagatctgggatacagccggtcaggaaaggtacagggccattacatccgcctattaccgtggagccgtaggcgcactactggtctatgatattgctaagcatcttacatatgaaaacgtggagcgctggctcaaggagttgcgagaccatgcagattccaatattgtgatcatgctggtgggcaataagagcgacctcagacacttgagagcggtaccgactgacgaggccagggccttcgcagagaaaaatggtctgagctttatcgaaacttccgccctggatagtactaacgtggaggcagccttccagaccatcctgacagagatctacaggatcgtgagccagaagcagatgtctgacaggagggaaaacgatatgagtccatctaacaatgtggtgcctatccatgtgcctcccaccaccgaaaacaaaccaaaagtgcagtgctgtcagaacatctag

SEQ ID NO: 237634 - DNA, 468 bp, Artificial Sequence
  Description of Artificial Sequence: Synthetic coding sequence
atgggaacgagggacgacgagtacgattatctgttcaaggtcgtgttgattggcgacagcggcgtgggaaaatccaacctcctatcccgatttactcgaaatgaattcaatctcgaaagcaaatcaactattggagtcgaatttgcgacccgcagtatccaggtagacgggaagacgattaaagcacaaatttgggataccgcaggccaggagcgatatcgggcaatcacaagtgcgtactacagaggcgcagtgggggcattgttggtttacgacattgcaaagcacctcacatacgagaatgttgaacggtggttgaaggaactcagggaccacgcagattcaaacattgtgatcatgctcgtaggtaacaagagtgaccttagacacctccgagctgtaccaaccgacgaagccagggccttcgcaggttataataaagcaaatgtgagacagacccgcaaatag

SEQ ID NO: 237635 - DNA, 612 bp, Artificial Sequence
  Description of Artificial Sequence: Synthetic coding sequence
atggcaaaggcctatgaccatctttttaagttgttgctgattggggattctggggtgggcaagacctgcctcataatccgctttgctgaggacaattttaataatacatacatctctaccatcggcattgattttaagattcgcaccgtagacatagagggaaaaaagatcaagctccaggtctgggacacagccggacaagagcggttcaagaccatcacaacagcatattaccggggagcaatgggtatcattctcgtctacgacattaccgacgagaagtcgttcgaaaacatacagaactggatgaaaagcattaaggagaatgcgtctgctggcgtggaacgcttactgctcggcaataagtgcgacatggaggccaagcgtaaggtgcaaaaagagcaggcagacaagctggcgagagaacatggtattagattttttgaaacaagcgctaagtcttcaatgaatgtggatgaagcatttagctccctggcgagggacatcctgttgaagtcagggggtcggagaagcggcaacgggaacaaacccccatcgaccgatctgaaaacttgtgataagaaaaacactaacaaatgctccctcggctag

SEQ ID NO: 237636 - DNA, 648 bp, Artificial Sequence
  Description of Artificial Sequence: Synthetic coding sequence
atggccactgcaccatacaactactcctacatttttaaatacattattatcggggatatgggagttggaaaatcatgcctgctgcatcagttcaccgaaaagaagtttatggccgactgtccccacaccatcggcgttgaatttggtacgcgaataatcgaggtaagtggccagaagatcaaactgcaaatctgggatacggctggccaagagcggtttagggctgtcacacgctcctactaccgcggtgcagccggtgcactgatggtttacgatatcacacggagaagtacctacaatcacttgtcctcttggctgaccgacgctagaaacctgacaaatccaaacactgttatcatcctgataggtaacaaggccgacctggaagctcagagggacgtcacctacgaggaggccaaacagttcgccgaggaaaatgggctgttattcctggaagcctcagcaaaaactggggagaacgtagaggacgccttccttgaggccgctaaaaagatttaccagaacatccaggatgggtctttggacctaaacgccgctgaatctggagtccagcacaagcctagcgcccctcaggggggaagactaacaagcgagcctcaaccccaacgagaaggatgcggttgctag

SEQ ID NO: 237637 - DNA, 546 bp, Artificial Sequence
  Description of Artificial Sequence: Synthetic coding sequence
atggcaaccgcaccatacaactattcctacattttcaaatacattatcataggcgatatgggcgttggtaaaagctgtctgctccaccagttcacagaaaaaaagttcatggctgactgtccacatactataggagtcgaatttgggacccggatcattgaagtgagtggacagaaaattaagttacagatttgggacactgctggacaagagcggttccgagctgtaacccgatcttactaccgcggagcggcaggggctctgatggtgtatgacatcacaaggcggagtacctacaatcatcttagttcatggctgacagatgcccgaaacctcactaatcctaacactgtcataatactgattggaaataaagccgatctggaggcacagcgggatgtgacctacgaagaagcaaaacagtttgctgaagaaaacggccttctctttttagaggcctcagctaagaccggggagaatgtagaagatgcattcctcgaagcagccaaaaaaatctaccaaaatattcaggatgggtccctgtag

SEQ ID NO: 237638 - DNA, 711 bp, Artificial Sequence
  Description of Artificial Sequence: Synthetic coding sequence
atgggacagaaagcttctcaacaactcgcactcaaagattcaaaagaagtccccgtggtctgcgaggttgtctcagaagcaattgtccacgcggcacagaaattaaaagaatacttgggattcgaataccctccatcaaagctgtgccctgccgctaacacacttaatgagatattcctgatacactttatcactttttgccaggagaagggcgtcgatgagtggctgaccacaacaaagatgactaagcatcaagcctttctgtttggtgctgattggatatggacgttttggggcagtaacaagcagatcaaactgcagctcgccgtacagacactgcagatgtcgtctccccctccagtggagagcaagccctgcgacctttccaatcccgaatcgagggtcgaagagtcttcttggaagaagtcacggtttgataaactggaggaattctgtaacctcatcggcgaggactgcctcgggcttttcatcattttcggcatgccgggaaaacctaaggacattcggggagtggtgctggattccgtcaagagtcagatggtaagatcgcatttgcctgggggaaaggccgtggcccagtttgttctggagacagaagactgtgtgttcataaaggaattgctgagaaactgtctttccaagaaagatggattgagggaggtgggaaaagtctacatcagcattttatag

SEQ ID NO: 237639 - DNA, 639 bp, Artificial Sequence
  Description of Artificial Sequence: Synthetic coding sequence
atggcacaggcgcaccgcactccccagcccagggccgcaccatcacaacctagagtctttaagttggtactgcttggttccggcagtgtggggaaaagctctctagctctgagatacgtgaagaatgattttaagtcaatactgcccactgtcgggtgcgctttctttacaaaggtggtggatgttggtgccaccagcctcaaattggagatctgggatacagctggccaggaaaagtatcactccgtgtgtcacctttactttagaggcgcaaatgctgctcttctggtgtatgacatcacgcgcaaagacagtttcctgaaggctcagcaatggttaaaagatttggaggaagagctgcatcctggagaagttctcgtcatgcttgtcggcaataagaccgatcttagccaggagcgtgaggtgacctttcaagagggcaaggagtttgcagactcccagaaactactgtttatggagaccagtgctaaattgaatcatcaggtgagcgaagttttcaacaccgtggcccaagaactcctgcagcggtcagatgaggaagggcaggctcttcgaggcgacgcagctgtggcacttaacaaggggcctgccaggcaggctaagtgctgtgcacattag

SEQ ID NO: 237640 - DNA, 258 bp, Artificial Sequence
  Description of Artificial Sequence: Synthetic coding sequence
atgctggtcgggaataagacggatttaagccaggagcgcgaagtgactttccaggagggcaaagagtttgccgacagccagaagttgctgtttatggaaacttctgctaaattgaaccaccaggtctcagaggtgttcaacacagtggcccaggaattactgcagaggagtgacgaagaggggcaggcactccgcggagacgcagcggtggctcttaataaaggacctgcaaggcaggctaaatgttgcgcccattag

SEQ ID NO: 237641 - DNA, 621 bp, Artificial Sequence
  Description of Artificial Sequence: Synthetic coding sequence
atggacgaggatgtgctgacgacactgaagatccttatcattggagagagcggggtgggtaaatcgtcactgcttctacgctttaccgacgacacctttgaccccgagctcgcagctaccatcggcgtggactttaaggttaagacgattagcgtggacgggaataaggctaaattggcaatttgggataccgcgggtcaggagcgcttcagaacactcaccccttcctattatcgtggcgcacagggagtgatcctggtctatgacgtaacccggcgagacacctttgtgaaattagacaattggctgaacgaactggagacatattgcacgcgcaatgatatcgtgaacatgctcgtaggcaataaaattgacaaggagaacagagaggtagatcgcaacgagggattgaagttcgccagaaagcacagcatgttgtttatcgaagcttctgccaaaacctgtgatggtgtgcagtgtgccttcgaggaactggttgagaaaatcatacagactccagggttatgggagtccgagaaccagaataagggcgtgaagctttcgcatagggaagaaggccagggtggcggagcctgtggaggctactgttctgtgctatag

SEQ ID NO: 237642 - DNA, 486 bp, Artificial Sequence
  Description of Artificial Sequence: Synthetic coding sequence
atggacgaggatgtgttaaccaccttaaaaatactcatcattggcgagtcaggagtcggcaagtcctccctgttgctgcgttttactgatgacaccttcgaccccgagctggcagcaaccatcgtgtacgatgtcacaagacgagacactttcgtcaagttagacaattggctgaacgaactggagacatactgcaccaggaacgatattgttaacatgcttgtggggaacaagatcgacaaggagaatagggaggtggacaggaacgagggcctgaaatttgctaggaaacacagcatgctttttatcgaggcatcagcaaagacatgcgatggagttcagtgtgcatttgaagaactcgtggagaagattatccaaacacccggattatgggagagcgaaaaccagaataagggtgttaaattgagccatagagaagagggccagggcggaggagcgtgcgggggttattgctctgtcctgtag

SEQ ID NO: 237643 - DNA, 876 bp, Artificial Sequence
  Description of Artificial Sequence: Synthetic coding sequence
tgacgcttaccgggttcacggccacttcctggcccatcctccttaggcaggagcccctcttgtagtgcagaaaaaacgccgttccggggaccccctctcgggcgacagtccgctgtcaaggagctggacctggtgacggctgggaagtttagattcagcgtgagaagtgaatgcttctcaagaggcccaccactgaagattaaatgcaactgttatttttccttctgtcatatcttgtggcgccagaagatcagcgtagtgctgtcattcttcactttcagcctaggaaagattatactgactgtggagctgagcatcagtctgctgctacggttcacggatgataccttcgacccagagctggctgctacaataggcgtcgattttaaggtgaagaccatctctgtggacggcaacaaggcaaagctcgcaatatgggtaacccttcaccagcagaccgcaaatttctttctgaagtcccaaattggcaatagtccaatcctcaagtgggccatgtggcagtacgatactgccggacaggaacgcttcaggacactgactcccagttattataggggtgcccagggggtgatcttagtgtatgatgtcacgcggagagatactttcgttaaactagacaattggctgaacgagcttgagacctactgtacccggaatgacatcgttaacatgttggtggggaataaaatcgacaaagaaaaccgcgaggttgatagaaacgagggtctaaaattcgcaagaaaacattcaatgctcttcattgaggcgtccgccaagacatgtgacggggtgcagtgtgcatttgaagaactcgttgaaaaaattattcagacgcctggtctctgggaatcatag

SEQ ID NO: 237644 - DNA, 429 bp, Artificial Sequence
  Description of Artificial Sequence: Synthetic coding sequence
atggacgaagatgttctgactaccttaaaaatcctcataatcggcgagagcggggttggcaagagtagtctgttactccgatttacagacgatactttcgatcctgagttagccgcaactattggtgtcgacttcaaggtaaagacgatttctgtggacgggaacaaagccaagctagctatatgggaaaatcgggaagtggatcggaatgaaggcctgaagtttgccaggaaacactctatgctattcatcgaagcctctgccaagacttgcgatggcgtgcagtgtgctttcgaggagttggtagagaaaatcatccaaacccctggtctctgggaatccgagaatcagaataagggtgtgaaattgagtcatcgggaagaaggacaagggggaggagcgtgtgggggatattgttcagtgttatag

SEQ ID NO: 237645 - DNA, 555 bp, Artificial Sequence
  Description of Artificial Sequence: Synthetic coding sequence
atggacgaggatgttttgactaccctgaagatcctaatcattggagagtcaggggtgggcaagagctcccttctgctgaggttcacagacgacacattcgacccagaattggccgcaaccgacactgccggtcaagaacggttccggactctgacacccagctattacaggggagctcagggcgttatcttggtgtacgatgtgacaaggcgcgacacattcgtgaagctcgacaactggctgaatgaactggaaacctactgcaccagaaatgatatcgtgaatatgctggtaggtaataagattgacaaggagaatagggaggtagatcgaaacgaaggattgaagtttgcgagaaaacattccatgcttttcatcgaggcttctgccaaaacttgtgacggcgtgcagtgcgcgttcgaggaactggtggaaaaaatcatccaaaccccagggctttgggaatcagaaaatcaaaacaagggcgttaagttatcccaccgtgaggagggtcagggcggtggtgcttgtggaggctactgcagtgttttgtag

SEQ ID NO: 237646 - DNA, 390 bp, Artificial Sequence
  Description of Artificial Sequence: Synthetic coding sequence
atgtcctcaatgaaccctgaatacgattacctgtttaaactacttctgattggggactccggcgtgggcaagtcctgcctgctgttaaggttcgcggacgacacgtacaccgaatcatatatctctactatcggcgtggacttcaaaattcgcaccatcgagcttgatgggaagaccataaagctgcagatcgaatttgcagatagtttggggattcccttcctcgaaacgagtgcaaaaaacgccaccaatgttgaacaatcatttatgaccatggctgcagaaatcaaaaaaagaatggggccaggagccactgctggcggtgcagaaaaatcgaacgtgaaaatccagagcacaccggtaaagcaatccggagggggatgttgctag

SEQ ID NO: 237647 - DNA, 390 bp, Artificial Sequence
  Description of Artificial Sequence: Synthetic coding sequence
atgtcttgcctgcaccctacctcagactatctcttcaagctcctgcttatcggcgacagtggtgttggcaagtcttgcctgctgctgagatttgccgacgacacctacaccgagtcctatatttccacaattggcgtagactttaaaatccggacaatcgaactggacggtaaaaccataaagctacaaatcgaatttgccgactccctggggattccattcttggaaaccagcgcaaagaatgcaaccaatgtggagcagtcctttatgacaatggctgcggagataaaaaagcgtatggggccaggggctaccgccggtggcgcagagaagtctaacgtaaaaatccagagtaccccagtgaaacagagcggtggaggatgctgttag

SEQ ID NO: 237648 - DNA, 522 bp, Artificial Sequence
  Description of Artificial Sequence: Synthetic coding sequence
atgtcgtctatgaaccccgagtatgattacttgttcaagctgctgctgattggagacagcggagtagggaagagctgcctcctactgcgctttgctgatgatacctacacggaatcttacatcagtacgatcggcgtcgacttcaaaattcggaccattgaactcgatggcaagaccatcaagctgcagattgagagttttaataacgtaaaacagtggctccaggagatcgacaggtatgcgtctgaaaacgtgaataaactgcttgtgggaaacaaatgtgacctcaccaccaaaaaagtggtggactacaccactgcgaaggagttcgctgattcactgggcatccccttccttgagacatcggccaaaaacgccacgaacgtggaacagtcctttatgactatggctgcagaaataaaaaagagaatgggcccaggggcaaccgcaggcggtgctgagaaaagcaacgtcaagattcaatctacaccggtgaaacaatcaggagggggatgttgctag

SEQ ID NO: 237649 - DNA, 522 bp, Artificial Sequence
  Description of Artificial Sequence: Synthetic coding sequence
atgagcagcatgaatcccgaatatgactatctattcaaactcctcctcatcggggacagcggagtaggaaaatcctgccttctgctcagatttgcatgggataccgccggacaggagcgctttagaaccatcacatcgagctactatcggggagcacacgggatcatcgtggtttacgacgttacggaccaggaaagcttcaataacgtgaagcagtggctgcaggagattgatcggtatgcatctgagaacgtaaataaattgcttgtgggaaataagtgtgatctgactacaaaaaaggtggttgattatactacagcgaaggagttcgccgatagcctcggaatccctttcctagagactagtgccaagaacgcgaccaacgtcgagcaatcttttatgacaatggcagccgagattaaaaaacgcatgggacctggggctaccgctggcggagccgagaagtcaaatgtgaagatccagtctacacctgtcaagcagagtgggggaggctgttgctag

SEQ ID NO: 237650 - DNA, 618 bp, Artificial Sequence
  Description of Artificial Sequence: Synthetic coding sequence
atgtccagtatgaatcctgaatacgattatctgtttaagctgttactcatcggtgacagcggggtgggcaagtcctgtttgttgctgcgttttgcagacgatacttacacggaaagctacatcagtacaattggcgtcgacttcaaaatccgaaccatagaacttgacgggaagacaatcaagctccagatttgggacaccgcgggacaggagcgcttccggaccattactagctcttattaccgaggcgctcacggcattatcgtcgtttacgacgtgaccgaccaggagtccttcaacaatgtgaaacagtggctgcaggagatcgatcggtacgcatctgagaacgtcaataagctcttggtcggcaataaatgtgacttgactaccaagaaagtggttgattatacaaccgctaaggagtttgctgacagcttaggaatcccttttttagagacctccgccaagaatgccaccaacgtcgaacagtcctttatgaccatggccgcagagattaagaagaggatgggtccaggcgctacagccggaggcgcagagaaatcaaatgtcaaaattcagtcaacacccgtgaaacagtctggaggaggatgctgctag

SEQ ID NO: 237651 - DNA, 426 bp, Artificial Sequence
  Description of Artificial Sequence: Synthetic coding sequence
atgtcgagtatgaatcctgagtacgactatctcttcaaattgctgctgattggggacagtggagtgggcaaaagttgtttactattacgctttgccgagtccttcaataatgttaagcagtggctccaagaaatagacaggtatgcctccgaaaacgtcaacaagctgctggtgggaaacaagtgcgatcttacaaccaagaaggtcgttgactacaccactgccaaggaattcgccgactcactggggatcccttttctcgagacttccgccaagaatgcaaccaatgtggaacagtcattcatgactatggccgcagaaattaagaagcggatggggcctggcgctactgcgggaggggcagagaagagcaacgtcaagatccagtcaacccccgtcaaacagtctggagggggttgttgctag

SEQ ID NO: 237652 - DNA, 606 bp, Artificial Sequence
  Description of Artificial Sequence: Synthetic coding sequence
atgaaccccgagtatgattacctctttaaactattactcattggggattccggagtgggcaagagttgcctcttgctgagattcgcagacgatacttataccgaaagctatatctcaacaatcggcgtggatttcaagattagaacaatcgaactggatgggaagactatcaaattgcagatctgggataccgcagggcaagaacgcttccggaccatcacttcctcttactaccgcggagcccacggcattatcgtagtgtacgatgtgaccgatcaggagtcgtacgcaaatgtgaagcagtggctacaggagatcgatcgatacgcgagcgagaatgttaataagctacttgtgggcaacaagtcagacctgactaccaaaaaggtggttgacaacaccactgcgaaagagtttgccgactcgctcggaatcccatttctggagacttccgcaaagaatgcaactaacgtggagcaagcatttatgactatggcagctgaaatcaagaaacggatggggcctggagcggcttcaggtggggagcgccctaaccttaaaatcgactctacaccagttaagccagccggaggtgggtgttgttag

SEQ ID NO: 237653 - DNA, 489 bp, Artificial Sequence
  Description of Artificial Sequence: Synthetic coding sequence
atgaatcccgagtacgattaccttttcaagctcctgctcataggagatagcggtgtagggaagagctgcctattgctgcgatttgccgatgacacttatacggagtcctacattagcaccataggggtggactttaagatccgcaccattgaactcgacggtaagacaattaagctacagatctgggacaccgccggtcaggagaggtttcggactatcacttcctcatactatcggggtgctcacggcataattgtcgtgtacgacgtcaccgaccaggaaagctatgcaaacgtcaagcagggctgcagaaggcttacagcaatgcctgcccgaacatcgatttcctcctggtgggctacacgcgctacttcacccccacgtcgttggtggaccacacctcagcccaggtcgcttcagactctgtgggccagcccaagctggcgcagagcaccaaggatgccacctatgtctagtcgaagatcttag

SEQ ID NO: 237654 - DNA, 360 bp, Artificial Sequence
  Description of Artificial Sequence: Synthetic coding sequence
atgaacccagagtacgactacctgttcaagctgttactcatcggtgactccggtgtcggtaagagctgcttgttgcttcggttcgccgacgatacctatactgagagttacatcagcaccatcggtgtagacttcaaaataaggacgattgaattggatggcaagacaattaaactgcagatttgggatacagccggtcaggagagattccggaccatcacaagctcttattacagaggtgctcatggcatcattgtggtctatgacgtgacagatcaggaatcatacgccaatgtgaagcaatggctccaagaaattgatcgttacgcgtctgagaatgtcaacaaacttttggtctag

SEQ ID NO: 237655 - DNA, 678 bp, Artificial Sequence
  Description of Artificial Sequence: Synthetic coding sequence
atggccgcagcgggaggcggaggcggaggcgctgctgccgctggccgagcctactcatttaaggtagtcctactgggggaaggctgtgtgggcaagaccagtctcgttttgcgatattgtgaaaataagttcaacgacaagcatattacaacactccaggcttcctttctcacaaagaaactgaacatcggtggtaagcgcgtgaacctggctatatgggatacagccggtcaggagagattccacgccctgggaccaatctactaccgcgactctaacggggctattttggtgtacgatatcaccgatgaagacagcttccagaaggtcaaaaactgggtaaaagagctcagaaagatgctaggcaacgagatctgcctctgtattgtcggtaacaaaattgatctggagaaagagcgccacgtaagtatccaggaagccgagtcttatgcagaaagcgtaggcgctaaacactaccatacatccgccaaacaaaataaaggtatagaagagctcttcctcgacctctgtaagcggatgatagaaaccgctcaggtggacgaacgcgctaagggtaacggttcttctcagcctggcaccgctcggcgtggcgtacaaataatcgatgatgagccccaggcccagacatctggagggggatgttgttcttccggctag

SEQ ID NO: 237656 - DNA, 585 bp, Artificial Sequence
  Description of Artificial Sequence: Synthetic coding sequence
atggcgcttcgagagctcaaagtctgcctgctgggtgacactggcgtcgggaagtcgagcatcgtttggcggtttgtagaggactcgttcgatcccaacatcaatccaacaatcggcgcaagttttatgacaaaaaccgtgcagtaccaaaatgagcttcacaaattcctcatatgggatacagcaggtcaggaacgctttagagccctagcccctatgtattatcggggaagtgcggcagcaattattgtgtacgatatcactaaagaggagacattttctacgcttaaaaactgggtgaaagaactgagacaacacggaccgccaaacattgtagtggcgattgcagggaataaatgtgatctaatcgatgtaagggaagtgatggaacgggacgcaaaagactatgctgattcaatccacgcaatcttcgtggaaacatctgccaaaaacgctatcaatataaatgagctgtttatagaaatttctcggcgaattccctccacggatgctaacctgccatcaggcggaaagggttttaagctaaggaggcagccgtctgagcccaaacggagttgctgttag

SEQ ID NO: 237657 - DNA, 714 bp, Artificial Sequence
  Description of Artificial Sequence: Synthetic coding sequence
atgctggaggaggacatggaggtggccatcaagatggtggtagtgggtaatggcgcagttggaaaatcatctatgattcagaggtactgtaaaggcatcttcactaaagactacaagaaaaccattggtgtggattttcttgagagacagatccaggtgaatgacgaggatgtgagactcatgctctgggataccgccggacaagaggaatttgacgctatcaccaaggcgtattatagaggagcacaggcatgcgtgcttgtgttttctacgactgatcgcgaatcgtttgaagccgtaagctcttggagagagaaagttgtcgctgaagttggcgacatcccaacagttctggtgcagaacaagatcgatctcctcgacgactcttgcattaaaaacgaggaggccgaggccctggccaagagactgaagttacgcttctataggacctccgtgaaggaggacctgaacgtaaacgaagtgttcaaatacctggcagaaaaatacctgcagaagcttaaacaacagatcgcagaagatccagaactcacacattcctcctccaataagatcggggtttttaataccagcggcggttcgcactcaggacaaaacagtggcactctgaacgggggtgacgttatcaatcttagaccaaataagcagcggaccaaaaagaaccggaacccattctctagctgcagcatcccctag

SEQ ID NO: 237658 - DNA, 714 bp, Artificial Sequence
  Description of Artificial Sequence: Synthetic coding sequence
atgctggaagaggatatggaagtggccatcaagatggttgtggtggggaacggagcggttggaaaatcatcaatgatccagcggtattgcaaagggattttcacaaaagattataagaagaccataggtgttgactttctagagcgtcaaatacaggtgaacgatgaggacgttcgtctcatgctatgggatactgctggtcaagaagagttcgacgctattacaaaggcttattataggggagcacaggcgtgcgtcctcgtgttctccacaactgacagagagtctttcgaggcggtatccagttggcgagagaaggtggtcgctgaagtgggcgatatccccacagtcttggtgcaaaacaaaattgatctcctggacgatagttgcattaagaacgaagaagctgaagctctggctaaacgtctcaaattaaggttttatcggacatcggtgaaggaggacctgaatgtgaacgaagtattcaaatatctggcagagaagtacctgcaaaaactgaagcagcaaatcgccgaggacccggaattaacccattccagctcaaataaaattggggtattcaacaccagcggtggaagccactctggtcagaatagcggcaccctgaacgggggagatgtgataaaccttcgcccaaacaaacaacgaactaaaaaaaaccgcaaccctttctcctcttgctcaattccttag

SEQ ID NO: 237659 - DNA, 612 bp, Artificial Sequence
  Description of Artificial Sequence: Synthetic coding sequence
atgtctgggcagcgcgtcgacgtcaaggtagtgatgctgggcaaggagtacgttggcaaaacttctttggtagaacggtatgtgcacgaccgattcctcgtggggccttatcagaatactatcggggctgcttttgtggcaaaagtaatgtcagtgggagacagaaccgtgacactaggcatctgggacacagcgggaagcgaacgctacgaagcgatgtccaggatctactatagaggggctaaagccgcaatcgtttgctatgacctgaccgacagttcctcatttgaaagggcaaaattctgggtcaaagagcttcggtccctcgaggaaggttgccagatctatctctgtggcaccaagtccgacctgttagaagaagatcgtagacgacgtagagtggacttccatgatgtgcaggattatgcggataatatcaaagctcagctttttgagacttctagcaagaccggacagagcgttgatgagctgttccagaaggtggcagaagactatgtcagcgtagccgctttccaggttatgaccgaagacaagggagtggacttagggcaaaagccgaacccgtacttctactcttgctgccatcactag

SEQ ID NO: 237660 - DNA, 612 bp, Artificial Sequence
  Description of Artificial Sequence: Synthetic coding sequence
atgtcaggacagcgtgtcgacgttaaagtggtgatgttggggaaagaatacgtggggaagaccagcctcgtggaacgttacgtgcatgatcggttcttggtgggtccttatcaaaacaccatcggcgcagcattcgtggcgaaagtgatgagtgttggagatcggactgtcaccctcggcatctgggacactgcaggctcagaaagatacgaggccatgtcccggatttactatagaggggctaaggcagcaattgtctgctatgacctcaccgatagctcctctttcgagagagcaaagttctgggtgaaagaactgcgctcgctcgaggaaggatgtcaaatctacctctgtggaacaaagtctgatctgctggaggaagaccgccgacggaggcgcgtcgatttccacgatgtccaggactacgccgacaatatcaaggcgcaactgtttgagaccagtagcaaaacgggccagtccgtggacgaactgttccaaaaagttgcagaggactatgtaagcgtggctgccttccaggtgatgaccgaagataaaggggtagacttaggccagaagccaaacccttatttttattcttgctgccaccactag

SEQ ID NO: 237661 - DNA, 201 bp, Artificial Sequence
  Description of Artificial Sequence: Synthetic coding sequence
atgtcagggcagcgtgtggacgttaaagtagtcatgttggggaaggagtacgtgggtaaaacaagtctggttgaacggtatgtgcatgaccgttttctggtgggcccataccagaatactatcggagccgcttttgtggcgaaggtgatgtctgtcggcgacaggacggttaccctagggatctgggatacagcaggatag

SEQ ID NO: 237662 - DNA, 642 bp, Artificial Sequence
  Description of Artificial Sequence: Synthetic coding sequence
atgggtaatggtacagaagaagattacaacttcgtatttaaagtggtcctgattggcgaaagcggcgtgggcaaaactaatctgctgtcacgattcaccagaaatgaattcagccatgattcacggacgacaatcggtgtggagttctctaccaggacagttatgctgggtacagcggcagtaaaggctcagatttgggatactgctggtctggagaggtaccgagcaatcacgtcagcgtattatcggggagctgtgggggctctgttggttttcgacttgactaagcaccagacttatgcagtcgtggagcggtggcttaaagagctgtacgaccatgcagaggcgaccattgtggttatgctggtggggaacaaaagcgacctctcacaggcgcgtgaggtcccgacagaggaggcaagaatgtttgcagagaacaacggccttcttttcctggagaccagtgctttggattcaactaatgtggagctggccttcgagacagtgttgaaggaaatcttcgctaaggtgagcaaacagcggcagaacagcattcgcactaacgcaatcacactcggaagcgcccaagctggccaggagcccggacccggtgagaagcgtgcgtgctgcatcagtctatag

SEQ ID NO: 237663 - DNA, 1110 bp, Artificial Sequence
  Description of Artificial Sequence: Synthetic coding sequence
atggaaggctcattggagagagaagcccctgccggagctttagcggcagtactcaaacattcttccactttaccaccagagtcgacacaggtgaggggttatgactttaacagaggcgtcaattacagggcgttgctcgaggccttcggcacaaccggtttccaagctacaaattttgggcgtgcagtgcagcaggtgaatgcaatgatcgagaagaagctcgagcctctgtctcaggacgaggaccaacacgcggacctcacacaaagtcgaagaccactcacatcttgtacaatcttcctgggttacacctcaaacttgatcagttctgggataagagaaacaatccgctaccttgtgcagcacaacatggtggatgttctcgtaacaacagccggaggcgtagaggaagatctgattaaatgtcttgcccctacttacctgggcgagttctctttacggggtaaggaactgcgcgaaaacggcattaacaggattgggaacctgttggtccccaatgagaactattgcaaatttgaggattggctcatgcctatcttggatcagatggtgatggaacagaatacagaaggcgtgaagtggacccctagcaagatgattgcaaggcttggcaaggaaatcaacaaccccgagtcagtatactactgggcacagaagaatcacatcccagtcttttctccggctctgactgacggttcgctgggcgatatgattttcttccattcctacaagaacccgggtctcgtactggacatcgtcgaagacctcaggctgatcaacacccaggccatcttcgctaaatgcactggcatgatcatactgggcggaggagtggtcaaacaccacattgcaaacgcgaatttaatgaggaacggtgctgattatgctgtgtacataaacacagcccaagagttcgacgggtcagacagtggcgctcgcccagacgaggctgttagctgggggaagatacgcgtggatgcacagccggtcaaagtttacgcagacgcaagcttggtcttccctcttctcgtcgccgagaccttcgcccagaagatggatgctttcatgcatgaaaagaatgaggactag

SEQ ID NO: 237664 - DNA, 573 bp, Artificial Sequence
  Description of Artificial Sequence: Synthetic coding sequence
atgctggtcggagattccggggtcggaaaaacttgcttgctggtgcggttcaaggatggagcctttctggccggaacctttatatccaccgtggggatcgatttccgtaacaaagtcctcgacgtagacggagtgaaggtgaagctccaaatgtgggatactgctggccaggagcgttttcggtccgttacgcacgcttattaccgtgatgcacatgcactactgcttttatatgacgtgacgaataaggcctccttcgataacattcaggcctggctaaccgaaatccatgaatatgctcagcacgacgttgcattgatgcttctgggtaataaagtggacagcgcccacgagcgggttgtgaaaagagaagacggagagaagctggccaaagaatacggtctcccatttatggaaacgagcgccaagactggtctcaatgtggatctcgcgtttactgctattgcaaaggagttgaagcaaagaagcatgaaggctccgtcggagccgagatttaggctgcacgactatgtgaaacgtgaagggaggggcgcatcctgctgtaggccatag

SEQ ID NO: 237665 - DNA, 666 bp, Artificial Sequence
  Description of Artificial Sequence: Synthetic coding sequence
atgtctgacggtgactatgattacctgattaaatttttagcgttgggtgactcaggtgtgggtaagacatccgttctgtaccagtatacagatggtaaattcaatagcaaattcatcacgacggtgggcattgatttccgagaaaaaagagtggtttaccgagctagcggccctgatggcgctaccggaaggggacagcggatccatctacagctctgggacacagcagggcaggaaaggttcagatcgctgaccacagctttcttccgcgacgccatgggttttctcctgctgttcgacctaaccaacgaacagtcgttcttgaacgtgcggaattggatctcacaactgcaaatgcatgcatactgcgaaaatcctgatatcgtgctctgcggtaacaagtccgacttagaggatcagcgcgtggtaaaggaggaggaggccatcgcactggcagaaaagtatgggatcccttattttgaaacctccgctgctaacggcaccaatatttcacaggccatagaaatgcttttggacctcatcatgaagagaatggaaaggtgcgtggataagtcatggatccctgagggtgtggtgcgctccaatgggcacgcctccactgatcagctttccgaagagaaggagaagggagcttgcggctgttag

SEQ ID NO: 237666 - DNA, 642 bp, Artificial Sequence
  Description of Artificial Sequence: Synthetic coding sequence
atgtctgatggagattatgattaccttattaagtttcttgcccttggcgatagcggcgtcgggaagaccagtgtcctgtaccagtacacagacggaaaatttaattctaaatttatcacgacagtgggtattgactttagagagaaaagagttgtgtacagggcgtcagggccagacggagcaaccggcagaggccaaaggatccacctgcagttatgggacactgcgggtcaggagcgtttcagaagccttaccaccgcttttttccgagacgcaatgggttttctactactgtttgatttaacgaacgagcagagttttctgaacgtgagaaattggattagccagttgcaaatgcacgcttactgcgagaatccagatattgttttgtgcggtaacaagagtgacttagaggaccaacgggtagtaaaggaaaagtatggtattccctactttgaaacctcagcggcaaacgggacaaatatcagccaggccattgagatgctattggatcttattatgaagcgtatggagcgttgcgttgacaagtcctggatacctgaaggtgtggtaaggtctaacggccatgcctccactgatcagctgtccgaggagaaggaaaaaggggcttgcgggtgttag

SEQ ID NO: 237667 - DNA, 666 bp, Artificial Sequence
  Description of Artificial Sequence: Synthetic coding sequence
atgtccgatggcgactacgactacctgatcaaattcctggccctcggggattccggcgtgggaaagactagcgtactctatcaatataccgatggaaagtttaactctaaattcattaccactgttggcatcgatttccgcgagaaaagggtggtatatcgcgcaagcggtcccgacggggctacgggcagaggccaacgcattcacctccagctctgggacactgccggacaggaaaggtttcgatcactcactactgcctttttcagggatgcaatgggtttcctgctgcttttcgacctcactaacgagcagtctttcctgaacgtacggaattggataagccagcttcagatgcacgcctactgtgaaaatccagacattgtcctctgtggcaataagtcggacttggaagatcagagagtggtcaaggaagaagaagccatagccctggccgaaaaatatggcatcccttacttcgagaccagcgcggcaaatggaacaaacatcagtcaggccatcgagatgttgctggaccttattatgaaacggatggagagatgcgtggacaaaagctggatccccgagggggtcgtgcgcagtaacggtcatgccagcaccgaccagttgtccgaagagaaagaaaagggcgcatgtggctgctag

SEQ ID NO: 237668 - DNA, 663 bp, Artificial Sequence
  Description of Artificial Sequence: Synthetic coding sequence
atgagcgacagcgaggaggagtctcaggatcgccaactgaagatcgtggtattgggggacggagcctcagggaagacctctctcactacatgtttcgcacaggaaacatttggaaagcagtacaaacagacaatcggactagattttttccttaggcgcataacacttcctggcaatctgaacgttaccctccaaatctgggacatcggcggacagacaatcggcggaaaaatgctggacaaatacatctacggggctcagggggttctgctggtatacgatattactaattaccagtcctttgaaaacctggaggactggtacacagtggttaagaaggtgagcgaggagtccgagacccagcctctggtggcgctggtgggcaacaaaattgacttagagcacatgagaacaatcaaacccgagaagcacctccgcttctgtcaagaaaacgggttctcctctcatttcgttagcgctaagactggggatagcgtcttcctgtgttttcaaaaagtggcagctgagattctgggaattaaactgaacaaggcagaaattgagcagtcacagagaattgtgcgcgctgaaatcgtgaaataccctgaagaggagaatcaacacaccactagcactcagagcagaatatgtagcgtgcaatag

SEQ ID NO: 237669 - DNA, 666 bp, Artificial Sequence
  Description of Artificial Sequence: Synthetic coding sequence
atgagcgatagcgaagaggagtctcaagacagacaacttaaaatcgtcgtgttgggtgatggcgctagtggaaagacatccctcaccacatgttttgctcaggagacttttgggaagcagtacaagcagacaataggactggacttttttttgagacgaataaccctgcccggaaatctcaacgtaactttacaaatatgggacattggagggcaaaccatcgggggtaagatgcttgacaagtacatctatggcgctcagggcgtgttactcgtatatgacatcacgaactatcagagctttgaaaatcttgaagattggtataccgtcgtgaagaaggtgtccgaggagagcgaaacccagccactggtggccctggtgggaaacaagattgacctggagcacatgagaaccattaagccggaaaaacacctccgcttctgccaggaaaatgggttctcctcacactttgtgtccgccaagaccggtgactccgttttcctttgtttccaaaaggtcgccgcagaaatcctgggcattaaactaaataaggccgagatcgagcagagccagagagttgtgaaggctgacatcgtcaactacaatcaggaacccatgtcccgcacagtcaatccaccacgaagctctatgtgtgccgttcagtag

SEQ ID NO: 237670 - DNA, 615 bp, Artificial Sequence
  Description of Artificial Sequence: Synthetic coding sequence
atgtcagattctgaggaagagagccaggatcgacagcttaagatcgtggtactaggcgacggcgctagcggtaagacgtccctcactacatgcttcgcgcaggagaccttcggtaaacaatacaagcaaaccattggcttagacttctttctgagacgtatcacactgcctgggaaccttaacgtaacactacaaatttgggatatcggagggcagacgattggcggaaagatgttagataaatatatttacggcgcacagggggtgctgttggtgtatgacatcacaaactaccaatccttcgaaaacttggaagactggtacactgtcgtcaagaaggtgtctgaagagtctgaaacccagcctctcgtggcgctcgttggcaataaaattgatttagaacatatgaggacgattaagccagaaaaacacctccggttctgtcaagagaatggcttttcttcacacttcgtctcagcaaaaaccggcgatagcgtgtttctgtgctttcaaaaggtggccgctgagatcctgggcatcaagctaaacaaggcggagatcgaacagtctcaagggcatttcattatcttcatttcctctaccaacagagaatag

SEQ ID NO: 237671 - DNA, 288 bp, Artificial Sequence
  Description of Artificial Sequence: Synthetic coding sequence
atgtctgactccgaagaagaatcccaagacaggcagttgaagatcgtggtgctgggagatggtgccagtggtaagacttctttaacgacctgtttcgctcaggaaacttttgggaaacagtataagcaaactatcggactggattttttcctccgtaggataacacttcctggtaatctcaatgtgacacttcaaatctgggacatcggaggtcagacaatcggaggcaagatgctggataagtacatctatggcgcacagttgatttggagcatttgtgaacaatag

SEQ ID NO: 237672 - DNA, 639 bp, Artificial Sequence
  Description of Artificial Sequence: Synthetic coding sequence
atggcctatgcgtacctgtttaaatacattatcattggagatactggtgttggaaaatcctgtctgttgttacagttcactgacaaaaggtttcagcctgtgcacgacctcaccattggcgtggagtttggcgctcggatgatcaccatcgacgggaaacagattaagttgcagatttgggatacagctggtcaagagtcattcaggtctatcaccagaagctattaccgcggtgccgctggggcactgctcgtgtacgatattactcggcgagacacatttaaccacctcactacttggctggaagatgcaaggcagcactccaatagcaacatggttattatgctgatcggcaacaaaagcgacctggagtcacggagggaagtcaaaaaggaggagggggaggcgtttgccagggagcacggactgatatttatggagacctcagctaagactgcctcaaacgtggaagaagccttcataaacactgcgaaagagatctacgaaaagatccaggagggcgttttcgatataaacaacgaggccaacggaataaagataggacctcagcacgccgctactaacgccacccatgccggtaaccaggggggacaacaggccggaggtggttgttgctag

SEQ ID NO: 237673 - DNA, 567 bp, Artificial Sequence
  Description of Artificial Sequence: Synthetic coding sequence
atggcctacgcttacctgttcaagtacatcatcatcggagacacaggggtggagttcggtgcacgcatgataactattgacggcaagcagattaaacttcagatttgggatactgcagggcaggaaagttttcgttcgataaccaggtcctattacagaggcgcagctggcgctttgctggtgtacgatataacccggagagacaccttcaatcatcttaccacttggttggaggacgcgagacagcattcaaactccaacatggtaataatgctcattggcaataagtccgacctggagtctcggagggaagttaaaaaagaagaaggcgaggcgttcgccagagaacacggtctgatttttatggagacaagcgcaaaaactgcttcgaacgtggaagaggcctttattaacactgcgaaagagatatacgagaagatccaggaaggcgtcttcgacataaacaacgaggccaacggaatcaaaatcgggcctcagcatgcagccacaaatgctactcacgcgggaaatcaaggcggtcagcaggcgggaggagggtgctgttag

SEQ ID NO: 237674 - DNA, 501 bp, Artificial Sequence
  Description of Artificial Sequence: Synthetic coding sequence
atgatcacaatcgacggtaaacaaattaagctccagatctgggacactgctggccaggagtcttttaggtccattacacgctcttattatcggggtgccgctggcgctctactggtatacgatattactcgcagagacacctttaaccatctcacaacttggctggaagacgcccgtcaacacagtaactctaacatggtaatcatgctaattggcaataaaagtgacctggagtcacggagagaagtgaaaaaagaggaaggcgaagcgtttgccagggagcatggcctcatatttatggagacatccgccaagacagcctccaacgttgaagaggccttcatcaataccgccaaggagatttacgagaaaattcaggaaggcgtcttcgacatcaataatgaggcaaacgggatcaagattgggccacaacatgcagcaacaaacgccacccacgccggaaatcagggaggacagcaggcgggtggcggatgttgctag

SEQ ID NO: 237675 - DNA, 630 bp, Artificial Sequence
  Description of Artificial Sequence: Synthetic coding sequence
atgacttatgcatacttgttcaagtacataataattggggatacaggcgtgggcaagtcctgtttactcctccagtttacagacaagcgatttcagcctgtccatgatctcaccatcggggtggaatttggggctagaatggtgaacatagatggaaagcaaataaagctgcagatttgggacactgccggacaggagagttttaggtctatcacccggtcttactacagaggggctgccggtgcactgctcgtctacgatattacccgcagggagacgtttaaccatctaacatcttggcttgaagacgcacggcaacatagctcgtctaatatggtcatcatgctaatcggaaataagtctgacctggagtcgcgtagagacgtcaaaagagaagagggagaagctttcgcaagggaacacgggctaatttttatggagacatctgctaaaacggcttgtaacgtcgaggaagcatttatcaatactgccaaagagatctaccggaagatacagcaaggtctgttcgacgtccataacgaggctaatggcataaagatcggccctcagcaatccatcagtacctctgtgggcccatctgcttcccagtccgcagggttgcaggtgtag

SEQ ID NO: 237676 - DNA, 651 bp, Artificial Sequence
  Description of Artificial Sequence: Synthetic coding sequence
atgacatatgcctatttatttaaatacataattatcggcgatactggcgtaggcaagtcgtgccttctcttacaattcaccgacaaaaggtttcagccggtccacgatttgaccatcggcgtagagtttggagcacgtatggtcaacatcgatggtaaacaaatcaaactacaaatctgggacactgctgggcaggaatcattcaggagcataactcggtcttactatcgcggagctgcgggtgctctcctcgtctacgacataacacggagggagacatttaatcaccttacaagctggctcgaagatgcaagacagcatagctcatccaatatggtgattatgctgatcggtaacaaaagcgatcttgagagcagacgtgacgtgaagagggaagaaggcgaagcctttgcacgggagcacgggctaatctttatggagacaagcgctaaaactgcgtgtaatgtggaggaggccttcatcaacaccgcaaaagagatctacaggaagatccagcagggcctgtttgatgttcacaacgaggccaacggaataaagattggaccacaacagtccattagcacttccgtgggcccttctgcctctcagagaaatagccgtgacattggcagtaactccgggtgttgttag

SEQ ID NO: 237677 - DNA, 189 bp, Artificial Sequence
  Description of Artificial Sequence: Synthetic coding sequence
atgacctatgcctacctgtttaagtacataattattggtgatacgggcgtggggaagtcatgtctcctgcttcaatttaccgacaagcggttccaaccagttcacgacctcactattggggtggagttcggagctcgtatggtaaatatcgatggaaaacaaatcaagctgcagatttgggacacatag

SEQ ID NO: 237678 - DNA, 2946 bp, Artificial Sequence
  Description of Artificial Sequence: Synthetic coding sequence
atggccgctgacagtgagcccgaaagtgaggtgttcgagatcaccgatttcacaacggccagcgagtgggaaaggtttattagcaaagtcgaggaggttctgaatgactggaaacttatcgggaacagtttgggaaagcccctggagaaaggaattttcacaagcggaacctgggaggagaagtctgatgagatctcctttgcggattttaagttttccgttactcatcactaccttgtgcaggaatccactgataaagaagggaaagacgagctgctggaagacgtggtgccacagtctatgcaggatctcctcggtatgaataacgacttcccccctcgagctcattgtcttgttcgctggtacggtctgcgggagtttgtggtgatcgcgccagccgctcactcagacgctgtgctcagcgaaagtaaatgtaatctcctcctgtcctccgtttcaatcgccctggggaacacaggctgccaggtccccctctttgttcaaattcatcacaaatggagacggatgtacgtcggagagtgtcagggccctggcgtccgcaccgacttcgagatggtgcatcttcgtaaagtgccaaaccagtacacccacctcagcgggctgctggacattttcaagtcaaagattggttgtcccctgacacctctacctcccgtctctatcgcaattaggtttacttacgtgctgcaggattggcaacagtacttttggccacagcagccaccagatattgacgccctggtgggcggtgaggtgggcggactggagtttgggaaactaccattcggcgcatgcgaagatccaattagtgagcttcatctggccacaacctggcctcaccttaccgagggcatcattgtcgataatgatgtgtatagtgatttggatcctatacaggccccacattggtctgtaagggtccgcaaggcagagaaccctcagtgcctgctgggggattttgttactgagttctttaaaatctgccggagaaaagaatccaccgacgaaatcctcgggcgatctgccttcgaagaggagggcaaggaaacagcagacataactcacgcgctgtcgaagctcaccgagccggcttccgtccctatccacaagctctcagtgagcaatatggtccataccgcaaagaagaaaattcgcaagcacaggggtgtcgaagagtcccctctaaataacgacgtgctgaacactatcctcctgtttctattcccagacgccgtgagtgaaaagccactggacggaaccacctctaccgacaataacaacccgccatctgagtcagaggactacaatctctataatcagtttaaaagcgctccgagcgattctctgacttacaagttggcgctctgcctatgtatgattaacttctaccatggaggactcaagggtgtagcacacttatggcaggagtttgtcctggagatgcgtttcaggtgggagaacaactttctcataccgggactggccagtggtccacccgaccttcgttgctgtttactgcaccagaagcttcagatgcttaattgttgtatcgagagaaagaaagctagagatgaagggaagaaaactagcgccagtgacgtgactaacatctatccaggggacgcgggaaaagctggagatcagctcgtgcctgataacctgaaggaaaccgacaaagagaagggtgaagtaggaaaatcttgggactcatggagcgattctgaggaagaatttttcgagtgcctgtctgacactgaggaattaaaaggaaacggacaagaatctggaaagaagggagggcctaaggaaatggctaacctcaggcctgaaggtcgcctctaccagcatggcaagctcaccctgctccacaacggtgaacctctctatatccccgtgactcaggaaccagccccaatgacagaggatctgctcgaagagcagtcagaagtgctggccaaattgggcacttccgccgagggggctcacttgcgggctagaatgcagtcagcatgcctgctctccgacatggaatctttcaaggcggcaaacccaggatgttcattggaggatttcgttcggtggtactcccccagagattatattgaggaggaagtcatcgatgagaaaggaaatgtagtcttgaaaggtgaactgtcagctagaatgaagatccctagcaatatgtgggttgaggcctgggaaaccgctaagcccatccccgcaagaagacagagacggctatttgatgatacacgggaggcagaaaaagttcttcattacctggcaattcagaagccagctgatctagcaaggcacctcctgccttgtgtcatccacgccgctgttctaaaagtaaaggaggaggagtcactggaaaatattagctcagtcaaaaaaattattaaacagatcatctcccattcgtcaaaggtcctgcactttccaaatcccgaggacaagaagctggaagagatcattcatcagattacaaacgtggaggccttgatagctagagctcgctctttaaaggcaaagtttgggacagagaagtgcgaacaggaggaggaaaaggaagacctcgaaagatttgtgagttgcttacttgagcagccagaggtcctcgtgacaggggctgggcgtggccacgctggtagaatcatccacaagctttttgtaaatgcgcagcgtgctgccgctatgactcccccagaagaagagctgaagcggatggggtcgccagaggagcgacggcagaacagcgtgagcgatttccccccacctgctggcagggagttcattctgcggacgacagtgcctcggccagctccatactccaaggccctgccacaaagaatgtactcagtgctgaccaaggaagactttagactcgcgggtgctttctcatctgatactagcttcttttag

SEQ ID NO: 237679 - DNA, 2808 bp, Artificial Sequence
  Description of Artificial Sequence: Synthetic coding sequence
atgtttagcctcatatcaggcatctttacctccggtacttgggaggaaaaaagcgacgaaatctcctttgctgactttaagttctctgtgactcaccactaccttgttcaagaatccactgataaggagggcaaggatgagttacttgaggacgttgtgcctcaatccatgcaggatctgctaggaatgaacaacgattttccaccacgcgcacactgcttggtgaggtggtacggcctgcgtgagtttgtggtcatcgctcccgcagcacacagtgacgccgtgctttctgagtccaagtgtaacttgttgttgtcaagcgtctctatagccctgggtaacacagggtgtcaagtgccactcttcgtccagatccatcataagtggcgcagaatgtacgtaggcgagtgtcagggtccaggtgtgcgcacagatttcgaaatggttcatctcaggaaggtccccaatcagtacactcacttaagcggcctgctggatatattcaagtctaagatcggctgtccgctgacacctctgccacccgtctccattgccataagattcacctacgtcctccaagactggcagcagtatttttggcctcagcagccccctgatattgacgcgctcgtcggaggcgaagtgggcggacttgagtttggcaaacttcccttcggtgcatgtgaagatccaatctctgaattacacctggccactacatggccccacctcaccgaggggattattgtcgataacgatgtctactctgacctcgatcccatccaggctccccattggtcagtccgggttcggaaggctgagaaccctcagtgccttcttggcgactttgtgactgaattttttaaaatttgtaggaggaaggagtccacggatgagatactcgggcgttcagcatttgaggaggaggggaaggagaccgcggacattacacatgcccttagcaaactgaccgagcccgcatctgtgccaatccataaactgtctgtgtccaacatggttcacaccgcgaaaaagaaaataaggaaacaccgaggggtggaagagtctcccctgaataatgacgttctcaatactattctgttgtttctgttcccagatgccgtgtccgaaaagcctctcgatggcaccactagcacggacaacaataacccaccatctgagtctgaagattataacctgtataaccagtttaaaagtgcgccttccgactctctgacctataagctcgcactgtgtctctgcatgatcaacttctaccacggcggtctgaaaggcgtcgcccatctatggcaagaattcgtgttggagatgaggttccgttgggaaaacaacttcctgattccaggcctggcgagcgggcctccagatctccgttgttgtctcctccaccagaagttgcagatgctgaattgctgtatcgagcggaaaaaagctcgggacgaggggaagaaaacctctgcatccgacgtcaccaacatttatccaggcgacgccggtaaggccggtgaccagcttgttcccgataacttaaaggaaacggataaagaaaaaggtgaagttggaaaatcctgggactcctggtccgactcagaggaggaatttttcgagtgcctgtccgacactgaggagctaaaggggaacggtcaggagtcggggaagaagggaggccctaaagaaatggccaatctgcggccagagggcagactgtaccagcacgggaagctcaccctcctccataatggcgaacccctgtatatccccgtcacacaagaacctgctcccatgacagaagatctgttggaggaacaaagtgaagtcctggccaagttagggaccagcgcagagggcgctcacttgcgagccagaatgcagtcggcatgcctcctgagcgacatggaaagtttcaaagcagcaaatccaggctgtagccttgaggactttgtgagatggtactccccgagggactatatagaagaagaggtgatagatgaaaagggaaacgtagttctgaagggggagctatcagcaaggatgaaaattccctcaaacatgtgggttgaggcatgggagacagccaaacctattcctgctagacggcaaaggcgtctattcgatgatacaagggaagccgaaaaggtattgcactacctggccatccagaagccagctgaccttgccaggcatctcttgccatgtgtgattcacgccgctgtgctcaaagtcaaagaagaagaaagtctagagaatatcagtagcgtcaagaaaattatcaaacagattatctcccactcttcaaaggtgctgcacttcccaaatccagaagataagaagctcgaagaaattattcatcaaattacaaacgttgaggccctcatcgcacgggcacggtctctgaaggcgaaatttgggaccgaaaagtgcgaacaggaggaggagaaggaagacctggagcggttcgtgtcatgtctcttagagcaacccgaggtgctggtcactggagccggtcggggacacgcaggcagaattatacataaactttttgtcaatgcccagcgggcagcggctatgacaccaccagaggaggagctaaagcgtatgggcagtcctgaggagagaaggcagaactctgtttcggatttccctcccccagctggtcgggagtttatactgcgcaccaccgttccccgtccggcaccctattccaaggctcttccccaacgcatgtattcggtgctgacaaaggaggactttcggctggctgtgaagattatagacggggacgtgtag

SEQ ID NO: 237680 - DNA, 2967 bp, Artificial Sequence
  Description of Artificial Sequence: Synthetic coding sequence
atggctgccgactcggagccagagagtgaggtctttgagataacagattttacgacagcatcagagtgggaaagattcatctctaaagtggaggaggtgttaaacgactggaaactcattggtaactcacttggcaagcctctcgaaaagggaatcttcactagtgggacctgggaggaaaaatcggacgagatctcgtttgctgacttcaagttttcagtgacccatcattacctagtccaggagtcgaccgacaaagagggaaaggatgagttactggaagacgttgtgccacagtctatgcaggatctcctggggatgaacaacgatttccctcccagagcccattgtttggtgaggtggtatggtttaagagaattcgtggtgatagcacctgcggctcattctgatgcagtactgagtgaaagtaagtgcaatctgttgctgagctctgtctccattgcgttaggaaacactggatgtcaggtccccctctttgttcaaatacatcataagtggagacgtatgtatgtgggcgagtgtcagggtcctggggtgagaaccgactttgagatggtgcaccttcgtaaagtgccgaaccagtatacacatctcagcgggctgttagatattttcaaatctaaaatcgggtgtccactgacaccgctgcctccagtctccattgctatccgcttcacctatgttctacaggactggcagcagtacttctggccacaacagcctccagacattgacgcactcgtggggggtgaggtaggaggcctggagttcggaaaacttccatttggtgcctgcgaggacccaataagcgagctgcatctcgcaacaacctggccccacctcacagaggggattatcgttgataatgatgtctactctgacctcgatccgatccaggccccacactggagcgtccgcgttcgcaaggctgaaaatccccagtgccttctcggcgattttgttaccgagttttttaaaatttgccgacggaaagaaagcactgatgaaatcctaggcagatctgctttcgaggaggaggggaaagaaaccgctgatataacacacgccctgtcaaagcttactgaaccagcttctgttccgatacataaactctccgttagtaacatggtgcacacggcaaagaaaaagattcgcaagcatcgtggggtcgaggagtcacctctgaataatgacgtgctgaacacaatcctgctgtttctctttcctgatgccgtatctgaaaaaccactcgatgggaccacgtcaacagacaacaataatcctcctagcgaatccgaagactataacttgtataatcagttcaagtcagccccttccgacagcctgacctacaagctggctctgtgtctgtgcatgataaatttttatcacggcggactcaagggcgttgcccatctatggcaggaatttgtactggaaatgcggtttcgttgggagaacaacttcctgattccaggtctcgccagtggccctccagacctcaggtgctgcctcttacatcagaagcttcagatgttgaattgttgcattgagcgcaaaaaagctagggatgaggggaaaaagacatcggcctctgacgtaaccaacatctacccaggagatgccggtaaggcaggcgatcagcttgtccctgataatctcaaagaaaccgacaaagaaaagggcgaagtagggaagtcatgggacagttggtctgatagcgaagaggagttcttcgagtgcttgtccgatactgaggaactgaagggcaatgggcaggaatcagggaagaagggcggtcctaaggagatggctaacttaaggccagaaggtcgcctttatcagcacggaaaactgaccctcttgcataacggcgagcctctatacatccctgtaacgcaggagccagcaccaatgaccgaggacctcttagaagaacagagcgaagtcctggcaaaattaggaacgagtgcggagggagcgcacttgagagcgagaatgcagtcagcttgcctgttgagtgacatggaaagcttcaaggccgcaaacccagggtgctccctggaggatttcgttagatggtactctccacgggattatatcgaggaagaggttatcgatgaaaagggaaatgtggtgcttaaaggcgagctgagtgcacgcatgaaaattccaagcaatatgtgggtggaagcctgggaaaccgctaaacctatccctgctagacgtcaaaggagactctttgacgatacgagggaggctgaaaaagttttgcattacctcgcgattcaaaaacctgccgatctggccagacatctcttgccttgcgtgatccacgctgccgtgttgaaagtaaaggaagaggaaagtctggagaatatcagcagtgtcaagaaaatcatcaaacagattatttcacactccagcaaagtcctccatttccctaacccagaagacaagaaactggaagagataatccaccagatcaccaacgtggaggcacttattgcacgcgctagaagcctgaaggcaaagttcggtacagaaaaatgcgagcaggaagaagaaaaggaggatttggagaggtttgtctcatgcctcctagaacagcctgaggtcctggtgaccggggctggacgtggacacgctggtcggattatccataagctgttcgtgaacgcccagcgcttaacggaatccagcgacgaggctgccgctatgactcctccagaggaggaactaaagaggatgggttcgcctgaagaaagacgccaaaactcggtgtctgactttccgccacccgctgggcgagagttcattctgcgaactaccgttccacgccctgccccatacagcaaagcgcttcctcaacggatgtacagcgtgttgacgaaggaagattttaggctggcaggcgcatttagctctgacacaagtttcttttag

SEQ ID NO: 237681 - DNA, 4182 bp, Artificial Sequence
  Description of Artificial Sequence: Synthetic coding sequence
atggcttgctctattgtgcagttctgttattttcaggatttgcaggccgctcgggactttttgtttcctcacctgagagaggaaattctgtctggggcattgaggagagaccccagcaaaagcactgattgggaggacgacgggtggggcgcatgggaggaaaacgaaccccaagaacctgaagaagaaggaaatacttgcaaaacacagaaaacaagctggcttcaagactgtgtgctgagcctgagccccactaatgacctcatggtgatcgcacgcgagcaaaaggcagtgttcctggtgcctaaatggaaatattcggataaaggcaaagaggaaatgcaatttgcagtcggttggagtggcagcttaaacgtagaagagggagagtgtgtcaccagcgccctttgtattcccttagcatcacaaaaaagatcatcaacaggccgacccgactggacctgcatcgtcgtgggatttaccagtgggtatgttcgcttttatactgaaaatggagttctgctgttggctcaactactgaacgaggatcctgttttgcaactaaaatgccggacctacgaaattccccgtcacccaggcgttacagaacagaacgaggaattgtccatattataccctgctgcaattgtgaccattgatggcttctctctttttcagtcactcagagcctgcaggaaccaggtggctaaggccgctgcatccgggaacgaaaacattcaacctccacccttagcgtacaagaagtggggactgcaggatatcgataccattattgatcacgcatcggttggcataatgactctgtctccctttgaccagatgaagaccgcatccaatattggcggttttaatgccgcaataaaaaacagccccccagctatgtcccaatatattactgtgggatctaacccctttacaggcttcttttatgccctagagggctcaacccaaccactcctgtcccatgtggcgttagccgtggcaagtaaactcaccagcgcgctgtttaatgctgcatctggatggctgggctggaaaagcaaacacgaggaggaagcagtgcagaaacagaagccaaaagtggaacctgcaaccccccttgccgttcgttttggcctgccagactctagaaggcacggcgagagcatctgtctctctccgtgtaataccctggctgccgtgacagatgattttggcagagtgatcctgttggatgttgctagaggaatagccatccgcatgtggaaaggctatagagacgcccagattggatggattcaaacagttgaggacctgcatgagagagtaccagaaaaggctgatttctctcctttcggtaattctcagggaccttcgagggtcgcccagtttctggtgatttacgcccctcgcaggggaatactggaggtgtggtccacccagcagggtcccagggtcggggcatttaatgtgggaaagcactgtcgcctgttgtacccaggctacaaaatcatgggtttaaataatgttacttcacaatcctggcagccccagacttaccaaatctgtctggtggaccctgtcagtgggtccgtcaaaacagtaaatgtccctttccatcttgctctgtccgataagaaatctgagcgagcaaaggatatgcacttggttaaaaaactcgccgctctcctgaagacaaagagtcctaatctggatctggtggagaccgaaataaaggaattgatcctggacatcaaatacccggcaaccaaaaagcaagctctagaaagcatcctggcttccgaacgcctccccttttcatgtttacggaatattacacagaccctgatggacacactgaaatcccaggagttagagtctgttgatgaggggctgctgcagttttgcgcgaataagctgaagctacttcagctttatgaatcagtgtcacagctcaacagcctcgactttcacttagacacccccttttctgataacgatctggcgctgctcctcaggctagatgagaaggaattgctcaaactccaggctctgttggaaaaatataagcaggaaaacactcggactaacgtcaggttttcagacgataaggacggcgtgctgcccgttaaaactttcctcgagtacctggaatacgagaaagacgtgctgaatatcaaaaagattagtgaagaagaatacgtcgcccttggctcttttttcttctggaaatgtctacacggcgaatcctccacagaagacatgtgtcacaccctcgagtccgctggcctgtctcctcagctcctccttagcttactgctgtctgtgtggctgtctaaagagaaggatattctggacaagcctcagtctatttgctgcctgcacactatgttgtcgctcttgagcaaaatgaaagtggccatcgatgagacatgggacagtcagagcgtgtctccttggtggcagcagatgaggacagcctgtatccagagcgaaaataatggagctgctctcctgtcagctcacgttggacactctgtggccgcacaaatttctaataatatgacagagaagaaattctcacaaaccgtgctaggagctgactccgaagctctgacagactcctgggaggctctgagcctggataccgaatattggaaattattactgaagcagctggaggactgcctcatcctacagactctgttgcactcaaaaggaaatacacaaacctccaaggtgtcctccctgcaggccgagcccctacctcggctgagtgtaaagaagttgctggaaggcggaaagggcggtattgctgactccgtggccaaatggatcttcaagcaggacttttctccagaggtgctaaaactggccaacgaggagagagacgccgagaacccagatgagcccaaggaaggagttaaccgttcgttcctggaggtaagcgaaatggagatggacttaggagctatcccagaccttttacacctcgcctacgagcaattcccatgttccttggagttggacgtgctccacgcccattgctgctgggaatacgtagtccagtggaataaagaccctgaagaagccaggttctttgtgaggtcgatcgaacacctgaaacaaattttcaatgcccacgtccagaacggaatagctctcatgatgtggaatacatttttggtgaagagatttagtgcagccacatacctcatggacaaagtaggcaaatcccccaaagatagactgtgcaggcgtgacgttggaatgagcgacacagcaatgaccagtttcctgggtagctgtctagacctccttcaaattctaatggaggctgatgtctctcgcgacgaaattcaggtgcccgtcctggataccgaggatgcctggctctcggtggagggcccaattagcattgtggagctggctctggaacagaaacacattcactaccctcttgtggagcatcacagcatcctctgctccattctgtacgccgtgatgagattcagccttaagaccgttaagcccctcagcttgttcgattccaaagggaagaatgccttcttcaaggatctgacctctatccaactgctgcccagcggagaaatggatcctaatttcataagcgttcgccagcagttccttctcaaagtggtgagtgccgctgtgcaggcccagcacagcgccacaaaagtgaaagatcccaccgaagaggctactcccacaccatttggcaaggaccaagactggcctgcgctggctgtggatctcgcccaccacctccaggtgtccgaggatgtcgtcaggcgccactatgtgggcgagctgtacaattacggcgtcgatcacctgggggaggaagcgatcctgcaagttcacgataaggaggtgctcgcatcacagcttttggtcctgacagggcagcgccttgcccatgctctgttgcacactcagaccaaagagggaatggagttactggcccgactgccgccaactctctgcacatggcttaaagccatggatcctcaggatctacagaacactgaggtgccaatcgctactactgcaaagctggttaataaggttatcgagttgttgcctgaaaaacacggccagtacggccttgctctgcatctaatcgaggcagtcgaggctatatcactgcccagtctctag

SEQ ID NO: 237682 - DNA, 612 bp, Artificial Sequence
  Description of Artificial Sequence: Synthetic coding sequence
atgtcgatggaggattacgatttcctgttcaaaattgtcctcatcgggaatgcaggcgtcggcaaaacctgcctggtgaggcgctttacccaaggattatttcccccaggccagggggcaactattggtgtggatttcatgataaagacagtcgagatcaacggcgagaaggtcaaactccagatctgggacactgcaggccaggagagatttaggtctataactcagtcttactatcgctctgccaatgccctgatactgacttacgatataacctgcgaagagagttttaggtgtctgccagaatggctgcgcgagatcgagcaatatgcgtccaataaggttattactgtgttggtggggaacaagatagaccttgcagagcggcgtgaggtaagtcagcagagggcggaggaattctctgaagcgcaggatatgtattatctggagacttctgctaaggaatcagataacgtagagaagctcttcctggatcttgcctgccgcctgatctccgaggctagacaaaacacgttggttaataatgtgagctcgccactacccggtgaaggtaaaagcatatcctacctgacatgctgcaactttaactag

SEQ ID NO: 237683 - DNA, 345 bp, Artificial Sequence
  Description of Artificial Sequence: Synthetic coding sequence
atgtctatggaagattacgacttcttgttcaaaattgtgctcattggaaacgctggggtgggtaaaacatgtctcgtcagacggtttactcagggactcttcccccctggccagggagccactatcggcgtggacttcatgatcaagaccgtcgagatcaacggagaaaaggtgaaactgcagatttgggacactgccggacaggagagatttcgttcgattacacaatcatattaccgaagtgcaaacgcattgatcctcacttatgacataacctgtgaggaaagctttaggtgcttacccgaatggcttcgggagatcgaacagtatgcctcaaacaagtag

SEQ ID NO: 237684 - DNA, 612 bp, Artificial Sequence
  Description of Artificial Sequence: Synthetic coding sequence
atgtctatggaggattatgattttctctttaagatcgtgctcattgggaatgccggagttggtaagacgtgtttggtgaggcgcttcacccaagggctctttccccctggccagggagctacaattggggtggacttcatgattaagacagttgagattaatggcgagaaagtcaaattgcagatttgggatactgccggacaagagaggtttaggagcataacacagagttattacaggtccgcgaacgccttaatcctcacctacgatatcacatgcgaagaaagttttcggtgccttccagaatggctgcgggaaatcgagcaatacgccagtaacaaagtcatcactgtgctggtaggcaacaagatcgatctggcagaaaggcgggaagtgagtcagcagcgggctgaagaattcagcgaagcacaggacatgtactacctagagacaagcgctaaggagagcgataatgtagaaaaactcttcctcgacctcgcctgccgactgatttctgaagccaggcaaaatacactcgtgaacaatgtttctagccccctccctggagagggcaaaagtatttcttacctcacctgttgcaactttaattag

SEQ ID NO: 237685 - DNA, 168 bp, Artificial Sequence
  Description of Artificial Sequence: Synthetic coding sequence
atgtccatggaggactatgacttcctcttcaaaatcgtgctcatagggaatgctggagtagggaaaacctgtctcgtccgacggtttactcagggcctcttccccccagggcagggcgctacaatcggggtggactttatgatcaaaaccgtcgaaattaatggctag

SEQ ID NO: 237686 - DNA, 507 bp, Artificial Sequence
  Description of Artificial Sequence: Synthetic coding sequence
atgtccatggaagattatgattttctgttcaagattgtgctaatcggcaacgccggagtcggcaaaacttgcctggtcaggcgtttcacacaggggctgtttcctccaggccaaggcgctacaattggtgtggatttcatgataaaaacagttgagatcaatggtgagaaggtaaaactacagatttgggatacagccggacaggagagatttcgctcaattacacagagctactataggtccgctaacgccttaattctcacatacgatatcacctgcgaggagagcttccggtgtctgcccgagtggttgcgagagatagaacagtatgcgtccaataaggtcataaccgtattagttgggaacaaaatagatctggcagagagacgggaggtctctcagcaaagagcagaggaattttccgaggctcaggacatgtactaccttgagacaagcgctaaggaaagcgacaacgtggaaaaactttttctggatctcgcctgttag

SEQ ID NO: 237687 - DNA, 183 bp, Artificial Sequence
  Description of Artificial Sequence: Synthetic coding sequence
atgtccatggaggactacgattttctgttcaaaattgtactcattggaaatgctggagtgggcaaaacttgtctggttagacgcttcactcaggggctcttccccccaggacaaggcgctactattggcgtggattttatgatcaaaacagttgagatcaatggggagaaggtcaaactatag

SEQ ID NO: 237688 - DNA, 612 bp, Artificial Sequence
  Description of Artificial Sequence: Synthetic coding sequence
atgagcatggaagattatgacttccttttcaagattgtgttaatcggaaatgccggtgtagggaagacttgcctggttaggcgctttacccaggggctgtttccacctggccagggggctacgatcggtgtcgacttcatgataaagaccgtggagatcaatggcgaaaaagtcaagctgcagatctgggacaccgccggtcaagaaagattccgttcaataacgcagtcatactaccgaagcgcaaatgcactaatcctgacctacgacatcacttgcgaagagtctttccgctgcctgcccgagtggttaagggaaatagagcagtacgctagtaacaaagtaataactgtgctggtcgggaataagattgatttggctgagcgaagagaggtctcccagcagcgtgccgaagaattctccgaagcccaggatatgtattacctggagacctccgccaaggagagcgacaatgtggagaagctgtttttagacctcgcatgtcggctcatctccgaggcacggcaaaatacattggtgaataacgtgagctcaccgctcccaggagagggcaagtctataagttatctgacatgctgcaattttaactag

SEQ ID NO: 237689 - DNA, 303 bp, Artificial Sequence
  Description of Artificial Sequence: Synthetic coding sequence
atgtcgatggaggactacgatttccttttcaaaattgtgctgattggaaacgctggggttgggaagacgtgcctcgtgcgcaggtttacccagggcttgttcccgcctgggcagggcgctacaattggcgtggatttcatgattaaaactgtcgagataaatggcgagaaggtgaaactacagatctgggacacagcaggtcaggagcggtttcggtccatcacgcagagctactacaggtcagcgaacgcattaatccttacttatgatatcacgtgcgaggagagctttcgctgtttgtag

SEQ ID NO: 237690 - DNA, 495 bp, Artificial Sequence
  Description of Artificial Sequence: Synthetic coding sequence
atgtcgatggaggattatgatttcctgtttaagattgtcttgatcgggaacgccggtgtggggaagacgtgtttggtgcggcgattcactcagggactctttccccctggccagggggctacaattggagtggatttcatgattaagaccgtggagatcaacggcgagaaagtgaagcttcagatttgggacaccgcgggacaagagagattccgtagcatcacacagtcatactatagaagcgcaaacgctctgatcctcacctacgatattacttgcgaggaatcgttcagatgcctccctgaatggcttcgcgagatcgaacaatatgcatctaataaggtcattaccgtgctggccacccgactgacatggttgaaaggggaaaggtttccttcaagtgaactgaaaaactctcagaaactgaggacctgtattatatggcggccacagccaagaaatttaattatgtggaggaatagctctctcacttag

SEQ ID NO: 237691 - DNA, 420 bp, Artificial Sequence
  Description of Artificial Sequence: Synthetic coding sequence
atgagtatggaggactatgatttcctttttaaaatagtactgatcggaaatgccggagtaggtaaaacctgtcttgtgagacgcttcacacagggcctgttccctcctggtcaaggagccaccatcggcgtagactttatgattaagacggttgaaataaatggggagaaagtcaaactccagatttgggacacagcgggtcaggaacggttccgctccattacacagagttattacaggtccgccaatgcgctaatactgacgtatgacatcacctgcgaagaatcatttcgttgtctgcctgaatggctgagagagattgagcagtatgcgtcaaacaaggttataactgtattggtaggtaacaaaatagatttggcagagcgacgggaagtctcccagcagagagcagaagagtag

SEQ ID NO: 237692 - DNA, 588 bp, Artificial Sequence
  Description of Artificial Sequence: Synthetic coding sequence
atgatggcgattagggagcttaaggtctgtctccttggagatacaggcgtgggcaagagttcgatagtgtgcaggtttgttcaggaccatttcgatcacaacatatctcctacaataggtgccagctttatgaccaagaccgttccatgtggaaatgagcttcacaaatttttgatctgggacactgctggccaggaacggttccattcactcgctccaatgtattatcggggtagtgcagcggcagtaatcgtgtacgacattacaaaacaggacagtttttacacacttaaaaagtgggttaaagaactcaaagagcacggccctgagaacatcgtgatggctattgccggtaacaaatgcgacctgtctgacatcagagaagtgcctctcaaggacgcaaaggagtatgctgagagtatcggagctattgtggtcgagacctccgccaagaacgccatcaatattgaggagctttttcagggcatttcccgacagattccacctctggatccccatgagaacggcaacaatggcacaataaaagtcgagaaacctacaatgcaggcttcgcgcaggtgttgttag

SEQ ID NO: 237693 - DNA, 561 bp, Artificial Sequence
  Description of Artificial Sequence: Synthetic coding sequence
tgcctccttaatgataccggagtaggtaaatcctctatagtgtgcagattcgttcaggatcatttcgatcacaacatttcccctactataggcgcaagcttcatgacaaaaaccgtcccatgtggaaacgaactgcataaattcctcatctgggacacagccggacaggaacgcttccactcactggcccctatgtattaccgtggctctgcggctgcagtgatcgtgtacgatataacaaaacaggattcgttttacactttaaagaagtgggtcaaggaactcaaggaacacggccctgaaaacatcgtcatggcaatcgctggtaacaagtgtgatctctccgacatccgggaagtgccacttaaagatgctaaggaatacgcggagagtattggagctatcgtagtggagacctcagccaagaatgcaattaacattgaagagctgttccagggaatctcaagacaaattccacccctggacccgcacgagaatggcaacaacggaacgatcaaggtggaaaagcccacaatgcaagcctctaggcgctgctgctag

SEQ ID NO: 237694 - DNA, 678 bp, Artificial Sequence
  Description of Artificial Sequence: Synthetic coding sequence
atggctggcggaggtgccggagatcctggtctgggcgctgcggctgctccagcaccagaaacgagggaacatctgtttaaggtgctggtaattggagagctgggggtgggaaagacctctatcatcaaaaggtacgtgcatcagctctttagccagcattaccgggcaacaattggcgtggacttcgcgttgaaagtacttaactgggatagtcgcaccctcgtcaggctccaactgtgggatatcgccggacaggagcggttcgggaatatgactcgagtgtactataaagaagccgtgggtgccttcgtggtgttcgatatcagtcggtcttcgacctttgaggctgtgttgaagtggaaatccgacctcgattcaaaagtgcatttaccgaacggttctcctatccccgctgtcttactggcaaataaatgtgaccaaaacaaagatagcagccagagcccatcccaggtggaccaattctgcaaagaacacggatttgccggttggttcgaaacttctgccaaggacaacataaatatcgaagaggcagctaggttcctcgtggaaaaaatcctggtcaaccaccagtccttccccaatgaagaaaatgatgtggacaagattaagctagatcaggaaacgctaagagctgagaacaagtctcagtgttgttag

SEQ ID NO: 237695 - DNA, 714 bp, Artificial Sequence
  Description of Artificial Sequence: Synthetic coding sequence
atggcacaacctatcctggggcacggctcccttcagccggctagtgccgctggcttggcatcgctcgaactagacagctcccttgatcagtatgtccagatccggatttttaagatcattgtaattggtgattctaatgtgggcaaaacatgcctaactttccgcttctgcggtggcactttcccggacaagaccgaggccaccattggcgtcgatttccgggagaaaacagtggaaatcgagggtgaaaagatcaaagtgcaggtgtgggacaccgccggtcaggagcgcttccgaaagtccatggtggagcattactacaggaatgtccatgcggtggtgtttgtttatgatgtgacaaagatgacaagttttaccaacctgaagatgtggatccaggagtgtaatgggcatgctgtgccacccctggtgccaaaggtgctggttggaaataagtgtgacctgcgcgaacagattcaggtgccgtccaacctggcgctgaaattcgctgacgctcacaatatgctgctcttcgagacttcagccaaagatcctaaggaaagccaaaacgtggagagcatcttcatgtgtctggcctgcaggttaaaagcacaaaagtccttgctttatcgtgatgctgaaaggcaacaggggaaggtgcagaagctcgagtttccgcaggaggctaacagtaaaacgtcctgcccctgctag

SEQ ID NO: 237696 - DNA, 714 bp, Artificial Sequence
  Description of Artificial Sequence: Synthetic coding sequence
atgaacatcctggctcccgtcagaagagaccgggttctggccgaattgcctcagtgtttgaggaaagaggccgcattgcacggccacaaggactttcatccgcgtgttacctgtgcgtgccaggagcacagaacaggtaccgtcggattctgcaaagatacgttcgataagaattataaggcaactattggagtggatttcgaaatggagcggttcgaagtcctcggaatcccattttccctgcaactctgggacacagccggacaggagaggttcaagtgcatcgcctcaacatactatcggggagctcaggccattatcattgtgtttaatttaaatgatgttgcctccctagagcacactaagcagtggcttgccgatgccctgaaggaaaacgatcccagtagcgtcttgctttttctcgtcggctcgaaaaaagacctgtcaactcccgcacaatatgccctgatggagaaggacgcattgcaagtggcacaagagatgaaagccgagtattgggctgtaagctcgcttacaggagaaaacgtgagagagtttttcttcagggtggccgcactgacattcgaggccaacgtgcttgcagagctggagaagtccggcgctcggaggatcggtgacgtggtcagaatcaactccgatgacagtaacctgtacctcaccgcatctaaaaagaaaccgacgtgttgcccctag

SEQ ID NO: 237697 - DNA, 780 bp, Artificial Sequence
  Description of Artificial Sequence: Synthetic coding sequence
atgaatatactcgcacccgtacgaagggacagggtgttagctgaactgcctcagtgcctgaggaaggaagccgcactgcacggtcacaaagacttccacccacgagtgacctgcgcctgtcaagagcacagaaccggaacagtcggctttaagatatcaaaagtcattgtagtgggagatttgtccgtgggaaagacctgtctgataaatcggttctgtaaggacacatttgacaagaattacaaagccacaatcggggttgactttgaaatggaaagattcgaagtgctgggtatccctttttccttgcaattgtgggacactgcaggacaggagcgattcaaatgtatcgcctccacctactatcggggtgctcaagctattatcatagtgttcaatttaaacgatgttgcgtctctggaacatacaaagcagtggttggccgacgcattgaaggaaaatgacccatcaagcgttctgctgtttttagtcggcagtaagaaggatctgtcgacacccgcacagtacgccttgatggaaaaagatgccttacaagtggcccaggaaatgaaggccgagtactgggctgtgagctccctcactggcgagaatgtgagggagtttttttttcgggttgctgccttgacttttgaagccaatgttctcgctgaactggagaagagcggcgctcgcaggattggcgacgtggtcaggatcaactcagacgatagtaatctgtatcttacagcctcaaagaagaagcccacctgctgcccgtag

SEQ ID NO: 237698 - DNA, 636 bp, Artificial Sequence
  Description of Artificial Sequence: Synthetic coding sequence
atgaacatactggccccagtcagaagagaccgtgtgttagcagaactgcctcagtgcctgcgcaaggaggctgcactccacggccacaaagattttcacccccgagtgacatgcgcctgccaggagcatagaactggaacagtgggctttaaaatttctaaagtgatcgtggtgggcgatctttcagttggtaagacatgtttgattaaccgcttttgtaaagatacatttgacaagaactataaggccactattggagttgacttcgaaatggaaagattcgaggttttaggcattccattcagcctccagctctgggatactgctgggcaggagagattcaaatgtatagcatccacttattacaggggagcacaagctatcatcatagttttcaatctcaacgacgtagcctccctggagcatacgaagcagtggttggccgacgctcttaaggagaacgatcctagcagtgtgctcctcttcttggtgggctccaagaaggacctgagtactcctgctcagtatgccctcatggagaaagatgccctccaggtggcacaagagatgaaagccgagtattgggctgtgtctagcttaactggagagaatgtgcgggagttcttctttagatag

SEQ ID NO: 237699 - DNA, 756 bp, Artificial Sequence
  Description of Artificial Sequence: Synthetic coding sequence
atgaacatcttagcaccagtccgcagagaccgcgtgctggccgagctaccacagtgcctgcggaaggaagccgcattacacgggcacaaggatttccatccacgggttacatgtgcatgtcaggagcacagaacgggaaccgtgggcttcaagatcagcaaggttatcgtcgtgggtgacctgtccgtcggcaaaacctgccttatcaaccggttttgtaaagataccttcgataaaaactacaaggccaccatcggtgtagacttcgagatggagcgattcgaagttctgggaattccattctctctgcagctctgggataccgcgggacaagagcgattcaagtgcatagcaagtacttactatcggggtgcgcaggcaattattattgtctttaaccttaatgacgtcgcctcactcgaacataccaagcaatggctggccgacgcacttaaggagaacgacccaagtagtgtgttgctgtttctgacgcctgcacaatacgcattaatggagaaggatgcccttcaagtggctcaggaaatgaaggctgagtactgggcagtttcctcgttgaccggagaaaacgtccgcgaattttttttcagagtggctgcactgactttcgaagccaatgtgctcgcagagctggagaaaagtggagctaggcgaattggagacgtcgtcaggatcaatagcgacgacagcaatctatatctgacggcctctaaaaaaaagcctacatgctgtccctag

SEQ ID NO: 237700 - DNA, 780 bp, Artificial Sequence
  Description of Artificial Sequence: Synthetic coding sequence
atgaacatactcgcacctgtgcgcagagatagagttctcgctgaactccctcagtgtttaaggaaggaggccgctcttcatggtcacaaggactttcaccctcgagttacttgcgcctgtcaggagcatcgcactgggaccgtggggttcaaaatcagcaaggtcatagtggttggcgacctgagcgtcgggaaaacttgcctgattaatcgcttttgtaaagatacattcgacaaaaattataaggctacaatcggcgttgactttgagatggaacggttcgaagtgctgggcatacctttcagcctgcagctgtgggatacagcaggacaagaacgattcaagtgtattgcaagtacctattacagaggcgctcaagcaattataattgtgtttaaccttaatgacgtagcatctctggagcacacaaaacagtggctggcagatgctttaaaagagaatgacccaagtagcgtcctgctctttcttgtaggtagcaaaaaggacttaagtacacctgctcagtatgcgttgatggagaaggatgctttacaagtggctcaggaaatgaaggctgagtactgggccgtgagttcgcttacaggcgaaaatgtgcgcgagttcttcttccgcgtagctgcactgaccttcgaggctaatgttctggcagaactggagaaaagcggtgccaggcgtattggggacgtggtccggattaactctgatgactcgaatctgtacctgacggcaagcaaaaaaaaacctacctgctgcccatag

SEQ ID NO: 237701 - DNA, 636 bp, Artificial Sequence
  Description of Artificial Sequence: Synthetic coding sequence
atgaatatactggcccctgtgcgcagagaccgcgttctggccgaactgcctcagtgcctgaggaaggaagccgctctgcacggccacaaagatttccaccctcgggtcacctgtgcctgtcaggaacatcggaccggcaccgtggggtttaagatttccaaggttatcgtggtgggcgacctgtctgtgggcaagacgtgcctgattaatcggttctgcaaggatacattcgacaaaaattataaggcgacaatcggagtagacttcgaaatggaaaggttcgaagttcttgggatcccatttagcttacagctgtgggacacggccggacaggagagatttaagtgtatcgctagcacatactatagaggtgcacaagcgatcattatcgtcttcaacctgaatgacgtggcttctctcgagcataccaagcaatggctggccgatgccctgaaagagaacgacccttcttctgtgctcctctttctggttggctcaaaaaaggacctatctactcctgctcagtacgcattgatggagaaggacgctcttcaagtggctcaggagatgaaggcggagtattgggctgtgtccagtcttactggggaaaatgttagagaatttttcttccggtag

SEQ ID NO: 237702 - DNA, 696 bp, Artificial Sequence
  Description of Artificial Sequence: Synthetic coding sequence
taatcattacggttcccgatcacaaacagcgcgggagcaccatgcaaggccgctggacgcatgaacatcctggcaccagtacggagggatcgggttctcgccgaactgccacaatgcttgcgcaaggaagcagctttacatggccacaaggatttccaccccagagtcacatgtgcatgtcaggagcatcgcactggcacagtcgggagattcaagatcagcaaagttatagtggtcggagacctgtctgtaggaaaaacctgcctgatcaatagattttgcaaagatacctttgacaagaactataaggcgacaatcggcgttgactttgaaatggaaaggttcgaggtgttgggtattcccttctcactgcagttgtgggatactgccggacaggaacggttcaagtgtatcgccagtacctactacagaggtgcacaggcaataatcattgtttttaatttgaatgacgtagccagcttggagcataccaaacagtggctagcggacgccctgaaagagaatgaccccagttccgttctgctctttttagtgggttccaagaaagacctgagcaccccggctcagtatgccctcatggagaaggacgcactacaggtggcacaggagatgaagactgtccagcgactgccctctcccagagccctctgtcacccacactcatccagagcctag

SEQ ID NO: 237703 - DNA, 951 bp, Artificial Sequence
  Description of Artificial Sequence: Synthetic coding sequence
atgtctcacctgcccggactagagcttagacgggaggcaccacctctcctggggcctctcctgtcccctttcccactgcccgctggaagttggcatagacaaatgctgaggtcctcacttaggtttccaatcactaatagcgccggagccccttgtaaggcagccggaagaatgaatatcctggctcccgtgagacgggatcgcgtgctggccgagctacctcagtgccttcggaaggaagcggctctgcacggccacaaggactttcatccacgcgtcacttgcgcgtgtcaggagcaccgcacagggactgtgggcttcaagattagcaaagtgattgtggttggagacttgagcgtgggcaagacgtgtcttatcaaccgattttgtaaggacaccttcgacaaaaattataaggccacgatcggtgtggacttcgaaatggagagatttgaagttctggggattcctttttccctccagctgtgggacaccgctgggcaggaaaggttcaaatgtattgcttctacctactatcgcggtgcccaggcaataatcattgtcttcaacttaaacgatgttgcttcccttgaacacactaaacagtggcttgctgatgcactgaaggagaacgacccttcctccgtgctcctattcttggtcgggagcaagaaggacctgtcaacgccggctcaatacgccctgatggaaaaggacgccctgcaggtcgcccaagagatgaaagctgagtattgggcggtctcctctttgaccggtgagaatgtgagagaatttttctttagggtcgcagccctgactttcgaggctaatgtgctggcagagttggagaagtccggtgccaggcgaatcggagatgtggtgaggattaacagcgatgactcaaacttatacctcactgcaagcaaaaaaaagcccacttgctgcccatag

SEQ ID NO: 237704 - DNA, 825 bp, Artificial Sequence
  Description of Artificial Sequence: Synthetic coding sequence
atgctcaggagttcactgcgatttcccataaccaattcagccggagcaccttgtaaggctgctggcagaatgaatatcctggcgccagtccgtagagatcgcgtcttagctgaactgccccagtgtctccgaaaggaagcagctctgcatggtcataaggatttccatcccagagttacttgtgcttgccaggagcaccgaaccggaaccgtgggttttaaaatttctaaggttattgtggttggcgacctatccgtggggaagacctgtctaatcaaccgcttttgtaaggacacatttgataaaaattataaggccacgatcggagtagacttcgaaatggagcgctttgaagtgctgggcattccattctcgctccaactttgggatacagccggtcaggagcgatttaaatgcattgcctccacctactatcgtggggcacaagccatcatcattgtgttcaacctgaacgatgtcgccagcctcgagcataccaagcagtggttggctgacgcattgaaagagaatgatccttcttccgtgttactgttcttgacaccggctcagtatgccttgatggaaaaagacgctttgcaggttgcccaggaaatgaaggctgaatactgggccgtcagctcccttaccggcgaaaacgtgcgagagtttttctttagggtggctgctctgacctttgaagcaaacgttctggcagagctggagaagtctggcgctcgtaggatcggagatgtcgtccgcatcaactccgatgattccaacctgtaccttaccgcctcgaaaaagaagccaacttgttgcccatag

SEQ ID NO: 237705 - DNA, 807 bp, Artificial Sequence
  Description of Artificial Sequence: Synthetic coding sequence
atgagtcatcttcctggcctggaacttcgaagagaggcgccaccattgctggggcctctactgtcgccctttccactccctgcagggtcatggcaccgacagatgcttcgatcgtctttgcgctttccaatcaccaactccgctggggctccttgtaaggcagctgggagaatgaatatccttgcaccagttaggcgcgacagggtgctggccgagctgccccagtgcctacggaaggaggccgctctgcacggtcataaggatttccatcccagagtcacatgcgcatgccaggaacatagaaccggcaccgtcgggagatttaaaatttcaaaagtcatcgtggtgggggacctgagtgtcggcaaaacatgccttattaacagattctgtaaggacacctttgataagaactacaaagccaccattggcgtcgactttgagatggaacggttcgaggtactcggtatacctttttcattgcaactgtgggacaccgctggccaggaacggttcaagtgcatagcttctacatattatcgcggagcccaggccatcattattgtgttcaacctgaacgatgttgcttccctggagcacacaaagcaatggctggccgatgctcttaaggagaatgacccatccagcgtgctgctgttcctcgttggctcaaagaaggacttgagtacccccgcacagtatgcactcatggagaaagacgctctgcaggtggcacaggaaatgaaaactgtccagcggctgccatcaccacgtgccctctgccaccctcactcatcacgcgcatag

SEQ ID NO: 237706 - DNA, 1002 bp, Artificial Sequence
  Description of Artificial Sequence: Synthetic coding sequence
atggtcatcgccggagcttcatggatgctgggcagggccgcagctagccccacccagacccctcctaccaccagcacaatcagggtcgccagaagatctagagtggcgctggtggcaatggttatcgcagcggctgggtccgggggtcccggtcgcgctgagcctcagctgtcgcagccttcgttggactgcgggcgtatgcgatcctcattgacccccttgggccctccagtgtcccgtgacagggtgatcgcatcattcccaaagtggtacacacctgaggcatgcttgcagttgcgggaacattttcatggccaggttagcgcagcatgtcagagacgcaatacgggaactgttgggctgaagttaagcaaggtagtggttgtgggagacctgtatgtgggaaagaccagcctcattcaccgtttttgtaaaaatgtcttcgacagggattataaagccaccattggagtcgattttgaaatcgaacgattcgagattgcaggcattccatactctctgcaaatctgggacaccgccggacaggagaaattcaagtgtattgcatctgcctattacagaggggctcaggtcatcatcacagcctttgacctgacagatgtgcaaaccctggagcatacacgccagtggttagaagacgcactccgggaaaatgaggcgggaagctgcttcatcttcctggtgggaaccaaaaaggacttactgtctggcgcagcctgcgagcaggccgaggctgacgcagtccacctggccagggaaatgcaggccgagtactggtcggtatccgctaaaacaggggaaaacgttaaggccttcttctcaagagtcgctgcgctcgccttcgagcagagtgtactacaggatttggagcgccagtcaagtgctaggctgcaggtaggtaatggtgatctcattcaaatggagggcagtcctcctgaaacccaggaaagtaaacgcccaagcagcctcggatgttgttag

SEQ ID NO: 237707 - DNA, 936 bp, Artificial Sequence
  Description of Artificial Sequence: Synthetic coding sequence
atggtcatcgctggcgctagttggatgttgggacgcgctgccgcttctcccacgcaaactcccccaaccacatccacgattcgggtcgctcgccgtagccgcgtggccctcgttgctatggtgatagcagccgctgggagcgggggtcctggcagagctgaaccccaactgagccagccgtccctggattgcggtagaatgagatcttctttaaccccgctgggtccacccgtgtcaagagatcgcgtcattgcgtctttccccaagtggtacacaccggaagcatgtctccagcttcgagagcacttccatggccaagtcagcgccgcttgccagcgaaggaacaccggcaccgtgggtttctgtaagaacgtgtttgaccgcgattataaagccacaatcggagtggattttgaaatcgaaagatttgaaattgcgggaatcccctactcactgcagatctgggacactgctggccaagaaaaattcaaatgtattgcctcagcatattaccgcggagcacaagttataattactgccttcgaccttaccgacgttcagacattagaacatacaagacaatggcttgaagacgccctccgggagaatgaagccggaagctgttttatcttcctcgtcggaaccaaaaaagatctactttctggggctgcctgtgagcaggctgaggcagacgctgtccatctggctcgggagatgcaagccgaatactggtccgtgagtgctaaaaccggtgagaacgttaaggccttcttcagccgggttgctgcactcgctttcgaacagagtgtcctccaggatttggaaaggcagagcagtgcacgattacaggttggaaatggcgacctgatccaaatggagggatccccccctgagacgcaagagagtaagcgcccatcttcactcggctgctgctag

SEQ ID NO: 237708 - DNA, 498 bp, Artificial Sequence
  Description of Artificial Sequence: Synthetic coding sequence
atggttatcgcagctgccggttctggtggacctggaagggcagagccacagctcagccagccaagcctcgactgtgggcgtatgcggtccagtctgacccctctcggacccccagtgtctcgcgacagagtgatcgcgtcctttcccaagtggtatacaccagaggcctgtttgcagctccgcgaacacttccatggccaggtgtcagctgcctgtcagcggagaaataccggcacagtgggcctgaagctttctaaagtagtcgtggttggagatctgtatgtcggcaagacgtctctatcagcgcagtatgcacatcctcagggatttctcaccgccatgaaccaaccacatagccctaggccgttgtcacccggatatgcccatagcagtcacccatcacgcgctgtcgcttctaggaggtggagggccccatgcaggcagccgtccgaccagtattgcagtccaagggcctggcacacagccgctgcgctctag

SEQ ID NO: 237709 - DNA, 549 bp, Artificial Sequence
  Description of Artificial Sequence: Synthetic coding sequence
atggacctgcagcgacctgactcttaccagggaggagctggtcccgatttcaacgaccacgtactccataagactatcctggtcggggactctggggtggggaaaactagcctcctagtccagtttgaccagggtaagtttattcccggtagcttcagtgcgacagtaggtatcggcttcacaaacaaggtggtgactgttgacggcgtccgcgtgaagctgcagatctgggacaccgctggccaagagcgcttcagatccgtaacacacgcctattatcgggatgcccaggcgctactgcttctgtatgacattacaaataagtcaagttttgataacatcagggcttggttaaccgaaattcatgagtatgctcagcgtgatgtcgttatcatgttgcttggcaataaggcagacatgtcctctgaaagggtgatcaggtcagaggatggggagactctggcacgagaatatggggtgccatttctggagacaagtgcaaagacggggatgaacgttgagctcgcctttctcgctatcgccaaatag

SEQ ID NO: 237710 - DNA, 570 bp, Artificial Sequence
  Description of Artificial Sequence: Synthetic coding sequence
atgacgggcacacccggagctgttgctacgagggatggggaagcacccgaaagatctcccccttgctcaccgtcatatgacctgactgggaaggtcatgttactcggagataccggtgtaggtaaaacctgcttcctcatccagtttaaagacggcgcattcctatctggaaccttcattgccacagtgggaatcgacttcaggaataaagttgtgactgtagacggcgtgcgtgttaaactgcagatttgggacactgctggccaggagaggtttcggagcgtcactcacgcatactatcgcgacgcccaagcccttctgttgctctatgatattaccaataaatcttctttcgacaatattcgtgcctggcttaccgagatccatgaatacgctcagagagacgttgtcattatgctactggggaataaggccgacatgagcagcgagagagtgatcagatctgaggacggagaaacgctcgcacgtgaatatggggtacctttcctggagacaagtgcaaagacaggcatgaacgtagagctcgcttttctggcgattgccaagtag

SEQ ID NO: 237711 - DNA, 561 bp, Artificial Sequence
  Description of Artificial Sequence: Synthetic coding sequence
atgactggtacccctggggctgtcgctactagggatggggaagcgcctgaacgttctcccccatgctcccccagttatgacctaacgggaaaaaataaggttgtcacagtggacggcgttcgggtgaagctgcagatttgggatacagccggtcaggaaagattccgctccgtcacacacgcatattatagagatgcacaggccctgctgcttttgtatgacattacaaacaagtcctcctttgataatatccgcgcatggttgaccgagattcatgagtacgctcagcgagatgtagtcatcatgctactcggcaataaggcagatatgtctagcgaaagagtaattcgtagtgaggacggagagaccctcgccagggagtatggcgtgccatttctggaaaccagtgccaaaacagggatgaatgtggaactggctttcttggccatcgccaaggagttgaaataccgcgctggtcaccaggctgatgaaccgagcttccagatcagagactacgtggagtcccagaagaaacggtcgtcctgctgtagctttatgtag

SEQ ID NO: 237712 - DNA, 672 bp, Artificial Sequence
  Description of Artificial Sequence: Synthetic coding sequence
atgactggcactccgggtgcagtggctactcgagacggcgaggctcccgaacgatctcccccttgcagccctagctatgatctgaccggcaaggtgatgcttctgggcgatactggtgtgggcaaaacttgttttctcattcagttcaaagacggtgcctttctgtctggaacctttattgctactgtcggaatcgattttcgaaacaaggtcgtgaccgtcgatggagttagagtgaagctgcagatatgggacaccgctggtcaggagcggttccggtcggtaacccacgcgtattatagggacgctcaggctctgctgctcctctacgacattacaaacaaatctagctttgacaacatccgcgcttggctcacagagattcacgaatatgctcagagagacgtcgtcatcatgttgctgggaaataaggccgacatgtcttcagagcgggtgatcaggtccgaagacggtgaaacattagcccgagagtacggcgtaccctttctggagactagtgcaaagacgggcatgaacgtcgaactcgcattcctcgctatcgcgaaggagctaaagtatcgagccggtcaccaggctgatgagccaagcttccagattcgcgactatgtcgagtctcagaagaaacgttccagttgttgttcatttatgtag

SEQ ID NO: 237713 - DNA, 687 bp, Artificial Sequence
  Description of Artificial Sequence: Synthetic coding sequence
atgtggctgatgtccgaagcgcatggtgcagagcccgtgttacttcgagaagctgccaggccttttactcagacactgcgtctgtgtgtcccgtcaggtaattccaaggtgatgctgcttggtgacaccggggtcggaaagacctgcttcctcatccagttcaaagacggcgcattcctctcaggaaccttcatcgctaccgtgggcatagatttccgcaacaaagtcgtgactgtagatggggtgcgcgtgaagttacagatctgggacactgccggtcaggagaggtttagatctgtgacacacgcgtattatcgggacgcccaggccttgctgcttctttacgatattacaaataaaagtagctttgataacatacgggcatggctgactgagattcatgagtatgcccaacgggatgtcgttatcatgctgcttgggaataaagcagatatgagctccgaacgggtgatcaggtccgaagacggagaaaccttggcacgcgaatatggcgtgccattcctcgaaacttcagccaaaactggcatgaacgtggagctcgcctttttagctattgccaaggaactaaagtatagggctggacatcaagccgacgaaccaagctttcagatacgcgattatgtggaatctcagaagaagagatcaagttgctgcagcttcatgtag

SEQ ID NO: 237714 - DNA, 576 bp, Artificial Sequence
  Description of Artificial Sequence: Synthetic coding sequence
atgtggctcatgtcggaggcccatggagctgaaccggttctgttacgcgaagccgcaaggccttttacccagacactgcgcctgtgtgtgccctccggaaacagcaagaacaaagtcgtgacagtggatggtgtccgggtgaagttacagatttgggatactgccggacaggagcgatttcggtccgtcactcatgcctactacagggacgctcaggcgttgctgctgttatacgatatcacaaataagagcagcttcgataatatcagagcctggctcactgagatccacgagtacgcacagcgtgatgtggtgattatgctcctgggaaataaagccgacatgagctcggagcgggtaatccggtccgaggacggtgagacactagccagagagtacggcgtgcctttcttggagacaagcgccaaaaccggtatgaatgtggagctcgccttcctcgccattgcgaaggaattgaagtatcgggcaggtcaccaagctgacgaaccaagcttccaaatccgtgattacgtcgaatctcaaaagaagcgctcttcctgctgttctttcatgtag

SEQ ID NO: 237715 - DNA, 510 bp, Artificial Sequence
  Description of Artificial Sequence: Synthetic coding sequence
atggatctgcagcggccagacagttatcagggcggagccggtcccgactttaacgaccacgtgctgcacaaaaccattttagtcggagatagtggggtggggaagactagcctgctcgtccagttcgatcagggcaaatttattcctgggagtttctccgccaccgttggcataggttttacgaataaagttgttactgtggatggagttcgggtgaagcttcagatctgggacactgcaggtcaggagagattccggagcgtcacccatgcatattaccgggacgcccaggcgcttttgttgttgtatgatataactaacaaatcatcgtttgacaatattcgcgcttggcttacagaaatacacgagtacgcgcagagagatgtggtaattatgcttctcgggaacaaggtctccgggagtggcgcagggtccgcccagccctgcacttcctcagccctcgctggaccgataacaactcaagagcaactgtctaggcacccttcttag

SEQ ID NO: 237716 - DNA, 651 bp, Artificial Sequence
  Description of Artificial Sequence: Synthetic coding sequence
atggacttgcaaaggccggactcttaccagggaggcgctgggccagactttaacgaccatgttctgcataaaactatcctggttggggactctggagtgggaaagacgtccctcttggttcagtttgaccagggcaaatttatcccgggatctttcagcgcaactgtagggatcgggtttactaacaaggtagtgacagtagacggtgttcgggtcaaactgcaaatttgggataccgccggtcaggagcgtttcaggagcgtgacccacgcctactatcgcgatgcccaagccctgctcctgctgtacgacattacaaataagagttcctttgacaacattagagcgtggttgacggagatccacgagtatgctcagcgcgatgtggtgatcatgttgcttgggaataaagccgacatgtcctcggaacgggtgatcaggagcgaggatggggagactctggctcgggaatacggggtgccattccttgaaacaagtgcaaagacagggatgaatgtggagttggcgttcttagctattgctaaagagctaaagtatcgggctggccatcaggcggatgagccatccttccagatacgtgattatgtggagtcacagaagaaacgctcttcgtgttgttcattcatgtag

SEQ ID NO: 237717 - DNA, 651 bp, Artificial Sequence
  Description of Artificial Sequence: Synthetic coding sequence
atggatctccagcggcctgactcatatcaaggaggagctggacccgattttaacgatcatgtgcttcacaaaactattttagtgggcgatagtggggttgggaagacttcactgcttgtgcagtttgatcagggcaagttcattcctggatcatttagtgcgacagtggggatcgggtttacaaataaagtcgtcactgtggacggagtgcgagtgaagcttcagatctgggatacggccggacaggaacggtttagaagtgtcacacatgcatactacagagatgcacaggccctcttactcctttacgacatcaccaacaagtccagcttcgataacatcagagcttggttgaccgagatacatgagtacgcccaaagagatgttgtgattatgctcctggggaataaggccgatatgagtagcgaaagagtgatccgaagcgaggatggcgaaaccctggcacgagagtatggcgtacctttcctggaaaccagtgccaagaccggaatgaacgtggaactggcttttctggctatcgcgaaggaactcaagtatagagctggtcaccaagcagacgagccttccttccagattagagactatgtcgaaagccagaagaaaagatcctcatgctgttcatttatgtag

SEQ ID NO: 237718 - DNA, 672 bp, Artificial Sequence
  Description of Artificial Sequence: Synthetic coding sequence
atgacaggaactcccggtgctgttgcaacgagggatggcgaggcacctgaacggtccccaccatgctcgcccagctatgatcttaccggcaaggtcatgttgctgggggacaccggggtaggcaagacatgttttctcattcagtttaaagatggggcattcctatcaggaacgtttatcgcaaccgttggaatcgacttcaggaataaagtggtaaccgtggatggagtccgcgtaaagctgcagatttgggatactgcaggacaggaacgttttcgttcggtaacacatgcctactacagggacgcccaggcactgttgttgttgtatgatattaccaataagtccagtttcgacaacattagagcttggctaaccgagattcacgagtacgcccagagagatgtagtgatcatgctgctcggcaacaaggccgatatgtcttcggagagagtgattcggtccgaagatggcgagactctggcacgggaatatggagttccctttcttgaaacatctgctaagactggcatgaatgtggaacttgcctttcttgccatagccaaagaactgaaataccgcgctggccaccaggcagacgagccttctttccaaattagagactacgtggaaagtcagaagaaaagaagttcctgttgttcttttatgtag

SEQ ID NO: 237719 - DNA, 591 bp, Artificial Sequence
  Description of Artificial Sequence: Synthetic coding sequence
atgtgctgcaaggtcatgctgctgggagataccggagtgggcaaaacatgcttcctcattcagttcaaggacggtgcatttctgagtgggacctttatcgcaaccgtcggaatagacttccggaacaaggtcgttaccgtggacggagtccgtgtgaagctgcagatttgggatactgcaggccaggaacgctttcgtagtgtgacacacgcctactatagggacgctcaagctctacttttgctgtatgacatcaccaataagtcttcttttgataacattcgcgcatggctgaccgagatccacgagtatgcccagagagatgtagtgattatgctgctgggcaataaggccgacatgtccagcgagcgggttatacgttcagaggatggggagacactggcgcgtgaatatggcgtcccatttctggaaacgagcgcaaagacagggatgaacgtagaattggcatttctggcaatcgctaaggaactgaagtaccgggcaggccatcaagcagacgagccttcctttcaaattagggactatgtcgagtctcagaagaaaaggtcttcctgttgtagctttatgtag

SEQ ID NO: 237720 - DNA, 636 bp, Artificial Sequence
  Description of Artificial Sequence: Synthetic coding sequence
atgcaggcaccacacaaagagcacttgtacaagttactggtcatcggggatctgggcgtgggaaagacaagcattattaagaggtatgttcaccagaatttctcgagccactaccgggcaactatcggcgttgatttcgcactgaaggtcctccattgggatcccgagacggtggtccgattgcagctgtgggacatcgctgggcaagaacgatttggaaacatgactcgagtgtattacagagaggccatgggtgcctttattgtcttcgatgtcaccagacctgcaaccttcgaagcagtggcgaagtggaagaatgatctggatagcaaacttagcctccccaacggcaagcctgtgagcgtagtgcttctcgcgaacaaatgcgaccagggtaaagacgtcctcatgaacaatgggctaaaaatggaccagttttgcaaagagcatggttttgtggggtggtttgaaacctccgccaaggagaacatcaatatcgatgaagctagtcgatgcttagttaagcatattttagcaaacgagtgtgatctaatggagtcgatcgaacccgatgtcgtcaaaccgcatctgacatccacaaaagtagcgtcttgtagtggatgcgccaaaagttag

SEQ ID NO: 237721 - DNA, 642 bp, Artificial Sequence
  Description of Artificial Sequence: Synthetic coding sequence
atggaagccatctggctgtaccagttcaggctcatcgtgataggagacagcactgtgggcaagtcatgtctgatcagacggttcaccgaaggcagatttgctcaggtgtcagatcccacagtgggtgtcgatttcttcagcaggcttgttgaaatagaacctggcaagcgtataaagctgcagatctgggatacagccggacaggagcggttccgctctattacacgggcttattacagaaactccgtcggaggactccttttgtttgatattaccaatagaagatccttccagaacgtgcatgagtggctcgaggagaccaaggtgcatgtgcagccataccagattgtctttgttctcgtgggccataaatgcgacctcgatacacagcggcaggtgactagacatgaagccgaaaaactagcagccgcttacggcatgaaatacattgaaacctccgctagggatgcgatcaacgtcgaaaaagcattcactgaccttactcgagatatttacgagttggtgaagaggggcgaaatcaccatccaggagggatgggagggagtaaagtctgggttcgtaccaaatgttgttcattcatcagaagaagttgtcaagtccgagcgtcgctgcctgtgctag

SEQ ID NO: 237722 - DNA, 2187 bp, Artificial Sequence
  Description of Artificial Sequence: Synthetic coding sequence
atggcgggtcccgagggcttccaatatagagcactgtatccattcaggcgcgaacggcctgaggatctggagctgcttcccggtgatgttctggtcgtttcacgagccgctttacaggccctgggcgtggccgagggcggagagcggtgtccgcagagcgtgggatggatgccaggtctcaacgaacgcactcggcagaggggtgacttccccggaacatacgttgagttcttaggtcccgtggcgctcgccaggcctggtccgaggcctcgcggtcccaggcccttgcctgcacgacctagagacggcgcaccagagccaggcttgactcttcctgacctaccggagcagttttcacctcctgatgtggcacctcccctcctagtcaagctcgtcgaggcaatcgaacggaccggcttggatagcgagtctcattacagaccagagctaccggcaccgagaacagactggagcctgagcgacgtcgatcagtgggacacagctgctctggcagatggcataaaatcctttttgctggcccttccagcacccctggtcacacccgaagcctcggcagaagctcgtcgtgccctgagagaagcggcaggccctgtgggaccggctcttgaaccccctacactgcctttacatcgggcactgaccctccggttcttgctccagcacctcggtcgagttgccagtcgcgcacccgctctgggccctgccgtgagggccttaggtgccacattcggccctctgcttctccgggcacctccgccaccctcgagcccacccccaggcggagccccagatggatccgagcccagtccggattttcctgctctcttagtcgagaaactcctgcaagagcacctggaagaacaggaagtagccccaccagctctgccgcctaagcctccgaaggccaagcccgcatcgaccgtgctagctaacgggggttcgcctcccagcctgcaggatgctgagtggtactggggcgatatcagtcgagaggaggtgaatgaaaaactacgagatacacctgatggaacattccttgttagagacgcaagctctaaaatacagggagagtatacgctcaccctccgaaaggggggaaataacaaacttatcaaggtgtttcatcgggatggacattacggctttagcgagcctctcactttttgctctgttgtggatctgatcaatcattaccggcacgagtccctggcccagtataatgcaaagcttgatactcgcctgctgtaccccgtcagcaaataccagcaagaccagattgtcaaggaggacagcgttgaagccgtcggagcacagctcaaagtctatcatcaacagtatcaggacaaatcaagagaatacgatcagttgtacgaggagtacactagaacttcccaggaactccaaatgaagcggaccgccattgaagcttttaacgaaaccatcaagattttcgaggaacagggacaaactcaggaaaaatgtagcaaagagtacttggaaaggtttagacgggagggcaacgagaaagaaatgcagcggatcctgctgaactctgagagattgaaatcccgtatcgccgaaatacacgagtctcgaaccaagctggaacagcaactaagggctcaggcctcagacaaccgtgagatcgataagcggatgaacagcctgaagcccgaccttatgcaactccggaagataagagaccagtatctggtgtggcttacacaaaagggagctagacagaagaaaataaatgagtggctcggtatcaagaacgaaacagaagaccaatacgctcttatggaggacgaagatgacttgcctcatcacgaggagagaacctggtatgttggcaagatcaatagaacacaggccgaggagatgctctcaggcaagcgggatgggacgtttctgatccgggagagcagtcagcgcggatgctacgcatgctccgtcgtcgtggatggggacaccaagcactgtgtcatttacagaaccgcgactggtttcggattcgccgagccctacaacttatacggctccctgaaggagctggtgcttcactaccaacatgcctcgttggtgcagcacaacgacgctctgaccgtaactttagcacaccccgtacgggctccaggtccaggtcctcctccggctgcgagatag

SEQ ID NO: 237723 - DNA, 660 bp, Artificial Sequence
  Description of Artificial Sequence: Synthetic coding sequence
atggccagcgttactgatgggaaaacaggagttaaagacgcgtccgaccaaaattttgattacatgtttaaacttctgattatagggaacagcagcgtcggcaaaacttcctttcttttcaggtatgcagatgatacgtttactccggcttttgtaagtaccgtgggaattgattttaaagtgaaaactgtatacaggcacgaaaagcgagtgaagttacagatttgggataccgctggtcaggaacgatacaggacaataactacagcttactaccgcggtgcaatgggcttcatcctcatgtacgacatcacaaatgaagagtcattcaatgctgtacaggactgggccacccagattaagacctattcttgggacaatgctcaagtgatacttgtcggcaataagtgtgacatggaagaagaacgcgtggtccccactgagaagggccagctcctcgctgaacagctgggttttgacttctttgaggcctccgccaaagaaaacatctccgtgaggcaggcattcgaacgactggtggatgccatctgcgacaaaatgtccgactctcttgataccgacccaagcatgcttggcagcagcaagaatactagactttcagatacccccccactcctccagcaaaactgttcatgttag

SEQ ID NO: 237724 - DNA, 660 bp, Artificial Sequence
  Description of Artificial Sequence: Synthetic coding sequence
atggcctcagtgactgatggcaagacaggcgtgaaggacgcgtcagatcaaaattttgattacatgtttaaactgctgatcattgggaattcgagcgtgggcaagacatccttcttgttcaggtacgcagatgatacattcacacctgcattcgttagcaccgtgggcatcgattttaaagtgaaaacagtttaccggcacgaaaaaagggtcaaattgcagatctgggatactgctgggcaagaaaggtatcggacgatcacaactgcctattataggggtgccatggggttcatactgatgtatgatattacgaatgaagaaagtttcaatgctgtacaagactgggcgactcaaatcaaaacgtatagttgggataatgctcaagtcatattggtagggaacaagtgtgacatggaggaggagcgagttgtgccaactgaaaagggacaattgctggccgagcagttgggcttcgattttttcgaagcgtcagccaaggagaacatttccgtgcggcaggcttttgagaggctggtcgacgctatatgcgataaaatgtccgatagcttggacaccgacccctcaatgctgggaagtagcaagaacacaagactaagcgacacacccccactactgcagcagaactgttcatgttag

SEQ ID NO: 237725 - DNA, 684 bp, Artificial Sequence
  Description of Artificial Sequence: Synthetic coding sequence
atgaggcatgaggctccaatgcagatggcctctgctcaggacgcaagatatgggcagaaggatagctctgaccaaaacttcgactatatgtttaagctgttaataatcggaaactcttccgtcggcaagaccagcttcctgtttcgttacgctgatgactctttcacctccgctttcgtgagtacggtcggtatagacttcaaggtaaagacagttttcaagaatgaaaaaagaataaaactgcagatttgggacactgcaggacaggaacgttacagaactattacaaccgcctattatcgaggagctatggggtttatactgatgtacgacattaccaacgaggaatcctttaacgctgtgcaggactggtccacccaaatcaagacctactcatgggataacgcacaggttattctggtgggaaacaagtgcgatatggaagacgagcgcgtcatttctacggaaaggggacagcatttgggcgagcagttgggcttcgagttttttgagacctcggctaaggacaatatcaatgtgaagcagactttcgagagactggttgatataatttgtgacaagatgtcagagtcacttgagaccgaccccgcaataacagctgccaaacagaatacacggttaaaagaaacgcctcccccaccacagcccaactgtgcatgctag

SEQ ID NO: 237726 - DNA, 783 bp, Artificial Sequence
  Description of Artificial Sequence: Synthetic coding sequence
atggctggcagccctctgctctggggacctagggcaggcggtgtcggcctgcttgtcctcctgctgttaggattgtttcggcctccccctgccctttgtgcccgtccagtgaaggaacccagagggctgtccgcagccagccctcccttggctgagacaggagccccacggaggtttcgcaggagtgtgcccaggggagaggccgcaggggctgtgcaagagttggcacgagcccttgctcacctcctcgaggctgagaggcaggagagagcgagagcggaagcccaggaagccgaggaccagcaggctcgagttctagcacaactgctccgggtgtggggagcgccacgtaatagtgacccggctctggggctcgacgacgacccggatgcaccagcagctcaactggcaagagcgcttttgcgcgctcgcctggatccagctgctctggccgcacagctagtgccggctcctgtccctgccgcagctctgaggccaagacccccagtgtacgacgatggacctgccggaccggacgccgaggaggccggtgatgaaacacctgatgtcgatccagaactgttgcgttatctcctgggtcggatcttggccggttcagcagatagcgaaggggtggcagcccctagacgattaaggagagccgctgatcacgatgtgggatctgagcttcctcccgaaggggtactgggtgccctcctccgggttaagcgcctcgagactccagctcctcaggtgcccgctcggagactgctgcctccctag

SEQ ID NO: 237727 - DNA, 657 bp, Artificial Sequence
  Description of Artificial Sequence: Synthetic coding sequence
atgagccagactgcaatgagtgaaacctatgactttctgtttaagttcttggtcattggaaacgccggaactggtaaatcttgcctcctgcaccagttcattgagaagaagttcaaagatgacagcaatcacacaattggcgtggaatttgggtcaaagataatcaacgtggggggaaagtacgtgaagctgcagatctgggacacagcagggcaggaacgatttcggagtgtgacaagatcatactaccgaggcgcagctggagccctgctggtttatgacattacttccagagagacatataacgccctgactaattggttgactgacgctcggatgctggccagtcagaacattgtgataatcctgtgtggcaataaaaaggaccttgacgctgaccgtgaagtaacatttctggaggcatcaagattcgcccaggagaatgagctgatgtttctggagacttccgctctcactggcgaaaatgtggaggaggcgtttgtccaatgtgccagaaagattctgaataagatagaaagtggcgaacttgacccagagagaatgggcagcggaatccagtacggagatgccgctctaagacagctgagaagccccagaagagcccaagctcccaacgcccaggaatgcggttgctag

SEQ ID NO: 237728 - DNA, 648 bp, Artificial Sequence
  Description of Artificial Sequence: Synthetic coding sequence
atggcttcacgcggtgcaactcgacctaacggacccaacactggaaacaagatttgtcagttcaagctggttcttttgggcgaaagtgccgtggggaagtccagcctagtgctccgattcgtaaaggggcagtttcatgaatttcaggagtcaacaatcggggctgcctttctgacacaaaccgtgtgtctcgatgacaccacggtcaagtttgagatttgggacacagccggacaggagcggtaccacagtctcgcaccaatgtactaccgaggagcccaagccgctatcgtggtctacgacattaccaacgaagaatcatttgcgcgtgccaagaattgggtgaaagagttacagaggcaagcatcccctaacattgtgatagcgctctccggcaacaaggcagacctggccaataagcgggcagtagattttcaggaggcgcaatcctacgccgacgataatagtcttttgtttatggagacatccgctaagacaagcatgaatgtcaatgagatctttatggcaatcgcaaaaaaactgccgaagaacgagccccagaaccctggggcaaactcagcccgaggacgaggtgtcgatctcaccgagcccacacagccgacgaggaatcagtgttgcagcaactag

SEQ ID NO: 237729 - DNA, 606 bp, Artificial Sequence
  Description of Artificial Sequence: Synthetic coding sequence
atggctagccgaggagcaacaagaccaaacggtccgaataccggcaataagatctgccagttcaaattggtgctcttaggcgagtctgccgtgggcaaatcttctctggtattaagatttgtgaagggccagtttcatgaatttcaggaatccactatcggcgtgaagttcgagatctgggatacagccggacaggagaggtaccatagtttagcacccatgtattatcgcggagcccaggctgcgatcgtcgtgtacgacatcaccaatgaagaatcatttgcccgtgctaagaactgggtcaaagagttgcagagacaggccagtccaaacatcgtaatcgcactatcaggaaacaaagccgacctcgccaacaagcgagctgtcgatttccaggaagcacaatcctatgcagacgataattcattgttgtttatggagacctcggcgaagacctccatgaacgttaacgagatctttatggccattgccaaaaagctcccgaaaaacgaaccccagaatccaggggcaaattccgccaggggccgtggggtcgacctcacagaaccgactcagccgacccggaatcagtgctgttctaattag

SEQ ID NO: 237730 - DNA, 48 bp, Artificial Sequence
  Description of Artificial Sequence: Synthetic coding sequence
atggcatctagaggagctacaaggcccaatggaccaaacacaggctag

SEQ ID NO: 237731 - DNA, 648 bp, Artificial Sequence
  Description of Artificial Sequence: Synthetic coding sequence
atgaccagcaggtcaactgccaggcctaatgggcagcctcaagcctcaaagatttgccagttcaagctggtgctgctgggagaatccgccgtcggaaagtcgtctctggtcctgcggtttgtgaaaggccagttccatgagtatcaggaaagcaccatcggcgcagccttcctgacgcagtccgtatgtttggatgacactactgtaaagtttgagatatgggacactgctggccaagagcgctatcactcattagctccgatgtattatcgcggagcgcaggccgcaatcgtggtatatgatattaccaaccaggagacattcgctagagccaagacgtgggtcaaagagcttcagcgacaagcctccccttcaatcgtcattgcacttgccggtaacaaagccgacttggctaacaagaggatggtggagtacgaggaggcacaggcttacgcagatgacaattcactgctgttcatggagaccagcgcaaaaactgctatgaacgtgaatgacctcttcctagcaatcgcaaagaaactgcctaagagtgagccccaaaatctggggggtgccgcaggtcgcagtaggggggtcgatctccatgagcagagccagcagaacaagagccaatgctgctccaattag

SEQ ID NO: 237732 - DNA, 525 bp, Artificial Sequence
  Description of Artificial Sequence: Synthetic coding sequence
atgacttcacgatccactgccaggcccaatggacaaccccaggcttccaagatctgtcaatttaaattggtgctgctgggcgaatcagccgtaggcaaatcgtccttagttctcagatttgtaaagggccagttccacgagtaccaagaatcaacaatcggcgctgcattcctcactcagagcgtctgcttggatgataccacagttaagtttgaaatatgggacacagccggtcaggaaagatatcactcactggccccaatgtactaccggggagcccaggctgccatcgtcgtctacgatattaccaaccaagaagcgcaggcttacgccgatgataacagcctgttatttatggaaacttcagcgaaaacagccatgaacgttaacgacctgtttctggcaatcgctaagaaattgcctaagagcgagccgcaaaacctgggcggagctgctgggagatcccggggagtcgatctgcacgagcagagtcagcagaacaaatcccagtgctgcagtaattag

SEQ ID NO: 237733 - DNA, 348 bp, Artificial Sequence
  Description of Artificial Sequence: Synthetic coding sequence
atgacctctagaagcaccgctagaccaaacggccagccccaggcgtcgaaaatctgccagttcaaactggttcttctaggcgaatccgctgttggcaaatcctctctggtgctgagattcgtcaaggggcaattccacgaataccaggagagtacaatcggagccgctttcttgacccagagcgtctgtctggatgataccaccgttaaatttgagatatgggatacagccggtcaggagcgctaccactctctagcccctatgtattatcgcggagcacaggctgcaatagtcgtgtatgacatcactaatcaggaaacctttgccagagccaagacctgggtttag

SEQ ID NO: 237734 - DNA, 303 bp, Artificial Sequence
  Description of Artificial Sequence: Synthetic coding sequence
atgacttcccgaagcactgccaggcccaatggccagcctcaggcaagcaaaatatgccagttcaagctcgtgctgcttggcgagagtgctgtcggtaagagctccctggtgttgcgctttgttaagggtcagtttcacgagtatcaggaatcaaccattggcgctgccttcctgacccaatccgtgtgcttggacgacaccacagtgaaattcgaaatctgggacacggcagggcaggaacgctaccattctctagcccctatgtactatcgtggtgcccaagccgctatcgtggtttactag

SEQ ID NO: 237735 - DNA, 648 bp, Artificial Sequence
  Description of Artificial Sequence: Synthetic coding sequence
atgactagccgcagcacagcgagacccaacggacaaccccaggcttcaaagatctgccaattcaaactcgtcctcctgggtgaaagcgctgttggcaagtcttcactagtcttacggttcgtgaagggccagtttcacgaataccaggagtccacaatcggtgcggcattcctcacacagtcagtatgtctggacgatacaaccgtaaagttcgaaatttgggatactgctggccaagaacggtatcactccctggcacccatgtactaccggggagctcaggctgctatcgtcgtttatgacatcaccaatcaggaaacattcgctagagctaaaacttgggtgaaggagctgcagcgccaggcttcaccctctatcgtgatagcactcgccggtaacaaggcggatctcgcaaacaaaagaatggtggagtacgaggaggctcaggcatatgccgacgacaatagtctattattcatggaaaccagcgcgaagaccgcaatgaatgtcaacgatctgttccttgctattgccaaaaaacttcctaagagcgagcctcagaacctggggggagccgctggacgatccagaggcgtggacttacacgagcagagtcagcagaacaagagtcagtgctgctccaattag

SEQ ID NO: 237736 - DNA, 651 bp, Artificial Sequence
  Description of Artificial Sequence: Synthetic coding sequence
atggcgggacggggtggagccgcaaggccgaacggacctgccgctggaaacaagatctgtcaattcaagttggtgctcctgggagaaagcgccgtcggaaagtcgtccctggtccttcggttcgtgaagggccaattccatgaataccaggagtctactatcggagccgcattcttaacccagactgtgtgcctggatgataccacagtgaagtttgaaatctgggatacagccggacaggaaagataccattcacttgctcccatgtactaccggggtgcgcaggccgcaatcgttgtctatgacatcaccaatactgacacattcgccagggcaaagaactgggtcaaggaactgcagcggcaggcatcccctaacatagtgatcgcgctcgccggaaataaagctgacttagcctctaagcgcgcagtagagtttcaggaggcgcaagcctacgcagacgacaattccctccttttcatggaaacaagtgccaagaccgccatgaatgtgaacgagatcttcatggcaattgctaaaaagcttcctaaaaacgaaccacaaaatgctacgggagccccaggcagaaacaggggggtggatttgcaggaaaataatccggcttcccggtcccaatgttgttccaactag

SEQ ID NO: 237737 - DNA, 651 bp, Artificial Sequence
  Description of Artificial Sequence: Synthetic coding sequence
atggccggtagagggggagctgctcgccctaacggtcccgcagctggcaacaagatctgccaatttaagcttgtgttgctgggcgagtcagccgtcggcaaatcatctctcgttctgcggttcgtcaagggacagttccatgagtatcaagagtcaactattggcgctgccttcttaacacagacagtttgtcttgacgatacaactgttaagtttgagatttgggatacggcaggccaggagcggtatcattccctagcacccatgtactatcgcggagcccaggccgcaatcgtggtctacgatattaccaacaccgatacctttgctcgtgcaaaaaactgggtgaaagagctgcagagacaagcatctccgaacatcgtgatcgccttagctgggaacaaagcagacctcgctagcaaaagagcggtggaattccaggaggcccaggcctacgccgacgataactctttgctattcatggaaacatcagcaaaaaccgcaatgaatgtaaacgagatctttatggcaattgctaagaagctccccaaaaacgaaccacagaacgcaacaggcgctccagggcgaaacagaggggtcgatttacaggaaaacaatccggctagcagaagccagtgctgtagtaactag

SEQ ID NO: 237738 - DNA, 750 bp, Artificial Sequence
  Description of Artificial Sequence: Synthetic coding sequence
atggagctcagttggcgcagcccgtctcccttatccgcttccttgcactctacctcaccacacccgcatgcactttggaccaccaccgctggacgggctatggcgggacggggaggtgcagcccgaccaaacggcccagcagctggcaacaagatctgtcaatttaagttggtgttgctgggcgagagcgccgtggggaaaagttccctcgtgcttagatttgtgaagggacaattccatgagtaccaggagtcaacaatcggagcagcgttcctgacgcagacagtctgcctagatgacacaacagttaaattcgagatctgggacaccgcagggcaggagagataccactccctggccccaatgtattacaggggcgcacaggccgctatcgtagtatacgatatcacgaatactgacacttttgcaagagcgaaaaattgggtcaaggaattacagcgtcaggcatctcccaatatcgtgattgccctggccggaaacaaagccgacttggcctctaagcgcgctgtggagttccaggaggctcaagcttacgcggacgacaactctcttctgtttatggaaaccagcgcaaaaacagccatgaacgttaatgagattttcatggctatcgctaaaaagctgcccaaaaatgagccacagaatgctactggggcacccggacgtaatagaggcgttgacctgcaggagaacaatcccgcttccaggtcccagtgctgttcaaattag

SEQ ID NO: 237739 - DNA, 225 bp, Artificial Sequence
  Description of Artificial Sequence: Synthetic coding sequence
atggcagggcgaggcggagcagccagacctaacggacctgctgctggcaacaagatctgccagttcaaacttgtgctactgggtgaatcagccgtgggcaaatcctcactggtgctgaggttcgtaaagggccagtttcacgaatatcaagagagcactatcggagcggcattcctcactcagacagtatgcctggatgacaccaccgtcaaatttgaaatttag

SEQ ID NO: 237740 - DNA, 279 bp, Artificial Sequence
  Description of Artificial Sequence: Synthetic coding sequence
atggcgggacgagggggagctgcccgtccaaacggccctgctgccggaaacaaaatttgccaattcaagctcgtcctgctcggcgagtccgctgtggggaaatctagtcttgtcttgaggttcgttaagggtcagtttcatgagtatcaggaatccacgatcggggcagcttttctcacgcagacggtatgtcttgatgatacaaccgtcaaatttgaaatctgggatactgcaggccaggagcgctaccactcactggccccaatgtattatcggtag

SEQ ID NO: 237741 - DNA, 375 bp, Artificial Sequence
  Description of Artificial Sequence: Synthetic coding sequence
atggccggacggggaggagccgctagacctaatgggccagcagccggaaacaagatctgccaatttaaactcgtgctacttggcgagagcgctgtcggaaagagttcactggtactccgatttgttaaaggccagttccatgagtatcaggagtccaccattggcgcagccttcctgacccagactgtgtgcctagatgataccacagttaaattcgaaatctgggatactgctggacaggaacgataccacagtctggcccctatgtactatcgcggtgcccaggctgctatagtggtctatgatatcaccaataccgacacgttcgctcgggcaaaaaattgggtcaaggagcttcagcggcaggcaagctag

SEQ ID NO: 237742 - DNA, 627 bp, Artificial Sequence
  Description of Artificial Sequence: Synthetic coding sequence
atgtcaacgggcggtgattttgggaaccctctgcggaaatttaaactggtgtttctgggggaacagtctgtggggaaaacgtcccttattacgagatttatgtatgattccttcgataacacataccaagccaccatcggaattgattttttgagtaaaacaatgtatcttgaagacaggaccattaggctgcagttgtgggatacagcgggtcaggaacggttcagaagcctgatcccaagctacatcagagatagtgctgctgcggtcgtagtatatgatattacgaacgtcaatagcttccagcagacaaccaagtggatagacgatgtgcgtactgagagaggcagcgacgtcattatcatgctggtggggaacaaaaccgacttggccgacaagaggcaggtcagcatcgaggagggggaacgaaaggccaaagagctgaacgtgatgtttatcgaaactagcgccaaagccggttacaacgtcaagcagttgttccggcgagtggctgccgctctgcccggaatggagagtacacaggataggtcgcgagaggatatgatagacatcaagttggaaaagcctcaggagcagcctgtgtctgaggggggatgtagctgttag

SEQ ID NO: 237743 - DNA, 627 bp, Artificial Sequence
  Description of Artificial Sequence: Synthetic coding sequence
atgtccaccggtggcgattttgggaatcccctgcgcaaatttaaactggtgtttctcggagagcagtcggtggggaaaacgtctttgattacccgattcatgtatgactccttcgacaacacttatcaggctacaattggcatcgactttttgagtaaaaccatgtacctggaggacagaacagtgagactgcaactgtgggatacagcgggacaggagagatttaggtccttaataccaagttatatcagggatagtactgtcgctgttgtcgtttacgacattaccaacgtgaattcgttccagcagactacaaagtggatcgacgacgtgcgcaccgaaaggggatctgatgttataataatgcttgttgggaataaaactgacctggctgataagagacaggtctcaatcgaggagggcgaacgcaaggctaaagagctgaacgtcatgttcatagaaacttccgccaaagcaggatataacgtgaaacaactcttcaggagggtggccgcagcactgcccggtatggaatcaacacaggacaggagccgggaggacatgatcgatattaaactggaaaagccccaggagcagccagtgtctgaaggcggatgctcctgttag

SEQ ID NO: 237744 - DNA, 627 bp, Artificial Sequence
  Description of Artificial Sequence: Synthetic coding sequence
atgagcactggcggagactttgggaatccactgaggaagttcaagctggtgttcctcggcgagcaatcagttgggaagacctcattaatcacccggttcatgtatgatagtttcgacaacacgtatcaggccacaataggcatcgactttctctctaaaacgatgtacctggaagatcgcaccatccgtttgcagctctgggacacagcgggacaagagcggttccgaagccttatcccttcctatatcagagattccgcagcagctgtggtggtgtatgatatcactaatgttaatagttttcagcaaacaaccaaatggatcgatgatgtgaggaccgagagaggcagtgacgtcatcataatgcttgtggggaataagacagacctggcggataagaggcaggtctccattgaggagggggagaggaaagccaaggagcttaatgtcatgtttattgaaacaagcgctaaggccggatataatgtgaagcaactcttccgacgggtcgcggctgctctgccgggtatggaaagcacacaggatagaagcagggaggacatgatagacattaagctcgaaaagccccaagagcagcccgtatccgagggaggctgcagctgttag

SEQ ID NO: 237745 - DNA, 525 bp, Artificial Sequence
  Description of Artificial Sequence: Synthetic coding sequence
tgacccctcagaaagttcaaactggtgttcctcggggaacagagcgtaggaaaaactagtcttataacccgctttatgtacgacagcttcgacaacacatatcaggccactatcgggattgacttcctgagtaaaaccatgtatctcgaggaccggaccgtaagactgcagctgtgggacactgccggacaggagaggttccgctcattaatacccagctatatacgggattcaacggtcgctgtggtggtgtacgatatcaccaatgttaatagctttcagcagaccaccaagtggatcgatgacgttcgcactgaaagaggaagtgacgtgataataatgctggtcggcaataagacggatcttgcggataagcgtcaggtgtccatcgaggaaggggagcgtaaggccaaggaacttaatgtgatgtttattgaaacttcagcaaaggccggttataacgtcaagcagaggataggatcttgccacgtcgcccaggcgtctctcgagctactagatagttag

SEQ ID NO: 237746 - DNA, 225 bp, Artificial Sequence
  Description of Artificial Sequence: Synthetic coding sequence
atgtctaccggaggggattttggtaacccgctcagaaaatttaagttagtctttcttggcgaacagtccgtggggaagacttctctcatcacacgctttatgtatgactccttcgacaacacataccaggctactatcgggatcgactttctgagcaagaccatgtatctcgaagacaggaccgtgcggctgcagctgtgggacacagccggacaggagagatag

SEQ ID NO: 237747 - DNA, 528 bp, Artificial Sequence
  Description of Artificial Sequence: Synthetic coding sequence
atgtatgacagcttcgataatacctatcaggcaactataggaattgattttctatctaagaccatgtacttggaggaccgcacaataagactgcaactatgggacaccgcaggccaggaaagattccgctctctcattccatcctatatacgcgacagcgccgcagctgtggtggtctacgatattactaacgtgaacagttttcagcaaacaaccaaatggatcgacgatgttaggacagagcgaggatctgacgtgataataatgctagtcggcaacaagacagatctcgcggacaaaagacaggtgagcatcgaagagggcgaacgcaaagctaaagagcttaatgtgatgttcattgagacatcagcaaaggctgggtataacgtgaagcaactgtttcggagggtcgctgccgctctgcccggaatggagagtactcaggaccgctcgagagaagatatgatcgatatcaaactggagaaaccacaggagcagccagtgagcgagggagggtgcagctgctag

SEQ ID NO: 237748 - DNA, 429 bp, Artificial Sequence
  Description of Artificial Sequence: Synthetic coding sequence
atgtctaccggtggtgatttcggcaatccattgcggaagtttaagcttgtcttcctcggcgagcagagtgtcggcaaaacttccctgatcaccaggtttatgtacgacagttttgataacacttatcaggccaccatcggtattgacttcttgtcaaagaccatgtacctggaagacagaacaattcgcctgcaactctgggacaccgcaggtcaggaacgctttcgatccttaatcccctcctacataagggatagcgctgcggctgttgtggtttacgatattaccaatgttaattcctttcagcagaccacgaaatggatcgatgatgtcaggacggaacgaggctcagatgtgatcataatgcttgtgggaaataagactgacctggctgacaaacgacaggtcagcattgaggaaggagaatag

SEQ ID NO: 237749 - DNA, 315 bp, Artificial Sequence
  Description of Artificial Sequence: Synthetic coding sequence
atgtccactggaggcgactttggcaatcctctacgtaagttcaaactcgtcttcctcggtgaacagtcagtcggaaagactagcctgatcacccgatttatgtacgactctttcgacaacacataccaagccacaattggcatagactttctctccaagacaatgtacctggaggatcgcactctattccgtcgcgtcgcagccgctctgcctgggatggagagtacgcaggaccgctctcgcgaggatatgatcgacattaaactcgaaaagccccaagaacagcccgttagtgaggggggttgcagctgctag

SEQ ID NO: 237750 - DNA, 606 bp, Artificial Sequence
  Description of Artificial Sequence: Synthetic coding sequence
taagtttttcctcgcggactggccctcaggtcagcagacgttgtcgaggtggggaaaaccagtctgataactcgattcatgtacgattcttttgataatacatatcaggccactataggaattgacttcctcagtaagaccatgtatctcgaggacaggaccattaggctacaactgtgggatactgccggtcaggaaagatttcgaagccttattccatcttatattagagactccgctgcagctgtggtcgtatatgacattactaacgtgaactcattccagcagacaaccaagtggattgacgatgttcggacagagcggggtagcgacgtgatcataatgctcgtgggaaacaaaacagatctggccgacaagcgccaggtgtcgatagaagagggagagcgtaaagcaaaggagctgaatgtgatgttcatcgaaacatccgctaaagctggatataatgtgaagcagctgtttcgcagggtggccgcagctttgccaggtatggaaagtacccaagaccggagccgcgaagatatgattgatatcaagctggaaaagcctcaagaacaacctgtgtccgaggggggttgcagctgctag

SEQ ID NO: 237751 - DNA, 144 bp, Artificial Sequence
  Description of Artificial Sequence: Synthetic coding sequence
atgtccaccggtggggatttcggaaatccactcaggaagtttaagctagtctttctaggcgagcagtccgtagggaagacaagcctgattactagatttatgtacgatagctttgataacacctatcaggccaccattggctag

SEQ ID NO: 237752 - DNA, 765 bp, Artificial Sequence
  Description of Artificial Sequence: Synthetic coding sequence
atgtccgcaggcggagattttggaaatccgcttcggaagttcaaattggtattcctgggggaacagtcggtggctaagacctccctgataactagatttaggtacgattccttcgacaacacatatcaggcaatcatcggaatagattttctgtcgaaaacgatgtatctagaagacggtaccattggccttcgactttgggacacagcagggcaggagcgcctcagatcgttaatcccccgatatattcgagattctgccgctgccgtggtcgtgtacgacattaccaacgtgaattccttccagcagacaaccaaatggatagacgatgttcggacagagcgaggtagtgacgtcatcattactctggtgggaaaccgaaccgacctcgctgataaaagacaagtaagcgtggaggagggcgaacgtaaggccaaaggcctcaacgtgactttcatcgaaacgagggccaaggctgggtacaacgtcaaacagttgttccggagagtggctgccgcactaccagggatggaatccacgcaagacggttctcgagaggatatgagtgatattaagttagagaagcctcaagaacagactgtgagcgagggcggttgtagttgttacagcccaatgagttctagtaccttgccacagaagccaccatacagcttcattgattgttccgtgaatattggcctgaacctttttccatcactcatcaccttttgcaacagtagcctcctgccggtttcctggcgttag

SEQ ID NO: 237753 - DNA, 612 bp, Artificial Sequence
  Description of Artificial Sequence: Synthetic coding sequence
atgggaagcagggatcatctctttaaggtcctggttgtgggtgacgctgccgtcggtaagacatccctcgtgcagcgatactcccaagactcgttctccaaacattacaaatcaacagttggtgtggacttcgccttaaaggttctccagtggtccgattacgagatcgtcagacttcagttgtgggatattgcgggacaagagcgctttactagcatgacaagactctattatagagacgccagcgcatgtgtgattatgtttgatgttacaaacgcaacgactttcagcaatagccagaggtggaaacaggatttggatagcaaattaactctgcctaatggcgaacccgttccctgcctactgctcgccaacaaatgtgacctgtctccttgggccgtgagccgagatcagattgatcggttttcgaaggagaacggcttcaccggatggactgagacttccgtgaaggagaacaaaaatatcaatgaagccatgcgggtcctgatagagaagatgatgcgtaactccactgaggacatcatgtctttgtccacccagggagattatattaacctccaaactaagtctagctcttggagctgttgttag

SEQ ID NO: 237754 - DNA, 612 bp, Artificial Sequence
  Description of Artificial Sequence: Synthetic coding sequence
atgggcagccgggaccaccttttcaaggtccttgtagtgggtgacgccgcagtaggtaaaacgagtcttgtacagcgttattctcaggatagcttctccaaacattataagagtaccgtgggggttgatttcgccttaaaagttctgcaatggtccgactatgagattgtgagactacaactgtgggatatagctggacaggagagattcactagcatgaccagattatattacagggacgcctcagcatgcgttattatgtttgatgtgactaacgccaccaccttttcgaatagtcagaggtggaagcaagatttggatagcaaactgaccctgcccaatggagaaccagtgccctgtctgcttctcgccaacaagtgcgacctgtccccatgggcagtcagccgcgaccagattgaccgcttctccaaggagaatggtttcaccggctggacagagacatcagtaaaggaaaataagaatatcaatgaggcaatgcgagtgctgatagagaagatgatgcggaattcaactgaggacataatgtccctgtcaacacaaggcgattacatcaatctacagaccaaatcctcatcgtggtcctgttgctag

SEQ ID NO: 237755 - DNA, 612 bp, Artificial Sequence
  Description of Artificial Sequence: Synthetic coding sequence
atgggcagccgggaccatctgttcaaggtcctcgtggtgggtgatgcagccgtgggcaagacttcattggtacagagatacagccaggattccttctccaaacactataaaagcaccgtcggggttgattttgccttaaaagtcttacagtggagtgattacgaaatcgtccgcctacaactatgggacattgcagggcaggaacgcttcacttccatgactaggctttactatcgagacgcctccgcttgcgtgatcatgtttgacgtcactaatgccactacctttagtaactcccagcgctggaaacaggaccttgattccaagctgactctaccgaacggagaacccgttccatgtctgctactagcgaacaaatgtgacttgtccccctgggccgtctctcgtgaccagatcgatcggtttagcaaggagaatggcttcacgggttggacggaaacatcagtaaaggagaacaaaaacatcaatgaggcaatgcgcgttctgatcgagaaaatgatgcgcaacagtacagaagacattatgtccctatccacacagggagattatatcaacctccagactaagagcagttcgtggtcctgctgctag

SEQ ID NO: 237756 - DNA, 396 bp, Artificial Sequence
  Description of Artificial Sequence: Synthetic coding sequence
atgactcgtttgtactacagggatgccagcgcctgcgtaataatgttcgatgtaaccaatgcaactaccttctccaacagtcagcgctggaaacaggatcttgactcaaaacttaccctaccgaacggggagccagtcccttgtcttctgctagccaataaatgtgacctcagcccatgggccgtctctcgggaccaaatcgaccggttcagcaaggaaaacggattcacagggtggaccgaaacctccgttaaggaaaataaaaatatcaatgaggccatgagggtcttgatcgagaaaatgatgcgtaactcgacagaggatatcatgtccctctctacccagggagactacataaatttgcagacaaagtcaagctcgtggtcctgctgctag

SEQ ID NO: 237757 - DNA, 540 bp, Artificial Sequence
  Description of Artificial Sequence: Synthetic coding sequence
atgggttctagggaccatctgtttaaggtacttgtggtgggagacgcagcggttggcaaaacctctcttgtgcaaaggtactcccaggattctttcagcaagcactataagagcacagtcggagggcaggagagatttaccagcatgacacgcttgtattaccgcgatgcgagtgcctgtgtgattatgtttgatgtcactaacgccacaacattttcaaattcccagagatggaagcaggatctcgactctaagctaaccctgcccaatggagagcccgttccctgtcttttactggccaacaaatgcgatcttagcccgtgggcagtcagtagagatcagatcgacaggttcagcaaagagaacggcttcacgggatggaccgagacctctgtcaaggagaacaagaacataaacgaggcaatgagggtgctgattgagaagatgatgcgaaacagtacagaggacattatgagcctctcaacccagggcgattacataaaccttcagaccaagtcatcatcttggagctgttgctag

SEQ ID NO: 237758 - DNA, 624 bp, Artificial Sequence
  Description of Artificial Sequence: Synthetic coding sequence
atggcgaaaacatacgattatctgttcaagcttctgcttattggagactccggcgtgggtaagacctgtgtcttgtttaggttctcggaggacgcatttaacagcacatttatttcaacaatcgggattgactttaaaatacgcaccatcgaactggacggcaaaagaatcaaactccagatctgggacaccgcgggtcaggagaggtttcgcacgattacaacggcttattatcgcggagcgatgggcatcatgctggtatacgatattacaaacgaaaaatcttttgacaatatccggaattggattcgtaacattgaagagcacgcctcagctgacgtggagaaaatgattctgggtaacaagtgcgacgtgaatgataaacgtcaggtgtcaaaagagagaggggagaaactggccctcgattatggcatcaagtttatggagacctctgcaaaggccaacatcaatgtggagaacgctttcttcacactggcccgtgatattaaagccaagatggataagaaactagaaggcaattccccacaaggcagcaaccagggcgtgaagatcactcctgaccaacagaaaaggtcctccttcttccgctgcgtcttgctgtag

SEQ ID NO: 237759 - DNA, 606 bp, Artificial Sequence
  Description of Artificial Sequence: Synthetic coding sequence
atgagcggcaaatctttattattgaaagttatcctcctgggagacggtggagtgggaaaaagtagtcttatgaatcgctatgtcacaaacaaattcgactctcaagcctttcacacaattggtgtagagtttctgaaccgcgatcttgaagtagacggacggttcgtaactcttcagatctgggataccgccggacaggagaggtttaagagcctgaggactccgttctaccgaggcgcagactgttgtctgctcaccttttctgttgacgataggcagagcttcgaaaatctgggcaattggcagaaagaattcatatactatgctgacgtgaaggaccctgagcatttcccctttgtcgtcctgggaaataaggttgacaaggaagaccgacaggtcacaacggaagaggcacagacctggtgtatggaaaacggggattacccataccttgaaacatctgccaaagatgatactaatgttacagttgcctttgaggaagccgtgcgtcaggtgctggcagtggaggagcaacttgaacattgcatgttgggtcacacgatcgacctgaattcaggcagcaaggccggttcctcatgctgctag

SEQ ID NO: 237760 - DNA, 2589 bp, Artificial Sequence
  Description of Artificial Sequence: Synthetic coding sequence
atggcgcagccgggtccagcatctcagcctgacgtttcactgcaacagagagtggcagagctggaaaagataaacgcagaatttcttcgcgctcaacagcagcttgaacaagaatttaatcagaagcgagcaaagtttaaagagttatatttggcgaaggaagaggatctgaagcggcagaatgctgtcctgcaagcagctcaggatgatctgggccatctgcgaacccagctctgggaagcacaggctgaaatggaaaacatcaaagccatcgctaccgtgtctgagaacactaagcaggaggccatcgatgaggtaaagcgacagtggcgcgaggaagtcgcctccttgcaggctgtcatgaaggaaacagtccgagactacgagcaccagtttcacctccgcttggagcaagagcggacacagtgggctcagtaccgcgaatcagcagaacgagagatcgcagacctcaggaggcgtctgagcgaaggccaggaagaggagaatctggaaaacgagatgaagaaagcacaagaggacgctgagaaacttcgctctgtagtaatgcccatggagaaggaaatcgccgcactgaaggataagttgaccgaggccgaagataaaattaaggaattggaggcctcaaaggtaaaggagcttaatcattatctggaagccgaaaaaagctgtcgcaccgacttggagatgtacgtggccgtcttgaacacacagaaatcagtgctgcaggaagatgccgaaaagctgcggaaggaactgcatgaggtgtgccaccttctggagcaagaaagacagcagcacaaccagttgaagcacacatggcaaaaggccaacgatcagtttctggagagccaacgactgcttatgcgcgatatgcagagaatggaaatagtgctgacgagtgaacaactcagacaggttgaggagctgaagaagaaagaccaggaagatgacgagcagcagcggcttaataaaagaaaggatcacaaaaaagctgatgtggaggaggaaatcaagatccccgtggtttgtgcattgacccaggaggagtcgagtgctcaactgagcaatgaggaagaacatctggattctaccagagggagtgtgcattcacttgatgcagggctactgctgccgagtggcgatccctttagcaaaagcgataatgatatgttcaaagacggcctgcggagggctcagtccacagacagcctggggacctccggttctctgcagtccaaggcgcttggttacaattataaggcgaagtccgctggtaatctggacgagtcagacttcggtcctcttgtcggagcagacagcgtctccgagaatttcgacacagctagcctcggttccctgcagatgccatccggcttcatgctgaccaaggatcaggagcgggctattaaggccatgacacccgaacaggaagagactgcctctttgctgagctctgttacacaggggatggaaagcgcctatgtctcccctagcggttatcggttagtcagcgaaacagaatggaacctgctgcagaaggaggtgcacaacgccggaaacaagcttggcagacgctgcgacatgtgctctaattacgagaagcagcttcaaggcattcagatacaagaagcagagactagagatcaggtgaagaaattgcagttaatgctgcggcaagcaaacgatcagcttgaaaaaaccatgaaagacaagcaggaactggaagacttcattaaacaatcatcagaggattcctctcatcaaatctccgcccttgtcctgagggcccaggcatcagaaatcctgctcgaagaattacagcaaggtctttctcaggccaagagggacgttcaggaacagatggccgttctaatgcaatcgcgggagcaggtgtccgaggagctggtcaggttgcagaaggataatgattccctgcagggtaagcatagtctgcacgtctctctgcaacaagccgaagattttattctccctgacacaaccgaggccctgagagagttagtcctgaagtacagagaggatattatcaacgtcaggaccgccgctgatcacgtcgaagagaagttaaaggcggagatcctgttcctgaaagagcagattcaggctgaacaatgcttgaaagaaaatctcgaggaaactctgcagctggagatagagaattgtaaagaggagatagctagtatcagctcactgaaagcagaattggaacgcattaaggtggaaaaaggacagctagaatcaacattgcgggagaaaagccaacaacttgagtccctgcaggagatcaagatcagcctcgaagagcaactcaagaaggaaactgctgcaaaggcaacggttgaacaactcatgttcgaagagaaaaacaaagcccagcggcttcaaaccgaactggacgtgtctgagcaggtgcagagagacttcgttaaactctcgcagacccttcaagtccagctggagaggattcggcaggctgactcactcgaaagaatcagagccatcctgaacgacaccaaattgacggacatcaatcagctaccagagacctag

SEQ ID NO: 237761 - DNA, 2490 bp, Artificial Sequence
  Description of Artificial Sequence: Synthetic coding sequence
atggctcaaccgggaccggcttctcaaccagacgtttctctgcagcaaagggtcgcagagctcgagaagataaacgcggaattccttcgtgcgcagcagcagctcgaacaggagtttaatcagaaacgagcgaaattcaaagaactgtacctggccaaagaggaggatctcaaaagacagaatgctgtgctccaggccgctcaggacgacctcggccacctgcgtacgcagctatgggaagcccaagcagagatggagaacatcaaagccatcgccacggtgtcggagaacactaagcaagaggcgatcgatgaggtcaagcgccagtggagagaggaggtagcctccttgcaagcggtcatgaaggagacagtacgtgactacgaacaccagttccaccttcggctggaacaggaacggacccagtgggcccagtaccgggaatctgccgagcgggaaattgctgatcttaggcgcagactgtcggagggacaagaggaggagaacctggaaaatgagatgaagaaggctcaggaggatgctgagaagcttcgctcagttgtgatgccgatggagaaggagattgccgcacttaaggacaagctcaccgaagccgaggacaaaataaaggagcttgaggcttcaaaggtaaaagagctgaatcactatttggaagccgagaagagctgtagaactgacctggaaatgtacgtcgctgtgctgaatacccagaagtctgtgctgcaagaggacgccgagaagctgcgcaaagaacttcacgaagtttgccatctgctggagcaggagagacagcagcacaaccagctaaaacacacctggcaaaaggcaaatgaccagttcctagagagccagaggctgcttatgcgcgacatgcagagaatggaaattgtgctgactagcgagcagctgcggcaagtcgaggagttgaagaagaaagatcaggaggatgatgagcaacagagactgaataagcgaaaggaccataagaaagcagatgttgaagaggagatcaaaatacccgtggtgtgtgcactgacacaggaggagtccagtgcccaactttccaacgaagaggagcacctggactctacacgagggtctgtacactctctggatgccggtctcctgcttccatctggagatcccttttcaaagtccgacaacgacatgtttaaagatggtctgcgccgagcacaatcgaccgattccttagggactagcggatctctgcagtcgaaagctctggggtacaattataaggctaaaagcgccggaaacctcgacgagtccgattttggtcccctcgtgggagccgactctgtgtctgaaaacttcgatacagcctctctcggatcgcttcaaatgccttccggcttcatgttgacgaaggaccaggaacgggctattaaagcaatgacacccgagcaggaggagacagcgtctctcttgagctcagtcacgcaaggtatggaatctgcttatgtgtcaccttctggctataggttagtgagtgaaacggaatggaatctcctccagaaagaagttcataacgcgggtaataaactcgggcgaagatgtgatatgtgctccaactatgaaaagcagctccaaggaatacaaatacaggaagccgaaactcgagaccaggtgaagaaactccagctgatgttgaggcaggccaatgaccaactcgaaaagaccatgaaggacaaacaggagctggaggacttcatcaagcagtccagcgaggatagctctcatcaaatctccgccttggtattacgagcacaagcatctgagatcctactggaggagctgcaacagggactgtcccaagctaagcgcgatgtccaagaacagatggccgtccttatgcagtcaagggaacaggtcagtgaggagttggtcagactccagaaggacaacgatagcctgcagggtaagcactctctgcatgtctcgctgcaacaggcagaggatttcattcttcccgataccaccgaagccttgcgcgagctggtcttgaagtacagagaggacattatcaacgtgaggaccgcggcagatcatgtcgaggagaagctcaaggccgaaattttgttcctgaaggagcagatccaggctgaacagtgcctcaaggaaaacctagaggagaccctgcagcttgaaattgagaattgtaaggaggagatcgcctcgatatcctctctgaaagccgagttggaaagaatcaaggtcgagaagggccaggctaccgtggagcagctcatgttcgaagagaagaataaggcccagcggctgcagacagagctggatgtgtcggagcaggtgcagagagattttgttaaactttcccagaccttacaggtgcaactggagcgtattcgacaagcagactcattggaaagaatcagagctatcctgaacgacacaaagctgaccgacataaaccagctgccagagacttag

SEQ ID NO: 237762 - DNA, 2490 bp, Artificial Sequence
  Description of Artificial Sequence: Synthetic coding sequence
atggcccaacccggacccgcaagtcagccggacgtgtccctgcaacaaagagtagcagagctggaaaagattaacgcagaattcttacgcgcacagcagcagttagagcaggagtttaatcagaagcgcgcaaaatttaaagagctttacctggctaaggaggaagatctgaaaaggcagaacgccgttctgcaggctgcccaggatgacttgggccacctgcgcacccaactatgggaggcccaagccgaaatggagaatatcaaggcaattgcgactgtgtctgaaaacactaaacaggaggctatagacgaggttaaaagacagtggcgtgaggaggtggcctccttacaggcggttatgaaggaaaccgtcagggactatgaacatcagtttcatctacgtctggaacaggaaaggacccagtgggcacagtatcgggagtctgccgagcgcgagatcgccgacttgcgacgcagattaagtgaagggcaggaggaggagaacctggaaaacgaaatgaaaaaagcacaggaagacgctgaaaagctcaggtcagttgtcatgccaatggagaaggagatcgctgccctcaaggataagctgaccgaagctgaggataaaatcaaggagctagaagccagcaaagtgaaggaactaaaccactatctcgaggccgaaaaatcatgccggaccgacctggaaatgtatgtggcagtactcaatactcagaaaagcgtgttgcaggaagacgcagagaaactgcgaaaggagctgcatgaggtgtgccacctgctcgaacaggagaggcagcagcacaatcagcttaagcacacatggcaaaaggcgaatgaccagttcctggaaagccagcgccttctcatgagggatatgcagcgcatggagatcgtcctgacgtctgagcagttgaggcaagtggaggagctaaaaaagaaagaccaggaggatgacgagcaacaaaggcttaacaagagaaaggatcacaaaaaagccgatgttgaagaggagatcaaaattcccgtcgtgtgcgccctgactcaggaagaaagctccgcccagctctccaacgaagaagaacatctagattcaaccagggggtcagtgcacagtctggatgcaggattgttgctgccttcaggagaccctttctccaagtcagacaacgacatgtttaaggacggtttgagaagagcccaaagtaccgattcactggggacctccggtagcctgcaaagtaaggcacttggctacaactataaggcaaaaagcgccggtaacctggacgagtcggattttgggcctctggtcggagctgatagtgtttccgaaaattttgacactgcatcacttgggtctttgcagatgccttcaggcttcatgcttaccaaagaccaggaacgggcaatcaaagcaatgacacccgagcaggaggagactgcctctctactaagtagtgtcacacagggcatggagtccgcttacgtgtctccatccggctaccggctagtgagtgagacggaatggaacttgctacagaaagaggtgcacaatgccggaaataagttggggagacggtgcgatatgtgcagtaactatgagaagcagctgcagggcattcagatacaagaggccgaaaccagagaccaggtgaagaagttgcagctgatgctccgtcaagccaacgatcagttggagaaaaccatgaaagacaaacaggagttagaggatttcatcaaacagtcgtctgaagattcttcccaccagatatcagccctcgtgctccgagcacaggcgtctgaaattctgctggaggaactccaacagggattgtctcaggcgaagcgggacgtacaagaacagatggccgtgctgatgcaatctagagaacaggtctcagaggagctcgtgagattgcagaaagacaacgactctttgcagggtaagcattccctgcacgtgtctctacagcaagccgaagatttcattctgcctgatacaactgaagcattgcgagagctggtgctgaagtacagagaggacatcatcaacgtccgtactgcagctgatcatgtggaagagaaactgaaggctgaaatactctttctgaaggaacagatccaagcggagcagtgtttgaaagagaacctggaagagaccctccagctggagatcgagaattgtaaggaagagatagcttcaatctctagtctcaaggccgagttggaacggatcaaagtggagaaaggtcaagccaccgtggaacaacttatgttcgaggagaagaataaggctcagcggctgcagacagaactggacgtgtcagagcaggtgcagcgggatttcgttaagctttcacaaactctccaagtgcaactggaacgaatccgacaagcagactcactggagaggattagagctatcctgaatgataccaagttaactgatatcaaccagcttcctgagacgtag

SEQ ID NO: 237763 - DNA, 2460 bp, Artificial Sequence
  Description of Artificial Sequence: Synthetic coding sequence
atggcccagccgggtcccgcttcccagcccgatgaggacctgaagagacaaaatgccgtactgcaagcagcccaggacgacctcgggcatctgcgcacccagctgtgggaagcacaggcagagatggagaacatcaaggccattgcaaccgtctccgaaaatacaaagcaggaagctatcgatgaggtgaagcggcagtggagagaggaggtggcgagccttcaggccgttatgaaggagaccgtgcgcgattatgaacatcagttccacctgcggctggaacaagagcgaacgcagtgggcccagtaccgcgagtccgccgagcgtgagatcgccgatctacgaagaagactttcagaaggtcaagaggaagagaatctagagaacgaaatgaagaaagcccaggaagacgccgagaaattgcgaagtgtcgtgatgccaatggagaaggagatagccgctctgaaagacaaactcacagaggccgaagacaaaatcaaggaactcgaggcatcgaaggtgaaagagctgaaccattacctggaggccgagaagtcctgtcggacggacctggaaatgtacgttgccgtgcttaacacccagaagtcagtcctgcaggaggatgcagagaagctaaggaaagaactgcacgaggtctgtcacctgctagagcaggaacggcaacagcataatcagttgaaacacacctggcaaaaggcaaatgatcagtttctcgaatcccaaagactccttatgcgggacatgcagagaatggagatagtcttgacatcagaacagttgcggcaagtagaagagctgaagaagaaagatcaagaggacgacgaacagcaaaggttgaataaacgcaaagaccacaagaaagctgacgtagaggaagagatcaagatcccggtggtgtgtgctctgacgcaggaagagagttccgcacagctctccaatgaggaggaacatttggacagcactagagggtccgtccacagtttagatgctggcttgctgctgcccagtggcgacccattcagcaaatccgacaacgatatgttcaaagatgggctgagacgggcacaaagtaccgacagtctggggaccagcggcagcctccaatctaaagctcttgggtacaactataaagctaaaagcgccggtaaccttgatgaatctgactttggtcctctggtgggtgccgactctgtcagcgagaacttcgacactgcatctcttggcagtttgcaaatgcctagcgggtttatgctgacaaaggaccaagaacgggctatcaaagccatgacgcctgaacaggaggagacagctagcctgctcagtagcgtcacccagggaatggaatctgcctatgtgtctccatctggataccggctggtgagcgagacagagtggaatctactgcagaaagaagtccacaacgcaggcaataaactcgggagacggtgtgacatgtgttccaattacgagaagcagctgcagggcattcagatccaggaagccgaaaccagggatcaggtcaaaaaattacagttgatgctcaggcaggccaatgatcaactggagaaaacgatgaaagataaacaggagctggaggacttcataaaacagagtagtgaagacagttcccaccagatcagtgccctggtgctcagggcgcaggcttctgaaatactcctggaagaattgcagcagggtcttagccaggccaaacgggatgtccaagaacagatggcagtgttgatgcagagtcgagaacaggtttccgaggagttggtgcgactacagaaagataacgactcccttcaaggtaaacatagtttgcacgtctccctccaacaggccgaggacttcattctgcctgacacaaccgaggctctgagagaactcgtgctgaaataccgcgaggatattatcaacgtgcgaaccgctgctgaccatgtggaagaaaaattgaaagccgaaattttgtttctcaaggagcaaattcaagctgagcagtgcctgaaagagaacctggaagagactctgcagctcgagatcgaaaattgcaaggaagagatcgccagtatatcttccctcaaggcagaacttgagcggattaaggtggaaaagggtcagcttgagagcacactcagggagaaatcacaacaacttgagagtctgcaggagatcaagatctctttggaggagcaattaaagaaggagacagcagccaaggcgacggtggagcagttgatgtttgaagagaaaaacaaggctcagcgtctgcagactgaactcgatgttagtgagcaggtacagcgtgattttgtgaaactgagccagactctccaggtccagctcgagcgcatccgccaggccgactccctggagcggatcagggctattctgaatgacaccaaacttactgatattaaccaactgcctgagacatag

SEQ ID NO: 237764 - DNA, 2151 bp, Artificial Sequence
  Description of Artificial Sequence: Synthetic coding sequence
atggcccaaccaggcccagccagccagcccgatgtgtctttacagcagagggtggcagaattggaaaaaataaacgccgagttccttagggctcagcagcaactcgagcaggagttcaaccagaagagggctaagtttaaggaactgtacctcgcaaaggaggaagatctgaagcgacagaatgcagtactgcaggcagcccaggacgacctgggccatctgcggacacaactttgggaggctcaggctgaaatggaaaatatcaaagctatagcaactgtaagtgagaatacaaaacaagaggctatcgatgaagtcaagaggcagtggagagaagaggtggcctccctccaggctgtcatgaaagaaactgtgagagattacgagcatcagttccacttacgactcgagcaagaaagaactcagtgggcacagtatagggagtcagccgagagagagattgcagatctgcggaggaggttgtccgagggccaagaagaggaaaatctggaaaacgagatgaagaaggcccaggaggatgctgaaaaacttcgcagtgtggtgatgcccatggagaaggaaattgcggctttgaaggacaagttgactgaagccgaggacaagatcaaagagctggaggcctccaaggtaaaggagctgaaccactacctcgaggcagaaaaatcatgccggaccgatctcgaaatgtacgtggccgttctgaacacccaaaaaagtgttctgcaggaggacgcagagaagttacggaaggagttgcaccaggaaaggcagcaacataatcagcttaagcatacttggcagaaggccaacgaccagtttctggagagccagagattactgatgcgggacatgcaacgtatggaaatcgttctgacaagcgagcagctgagacaggtagaggaacttaagaagaaagaccaagaggacgacgaacaacagaggctgaataaaaggaaggatcataaaaaggctgacgtcgaagaggagatcaaaattccagtcgtatgcgcattgacgcaggaagagagttcggcgcagctcagtaacgaggaagaacacttggattccacgcggggaagcgtgcactcactggatgccggtctgctcctgccgtctggcgatccattttcgaaatctgataacgatatgttcaaagatggcctcaggcgtgctcagtctaccgactcccttggaaccagcggctcgctacagtcaaaggccttgggctataactataaagcaaagtccgccggaaatttggatgagagtgactttggcccacttgtcggcgctgatagtgtcagcgagaatttcgatacagcgtccctcggctctctgcagatgcccagcgggttcatgctgaccaaggatcaggaacgagcaattaaagccatgacacctgaacaggaagaaaccgcctcactgcttagtagcgtcacgcagggaatggaatctgcctacgtctcacccagcgggtatcgcctggtatcagagaccgaatggaacctgctccagaaggaggttcacaacgctggcaacaagctgggcaggagatgcgatatgtgttccaattatgaaaagcaactccagggaattcagatccaagaggccgagacacgcgatcaggtgaagaagttacagctaatgcttcggcaggctaatgaccaacttgaaaagacgatgaaggataaacaagaactggaggatttcattaaacagtcttctgaagactcatcccatcagatttccgctctcgtgcttagggcccaggcgtcagaaatacttcttgaagagcttcagcagggactatcgcaggcaaaacgggatgtccaagagcagatggccgttctgatgcaaagccgcgaacaagtgtccgaggagctggtccgcttgcagaaagataatgacagtcttcagggaaagcacagtttgcacgtttctctgcaacaggcagaggactttatcctgcctgacacaactgaggctttacgggaactggtactgaaataccgggaagacattatcaatgtacgcaccgccgcagaccatgtcgaggaaaagttgaaagctgaaatcttatttctgaaggaacagatccaggctgaacaatgtttgaaaaagaagaagtag

SEQ ID NO: 237765 - DNA, 2589 bp, Artificial Sequence
  Description of Artificial Sequence: Synthetic coding sequence
atggcccagccaggtcccgcaagccaaccagacgtatctttacagcagagggtggccgagctcgagaaaatcaacgctgagtttttgcgagctcagcagcaactagaacaggagtttaaccagaaaagggcaaaatttaaagaattgtatctcgcaaaagaggaagatctcaaaagacagaatgcagtcctacaggctgcccaggatgacctcggccacctgcgtactcagttatgggaggcacaagccgagatggagaacattaaggctattgccacagtctccgagaatacaaagcaagaggccatcgatgaagttaagaggcaatggagggaggaggtcgcatcactccaagcagtgatgaaggagaccgtgagagattacgaacaccagtttcacctgagattggaacaggaacgcacccagtgggcccagtaccgcgagagtgccgagagagagatcgctgatctgagaaggaggctgtccgaaggtcaggaggaagaaaacctggagaatgagatgaaaaaagcacaggaggacgctgagaagctgagatcagtcgtgatgcctatggagaaagagattgctgctctgaaggacaagcttactgaagctgaagacaagattaaggaactagaggcgtctaaggtgaaggagctcaaccattatctggaggccgagaaatcttgccgcacagacctcgaaatgtacgtggcagtgctcaatacacagaaaagcgtcctgcaggaagatgccgagaaactgagaaaagagttgcacgaagtctgccatctcctcgaacaggagagacaacagcacaaccagcttaaacacacctggcagaaggctaacgatcagttcctggagtcccagaggctcctcatgcgggacatgcaaaggatggaaatcgtcctgacctctgagcaactccgacaggtggaagagcttaagaaaaaagatcaggaagatgatgaacagcagcgactgaacaagcgaaaagatcacaaaaaggcggatgtggaggaggagattaagatcccagttgtgtgcgctctgacccaggaggagtccagtgcacagcttagtaatgaagaagaacacttggatagtactcgaggttctgtgcactctctggatgcaggactcctcctgccttcaggggatccattttcgaagagcgataacgatatgtttaaggacggactgcggagagcccagagcacggactctctcggcaccagtggttcccttcagagcaaggcattagggtacaattacaaggccaaatccgcgggaaatctagatgaatccgactttggccctctcgtcggcgctgacagtgttagtgaaaatttcgatacagccagcctcggctcattacaaatgccctcaggtttcatgttgactaaggatcaggagagggccattaaagccatgacgcccgagcaagaggagaccgcctcactgctgtccagcgtgacccagggcatggagtcagcttatgtttcccccagtggctaccgtctggtcagtgaaacggaatggaatctgctgcagaaagaggtgcacaacgctgggaataagctgggacgcaggtgcgatatgtgctctaattatgaaaaacagctgcagggaatccagattcaggaggctgaaactcgggatcaggtaaaaaagctgcaattgatgctgagacaggctaatgaccaacttgagaaaacaatgaaagacaagcaggagctggaagactttatcaagcagtctagcgaggactccagccaccagatttctgcactcgtattgcgggctcaggcctccgagatactgctggaagagctccagcaaggtctgtcacaggcaaaaagagatgtccaggaacagatggcggttttaatgcagagccgcgaacaggtgtctgaggagcttgtgaggttgcaaaaggacaacgactcactgcagggtaagcatagtctgcacgtctcactgcagcaggcggaagacttcattctgcctgacacgaccgaagccctccgtgaactcgtactcaagtaccgcgaggacattattaacgtgaggacagctgctgaccatgtagaggagaagctcaaggcagaaattctcttcctgaaggagcaaatccaggccgagcagtgcctcaaagaaaacctggaggagactctccagctggaaattgaaaattgtaaagaagaaattgcttctatttcctcacttaaagccgagcttgagcggattaaggttgaaaaaggacaacttgagagtacattgagggagaagtcacagcagctcgagagcctgcaggaaataaagattagcttggaagaacagctgaaaaaggaaacagccgcaaaggcaaccgtcgaacagctaatgttcgaggaaaaaaacaaggctcagcggcttcaaactgaactcgacgtttctgagcaggtgcagagagattttgtgaagctgtctcagacattacaagttcagctggaaagaattcggcaggccgattctctagagcgcatacgggctatcctcaacgataccaaactcactgatatcaaccaactgcctgaaacttag

SEQ ID NO: 237766 - DNA, 1602 bp, Artificial Sequence
  Description of Artificial Sequence: Synthetic coding sequence
atggccgcagctgctccagtggctgctgacgatgatgagcgcaggcgcaggccgggagcagctctggaagattcgcgtagtcaggagggcgcaaatggcgaggccgagtccggggaactgtctaggctccgcgcagagttagcaggagccctggcggagatggaaacgatgaaagctgtggctgaggtctcagagtccactaaggccgaagcggtggccgctgtgcaacggcagtgtcaggaagaagtcgcttcgctacaggccatccttaaagactcaatttcctcttacgaggcgcaaatcaccgcactcaagcaggagaggcagcagcagcagcaagattgtgaggaaaaggagagagagttggggagactgaaacaactgctctccagagcctaccctctcgattccttggaaaaacaaatggagaaggcccatgaggacagcgagaagctacgcgagatcgtcctgccgatggagaaggagattgaggagcttaaggcaaaactgctgagggcagaggaactgattcaagagattcaacggcgtccgcgacacgctccaagtctgcacggaagcactgaactcttgcctttatctcgggacccttctccaccccttgaaccgctcgaagagctctcaggggacggaggtccagccgctgaagctttcgcacacaactgcgacgactccgcatctatatcctctttctcgctcggtgggggtgtcggcagcagtagttccctcccccaatcccgacagggactctctcccgagcaggaagagaccgcaagcctcgtgtcaacggggactctggtgcctgagggaatctacctgccccctcccggttatcagctggtcccagacacccagtgggagcagttacaaactgagatgcaggtattactggcccaagttcagaactccgagcagttacttagaacactgcaaggcactgtatcccaggcccaggagcgtgtgcagcttcagatggctgagctggtgactacgcacaagtgccttcaccatgaggtgaagagacttaatgaagagaatcaggggctgagagcagaacaactgccctcgtcggcacctcagggctctcagcaggagcaaggagaggaagaatcactgccttcatcagtacccgaacttcaacagctgctgtgctgtacgcgacaggaagccagggccaggctccaggcccaagagcacggagctgaacggcttcggatcgagatcgtgactctgcgagaagctctggaagaggaaacggtggccagggcgtccctggaaggacaactgcgagtgcaaagagaagagaccgctagtctctgtagcctgcgcaccgagatggaacgggtgcaacaggaacagtccaaagcccagttgcctgacctgctgagtgaacaaagagcgaaagtgctccggctgcaggcggaactggaaacaagtgagcaggtccagcgcgacttcgtgaggctgagtcaggcacttcaagttcggctggagagaattcgccaggcagaaacgctggaacaggtgagaagcatcatggacgaggctccacttacagacgtgagggacattaaagatacatag

SEQ ID NO: 237767 - DNA, 1710 bp, Artificial Sequence
  Description of Artificial Sequence: Synthetic coding sequence
atggcagccgcagctcccgtcgccgctgacgatgatgagcggagaagacggccaggtgctgctctcgaggatagccggagccaagagggcgcaaatggcgaggcagaatccggcgagctcagccgcctgcgggcagaattggcaggcgcattggctgagatggagacaatgaaagccgtcgcagaagtgtccgagagtacaaaagccgaggccgttgccgcagtgcagagacagtgtcaggaggaggtagcttcactccaggccatcctgaaggacagcatttcttcatatgaggcccagataaccgccttaaagcaggaacggcagcagcagcaacaagattgcgaggagaaggaaagagagctggggcgtctgaagcaacttttgagccgtgcttaccctttagattctctggaaaagcagatggagaaggcgcacgaagactcagaaaagctgagagagatcgtgctccctatggagaaggagatagaagaactgaaagcgaaactgctgagggcggaagagctgatccaggagatccagagaagacctaggcacgcccctagcctgcacggcagtacagagctacttcccctcagccgtgatccaagtccacccctggaacccctggaggagctttccggcgacggaggaccggctgccgaggccttcgcccacaactgcgacgattctgcgagtatatcttccttttcactgggcggaggagtgggcagttcctcaagcctcccccagtccaggcagggcctgagcccggagcaagaggagactgcctcgctcgtgtccacagggacacttgtcccagagggcatatatctgcctccacctggctatcagctggttcctgatacgcagtgggagcaactccagaccgaaggccgtcagctgcagaaagatctggagagcgtgtcccgtgaacgggacgaactccaagaggggcttcgcagatccaacgaagactgcgccaaacaaatgcaggttttgcttgcccaagttcagaactccgagcaactgctccgtacactgcaaggaacagtgtcacaagcccaagagcgcgtacaattgcaaatggcagagctggtgaccactcacaaatgtctgcatcacgaggttaagaggttgaacgaagagaatcagggccttcgagcggagcagctccccagttccgcacctcagggctcccagcaggagcagggtgaggaggagtccctccctagttctgtaccagagttgcaacagcttctgtgctgtacgagacaggaggctcgtgcgcgactgcaggctcaggaacacggagcagagcggcttcggatagaaattgtcacacttagagaggcattggaggaagagacagttgcacgggcatccttggagggccagctccgagtgcagagggaggaaacagaagtgctggaagcatccctgtgctctctgagaactgagatggagagggttcagcaagaacaatcaaaggctcagctccctgacctgctcagcgagcagcgcgctaaagtgctccgcttacaggcagaactggagacatcagagcaggtgcagcgcgattttgtacggttgagtcaggctctgcaggtgaggctggaacgcatccggcaggctgagacactggagcaggtgaggagcatcatggacgaagcccctctcacagacgtgcgggacataaaggacacatag

SEQ ID NO: 237768 - DNA, 1497 bp, Artificial Sequence
  Description of Artificial Sequence: Synthetic coding sequence
atggcagcagccgcacctgtagctgcggacgacgacgaacgccgaagaaggcccggagccgatagtatcagttcttacgaagcacagatcacagcactgaagcaggagcggcagcagcagcagcaggactgcgaggagaaagagcgggagttgggccgattgaaacagttgctgtcacgggcataccctctcgattctctcgagaaacagatggagaaagcacatgaagactctgagaaacttagagagatcgtgctgcccatggaaaaggagattgaagaactgaaggctaaacttttgagggccgaagagctaattcaagaaattcaacgtcgaccaagacacgctccaagtctgcatggatcaaccgagctgttaccactgtccagagatccatcaccacctctggagccgcttgaggagctgtcaggggacggtgggccagctgccgaggctttcgcacataactgcgatgattcagcatcaatcagttcattcagcttaggcggtggcgtgggctccagtagctcactgccccagtcaaggcagggtctgagccctgaacaagaggaaaccgcctcccttgtgtccaccggcacgctcgtaccagagggtatctatctgcccccacctggctaccagttggtgcctgacacacagtgggaacagttgcaaactgaggggaggcagcttcagaaggatcttgagtccgtttccagagagcgtgatgagctccaggaaggcctcagacgatctaatgaggattgcgcaaagcagatgcaggttctactggctcaggtccaaaactcagaacagctgctgcgcactctccagggtaccgtgtcacaggcacaggaacgcgtgcagcttcagatggccgaacttgtgacgactcataaatgcctccaccatgaagtgaagaggctgaacgaggagaaccagggacttagggccgagcaactccctagtagcgcaccccaaggatcacagcaagaacagggtgaggaagagtcgctgccttcgagtgtgcctgaactccagcagctgttatgctgtactcgccaggaagctcgagccaggctccaggctcaggagcacggcgcagagaggctgaggatagagattgtaaccttacgtgaggctctggaggaggagaccgtggctagggcttccctggaaggccagctcagagtgcagcgagaggagacagaggtcctcgaggcatccctttgctccctgcgaactgaaatggaaagggttcagcaggagcagtccaaggcccaactgcccgatttgctgtcggagcaacgcgctaaggtgctgcgtttgcaggcagaattggagacatcagaacaagtccagagagactttgtgaggctgagtcaggctctgcaggttcgtctggagagaattcggcaagcagaaacccttgaacaggttcggagcatcatggatgaagccccactgaccgacgtgagggacatcaaagacacttag

SEQ ID NO: 237769 - DNA, 2085 bp, Artificial Sequence
  Description of Artificial Sequence: Synthetic coding sequence
atgactgacactgtattttccaatagctctaatagatggatgtatccttctgacagaccactgcagtctaatgacaaagaacaacttcaggcgggatggtccgtccatcccggaggccagccagatcgccagaggaagcaggaagaactgacagatgaagaaaaagaaataataaaccgggtgattgccagggcagagaagatggaagaaatggagcaggaacggataggtcggctcgtcgacagattggagaacatgcgcaagaacgtggccggtgatggagtcaatcgttgcatcctgtgcggagagcagctagggatgctgggctcagcgtgtgtcgtctgcgaagattgcaaaaaaaacgtatgcactaagtgtggcgtggaaactaacaatcgtctgcacagtgtgtggctctgcaaaatctgcatcgaacaaagagaagtgtggaaaagatccggcgcttggttttttaaaggcttcccaaaacaggtcctccctcaaccgatgcccatcaagaagaccaaacctcagcagcccgtctccgagcccgctgcccctgagcaaccagcaccagagcctaaacaccctgcacgcgcaccagcgcgtggcgattctgaagatagaagaggaccagggcagaagacaggtcctgatccagctagcgcgcctggacgtgggaattatggccctccagttagacgcgcaagcgaagcccgaatgtcctcatcttcacgcgactctgagtcctgggaccatagcggcggagccggagactcctcacggtctcctgcgggactccggagagccaacagtgtgcaggcaagcagacctgctccgggtagtgtacagtcgccagctcctccacagcctggacagcccggaacccctggaggttctcggcctggcccaggtccagcaggacgcttcccagatcagaaacccgaggtggccccatccgatcctgggacaactgctccaccccgagaagaaagaaccgggggagtaggaggctatcctgctgttggggcacgagaagaccggatgagtcatcccagcggcccatattcacaggcgtctgccgcagctccccagcctgccgctgctcggcaacctccacctcctgaggaagaggaggaggaggctaacagctatgactctgacgaggcaactacattgggcgctttggagtttagtttattatacgatcaggacaattcctctcttcaatgcacgataattaaggccaagggcctgaaacccatggattcaaatggcctggccgacccttatgtgaagttgcatctgctgcctggggcttcaaagagcaacaagctgcggacaaagacacttagaaatacaagaaatcccatctggaatgagaccctcgtctaccacggcatcactgacgaagacatgcaaaggaaaaccctcaggatatccgtttgtgacgaggataagttcggtcacaacgagttcattggcgagacaagattctcactgaagaaactgaaacctaatcagcggaagaatttcaatatttgtctcgaaagggttatcccaatgaaaagagcgggtacaacaggtagtgccagagggatggccttgtatgaggaagaacaggtggagagggtgggagatattgaagaaagggggaaaatcttagtcagcttgatgtacagtacacagcaaggaggtttgatcgtcggcatcattcggtgcgtgcacctggctgcgatggacgccaacggatactctgatccattcgtaaagttgtggctgaaacctgacatgggcaagaaggccaagcacaaaacacagattaagaaaaaaacccttaatccagaatttaatgaagagttcttctacgatattaagcacagcgacttagccaaaaaatcactcgacattagcgtgtgggactacgacataggcaaatcgaatgactacatagggggatgtcagctgggtatctcagccaaaggcgagagactcaagcactggtatgagtgccttaaaaacaaagacaagaagatcgagagatggcatcagctgcagaatgaaaaccacgtcagctccgactag

SEQ ID NO: 237770 - DNA, 2085 bp, Artificial Sequence
  Description of Artificial Sequence: Synthetic coding sequence
atgacagacaccgtgttttcaaattcatccaatcgatggatgtacccgagcgacagaccactccagtcaaacgacaaggaacagctccaggctggatggagcgtccatccaggcggacaacctgaccggcagaggaaacaggaagagctcacagatgaggaaaaagaaattataaatcgcgtgatcgcacgggcagaaaagatggaggagatggaacaagagagaattggtaggctagtggataggctggaaaacatgcggaaaaacgtggcaggtgatggcgtcaatcgatgcatcctctgtggcgagcagttaggtatgctgggatcagcatgcgtagtgtgcgaagactgtaagaagaacgtctgtacgaagtgtggggtggaaacgaacaatcgactgcattcagtgtggctctgcaaaatctgcatcgaacaaagggaggtgtggaagaggtcaggagcttggttcttcaaagggttccccaagcaagtcctgccccagccgatgcctatcaagaagacgaagccccagcagccagttagcgagccagccgcacctgagcaacctgccccagaacccaagcaccctgcacgcgctcccgcacgcggagacagcgaggatagacggggtcctggccagaagaccggaccagatccagcatctgcgcctggcagaggcaactacggtcccccagtgcggagggcctccgaggccaggatgtcctcgtcttctcgcgactcagagagttgggaccacagcgggggagccggtgactctagtcggtcccccgctgggctccgccgtgcgaatagcgtgcaagcctctaggcccgcaccaggctctgtccagtctccagctccgcctcagccagggcaacccggtacccccggaggcagtcgacccggacctggcccagctggcaggtttccagatcagaagcctgaggtcgcaccttccgacccaggaacaactgctcctcccagggaagagcgcactggcggtgttggcggataccctgccgtgggggctagggaggatagaatgagccatccaagcggtccgtattctcaggcctctgccgctgcccctcagcccgcagctgcaagacagccacctccacccgaagaggaggaggaagaggcgaatagctacgacagtgacgaggctaccacactgggcgctctggagttttcactcctctacgaccaggataacagttccctgcagtgtaccattatcaaggccaaagggctgaagcctatggattcaaatggcttggccgacccatacgttaagctccatttactgcctggcgcatcaaagagtaacaaacttcgcaccaagactctacggaacacccggaaccccatctggaatgagacgctggtctaccacgggatcaccgatgaagatatgcagaggaagaccctgcgcattagtgtgtgcgacgaggacaagttcggacacaatgagttcatcggggagacccggtttagtctgaaaaaactcaaacccaatcagcgaaaaaatttcaacatttgcctagagagagtcattcctatgaagcgggcaggtaccaccgggtccgcccgaggcatggccctctacgaggaggagcaggtagaacgcgtcggagacatagaagagcgcggaaaaattctggtgtcgctcatgtattctacacaacagggcggattaattgtgggaattattcgatgtgtacacctggccgctatggacgccaacgggtatagcgatccgtttgtgaaactgtggctgaaacctgacatgggaaagaaagccaaacacaagacacaaatcaagaagaagaccctaaaccccgaattcaatgaagagtttttctacgatataaagcatagtgacctggccaaaaaaagtctagatatctctgtctgggattatgacatcgggaaatcaaatgattacataggtggctgtcagctcggcatttctgccaagggggaaaggctcaaacactggtacgaatgcctgaagaacaaggacaagaaaatagagcggtggcaccagctacaaaatgagaaccacgtttccagcgactag

SEQ ID NO: 237771 - DNA, 2085 bp, Artificial Sequence
  Description of Artificial Sequence: Synthetic coding sequence
atgaccgacacggtgttcagtaacagctctaatagatggatgtaccccagtgacaggccactccagtcaaatgacaaagaacagctgcaagcagggtggagcgtccaccccggtggccagcccgatagacagcggaagcaggaggaactgacggatgaagagaaagagattatcaatcgggtgattgcaagagctgagaagatggaagagatggaacaggaaaggatcgggcgactcgtggataggctcgaaaatatgcgcaagaacgttgccggagatggtgtgaacagatgcattctatgcggcgaacagcttggaatgcttgggtcagcttgcgtagtatgtgaggattgtaagaagaacgtctgtaccaagtgtggggtggaaacaaacaacagactccattcagtatggctctgcaagatctgcatagaacagcgggaagtctggaaacgctcaggagcttggttctttaaggggtttcctaaacaggtgctgcctcaaccaatgcctataaagaaaacaaagccacagcagcccgtgagtgagcctgcagcaccagagcagcccgcacccgagccaaagcatccagctcgcgcaccagctaggggtgactctgaggatcggcgagggccaggtcaaaagaccggtccagatccagctagtgcacctggtagagggaactatggaccaccggtgcgacgggcttccgaggccagaatgagctcaagttctcgtgactctgagtcgtgggaccattcagggggagcaggcgattccagccggtcccccgcaggtctgcgcagagctaactctgttcaagcttcgagacccgctccaggatccgtgcaatccccagcccctccccagcctggccagcctgggacccccggaggatctcgccctggacccggaccagctggccgatttcccgatcaaaaaccagaggtggcccctagtgacccaggcacaactgccccaccccgagaggaacgaacaggcggagttggaggctaccccgcagtgggcgcacgcgaggatagaatgtcgcatcctagtggcccatacagccaagcctcagctgccgctccacagcctgccgctgcaaggcagccaccccctcctgaggaggaggaggaggaggctaacagttacgacagcgacgaggcgacaactctcggcgcattggaattcagtctcctgtatgatcaagacaatagcagcctccaatgtacaattatcaaagcaaagggactgaagcctatggacagtaacggactggcggatccctatgtgaagctacacttactacctggtgctagcaagagtaacaaactgcgcacaaagacgctgcgcaacacccggaatccaatctggaacgaaacgcttgtctaccatggcatcacagatgaagatatgcagcgtaagaccttgcgcatctccgtctgtgatgaggataaattcggacataatgaattcataggtgaaactagattctccttaaagaagctgaagccaaaccagaggaaaaacttcaatatttgcctggagagggtgatacccatgaaacgtgcgggaaccaccgggtctgcacgtgggatggcgctgtatgaagaagagcaggtcgagagggttggagatatagaggagagaggtaaaattctagtgagtctcatgtactccactcaacaaggtggtctgattgtgggtattattaggtgcgtgcatttggcagcaatggacgccaatgggtactcagatccctttgttaagctctggctcaagcctgacatgggaaagaaggccaagcacaaaactcagattaaaaagaagacccttaatccagaatttaatgaagagttcttctatgatataaagcattctgatttagccaaaaagagcctggacatctccgtgtgggactacgatatcggcaagtccaatgactatatcggcggttgccaactgggtatctccgccaaaggagagcgcttgaaacattggtatgaatgcttgaaaaataaggataaaaaaatagaacgctggcaccaactgcagaatgagaatcacgtctcctccgactag

SEQ ID NO: 237772 - DNA, 1938 bp, Artificial Sequence
  Description of Artificial Sequence: Synthetic coding sequence
atgactgatactgtcttttccaattccagtaacagatggatgtatccgagcgaccgaccactgcagtccaaactgaaggaccgccgtctggtggatcggctcgagaacatgcggaagaacgtcgccggagacggcgtgaaccggtgcatactgtgcggcgagcagttgggcatgttaggctcagcatgtgtagtctgtgaagactgtaagaaaaacgtctgtactaagtgcggcgtagaaacaaataacagactccatagcgtttggctgtgcaaaatctgcatagagcagcgcgaagtgtggaaacggtccggcgcatggttttttaagggctttcctaaacaggtgctccctcagccgatgcccataaaaaaaaccaagccacagcaaccagtgtctgaaccagccgcaccggagcaaccagccccagagcccaagcacccggctagggcgccagctagaggagatagcgaggaccggagagggcctggtcagaagactggccctgaccccgctagtgccccaggcagagggaactatgggccaccggtgcgtcgggcatcggaagcccgtatgtcctccagttcgcgggatagcgaaagctgggatcattctgggggtgctggtgacagtagccggtctcccgctgggctgcgacgggctaatagcgtacaggccagtcgacccgcacccggatctgttcagtctcctgccccaccgcaacccggacagccgggaacacccggagggtctcgcccaggaccaggccctgctggtagatttccagatcagaaacccgaggttgcgccttccgaccctggcacgactgctcctcccagggaagagaggaccgggggtgtcggaggctacccagctgttggagccagagaagaccgcatgtctcacccgagtggcccttatagtcaggcgagtgcagcagcgccacagccagctgccgcaaggcagccccctcctccggaagaggaagaggaagaggccaacagctatgactcagacgaagctactacgctgggcgcactcgagtttagcctgctgtatgaccaggacaatagttcccttcagtgtactatcattaaagccaagggcctgaaaccaatggatagcaacggcctggcggatccctacgtgaagcttcatctgctgcccggagctagcaagagcaataaactaagaacgaaaacactgagaaatacccgaaatcctatctggaacgaaacattggtctatcacgggattactgacgaggacatgcaaagaaaaacacttcgtatctcggtatgcgacgaagacaagtttggacataacgagtttatcggggaaaccaggttctccttgaaaaagctcaagcccaaccagcgaaagaattttaacatttgccttgaaagggtaatcccaatgaaaagagcgggtacaaccggtagcgccaggggcatggcactttacgaagaggagcaagtcgagagagtgggcgacatagaagagaggggcaagattctggttagcctaatgtacagcacccagcaaggtggtctgatcgtgggtattataaggtgcgtgcacctggcagccatggacgccaatgggtacagtgaccctttcgtgaagctgtggttaaagcccgacatggggaagaaggctaaacacaaaacccagattaagaagaagactctaaaccctgaattcaacgaagagttcttttacgacattaaacactccgacctagccaagaaatccctagacatcagtgtgtgggattatgacatcggtaagagtaacgactatatcggcggatgtcaattaggaatcagtgccaaaggcgagagattgaagcactggtatgaatgtctcaaaaataaggacaaaaagatcgagcggtggcatcagctgcagaacgagaatcatgtgtcctctgactag

SEQ ID NO: 237773 - DNA, 2085 bp, Artificial Sequence
  Description of Artificial Sequence: Synthetic coding sequence
atgaccgatactgtgttctccaatagcagcaatcgctggatgtaccctagcgatcgaccactgcagagcaacgataaggaacagttgcaagcaggttggtctgtgcatcccggaggccagcctgaccgccaaaggaaacaggaagaactgacggacgaggagaaggaaatcataaaccgagtgatcgctagggctgaaaagatggaagagatggaacaggagcgcataggcaggttagtggaccggctggagaacatgcgcaaaaacgttgcaggcgatggagtgaaccggtgtatcttatgtggagaacaacttggtatgctggggtccgcctgcgtagtctgtgaggactgtaaaaaaaatgtgtgtacgaagtgcggggtagagactaataacaggcttcattctgtgtggctgtgtaagatctgtatagaacagagggaggtttggaagcgcagcggcgcttggttttttaagggttttcctaagcaggtgttgccccagccaatgcctattaaaaagaccaaacctcagcaaccagtgtcagagccagccgcacctgaacagcctgcgccagagccaaagcatcccgctagggccccagctaggggagactccgaagatcgacgtggacctggccagaaaacagggcctgacccggcatcagcccctggtcgcggaaactatggaccacccgttagacgggcatcagaggcacgaatgagtagtagcagccgggacagtgagtcatgggatcactctgggggagccggtgacagctccagatccccggcaggcctccggcgtgctaactctgtccaggcttctcgcccagcgcctgggagtgttcagagtcctgccccaccccagccaggccagccaggaactcccggaggctcccgccctggtccagggcctgctggccgtttccctgatcagaaaccagaagtcgctcctagtgaccccggaacgaccgccccacctcgggaagaaaggacgggcggtgtcggcggttatccagctgtaggagcacgggaggatcgcatgtctcatcctagcggcccatattctcaagccagtgctgcagccccacaacctgccgctgctagacaacctcctccgcctgaggaggaagaagaagaagctaatagctacgattcagacgaggctacaactttaggagcgttagagttttctctgctgtacgaccaggacaactcaagcctgcagtgtaccattataaaggccaaaggcctgaagccaatggattccaatggattagccgatccatatgtcaagctgcatttacttccaggggcttccaagagtaacaagctgcggacaaagactcttcgcaacactcggaaccctatctggaatgagactctcgtgtatcacggcattacagacgaagacatgcagaggaagactttacgcatttcagtatgtgacgaggacaaatttggccacaacgaattcattggagaaaccaggttttctctgaagaagctcaagcctaaccaacgcaaaaattttaacatctgccttgagagggtgatccccatgaagagggcaggcacaaccgggtcagccagaggaatggcactgtatgaagaagaacaggttgaaagagtgggcgacattgaggagagggggaagattcttgtgagcctcatgtactccacgcagcagggcggattaatcgtggggatcatcagatgtgtacacctggctgctatggatgctaatggatactctgaccctttcgttaagttgtggctgaagcccgatatgggcaaaaaagcgaagcacaaaacccagatcaaaaagaaaactcttaacccagagttcaacgaggagtttttttacgatatcaagcacagtgatttggccaagaaaagcttggatatctccgtatgggattatgatattggcaagtcgaacgattatatagggggttgtcagctgggcatctccgcaaagggcgagagactcaaacattggtacgagtgcctgaagaacaaagataagaagatcgagagatggcatcaactgcagaatgagaatcatgtatcttctgactag

SEQ ID NO: 237774 - DNA, 39 bp, Artificial Sequence
  Description of Artificial Sequence: Synthetic coding sequence
atgacggacacagtatttagcaacagcagtaacagatag

SEQ ID NO: 237775 - DNA, 252 bp, Artificial Sequence
  Description of Artificial Sequence: Synthetic coding sequence
atgactgatactgtattcagcaacagctccaaccgatggatgtacccaagcgataggcctctccagagcaatgacaaggaacaactgcaagcagggtggtccgtccatcctggaggtcaacctgacaggcagcgcaagcaggaggagttaaccgatgaggagaaagaaattatcaatcgcgtgatcgccagagccgaaaagatggaagagatggagcaagagcggatcggcaggctggtggaccggctgtag

SEQ ID NO: 237776 - DNA, 285 bp, Artificial Sequence
  Description of Artificial Sequence: Synthetic coding sequence
atgaccgataccgttttcagcaacagctcgaatcggtggatgtacccatccgataggccactgcagagtaacgacaaggaacagctccaagctggctggtctgttcaccctggcggacagccagaccggcagaggaaacaagaagaactgacagacgaggaaaaagaaataatcaaccgcgttatagctcgcgctgagaagatggaagagatggagcaggagagaataggcaggctggttgatcgattagagaatatgaggaaaaatgtcgctggagatgggtag

SEQ ID NO: 237777 - DNA, 492 bp, Artificial Sequence
  Description of Artificial Sequence: Synthetic coding sequence
atgacagatactgtgtttagcaacagcagcaataggtggatgtacccctctgacaggccacttcaaagcaatgacaaagagcagctacaggcagggtggagcgtccatcccggaggacagccagacaggcaaagaaaacaagaggagctgaccgacgaagagaaggaaattatcaatcgggttatcgctagggcagaaaagatggaggaaatggagcaggaaaggattggtcgcctggtcgacaggctagaaaatatgcgcaaaaacgttgccggtgatggcgttaatcgttgcatcctgtgcggcgaacagctcggcatgctgggatcagcctgtgtggtttgcgaggattgcaaaaaaaatgtgtgcacaaagtgtggagtcgagacaaataacaggctccacagcgtttggctctgtaaaatatgcatcgagcaaagagaggtctggaaaagatctggggcatggttctttaagggctttccaaaatag

SEQ ID NO: 237778 - DNA, 384 bp, Artificial Sequence
  Description of Artificial Sequence: Synthetic coding sequence
atgaccgacacagtcttttcaaactcttccaatagatggatgtatccatccgacaggcccctccagtcaaacgataaggaacagcttcaagccggatggagtgtgcacccaggtgggcagcctgataggcagcgcaagcaggaggagctgaccgatgaagaaaaagagattattaacagagtgatcgccagagcggagaagatggaggagatggagcaggaaagaatcggcagactggtggatcgactggaaaatatgagaaaaaacgtcgccggagatggggttaatagatgtattctgtgcggtgaacagctcggcatgttgggatctgcttgtgtcgtctgtgaggactgtaaaaaaaacgtgtgtaccaagtgcggctag

SEQ ID NO: 237779 - DNA, 315 bp, Artificial Sequence
  Description of Artificial Sequence: Synthetic coding sequence
atgactgacactgtcttttcgaacagttctaaccggtggatgtatccctctgacaggcccctccaatccaacgataaggagcaactccaggccggatggtcagtgcatcccggaggccaacccgatcgacagaggaagcaggaggaactcacagacgaggaaaaagagattatcaaccgtgttatcgctcgagccgagaagatggaggagatggaacaagaaagaatcggacggctggtcgacaggcttgagaatatgcgcaaaaatgtagctggcgatggtgtaaataggtgcatactgtgtggggagcaatag

SEQ ID NO: 237780 - DNA, 120 bp, Artificial Sequence
  Description of Artificial Sequence: Synthetic coding sequence
atgacagacaccgttttttccaatagctcaaacaggtggatgtatccttccgacaggcctctgcagagcaacgacaaggagcaactgcaggcaggctggtccgttcaccctgggggttag

SEQ ID NO: 237781 - DNA, 348 bp, Artificial Sequence
  Description of Artificial Sequence: Synthetic coding sequence
atgacagataccgtgtttagtaatagttctaatcggtggatgtacccctccgacaggccattacagtccaacgataaagagcagttgcaggcgggatggtccgtgcatcctgggggtcagcctgacagacagagaaaacaggaagagctcacagatgaagaaaaagaaatcataaaccgcgtgatagcgagggcagaaaaaatggaggagatggagcaagaacgtatcggacgactggttgaccgcctggagaacatgagaaagaacgtggccggtgatggcgtgaatcgttgtatattgtgtggagagcagctcggtatgcttggctctgcttgtgttgtttgctag

SEQ ID NO: 237782 - DNA, 2073 bp, Artificial Sequence
  Description of Artificial Sequence: Synthetic coding sequence
atgaccgatactgtcttttcgaatagcagtaacaggtggatgtatcccagcgatcggcctctgcaatctaagcttcaagcaggatggagtgtgcatccgggtggccagccagaccggcaacggaagcaggaagagcttactgatgaagagaaggaaatcataaacagggtgatagcccgtgccgaaaagatggaagagatggagcaggagaggataggcagactcgttgatcggcttgagaacatgcggaagaacgtagcaggagatggagtcaacaggtgcatactgtgcggcgagcaactagggatgctggggagcgcgtgtgtggtgtgcgaggactgtaaaaagaacgtgtgcacaaagtgcggcgtggagacaaacaaccgcttgcatagcgtgtggctgtgtaagatctgtattgaacaacgcgaggtgtggaagcgttctggagcttggttcttcaaagggtttccaaaacaggtgctgccacaaccaatgcctatcaagaaaacaaagcctcaacagccggtctccgagcccgcagcaccagagcagcctgctccagaacccaagcaccccgctagagccccagcacggggagacagcgaggatcgcagaggacccggtcagaagaccggacccgaccctgcatctgctccgggtcgtggcaactatgggcctcccgtgcgtagagcttccgaggccaggatgtcctcttcttcacgggatagtgaaagctgggatcattctggaggtgccggtgactccagccgcagcccagccggtttgcgacgcgcaaacagcgtacaggccagtaggccagcacctggatcggtccagagtcctgccccaccccagccaggacagccaggcactccaggcggatctcgacccggaccaggtcccgcagggagattccccgatcagaaacccgaagtggctcctagtgatcccggtaccacagcccctcctcgcgaggagagaactggcggagtaggcggatacccagctgtgggtgccagagaggatcgaatgtctcacccatccggcccatattctcaagcatcagcggcagcaccacagcctgcagccgctagacagccgccaccccctgaggaggaggaagaggaagcaaattcttatgactcagacgaagcaactaccttgggagcactggagttcagcctcttgtacgaccaggacaattcttctcttcaatgtacaattataaaagctaaggggttaaaacccatggattccaatggactggctgacccttacgtgaaactccacctgctcccaggcgcttcaaagagcaacaagcttcgcacgaaaacccttagaaacacccggaaccccatctggaatgagactctcgtctaccatggaattaccgatgaggatatgcagcgcaagaccctacggatctcggtttgtgacgaagacaaattcggacacaatgaattcatcggagagaccagatttagtttaaagaagcttaagcctaaccagcgaaagaactttaacatctgtctagaaagagtgatccccatgaaacgcgcagggaccaccggatctgctcgaggaatggctctgtacgaagaggagcaggtagagcgggttggagacatcgaggagcgtggtaagatcctggtatccttgatgtactccacgcagcagggtggcctgattgtcggaatcattcgatgcgtgcacctcgctgccatggacgcaaatggctattcagaccccttcgtgaaactttggttgaagcctgatatgggtaaaaaagctaaacacaagacacaaattaagaagaaaacactcaatccagagttcaacgaagagttcttctacgatatcaagcactctgatctcgcaaagaaatctcttgacatctccgtttgggactacgacattggaaaatccaacgactacataggcggttgtcagcttggaataagtgcgaaaggggagcgcctgaagcactggtacgaatgccttaagaacaaagataagaagattgagcgttggcatcagctccaaaacgaaaatcatgtttcttccgattag

SEQ ID NO: 237783 - DNA, 378 bp, Artificial Sequence
  Description of Artificial Sequence: Synthetic coding sequence
atgacggataccgtgttctcaaactcttcaaatagatggatgtatccctccgataggcccctgcagtccaacgataaagagcagcttcaggcgggttggtcagtccaccccggtgggcagccggacagacaacgcaaacaggaagaactcactgatgaggaaaaggaaataatcaaccgtgttatcgccagagctgagaaaatggaagagatggagcaggaaagaatcgggaggctggtagatcgactggaaaatatgcgcaaaaacgttgccggtgacggcgttaaccgatgtatactttgcggggagcagttgggaatgctgggctcagcttgtgttgtatgtgaagactgcaaaaaaaacgtctgcaccaaatag

SEQ ID NO: 237784 - DNA, 546 bp, Artificial Sequence
  Description of Artificial Sequence: Synthetic coding sequence
atgaccgatacggtgttcagtaattcttcaaacagatggatgtacccctccgaccgcccactgcaaagcaatgataaggaacaactgcaggctggatggtctgtgcacccgggagggcaaccagaccgccaaaggaaacaagaggaactgactgatgaggagaaggaaatcatcaacagggtaatagcgcgagctgaaaagatggaggagatggaacaagaacgcattggccgtctggtggacagactcgaaaatatgaggaagaacgtggccggtgatggagtgaaccgatgcattctgtgtggggaacagctgggaatgttaggttccgcttgcgtggtgtgcgaagactgcaaaaaaaatgtctgcaccaagtgcggggttgagactaataatcgactacactccgtctggctctgcaagatttgtatagagcagcgggaggtgtggaaaagatccggcgcttggtttttcaaaggctttcctaaacaggtgctcccccagcctatgcctatcaaaaaaaccaagccgcagcagcccgtgtag

SEQ ID NO: 237785 - DNA, 285 bp, Artificial Sequence
  Description of Artificial Sequence: Synthetic coding sequence
atgaccgacactgtgttcagcaactcaagtaacaggtggatgtaccccagcgatcgacctctgcaatcaaatgataaagagcagttgcaagccggttggagcgtccaccctggtggccaacccgaccgtcagcgtaaacaggaggagctgactgacgaagaaaaagagattatcaatcgtgttatcgctagagctgaaaagatggaagaaatggagcaggagcggattggcagactggttgacaggttggagaatatgcggaagaatgtggcaggtgatggctag

SEQ ID NO: 237786 - DNA, 363 bp, Artificial Sequence
  Description of Artificial Sequence: Synthetic coding sequence
atgacagacacggtgttttccaattcatctaacaggtggatgtacccgagtgacaggccactccaaagtaacgacaaggagcagctgcaagcgggatggtccgtgcatccaggcggacaacctgatagacaaagaaagcaggaggaactgaccgacgaggaaaaagaaatcatcaaccgggtcatcgctcgcgctgagaaaatggaagagatggaacaagaacgtattgggagactcgtagatcgcctggagaatatgcgtaaaaatgttgcaggggacggcgttaacaggtgcatcctgtgtggagagcagctcggcatgctgggatctgcttgtgtcgtgtgtgaggactgcaagaagtag

SEQ ID NO: 237787 - DNA, 405 bp, Artificial Sequence
  Description of Artificial Sequence: Synthetic coding sequence
atgactgacacagtgttcagcaattcaagcaataggtggatgtacccctctgatagaccattgcagtctaacgataaggagcagttgcaggcgggttggtctgtgcaccccggtggtcagcctgataggcagcgcaagcaggaagagctgacggatgaggagaaagaaataatcaatcgggtgattgccagagctgagaaaatggaagagatggagcaggagcggattggcaggctggttgaccggctcgaaaatatgaggaagaacgtggcaggggacggagttaacagatgtatactgtgcggggagcagctcggcatgctcggtagcgcctgtgtggtgtgcgaagattgtaaaaagaacgtttgtaccaagtgcggagtggagactaataatcgcttgtag

SEQ ID NO: 237788 - DNA, 948 bp, Artificial Sequence
  Description of Artificial Sequence: Synthetic coding sequence
atggcagatacaatctttggctccggcaatgaccagtgggtgtgccccaacgatcggcagctggccctaagggccaagctgcagactgggtggagcgtacatacctaccaaacagagaagcagagacgcaagcaacacttatcccccgcagaagttgaagctattctgcaggtgatccagagagccgagcgattagacgtgctcgagcaacaacgtataggacgcctagtggagagactcgaaaccatgcgtagaaatgtgatggggaatggactctcgcagtgtctgctctgcggagaggtgctggggtttctcggctccagctctgtcttttgtaaggattgcaggaaaaaagtgtgtacgaaatgtggcatcgaagcatctcccggacaaaagcgccctctgtggctctgcaagatatgcagcgagcagcgggaggtgtggaagcgttcaggagcatggttctacaaggggctcccaaaatacatcctccctctcaaaacccccggtcgcgctgacgatccacacttcaggcctctgcctacggagccagctgagcgtgaaccacggtcaagcgagacatcccgaatttatacctgggccaggggaagggtcgtgagcagtgactccgattccgatagtgacctgagtagcagctcgctggaagatcgcctcccctccacaggcgtgagggataggaagggggataaaccatggaaggagtcaggcggatctgtggaagcacctcgtatgggtttcacacatccacctgggcacttgagcggctgccaaagctcactggccagcggtgagactggcactggatccgcagatccgccagggggacctcgtccaggcctgaccagacgtgcccctgtgaaggacactcccggaagagcaccagcggctgatgcggctcctgccggacccagctcctgcctgggttag

SEQ ID NO: 237789 - DNA, 861 bp, Artificial Sequence
  Description of Artificial Sequence: Synthetic coding sequence
atggctgacacaatttttggctcaggtaatgaccagtgggtttgccccaacgaccgacaattggctcttcgagctaagttgcagaccggatggagcgtccatacctaccagaccgagaagcaaagacgcaaacagcacctttcaccagctgaagtggaggcaatcctgcaagtaattcaaagagctgagagacttgatgttttggagcagcagcgcattgggaggctggttgagagactcgagactatgcgcagaaatgtgatgggaaatggactttctcagtgtctcctttgtggtgaggttctgggatttttgggaagctctagtgtgttttgtaaagactgccggaaggtatggaagagaagtggcgcttggttctacaaagggctgccgaagtacatcctgcccttgaagactcccggaagagcggatgatcctcacttccggccactgcccacagagcccgctgaaagagaacctcgaagctccgagactagtagaatctacacatgggccaggggaagagtcgtgtcttcggactctgattcagactctgacttatcttctagttccctggaggaccgattgccctccacgggcgtgcgagatcggaagggcgataagccatggaaagaatccggagggagcgtcgaagccccacgaatggggttcacccaccctcccggacacctctccgggtgtcagtcttcactagcaagcggcgagactgggacaggcagcgcagaccctcccggtggaccaagacctggactgaccaggcgagcacccgtcaaggacaccccgggtagagccccagccgcagatgccgcacctgcaggaccatcatcatgtctgggttag

SEQ ID NO: 237790 - DNA, 861 bp, Artificial Sequence
  Description of Artificial Sequence: Synthetic coding sequence
atggctgacactatttttgggtctggcaacgatcagtgggtttgtcctaacgacagacagttagcattgagggccaagctgcaaacagggtggtcagtccacacttaccaaacagaaaagcagagaaggaaacagcacctgagcccggcagaggtggaggctattttacaggtcatccagagagctgagcggctcgacgtgctagagcagcagcgcatcgggaggttggtcgagaggctggagactatgcgcagaaacgtcatgggaaacggacttagccaatgcctgctgtgcggcgaagtgttgggtttccttggctcttccagcgttttttgtaaggattgccgtaaagtctggaagcgaagcggcgcttggttctataaaggactgccgaagtacatcctgcccctcaaaaccccaggacgagcagacgacccacattttcgcccattaccaactgagcctgcggagagggagcctcggtcaagcgaaacatcgaggatatacacatgggccaggggtagggtcgtgtcttccgactcagatagtgactcagatctgagctcctcgtccttagaggatagactgccgtccaccggcgtgcgtgacaggaaaggggataaaccatggaaggaaagtgggggttccgtagaggccccacgaatgggatttacccacccccctgggcacctcagcggatgccagtccagcttagcaagtggtgagacaggcactggctcagcagatccccctggagggcctcggcctggcctcacccgaagggctcctgtcaaggatactccaggcagggcgccagccgctgacgcagcaccagccggtcccagcagctgcctgggatag

SEQ ID NO: 237791 - DNA, 2331 bp, Artificial Sequence
  Description of Artificial Sequence: Synthetic coding sequence
atgaaccctgaggagcagattgtgacgtggctcatatccctgggtgttctcgagtcgcccaaaaagaccatctgtgaccccgaagaatttctgaagagctctctgaagaacggagtcgtcctgtgtaagctaattaatcggcttatgcctggaagcgtagagaaattctgcctggacccccaaacagaagccgactgcatcaataatatcaacgactttttgaagggctgtgcaaccttgcaggtcgagattttcgacccagatgatctttactcaggcgtgaatttcagtaaagtcctgtccactcttctggctgtcaacaaggccacagaagaccagctgagcgaacgcccttgcggaaggagttcatctttgagcgccgctaacacttcacagactaatcctcagggtgctgtatcatcaaccgtgagtggcctgcagcgtcaaagtaagaccgtggagatgactgaaaatggaagccaccagctgatcgtgaaggctcgcttcaacttcaaacaaaccaatgaagatgagctaagcgtctgcaagggcgacataatttacgtgacacgcgttgaggagggcggatggtgggagggcaccttgaacgggaggactggctggtttcctagtaactacgtgcgggagattaaatcgtctgaacgacccctctcccctaaagcagtcaaaggcttcgaaaccgccccactcactaaaaactactacaccgtggtgctgcagaacatcctagacaccgaaaaggagtacgcaaaagagctgcagtcgcttttggtaacatacctgcggcctctccagagtaacaataatctgtctactgtggaggtgactagtctgctgggaaatttcgaggaggtgtgcactttccagcagactctgtgccaggccttggaggagtgttccaaatttccagaaaatcaacataaggtggggggatgtctgctgagtctgatgccacacttcaagagcatgtacctggcttattgtgctaaccacccctccgctgtaaatgttctcacccaacatagcgacgaactggagcagtttatggaaaaccagggagcctcctcacccggaatacttattctcaccacgaatctgtctaagccattcatgagattagaaaagtacgttaccctgcttcaggagctggagaggcacatggaagatacccatcctgaccatcaggacattctcaaggctattgtggcttttaaaacactgatgggccagtgtcaggacctgaggaaaaggaaacaattggagcttcagatcttaagtgagcctatacaggcctgggagggcgaggatatcaagaatcttggcaatgtcatttttatgtcccaagtcatggttcagtatggagcttgcgaggaaaaggaggaaaggtacctgatgctcttctccaatgtccttattatgctatccgcgtctcctcggatgtctgggttcatataccaggggaagatccctattgcagggacagtggttacccgcttggacgagattgaggggaacgactgtacgttcgagattaccggaaatacagttgaaaggatagtggtgcactgcaataacaaccaggattttcaagagtggctggagcagctgaatcgccttatccggggacccgcatcttgctccagtcttagtaagaccagcagctcttcctgttccgcacatagtagttttagctctacgggacagccccgtggcccactggaaccgccacagatcataaagccatggtctctgtcatgcctaagacctgctccccctctgcgtccgtcggctgccctcgggtataaggaacgcatgtcatacatactgaaagagagcagtaagtcccctaaaaccatgaagaaattcctgcacaagcgtaagaccgagagaaagccctccgaggaggaatacgtcattcgtaagtccaccgctgctctcgaggaagacgcacagatcctgaaggtgattgaagcttattgtacgtccgcaaactttcagcagggacatggatcaagtactaggaaagattctattccacaggtgcttctccccgaggaagaaaagctgatcatcgaagagacccgctccaatggtcagaccatcatggaagaaaagagccttgtggacacagtctacgcactcaaggacgaggtccgagagcttaaacaggagaacaaaaggatgaaacagtgcctggaagaagagctcaagtccagaagagacctggaaaaactcgtgagacgacttcttaagcaaactgatgaatgcatccgaggggagtcatcctccaagacaagcatcctcccatag

SEQ ID NO: 237792 - DNA, 1869 bp, Artificial Sequence
  Description of Artificial Sequence: Synthetic coding sequence
atgacagaaaatgggagtcatcaactcatagtgaaggccaggtttaacttcaagcagacaaatgaggatgaattgtctgtctgcaaaggagacattatatacgtcacccgagttgaggaaggagggtggtgggagggtaccctaaacggcaggaccggctggttccccagtaattatgtgcgggaaataaaatcttccgagcgtccactttccccaaaggccgtaaaaggcttcgaaacagcgcctttgaccaagaactactacacagtggtcctgcaaaatattctggacaccgagaaagagtacgctaaagaactgcaatcgctactggtgacatatttacgacctctgcaaagtaataacaatttgtccaccgttgaggtgacatccctactgggcaactttgaggaagtttgcaccttccaacaaactctgtgtcaggcgctggaagagtgctccaaattccctgagaatcagcacaaagtgggaggctgtctgttatcattgatgccacacttcaaatccatgtacctggcctactgtgctaaccaccccagcgctgttaacgtgctcacacaacactctgatgagctggaacagtttatggaaaatcagggggcaagtagtccaggaattctcatcctcaccactaatttgagcaagccttttatgaggctcgagaaatatgtgactctgctgcaggagctcgaaaggcatatggaagacacgcatccagaccaccaagatatccttaaggccatagtcgcttttaagactctcatgggacagtgccaggatctcagaaaaagaaaacagctcgaactgcagatcctgtcagagccgatccaggcttgggagggcgaggacattaaaaaccttggaaacgtgatttttatgagccaggttatggtgcagtacggcgcttgcgaggaaaaggaggaacggtacctcatgctgttctctaatgtactgatcatgctctctgcgtcaccaaggatgagtggattcatttatcagggtaagattccaatagcgggaaccgtggtaacacgtctggacgagatcgaaggcaatgattgtaccttcgagataactggaaatactgtggaaagaatcgtggtacattgtaataacaatcaggactttcaagaatggttagaacagcttaaccgattgattcgtggacccgcatcatgctcgagcctgtcaaagacatcttcttcctcctgttctgcacattcttctttttcgtcaacaggccaacctcgcggacccctcgagccaccccaaatcatcaaaccttggtccttgtcttgtttacggccagcgccacccctgcgaccctccgcggctctgggatataaggagcgcatgtcctatattctcaaggagagttcaaaatcccctaagactatgaaaaagtttctgcacaagcggaaaacagagcggaaaccgtccgaggaggagtacgtaattcggaaatccaccgccgcactggaagaagacgctcagatccttaaagtcattgaagcatactgcacctcagccaacttccaacaggggcatggctcttccacccgcaaagacagcattccccaggtgcttctgcctgaagaggagaagctgattatcgaggagacgagatccaatggacagacgatcatggaggagaagtccctggtagatacggtatacgctttaaaggatgaggtccgagaactaaagcaagaaaataagaggatgaagcaatgcctggaagaggaactcaaaagcaggagggaccttgaaaagctggtgcgcaggctgctaaagcagacagatgaatgtattagaggtgaatcatcttctaagacgagcattctgccctag

SEQ ID NO: 237793 - DNA, 1869 bp, Artificial Sequence
  Description of Artificial Sequence: Synthetic coding sequence
atgacggaaaatggctcccatcagctgatagtcaaagctagattcaactttaaacagaccaacgaggatgaactgtcagtttgcaagggtgacataatttacgtgaccagggttgaggagggtggctggtgggaggggaccctgaacgggaggaccggctggtttccatccaattatgtgagagagatcaagagcagcgaacgcccattatcgccaaaagccgtaaaagggttcgaaactgccccacttacgaagaactattacactgtggtattacaaaatatattggatacagaaaaagaatatgcaaaagagctgcagagcttgctggtgacatacctgcggcctctgcagtctaataacaatctgagcaccgtcgaagtgacatctctgctgggtaactttgaagaagtatgcacctttcagcagacattgtgtcaagctctcgaagagtgtagcaaatttccagagaatcagcacaaggtgggcggttgtctgctgtcattgatgccgcacttcaaaagcatgtatctggcttattgtgctaatcatccctcagccgtgaatgtgctgactcagcatagcgacgaattggaacagtttatggagaaccaaggggctagctctcctgggatattaatcctgaccactaacttatcgaaacctttcatgaggcttgagaaatacgtcacccttctacaggagctggagcggcatatggaagacacacatcccgatcatcaggacattttgaaggctattgtggcctttaagacactcatggggcagtgtcaagacctgaggaagcggaaacagctagagctccaaatcctgtccgaacctatccaggcatgggagggtgaggacataaagaacctgggcaacgtcatctttatgagtcaagtcatggtgcaatatggcgcttgcgaggagaaggaggaaagatatcttatgctgtttagcaacgtgctgataatgctgagtgcctcacctcggatgtcaggttttatttatcagggtaagatccccatcgctggaactgttgtgacacgtctggatgagatcgagggcaatgattgcacattcgaaattaccggtaacacagtcgaacggatcgttgtacattgtaacaacaatcaggacttccaggagtggctggaacagctcaacaggttaatccgcggtccggcttcctgctctagcttaagtaaaacctccagctcttcctgtagcgcccattccagtttttcaagcacagggcagccacggggacccttagagccacctcagatcattaagccatggagcctctcttgtctgcgcccagctcctcccttgcgtcctagtgccgctctcggatataaggaaagaatgtcgtatatacttaaggagtcgagcaagtctcccaagacgatgaaaaagttcctgcacaaacggaaaactgagcgcaagccttctgaagaggagtatgtgataaggaaatctaccgccgctctggaggaggacgcacagattctgaaggtcattgaggcatactgtacatctgctaatttccagcaaggacatggcagctctactcggaaggactctataccccaggtgctgctccctgaggaggaaaaattaatcatcgaggagacacgctcgaatggtcagaccattatggaggaaaagtccctggtggatactgtttatgccttaaaggacgaggtgcgggagctgaagcaagaaaataaacggatgaagcagtgcctagaagaagagttgaagtcgagacgggatctggaaaaattagtgcgacgactgttgaaacaaactgatgagtgtatacgcggagaaagttcaagcaaaacgtcaattcttccttag

SEQ ID NO: 237794 - DNA, 1950 bp, Artificial Sequence
  Description of Artificial Sequence: Synthetic coding sequence
atgactgagaacggatctcaccagttgatcgtgaaggcgaggttcaattttaaacagacgaacgaagatgagcttagtgtttgtaagggagacattatctatgtcacacgagtggaggaaggcggttggtgggaaggcacccttaacgggcgtacgggatggtttcctagtaattatgtgagggaaatcaagtcctcagatggcgtgtctctgctcctgcctggtttagagtgtaatggcgctatcagtgctcaccacaatctctgcctacctggctcaaagcgcccactctcacctaaggcagtgaagggctttgagacagcacccttaactaaaaactactacaccgtagtccttcagaacatcttggatacggagaaggaatatgccaaagagctgcagagtctgctggtcacttatttaagacccctgcagtctaacaataatttgagtactgtggaagtgacaagcctgttgggaaattttgaagaagtctgcaccttccagcaaaccctttgccaggcattggaggaatgttcaaaattcccagagaaccagcataaggttggcggttgtcttctatccctgatgccccactttaaaagcatgtacctggcctattgtgcaaatcaccccagtgctgtgaacgtgctaacgcagcactctgatgaactggagcagttcatggaaaatcagggagcatccagtccaggaatcttaatattaaccacaaacctcagtaagccatttatgcgcctagaaaagtatgtgactttgttacaggagctcgagagacacatggaagacacacacccagatcatcaggacatcttgaaagcaatcgtcgcgttcaagactcttatggggcagtgccaggatctgagaaagagaaaacagctggagctgcagatcctgtccgagcctatccaagcctgggaaggagaggatatcaaaaacttaggtaacgtcatcttcatgagtcaggtcatggtgcagtacggggcttgtgaggagaaggaggaacgctacctgatgctcttctctaatgtcctcattatgttatcagctagtccacgtatgtctggtttcatctatcaaggaaaaatacccatagcaggcaccgtggttacgagattggatgagatagaaggcaatgactgtaccttcgagattacaggcaacacagtcgaacgcatcgttgtccattgcaataacaaccaggatttccaggaatggttggaacaattaaaccggttgatcaggggtcccgcaagttgctcatctctgagcaagacctcttcatcttcatgtagtgctcactcttccttctcttcaactggccagccccgtgggcctttagagcctccccagatcatcaagccatggtccctctcttgcctgagacctgcccctccacttcgtccatcagctgcgctcggctataaggaacggatgagctacatcctcaaagagagcagcaagtctcccaagaccatgaagaaattcctgcacaaacgaaaaactgaacgaaaaccttctgaagaggagtacgtaattcgcaagagcaccgctgctctcgaggaggatgcccagattcttaaggtgatagaggcctactgtacatccgctaatttccagcagggccatgggtcatcgaccagaaaagactccataccccaggtgttactccccgaggaagaaaaactcattattgaggaaacccgatctaacggccaaaccatcatggaggagaagtcgctggtggatacagtgtacgctctgaaggacgaagttagagagcttaagcaggagaataaaaggatgaaacagtgcttggaggaagagttgaagagccgtcgggatctggagaagctagtaaggcgactgctcaaacaaaccgacgaatgtatccgaggcgaaagctcatctaaaacctctatcttaccttag

SEQ ID NO: 237795 - DNA, 1869 bp, Artificial Sequence
  Description of Artificial Sequence: Synthetic coding sequence
atgacggagaatggctctcaccagctaatcgtcaaggcgcgttttaattttaagcaaacaaatgaggatgaactgagtgtgtgcaaaggtgacatcatttacgtgacaagagtggaagaaggtggatggtgggagggcacactgaacgggagaactggctggttcccatccaattatgtgcgcgaaatcaaaagctccgagcgcccactttctcctaaggcagtcaaggggtttgaaactgcgccactcacaaagaattactacaccgttgtactccagaacattctggacactgagaaggagtatgcaaaggagctgcagagtcttctagtcacatatctgcggccactgcagtcaaataataacctcagtaccgttgaggtgacttccctcttaggcaactttgaggaggtctgcacgtttcagcagacactgtgccaggcgctcgaggagtgcagcaaattcccagaaaatcagcacaaagtgggaggatgtctgctgagccttatgccacattttaaatccatgtaccttgcctactgtgccaatcaccctagtgctgttaacgttttgacacaacacagcgacgaactagagcagttcatggaaaaccagggggcatcatctcccggaattctcatcctgacgaccaatctatcaaagccattcatgcggctcgaaaagtacgtgactctgcttcaggagctggaaagacacatggaggatacacaccctgaccaccaagacattctgaaggccatagtagccttcaaaacattgatgggacaatgccaggatctcagaaaacggaagcagctagagctgcagattcttagtgagcccatacaagcctgggagggagaagacatcaaaaaccttggtaatgttattttcatgagccaggtcatggtgcagtacggagcttgtgaggaaaaggaggaacggtaccttatgcttttcagcaacgtgctcatcatgctttccgcttcacctaggatgagcggttttatttatcaggggaaaatacccatagctgggacagtcgtgacacggctggacgaaattgagggcaacgattgtacgttcgagattaccgggaacaccgtggagaggattgtcgttcactgcaacaacaaccaagattttcaggagtggcttgagcaactcaacaggctcattagaggcccagcatcctgctctagccttagtaaaacaagcagctcctcctgctcggcccactcctccttttcctctacaggacagccaaggggacccctggaaccacctcagattataaagccctggagtctatcgtgtctgcggccagcgcctccactgagaccatctgccgcacttggctataaagaggcatttacgtttgtgtttgaggagtctagcaagagtcccaaaaccatgaagaagttcctacacaagaggaaaaccgaacgtaagcccagcgaagaggagtatgtgattcgaaaatcgaccgcggctcttgaagaagacgcacagatcctgaaggtgattgaggcctattgcacatcagctaactttcaacagggccacggatcaagcacccggaaggacagcatcccgcaggttttgctcccagaagaagagaaactgattattgaagagacaaggagcaacggccagaccattatggaggagaagtctttggtggacacagtctatgcattgaaagacgaggtgagggaactgaagcaggagaataaacgcatgaagcaatgcttagaggaggagctgaagtctagacgggatcttgaaaagctggtcaggaggctcctgaagcagaccgatgagtgcatcagaggggagtctagctctaagacttctattttgccgtag

SEQ ID NO: 237796 - DNA, 1896 bp, Artificial Sequence
  Description of Artificial Sequence: Synthetic coding sequence
atgttttacgctcactttgtactctcgaagaggggcccactagcaaaaatttggctggccgctcactgggacaaaaagttaacaaaggcacatgtttttgaatgcaaccttgaatcttctgtggagagcattatctctccaaaggtgaaaatggctttgcggacctcaggtcacctcctgctgggggtggtcaggatttaccatcgcaaagcaaagtatctcctcgcggattgcaacgaagctttcattaagatcaaaatggccttcaggccaggggtggtggatcttcctgaagagaaccgcgaggccgcatacaacgctatcacactgcctgaggaattccacgacttcgaccagccgctccctgatcttgatgatattgacgtggcgcagcaattcagtcttaaccagtcacgggtggaagagatcacgatgcgcgaggaggtcgggaacatcagcatcctgcaggagaacgatttcggtgactttgggatggatgaccgagagattatgagagaggggagcgctttcgaggacgacgatatgctcgtgagtactacaactagcaacttactactggagagcgaacaatcaacctccaatctaaatgagaaaattaatcatcttgagtacgaggatcaatataaagacgataacttcggcgagggtaacgacggcggtattctggatgacaagctgatctccaacaacgatggtggcattttcgatgaccccccagcactcagcgaggctggggttatgcttcctgagcagccagcccacgacgacatggatgaggacgataatgtgtccatggggggtcctgacagtcctgacagcgtcgacccagtagagcccatgcccaccatgactgatcaaaccactctagtgccaaacgaggaggaagcatttgccctcgagccaattgacattactgttaaagagactaaagcaaaacggaaacgcaagctgatcgtggattcagtgaaggaattagattccaagacaattcgggcacaactgtctgactacagtgatatcgtcacaacccttgacctggcccctcccaccaaaaagcttatgatgtggaaagagacaggcggagttgaaaagctgttctctcttcctgcacagcctctgtggaacaatcggctactcaagctcttcactagatgtttgacacctctggtacccgaggatctgaggaagcgacggaaggggggagaagctgataatctggacgagttccttaaagaattcgagaaccctgaggtaccgagggaggatcagcagcagcagcaccagcagcgtgatgtgatcgacgaaccgataattgaagagccttctcgtcttcaagagtctgtaatggaggcttcccggaccaacatagatgaatcagctatgcctccaccacccccacaaggcgtgaaacgcaaggccggacagatcgatcctgagcctgtgatgcctccgcaacaggtcgagcagatggaaatcccccctgtcgagctgcccccagaggagccaccaaatatttgccagcttattcccgaactggaactcctgcccgagaaagaaaaagagaaagagaaagagaaggaggacgacgaggaagaagaagacgaggatgcatctggtggagaccaggatcaggaggaacgccgatggaataagcggactcagcagatgctccatggcctgcagcgggctctggccaaaaccggagccgagtccattagcctattggaactctgccgcaatacaaataggaagcaggctgccgcaaagttctatagttttctcgtgctcaagaagcagcaggccattgaactgacgcaggaagaaccctatagtgatataattgcaactcctggccctcggttccatataatttag

SEQ ID NO: 237797 - DNA, 501 bp, Artificial Sequence
  Description of Artificial Sequence: Synthetic coding sequence
atggcaccaaaaaaagcaaagaagagagccggaggagccaatagcaacgtcttctccatgttcgaacaaactcagatccaggagttcaaagaggccttcactatcatggatcagaacagagacggcttcattgataagaacgacctgagagataccttcgccgcactgggacgcgtcaacgtgaagaatgaggagattgacgagatgatcaaagaagccccaggcccaatcaattttaccgtattcttaaccatgtttggcgagaaattgaaaggggcagatccagaggaaaccattctgaacgccttcaaggtgttcgatccagaagggaaaggggtgctgaaggcagactacgttagagagatgcttacaacacaggccgaaagattttctaaggaggaagtggaccagatgtttgcagcctttccaccggacgtgactggcaatttggactataaaaatctggtacatatcattacacacggagaggaaaaggactag

SEQ ID NO: 237798 - DNA, 909 bp, Artificial Sequence
  Description of Artificial Sequence: Synthetic coding sequence
atggttcggccagttaggcacaaaaagcctgtgaattactcacaattcgaccatagcgactctgacgatgacttcgtgtccgccactgtacccctaaataaaaagagccgcacagcacctaaggagctgaagcaggataagcctaagcctaacctgaacaatctgcgcaaagaggaaatccctgtgcaggagaagacccccaaaaagagactgcctgagggaacattttctatcccagccagcgccgtaccatgcactaaaatggccctggatgacaagctgtatcagagagacctggaggtggcattggcgctgtcagtaaaagaactgcccacggttaccaccaatgtgcagaatagccaagataaatccatcgaaaagcatggcagtagcaagatcgagacaatgaataagagcccacatattagtaactgctctgtggcaagcgattatctggatctcgacaagatcacagtggaggatgacgtggggggagtccagggcaagcggaaggccgctagtaaggcagcagcccagcagcggaagatccttctggaggggtccgatggagacagtgctaacgacaccgaacctgacttcgctccaggtgaagactcggaggatgacagtgatttctgtgagtctgaggacaacgacgaggatttctccatgcggaaatcaaaagtcaaagagattaagaagaaggaggttaaggttaagtcccccgtcgaaaagaaggagaagaagtcaaaaagcaagtgcaatgccttagccgcatctggaggatctcgaagttcgtcaagtcccctcgtcgtagtgtccgttaagtctcctaatcaatcactccggctgggactgtcaaggctggccagggtcaagcccctccatccaaacgctacttccacatag

SEQ ID NO: 237799 - DNA, 1008 bp, Artificial Sequence
  Description of Artificial Sequence: Synthetic coding sequence
atggtaaggccagtcagacacaaaaagccagttaattactcccagttcgaccattccgattcggatgatgactttgtcagtgcaacagtcccgctcaataaaaaaagtagaactgcacccaaggaactcaagcaggacaagcccaagcctaacctgaacaacctgagaaaggaggaaatccccgttcaggagaaaacacccaaaaagcgaatggccttagatgataagctgtatcagcgcgatctggaggtagcactcgcactgagcgtaaaggaactccctacggtgaccaccaacgtgcagaactcccaggacaaatcaatcgagaagcacggcagtagtaagatcgagacgatgaataagtcaccgcacatttctaactgtagtgtcgcatccgattatctcgacctggataaaataaccgtcgaggatgatgtcgggggtgtgcagggaaagaggaaagcggcttccaaggcggcagcacagcaaagaaaaattctgctcgagggctctgatggagactctgcaaatgatactgagcctgacttcgctcccggagaggattccgaagacgatagtgacttctgcgaatctgaagacaatgatgaggatttctccatgaggaaatcgaaggtgaaagagatcaagaaaaaagaggtcaaagttaagtctcccgtcgagaagaaagagaagaaatccaaatccaaatgcaatgcactggtaacatcggtcgatagtgcccctgccgctgtgaagagcgagtcccaaagtttgcctaagaaagtctctttgagcagtgataccacacggaaaccactggagatcagaagcccgagcgcagaatccaagaaaccaaagtgggtgcccccagccgcatcagggggtagtaggtcaagcagctcccccctcgttgtggtgagtgtgaagtcgcctaaccagagtctgaggttgggtctgtccaggctggccagagtcaaacctttgcacccaaatgccacaagtacgtag

SEQ ID NO: 237800 - DNA, 702 bp, Artificial Sequence
  Description of Artificial Sequence: Synthetic coding sequence
atgaataaatctcctcatatctcgaactgctctgtggctagcgattatctggatctggataaaatcaccgtggaggatgatgtggggggagttcaaggcaaacgcaaggccgctagcaaggcagctgcacagcagaggaaaatcctgctcgaaggatcagatggagattccgccaatgatactgagcctgacttcgccccaggagaagacagcgaagacgactcagacttctgcgagtcagaagacaacgacgaggatttcagcatgcgcaaaagtaaggtcaaggagattaaaaagaaggaggtcaaagtcaagagccctgtggagaaaaaggaaaaaaagagtaagtccaagtgcaatgcactggtcaccagcgttgattctgccccagccgctgtcaagtctgagtctcagagcttgcccaagaaggtgtctctttcatcagacacgactcgcaaacctctggagattcgctcaccttcagcagaaagtaagaaacctaagtgggttccccctggcatggcttacctatcttccagaacgggggcttggaaaattatcacagccgcatctggcggatcaagatccagctcatcccccctggtagtggtatccgtgaaaagcccaaaccagagtctgcggctgggtctctctaggctagcacgcgtcaagccactccatcccaacgccacaagcacctag

SEQ ID NO: 237801 - DNA, 408 bp, Artificial Sequence
  Description of Artificial Sequence: Synthetic coding sequence
atgagaggcaagacgttccgctttgaaatgcaacgagatctcgtatcttttccactctcccccgctgtcagagtcaaacttgtttctgccggttttcagacggccgaagagctcctcgaggttaaaccgtctgagctgagcaaggaagttggaatcagcaaggccgaggccctggaaacgctgcaaattatccgcagggagtgtttgacaaataagcccaggtacgccggaacaagcgaatcccacaaaaaatgcacagccctggagctcctggagcaggagcacacgcagggctttatcatcacattctgcagtgcactggacgacatcctgggcggtggggttcccttaatgaaaactaccgagatctgcggcgctcccggagtaggtaaaacccagctctggtag

SEQ ID NO: 237802 - DNA, 855 bp, Artificial Sequence
  Description of Artificial Sequence: Synthetic coding sequence
atggcagagttggtacctttcgccgtgccaatcgaatctgacaagactcttctggtgtgggaactgagctctgggcctacagctgaagcactccatcattcgctgtttactgccttctcacaatttgggttactgtattccgtccgcgtgtttcctaacgctgctgtagcgcacccaggattctacgccgttatcaaattctattccgcacgggctgctcatcgcgctcagaaggcctgtgatagaaaacaacttttccaaaagagccccgtgaaagtacgactaggcacaagacataaggctgtgcagcatcaggctcttgccctgaacagctccaagtgtcaagagctggccaattactattttggctttaatggctgctctaagcgaatcattaagcttcaggagctgagcgatctggaagaacgtgaaaatgaagactccatggttcctctgcccaaacagtccctcaagtttttctgcgcattagaggtcgtcttgccttcttgtgattgccgaagtcccggaattgggctggtcgaagagcccatggacaaagtggaggagggccctctctctttcctgatgaaaagaaagaccgcccagaaactggccattcagaaagctttgtccgatgcgtttcagaagctgttgatcgtagttctcgaatctgggaagattgccgtcgagtatcgccctagcgaggatatcgtgggcgtccggtgcgaggaggagctgcacggtctgatccaggttccctgtagcccctggaagcagtatgggcaggaagaagagggatacctcagcgacttttccctggaggaggaggagttcagattgcctgagctggactag

SEQ ID NO: 237803 - DNA, 351 bp, Artificial Sequence
  Description of Artificial Sequence: Synthetic coding sequence
atgcaccttctagtaccgcctccgcagcattcactgtttaccgcttttagtcagtttggcctactctactccgtgagagtgttccctaacgccgctgttgcccaccccggtttctatgccgtgatcaagttctatagcgcacgtgccgcacatagagctcagaaggcttgcgatcgcaagcagttattccagaaaagccccgttaaggtccgactggggacaaggcacaaagcagtgcagcatcaggccttggctttaaacagctctaagtgccaagaactcgctaactactacttcggcttcaacggttgtagcaaacgtatcattaaagatcactatcactcactatag

SEQ ID NO: 237804 - DNA, 711 bp, Artificial Sequence
  Description of Artificial Sequence: Synthetic coding sequence
atggctgaactcgtgcccttcgcagtaccaatcgaaagcgataaaaccttactcgtttgggagttgagctccggcccaacagctgaggccctccaccattctctatttaccgccttctcacagttcgggctcctgtattccgtacgggtgttcccaaatgctgccgtagcccatccgggattttatgccgtgatcaaattctattcggccagagctgctcacagagcacagaaggcttgtgataggaaacagttgttccagaagtctccagtgaaagtgcgcctgggtacccggcacaaagcagtgcagcatcaagcactcgctctgaactctagtaagtgccaagagctggccaattactactttggcttcaatggctgtagcaagaggatcattaaattgcaggagctgtccgacctggaagagagagaaaatgaagactcaatggtgccactgcccaaacagagcctgaaattcttctgcgccctggaggtcgttctgccctcctgtgattgtcgctctccaggcattggcttagtagaagagccgatggataaggtggaagaggggcctctgagttttctgatgaaacggaagaccgctcagaagttggcgatccagaaagctttgagtgatgcatttcaaaaactccttattgtggtgcttggtaagaccgtcctcattatattagaagttctgcaattccaatag

SEQ ID NO: 237805 - DNA, 786 bp, Artificial Sequence
  Description of Artificial Sequence: Synthetic coding sequence
atgcatttgctggttcctcctcctcaacacagtctctttacagccttcagtcaatttggattgctttatagcgtacgagtttttcccaacgccgctgtggcccatccaggtttctatgctgttattaaattctatagcgcacgggctgcccacagggcccaaaaagcatgtgaccgaaagcaactcttccaaaaatcccccgtaaaagtgcgcttgggcacccggcacaaggccgtgcagcatcaggccttagcactaaactcctctaagtgccaagagctggccaattattacttcggcttcaatggctgctctaaacggataataaagctccaggagctgagcgatctggaagagcgggagaatgaagactctatggtgcctcttccaaagcagtccctgaagttcttctgtgctctcgaagttgttctcccttcctgcgactgccggagccctggaatcggactggtggaggagcctatggacaaggttgaggaaggccctttgtcatttttgatgaaacggaaaacggcccagaaactagcaatccaaaaagccctgagcgacgcctttcaaaaactgttgatcgtggtgctggagagtggaaagattgcagtcgagtatcgacccagcgaggacatcgtgggagtgcggtgcgaggaggagctgcacggccttatccaggtgccatgtagcccatggaagcagtacggacaggaggaggaagggtacctttctgatttcagtcttgaagaggaagagtttcgattgccagagctggattag

SEQ ID NO: 237806 - DNA, 393 bp, Artificial Sequence
  Description of Artificial Sequence: Synthetic coding sequence
tttggtttcaacggatgttccaagcggatcataaaactccaggaacttagtgacctagaagaaagggaaaatgaagactcgatggttcccttgccaaagcaaagcctcaagtttttttgcgctctggaagtggtcctgccttcatgcgactgccggagtcctggcatcggattggtcgaggaaccaatggacaaggtggaagaagagtctgggaaaattgccgttgagtataggccatccgaggacattgttggagtgcgctgcgaagaggagttgcatggattgattcaagtgccatgcagcccgtggaagcaatatggccaggaggaggaaggatatctttccgacttttccttggaggaagaagagtttcgcctgcctgagctggattag

SEQ ID NO: 237807 - DNA, 501 bp, Artificial Sequence
  Description of Artificial Sequence: Synthetic coding sequence
atggcggagttggtacctttcgccgtgcctattgaatctgacaaaacacttctggtttgggagctgagttctggacccacagcggaagccttgcaccatagccttttcacagccttcagccaattcggactactgtattcagtgcgggtgtttccaaacgctgctgtggctcatcctggattttacgccgtcattaagttctattctgccagagccgctcacagagcccagaaggcctgcgatagaaaacaattgttccagaaatctccagtgaaggtgcgtcttggcacacgccataaggcagtgcagcaccaagccctcgctttaaacagttctaaatgccaggagttagccaattattattttggttttaatggctgttctaaacggattattaaagtgccttgttccccctggaaacaatatggccaagaggaagaaggctatttgtcagacttctctctggaggaggaggaattccgcttacctgagttagactag

SEQ ID NO: 237808 - DNA, 642 bp, Artificial Sequence
  Description of Artificial Sequence: Synthetic coding sequence
atgcatctgctggttcctcccccacagcattcactgtttacggctttcagccagttcggactgctgtactctgtaagagtcttcccaaacgctgccgtcgcacatcccggtttctacgctgtgataaaattctacagcgccagggccgcacacagggctcaaaaggcgtgcgataggaaacagttgtttcagaagtctccagtgaaagtgcggctgggaaccaggcataaagccgtccagcaccaggctttggcgctcaacagttccaaatgtcaagaactggctaattattacttcggatttaacgggtgtagcaagaggattattaagttacaagaattatccgacctggaggagcgagaaaacgaagacagtatggttccattgccaaaacagtcactcaagtttttttgtgctctggaagtggtgcttccaagctgtgactgtcgcagcccaggcatcgggttagtggaagagccaatggataaggttgaagaaggacccctctcattcctcatgaaaaggaagaccgcacagaagctggctatccagaaggctctgagtgacgcctttcagaagttgctgatcgttgttctggggaaaaccgtactgatcatcctggaagttctccaattccagtag

SEQ ID NO: 237809 - DNA, 756 bp, Artificial Sequence
  Description of Artificial Sequence: Synthetic coding sequence
atggcagaactagttcctttcgccgtgcccatagaaagtgacaagacactgcttgtgtgggagctcagcagtgggcctaccgctgaagctttgcatcactcacttttcactgctttctcacagtttgggctactctattctgtaagagtttttcctaacgcagccgtagcccatccagggttctacgccgtgattaagttttactcggctcgggcagcccatagggcccaaaaggcgtgtgatagaaaacagctgttccaaaaatctcctgtgaaggtaagactcggcactcggcacaaggccgtccagcatcaggccctggccctcaactccagcaagtgccaagaattggctaactattatttcggattcaacgggtgctccaagcgcatcattaaactgcaggagctatctgacttggaggagagggaaaacgaggattctatggttccacttccgaagcagagcttaaaatttttttgcgccctggaagtggtgttgccaagttgcgactgtaggtcaccaggaattggtctggtagaggagcccatggacaaggtggaagaggagtccggcaagatcgcagtcgaatatcgcccttctgaagatatcgttggcgtccgctgcgaggaggaactccatggcttgatccaggtgccttgctctccttggaaacagtatggccaggaggaagagggctaccttagtgatttttccctggaagaagaagagttcaggttgcctgagctggattag

SEQ ID NO: 237810 - DNA, 420 bp, Artificial Sequence
  Description of Artificial Sequence: Synthetic coding sequence
atggccgagctggtgcccttcgcggtccccatcgaaagcgacaagactctgcttgtttgggagttgtccagtggacccaccgcagaggcgctgcatcactcactgtttacggccttttcacagtttgggctcctgtacagcgtgcgtgtgtttcccaacgctgccgtggctcatccagggttttacgctgtgattaagttctactccgcaagagctgcccaccgcgcacagaaagcctgcgaccgcaagcagttgtttcagaagagcccagtgaaagtcaggctcggcactcgccataaggcggtccagcaccaggctcttgctctgaattctagcaagtgccaagagctcgcaaattattatttcgggttcaatggttgtagtaagaggatcatcaaggatcactaccattctttgtag

SEQ ID NO: 237811 - DNA, 432 bp, Artificial Sequence
  Description of Artificial Sequence: Synthetic coding sequence
atgcacctccttgttccacccccacagcactcactttttacagcgtttagccaattcggcttgctgtattccgtgcgagttttccccaacgctgctgtcgcacaccccggtttttacgccgtcatcaagttttatagtgcgagggccgctcacagggcccagaaggcttgtgacagaaagcagctgttccagaaatcaccagtaaaagtgagactgggaacaagacataaggccgtacaacaccaagccctggccctgaacagctccaagtgtcaggagctcgctaattactacttcggtttcaacgggtgttcaaaaagaatcataaaagtgccctgttctccttggaagcagtatgggcaggaagaagaaggatacctctctgacttttccctggaagaagaggagtttagacttccagaattggattag

SEQ ID NO: 237812 - DNA, 2733 bp, Artificial Sequence
  Description of Artificial Sequence: Synthetic coding sequence
atgagacgaagtgcggcaccttcccagctccaggggaacagttttaaaaaacccaaatttatcccccctgggagatctaacccaggattaaacgaagagattaccaagctaaaccccgatataaagctgtttgagggagtcgcaatcaacaatactttcctccccagtcaaaatgaccttcggatttgcagtttaaacctgccatcggaggaatctactagagagatcaataacagagataattgttctggcaagtactgcttcgaggcacctactctggcaacccttgacccacctcacactgtgcattcagctcctaaagaggtcgctgtgagtaaagagcaagaggagaagtccgactcattggtaaagtatttctctgtggtctggtgcaaaccctccaagaagaagcacaaaaaatgggaaggcgacgccgtgttaatcgtcaaaggcaagagtttcatcctcaaaaatctggagggcaaggacattggcagaggtatcggatacaagttcaaggagcttgagaaaatcgaagaagggcagaccctgatgatttgtgggaaagaaatcgaggtgatgggggtcatcagccccgacgacttttctagtggcaggtgctttcaattaggtggtgggagcaccgccattagccacagcagtcaggttgccagaaaatgtttttctaatcctttcaaatctgtatgcaagccatcttccaaggagaatcggcaaaatgactttcaaaactgtaagcccagacacgatccttatactcctaatagtctggtcatgccaaggcctgataaaaaccaccagtgggttttcaataagaactgctttccgctcgtcgatgtggtcattgatccttacctagtgtaccatctcaggccgcatcagaaagaaggaattattttcctatatgagtgcgtcatgggaatgcgcatgaatggcaggtgtggggctattctcgccgacgagatgggcctgggtaagacactccagtgtatttcattgatctggaccctacagtgccagggcccttatggcggaaagcccgtgataaagaagacattaatagtcacacctggaagtcttgtcaacaattggaagaaagagtttcagaagtggctgggcagtgagcgtatcaagatctttacagtggatcaggaccataaggtggaagagttcatcaagagcatcttttactccgtcctgataattagttacgagatgctgctcagatctcttgatcagataaaaaatatcaaattcgacctgcttatctgtgacgaaggccaccgcctaaagaatagcgccatcaaaacgacaaccgctctgattagccttagctgtgagaaacggatcattttgaccggaactccaattcagaacgatcttcaggaattcttcgccttaatcgactttgttaaccctggcattcttggctccttgagttcttatcggaaaatctatgaagagcctattattctgtcccgcgagccctccgcaagcgaagaggaaaaggaactaggagagagacgagcagctgaactgacttgtctcacaggcttgttcattctgagacgaacgcaagagattatcaacaagtatctgccacctaaaatagaaaacgtcgttttctgtagacctggcgctctgcaaatcgagttatacagaaaactgctgaattcccaggtagtacggttctgtctgcagggccttctggagaattcccctcacctcatctgcatcggcgctctgaaaaaactgtgtaaccacccatgtctcctctttaactccatcaaagaaaaggagtgttccagcacctgcgacaagaatgaagagaaatccttgtacaagggcctgttgtctgtatttccagccgactacaaccccctgctgtttacagaaaaagaaagcggaaaactgcaagtgctgtcaaaactcctcgccgttattcacgaactcaggcccacagagaaggtggtcctggttagcaattacacgcagactctgaatatactgcaagaagtgtgcaagcgacacgggtacgcttacacgcgcctggacgggcagacccccatttcccaacgacaacaaatcgtggatggtttcaactcacagcacagcagcttctttatcttcttgttgtctagcaaagctggcggagtggggctgaatcttatcggaggcagccatttaatactgtacgacattgactggaacccagctaccgatatccaggcaatgtcaagggtttggagggatgggcagaaatatccggtgcatatttacagattactgacaacagggaccatcgaagaaaagatatatcagaggcagatttccaagcaggggctgtgtggggcagtggtagacctgaccaaaacgtctgagcatatacagttctccgtggaagagctaaagaacctcttcactcttcacgagtcttctgattgcgttacgcatgacctcctggactgtgaatgtaccggggaggaggtacatacgggagactctttagagaagttcatcgtgtcacgcgattgtcagctaggaccacatcatcagaaatccaatagtttgaagcccctgtctatgtcccagctgaaacagtggaagcacttcagcggtgaccatttaaatctaacagaccccttcctggagcgtataaccgagaacgtgtcattcatttttcagaacattaccactcaggctaccgggacatag

SEQ ID NO: 237813 - DNA, 900 bp, Artificial Sequence
  Description of Artificial Sequence: Synthetic coding sequence
atggtgggcaaagccaggtcatccaatttcacgttgtccgaaaagctcgatctgctaaaactggtcaaaccctatgtgaagatcctggaggagcacaccaataagcattctgtgatagtggaaaaaaatagatgctgggacattatcgccgttaactacaacgcaattggagtggatagaccccctaggaccgcccagggtctgagaacactatacaaaagactcaaggagtacgcgaagcaggagctgttgcagcaaaaggagacacagtcagattttaaatccaacatctctgagccaaccaaaaaggtgatggagatgatcccccagatctcttcattctgcctagtacgggaccgtaaccacatccagtctgcaaatctggatgaggaggctcaagctgggacctcttcgctccaggtcatgttagatcatcacccagtcgctatcacggtcgaagtgaagcaggaagaggacatcaaaccaccccctcctctggtgctgaactcacagcagagcgacactttagagcagagagaagagcacgagcttgtacatgtcatggagcggtcattaagcccctcattaagtagtgtggatatgagaatgactagcagtccctccagtattcccagacgcgacgatttctttcgtcatgagtcgggggagcattttagaagcctccttgggtacgatcctcagatcctccagatgttaaaagaagagcatcagatcatcttggaaaaccaaaagaactttgggctttacgtccaagaaaaacgagacgggcttaagagaaggcaacaactggaagaggaactcttacgcgcaaagattgaggtggaaaaattgaaggcgattcggctcaggcacgacctcccggaatataattctctttag

SEQ ID NO: 237814 - DNA, 378 bp, Artificial Sequence
  Description of Artificial Sequence: Synthetic coding sequence
atgcgtagaagcgcagcgccttctcagctgcagggaaactcttttaagaagcctaagttcatacccccaggccgttccaaccctggccttaacgaagaaatcaccaagttgaaccccgacatcaagctgttcgagggtgtcgcaatcaacaacacctttttacctagccaaaatgatctgcgcatatgcagtctaaaccttccctccgaggagagtactagggaaatcaacaaccgggacaactgctccgggaaatactgctttgaagccccaacgttggccactctcgatccccctcataccgttcattctgctccgaaggaggttgccgtgtcaaaggaacaggaagagaagtccgattctctcgtaaaatattag

SEQ ID NO: 237815 - DNA, 354 bp, Artificial Sequence
  Description of Artificial Sequence: Synthetic coding sequence
atgaggagatctgcagcgccatcccagctgcaaggcaatagctttaagaagcccaagtttatccccccaggacggtctaaccccggattgaatgaagagattactaaattgaacccggacatcaagctcttcgaaggcgtggcgatcaataacacttttttaccctctcaaaatgacctgagaatttgcagtctcaacctgccgtcagaagaatctactcgagagattaacaatcgcgacaactgctccggtaaatattgtttcgaggcacctacgctggctactctggatccaccgcatacagttcagacctggatgaggcgacataggctcgtgcctgttcattatcgctag

SEQ ID NO: 237816 - DNA, 477 bp, Artificial Sequence
  Description of Artificial Sequence: Synthetic coding sequence
atgctggatcatcaccctgtggctattacagtagaagttaagcaggaggaagatatcaaaccacccccacccctggtgctaaattcccaacaatccgataccttagagcagagagaagaacacgagttggtgcacgtgatggaaaggagtctctcacctagtctgagctccgtggacatgaggatgacaagttctcccagctccatacctcggagagatgactttttcagacacgaaagtggagagcacttccggtctctgctgggctacgacccccagatcctgcagatgctcaaagaggagcatcagattatcctggaaaaccagaagaactttggtttgtatgtccaagagaagcgtgacggattaaagaggcgccaacagttggaggaagaactgctccgcgcaaagatagaggttgaaaagctcaaagccatccggctccggcacgaccttcctgagtataactctctctag

SEQ ID NO: 237817 - DNA, 1749 bp, Artificial Sequence
  Description of Artificial Sequence: Synthetic coding sequence
atgggcctgggcaagactctacagtgtatcagtcttatctggaccctgcagtgtcagggaccctacggcggaaagcctgtcatcaaaaagacattaatcgtgacaccgggtagcttagtgaataactggaaaaaggaattccaaaagtggctgggttccgagagaatcaagatcttcactgtggatcaggaccataaagtggaggagttcattaagtctatcttttacagcgtattaataatttcttatgagatgctgctgaggtccttggaccagatcaagaatatcaaattcgacctgctgatctgtgacgaaggccaccggttaaagaattctgcaatcaagactactactgcactcatcagtctgagctgtgaaaaaaggattatcctgactggtacacctattcaaaacgacctgcaagaattcttcgctctcattgattttgtcaatccgggaattttaggttcactctcttcatataggaaaatctatgaggagccaatcattctctcccgcgaaccaagcgcctccgaggaggagaaggagctgggagaacgggagcagctcaaccttctggcatccctcgacagcctccttagacgcacacaggagatcattaacaagtaccttcctccgaaaatcgaaaacgtcgttttctgccggcctggggcattacaaatcgagctgtaccgaaaactgcttaattcacaggtggtgagattctgcctgcaagggctgttggagaactctccccacctgatttgtatcggggctctgaaaaaactctgtaaccacccctgcttgctctttaactcaatcaaggaaaaagaatgttcttcaacctgcgacaagaacgaggagaagtctctctataaagggttgctgtctgtttttcctgccgactataaccccctgctatttaccgagaaagaaagcggaaagcttcaggtgctgagcaaactgctcgccgtgattcacgagttgcgacccacagagaaggtcgtgctggtttctaactacacacagaccctcaacattctgcaggaggtctgtaagcgtcatggttatgcctacacccgtctggatggccagacccccatttcccaaagacagcagatcgtggacggatttaactctcagcattcttccttttttattttcctgctgagctccaaagccggaggagtagggttgaacctcattggtggtagtcatttgattctctacgacattgactggaaccccgcaaccgacatacaggcaatgtctagagtgtggagggacggacagaaatacccagttcacatatatcggctgttgacaacagggaccatcgaagaaaaaatttatcagcgccagatctcaaaacaaggcctgtgcggggcagtcgttgacctgacaaagacatcagaacacatccagttttccgtagaggaactcaagaacctgtttacactgcacgaatcaagcgattgcgtgactcatgatctgcttgactgcgagtgtacgggggaggaggtacacaccggcgattctctcgagaagttcatcgtgagcagagactgtcagctgggacctcaccatcagaaatcaaacagcctgaaaccgctgtcaatgtcgcagctgaagcagtggaagcatttcagcggcgatcatctgaatcttacagaccccttccttgagagaatcacagaaaatgtttcttttatcttccagaatattactactcaggcaactggtacgtag

SEQ ID NO: 237818 - DNA, 1290 bp, Artificial Sequence
  Description of Artificial Sequence: Synthetic coding sequence
atggcggcaatgctgaagtgcgtgatgagcggtagtcaggttaaagtgttcggcaaggccgtgcaggctctgtctcggatatcagatgaattttggcttgacccatctaagaaaggcttggctcttaggtgtgtgaactctagtagatccgcctacggatgtgtgcttttttctccggtcttctttcagcattaccagtggagcgccttggtcaaaatgtcggagaatgagcttgacacgaccctgcatctaaaatgcaaattaggaatgaagagcattctgcccatttttaggtgcctcaacagtcttgagcgcaatattgagaagtgcaggattttcacacgcagcgacaaatgcaaggttgtcattcagttcttctatagacatggcatcaaacgcactcataatatctgtttccaggagagccagcctctgcaggtaatcttcgataaaaatgtgtgtacgaacacccttatgattcagccccgacttctcgccgatgcaatcgttctttttacgagctcacaggaggaagtgaccttggcagttactcctcttaacttttgcctcaagtctagcaatgaagaaagcatggacctttccaacgccgtgcacagcgagatgtttgtgggctctgacgagtttgacttcttccagattggcatggatacagagattactttttgcttcaaggagctgaagggcattctgacattcagcgaggctacccacgctcccattagtatctattttgactttccgggaaaacctcttgccctatccatcgatgacatgcttgttgaggccaacttcatcctggcgacattggcggacgagcagagtcgggcatcttctcctcagagcttgtgtctctcccagaaacggaagcggtctgatctcattgaaaagaaggcaggcaaaaatgtgacaggtcaggcactggaatgcatctctaaaaaggccgctcccagacggttatatcctaaggagaccttgacaaacattagtgcactcgagaactgtgggagtccagcaatgaaaagagttgacggagacgtaagcgaggtgagcgaaagcagcgttagtaatactgaagaggtcccaggcagcctgtgcctgcgcaaattttcctgcatgttcttcggggcagtgtccagcgaccagcaggagcattttaatcatccttttgactccctggccagagctagcgatagtgaagaggatatgaataacgtctgctgtagaaaagagttcaatgggagcgacgctaagtacttctgtattatctag

SEQ ID NO: 237819 - DNA, 1038 bp, Artificial Sequence
  Description of Artificial Sequence: Synthetic coding sequence
atgtccgagaacgagctcgacaccactttgcatctgaagtgtaagctgggcatgaagtccattctgccaatatttcgatgtctgaattcattggagcggaatatcgagaagtgccgcatctttacccgcagtgataagtgcaaggtggttatccagtttttctacaggcacggaatcaagcgaacccataatatatgcttccaggagtcacaacccttgcaggttatctttgataaaaatgtgtgtactaacaccttgatgatccagccacgcttactggccgacgccatagttctgtttacgtctagtcaagaggaggtgactctggcggtgaccccccttaacttttgcctcaagtcgtcgaacgaggaaagcatggacctttcaaacgccgtgcacagtgagatgttcgtcggcagtgacgagtttgacttttttcagatcggtatggatacagaaatcaccttctgcttcaaggaattaaaaggtatcctgacatttagcgaggctacccatgcgcctattagcatatatttcgactttcctggcaagccacttgccctgtcaatcgatgatatgttggttgaggccaatttcattctggccacactggcagatgagcaatcacgagcttcctcaccccagtctctgtgcctgtctcaaaagaggaaaaggtctgatctcattgagaagaaggccggaaagaacgtcactggacaggcccttgagtgtatcagtaagaaggcagccccacgccgactgtatccaaaggaaacacttacaaatatatctgcattggaaaactgtgggagccccgcaatgaaacgggtcgatggagatgtctcagaagtgagcgaaagttcggtgagcaacaccgaagaagtccccggatctttgtgccttcgcaaattctcctgtatgttcttcggcgctgtctcgagcgaccagcaagaacatttcaatcatccttttgactctctcgcacgcgcttctgattccgaggaggatatgaataacggaagcttctcgattttttag

SEQ ID NO: 237820 - DNA, 1038 bp, Artificial Sequence
  Description of Artificial Sequence: Synthetic coding sequence
atgagcgagaacgaactggacaccaccctacaccttaaatgtaagctggggatgaaaagtatactccccatatttcgttgcctcaattcccttgagcggaacatcgaaaagtgtcgcatctttacccggagtgataagtgtaaggttgttatccagttcttctaccgtcacggtattaagcggacccacaacatttgtttccaggaaagccagccgctccaggtgatttttgacaagaacgtgtgtacgaacacactcatgatccaacccaggctattggccgacgccattgtcctgttcacctcaagtcaagaagaggttactctagccgtgacgcctctgaatttctgcttaaagtccagcaacgaagaaagcatggacctgagcaatgcggtccacagtgaaatgttcgtcgggtccgatgaatttgactttttccagatcggtatggacactgagattactttctgtttcaaagagcttaaaggcatcttgaccttctcagaggcaacacacgctccgataagcatttatttcgacttcccaggcaagcccctggcgctgagcattgacgacatgcttgttgaagcaaatttcatcctggctactctcgccgacgaacagtcgagagcctcatcaccgcaatctctgtgcttaagtcaaaagcggaaacgctccgatcttattgagaagaaagccggaaaaaacgtgactgggcaagctttggagtgcatctctaagaaagcggcacccaggcgcctttaccccaaagagaccttgacaaacatcagcgccttggagaattgcgggtcccccgcaatgaagagagttgatggcgacgtgagtgaggtgtctgaatcatccgtaagcaacactgaggaggtgccgggatctctttgcttgcgaaagttcagttgtatgttttttggggcagtgtcctccgatcaacaagagcactttaatcaccccttcgactctctggccagagcctccgattccgaggaagacatgaataatggaagcttcagtattttctag

SEQ ID NO: 237821 - DNA, 1449 bp, Artificial Sequence
  Description of Artificial Sequence: Synthetic coding sequence
atgggctgcgtgcagtgtaaggacaaggaagccacaaagcttaccgaagagcgagatggtagtctgaaccaatcaagcggatataggtacggcactgacccaactcctcaacattacccttccttcggcgtaaccagtatccctaactataataactttcacgcggcaggcggtcaaggcctgacagtgtttgggggtgttaattcatccagtcatacgggaactctccgcactcgcggtggcacaggcgtcactctgtttgtggcattatacgattatgaggcaaggaccgaggacgacttgtccttccacaaaggcgagaagtttcagattttgaattcaagcgagggggactggtgggaggcccgatccttaaccaccggtgaaaccggatatatcccctccaactacgtggcccctgtcgattccattcaggcagaggaatggtacttcggcaagctcggtagaaaggacgcagagagacaactgcttagctttggtaaccccagggggacgtttctaattcgggaatcagagaccaccaagggggcttattcgctctctattagggactgggatgatatgaagggcgaccacgtcaagcactataaaatcagaaagctggacaacggcggttattacattaccacccgggctcagtttgagaccttgcagcagttggtgcagcattactccggtacctggaacggcaatactaaggtggcaattaagactctgaagccagggaccatgagtcccgaatcatttctggaggaggctcagatcatgaagaaattgaagcacgataaacttgtgcagctatatgctgtggtctcggaggaaccaatctacatcgtgaccgaatacatgaataagggatccctccttgattttctcaaagatggagaaggtcgggcattgaagttaccaaatctggtagacatggctgcccaggtggccgctgggatggcctatatagaaaggatgaattacattcatcgcgatcttagatcggccaacatactcgtgggcaatggactgatatgcaaaatagcagactttggtctggcacggctcatcgaggataatgagtacacagctaggcagggagctaagtttcccatcaaatggactgcccctgaggccgcattgtatggacggttcactatcaaatcagacgtctggtcttttggcatcctgctaaccgagctggtgaccaaggggagggtgccctatcccggtatgaacaatagagaggtgctggagcaggtggagcggggatacagaatgccatgtccccaggattgcccaatcagcctccacgagttaatgattcattgctggaagaaggacccagaggaaagacctacctttgagtatctgcagagcttcctggaggattactttactgccaccgaaccccagtatcagccgggagagaacttatag

SEQ ID NO: 237822 - DNA, 1410 bp, Artificial Sequence
  Description of Artificial Sequence: Synthetic coding sequence
atggaggactctacatcaccgaagcaggagaaagagaatcaagaagagctcggagagactagacgtccatgggagggcaagacggcggcaagcccccagtattctgaacctgaaagcagtgagccactggaggccaaacagggccctgagacaggacgccagagccgctccagcagaccctggtcgccgcagagccgggctaagactcctttgggagggcctgccggaccggaaacatctagtcctgcgccagtctcaccgagggagccctcctccagtccctcccctttagcacccgctagacaggacctggccgctccccctcagagcgacaggaccaccagtgtgattccggaagccggaactccataccccgatcctctggaacagtcatcagacaaaagggagtcgacccctcaccacacctcgcaaagcgaaggaaacacattccaacagagccagcagccgaagccccatctctgtgggcgacgcgatgtatcctacaataatgccaagcagaaggagttgcgctttgacgttttccaggaagaagatagtaattccgactacgacctgcagcagcctgcccctggaggtagcgaagtcgccccaagcatgctcgagatcacgattcagaacgccaaagcttaccttctgaaaacgtctagtaatagcggattcaatctgtacgatcaccttagtaatatgctcaccaaaatattgaacgaaagacccgaaaatgctgtagacatttttgagaatattagccaggacgtcaagatggcccacttctctaagaaattcgacgccctacagaatgagaatgaactgctcccgacatacgagatagccgaaaagcaaaaggccctgtttctgcagggccatctggagggagtggaccaggaacttgaggacgagatagggaggtgcaattggtttaatagtatccagaagaatgaggaggaagaagaagaagaggacgaagagaaagacgattctgattatatcgaacaagaagttgggctcccactcctcacgccaatatccgaggacttggaaattcagaacatccccccttggaccacccggctgagttctaacctgatcccccagtacgctatcgctgttctgcagagcaacctatggccgggagcttatgcctttagcaatggcaagaaatttgaaaatttttacataggatgggggcataaatactctccagataattatacgcctccggtcccccctcccgtctatcaggagtatccaagcggccctgaaatcaccgagatggatgatccatcagtcgaggaggagcaagctttccgcgcagcacaagaagcggtgttgctggccgcagagaatgaggagtcagaagaggacgaagacgaggaggatgactatgattag

SEQ ID NO: 237823 - DNA, 1803 bp, Artificial Sequence
  Description of Artificial Sequence: Synthetic coding sequence
atggaggattctacaagcccaaagcaggaaaaggaaaaccaggaagagctgggagagactcgcaggccatgggagggtaagaccgcggcttcacctcagtactctgaacctgaaagcagtgagcctctcgaggctaagcaaggcccagagaccggacggcagagccggtccagcagaccgtggagcccacagtcccgagctaaaacaccattgggcggaccagccggtcccgagacttcttctcccgctcccgtcagcccgagggaacccagcagtagcccgagccccttggcacctgccagacaggatctcgccgctccaccgcagtcggatagaacgacttccgttattcccgaggcgggtaccccctaccccgaccctctcgagcagtcaagtgacaaacgagaatccactcctcaccatactagtcagtcagagggtaacaccttccaacagtctcagcagcctaagccgcatctctgcggcagaagggacgtgtcatataataatgccaagcagaaggagctgaggtttgatgtgtttcaggaggaagattccaattccgattatgatttgcagcagcctgcccctggagggagtgaagtggctccttctatgctggagataacaatacagaacgccaaagcctacctgctaaagacctccagtaacagtggctttaatctatatgaccacctgtcaaatatgctgacaaagattctgaatgaaagacccgagaacgcggtagacatcttcgaaaatataagtcaagatgtaaagatggcccatttttcgaaaaagttcgatgccttgcagaatgagaacgaattattgcccacctacgaaattgcagagaagcagaaggccctttttttgcagggccatcttgagggcgtggatcaagagttagaagatgaaattgctgaaaatgcgctccccaatgtgatggagtccgctttttacttcgagcaggccggtgtgggactaggcacagacgagacgtatcggatctttctggcgctaaaacagcttaccgatacacacccaattcagcggtgtaggttctggggaaagatccttggactagagatgaattatattgtggcggaggtcgagttcagggagggcgaagatgaggaggaggtggaggaagaggacgttgcggaagagcgggacaatggggagagtgaggcccatgaggacgaggaagacgagctgcccaaaagcttctataaggcgccacaggcaattccgaaagaagaatcccgaactggcgcaaacaagtacgtctattttgtgtgcaacgagcctggtcgcccttgggttaaacttccaccagttatccccgcacagattgtgatcgccagaaagattaaaaaattctttaccggtaggctcgacgctccaattatctcctatccccctttccccggaaatgaatccaattatcttagagcacagatcgctcggatttcagcaggcacacatgtcagcccactcggattctatcagttcggcgaggaggagggcgaggaggaagaagaggcagagggcggtagaaacagttttgaggagaatcctgatttcgaagggattcaagtgatcgatttggtcgaatctctgtctaactgggtccatcacgtgcagcacattctgagccagagatttagaatttatcccccagggcagcatggatatcctcagatcagttttcacaacatgctgcttcagagctttaaccccactttcggactggagcatatgccttccccgatggccaagagtctaaagatctctacgtag

SEQ ID NO: 237824 - DNA, 1536 bp, Artificial Sequence
  Description of Artificial Sequence: Synthetic coding sequence
atgcttgaaataaccattcagaacgcaaaagcttatctgctgaagacatcttctaactcaggctttaatctgtatgatcacctgtcaaacatgctgaccaagatactcaacgagcgccctgagaacgcggtcgatatttttgagaatatatcacaagacgtgaaaatggcccacttctccaaaaaattcgatgcactacagaatgagaatgaactcttgcctacctacgaaattgccgagaaacagaaggcactctttctccagggccatttggaaggcgttgatcaagaactggaggacgagattgccgaaaatgctctgcctaacgtaatggaatcagctttttacttcgaacaagcgggagtgggcctcggtactgatgagacttatagaatttttcttgccttaaagcagcttactgatacccatcccatccaaagatgccggttctggggcaaaattctgggcttggaaatgaactatattgtagccgaagtggagttccgggagggtgaggacgaggaagaagtggaggaggaggacgtagctgaggagagagacaacggcgagagcgaagcacacgaggatgaggaggatgagctgcccaaatcgttttacaaggcacctcaagccatccccaaggaagagagccgtacgggagctaacaagtacgtgtactttgtgtgcaacgagccaggacggccttgggtgaagcttccgccagtgatcccggcacagattgtaattgccaggaaaattaaaaagttcttcactgggagactagacgccccaattatatcttacccaccattccctggcaacgaaagtaactatctgagagcacagatcgcccgaatcagtgctggcacacacgtttctccactgggcttttaccagttcggggaggaggagggcgaagaggaagaggaggcagagggcggacggaattcatttgaagagaatcctgattttgagggcatccaggtgattgatctggtcgagagtttgtccaattgggtccatcatgtgcaacacatcctaagtcaggggaggtgtaattggttcaacagcatccagaagaacgaagaagaggaggaggaggaagatgaggaaaaggacgattcggattatatcgagcaggaggtcggactgcctctcctcactccaatttccgaggacctggaaatacaaaatattcccccttggacaacccggttgtcttccaacctgattccccagtacgctatagctgtgctgcagagcaacctttggccaggagcctacgcgttcagcaacgggaaaaaattcgagaatttttatattggatgggggcataagtattcccccgataactatacccctcctgtgccacctccagtataccaagagtaccctagtggccctgaaattaccgagatggatgatccttcagtcgaagaggaacaggctttccgtgccgctcaggaggcagtactgctggctgcagagaatgaggaatcagaagaagacgaggacgaagaggatgattatgactag

SEQ ID NO: 237825 - DNA, 531 bp, Artificial Sequence
  Description of Artificial Sequence: Synthetic coding sequence
atgttagtgaaacgggactaccggtatgaccgggtgctgttttggggaaggatcctgggactggtagcagactattacattgcacaggggctgtcagaagaccagctcgctccccgtaagacactctatagcctgaattgcaccgagtggagtctgctcccgccagctaccgaggaaatggtagcacagagcagcgtggtgaaggggaggttcatgggtgacccttcatacgagtatgagcatactgagctacagaaggtgaacgagggggagaaggtgttcgaagaggaaatcgtcgtccagatcaaggaagagacacgcttggtgagcgtaatagaccagattgacaaagcggtggctattatcccacgcggagcattgtttaagactccttttgggccaactcacgtaaataggacattcgaggggtattacaattggtacaagacccccgcacctcatcccacatgcgatggcaaccaaggagttagggcccgtggccgaagtcctagcttgggaaggttcctgtag

SEQ ID NO: 237826 - DNA, 831 bp, Artificial Sequence
  Description of Artificial Sequence: Synthetic coding sequence
atggacgctgattctctgttgctgtccctcgagctcgccagtggctccggacaaggactgagccccgaccgcagggcctctctcttaacatctttgatgctcgtcaagcgcgactacaggtatgatcgcgttctattttgggggagaatcttgggtctcgtcgcagattattatattgcgcaagggttgtccgaagaccagctggccccacggaaaactctctacagtcttaactgtacagaatggtccctgctaccgcctgccaccgaagagatggtggcccaaagctcggtggtgaagggcagatttatgggcgatccctcatacgagtacgagcatacggagctgcagaaggtcaatgaaggcgagaaagtcttcgaagaggagattgtggtgcaaattaaagaagaaactagactagtgagtgtaattgaccaaatagacaaggccgttgccatcattccccgaggtgcgctgtttaaaacccctttcgggccaacccacgtaaatcggacttttgagggcctgagcctgagtgaggcaaagaagctgtccagttacttccactttcgggagcctgttgagctcaagaacaagacactgctggaaaaggcggatctcgaccctagcctggatttcatggacagcctggagcatgatattcccaaaggtagttggtccatccagatggaacggggtaatgctctcgttgtactgcggtctcttctgtggcccggtttgaccttttaccatgccccaaggaccaagaactacggctacgtgtatgtgggcaccggtgagaaaaacatggacctgcccttcatgttgtag

SEQ ID NO: 237827 - DNA, 921 bp, Artificial Sequence
  Description of Artificial Sequence: Synthetic coding sequence
atggatgctgacagcctcctccttagcttggaactagcctctggttctggacagggactgtcacccgaccggagggcctcattgttgacctccctgatgctggttaaaagggattaccggtacgatagagtgctcttttggggacgcattctcggactggtcgctgattactatatagcccagggattatccgaagatcagcttgccccacgcaaaactttatattccttgaactgcactgagtggtctctgcttccccctgctaccgaagagatggtggcccagagtagtgttgtgaagggacgcttcatgggagatccctcttatgaatacgagcacactgagcttcagaaggttaacgagggagaaaaagtattcgaggaagaaatcgtgatcgataaagccgtcgcaataatccctaggggcgctctatttaagaccccatttggccctacacatgtgaaccgcacgttcgaaggcctctctttgagcgaagcgaaaaagttgtcctcctatttccacttccgggaacctgtcgaactgaagaataaaacactgttggagaaggcggacctcgacccaagccttgattttatggatagcctcgaacacgacatccccaaaggatctgaggctgtggtgcaaggcgattttacctggctgctgtccaggtgtggctttgggtggccttgcagctgggatagctgctctgtcagcatgcgcgtactcgaacacccagacggcgagggtcaatgcccaggcggtgctgcccaacccgctcttgccggaccccatctcctgccctgttctccacatcaggagctgtggctccgcttgcgcggacactggagggaagaacatggcctggcactccacgcaatcgaatgggaaccagcttggatgttcctgaacagagtgtag

SEQ ID NO: 237828 - DNA, 402 bp, Artificial Sequence
  Description of Artificial Sequence: Synthetic coding sequence
taattgaactgtacagaatggtccttgctgccccctgccaccgaagagatggttgctcaatcatccgtcgtgaaagggcgtttcatgggcgatcccagctacgagtatgagcacactgagctccaaaaggtcaacgagggggaaaaagtgttcgaggaagaaattgtagtgcaaataaaagaagaaacacggctagttagtgtcattgaccagatcgacaaggcagtggctataattcctaggggcgcactctttaaaacaccttttggaccgacgcacgtcaatcgcaccttcgaaggatattacaattggtataagacacctgcaccccatcctacttgtgacggaaaccagggcgttagggcccgaggtagatcacccagccttgggaggtttttatag

SEQ ID NO: 237829 - DNA, 1086 bp, Artificial Sequence
  Description of Artificial Sequence: Synthetic coding sequence
atgtgggtcctgactcctgcagcgttcgccggaaagctgctgtccgtgtttcggcagccactttcatctctgtggagatctctcgtgccactgttttgttggctaagggccacgttctggctgctggccactaaaaggcgcaaacagcagctggtactgagaggccctgacgaaacgaaagaggaagaggaggaccctccactccccaccacacccaccagtgtgaactaccacttcacccggcagtgcaattataaatgcgggttttgtttccacacagccaagacttcatttgttctgccgctggaggaagctaagaggggtctgctcttgctgaaagaggccggaatggaaaaaatcaacttctctggaggcgagcctttcctgcaggatcgaggcgaatatttagggaaactcgtgcgattttgcaaggttgagctgagactgcctagcgtttcaattgtttcaaacggttcattaatccgggagcgatggtttcagaattacggagaatacctcgacatccttgccatctcatgtgattctttcgacgaggaggtgaatgtgctgatcggcaggggccagggaaaaaaaaaccacgtcgagaatctgcagaagcttcgaaggtggtgtagagactatagggtcgcgtttaagatcaactcggttatcaataggtttaatgtggaggaggatatgacagaacaaattaaggcacttaaccctgtgagatggaaggtgtttcaatgcctgctcatagaaggagagaactgtggcgaggatgcactgcgggaagcagagcgattcgtgatcggtgatgaagaattcgagcgatttctggagaggcacaaagaggtaagctgcctcgttcctgagagtaaccagaagatgaaggactcctacctgatcctggacgaatatatgcgcttcctgaattgtcggaagggcaggaaagatcccagcaagtccatcttagacgtgggggtggaggaagccattaagttttcaggttttgacgagaagatgttcctgaaacgcggaggaaagtacatatggagcaaggctgacctgaaactcgactggtag

SEQ ID NO: 237830 - DNA, 765 bp, Artificial Sequence
  Description of Artificial Sequence: Synthetic coding sequence
atgctccactcttcccattaccccggaatggagaagattaatttttctggcggtgagccgttcctgcaggatcgtggcgagtacctggggaagcttgtccgcttttgtaaagtggaactgcggctccctagcgtttctattgtaagcaatggcagcctaattagagaacgctggttccagaactacggggagtatttggatatcctggccatctcctgcgacagtttcgatgaggaagtaaacgtcctgattggccgaggacagggcaaaaagaatcacgtggagaatttgcagaagctacggaggtggtgtcgtgactaccgggtggccttcaaaatcaactccgtgataaatagatttaacgttgaggaggacatgacggagcaaatcaaggctctgaatccggtcaggtggaaggtctttcagtgcttgttgattgaaggagagaactgcggcgaggacgccctgagggaagcagagcgcttcgtaatcggcgatgaagaatttgaacgattcctggagcggcacaaggaggtcagctgcctcgtccccgaatccaatcagaagatgaaggatagctacctgattctggatgagtatatgagatttttgaattgccgaaagggcagaaaagatcctagtaagtcaattttagacgtgggagtagaggaggctattaaatttagtggcttcgacgagaaaatgtttcttaagcggggagggaaatacatatggagcaaagcagatctcaagctggattggtag

SEQ ID NO: 237831 - DNA, 1674 bp, Artificial Sequence
  Description of Artificial Sequence: Synthetic coding sequence
atgtataaacgtaacgggctaatggccagtgtgctcgttacctctgcaactcctcagggctcctcctcttccgacagcctggaggggcaatcttgcgactatgcctctaaatcctatgatgctgtggtatttgatgtcttgaaagtgacgcctgaggaatttgcttcacagataacgttgatggatatcccagtgtttaaggccatccagccggaggaacttgctagttgtggctggtcaaagaaggagaagcattctctagcgccaaacgtggtcgcttttaccaggcgcttcaaccaagtgtccttttgggtggtccgtgaaatcctgaccgcgcagacactaaagattcgggcagagattctgagtcacttcgtcaagatcgcaaagaagctgctggaactgaataatctacatagtctgatgagcgtcgtgtcagcccttcagagcgcccctattttcagactgacgaagacttgggccctgttaaacaggaaggacaagactaccttcgagaaactggattatctgatgtctaaggaggataactataagcgcaccagagaatacattcggtccctgaagatggtgccatccatcccatacctcggaatttatctactggacctcatttacattgattccgcttatccggcttccggtagtataatggaaaatgaacagcgcagtaatcaaatgaacaatatcctccgaatcatagccgatttgcaagtttcctgctcgtacgatcatctgacgacactcccgcacgtacagaaatatctgaagagcgtgaggtacatcgaggagcttcagaagtttgtggaggatgacaactacaaattgtccttgcgtatcgaacccggaagctcgagcccacggctggtgtcatcaaaggaggacctggctggcccttctgctggctcagggtctgcacgattctcacgcagacccacctgccccgacaccagtgtggctgggtcactcccaacaccgcctgtgccacggcacagaaagtctcatagtctaggcaacaacatgatgtgtcagttgtctgtcgtggagtccaaatcagctacctttccttccgaaaaagccaggcatctgctcgatgactcggtgctggagtccagaagcccgaggagggggctggccctcacttctagctccgccgtgaccaatggactgagcctgggctcttctgaaagctctgagttcagtgaagaaatgtccagtggactggagagccctaccggtccatgcatttgctcactaggtaattcagccgctgtgccaacgatggaaggcccactccgccgaaaaaccctcctcaaggagggcagaaaacctgctcttagtagctggacccggtactgggtaatcctgagcggctccacactcctctattatggagccaaatctctcagaggtacagatagaaagcattacaagtccacaccaggaaaaaaggtgtcaatagtagggtggatggtacaactgcccgatgacccggaacatccggatatctttcagcttaataatcccgataagggcaatgtatataaatttcaaaccggtagtcggttccacgctatcctgtggcataagcacctggatgacgcgtgtaaatcaaacagacctcaggtccccgctaatcttatgtccttcgagtag

SEQ ID NO: 237832 - DNA, 522 bp, Artificial Sequence
  Description of Artificial Sequence: Synthetic coding sequence
atgtacaaacgcaacggactgatggcctcggtactggtcacatcggctacgccgcagggatcctcctcttctgatagtcttgaaggacaatcctgcgactatgctagcaaaagttatgatgccgtcgtgttcgacgtcctcaaggtgacaccagaagagtttgccagccagattaccctgatggatattccggtgttcaaagccattcaacccgaagaactggcttcttgtggatggtccaaaaaagaaaagcactccttggccccaaacgtggttgcgttcactagaaggttcaaccagaaactgctggaactgaacaatctccacagtctgatgtcagttgtgagcgccctgcagagcgccccaattttcaggctcacaaaaacctgggccttgctgaatcggaaagataagacaaccttcgaaaaattggattatttaatgagtaaagaggacaactataaacgtacccgcgagtatatccgcagccttaaaatggtgccaagcatcccctacctatag

SEQ ID NO: 237833 - DNA, 1590 bp, Artificial Sequence
  Description of Artificial Sequence: Synthetic coding sequence
atgtacaagcgtaatggcctgatggcctctgtgctggtgaccagcgcaacccctcagggttccagcagtagcgactctctcgaaggtcagtcctgcgattatgcttctaaaagctatgatgccgtagttttcgacgtgcttaaggttacaccagaagagtttgccagccagattacccttatggacatcccagtgttcaaggccatccagcctgaggaactcgcgtcctgtggatggtctaagaaggagaagcactctctggcccctaatgtggttgctttcacaaggaggttcaaccaagtgagcttttgggttgtgcgagaaattctgacagcgcagaccctcaaaatacgcgcagagattctttcacacttcgtcaaaatcgccaaaaaactgctggagttaaacaacctgcatagtttgatgtctgttgtgtccgcactgcagtctgctcccatctttcgcttgaccaaaacttgggccctgctgaatcgaaaagacaagaccacctttgagaagttagattacctgatgagcaaggaggataattataagcggactcgtgaatatatacggtctttaaagatggtgccgtccattccctacctgggtatctacctgctggacctgatatatattgatagcgcatatccggcatctggctccatcatggaaaatgagcagcggtcaaaccaaatgaataacatccttaggattatcgccgatctgcaggtgagttgtagctacgaccacttgacgaccctcccccatgttcagaagtaccttaagtctgtgaggtacattgaagagctccagaaattcgtagaagatgataactataagctgtcacttcgcattgagccaggtagctcctctcccaggctcgtcagcagtaaagaggacctggccggacctagcgcgggttccggctcagccagattcagtcggagaccaacttgtcctgacactagcgtggcaggatcactcccaaccccacccgtccccagacaccgcaaaagccactccctcggaaacaaccgcggtcgattatacgccactcttgggccaaactggcgggtgcctgtgcggaattcacccaggaccaggagttgcgtatattccccgacgggtccttgtatatgtagcctcgggaacagcgcagcggtaccaaccatggaagggcctctgagaagaaagaccctgctcaaagaggggagaaaaccagctctctccagctggacccgatattgggtgatcctaagtggatctactctgctgtactacggcgcaaagtctctcagggggacagaccggaaacacgtgtccatcgtgggctggatggtgcagctgcctgatgatcccgaacacccagacattttccagctcaacaacccggacaaggggaacgtgtataaattccagacaggctctcggtttcacgccatactttggcacaagcatcttgacgatgcttgcaaatctaatcgcccacaggaagctggagctgctccgggaccaacaggtacggactcccatgaagtcgaccacttggagggcggagccggtaaagaggccggtccttgtgcctag

SEQ ID NO: 237834 - DNA, 918 bp, Artificial Sequence
  Description of Artificial Sequence: Synthetic coding sequence
atgtataaacgcaacggcctcatggcctcagtccttgtgacatccgctaccccccagggctccagctccagcgactcgctagaaggacagagctgtgactatgcatctaagtcttacgacgctgttgtgttcgacgtgctcaaagttacacctgaggagttcgcctcccagatcacgttaatggacatacccgtcttcaaagccatacagccagaggaactggcttcttgtggatggtccaaaaaggagaaacattccctcgctcctaacgtggtggccttcacccggagatttaaccaggtgtccttttgggtggtacgagagatcttgaccgctcagacactgaagattcgggctgagatcctctctcacttcgtgaaaatcgcaaagaagctattagagctgaacaacctgcactcactaatgtccgtggttagtgctctgcagtctgctcccatttttcgtctcacaaagacctgggctttacttaatcggaaggataaaactactttcgagaagctggactatctgatgtctaaagaagacaattataaaaggactagagaatacattcgaagcctcaaaatggtgccaagcattccttacctgggaatctacttgctcgatctaatctacattgactccgcttaccccgctagtggaagtattatggaaaatgaacaacggtctaaccagatgaacaatatcttaagaatcattgcggatttacaagtcagctgcagctatgatcatttaactaccctaccccacgtgcagaaatatttaaaaagtgtgcggtacattgaggaattgcagaagtttgtagaagacgacaattataagctctccttaaggatcgagccaggcagtagctcaccacggctcgtgagctcaaaagaggacttggctgctatgtag

SEQ ID NO: 237835 - DNA, 642 bp, Artificial Sequence
  Description of Artificial Sequence: Synthetic coding sequence
atgtataagcggaacggtctgatggccagtgtactggtgacaagcgctacccctcaggggagcagtagcagcgattctttggaggggcagagttgcgattatgcttccaagtcgtatgatgcggtggttttcgacgtattaaaagtgacacccgaggagttcgcatcccagatcaccttgatggacattcccgtgttcaaggccattcagccagaagaactcgccagttgcggctggagtaaaaaagaaaagcactcacttgcgcctaatgtggtagcatttacccggaggttcaatcaagtgtctttctgggtagtaagagaaattctgacagcacaaaccctaaaaattcgagcggaaattctatctcacttcgtcaaaattgctaaaaagctattggagctgaataacctccattcattaatgtccgtggtgtcggcactgcagtctgctcctatcttccggctgactaaaacctgggccttactgaatcgaaaagataaaactacttttgaaaagctcgactacctgatgtctaaggaagacaattacaagaggacgcgggaatacatcaggtccctcaaaatggtcccatcgatcccttatctggggagatcattgaattggctcattttcttctag

SEQ ID NO: 237836 - DNA, 327 bp, Artificial Sequence
  Description of Artificial Sequence: Synthetic coding sequence
atgtataagcggaatggtttaatggcatccgtgcttgtaacatccgccaccccacaaggctctagcagcagcgattctcttgaggggcagagctgcgactacgcttcaaaatcctatgacgctgtcgtgtttgacgttctgaaagtaacccctgaagagttcgctagccagatcactttgatggacatccccgttttcaaagccatccagccagaaaagggctggccagcaagaatggaagacagtctgcagaaatcaactgttagcagcagaccacatgatacattgcaattcaggaaaactctgcccgtggggcctgggacctag

SEQ ID NO: 237837 - DNA, 1155 bp, Artificial Sequence
  Description of Artificial Sequence: Synthetic coding sequence
atgtataaacgaaacggcttaatggcatctgtacttgtcacgtccgcaactccgcaggggtcatcatctagtgacagtttagagggacagagttgcgattacgccagcaaatcttacgatgcagtggtgtttgatgttttgaaggttacgcccgaagagttcgcaagtcaaattaccttgatggatatacctgttttcaaagccatccagcctgaagagcttgcatcctgtggatggagcaagaaggaaaagcacagtctcgcacccaatgtggtcgcattcacccgaagatttaaccaggtcagtttttgggtggtgcgggagattctgaccgcccagacattaaagattcgcgcagagatcctgtcgcatttcgttaagattgctaagaagttgctggaactgaataatctccatagtcttatgagtgtcgtgtccgcactgcagagtgcccctatatttcggttaacaaagacctgggcgctcttaaaccgcaaagacaaaacaacctttgagaaactcgattatctgatgagcaaggaggacaactataaacgcactagagaatacattagatcgctgaaaatggtcccctctattccctacttgggcatctacctgctggatctcatttacatcgatagcgcttacccggcttctggcagtattatggaaaatgaacagaggtccaaccaaatgaacaatattttacgcattatcgcggatttgcaggtgagctgcagctacgatcatctgacgacacttccccatgtccaaaaatacctgaagagcgtcagatatattgaggaattgcagaagtttgtcgaggatgataattacaagttgagcctgcgcatcgagcccggttcaagcagtccgagactagtctccagtaaggaggacttagctgtttcccatttgagctccctgtcccaccagggccaggcagaagaggcacggctgaaaccaacttcaggacagcaccctgcttggatgtggcccagcagttcgcgcgtgcccgcagctcctccggctagcgctgctccccgttctccctggccccgaaacttgcgcaatgaccagggtcagcccggtgccgttgccttaacctgcaatcctagcacactgggaagtcggtcacgccgaataacatag

SEQ ID NO: 237838 - DNA, 1614 bp, Artificial Sequence
  Description of Artificial Sequence: Synthetic coding sequence
atgtacaagcgtaacggcctcatggcatccgtcctggtgacctctgccactcctcagggctctagtagttccgacagcctggagggtcagtcctgtgactacgccagtaagtcgtatgacgcggtcgtatttgacgtgttgaaggtgacccccgaagagtttgcctctcagattacactgatggatatccccgtatttaaggctatacagcctgaggagttagcttcctgcggctggagtaaaaaagagaagcattctctagcacctaatgtcgtggctttcacgagaagatttaatcaggtgtccttttgggttgtgcgagagattctcacagcacagaccctgaagatcagagccgagattttgagccactttgtcaagatcgcaaagaagctcctggaacttaacaatctgcactccctgatgtctgtcgtctctgcactccagagcgccccaatctttcggctgaccaagacatgggccttgcttaatcgcaaagacaagaccacctttgagaagctcgactacttgatgtctaaggaggacaattacaaacgtacacgagaatatattcgctctctgaaaatggtaccatcaattccctacctggggatatacctcctcgacctcatttacattgactcggcctatcccgcttccggatccattatggaaaatgagcagcgaagtaaccaaatgaataatattctcaggataattgcagacttacaagtctcgtgcagctacgaccacctcacaacgcttccccatgtgcaaaaatatctgaaatcagtgcgttatatcgaagagcttcaaaagttcgtagaagacgacaactacaaactgtctctcagaattgagcccggatcatcgagccctaggcttgtgagctctaaggaagacctagctggcccttccgccggatctggctcggccagattctcacggagaccgacttgccccgacacctctgtggccggtagcctacccacaccacccgtgccccgtcacagaaagagtcactcacttggcaacaacaggggaagactctatgccacgctcggaccaaattggcgagtgccagtcaggaacagtccccgaacaaggtcttgcgtatacagcccaaccgggccttgcatttgctccctaggtaactccgccgctgtccccacaatggaggggccactgagacggaagactctgcttaaggaaggcaggaagcccgcactgagctcatggacaagatactgggtgatcctgtccggctctacacttttgtactacggcgctaagagcctcaggggtacagatcgcaagcactacaaaagcacccctggtaaaaaagtcagcatcgtcggctggatggtgcagttgcctgacgatcccgagcatcccgatatttttcagcttaacaacccagataagggaaatgtttacaagtttcagaccgggagtagattccacgctattctgtggcacaagcatctcgacgatgcttgcaaatctaatcgtccacaggaagctggagccgcaccagggcctactggaactgattcccacgaagtggaccatctggagggcggagcagggaaagaggccggaccatgcgcctag

SEQ ID NO: 237839 - DNA, 462 bp, Artificial Sequence
  Description of Artificial Sequence: Synthetic coding sequence
tagaactcaccccgaactcgctcctgtgtgtactctccaaccggcccttgtatatgtagtctcgggaactccgcggctgtacccactatggaaggacctctgaggcggaaaacgttgttgaaggaggggaggaagcccgctttatcttcttggacccggtactgggtgatcttatctggttctactctgctgtattatggcgctaaatctctgcgcggtactgacagaaagcactacaaaagtacccccggtaagaaggtgagcatcgtgggctggatggtacagctgccggacgaccccgaacaccctgacatcttccagctgaataatcctgataaggggaacgtttacaaatttcagacaggctcacggtttcacgctattctgtggcacaagcacttggacgatgcctgtaaatcaaaccggccacaagtacccgctaatctaatgtcgttcgagtag

SEQ ID NO: 237840 - DNA, 6252 bp, Artificial Sequence
  Description of Artificial Sequence: Synthetic coding sequence
atgtttagtaagaagcctcatggagacgtgaaaaagtccactcagaaggtcttggatactaagaaggatgctctgacaaggctcaagcacctgcggattgtgattgagaacgccgagtcaatagatctcaagcagttctttgaccagcattttagccacatctactacgtgtttttcgagaatttcgttaccatcgaggcgagtttgaagcaaaaagggcacaagagccagcgtgaagagctcgacgctatactgttcatctttgaaaagatcttacagcttttgccagagcgcatccaccagcgatggcagttccatagtattggactgatcctgaagaaactactgcacaccggtaattccctgaagattcggcgagagggagtgcgcttgtttcttctgtggcttcaagccttgcaaaacaactgctctaaggaacagctctggatgttctcatgtttgattccaggtttctcagcgccacagagcgagcacggcccacgcacactagataacttgattaatcctcctctcaatctgcaggagacccaggttactatcgaagagattacaccactggtgccccctcaatccggcgacaaaggacaagaagacctgaccagctatttcctggaggctctgctgaaatatattgtcattcaggtgaagtctctggagtggaagaacaaggagaaccaggagcggggatttagcttcctcttcagccactttaagaagtactatctcccgtatatcttccccaacatctgtaaggaaaactccctttatcatccaatcctcgatatcccgcagatgagaccgaaaccacattatgtggtaatcaagaaagatgccgagaccaacgaggctatttattgcaccaaggaaccctttatcaaggcacgcgtgattgtgatcaggtggttggtgtccttttggctcgagcccaaaccccacacaggcccacacatcccagggatggaaggcgaagtgttgccaaaaaacatccagcgcgctgccgctagtctcgtgtccagagaagagagcaaaaatgataacgctgataagacagacagaactacggagccagaacagtcgcattccaacacatctacgttgaccgaacgggagccttcttctagtagtttgtgtagcattgatgaagaacacctcactgacatcgaaattgtcagaagggtatttagttcaaagcgcagcaatgtgaactttgtgacagagatcttccgtcaagctttcctgctgcctatctgcgaggccgcagccatgcggaaagtagtgaaagtataccaggaatggattcagcaggaggagaaacctctgtttatgcaggagccagaagagattgttatcacttctagcgaccttccatgcattgagaatgtgactgaccacgacatctcaatggaagaaggagagaaacgggaggaggagaacgggaccaatacggcagatcacgttagaaactcctcctgggctaaaaacggttcataccagggtgcactacataacgcctccgaggaagcaactgaacagaacattcgagccggaacacaggcggtgctgcaggtgtttataattaacagcagtaacattttcttgcttgagcccgcaaacgagattaagaacctccttgatgagcataccgatatgtgtaaacgcatcctgaacatctatagatacatggttgtgcaggtttcaatggataagaagacgtgggagcaaatgctgctggtcctgttgagagtgaccgaatcagtccttaagatgccctctcaagcctttctgcaattccagggcaagaagaatatgacgctcgcaggcaggctggcagggccacttttccagacactgatagtggcctggatcaaagcgaacctgaacgtttacatctcacgcgaactttgggacgatctactcagcgtcctgagttctctgacttattgggaagagcttgcaaccgagtggagtctcactatggaaacactcactaaggtcctggctcgcaatttgtacagtctggacttatctgatctccccctggataagctgtcagagcaaaaacaaaagaagcacaagggaaagggggtgggtcatgaattccagaaagtgagtgtcgataaatccttcagcagggggtggtccagggatcagcccggtcaggcgccaatgcgccagaggagtgccaccaccactggaagccccggaacagagaaggccaggtccatcgtgcggcagaagacggttgctatgcgcagccgtagcatcggggagtgtgctctcccctccgcctacatccgcagcgctaaatccgcgccagtgctgattcacaccagtaagccatttttgccagacatagtccttactcccctgtctgatgaactgtccgatattgacgatgcacagatcctgccaaggagtactcgcgtgcggcatttctcacaatcagaagaaacgggcaatgaggtgtttggagccctcaatgaggaacaacccttgccacggtcatcaagcacatccgatatcctggagccatttaccgtggagcgtgctaaggttaacaaggaggacatgagccagaagctgcctccccttaactccgacattggcggatcgtctgccaacgtgcccgatttgatggacgaattcatcgccgaacgactcagaagcggaaatgcatctaccatgactcgaaggggatcctctccgggatctctggagatcccaaaagacctgccagacatccttaataaacagaatcagatgcgccctatcgacgaccccggagttccttctgagtggacctcgcccgcatctgccggttcctccgacttgattagctccgattcccatagtgattctttttcagcttttcagtacgatggacgaaaatttgacaacttcggattcggaactgacactggtgtgacctcgagcgccgatgtggactcaggaagcggtcatcatcagtctgctgaggagcaggaagttgcaagcctgaccacactccatatagattctgaaacttcgtccctgaatcaacaggctttctctgccgaggtggcgaccatcaccggcagtgagagcgcatcgcccgtgcacagtcctctgggatcacggtcgcaaaccccctcaccctccactctcaatattgaccatatggagcagaaggacctgcagctggatgagaaattgcatcattcagtgctgcaaactcccgacgatctcgagatctcagaattccctagtgagtgttgttcagtcatggccggagggacactgacaggctggcatgcggatgtcgctaccgtaatgtggagaaggatgctcggcattctcggggacgtgaattctataatggaccctgaaatccacgctcaggtgttcgactatctgtgcgaactctggcaaaacctcgcaaagattagggacaatctgggcatctcaacagacaacttaacctccccttcacctcctgttctgattcccccattgcggatcctcacaccatggctgttcaaggcgaccatgctcaccgataagtataagcaaggtaaactgcacgcctacaaactaatttgcaatactatgaagcgaaggcaggatgtgtctccaaacagggacttcctgacacacttttacaatataatgcactgcggtcttctccacattgaccaggacattgtaaatactatcattaagcactgctcgccccagttctttagcctgggactgccaggcgctacaatgctgataatggacttcattgttgctgccggaagagtggcaagttccgcattccttaacgctccgagggtggaggctcaggtgctgctgggcagtctcgtgtgtttcccaaatctgtactgcgagttgccgtctctccatcccaatataccagacgtggccgtgagtcagtttactgacgtaaaggagcttattatcaaaacagtgctgtcatcagcgagggatgagccctcggggccagcaaggtgtgtggccctgtgcagtctggggatttggatatgcgaggagcttgtccacgagtcacatcacccacaaataaaggaggctctcaatgttatttgtgtgagcttgaagtttactaacaagaccgtagctcatgtggcctgcaatatgttgcatatgttagtgcactatgtgccaaggcttcagatctaccagcctgactcaccactgaaaattattcagatcttgatcgccacgattacacatctgctgcccagcaccgaggcaagcagctacgaaatggacaagaggttagttgtttcgttactcctctgcctcctggactggatcatggcattgccgctcaagactttgctccagccatttcatgctacgggagccgaatctgacaaaacagaaaaatctgttcttaactgtatctacaaggtgctacacgggtgtgtgtacggcgctcagtgtttcagcaacccgaggtactttcctatgtctctcagtgacttggcctccgtggactatgaccctttcatgcaccttgaatccctcaaggagcccgagcccctgcactcgcctgacagtgagcggagtagtaagcttcagcccgtaactgaagtgaagacccagatgcagcatgggctcattagtattgccgcaagaacagttataacacatctggtgaatcacctgggacattatcctatgtccggaggacccgcaatgctgaccagccaggtctgcgagaaccatgacaatcattatagtgagtctacagaattgtcccccgagctgtttgaatctccgaacattcagtttttcgtattaaacaacactacattagtgtcatgtattcagatccggtccgaagagaatatgccaggaggtggcctttcggctggattagcatccgcaaattcgaacgtgaggataatagtgagagacctgagcggaaagtactcctgggattccgctattctgtacgggcctccaccagtttcaggactctctgaaccaacgagctttatgctgtcactttcccaccaagagaaaccagaagagcctcccacttctaatgaatgtctcgaggatatcaccgtcaaggatggcctctctctccagtttaaaagattccgggagactgtcccaacatgggacaccatacgtgacgaagaggatgtcctggacgaactcctgcagtacttaggtgtgacctcacccgagtgcctccagagaaccgggatctctctaaatatcccagccccacagcccgtctgcatctccgagaaacaagaaaatgacgtgattaatgccattttaaaacagcataccgaggaaaaagagttcgtagagaagcacttcaacgatctgaatatgaaggccgttgagcaggatgagcctataccacagaaaccgcagtccgccttctactactgtagactcttgttatccatcctgggcatgaattcatgggacaagaggaggtccttccaccttctgaagaaaaacgagaagttgttaagagagctgagaaatctcgactcacgacagtgtagggagacgcacaaaatagcggttttctacgtggcagagggccaggaagataagcattccatcctcaccaacaccgggggaagtcaggcatacgaagatttcgtcgcaggtcttgggtgggaagtcaacctcaccaaccactgcggattcatgggtggccttcagaaaaataaatcgactggactgaccactccatacttcgcaacttcaacagtcgaagtcatcttccatgtgagcacccgtatgccctccgattcagacgactcccttacaaaaaagctgagacacctgggaaacgacgaagtccatatcgtgtggagtgaacacaccagagactatcgcagaggtattatccccacggagttcggagatgtgcttatcgtgatctaccctatgaagaatcacatgttctctatccagatcatgaaaaaacctgaggtgcccttcttcggtccactcttcgacggggctattgttaatggtaaggtgttgccgattatggtgcgggcaacggctatcaacgcctctcgggcattgaaaagtctgattccgttgtaccagaacttctatgaggaaagggctaggtatctgcagactatcgtgcagcatcatctagaaccaactaccttcgaggattttgcagctcaggtgttttccccagctccctaccaccatcttccgtccgacgcagaccactac

SEQ ID NO: 237841 - DNA, 6252 bp, Artificial Sequence
  Description of Artificial Sequence: Synthetic coding sequence
atgttctccaagaagcctcatggagatgtaaagaaatctacccaaaaagtgctcgatacaaaaaaggacgctctgacccggctaaagcacctaagaatcgtcatcgagaacgcagagagtatagacttaaaacagttttttgatcagcacttctcgcacatctactacgtgttcttcgagaatttcgtgactatcgaagcctctcttaaacagaagggacataagagtcagcgggaagagctggatgcaatactgtttatattcgagaaaattctccagttgctccccgagagaatccaccaacgctggcagttccacagcattggacttatcctgaaaaaacttctgcatactggaaactctctcaaaatccgcagggagggggtgcgcctgttcttgctgtggctccaggccctgcagaacaactgcagcaaagagcagctgtggatgttcagctgtttaatccctgggttctctgcgcctcaatccgaacacgggcctagaacccttgataacctcatcaatcctcccttaaatttacaagagactcaggtgacaattgaagagattactccactggtccccccacagtcgggtgataaggggcaagaagacttaactagttattttctggaagcactcctgaagtacatcgttattcaggttaaatctctggagtggaaaaacaaggaaaatcaagagcgtggcttttcatttctgttctcccatttcaaaaagtattacctgccatatatcttccctaacatttgcaaggaaaattccctgtaccaccctatactagatatccctcaaatgagacccaaaccccattatgtggtgattaaaaaagacgccgagaccaatgaggctatctactgcaccaaagaaccttttataaaggcgcgagttatcgttatacgatggcttgtgtccttctggctcgaacccaaaccccacactggcccacacatccccggaatggagggtgaggtgctgcccaaaaatatccaacgcgcagcggcttccctcgtttcccgggaggagtccaagaacgacaacgctgacaagaccgaccgaacaaccgagcccgagcagtctcatagtaacactagtacactgacggaacgggagcccagtagctccagcctctgctccatcgatgaggagcatctgacagacatagaaatcgtgaggcgggtgttctcttcaaagcgcagcaatgtgaacttcgtcactgaaatctttcgccaggctttcctgcttcccatttgcgaggctgcagctatgcgaaaggtcgttaaggtgtatcaggagtggatccaacaggaggagaaaccattgtttatgcaagagccagaagagatagtgattacgagcagcgatctgccctgtatcgagaacgttactgaccatgatatcagtatggaagagggggaaaagcgggaagaagaaaacgggaccaacacagcagatcacgtccgcaatagctcatgggccaagaatggcagctaccaaggcgcactgcacaacgctagcgaggaagccacggagcagaacatacgtgccggtacacaggccgtcctccaggtcttcatcattaactcctctaatatttttctgttggagccagcaaatgaaatcaaaaatcttctggacgaacacacagatatgtgtaaacgcatactgaatatttaccggtacatggtggtgcaggtgagcatggacaagaaaacttgggagcagatgctcctggttctgctgagggtgaccgaaagcgtgcttaagatgccttcacaggcctttctgcagtttcaaggaaagaaaaatatgactcttgccggaagactggccggtcctctttttcagaccctgatagttgcctggattaaggctaatctgaatgtctatattagccgtgaactctgggatgacctactctccgtgctcagctcactgacttactgggaggaactggctaccgagtggtctttgacaatggagacgctgactaaggttttagctcgcaatttgtactcgcttgacctgtcagatttacctctggacaagcttagcgagcagaagcagaaaaaacataagggcaagggagttggacacgagtttcagaaagtgtccgttgataaatcattcagcagaggttggagtagagaccagccgggacaggctcctatgaggcagcgcagcgcaacgacaactgggtcccctgggacagaaaaagccaggtctatagtgaggcagaaaaccgtggacattgacgacgctcagatcctgccaagatctacccgcgtaaggcacttctcccaatctgaggaaactggtaatgaagtattcggagctctcaacgaagagcagcccctccctagatcatctagcacatcagacatcctggaaccatttacagtcgaaagagccaaggtaaataaagaggacatgtctcagaagctgccccctctcaatagcgacatcggagggtctagtgcgaacgtgcctgacctcatggatgagttcattgccgagcgcctccggtccggtaatgccagtacgatgactagacggggaagcagccccggaagcctggagattccaaaggacctccctgatatcctgaacaaacaaaaccagatgaggccaatcgatgaccctggcgttccttccgaatggacttcgccagcatcagccggtagtagcgacctcattagcagcgatagtcactcggactccttcagtgctttccagtacgatggaaggaaatttgacaacttcgggttcggcacggatactggagtaactagcagtgctgacgtagactccggcagcggacaccaccagtcggccgaagaacaggaggtggcttccctcacgacactgcacattgactctgagacgtcctctctgaatcagcaggccttctctgccgaggtcgccacgattactggttcggaatcagcttctcctgtgcactcgcctctgggttccaggagccaaaccccatccccatccacactcaacatcgatcacatggaacagaaggatcttcagcttgacgaaaagctgcaccactctgttctccaaacgcccgacgacctggagatctccgagttcccatccgaatgttgttctgttatggcagggggaacactgaccggctggcatgctgacgttgccaccgtcatgtggcggaggatgttgggaatcttaggcgatgtgaactctatcatggatcccgagattcatgctcaagttttcgactacctctgtgagctgtggcagaacctggccaagatccgcgataacctggggatcagtactgacaaccttaccagtccttcaccgccagtgcttatccccccactgagaatcctgacaccatggcttttcaaagcgaccatgcttactgacaaatacaaacaagggaagcttcatgcttataagctgatctgcaacaccatgaaaaggagacaggacgtcagtcccaatcgggatttcctgactcacttctataatataatgcattgtgggctcctgcatatcgaccaagacatcgttaacaccatcatcaagcactgctcccctcagtttttctccttgggtctgcctggcgcaaccatgctcatcatggacttcatcgtcgcagctggccgagtggccagcagcgcatttctgaatgcacccagggtggaggcgcaagtgcttctaggctccctggtgtgctttccaaacttgtactgtgagttgccctcgctgcatccaaatataccagacgttgcagttagtcagttcaccgacgttaaggagctgattataaaaactgtgctgagctcagcgagggacgaaccctccggccctgccagatgtgtggcactctgcagtttagggatttggatttgcgaagaattagttcacgagtctcatcatccacaaattaaggaggccctgaatgtaatttgtgtctctctgaaattcaccaacaagacagttgcacatgtggcatgcaatatgcttcacatgctcgtacactacgtgcctcggctgcagatttaccagcccgattcccccctgaaaatcatccagatattgatcgctaccatcactcacctgctcccctctactgaggccagttcttatgagatggataaaagactggtggtgtcactcttactctgcctgttagactggatcatggctctacccttgaaaacactgctgcagcctttccatgctaccggggctgagtcggacaaaacagaaaaatcggtgctgaattgtatatataaagttctccacggctgcgtatatggcgctcagtgcttctctaaccccaggtatttcccgatgtccttaagcgacctggcctcagtggactatgacccttttatgcacctagagtcactcaaagaacccgaaccgctgcacagtccagacagcgaacggagctccaaattgcaaccagtgaccgaggtgaaaacccaaatgcagcacggcctcatttctatcgccgctagaaccgtgatcacccacctagttaaccacctaggacattacccaatgtccggcggtccagccatgcttacctctcaggtgtgcgaaaaccacgataatcattatagtgagagtactgaactgtctcccgaacttttcgagtcgcctaatatccagtttttcgtactcaataacacaacactcgtgtcgtgtattcagatccggtctgaggaaaatatgcccggtggcggtctctcagccggactggcatccgccaattcaaacgtgagaatcattgttagagacctgagcggcaagtattcttgggatagcgcaatcctatacggtcccccaccggtgtctggactttcggaacccacatcatttatgttatccctatcacatcaggagaagcctgaagaacctccaacgtccaacgagtgtctggaagacatcacagtgaaagacgggttgagcctgcagttcaagaggtttagagagactgtgccaacatgggataccattcgtgacgaggaggacgtcttggatgagctgcttcaatacctcggggttacttcccctgaatgcctccagcggactggcatctctctcaacattcctgcccctcagcctgtctgcatcagcgagaaacaggagaacgatgtgatcaatgccatacttaagcagcacacagaagagaaggaatttgtggagaaacacttcaatgatctcaacatgaaggccgtcgagcaggacgaacccatcccccaaaagccccaatccgctttctactactgtaggctgttgctgtcgattctgggcatgaactcgtgggacaaaaggcgaagcttccacctccttaagaagaacgaaaaacttttgagggaactgcggaacttagattctagacagtgccgggagacccataagattgcagtcttctatgtggccgagggacaggaagacaaacactcaatccttacgaataccggcggtagccaagcatatgaggattttgtcgcgggacttggctgggaggtgaatttaactaatcactgcgggttcatgggcggtctgcagaaaaacaagtctactggattaactaccccctacttcgctacgtctaccgtggaggtcatctttcacgtatctacaagaatgccctctgattctgacgatagcttgactaagaagctgcgacatctcgggaatgatgaagttcacattgtatggtcagagcacacaagagattataggcgaggcattattccaactgagttcggcgatgtgctgatagttatttatcccatgaaaaatcacatgttcagcatccagattatgaaaaagcccgaggtaccatttttcggccctttgttcgacggcgctatcgtgaacggaaaggtactccctatcatggtgagggccacagcaataaatgcttctagagccttaaagagcctcatcccactgtatcaaaatttctacgaggagagggccaggtacctgcagacaattgtccagcaccatctcgagccgactacctttgaggattttgctgcccaggtattctctcccgcaccataccaccatcttcctagtgatgccggtagctatccagagatattgccaagcgagactccaactgcaacccaggtggatggcgctgatctggcatccccaatgtcacctaggacctctaagtcccgtatgtctatgaaacttcggagatccagtggcagcgccaataaatcctag

SEQ ID NO: 237842 - DNA, 6221 bp, Artificial Sequence
  Description of Artificial Sequence: Synthetic coding sequence
atgttcagcaagaaaccccacggcgacgtgaagaagtcaacccaaaaagtcctggatacaaagaaggatgctctcacaagattgaaacacttgagaatcgtaatcgaaaacgccgaatctatagacctaaaacaattcttcgaccagcactttagccatatctattacgtgtttttcgagaatttcgtgacgatagaagccagtctgaaacaaaagggtcacaaaagtcaacgggaagagcttgatgcaatcctgttcatatttgagaaaatccttcaactcttgcccgaaagaattcaccagagatggcagtttcatagcattggacttattctcaaaaagctgctgcacacaggtaactccctgaagattcgcagggaaggggtgcgactctttctactgtggctgcaggcccttcagaacaactgcagcaaggagcagctatggatgtttagctgtttgattcctgggttttcggctccccaatccgaacacggacctcggacactggacaacctcattaatccacctctgaatctacaggaaacacaggtgactattgaggagattacccctctggtacctcctcagtcgggggataaagggcaggaggacctgacttcttacttcctcgaggccctgctcaaatatatcgtgattcaggtaaagagtctcgaatggaagaacaaggaaaaccaggaacggggattttcttttcttttttcccactttaaaaagtattatctcccctacatcttccctaacatttgtaaggaaaacagcctgtaccacccaatactcgatatccctcagatgcgccctaagccacactacgtggttataaagaaggacgccgagaccaatgaagcaatctactgcactaaggagccattcataaaggccagggtcatcgtcatccgctggctggtttccttttggttggaacccaaacctcatacagggccacacatcccaggtatggagggagaggtcctgccaaagaatattcagagagccgctgcctctctggttagccgcgaggaatccaagaacgacaatgccgacaagaccgaccggaccacggagccagaacaatcccatagcaatacgtccaccttgactgaaagggaacccagctcctcatctctttgtagtatcgatgaggaacatcttacagatattgaaattgtaagaagagttttcagttctaagcgctctaacgttaattttgtgacagaaatctttaggcaggctttccttctgccgatttgcgaagcagctgccatgcgcaaggtggtgaaagtttaccaggagtggatccagcaggaagagaagccactcttcatgcaagaaccagaagagatagtgattacatcttctgacttaccctgtatcgagaacgtgaccgaccacgacatctccatggaggaaggagaaaaacgggaggaggaaaatggaaccaataccgctgatcacgtcaggaatagctcctgggctaagaatggcagctatcagggcgctctccacaacgccagtgaagaagcaacggaacagaacatacgggctgggacccaagccgtcttacaagtgttcattattaactcaagcaatatcttccttctggagccggcaaatgagattaaaaaccttctcgacgagcataccgacatgtgcaagagaatcctgaatatttaccggtacatggtcgtccaagtgagcatggacaagaaaacttgggaacagatgcttctggttctgctgagggtgacggagagtgtgctcaaaatgcccagccaggccttcctgcaatttcagggaaaaaagaacatgacattagctggacggttagcgggacctctcttccagacacttatcgttgcctggattaaagcgaatctcaatgtctatatcagccgtgagctgtgggatgatctcctgtcagtgctgtccagtttaacatactgggaagagctcgccaccgagtggagcctgacaatggaaaccctgacaaaggtgctcgcccgaaatctgtactccctggacctatctgatctcccactcgacaagctgagcgagcagaaacaaaaaaaacacaagggaaagggcgtgggtcacgagttccaaaaagtatctgttgacaagagctttagtcgaggatggtcccgggaccaacctggccaggccccaatgaggcaaaggagcgcaacgacaaccggctctcccggtaccgaaaaggcgaggtcaattgttcgccagaaaactgtcgatatcgatgatgcacagattctcccgaggtcaaccagggtgaggcacttttcccagagtgaggagactgggaacgaggtgtttggggcactgaacgaagaacagccactgccacggtcatcttccacatccgatattctcgagcccttcaccgtggagagggcaaaagtgaacaaggaggacatgagccagaagctccccccactgaattccgacatagggggaagttccgccaatgtccccgaccttatggacgagttcattgctgagcgactgcgctctgggaatgcctccacaatgaccagacgcggtagctcccctggctccctggagatcccgaaagacttgcccgatatcctgaacaagcagaatcagatgagaccgatcgatgaccccggagttccgtccgagtggacatcacccgcaagcgccggatcttccgaccttatctcctcggactcccactctgattcctttagtgcatttcagtatgacggtcggaaatttgataactttggattcggaacagacaccggagttacttcgagcgcagatgtggatagcgggtcaggccaccaccagagtgctgaggagcaggaagtagcttcgctcacaaccctgcatattgactccgagactagctccttgaaccagcaagccttctctgcggaagtagccactatcaccgggagcgaatcggcatccccagtgcattcaccactcggtagcaggtctcagaccccaagcccttcaacccttaatattgatcacatggagcaaaaggatctccagcttgatgaaaaactgcaccactcggtgctgcagaccccagatgacctcgagatctctgagtttccctcagaatgctgttccgtgatggctggcggtaccctgaccgggtggcacgcggacgtggctacagtgatgtggcgacgcatgctgggaatcctgggcgacgttaatagtatcatggatccagaaattcatgcgcaagtgttcgattacttatgtgaactgtggcaaaatttagccaagataagggacaatctgggcatcagcacagacaatctgacctctccttccccacccgtcttgatccccccactacgtattctgaccccgtggctctttaaggccactatgttaacagacaagtataaacaaggtaagctgcatgcatataagctgatttgcaacacaatgaagcgaaggcaggatgtctcacccaatcgggattttctgactcacttctacaacatcatgcactgtggtctgttacacatcgaccaagacatcgttaacaccattatcaagcactgctcccctcagtttttttctctgggtttacccggtgcaactatgctcattatggactttatcgtggcggcaggcagggtggccagcagtgccttcttgaatgcacccagagtggaagcacaggttttgcttgggtcattggtgtgtttccccaatctgtattgtgaactgccaagcctgcatcctaacattcccgatgtcgctgtcagtcaatttacggatgtgaaggaactcattatcaagactgtgctatcgagcgcaagagacgaaccatccggccctgcccgttgcgtagccctctgctccctcggcatttggatttgcgaggagctggttcatgagtctcatcaccctcagatcaaagaggccctgaatgtgatttgtgtttcactgaaattcacaaacaaaaccgtcgcacacgttgcctgcaacatgctgcacatgcttgtgcactacgtccctcgattgcagatttaccagcccgattccccccttaagatcatccagattctgattgccacaattactcatctgctgccaagcactgaagcctctagctacgagatggacaagcgtctggtcgtgtctctgttgctctgtctcctggactggatcatggctctgccattgaaaaccctgttgcagccttttcacgctacaggggcagagtctgataagacagaaaagtccgtactaaactgcatatataaggtgctacatggctgtgtgtacggagcccagtgcttctccaatccaagatatttccccatgtctctgtccgacctcgccagcgtcgattatgaccccttcatgcacttggagtcattgaaggaacccgagccacttcattcaccagatagtgaacggagttcaaaattgcagcccgttacagaggtcaagacgcagatgcagcacggactgatttccatcgccgcacgaactgtcattactcacctggttaatcacctagggcattaccctatgtccgggggtccggctatgctgacctctcaggtatgcgaaaaccatgacaaccactactcagaatccacagagctgtcccccgaactatttgagagtcccaatatccagttctttgtgctgaacaacactacgctggtgagttgtatccagatccggagcgaagagaacatgccgggtggaggactgtctgcaggcctggcaagcgccaatagcaatgtgagaattatcgtgagagacctgtctggaaagtactcttgggactctgccatcctgtatggtccacctcccgtgtccggtctgagcgagccaacttccttcatgttatcgctgtcccatcaagagaagcctgaagaaccccctacctccaacgagtgcctggaggacatcacagtgaaagacgggctgtcactgcagtttaaacggttccgcgagacggtgccaacctgggataccataagggacgaagaagatgtgctggacgagctgctacagtatctgggcgtgacatcgccagagtgtctccagagaaccggcataagcctcaatattcccgcacctcagccagtgtgtataagcgaaaaacaggagaacgacgtaatcaatgcaattttgaaacagcatacagaggagaaggagttcgtggaaaagcacttcaatgatctaaacatgaaagcggtcgaacaggacgagcctattccacaaaagcctcagagcgcattctactactgcaggctgttattgtccatcctgggcatgaactcatgggataagcgccgatcttttcatctgttaaagaaaaatgaaaagctccttcgggaactcagaaatctagattcgcgccagtgccgcgaaacccacaagatagcagtcttctacgtggcagagggccaagaggataaacactctatactgaccaatacgggcggttcccaagcttatgaagattttgtggccggactgggatgggaggtgaacttaacaaaccactgcggttttatgggagggcttcagaagaacaagtctacagggttgaccaccccctactttgcaacctctaccgtggaggtcatattccacgtgtccactcggatgccatccgactctgacgactctttgacaaagaagctccggcacctgggcaacgacgaggtgcacatcgtgtggtctgaacatacacgggactacagacggggaattatccctaccgagttcggtgatgtgctgatcgtcatctacccaatgaaaaaccatatgtttagtatccaaattatgaaaaaaccagaggttcctttctttggcccactgtttgacggcgcaattgtgaacgggaaggtgctgcccataatggtgagagctacggctattaacgcatctagagctctgaagagtctcattcccctctatcaaaatttttatgaggagagggccagatatctacagacaatcgtgcaacaccacctcgaaccaacaacatttgaagactttgcggctcaggtgttctctccggcaccataccaccacttacccagcgatgccgaggaaagaaacgctgttattgttctcttcctgccaaaacctcccctggaaaacattggccacctgaaggcccctactcagcgcttttaccctgtaaagcttcctcagcagagaagata

SEQ ID NO: 237843 - DNA, 6149 bp, Artificial Sequence
  Description of Artificial Sequence: Synthetic coding sequence
atgttttctaagaagccccatggcgacgtaaagaaatctacccaaaaggtgctggacaccaagaaggacgcccttactcgtctgaaacatctgaggatcgtcatcgagaacgctgagtctatagatctgaagcagttctttgaccaacacttttctcacatttactatgtattcttcgaaaactttgtgaccattgaagccagccttaaacagaagggacacaagagtcagcgggaagaattggatgccatcctattcatttttgagaagattctacagctgttgccagaacggatccaccagagatggcaattccattccattggcctcatactcaagaagctgttacataccggaaactccttgaagattcgtcgggagggcgtgcgcctgtttctgctgtggttacaggcactgcaaaacaattgctcgaaagagcaactgtggatgttcagctgtctgattccaggcttttccgccccacagagcgagcacggtcctaggacactggacaacctgatcaatcctccactgaatctgcaggagacccaggtgacaatagaggagatcacccccctggtgcccccacagtccggtgacaaaggccaggaagatctgacctcctattttctcgaagccctgttaaagtacatagtgatccaggtcaaatctctcgaatggaagaataaagagaaccaggagcgtgggtttagcttcctgttctcacactttaagaaatactaccttccatacatattccctaacatatgcaaggagaattcactgtatcacccgattctggacataccgcagatgcgccctaaaccccactacgtggttatcaagaaagacgctgagacaaacgaagccatttactgcacaaaagagcccttcatcaaagcccgagtcatagtgatcagatggctagtttcattttggctcgagccaaaacctcatacgggacctcacatacccggtatggaaggagaggtcctcccaaagaacatccagcgagccgcagcatcattggtatcccgtgaggagtcaaagaacgacaatgcggacaagacagatagaaccactgagccagagcagtctcattccaacacttctacactcacagagagagagcctagctcgtcctcactctgcagcatcgatgaggaacatctgacagatattgagatcgtgcggagggtgtttagttccaagcggagcaatgtgaattttgtaacggagatcttcagacaggcgttcctgctacctatttgcgaggctgcagccatgcgcaaagtggttaaagtctatcaagagtggatccaacaggaagaaaagcctctgttcatgcaggaaccggaggagatcgtcattaccagctccgacctgccctgtatcgagaatgtcacagatcacgatatttcaatggaagagggggagaaacgcgaagaagagaacggaactaacacagcagatcatgtcaggaactcatcctgggccaaaaatggcagctaccagggggcactgcacaatgcatccgaagaggccacagaacagaacatccgtgctggcactcaagccgtgcttcaggtgtttatcatcaattcatccaacatcttcctgctcgaaccggctaatgagattaagaatctgcttgatgaacacaccgatatgtgcaaacgaatcctgaatatctatagatacatggtggtgcaggtgagcatggataagaaaacctgggagcagatgcttctggtgctcctccgcgtcactgaaagtgtgctgaagatgccgtctcaggccttcttacagtttcagggcaaaaagaatatgacattggccggacggttagccggtcctttattccagaccctcatagtagcttggatcaaagctaatctcaacgtgtatatcagtagggaactctgggacgatttgctgtcggttctctcatcactcacatactgggaggagcttgctaccgaatggtctctcaccatggagacgctgaccaaagtgctggccaggaacctctactcactggatttgagcgatcttcctcttgataagttgtccgaacagaagcagaagaagcacaagggtaagggtgtcggtcacgagttccaaaaagttagcgtggacaaaagcttcagccgaggctggagtcgcgaccaacctggccaggcaccgatgaggcaacgctccgcaaccactacaggatctcccggtaccgaaaaggcacgttccatcgtgaggcagaaaactgtcgacattgatgacgcccagatcctgcccaggtcaacccgggtacggcatttttcacagtccgaggaaaccggcaatgaggtgtttggagctctgaatgaggagcagcctctgcccagaagtagttccacgtcagacatcctggagcctttcactgtggagcgggctaaggaagcggagcagaacgccacccgcggaagtaccgagggaagtgttcagtcctgcaacggactgttttggaaggaaagttgtagtgacatagggggatcaagcgctaacgtgcctgatcttatggatgagtttatcgctgagaggctcagaagcggtaatgcgtcaacaatgaccagacgtgggtcatcccctgggtcgctggagatccccaaggacttgccagatattcttaataaacaaaatcagatgaggccaatcgatgatccaggcgtacccagcgagtggacttcccccgcaagtgctgggtccagcgacctcatcagctcggattcccatagcgatagtttttccgcattccagtatgacggcaggaaatttgacaattttgggttcggaacagacaccggtgtaacgtcctctgcagatgtcgattcaggctcgggtcaccaccagtctgccgaagaacaagaagttgcctctctgacaactctgcatattgactccgagaccagcagcttgaaccaacaagcattttcagcagaggttgccactattaccggaagtgaatcggcctctccagttcatagcccactgggatctcggtcacagacccccagcccctctactctgaatattgaccacatggagcagaaagacttgcagttggacgaaaagctgcaccacagtgtactacaaacccctgacgatctcgagatctccgagttcccaagtgaatgttgctctgtgatggcaggcggaactctgaccggatggcatgctgacgtcgcaaccgttatgtggagacgaatgttagggatcctgggtgacgtgaatagcataatggatcctgagatccacgctcaagtgtttgactatctatgcgaactctggcagaatctggccaaaattcgggacaatctcggtatcagcaccgacaacctcacgtctccatcccctccagttcttattcctccattgagaattttaacaccttggttattcaaggctactatgttaaccgataagtacaagcaaggaaagttgcacgcatacaagctcatctgcaatactatgaagcggagacaggacgtctctcccaacagagattttctgactcacttttacaacatcatgcactgcggactcttgcatatagaccaggacattgtgaacaccatcatcaagcactgctctcctcaattttttagcttgggactgccgggtgcaacaatgctaataatggattttatcgttgccgcaggacgtgtcgccagctctgcttttctgaatgcccctcgcgttgaggcccaggtgctgttgggctcactggtatgtttccccaatctctattgcgagctcccctctctccaccccaacatccctgatgtggcagtgtctcagttcacagacgtaaaagaactaattattaagactgtccttagctccgccagagatgagccaagcggccctgcaagatgtgttgccctgtgttcactcggcatttggatctgtgaggagttagttcatgagagccatcaccctcagattaaggaagctctcaacgtgatttgtgtgtctctaaaattcacgaacaaaaccgtggcccatgtggcttgcaacatgctccatatgttggtgcactatgtccctaggctgcagatatatcagcctgactccccacttaagataatacagatcctgatagccaccattactcatttgctacctagcaccgaagcatcgagttatgagatggacaaacgcttggtggtatccttattgctctgcctgctcgactggatcatggccctccccctgaaaactcttttgcagccctttcacgcaaccggggcagagtctgacaaaactgagaaatctgtgttgaactgcatttacaaagttttgcacgggtgcgtgtacggcgctcaatgtttctctaatcccagatatttcccaatgtcgctcagcgacttggcgagcgtggattacgacccattcatgcacctcgagagcctgaaagaaccggagcccctgcattcacctgattccgaaagaagctcgaagctccagccagtgactgaggtgaaaacgcagatgcagcacggcctgatctctatagccgctagaacagtgatcactcacctcgtgaaccatcttggccattaccccatgtccggcggaccggctatgctgacctctcaggtgtgtgagaatcacgataaccactactctgagagtaccgagctgtcgcctgaattgttcgagtcccccaatattcagttcttcgtcctgaataatacgaccctcgtgagctgcatccagatcaggagcgaggaaaatatgcctggcggaggtttatccgccggacttgcatcagctaactccaacgtccgcatcatcgtccgcgatctgagtgggaaatattcatgggactcggcaatcctgtacggaccaccgcctgtgtcaggactatcagagccgacgtcgtttatgttatcactttcacaccaagagaagccggaagagccaccaacgagtaacgagtgcttggaggacatcactgtcaaggacggcctctcattgcagtttaaacgctttcgcgagaccgtccctacttgggacactattagggacgaagaggatgtgctggatgaactgctgcagtatctgggagtcactagtccagagtgcttgcaaagaaccggtatttccttgaatatacccgcaccccagcctgtttgcatttccgaaaagcaggaaaacgatgtcatcaatgccattcttaagcaacacacagaagagaaagaattcgtggaaaagcatttcaacgacctgaatatgaaagcagttgagcaggacgaaccgatccctcagaagccacaatctgcgttttactattgtcgcctcctgctctcaatcctcggtatgaactcctgggacaaacggcgtagtttccacctgctgaagaagaatgagaaattactgcgcgagctgcgtaatctggatagccgccagtgccgcgagactcacaaaatcgcagtcttttacgtcgccgagggccaggaggacaaacatagcattctgaccaataccgggggaagtcaagcttacgaagacttcgttgctgggctggggtgggaggtgaaccttacaaaccactgtggttttatgggcggtcttcagaaaaataagtcaacaggcctgactacaccttactttgctacttccaccgttgaggtgatttttcatgtgtctactcggatgccatccgactcagacgattcactgactaagaagcttcgtcacttagggaacgacgaagtacatatcgtttggtctgagcacactcgggattaccgccgtggcatcatccctacagaatttggagatgtcctcatagtgatctatcctatgaaaaaccacatgttctccattcagatcatgaaaaagcctgaggttccctttttcggccctttgttcgacggtgccattgtcaacggaaaggtcctgccgatcatggtaagagccactgcaattaatgcttcacgcgcactcaagagcttgatccccctgtatcagaacttctacgaagaacgggcaaggtacctccaaaccatcgttcagcaccacctggagccaaccaccttcgaagacttcgcagcacaggttttttccccagccccttaccatcacctaccgtccgacgccgaccacta

SEQ ID NO: 237844 - DNA, 6110 bp, Artificial Sequence
  Description of Artificial Sequence: Synthetic coding sequence
atgttttctaagaagcctcatggtgacgtgaaaaaaagcacacagaaagtcctcgacacgaagaaggacgccctgacccgcctgaagcacctgcggatcgtcatcgaaaatgcagaatcaatcgacctgaagcagtttttcgatcagcacttttcgcatatctactatgtgttcttcgagaattttgtcaccatcgaagcaagcctgaagcaaaaaggccacaagagccaaagggaagaactggatgccatactgttcatatttgaaaaaatcctgcaattactcccagagcgcattcatcaaaggtggcagtttcatagcatagggctgatcttgaagaagctcttgcacaccggaaatagcctgaaaatacgcagagaaggggttaggctctttttgctgtggttacaggctctccagaacaactgctccaaagagcagctctggatgtttagctgtttgatccccggatttagcgctccacaatcagagcacgggccaagaacactcgacaatctgatcaacccccctttgaatctgcaagaaacacaagtgaccatcgaggagattacgcctttggtgccgcctcagtctggagacaaaggccaggaggacctgacatcctattttctcgaggctcttttgaagtacattgttatacaggtgaaatctctcgagtggaaaaataaagagaatcaagagaggggtttttcctttttgttttctcattttaagaaatattacttaccctatatcttccctaacatctgtaaggaaaactccctgtatcatccaattctggatatacctcagatgagacctaaaccacattatgtggtgattaagaaagacgccgagaccaacgaggcaatctactgcacaaaagagcctttcattaaagctagagtgattgtaatccggtggctggtttcattttggctggaacccaagcctcacactggaccccacatccctgggatggaaggtgaggtcctgccaaagaatatccagcgggctgccgcttcactggtgtcccgtgaagaatccaaaaacgacaatgcagacaaaactgacagaaccactgagcccgaacagtcccattcgaatacatccactctgacagagcgtgaaccgtcgagctctagtttatgtagcatcgatgaggaacacctcaccgacatcgaaattgtgcggagagtgttctctagcaagaggagcaacgttaatttcgtgaccgagatcttccgacaggccttccttctaccaatctgcgaggccgcagcaatgcggaaggtggtcaaggtctaccaagagtggatacagcaagaggagaagccgctctttatgcaggaacccgaagaaattgtcatcacgtcttcggacctgccctgtattgaaaacgtgaccgatcacgacatcagtatggaggagggagaaaagagggaagaggagaacggaacaaacacggcagatcacgtgcggaactccagctgggcaaaaaacggctcataccagggagccctacacaatgcctctgaggaagcgacagaacagaatatccgcgctgggacgcaggccgtgctgcaggtgttcattatcaacagcagcaacatctttctgctggagcctgcaaacgagataaagaatctcctcgacgaacacacagacatgtgtaagagaattcttaacatatatcgctatatggtcgtgcaggtgtccatggacaagaaaacctgggaacagatgcttctcgtactcctccgggttacagagtcggttctaaaaatgccgtcccaggctttcctccaatttcagggcaaaaaaaacatgacattagcaggcaggcttgccggaccattattccagaccctcatcgtggcttggataaaagctaaccttaacgtttacatttcccgcgaattgtgggacgacctgctcagtgtgctgtcttctctgacatattgggaggagctggcaaccgagtggtctctgacgatggagacactcaccaaggttctggcaagaaatctgtattctttagacctctctgatctgcctctggacaaactgtcagagcaaaagcagaagaagcacaagggaaagggggtcggacacgagtttcagaaggtgtccgtggacaagtctttcagtcgcggttggagcagagatcaaccagggcaggctcctatgagacagcggtctgcgaccacaacagggtcaccaggtactgagaaggcacgcagcattgtccggcagaagaccgtcgacatcgatgatgcccagatcctccctcgatctacaagggtaagacacttctcccagtccgaagagaccggcaacgaagtgttcggggctctgaatgaagaacagccactccccagaagctccagcacttctgacattctggagccattcacagttgaacgagccaaggtgaacaaggaggatatgtctcagaaactgcccccactgaacagcgacatcggtggatcatccgccaatgtgccagaccttatggatgagtttatcgcagagaggctgcgatctggtaacgcgtccactatgacacgcagaggaagcagccctggttcgttggaaatcccaaaagacctacccgacatcttgaacaagcagaaccaaatgcgtccaatcgatgatcccggtgtaccctctgaatggacatcaccagcatcagccggttctagcgacctgatctcatctgactctcactccgactcatttagcgcatttcagtacgatggcaggaagttcgataatttcggcttcgggacggataccggagtgacctcatctgccgacgtggactcaggcagcggccaccaccaaagcgccgaggagcaggaagtggcatcattgaccactctacatatagattcagagacctcctcccttaatcaacaagcattcagcgcggaagtggccacgatcaccggaagtgagtctgcttcgccggtgcattcaccactcggatctcgcagccagactccctcaccctccacactgaatatcgaccacatggaacagaaggatcttcaactcgatgagaagcttcaccacagtgtattacagactcccgacgatttagaaatctctgaattcccttcagaatgttgctccgtaatggcagggggtacattgactggctggcatgcggacgttgctaccgtaatgtggaggcggatgctcggcattctcggggatgtaaatagtataatggatccagagatccatgctcaagtgttcgactatttatgtgagctatggcagaacctagccaagattcgggacaacctggggatctcaacagataacctgactagtccctcacctcccgttttgattcctcctttgcggattctgacaccatggctctttaaagccaccatgctaaccgacaagtacaaacaggggaagcttcacgcatataagttgatctgcaacaccatgaaacgccgacaggacgtgtcccctaaccgcgacttcctgacacacttttataatattatgcactgcggcctgttgcacatcgaccaggacattgttaataccatcattaaacactgctctccacagtttttttccctcgggcttccgggagctaccatgctaataatggatttcattgtggcggctggcagagtcgcctccagcgccttccttaacgcccctagggtggaggcccaggtcctcctggggtcactggtgtgttttcctaatctttactgcgagctgccaagcctgcatcccaacatccctgacgttgcagttagtcagtttacagacgtgaaggaacttattatcaagacagtgctgtcaagcgcccgagacgagccatccggtcccgctcgttgtgttgctctgtgctcattaggcatctggatctgcgaagagctggtgcacgagagtcatcaccctcagattaaagaggccctgaatgtcatctgtgtcagcctcaaattcaccaataagacagtggctcatgtggcgtgcaacatgttgcatatgctggtgcactatgtgcccagactgcagatctaccaacccgattcacctctaaagattatacagatactgatcgctacaataactcatctgctgccatccaccgaggcaagctcttacgagatggataagaggctggtcgtgagcttgctgctgtgtcttcttgattggataatggccctccctcttaaaactttgctccagcctttccacgcgaccggggcagagagcgacaaaactgaaaaaagcgtactgaactgtatctacaaagttctgcacggctgtgtctacggggcacagtgtttcagtaatcccaggtatttcccgatgtctctaagtgacctggcctcagttgactacgacccattcatgcatctggagtcccttaaagagcccgaaccacttcactctcctgatagcgagcgaagcagcaaactgcagccagtcactgaagttaagacccagatgcagcatggcctcatctcaattgctgccagaaccgtgatcacacatctggtaaaccacctaggtcactaccctatgtcaggcggtcccgctatgctaacatctcaggtgtgcgagaatcacgataaccactactcagagtccactgagctgagccccgagttattcgagtcccccaatattcagtttttcgtactcaacaatacgaccctcgtatcgtgtattcagatccggtctgaagagaatatgccagggggtggcctgagcgcagggcttgcgtctgcgaactcgaacgtccgcattattgtcagggatctgtccggcaagtactcctgggatagcgccattctgtatggccctcctcccgtcagcgggctgagcgaacctactagttttatgctgtctttgagtcaccaggagaaaccagaggagccaccgacttctaatgaatgcctggaggacatcaccgtgaaggacggactgagcctgcagtttaaaaggttccgcgagactgtgcctacttgggacactatcagagatgaggaagacgttctagacgagctgttgcagtatctgggggtcacctctccagaatgtcttcaaaggacgggtattagtctgaatatacctgctcctcagccagtttgcatctccgagaaacaggaaaacgatgtgatcaatgcgattctcaaacagcatacagaggagaaggagtttgtagaaaaacacttcaacgatctgaatatgaaagccgtagaacaagacgagccaatacctcaaaaaccccagtccgcgttttattattgccgcttattactgtcgatcctgggcatgaacagttgggacaagagacgctcttttcatcttctcaagaaaaacgaaaagctgcttagagaactcagaaacctcgactcgcgccagtgtagggagacgcataagattgctgtcttttatgttgctgagggccaggaagacaagcacagtattctgactaataccggaggttcgcaagcgtatgaggatttcgtggcagggctgggatgggaagtcaacttgacgaatcactgtggtttcatggggggtctgcaaaaaaataagagcacagggttgaccacaccttacttcgcgacttctaccgtagaagtgatcttccatgttagtactagaatgcctagcgattccgacgattctctaaccaaaaaactgcggcatctggggaatgatgaggtacatatcgtatggagcgagcacacgagagactaccggcgaggaatcatcccaaccgagtttggggacgtgcttattgtgatatacccaatgaaaaatcacatgttctctattcagatcatgaaaaagcccgaggttccttttttcggacctctgtttgacggggctattgtcaatgggaaagtccttccaatcatggtgagagccactgccattaatgcgagtcgggcattgaagtcacttatacccttgtaccaaaacttctatgaagagagagcgcgttacctgcagaccatcgtgcagcaccacctggagccaactaccttcgaggatttcgctgcgcaggtgttttcacccgctccctatcatcacctgcctagtgacgcggatcatta

SEQ ID NO: 237845 - DNA, 6251 bp, Artificial Sequence
  Description of Artificial Sequence: Synthetic coding sequence
atgttttcgaagaaacctcacggtgatgtgaaaaagagcacgcagaaagtactcgacaccaaaaaagatgccctgactcggctgaaacacctaagaatagtcatcgagaatgctgagtcaattgatttaaagcagtttttcgaccagcacttctcccatatctactatgtattttttgaaaatttcgtgactatcgaagcctccctgaagcaaaaagggcacaagtcccagcgagaagaactcgatgctattttatttatctttgagaaaattctgcagcttctgccagagcggatacatcagcgttggcaatttcatagcatcggtctcatactgaaaaagttgcttcacactgggaacagtctgaaaatccgcagagagggcgttcggctctttttgctatggcttcaagctctgcagaacaactgttcaaaggaacaattgtggatgtttagctgcctgattcctggtttctccgccccacagagtgagcacggacccaggactttagataatttgatcaaccctccactcaatttgcaggaaacacaagtaacaatcgaggagattacccccctagttccaccccagagtggggacaagggccaggaagacctgacctcatatttcctggaagcactcctcaagtacatagtgattcaggtgaaaagccttgaatggaagaacaaggagaatcaggagagggggttctccttcttatttagtcatttcaagaaatactatcttccctacatttttccaaatatctgcaaggaaaactccctgtatcacccaattttagatatcccccagatgaggccaaagccccattacgtagtgatcaaaaaggatgctgagactaatgaggctatctattgcaccaaggagccttttataaaggccagagtgattgtgattagatggctggtcagcttctggcttgagcctaagcctcacaccgggcctcatatacccggtatggagggcgaggtgctccctaaaaacatccagcgagcagcagcttcacttgtttcacgggaagagagcaagaacgacaatgccgataagaccgatagaacaacagagccggagcaatctcatagtaacaccagtacattgaccgagcgggagccctcttccagcagcctatgctcaattgatgaagaacacctcactgatatcgagattgtcagacgcgtgtttagctctaagcggtctaacgttaactttgtgacagaaatctttaggcaagcatttctgctgcctatttgtgaagccgcagcaatgagaaaagtggttaaggtttatcaggagtggatccaacaggaggaaaaacctttgtttatgcaggaaccagaggagatcgttataacaagtagcgatttaccatgtattgaaaatgtgactgaccacgacattagtatggaagagggagaaaaacgggaagaggagaacgggacaaataccgccgaccacgtgagaaacagctcctgggccaaaaacggatcctatcagggagccctccacaacgcgtccgaagaggcgacagaacagaacataagggctggcactcaggccgttttacaagtgtttatcattaactccagcaacattttcctccttgagccagcaaatgagattaagaatctgttagacgagcatactgacatgtgcaagcgtatattgaacatctatcgatacatggtcgttcaggtgagcatggacaagaagacttgggagcagatgctcctggtcctcctgcgggttaccgaaagtgtcctgaagatgccatcccaggcttttttgcagttccaagggaaaaaaaacatgacgcttgcaggaagattggctggcccattgtttcagacccttatagtggcatggatcaaggccaatctgaatgtttacatctcccgggaactgtgggacgatctgctgtccgtcctgtcttccctcacctattgggaggagctggccacggaatggtctctcacaatggaaaccctcactaaggtgctggctcggaatctctacagcctggatctcagtgacttgcctttggacaagctgtccgagcaaaaacagaaaaagcacaaaggaaaaggcgtcggccacgagtttcagaaagtctctgtggataagtccttcagtcggggttggtcacgcgaccaacctggacaggctcctatgaggcagcgttcagcaacaacgaccggaagccctgggaccgaaaaggccagaagtatagtacgccagaagactgttgctatgcggtctagaagcatcggagagtgtgccctgccctcggcatacatccgatccgctaagtctgcacccgtgttgatccatacctccaaacctttcctgcctgacattgtgctgaccccgctatccgacgaattatctgatattgacgacgcccagattttgccaaggtctacacgcgtcaggcacttctcccagagcgaagagaccggtaacgaggtgttcggcgctctgaatgaagaacagcctctccccaggtccagctctacgtcggacatactggaaccctttacagtggagagagccaaagtgaacaaggaggacatgtcacagaaattacctcccctcaattcagatatcgggggatcttctgcaaatgtgccagacctgatggatgaattcattgccgaacgactgcgctctggaaacgccagtaccatgacacgccgaggatcaagtccgggatccttagaaatacccaaagacttacctgatatcctgaataagcagaatcagatgcgtcccatcgacgatccaggagtgccctccgaatggacaagtcctgccagcgccggaagctctgacctgatcagtagcgatagccattccgacagcttcagcgctttccagtacgacgggaggaagttcgacaattttgggttcggcacggatacaggggtcacatctagcgctgacgtcgattccggctcaggacaccatcagtccgctgaagaacaagaggtagcttcactgactacattacacattgattctgagacaagttccctcaatcaacaggccttcagtgcggaggtagccactataacaggttcggaaagcgctagtcccgttcactcaccactggggtctaggagtcaaaccccctcccctagcacacttaacatcgatcacatggaacaaaaggacctccaactagatgagaagctacatcattcagtactgcagaccccagatgatctggagatctccgagttcccatctgaatgctgtagtgtgatggcagggggtactttgacaggttggcatgctgacgtggccacggtgatgtggagacgcatgctcgggatactgggtgacgtgaatagcataatggacccagagatccatgcacaagtctttgactatttgtgtgaactgtggcaaaatctggctaaaatcagagacaacctcggaatcagcacagacaacctcacttcaccatctccacccgtgttgataccccctctgcgcattcttacaccctggctgttcaaggctacaatgctgactgataagtataaacaggggaaattgcacgcctacaaattgatctgtaatacgatgaagagaaggcaggatgtttccccaaaccgggattttttgacccacttctacaacatcatgcactgcgggttactccatatagaccaggacatcgtaaatacaatcattaagcattgttccccccagtttttttcgctaggactgccaggcgcaactatgctaattatggattttatcgttgcggctggacgcgtagctagttccgcgttcctgaacgcccctagagtggaggctcaagtgcttctgggcagcctggtttgtttcccaaacttgtattgtgagctgcccagtctacaccccaacatcccggatgtcgccgtctcacagttcacggacgtcaaagagctgatcatcaaaacggtacttagtagtgctagggatgagccctccggcccagcgaggtgtgtggcactttgcagcttgggtatttggatctgtgaagaactcgttcatgagtcacaccatccacaaatcaaggaagccctgaacgtcatctgcgtatctttaaaattcactaataagaccgttgcccacgtagcttgcaacatgctacacatgcttgtgcactatgtccctagacttcaaatctatcagccagattccccattgaagatcattcagattctcatagcgacgatcacacacctcctgccaagcactgaggcaagcagctatgaaatggataaacgtctggtggtcagtctgctgttgtgcctcttggattggataatggctctccccctgaagacattactgcaacctttccacgccaccggggctgagagcgataagactgagaagtctgtgcttaactgcatctacaaggttttgcacggatgtgtttacggggctcagtgtttctcgaatcctcgttattttccgatgtcgctatctgacttagcatctgttgactacgaccccttcatgcacctagagtctttgaaagagccagagcctctgcactccccggactctgaacgtagctctaaactgcagcccgttacggaagttaaaacacaaatgcagcatggcctgatcagtatcgcagcaagaacggttataacccacctggtcaaccaccttggccattaccccatgagtggtggtccggcaatgttaacatcgcaggtttgtgagaaccacgacaaccactactctgagagcaccgagctgagccccgagctgttcgagagtcctaatattcaatttttcgttttaaacaataccaccctcgtgtcttgcatccaaataaggtccgaagaaaacatgcccggaggtggcctttcagctggacttgcctccgctaattctaatgtcagaatcattgtaagagacctgtcggggaagtactcatgggatagcgccatcttgtacggacccccaccagtgtccggactttcagaacctacgtcctttatgctgtcactgtcacatcaagagaaacccgaggaaccaccaacttccaacgagtgtctggaggacatcacggtgaaggacggcctgtcactacagtttaagaggtttcgcgagactgtgccaacgtgggacactatccgggacgaagaagatgtgctcgacgagctgctgcaataccttggagtaacatctccagaatgtttacagcggactgggatctccttaaacattcccgctccccagcccgtgtgtatctctgagaaacaggaaaacgatgttatcaatgccatcttaaaacagcacacagaagaaaaagagtttgtcgaaaaacacttcaacgatctaaacatgaaggcagtggaacaggacgagcctattccccagaagcctcaatctgctttctattattgccggttgctgctgtccatactcggtatgaacagctgggataaacggagatcttttcatttgcttaaaaaaaacgagaaacttcttagggagcttcgaaacttggacagccggcagtgccgggaaacacataagatcgcagtgttctatgtggccgaggggcaggaggataaacatagtatcttaaccaacacaggaggttcgcaagcctacgaagactttgttgctggcctgggctgggaggtgaatcttaccaatcactgcggattcatgggagggctacagaagaataagtccaccggactgacaaccccttacttcgccacaagcacagtggaggtgatatttcacgtgtcaactagaatgccctctgactctgatgattcactgaccaagaagctcaggcacttgggaaacgacgaggtgcatatagtgtggagcgagcacacccgggactaccgccgtggaattattcccaccgaattcggtgacgtccttattgtcatctatcctatgaaaaaccatatgttctcaatccaaattatgaagaaacccgaagtgcccttcttcggaccactgttcgacggggcaattgttaacggtaaggtgctgccaatcatggtgcgtgctacagcaatcaacgcctcgagggcccttaagtctctgatcccattgtaccaaaatttttacgaggagcgggctaggtaccttcaaaccatagtgcagcaccaccttgagccaactaccttcgaagacttcgccgcacaggtcttctcccctgctccttaccatcatctaccaagcgatgctgaccatta

SEQ ID NO: 237846 - DNA, 2169 bp, Artificial Sequence
  Description of Artificial Sequence: Synthetic coding sequence
cagatcctcattgctacaatcacccatctgctgcctagcacagaggcctcaagctacgaaatggataagagactcgtcgtgtccctgttactgtgcctcctggattggatcatggctcttcccttgaagaccctcttacagccatttcatgcaactggagccgagtcggataaaaccgaaaagtctgtgctaaattgtatttataaggtgctgcacggttgtgtgtacggggctcagtgttttagcaacccaaggtatttcccaatgagtctgtctgacctggcgtctgttgattacgacccatttatgcacttagagagtctcaaagaacctgaacccttgcacagtccagacagtgaaagatccagcaagctccaaccagtgaccgaagtcaagacgcagatgcagcatgggttaatctcgattgccgctcggacggtcatcacccatctggtcaatcacctcggacactatcccatgagcggcggtcctgcaatgctgacctcccaagtttgcgaaaaccacgataatcattactccgagtctaccgagctgagcccagagctgtttgagagcccaaacatacagttctttgtcttgaataacacgactctggtcagctgcatccagatccggtcagaggagaatatgcccggtggtgggttgagtgccggactcgccagtgctaatagtaacgtgaggatcattgtgcgtgacctaagcggaaagtatagctgggattccgctatcctgtatggcccacctccagtgagcgggttatcagaacctacttctttcatgctgtcactgtcgcaccaggagaaaccagaggagccacctacctctaatgaatgcttagaggacatcaccgtgaaagacggtctgagcctccagttcaagaggttccgtgaaacggttccaacttgggacaccattagggatgaagaggatgtcctggatgaactcctacagtacctcggagtcacgtcccctgagtgcctccaaaggactggtatctctctgaacatccctgccccacagccggtgtgtataagcgagaaacaggaaaacgacgtgataaatgcgattcttaaacagcacactgaagagaaagagttcgttgagaagcacttcaatgacctgaatatgaaagcggtggaacaagatgaaccgatccctcagaaaccccagtccgcgttttactactgtcgcttgcttctgagcattcttggcatgaactcgtgggataagcgccgaagcttccatctgctcaagaagaatgaaaagctcttgcgcgaactgcggaacctggactctcggcagtgtcgggagacccataagatcgctgtgttttacgtggcagaagggcaagaggacaagcacagcatcctaacgaacactggcggttctcaggcttatgaagattttgtcgcgggattggggtgggaggtcaacctgacaaatcattgcggattcatgggagggttacagaagaataagtccacaggactaactactccttatttcgctacatcaaccgtcgaggttatttttcacgtatctacccgtatgcccagcgactccgacgactctctgactaaaaagctgagacacctcggcaatgacgaggtccacatagtgtggtccgagcacaccagggattatcggaggggaattataccaaccgaattcggcgatgttctgatcgttatctatcccatgaagaaccatatgttcagcattcaaattatgaagaagcctgaagttccgtttttcggcccacttttcgacggcgcaatcgtgaacggcaaggtgctccccattatggtcagggctacagccatcaacgccagtcgcgcactgaagagcttaatccccctgtatcagaatttctacgaagagcgcgctaggtacctccagacaatcgtccagcatcatctcgagcctactactttcgaggatttcgccgcacaggtgttctcaccagcaccctaccaccacctgcctagtgatgctgtcggatcttatcctgagatcctcccctcagagacgcccacagcaacccaagtcgacggggcagacctggctagcccaatgagccctcgaacatctaagtcacgtatgtccatgaagctgagacgctcctccggaagtgcgaataagtcatag

SEQ ID NO: 237847 - DNA, 2709 bp, Artificial Sequence
  Description of Artificial Sequence: Synthetic coding sequence
atggtgcaaaggatgtgggccgaggctgcgggtccagcaggcggtgctgagcctctctttcccggaagtcggcgatcaagatctgtgtgggacgccgtgcggcttgaagttggagtgccagatagctgtcctgttgtgctgcactcattcacacagctagatcccgacctccctcggcctgaatcaagtacccaggaaattggcgaggagttgatcaatggggtgatttattcgataagcctccgtaaggtgcagttgcatcacggcggtaataaaggacaacggtggctgggttacgaaaacgagagtgcactgaacctgtacgaaacttgtaaggtgaggaccgtaaaagccggaacactggaaaaactagtggaacatttggttccagccttccagggcagtgacctctcctatgtgacgatcttcctgtgtacctacagagccttcaccactactcagcaggtgttagaccttctgtttaagagatatggctgtattctgccatactctgacgaagatggaggtcctcaggatcaacttaagaatgctatatcttctatactggggacatggctagatcaatactccgaggatttctgccagccgccagactttccatgcctcaagcagctcgttgcgtacgtgcaacttaatatgcccggatccgacttagagaggagagcacacctgctgctggctcaactggagcatagtgagcccatcgaggccgaacccgaggcgctgtcccctgttcctgcactgaaacctacccccgagctagagttggccctgacaccggcaagagctccatcccctgttccagcccctgcaccggaacccgagcccgcacctacaccagccccagggtcagaactggaggtcgcacctgcccctgctcctgaactgcagcaggcgccagagccagctgtgggactggagtctgcgccagcacccgctctggaactcgaaccagcaccagagcaggaccccgcacccagccagactctagagctcgaacccgctcccgcaccagttccttcgttacaacctagctggccttcccctgtggtggccgaaaatggcctttcagaggagaaaccacatctgttggtttttcctccagacctggtggcagagcagtttactcttatggatgccgagctcttcaaaaaagtcgtcccatatcattgcctgggctccatctggtcccagcgtgataagaaaggtaaagaacatctcgcaccaactataagagctacagttactcagttcaactcagtcgccaactgcgttatcaccacctgcctgggaaatcgctccaccaaggctcctgaccgcgcaagagtggtagaacactggatcgaggttgccagggaatgtaggatccttaaaaacttcagctctctgtacgccatcctgtccgctctgcagtccaattccatccacagactcaagaagacatgggaggacgtgtcccgggattcttttagaatctttcaaaagctgtccgaaatattttctgacgaaaataattattccttaagccgcgaactgttgatcaaagagggcactagcaaattcgcaacccttgagatgaacccaaagagggcacagaagcgaccaaaggagactggtattatccaggggaccgtaccatacctggggacattcttgaccgatctcgttatgctcgacaccgccatgaaggactacctgtacggccgtctgatcaatttcgagaagcgacgaaaagagttcgaggtgatcgcccaaattaaactgctccagagcgcctgtaacaattatagtatcgcccctgacgagcagttcggagcctggttcagggccgtggagagactatccgaaacagagtcttataacctgtcctgtgaactggagccacctagcgagagtgccagcaacacacttcggaccaagaaaaacactgccatagttaagcggtggtctgatcgtcaggcaccctccaccgagcttagcacctccggctctagtcactcaaaatcctgcgatcagctgagatgcggcccttacctctcaagcggggacatcgcggatgctctgtccgtgcatagtgctggatcttccagttcagatgttgaggaaattaacatttcgttcgtaccggaatcccccgacggccaggagaagaaattttgggaaagcgcctcacagagcagcccagagaccagtggcatcagctccgcaagcagcagcacgagttcatccagcgccagcaccaccccagtggccgctaccagaactcacaaacgaagcgtaagcggcttgtgcaacagctcaagcgcacttcccctgtacaatcagcaggtgggggactgctgcattatccgggtctcgctggacgtggacaatggcaacatgtataagtccatactagtgacgtcacaagacaaagcccctgccgtcataaggaaagccatggacaagcacaacctggaagaggaagagcccgaggactacgagttactccagatcctcagcgatgatcggaagctaaagatccccgaaaacgccaatgttttctacgcaatgaatagcacagcgaattacgactttgtcctcaagaagagaacattcaccaagggggtgaaggttaaacacggggcttcctcaacactgccacgcatgaaacagaaagggttaaagattgccaaaggaattttctag

SEQ ID NO: 237848 - DNA, 2745 bp, Artificial Sequence
  Description of Artificial Sequence: Synthetic coding sequence
atggtccagaggatgtgggcggaggcggctggccctgctggtggggctgaacccttgttccccggaagcagaagatcacgctctgtgtgggatgccgtgcggctcgaggtaggggtgcccgactcatgtcctgtggtcctccacagctttacacaacttgatccggatctgccgagacccgagtcttctacccaggaaatcggggaagagctgattaacggcgtgatctacagcatatccctgcggaaagtgcagctccatcatggtggaaacaaagggcaaaggtggttaggatatgagaatgaaagcgccctcaacctctatgagacctgcaaagtccgtactgtcaaagcgggaacgctggagaagctggtcgagcacctggtcccagcattccaaggtagtgacctctcctatgtgacaatctttctttgcacttacagggctttcaccacaactcagcaggtgcttgatttactgttcaaaagatacggaaggtgcgatgccttgacggccagtagccggtacgggtgtatactgccttactctgatgaggacggcggaccccaggaccaacttaagaatgccattagttccattcttggtacatggctcgaccaatactctgaggatttttgccagccgcctgattttccatgcttaaagcagctggttgcctacgtgcagctgaacatgcctggttctgacttggaaagaagggcacacttactcttagcacaattagagcattccgaacctatcgaggcggagccagaagcactcagtccagtgccagccctgaagccaacaccagaactggagctggcccttacccctgctcgagcaccctctcctgtgccagccccagcaccagaacctgagcctgctcccacacctgcgcctgggtctgagttagaggttgcaccagctcccgctccagagttgcagcaggctcctgagccagccgtcggattggagtccgcccctgctcctgcgttggagctcgagccggcacctgagcaagacccagctccctcccaaaccctggaattggagcccgcacccgctcctgttccctctcttcagccttcttggccttctccagtggtggccgagaacggcctgagtgaagagaagcctcatttgctggtttttcctcctgaccttgtggcagaacagtttacactgatggacgctgaattgtttaaaaaagtcgttccatatcactgtttaggctcgatctggagccagagagacaagaaaggcaaggaacatctagctcccactattcgtgccacggtgacacaatttaatagcgtcgccaactgcgtcataaccacgtgtctgggaaatagaagtacaaaggctccagaccgggctagagttgtggaacattggatcgaagtcgctagagagtgccgcatccttaaaaattttagcagtctgtacgcgatattatcagcattgcaaagcaactccatccaccgcttaaagaagacatgggaagatgtctccagggacagttttaggatcttccagaagctctcggagatcttcagcgacgagaacaactacagtctctcccgggaacttttgatcaaggaaggtaccagcaagttcgccaccctggagatgaatcctaaacgggctcagaagcgtccaaaagagacagggattatacagggcactgtgccttacctgggcacttttttgaccgatctcgttatgctagatacagccatgaaagactacctttacggcagactcattaattttgaaaagcggaggaaggagttcgaagttattgcacagattaaactgctgcagtccgcatgtaacaactattcgatagcaccagatgaacaatttggggcttggtttagagcagttgaaaggctgagcgagaccgaaagttataacctgagctgcgaattggagccaccatcagagagtgcctcaaacactttacgcacaaagaagaacacggcaatcgtcaagcggtggtcagacagacaggccccaagcactgagctgtcaacttccggatcatctcattcaaagtcatgcgatcagctcagatgtggcccatacctgagctcaggagacatcgccgacgctttgtcagtgcatagcgcgggatcaagcagcagtgatgtcgaagagataaacatcagctttgtacccgaatcacccgacgggcaagagaagaaattttgggaaagtgcatcacaatctagccccgaaacttcggggatctcatcagcatcgtcctccacaagttcatcatccgcctctacaactcctgtcgcagccacaaggacacataaacggagtgtctctggcctgtgcaactctagttccgcactcccactctacaaccagcaggtcggcgattgttgtattatcagggtgtccctagatgtcgataatggtaatatgtacaagtcgatcctcgtcacgtcacaggacaaagcaccagccgtgattagaaaggcgatggataaacataacctggaagaggaagaacctgaggactatgagctgctccaaattttgagtgatgacagaaagttgaaaataccagaaaacgcgaatgtcttttatgccatgaattctactgcgaattatgactttgtgctcaaaaagagaacctttactaagggagtcaaagtgaagcacggggctagcagtaccttaccacgaatgaagcaaaagggcctcaaaatcgcgaaaggcattttttag

SEQ ID NO: 237849 - DNA, 1341 bp, Artificial Sequence
  Description of Artificial Sequence: Synthetic coding sequence
atgcccggaagcgacctcgaacgcagggcccatctgctgttggcacagctggagcactccgaacccatagaggctgagcctgaggcacttagccccgtccctgccctaaaaccgactccagaattagagctggccctgaccccggctcgtgcaccgtcccccgtaccagcccctgcacctgagcccgagccagcccctacaccggcacccggttctgagctggaggtcgctcctgcccctgcccctgaattgcagcaggcccctgaacctgcggtgggcctggagagcgcaccagccccagcactggagctggagcccgcacccgagcaagacccagctccatctcaaactctcgagctggagcctgccccagccccagtgccttctcttcagccctcatggccaagcccagtggtggccgagaatggcctatctgaagaaaaaccacacctgctggtcttcccgcctgacctggttgctgagcagtttaccctgatggacgccgagtgcaggattttaaagaactttagcagtctgtatgcaatactgtcagccttacagtcaaacagcattcacagactcaaaaagacttgggaggatgtttctcgcgactcctttcggatttttcagaagctgtccgagatcttctcagacgaaaacaattattctctttctcgggagctgcttattaaggagggcacgagtaaattcgcaactctggagatgaaccctaaacgagcacagaagcgacccaaggagacaggcataattcagggcaccgttccctatttgggcacgtttctcaccgatctcgtgatgctggataccgcaatgaaagactatctctacggcagactaatcaattttgagaaaaggcgtaaggagttcgaagtgatcgcacagattaagctacttcaatcagcatgtaataattacagcattgctccggatgagcagtttggagcctggttcagggctgttgaaaggctgagcgaaaccgagtcctacaacctaagctgtgagttggaacctccctccgaaagcgcatccaatacccttagaacaaagaagaacacagctatcgttaagcgatggagtgatagacaggccccatcgaccgagctgagcacatccgggtcatctcactcaaaaagctgcgatcagcttcggtgtggaccctacctgtcctccggcgacattgcagatgcgctgagtgtacactccgctggatctagctccagcgacgtcgaagaaataaacattagcttcgttcctgagtctccagatggccaggaaaaaaagttctgggaatccgcatcccaaagctcccccgagacatag

SEQ ID NO: 237850 - DNA, 2658 bp, Artificial Sequence
  Description of Artificial Sequence: Synthetic coding sequence
atgtgcttgtggggtcactcaaccgcacccgctcacacactgtcttctcctcctctcctgttctgttccttaccatgcgctctgcatcttcaacccggaactggacaccctcccggtcaggtgccaagaaaaagcagcacccaggagattggggaagagctaataaacggggttatatactcaatcagcctacggaaagtgcagctgcaccatggcggtaacaaggggcagcgttggctgggctatgagaatgagtcagcactcaatttgtatgagacctgcaaagtaagaacagtgaaagccggaacgttggagaaactcgtcgagcaccttgtgcctgccttccagggctccgacctgagttacgtgacaatcttcctgtgtacctatcgtgcgtttaccaccacgcagcaggtgctggatctgctatttaagaggtatggctgtatccttccttacagcgacgaagacggtggacctcaggatcagctcaaaaacgccatttcttcaattttgggtacttggcttgatcaatacagcgaagacttctgccagcccccagacttcccctgcctcaagcagctggtcgcctacgttcagttaaatatgcccggatcagatctggagaggcgagcccaccttctgctcgcccagctggagcactcagagccaattgaagccgaacccgaagcattgagccccgtgcccgcactgaaacctacccctgagctggagctggcactcactcctgcacgtgccccatcaccagtccctgctcccgctccggaacccgagccagcgcctacgcccgcacccggatccgaattggaggtagccccagcgcctgcccctgaactccaacaagcacccgaacctgctgtcggactcgagagcgctcctgctcctgcgctggagttggagcctgccccagaacaagatcctgctccttctcaaactctggagctggaacctgctcccgctcccgtgccaagtctacaacctagctggccctccccagttgtggccgaaaacggcctcagtgaagaaaaaccccacctgctcgtctttccccctgatctggttgcggaacagttcaccttaatggacgcagaactttttaagaaggtggtcccgtaccattgtcttgggtcgatctggtctcagcgcgataagaaaggcaaggaacacctggccccaacaattcgtgccacagttacccagttcaactcagtcgctaattgtgtaattaccacttgcctaggcaatcgaagcacgaaagcacctgatagggcccgagttgttgagcattggatagaggtagctagggagtgtcgcatcctgaaaaacttctctagcctttacgccattctgtcagccctccagagcaactccatccacaggttgaagaaaacatgggaggacgtgagccgcgactcgttccgtatttttcaaaagctaagtgagatcttctccgatgagaataactattccctttcccgcgagctgctcatcaaagaaggaacctcaaaatttgccacgctcgagatgaacccaaagagagcccagaagagacccaaggagactgggatcatccagggaaccgtcccatacctgggcacttttctgactgatctcgtgatgctggacacagctatgaaggattatctttatgggagactgattaacttcgagaaacggagaaaagaattcgaagttatcgcacagattaaactactgcagtcagcgtgcaataattacagcattgcacccgacgaacaattcggcgcatggttccgggcagttgagagattgagcgaaaccgaatcttacaatctctcatgtgaattggagcctccttcggagtccgcgtctaacacactgcgcacaaaaaaaaatactgccatagttaagcggtggtctgacagacaggccccaagcactgaactctctacctccggttcttctcactctaagagctgtgatcagttaagatgtggcccttatctctcatcaggcgacatcgctgacgctctctcagtgcactctgctggctcatcctctagcgatgttgaagaaatcaacatctctttcgtgcctgaaagcccagacggtcaggaaaagaaattctgggaaagcgcttctcaatcctctccagagacatccggcatctcgtccgcgagttcaagcaccagctccagcagtgcttctacgactccagttgctgccacaagaactcacaaacgaagcgttagcggactgtgtaactccagtagcgctttgcctctgtataatcagcaggtaggggactgttgtattataagggtcagcctggatgtagacaacggtaacatgtacaagtctattctcgttacaagtcaagacaaggcaccagctgtgatccggaaagcgatggataagcacaatctggaggaggaggaacctgaggattacgaactgttacagattctctccgatgacaggaagcttaaaatccctgaaaacgcgaatgtgttttatgcaatgaatagtaccgctaattacgacttcgtgctcaaaaaacgaacttttaccaagggggtaaaggtcaaacatggcgcatccagtactctccccaggatgaagcagaaaggcttaaagatcgccaagggtatattctag

SEQ ID NO: 237851 - DNA, 2742 bp, Artificial Sequence
  Description of Artificial Sequence: Synthetic coding sequence
atggcacgcgaagctgggcaagtttgcgcacgccctgctgtgcccagaggccgaaagggctccgtgttttttgcctgtgtcagcgtggtcaccgcccgtaggagagctgtggctcgcagagcagcactccagtctcccactccctggctggcaccattacccgcacccgctactacagaatcctccacacaggaaataggtgaagaactgatcaacggcgtcatctatagtatctcgttacgtaaggtgcaactccatcatgggggtaacaaaggtcagcgctggttgggttacgaaaatgagtctgccttgaacttatacgagacctgcaaagtgagaactgtgaaggcaggcacactcgaaaaactggtggaacacctggtaccagcgttccagggaagcgacctctcttatgtcactattttcctgtgcacttatcgcgcatttacaaccacccagcaggtgctagacctcttgtttaagagatacggacgttgtgacgctttaacagcctcatctcggtacggctgcatactgccttattcagacgaggacggagggcctcaggaccagctcaagaacgctatctcttccattctgggcacatggctggatcagtattcagaggacttctgtcagcccccagattttccatgcctcaagcagttagtggcctacgtgcagttgaacatgcctggttctgaccttgaacgcagagctcatctgctgctcgcccagttggagcattccgagcccatcgaagcagaacccgaagccctttcccctgtacctgcactcaaacccactcccgagttggaactcgccctgacccccgcaagagcccctagcccggtgcctgcccctgcccctgagcctgagcctgctccaacgccagctcccggaagtgagctagaggtggcccctgcccctgccccagagctgcaacaagccccagaacctgccgtcggattagagagcgctcctgcacctgctttggagctcgaaccggctccggagcaggatcccgcaccatcgcagaccctggagctggagcccgcacccgctcccgtgccctcactgcagccgagctggccctcccctgtggtggccgagaacggccttagtgaagagaagcctcatctgctggtgttccctcccgatctggtggccgagcagtttaccctaatggacgcagagttgtttaaaaaagtagttccataccattgcctgggatctatatggtctcagcgcgacaagaagggcaaggaacatctcgcacctactatccgcgcaacagtcacccaattcaattctgtggccaattgcgtgatcacaacctgcctgggcaatcgcagtactaaagccccagatcgagcgagggtagtggagcactggattgaagttgcaagggaatgccgcattctgaagaatttctcatcactatatgccatcctgtctgccttgcaaagcaatagtatccaccgactgaagaagacttgggaagatgtctcccgcgacagttttaggattttccagaagttgagtgagatcttttctgatgagaataactactccctgagcagagaattactgattaaggaggggacttctaagttcgcaacactcgaaatgaacccaaagcgtgcacagaagcgccctaaagagactggcatcattcagggcaccgtgccttatctgggaacttttttaaccgaccttgtgatgcttgacacagctatgaaagactatctctacgggaggctcatcaatttcgagaagaggcgaaaagagtttgaggtgattgcccaaatcaaactattacagtctgcctgtaacaattacagcatcgccccagacgagcagtttggcgcttggtttcgagctgttgagaggctttcagaaaccgagtcatataatctcagttgtgaattggagccaccttccgaatccgcgtcgaacacactgagaactaagaaaaacacagccatagtgaaacgatggtccgataggcaggctccttccacagaactgtccacctctggatcatcacacagtaagtcatgtgaccagttgcgatgcggcccttatctaagctcaggcgacatcgcagacgccctatccgtgcactcagcaggcagcagttcatccgatgtggaggaaattaacatctctttcgtgccagaatccccagacggacaagaaaaaaagttttgggaatcagcatcccaatccagtccagagacaagcgggatcagtagcgcgtcttcttctacatcctcatcgagtgcctccacgacaccggtggctgctacccggacccacaagagatcagtgagcggtctgtgtaatagtagttcagccctgccattatacaatcaacaagtgggcgattgctgtataatccgcgtaagtttggacgtcgataatgggaatatgtacaaaagcatcctggtaactagtcaagacaaagcgccagccgtcatacggaaagccatggacaaacataacttggaagaggaagaaccagaggactacgagcttctccagatcttatcagatgaccgtaaactgaaaattcccgaaaacgcaaacgtcttctacgccatgaactccactgccaattacgattttgtgctgaaaaaacggacttttaccaaaggagtcaaagtcaaacacggagcctcaagtacactgcctaggatgaagcagaaaggtcttaagattgccaaaggtatattctag

SEQ ID NO: 237852 - DNA, 2580 bp, Artificial Sequence
  Description of Artificial Sequence: Synthetic coding sequence
atgatggtcgactgccaaagttccacacaggagataggggaggagttaattaatggggtcatatacagtattagccttcggaaggtccaactccaccacggcggaaacaagggccaaaggtggctgggctacgagaatgagagcgcattgaatttgtacgagacatgtaaagtgcgcaccgttaaggctgggacgctggaaaagctggtcgaacatcttgtccctgcttttcaagggtccgacctgtcttacgtgacaatattcctttgcacttatagggccttcaccacgacacagcaagtgctggatctgctatttaaacggtatggacgctgcgatgcactcactgcttcttcacgctacgggtgcatcctgccttactcagacgaagacgggggacctcaggatcagcttaagaatgcaatatcatcaatcttgggcacctggctggatcagtactccgaggacttctgtcagccacccgactttccctgcctgaagcagcttgtggcatacgtgcagttaaatatgcccggaagtgacctcgagcgaagagctcatttgctgttagcacagctcgagcattcagagcctatcgaggctgaacccgaagcactctctcccgtacctgccctgaagcctactcccgagctcgaacttgcccttactcccgctagggccccttcacccgtcccggcacccgctcccgagcctgagcccgcacccaccccggcacccggtagcgaacttgaagtggcacccgcacccgcacctgagctgcagcaggctccggaacccgctgtcggcttggagagtgcacccgctccagccctggagctcgagccagctcccgagcaggatcctgctccctctcagactttagagttagagcccgctccagctcccgtgccctcccttcaacctagttggcctagtcccgtggtggctgaaaacggactcagcgaagaaaagccccatctcctcgtttttcctccagacctggtggcagaacagtttacgctgatggacgcagagctatttaagaaggtggtcccttatcactgcctgggtagcatttggagccagcgcgacaaaaagggcaaggaacacctggccccaaccatacgggcaacggtcacccagtttaatagtgtggccaactgcgtgatcaccacttgcctggggaatagatccactaaagcacctgaccgagcaagggtggttgagcactggatcgaggtggcccgagaatgcagaattttgaagaacttttccagcctctacgccatcctaagcgcgttacaaagcaatagtatccatcgtttgaaaaagacctgggaagatgtttcccgggactcctttcggattttccagaagctgagtgagattttcagtgacgagaacaattatagtctatcccgcgagctgttaatcaaagaggggacaagtaaattcgccaccctggagatgaacccaaaacgcgcacagaaacggccaaaagagaccggcatcatccaaggcaccgtgccatacctgggtacattcctgactgacctggtgatgctggatacagccatgaaagattacctgtatggaagattgatcaacttcgaaaaaagaaggaaggagttcgaagtaatagctcaaattaagcttctgcagagtgcctgcaataactactctatcgcaccagacgaacaatttggagcatggtttagagcggttgagcggttatctgaaactgagtcctataatctctcatgtgagttagaacctccctcagagtctgcatcaaacacgttgcgcactaagaagaacaccgccatcgtgaaacgatggtccgatagacaggcaccctcaaccgaactgagcacatcaggttcctcccactctaagtcttgtgaccagctgagatgcgggccttacctctccagcggagatattgcggacgctctgtctgtgcacagcgccggatcgtcatcatctgacgtggaagagatcaacatcagtttcgttccagaatcacctgatggccaggaaaaaaagttctgggaatcagcatcacagtcttcgcctgaaacaagtggtatatctagcgcatcttcctccacctctagctcctccgctagtacaactccagtcgcagccacaaggacacacaagcggtccgttagtggcctgtgcaacagctcttctgctctcccactatataaccaacaagtaggtgactgttgtatcattcgagtcagcctggacgtcgacaacggaaacatgtacaaaagcattttggtcacaagtcaagataaggcaccagccgtgatcaggaaggctatggacaaacataaccttgaagaagaagaacccgaagattatgagcttctgcagattctgagcgatgaccgtaagcttaagatcccagaaaacgctaacgtgttctacgctatgaatagcactgcgaactacgattttgtcctaaaaaagcggacattcactaagggcgtgaaggtgaagcacggtgcatcttccacactgcccaggatgaagcaaaagggcttaaaaatagccaagggaatattctag

SEQ ID NO: 237853 - DNA, 930 bp, Artificial Sequence
  Description of Artificial Sequence: Synthetic coding sequence
gtcgttgcagaaaacggtctgtcagaggagaaacctcacctactggtgttcccacctgacctagtggccgaacaatttacattgatggatgctgagtgcaggatcctgaagaatttcagcagcctgtatgcgattctgagcgctctgcagtccaatagtatccataggcttaagaagacctgggaggatgtgtcccgggactcattcagaatctttcaaaagttaagcgagattttctccgatgagaataactacagcttgagccgggaacttcttatcaaggaaggaactagcaaattcgcaaccctggagatgaacccgaagcgtgcgcagaaacgcccaaaggagacgggtattattcaggggaccgtgccatatctcggcaccttccttactgatctcgtgatgctcgatacggcaatgaaagactatttgtatggccgactcattaacttcgaaaagagacgcaaagagttcgaggtcatcgctcagattaaactgttacagtctgcgtgtaacaactactcaatcgccccagacgagcagtttggagcctggtttcgggcagtcgagaggctgagcgaaactgaaagttataacctgagctgtgagttggagccccctagcgagagcgcatccaacactctgcgaaccaagaagaacacggcgatcgtgaagagatggtctgaccggcaggccccatcgactgaactgtcaacctccgggtcttcccacagcaagtcttgcgatcagctgagatgtgggccttacctctcgtccggcgatatcgcagatgctctatcggtccacagcgcgggatccagttcaagcgacgtcgaagagatcaatatctctttcgtgcccgagtcccccgatgggcaggagaagaaattttgggaatccgcctctcagtcctccccagagacatag

SEQ ID NO: 237854 - DNA, 2958 bp, Artificial Sequence
  Description of Artificial Sequence: Synthetic coding sequence
atgcaccgtcgcaggctggcactcgggcttggcttctgtctgctcgctggcacatccctgtcagtgttgtgggtgtacctggaaaactggcttcctgtgtcctatgtgccgtattatctcccctgtcctgagatcctcccaatgatgatggccttgtcttgtttatgtcatcagcaacacgaggccgctctgcaggaaggagaggccacccccgcaagaggaatggtgactgtgccaagtgcacaggcagcaggcgcacaagctcatactgctgcagacacacacactctcgtgggagctcacaggctcaggggtaatctacagccgagggccagtgccgctcacctgcccgctaccgagcccgatcattggggacatggcgtgtgccggggagagagctctactcaagaaatcggcgaggagctcattaacggtgtgatctatagcattagcctgaggaaagtccagctccaccacggaggaaacaagggccagagatggttaggctatgagaatgaatccgccttaaatctgtacgaaacatgcaaggtccgaacggtgaaagccggtacactcgaaaagctcgtcgagcacctagtgcccgcattccaggggagcgacctaagctatgttaccatctttttgtgcacttatcgggctttcacaaccacccagcaggtgctggatcttctttttaaaaggtatggtcgatgcgatgccttgacagcatctagtagatatggctgtattttgccatatagtgatgaagatggcggtccacaggaccagctgaaaaatgctatatcttcaattcttggcacttggctggaccaatatagcgaggacttttgccaaccgcctgactttccttgtctgaagcaactggtggcctatgttcagctcaacatgcctggcagcgatctagaaaggcgggcacatcttctgttagcacagcttgaacactccgagccaattgaggccgaaccagaagcattaagtcccgtccccgctcttaaacccactccagagctggagttagctctgacacccgctagggctccatctcctgtgcctgcgcctgctcccgagcccgagccggctccgacacccgcacccggatctgaactcgaagtcgcaccagctcctgcgcctgagttacagcaggccccagagcccgcagttggcctggaaagtgcccctgcgccagccctagagctcgagccagcccctgagcaggatccagccccatctcagaccctcgagttggaaccagctccagcaccagttccttccctgcagccaagctggccctcaccagtagtggctgagaacggactcagcgaggaaaaaccgcacctgctggttttccctcctgatctggtggccgaacagttcactctgatggatgccgaactgttcaagaaggttgtcccttatcattgtctcggctctatctggtcgcagagggacaaaaaaggcaaggagcacctcgccccaactatcagggcaacagtgacccagtttaattccgtggcaaactgtgtgattacaacgtgtctaggaaatcgcagcactaaggcacccgaccgggctagggtggtcgagcactggatcgaggttgcacgcgagtgccgaatattgaaaaacttctcatcgttgtacgccatcctcagtgcccttcagagcaattccatacacagattaaagaaaacatgggaggacgtaagccgcgacagctttcgaatattccagaaattgtctgagatcttctcagatgaaaataattacagcctgtctcgggagctcttgatcaaggaagggacaagtaagtttgcgactctggaaatgaatcctaagcgtgcgcagaaacgccctaaagagacgggcattatacagggtactgtaccctatctgggaacgtttcttaccgatttggtaatgctggatacagcaatgaaggattacctctacgggaggctgataaatttcgagaaaagacgcaaagaattcgaagtaatagcgcagataaagctgcttcagagtgcctgtaacaactattcaattgctcccgatgagcagtttggggcttggttcagggccgttgaacggttatccgaaactgaaagctacaatctttcgtgcgagcttgagccaccctccgagtcagcgtccaatacccttaggacgaaaaaaaacaccgccattgtgaaaaggtggtctgacagacaagcgccatccacagagttatccacttcaggatcgagccactccaagagctgtgaccaattgagatgcggcccatacctgtcttcgggtgacattgccgacgctctgagcgtgcactctgcaggctcatcgagcagtgacgtcgaggagatcaacatatccttcgtacctgagagcccagacggacaggagaagaagttttgggaatccgcttcgcaaagcagccctgaaacatctggaatttcatccgcaagttccagcactagtagttcctctgcctccaccacacccgtggctgccactagaactcataagagatctgtgtccggactgtgtaacagcagctcagctctgcctctctataaccaacaagttggagattgctgtatcatccgcgtgtctttagacgtagataacggaaacatgtacaaatccatccttgttacttcccaggataaggcccctgctgtgatccgaaaagccatggacaaacacaatttagaggaggaagagccggaggattacgagctactgcagatcctctcagacgacaggaagcttaaaatacctgagaacgccaacgtgttttatgcgatgaactcaaccgcaaactatgatttcgtgctgaaaaaaagaaccttcacgaagggagtaaaagtaaagcatggcgcttctagcaccctccctcgaatgaagcaaaaaggactgaagatcgctaaaggcatattctag

SEQ ID NO: 237855 - DNA, 2412 bp, Artificial Sequence
  Description of Artificial Sequence: Synthetic coding sequence
atggaggttaaaccagtgggggagccaacccaggaggtcagtaagttcaaattgagcacaaaggtggagtctacgggtcactggctggtggaggatcatgtgcgaatctgggaagtgctgaaaaccgaggagagctcaatccaggattggggtgaggaagtagaggagggggctgtgtaccacgtaacccttaagagggttcagatccagcaggcagccaacaagggggctcgatggttgggggtggaaggagatcagctcccacccggacacactgtgtcacagtatgagacctgtaaaattaggacgatcaaggccggtaccttagaaaagctggtggagaatctcttaacagcctttggggacaatgattttacatatatttccatttttctgtccacctatagaggattcgccagcacgaaagaagtgctagaactgctcttagatcgatacggaaacctgactagtcctaattgtgaagaagacgggagtcagagctccagcgaatctaaaatggtcatccgtaatgcaatcgcctccatattgcgagcctggttagatcagtgtgccgaggatttccgtgagccaccgcactttccatgtttgcaaaaattgctcgactacctgaccagaatgatgcctggcagtgatccagagagacgggctcagaacctgttggagcagtttcagaaacaagaggtggagactgacaacgggcttcctaacactataagcttctccttggaagaggaggaggagctcgagggcggagaatctgccgagttcacatgtttttccgaggatttagtagcggagcagttgacttatatggacgcccaattatttaaaaaagtcgtcccacaccactgtctggggtgtatttggagtcggcgagataaaaaggagaacaaacacctggcccctacaatcagagccacaatctctcagttcaacactttaactaagtgcgttgtcagcacaatactcggcggtaaggagctcaagacacagcagagagctaagattatagagaagtggatcaacatcgcgcacgaatgtcggctgctcaagaactttagttctctgagggctatagtgagcgctctgcagtccaacagcatttaccggcttaagaagacatgggctgccgtgcctcgcgaccgcatgctgatgttcgaggagttaagcgacattttctctgatcacaacaaccatcttacatcccgggaactgcttatgaaagaaggcacaagtaagtttgctaatctcgattccagtgtgaaagaaaaccagaaaaggacacagaggaggttgcaattgcaaaaggacatgggagtcatgcagggcacggtgccatacttgggaacttttttgacagatttgacgatgctcgacacggcactgcaggactatatcgaagggggacttatcaattttgagaagcggcgaagggaattcgaggtcatcgcccagattaaattacttcaatcagcatgcaatagctactgtatgaccccagaccagaaattcattcagtggtttcagcgtcaacaattgttaaccgaggaagagagctacgccctctcttgcgagatagaggccgctgctgatgcctctaccacgtctcccaaacctaggaagagtatggtcaaacgcctgagtttgctctttctgggtagcgacatgatcacctcccccaccccgaccaaggagcagcccaagtctaccgctagcggatcatcaggcgagagcatggactccgtatccgttagctcttgtgagtcaaaccattccgaggcggaagaaggttcgatcacccccatggatactccggatgagcctcagaaaaagctgtctgaatcctcctcatcgtgtagttctatccattcaatggatacaaacagtagtggaatgagcagcctgataaatcccctctcctcacctccctcttgtaacaataaccctaaaatccataaaaggtctgtttctgttaccagtatcactagcaccgtgctgcctccagtatacaatcaacagaatgaagatacatgcatcattagaatttctgtggaggacaacaatgggaatatgtacaaatcaatcatgctcacatcacaggataagacccccgcagtgatacagagagccatgctaaaacacaatctcgattcagatcctgcagaggaatatgaactggttcaggttatctctgaggacaaggaactggtgatccctgacagcgcgaacgtgttttatgcaatgaattcccaggtcaactttgatttcatactgcgtaagaagaattccatggaggagcaggttaaactccgctcccgcactagccttaccctgcctcgcacagccaaaaggggctgttggtccaatcggcactcaaagataaccctctag

SEQ ID NO: 237856 - DNA, 2307 bp, Artificial Sequence
  Description of Artificial Sequence: Synthetic coding sequence
atgaagttattgtggcaggctaagatgtccagcatccaggactggggcgaagaggtagaagagggagctgtgtatcatgtgaccctcaaacgggtacagatccaacaagcagctaacaaaggagcacgctggctgggcgttgaaggtgaccagctgcctcccggacacaccgtgagccagtacgagacatgtaaaattcgcaccatcaaggccggaacgctggaaaaacttgtcgaaaacttgctgaccgcttttggtgacaacgattttacgtacatcagcatcttcctcagtacttataggggatttgcaagcacaaaagaagtactggagctcctgttggatcgctacggcaacctcacaagtcctaattgtgaggaggatggatcacagtcatcttccgagtcgaagatggttattaggaacgctattgcttctattctgagagcttggctggaccagtgcgccgaggactttagagagccgccacattttccttgccttcagaagctactggactacctgactagaatgatgccaggctcggaccctgagcgaagggcacagaatcttctcgagcagtttcagaaacaagaagtggaaacagataatggcctgccaaatacaatctcattctctttggaggaagaggaggagctagagggcggtgagagtgcggaattcacctgtttctccgaagatttggtcgcagagcagcttacctacatggacgcgcagttgttcaagaaagtggtgcctcaccattgcctgggctgtatctggtctcggagagacaaaaaagaaaacaagcacttggctccgactattcgggcaaccataagtcaattcaacactctcacaaaatgcgtcgttagtacaatacttggcggtaaagagctaaaaacccaacagcgggcaaagattatcgaaaagtggattaatatcgcccacgaatgtaggctgctcaagaatttttcttcgctgcgcgctatcgtatccgccctccagtccaatagcatctataggctgaagaagacctgggccgcagtgccccgagacaggatgttgatgttcgaggagctgagcgacatcttcagtgaccacaacaatcatctgacttctcgggagctgctgatgaaagaaggcacatcgaagtttgctaacctggactcatctgtgaaggaaaatcagaaaaggacccagcgcaggctgcagttacagaaggatatgggagtgatgcaagggactgtgccttacctcgggacctttttgaccgatcttaccatgctggacactgcactgcaggattacattgagggcggactaattaatttcgagaagcggaggagggagttcgaagtcatagctcagataaagctgctccagagcgcttgcaacagctactgtatgactcccgaccagaaattcatccaatggttccaaagacaacagttactcaccgaagaggaaagttatgccctgagctgcgaaatagaggccgctgccgacgcctcaactacctcccctaagcccagaaaaagtatggttaaacgcctgtcgttactgttcctgggatctgacatgatcacgtccccaacccctaccaaggagcagcctaagagcaccgccagtggctctagcggcgagtcaatggactctgtgtcagtcagttcttgcgagagtaatcacagcgaggccgaggagggttctatcactcccatggacacgcctgacgagccacagaaaaaattgtctgagtcatcaagcagttgctcttcaatccactctatggatacaaactccagcggtatgtcttcccttatcaaccccctgtctagccctccctcatgcaacaataatcctaagatccacaaacgaagtgttagcgtcacatcgattacatccactgtgctcccccctgtgtataaccagcagaatgaagacacatgcatcattcggatctcggtggaggacaacaacgggaacatgtataagagcatcatgctgaccagtcaggacaagactccagccgtgatccaaagagctatgctaaagcacaacttagactcagatccagcagaggaatacgagttagtacaggtgattagtgaggacaaggaactggtcatccccgatagcgctaacgtgttttacgcaatgaactcccaagttaatttcgatttcatcctgcggaagaaaaattccatggaggagcaggtcaaattgagaagccgcacaagccttaccctgcctaggacggccaaaaggggctgctggagcaatcggcactcaaaaattactttgtag

SEQ ID NO: 237857 - DNA, 2412 bp, Artificial Sequence
  Description of Artificial Sequence: Synthetic coding sequence
atggaggtgaaaccagtgggcgaaccaacccaggaggtgtcgaagtttaaactaagcacaaaggtggaatccacagggcactggctcgtagaagaccatgtgcgcatttgggaggtgctgaagaccgaggaaagttctatccaggactggggggaggaagtggaagagggcgcagtgtatcatgtgaccttaaaaagagtccagatccaacaagctgctaacaaaggcgctcgctggctgggcgtcgaaggcgatcaactgccacccggacacacagtcagtcaatatgaaacatgtaaaatccggacgattaaagctggcaccctcgagaagctggtggaaaacctactgacagcattcggtgacaatgacttcacatacatcagtatcttcctcagtacctaccggggattcgcgagtacgaaagaagtgctcgagttacttctggatcgatacgggaatctgaccagcccaaattgtgaggaggacggctcccagtcttcttccgagtccaaaatggtgatacgtaacgccatagcctctatcctaagagcctggcttgaccaatgcgctgaagattttagagagccccctcactttccttgcctccagaaactgttagattaccttaccaggatgatgcccggaagtgatcctgaaaggagggcacaaaatctgctcgaacagtttcaaaagcaggaagtggaaacagataacggactgcctaatactatcagctttagtttggaagaagaggaagagctggaaggaggtgaatcagccgaatttacttgtttcagtgaagatctggtggcagaacagttgacctacatggacgcgcagctttttaagaaggtcgtgccacaccattgcttaggctgcatctggagcagacgcgacaagaaggaaaacaagcatctggccccaaccatccgcgctactatctcacagttcaataccctcacaaagtgtgtggtgtccactattctgggaggtaaggaactgaaaacacaacagagagccaagatcattgagaaatggattaacatagctcacgaatgccgcctcctgaagaatttctcttcactccgcgcaatcgtgtccgcactgcaaagtaattccatttaccggctgaaaaaaacgtgggccgctgtcccccgagacagaatgctgatgtttgaggaactctctgacatcttcagcgaccataataaccacctaacatcacgtgagctgctcatgaaggagggaacctcgaagtttgccaaccttgacagctctgtgaaggagaatcaaaagcggacgcagaggcgccttcagctccagaaagacatgggcgtcatgcagggcacagtgccgtatctcggcacattcctgaccgatttgacaatgcttgacaccgcactgcaggattacatcgagggcggactgattaatttcgagaaaagacgtcgcgagtttgaagttatcgctcagattaagctcctgcagtcagcctgtaactcttattgtatgactcccgatcagaaatttatccaatggttccaaagacagcagctcttaacagaggaggaatcatacgccctcagctgcgaaattgaggccgcagcagacgcttcaacaacatctcctaagcctcggaagagtatggttaaaaggctttcactgctattcctgggctctgatatgatcactagcccaactcctaccaaggagcagcctaagagcactgcttccggctcttccggtgagtctatggacagtgtgtccgtttcatcctgtgagtctaatcattccgaggctgaagagggctctatcacacccatggacacacctgacgagccacagaaaaaactgtccgaatcctcttcctcctgttcatctatccatagtatggacacaaatagctccggcatgagttccctgataaatccactcagctcacctccctcatgcaacaacaaccccaagattcacaagcgctctgtgagtgtgaccagtattacctctaccgtgcttccccctgtatataatcagcagaacgaagacacgtgtataattaggatctccgtggaggataacaatggcaatatgtataagagcattatgctgacgtctcaagacaagactccagccgtcattcagagagctatgcttaaacacaacctggatagtgatcccgcagaggagtacgagttggtgcaggttatctctgaggacaaagagctggttattcccgatagcgctaacgtattttacgccatgaactcccaggtgaatttcgattttatccttcgtaagaagaattcgatggaggaacaggtgaagttgcggtctcgcaccagtctgacactgccaaggacagccaagagaggctgttggtccaacaggcattccaagatcaccctgtag

SEQ ID NO: 237858 - DNA, 2301 bp, Artificial Sequence
  Description of Artificial Sequence: Synthetic coding sequence
atggaggtaaagcctgtcggagagcctacccaggaggttagcaagtttaaactcagcacaaaagtcgagtccacagggcattggctggttgaagatcacgtgcggatctgggaggttctgaaaacagaagaagtcgagggcgaccagctacctccagggcacacagtctctcaatacgagacttgcaaaatccgcaccatcaaagcgggaactctggagaaactggtagaaaacctgctgacggcctttggagacaatgatttcacttatatctctatctttttgtcaacctaccgcggattcgcgagcaccaaggaggtgctggagctgcttctggacaggtacggcaatctaaccagcccaaattgcgaggaggacggttctcagagtagttcggagtcgaagatggttattaggaatgccattgcctcaatcctgcgtgcatggctggaccagtgcgccgaggacttcagggaaccacctcatttcccttgtctgcagaaactgctggattacttgaccaggatgatgcccggatccgatcccgaaaggagagcacagaatctcctggagcagtttcagaagcaggaggtcgagactgataacggccttccgaacacaattagcttttctttggaggaagaggaggaattagagggcggagagtcagccgagtttacatgttttagtgaggacctggtagcagagcagctgacatacatggatgcgcagctgttcaagaaggtggttccccaccactgtctggggtgcatctggtctaggagggacaagaaagaaaataagcacctggcaccaacaatacgagcaactatctcccagttcaatactcttactaaatgcgttgtgtcgacaatcttgggcggtaaagaacttaagactcagcagcgagcgaagataatcgagaaatggattaatattgcacacgagtgccgactgttaaaaaacttcagctccctgagggcaatcgtgtcagcgctgcagtctaactcaatctaccgcctcaaaaaaacatgggctgcagtgcctcgagacagaatgctgatgttcgaagaactgagtgatattttctccgatcacaacaaccatcttacttccagagaacttctgatgaaagagggcacatcgaagtttgcgaatctcgattcatcagtgaaggagaatcaaaaaagaacacagcgcaggctgcaactccagaaggatatgggcgttatgcaaggcacggtgccctacttggggacttttctaaccgatctgaccatgctggacacagcactgcaagattatatagagggtggactaatcaactttgagaagcggcgtcgggaatttgaagtcatcgcccagataaaattgctgcagtcggcttgcaattcttactgcatgaccccggaccagaagttcatccaatggttccaaaggcagcagctccttactgaggaagagagttatgcactctcatgcgagattgaagccgcagctgacgcgagcacaacttcaccgaaaccccgtaagagcatggtcaaaaggctgagccttctgttcctcgggtcagatatgataacaagtcctactccaaccaaagagcagccaaagagcaccgcgagtggctctagtggggagtcaatggactccgtgtcagtgagcagctgcgagtccaatcatagcgaggccgaagagggatctatcactcccatggacactcccgacgagcctcagaagaaactttcggaatcgtctagctcttgttcctctatacattcaatggacacaaattcatctggcatgagctccttgatcaaccctctcagcagtcccccttcatgcaataacaatccaaaaatccacaaacggagcgtgtcagtcacctccataactagcacagtcctgcctcccgtatacaaccaacaaaacgaagatacttgcatcattcgcataagtgtagaagacaacaatggtaacatgtataaatcaatcatgctgacgagccaggacaaaaccccagctgttatacaaagagcaatgctgaagcataacttggacagtgaccctgccgaggaatacgaactggtgcaggtgatctcagaggataaagaattggtgatccctgactcagccaatgtcttctatgccatgaactctcaggtcaactttgacttcatcttgcggaagaagaactctatggaggaacaggtgaagctgcgcagcagaacgagcttaacattgccgcgtactgctaagcgagggtgctggtccaatcgacactcaaagattactctatag

SEQ ID NO: 237859 - DNA, 2220 bp, Artificial Sequence
  Description of Artificial Sequence: Synthetic coding sequence
atgaaactcttgtggcaggcgaaaatgtcatcaatacaggattggggagaagaggtggaggagggggctgtttaccacgtaacacttaaaagggttcagatccaacaagctgcgaataaaggcgcaaggtggctgggggtcgagggcgatcaactgcctcctggacacaccgtcagtcaatacgaaacttgtaagataaggactattaaagcaggtactttggaaaagctggtggaaaaccttcttacagcatttggagacaatgatttcacctacatctccatattcctgagcacttatcgcggttttgcatccacaaaagaggtcctagaacttctcctcgacagatatggtaatctgacttcgcctaactgtgaggaagatggctcccagtcgtcatctgagtcaaagatggttattcgcaatgctatcgctagtatactccgcgcttggctggatcagtgtgctgaggattttagagagccgccacacttcccatgcctgcaaaaactgctggactatcttacaagaatgatgccaggttcagacccagagagacgagctcagaatctccttgagcaattccaaaaacaagaggtcgagacagacaacggtctccccaatactatttcgttcagcctggaggaggaagaggagttggaaggcggagaaagtgcagagttcacgtgcttctcggaggatttggtggctgagcagttaacatacatggatgctcagctgtttaagaaagtggtgcctcatcactgccttggctgtatctggtcccggagagataagaaggagaataaacatctcgcgccaaccatcagggctacaattagccagtttaacactcttacgaaatgcgtggttagcacaatccttgggggtaaagaactgaagacacaacagagggccaaaatcattgagaaatggatcaacatcgcacacgagtgtcggcttttaaaaaacttttctagtctgagggccatcgtatctgccctgcaaagcaactccatttaccgccttaaaaagacttgggcagccgttccacgagaccgtatgctgatgtttgaagagctatctgacatttttagcgaccacaataatcatctcacaagccgggagttgcttatgaaagaaggaacctctaagttcgccaacctggatagttccgtaaaggagaatcaaaagcgcactcagcgaagactccagctacagaaagatatgggaggcctgattaatttcgaaaagcggagacgcgaatttgaagttattgcacagattaagttgctacagagtgcctgtaattcctattgcatgacacctgaccagaagttcatccagtggtttcaacggcagcagctgctaactgaggaagagtcatacgcactgtcctgcgaaattgaagctgctgccgacgcgtctactacctcccccaaacctcggaaatctatggttaaaagactgtctctgctttttttggggtcagatatgatcacttcacccactcctacaaaagagcagcctaagtcgaccgcgtctggcagctcaggggagtccatggatagtgtgtcagtttcatcttgtgagtctaaccactcagaagcggaagaaggctcaatcacaccaatggacacgcccgatgaacctcaaaagaagctgagcgagagcagttccagttgctcatcgattcactccatggacacaaacagtagtggaatgtctagtttgattaacccattgtcatcacctccgagctgtaacaataaccccaaaatccataaacggtcagtgtctgtaactagtatcacatcaacagttctgccccctgtgtataatcaacagaacgaagacacttgtattattcgcatctccgtcgaagacaacaacggcaacatgtataagtctattatgctaacttctcaggataagactcctgccgtgatccagcgggcaatgttaaagcataatttggactcagaccccgctgaggaatacgagctggtccaagtaatatcagaagacaaagagttagttattcctgatagcgccaatgtattttacgctatgaatagccaggttaattttgattttattttaaggaagaaaaattccatggaggagcaggtgaagctgaggagcaggacgtcattgaccctaccaaggactgctaagcgcggttgctggtctaatcggcattccaaaataactctttag

SEQ ID NO: 237860 - DNA, 1173 bp, Artificial Sequence
  Description of Artificial Sequence: Synthetic coding sequence
atgggttccttcaaggacagaggagacggcctgccaaacaccatctcctttagcttggaagaagaggaagagctcgaagggggagaatcagcggagttcacatgtttctccgaggatctggttgccgagcaactgacgtatatggacgcccagctcttcaagaaagtggtgcctcaccattgtctcggttgtatatggagtagacgggataaaaaggaaaacaagcacttggctcccacgatcagggccacaatctctcaattcaataccctgacaaagtgcgtcgtatccaccatcttgggcggaaaggaactgaagactcagcaaagggccaaaattattgagaagtggatcaatatcgcccatgagtgccgcctcttgaagaacttcagttcattgagggctatagtgagcgctctccagtccaactccatttacaggctaaaaaagacatgggcagccgtccctagagacaggatgctcatgtttgaggagttgtcagatattttttctgatcacaataaccacctcaccagtcgggaactgcttatgaaggagggaactagtaaatttgcgaacctggacagcagtgtgaaggaaaaccagaagcggactcagcgcaggcttcaactccagaaagatatgggcgtgatgcaggggacggtaccttacctggggaccttccttactgatctcaccatgctggataccgcactgcaggactacattgagggcggactgataaacttcgagaagcggcgacgagagttcgaggtaatcgcccaaatcaagctgctccagagcgcgtgcaattcttattgtatgaccccagaccaaaaatttatccagtggttccagcgccagcagctgctgaccgaagaggaatcgtacgcactatcctgcgagatcgaggcggcagcagacgcttccactacttctcctaagccaagaaagtctatggtcaagagattgtccttgctgttcttgggcagcgatatgataacttcaccaacccctaccaaagagcagcctaagagcaccgcttcaggcagctcgggtgaatccatggatagcgtcagtgtttccagctgcgaaagcaaccactcagaggctgaggaaggatccatcacgccaatggacacccccgacgagccacagaagaaggcactgtag

SEQ ID NO: 237861 - DNA, 1422 bp, Artificial Sequence
  Description of Artificial Sequence: Synthetic coding sequence
atgcgaaagctgcttacaaacctcccggctgccgctgttttgtctgcccaggtatactctgcagtgcttcagggcctatgggaggagaatgtttgcgggacacccggtcggacccgcgtatgtaccgccttgctatatgggcaggtttgcccattccaggattctactgatgggctgcggactattacctcaattctgttcaactggccccctgagaacacgtcagtgtattaccagcctcctcagcgcagctccttccgcattaagttggccttcagaaatctttcttggcctgggctggggctggaggaccaccaggagatagtgctaggccagttagtactcccagaaccgaatgaagctaagcccgacgatcccgctccaaggccagggcagcacgccctcaccatgcctgctctcgagcccgctccacctttgctagccgatctgggcccagccctcgagcccgagagtcccgcagctctgggcccacccggatatctgcatagcgcccctgggcctgcacccgcacccggagagggtcctccacccggtaccgtgttggagccacagagcgctccagagagcagttgtccgtgcaggggctccgtgaagaatcagccatccgaggaacttcccgacatgaccactttcccaccgaggctgctggccgagcagcttacactgatggacgccgagctgttcaaaaaagttgtgcttcacgagtgtttggggtgtatctggggccagggccatctgaaaggcaacgagcatatggctcccaccgtccgtgcgacaattgcccattttaatagattgaccaattgcatcaccacctcgtgcctgggtgatcattccatgcgtgccagagaccgggctagggtggttgagcactggataaaggtggcgagagaatgcttgtccttgaacaacttttcttctgtccatgtcattgtcagcgctctgtgttcgaacccaatcggccagctgcataaaacgtgggccggagtctctagtaaaagcatgaaagaactaaaagagctttgcaaaaaagacaccgcagtgaagagagaccttttgattaaggctggatcttttaaagtcgccacacaggaaaggaatccacagcgcgttcagatgcgcctgaggcgtcaaaaaaagggtgttgtgcctttcctgggtgattttctcacagaattacagagactcgacagcgccataccagatgatctcgacgggaatacaaataagcgctctaaggaggttcgcgtccttcaggagatgcagctccttcaggtggcagctatgaattacaggcttcgaccattggagaaatttgttacgtatttcacccggatggagcagctgtcagataaggagtcttacaagctgtcttgtcagctcgaacctgaaaacccttag

SEQ ID NO: 237862 - DNA, 1743 bp, Artificial Sequence
  Description of Artificial Sequence: Synthetic coding sequence
atgcgcaaactgcttactaacctcccggctgccgcagttctgtcagctcaagtgtattctgccgtcctgcaaggtctgtgggaagagaacgtttgtgggactcccggtagaacaagagtttgtaccgccctgctatacggacaagtgtgtccctttcaggattcaacagacggactccgcacgattaccagcatattatttaattggcctcctgaaaacacctcggtctattaccagccgccacagcgctcctccttccgaattaaacttgctttccgaaacctttcctggccaggcctgggactggaggatcaccaggagatcgtcctcggacagttggtactgcccgaaccaaatgaagctaagcccgacgaccctgcacccaggcctggccaacacgcactgacaatgcctgctcttgagccagctccccctctgctcgctgaccttggccctgcgctagagccagaaagtcccgcagctctcggcccacctgggtatctccatagcgctccaggtcctgccccagctccaggggaaggccctccaccagggacagttctggaaccgcaaagcgcccctgagagctcatgcccctgccgtggatctgtgaagaaccagccttcagaggaactccctgatatgactacttttccgcctagactactagcggaacaattgaccttgatggacgctgagctcttcaaaaaggtggttttacatgagtgtctcgggtgcatctggggacaagggcacctcaagggtaacgaacacatggcccctaccgttagggccacaatagcccacttcaataggcttacgaactgtattaccacctcatgcttgggcgatcacagcatgcgagcaagagacagggcgagggtggtggaacattggatcaaggtggcccgtgagtgtctcagcctgaataatttctcctcggtgcatgtgatcgtctccgccctgtgtagcaatccaattggtcagctgcataaaacctgggccggtgtttcttcaaagtccatgaaagagctcaaggagctgtgtaaaaaggacactgctgttaaacgcgacctgcttatcaaggccggaagttttaaagtggctacacaggagcgaaatccacagagagttcaaatgcggctgagacggcagaagaagggtgttgtcccgtttttgggagatttcctcacagaattgcaacggctcgacagtgccattcccgatgatcttgacgggaacactaacaaaaggagcaaggaagtcagggtcctccaggagatgcagttgctccaggtggctgcaatgaactatcgcctccggccacttgagaaatttgttacgtacttcaccagaatggagcaattaagcgataaagaacgctgggggttcaccatgatgtcccgtatagtttccaactcatggccacaggccattcatccccctcagccgccaaaagtacttactctgcagctccaggcagtgctgccagccggtgcaaggaaacccgtgggatggcagcatcccgctgtcgccggaaacccaccgggttgctggcctgaacaccgactgtgcactatccctcacccagatcgtcggcatcagggcactacttccagacgactggcggctcaattacatctggctctcgacccccatcaccaattactgcttttggcacgaatacggccttgggatttttgtgaatctgggggacgcccattctacgtgtatttcctatag

SEQ ID NO: 237863 - DNA, 1968 bp, Artificial Sequence
  Description of Artificial Sequence: Synthetic coding sequence
atgacggagtgttttctacccccaacatcaagtccgtcagaacaccgccgagtggagcacggcagtggactcacgagaacaccttcttctgaggagattagccctaccaagtttcctggactctacaggaccggggaaccctctccgcctcatgacatcctgcacgaaccccctgatgtggtttcggatgacgaaaaggatcatggcaagaaaaagggcaaattcaaaaaaaaggagaagcggactgagggctacgctgcattccaggaggactcctccggcgatgaagcagaaagcccttcaaaaatgaagagatccaagggcattcatgtatttaaaaagccgtccttctcaaaaaagaaagaaaaggacttcaagattaaagagaaacctaaagaggagaagcacaaggaagagaaacataaagaggaaaagcacaaggagaagaagtccaaggacttaacggccgcagatgtcgtgaaacagtggaaggagaagaagaagaagaagaagcctatacaagaacccgaagtcccacagatcgatgtgcctaatctgaagcccatcttcgggatcccactggcagacgccgtcgaacggactatgatgtacgatggcatcaggttgccggcagtctttcgggaatgtattgattacgtggaaaagtacggcatgaaatgcgaggggatttatagagtctcaggaattaagagtaaagtggacgaactcaaggcggcttatgaccgtgaagagagcacaaacctggaggactacgagcccaacactgtggccagccttcttaaacagtatctaagggatctgccggaaaatctcctaacaaaggagctgatgccaagattcgaggaagcatgtggccgtactacggaaaccgaaaaggtccaagaatttcagcgtctgctgaaagagctgcccgagtgcaactacctgttgattagttggctgatagtgcacatggaccacgtaatcgcaaaggagctggagacaaaaatgaatattcagaatatatccatagtcctgtctccaacagtgcagatttctaacagagtactctacgtgttctttacgcatgttcaggagctgttcgggaacgtagtcttgaagcaggtgatgaagcctctcagatggtccaacatggccaccatgcccacccttcccgaaacgcaagccggtatcaaggaagagattcgtaggcaggagttcctgctgaactgcctccacagagatctgcagggcggaatcaaagacctcagcaaagaagagcgcttgtgggaggtccagcggatccttacagccctgaagcgaaagctacgagaggcaaagagacaggaatgcgaaaccaaaattgcccaggagatcgcatcactgagcaaagaggatgtatcaaaagaagagatgaacgagaacgaagaggtaattaatatcctgctggcccaggagaatgagatcctgactgaacaagaagagctgcttgctatggaacagtttctacgacggcagattgcgtccgagaaagaggaaatcgagaggctaagagcagaaattgccgagattcagtcccgtcaacaacacgggagaagtgagactgaagaatattccagcgagagtgaaagtgagagcgaagatgaggaagaactgcagattatactggaagatctgcagcgccaaaatgaagagctagagatcaagaataatcatcttaatcaggccatccacgaagagcgggaagcaatcattgagctgcgggtgcagctccggcttctccagatgcagagggcaaaggcagaacagcaggcccaagaggatgaggagccagagtggaggggcggagctgtgcagccacccagggacggagtcctggagcctaaagctgccaaggagcagcccaaagctggtaaggaaccggcaaaacccagcccatcaagagataggaaggagacctctatctag

SEQ ID NO: 237864 - DNA, 1968 bp, Artificial Sequence
  Description of Artificial Sequence: Synthetic coding sequence
atgacggagtgctttctgccacccactagctctccctccgaacacaggcgtgtcgagcatggttccggtttaacccggacaccatcttccgaggagatttccccaactaagtttccagggctataccggactggggagcccagcccccctcacgatattctacacgagccacccgatgtggtatctgatgatgagaaagaccacggcaaaaagaaagggaagttcaagaagaaggagaaacggacggagggatacgcagcattccaggaagactcttcaggggatgaagccgagtcccctagcaaaatgaaaagatctaaagggatacatgtgttcaaaaagccttcctttagtaagaaaaaagagaaagactttaagataaaagaaaagccgaaagaagagaagcacaaggaggagaaacataaggaagaaaagcataaagagaagaagtcaaaagatttgacagccgctgacgtagtcaaacagtggaaagaaaagaaaaagaaaaagaaacccattcaggaacccgaagtgccacagattgatgtccccaacctaaaaccaattttcggcatacccctggctgacgccgtcgagcgcactatgatgtacgacggtattaggctgcccgctgtgtttagggagtgtattgactatgtcgagaaatacggcatgaaatgtgaaggtatctacagggtttcaggcatcaagtcaaaggtcgatgaactgaaagccgcttacgatagggaggaatccacgaacttggaggactatgaacctaatactgtggcatctcttctgaagcagtacctacgcgacctccccgaaaacctactcacaaaggagcttatgccaagatttgaagaggcctgcggccgtacgaccgagactgagaaagtccaggagtttcagcggctccttaaggagctccccgagtgtaattacctgttgatcagctggttgatcgtccatatggaccacgttattgccaaggagcttgagacgaagatgaatattcagaacatctccatagtgctgagcccaacagtccagatcagcaacagggtcctatacgttttcttcacccacgtgcaggagttgttcggcaatgtagttctcaaacaggtgatgaagcctttacggtggtccaatatggcaaccatgccaaccctgccggagacgcaggcaggcattaaagaggagataagacgccaggaattcctgttgaattgcctgcacagagatctgcaggggggaataaaggatttgtcgaaggaggagagactttgggaagtgcagaggattctgactgccctgaagcgcaagctgagggaggcgaaaagacaggaatgcgagacaaagatagctcaggagattgcatctctgtcaaaggaggacgtctccaaggaagagatgaacgaaaacgaggaagtgatcaacatcttattggcgcaagagaatgagattctgacggaacaggaagagcttctggccatggaacagtttctgaggaggcagatcgcatcagagaaagaagagattgaacggttgagagccgagatcgcagaaattcagtcccggcagcagcatggacgctcagagaccgaagaatacagttctgaatcagaatcggagtcagaagatgaagaggaacttcagattatcctcgaagacctgcagcgccagaatgaagagctcgagatcaagaataaccatttgaatcaggcgatccatgaagagagggaggccattatcgaacttcgagtccagctgagactcctgcagatgcaacgggctaaggcggagcagcaagcacaagaggacgaagagcctgagtggagaggaggcgcagtgcagccacctcgcgacggcgtcctcgaaccaaaagccgctaaggagcaaccaaaagcgggtaaagagccagctaagcctagcccctcaagggaccggaaggagacatcaatatag

SEQ ID NO: 237865 - DNA, 1044 bp, Artificial Sequence
  Description of Artificial Sequence: Synthetic coding sequence
atgacagaatgcttcctgccacctacttcgtcaccttctgagcaccggagagtagagcacggatctggcctgactaggactccatcatcggaagagataagccccaccaagttcccaggtctctatcgaacgggagagcccagccctccccacgatattctgcatgaaccccctgatgtcgtttccgatgatgagaaagaccatggaaagaagaagggcaagtttaagaaaaaggagaaaaggaccgagggatatgcagcctttcaggaggacagtagtggagatgaggccgagtccccttctaagatgaaaaggtccaagggcattcacgttttcaagaagccgtccttcagcaagaaaaaagagaaagactttaagattaaagaaaaacctaaagaggagaaacataaagaagagaagcataaggaagagaaacacaaggagaaaaaatcgaaggacctaactgctgccgatgtggtgaaacagtggaaagagaagaagaagaaaaagaagcctatccaggagcccgaggtcccacagattgatgtgccaaatcttaagcctatcttcggcatccctttggccgatgctgtcgagcgcacaatgatgtacgacggaatcaggcttcccgctgtgtttcgtgaatgcattgattacgtagaaaaatatggcatgaagtgcgagggcatttaccgagtgtctggtatcaagagcaaggtggatgaactcaaggcagcgtacgatcgcgaggagagtactaaccttgaggattacgagcctaatactgtcgccagcctgttgaagcagtatttaagggacctgcctgaaaatttgctgactaaagagcttatgccgaggtttgaagaggcttgcggacgtacaacggaaactgaaaaggtacagagctccggcgaggaagccgcaagatcatgccagttcctgaccgctggaaccagtaagggcctgctgaccggccttgtgaaggggtctcacctgggtctggtccaccctcaaagaatgctgttcaagcctgagatcttttag

SEQ ID NO: 237866 - DNA, 1980 bp, Artificial Sequence
  Description of Artificial Sequence: Synthetic coding sequence
atggaagctgccgctgccgcagcggcagccgcagccgctgccgctgccgctgggggaggttgtggctccggaccccctccacttctcctgagcgaaggcgagcagcagtgctattcggaacttttcgcaagatgcgccggagctgccggaggtgggccaggatcaggtccaccggaggctgccagagtggccccagggactgccaccgccgctgccggaccggtcgccgacttgtttcgtgccagtcaactacctgccgaaacactccatcagattacagaactgtgtggcgctaagcgggttggatacttcggaccaacacagttctacatagcactgaaactcattgccgctgcccaatctggtctgcctgtgcggattgaaagcatcaaatgcgaactgcccctgcccaggtttatgatgagtaagaacgatggtgagattaggtttgggaacccggcagagctccacgggaccaaggtgcagatcccctacctcactactgaaaagaactctttcaaaagaatggacgatgaagataagcaggaaacgcagagcccaacaatgagtcccttggctagtcccccatcatcaccaccccactaccaacgggtgccgcttagccacggatattctaagttacgctcaagcgcagaacagatgcacccagccccttacgaagctaggcagcccctggtccaacctgagggatcttcaagcggtgggccaggcacaaagccgctgaggcaccaagctagcctcattcggagcttctcggtggaaagggaattacaagataatagttcctaccccgatgagccctggcgcataacagaagaacagagagaatactacgttaatcagttcaggagcctgcagcccgacccaagctcattcattagcgggagcgtagcgaaaaatttcttcacaaagagcaaattatccataccagaactctcgtatatctgggagctaagtgacgcagactgcgatggcgctctgaccctccctgaattttgcgcagcatttcatctcatcgtggcacggaaaaatggatatcctctgcctgaggggctgcctcccacccttcagccagaatacctacaggctgcattccccaagccaaagtgggactgtcagcttttcgattcctattctgagtcattgcctgccaatcagcagccaagggacctcaaccgcatggaaaaaacatccgtgaaggatatggctgatctgccagtcccaaaccaggacgttacctcagatgacaagcaggccctcaagtcaacaatcaacgaagctctcccaaaagacgtctcagaggacccagcaacccctaaggacagcaacagcctcaaggcgagaccaagatctagatcatactcgtctaccagtattgaagaggccatgaagcgcggagaagaccctcctacgccaccaccacggcctcaaaaaactcattccagagcatccagcctcgatctgaataaagtttttcagccctctgtccctgcgacaaaatcaggacttctaccgccacctcctgcactcccaccacgcccatgcccctcccagtccgaacaggtttcagaagcagaacttctcccgcagcttagtagagcaccatcgcaggcggctgaatcttcgccagcaaagaaggatgttctctattcccagccaccttcaaagcccattcgaaggaagttcagaccagagaatcaggctactgagaaccaggagcctagcactgccgcttccggcccagccagtgcggctactatgaagccgcatcccaccgtgcagaaacagtctagcaagcagaaaaaggccattcagactgctatccggaagaataaggaggccaatgcggtgctggctcggctgaactctgaacttcaacagcagcttaaagaggttcaccaggagagaatcgccctcgaaaaccagcttgaacagctccgtcccgttacagtcctctag

SEQ ID NO: 237867 - DNA, 1983 bp, Artificial Sequence
  Description of Artificial Sequence: Synthetic coding sequence
atggaggccgcagccgcagccgcagcagccgcagccgcagcggcagctgctggaggcggatgcggcagcggacctccccctcttcttttaagcgagggagaacaacaatgctatagtgaactgttcgcccgatgtgctggagccgctgggggtggaccagggagcgggcctcccgaagctgccagagtggcccctggaactgcgactgccgcagctgggcctgttgccgacctcttcagagcttcgcaactgcccgcagagacactgcaccagattactgagctgtgtggggcaaaacgagtcggctacttcggaccaactcagttttacattgccctgaagctcatcgcagcagcacaaagtggcctccctgtgagaattgagtccataaagtgtgagctgccattgcccagatttatgatgagtaaaaatgacggcgaaattcgatttggtaaccccgcagaactccacggcactaaggttcaaattccatacctaaccacagaaaaaaattcattcaagcgcatggacgacgaggataagcagcaggaaacgcagtcccccaccatgagtccactcgcctctccaccatcctcgcccccacactaccagcgagtgcctttatcacacggttattctaagctacgatcctcagctgagcaaatgcacccagctccttatgaagccaggcagcctctcgtccagccagagggttcctccagtggcggaccagggactaaaccgctccggcaccaggccagcctgattaggagttttagtgtggagagggagctgcaggacaacagctcctacccagacgaaccttggcgcatcactgaggagcaacgagaatattacgtcaaccagtttcgaagtttgcagccagacccttcttctttcatttcgggctctgtcgctaagaatttctttacaaagtctaaactttcaatccctgagctcagctatatatgggaactctcagatgctgattgtgatggtgccctgacacttcccgaattctgtgctgcatttcatttaattgtggcaagaaagaatgggtatccactaccagagggtctccctcccacacttcaaccagagtaccttcaggctgcgttcccaaagcctaagtgggattgccaactgttcgactcatactccgaatcgctgccggcaaatcagcagccgagggacttgaataggatggagaagactagcgtcaaggacatggccgacctccctgtcccaaatcaggacgtgaccagtgacgacaaacaggcattaaagtcgacaatcaacgaagccctgccaaaagacgtgtcagaggacccggctactcctaaggacagcaacagtttgaaggcacgaccacggtcccgttcctatagcagcaccagcatcgaggaggccatgaagcgaggggaggatccacccacacctccgccaagaccgcagaaaacccattccagggcctcttcactggacttaaataaggtatttcagccctctgtccctgccacaaagtcaggtcttctgccccctccgcctgcgctcccaccaaggccatgcccctctcagagcgaacaagtaagcgaagctgaactgcttccacagcttagccgggcaccctcccaagcagccgaaagctccccggcaaagaaagatgtgttgtacagtcagccaccctctaagcccattcgcaggaaatttcggcctgaaaaccaggccacagaaaaccaggagccaagtactgcagcatcaggtcccgcaagcgccgctacaatgaaacctcatcctaccgtccagaaacagtcctctaaacagaaaaaagccatccaaaccgcgatacggaaaaacaaggaggccaatgcagtgctcgccagattaaactccgagctgcagcagcaactgaaagaggtccatcaagagcgaatcgctctggagaaccagctggagcagcttcgacccgtgacagtgctgtag

SEQ ID NO: 237868 - DNA, 1824 bp, Artificial Sequence
  Description of Artificial Sequence: Synthetic coding sequence
atggaggccgcagccgcagccgcagccgctgccgcagccgcagctgccgctgggggaggttgtggcagcggtccacctcctctcctcctgtctgagggcgagcagcaatgctatagcgagctgttcgccaggtgtgccggagccgctggcggaggacccggatccggacccccagaggctgctcgcgtcgctcctggtactgccaccgctgccgcagggcctgtggctgacttattccgtgccagccagttaccagctgaaacgctgcatcagatcaccgagctatgtggtgccaagagggtggggtattttggaccaacccagttctatatcgccctgaagctgattgctgccgcacagtcaggacttcccgtgcgcatagagtctattaagtgtgagctacccttgcctagattcatgatgtctaaaaatgatggcgagatccggttcggcaaccctgcagaactgcacggaactaaggtccagatcccatacttgacaactgaaaaaaattcttttaagcggatggatgacgaggacaagcagcaggagacccaaagcccaaccatgtcccccttggcttcgccgccaagcagtccccctcattaccagcgggtgcccttaagccatggctattcaaagttaaggtcctccgctgagcaaatgcatccagcaccctacgaagccaggcagccgctcgtgcagcctgaaggctccagttcaggcggacctgggacaaaaccgctccgacatcaggcaagcctgatacgctctttcagtgttgaacgcgaactgcaagataactcttcttatcccgatgaaccatggcggatcactgaagaacaacgcgaatactacgtgaatcagttccgctccctccagccagatcctagttcctttatctctgggagcgtggctaagaattttttcactaaatcgaagctgtctatccctgagttgagctatatctgggagttgtcagacgctgactgcgatggcgctctcactttgcccgagttctgcgcggcatttcatctgatcgtggctagaaaaaacggatacccactgccagaggggttgcccccaacacttcaacccgagtacctccaggcagcctttcctaaaccaaagtgggattgccagcttttcgactcctatagcgaatctttaccagctaatcagcaacctagagatttgaaccgaatggaaaagacatcagttaaggatatggcagacctgccagtgcccaaccaagatgtgacatctgacgataaacaggctctaaagtcaaccatcaacgaagcactccctaaagacgtgagcgaggacccagctacacccaaagactctaattcgctgaaagcaaggcctagaagcagatcatactcatctacctccatcgaggaagctatgaagaggggagaagatccgcctacccccccaccacggcctcagaaaactcactcacgagcaagctctctcgacttaaacaaggtatttcagccgtctgttcccgctaccaaaagcgggcttttgcctccccctcctgcccttcctccaaggccttgccccagccagagtgagcaggttagtgaggctgaacttctccctcagctcagccgcgctccctcacaggccgctgagtcttcgcctgccaaaaaagacgtgctctactctcagccgcctagcaagcccatccgacgcaaattcagacccgtttgtggtatccaacccctcattagtattgagcttcgggctttccggacgtctcggcatctttttaatgtcagcctggtacactggcaggccctcagtatcgcctag

SEQ ID NO: 237869 - DNA, 1380 bp, Artificial Sequence
  Description of Artificial Sequence: Synthetic coding sequence
atgatgagcaagaatgatggtgagatccgcttcgggaaccctgctgagctgcacggaacaaaagtgcagataccatatttgaccaccgaaaaaaattcttttaaaaggatggacgatgaagacaagcaggagactcagagccctactatgtctccattggcttccccaccttcgtccccaccacactatcaaagagtgcctctgtcccacggctacagtaagcttagatccagcgccgaacagatgcacccagccccatacgaggcacgccagcccctagttcagccagaaggaagctcctcaggaggacctggcacgaagccactgcggcaccaagcctccctcatacgctctttttccgtcgagcgcgaactgcaagacaattcctcctatcctgacgaaccctggcgcattacagaggagcaacgagaatactatgtgaatcaattcaggagtcttcaaccagacccatcttccttcatttcagggtccgtcgccaagaacttttttaccaagagtaaattgtctatccctgagttgtcttacatttgggaattgagtgacgccgattgcgatggggctttgaccctccccgaattctgtgccgcatttcatttaatcgtggctcgaaaaaatgggtatcccctcccagaaggcttgccgcctaccctgcaacccgaatatctgcaggccgcatttccaaagccaaagtgggactgtcagcttttcgattcatacagcgaatctcttcccgcaaatcagcagcccagagatcttaacagaatggagaaaactagcgtgaaggacatggctgatctgccggtgcccaaccaagacgttacttcagacgacaaacaggcactgaagtcaacaattaacgaggctctgccaaaggacgtgtcagaggacccagctacaaaatccggacttttgcctccccctcccgctttgcctccaaggccatgtcccagtcagtcggaacaggtatctgaggctgaactccttccccagctttctcgggcaccatcacaggctgccgagtccagcccagccaagaaggatgttctgtattctcagccgcctagcaagcccataaggagaaagtttaggcccgaaaaccaggctacggagaatcaggagccatccacagccgcttccggccctgcatcagccgcaactatgaaacctcacccaactgtccagaaacaatcatcgaaacagaagaaagcgatccaaacagccataaggaaaaacaaagaagccaatgccgtcctcgcgagattaaattctgagttgcagcaacagctcaaagaggttcatcaagaaaggatcgcattggagaatcagctggagcaactacggcctgttaccgtgctgtag

SEQ ID NO: 237870 - DNA, 1863 bp, Artificial Sequence
  Description of Artificial Sequence: Synthetic coding sequence
atggcagccgctacagcagatccaggcgctggtaatccacaacccggagattcatctggcggaggcgctgggggagggctcccatcacccggagaacaggagctatctcgtaggctgcaaagattgtatcccgcagtaaaccaacaagagaccccgcttccgaggtcatggagccctaaggacaaatacaactatataggcctttctcagggcaatttaagagtgcattataaaggccacggtaaaaaccataaggatgccgctagcgtgagggccacacaccctattccagcagcttgtggaatctactacttcgaggtcaaaatcgtgtctaaagggagggacggatacatgggaatcggtctgtccgctcaaggagttaacatgaaccggctgcccggatgggacaaacatagttacgggtatcatggggatgacggccattcattctgctccagcggcacaggccagccttatggtcccaccttcaccacgggtgacgtgataggatgctgtgtcaacctgattaatggtacatgcttctacaccaagaacggtcattctctcggaatcgcctttaccgaccttcccgcaaacctgtatcctaccgtgggactacagactcctggggaaatcgtggatgcgaacttcggccagcagccatttctgtttgacattgaggactatatgagagagtggcgcgctaaggttcaggggacagtacattgtttcccgatcagtgccaggctcggggaatggcaagccgtgctgcagaacatggtgtcttcatatcttgtgcatcatggttactgtgctactgctacagcctttgcacgcatgactgagacccctattcaggaagagcaggcctctataaaaaacaggcagaaaatccagaaactcgtcctcgagggccgtgtgggcgaggccattgaaacaacgcagagattctatcctggattgttagagcacaacccgaacttgctgttcatgctcaaatgtcgtcagttcgtcgagatggtgaacggaaccgacagcgaggtccgatccctgtcttcgcggtcacctaagtcgcaggacagctatccagggagtccttctctgtctcccagacacggcccatcctcgtcacatatgcataacacaggtgcagatagcccaagctgttctaacggcgtggcctcgaccaagagtaaacaaaatcattctaagtaccccgctccaagctctagttcttctagcagctccagctctagctcatcctctccgagttcagtaaactactccgaatcgaatagcaccgatagtaccaaaagccaacatcactcatcgacttccaaccaagagactagcgacagcgaaatggaaatggaagccgagcactaccctaatggcgtgctgggtagtatgtcgactcgaatcgtcaacggcgcatacaaacacgaggatttgcaaactgacgaatctagcatggatgatcggcatccgaggcggcagctttgcggcggaaaccaagctgcgactgagagaataatcctgttcggcagggaattacaggccttgtctgagcagttaggccgagagtatggaaagaacctcgctcacacagagatgctgcaagatgccttcagcttgctggcttatagcgatccatggagctgtccagtaggacagcagctggatcccatacagcgagagccagtgtgcgccgctttgaactcagccatactggaatctcagaatttgccaaaacagccacccttgatgcttgcgcttggtcaggcatcagaatgcctgaggctcatggctcgcgcagggttgggctcatgttctttcgcccgtgtagatgactatcttcactag

SEQ ID NO: 237871 - DNA, 1602 bp, Artificial Sequence
  Description of Artificial Sequence: Synthetic coding sequence
atgggtatcggattgtcggctcagggtgtgaatatgaatcgcctgcccggttgggacaagcactcctatggctaccatggcgatgatggccactccttttgttctagcggcacagggcagccctacggcccaacatttaccaccggcgatgtgattgggtgttgcgtcaatcttatcaacgggacatgtttctacactaagaacggacacagcctcggtattgcatttaccgacctcccagctaacctttaccccactgtggggctgcagacccctggcgagatcgtggacgccaattttgggcagcagccctttctgttcgatatcgaggattatatgagggagtggcgagcaaaagtgcagggcaccgttcactgctttcccatctcagccaggctaggggaatggcaggccgtgcttcaaaacatggtctcttcctatctggttcaccacggctactgcgcaacagcaactgcttttgccagaatgaccgagacccctattcaggaagagcaagccagtataaaaaaccggcaaaaaattcagaagctggtgctcgagggacgggttggcgaggcaatcgaaactacacagcggttttacccgggtctactggagcataatcctaacttgctttttatgcttaaatgtcgccagttcgttgaaatggtgaacggtacggattcagaggttagaagcctgtcatctaggtctcctaagtctcaagatagttacccgggttcaccctctctttcccccaggcatggtccatcatccagtcatatgcataacaccggggcagactccccatcttgctctaatggagttgcgtcaactaaatcgaagcaaaaccattcgaaataccccgcaccttcctccagttcatcctcaagctcttcttcaagtagctctagcccctcctcagtcaactattctgaaagcaacagtaccgatagtaccaagagccagcaccatagttccacatcaaatcaggaaacctcaaatccctggctgcagctggagcgtcgccctaaccaggctgcccctaccacccctccaggcccaaccccaacctccacgccccctcactcagattcggaaatggagatggaagccgaacattatccaaacggagtgctgggatccatgtctacccgcatagtgaatggcgcatataagcacgaggatctacagacagacgaaagcagcatggatgacaggcaccctcggagacagctatgcggaggcaaccaggccgcaactgagcgcataatcctgtttggacgcgaactgcaagcactttcagaacagctgggaagggagtacggaaaaaacctggctcatactgaaatgctgcaggacgcctttagtctcttagcatactccgatccttggagttgtcctgtcggacagcagctagatcccatccagagggagccggtgtgcgccgctctgaactcagctattctcgagtctcaaaacctgccaaagcagccccctcttatgctcgctctcgggcaggccagcgaatgcttgcgcctgatggcccgtgctggtctgggcagctgttcatttgctagggtggacgactacctgcattag

SEQ ID NO: 237872 - DNA, 540 bp, Artificial Sequence
  Description of Artificial Sequence: Synthetic coding sequence
atgggttgggataagcattcttatggataccatggggacgatggccattccttctgctcttctgggacagggcagccctacgggcctaccttcactaccggggacgttatcggctgctgcgtgaatctgatcaacggcacctgcttctacactaagaacggccacagtttgggaattgcttttactgatcttccggcaaatctgtaccctacggtgggcttgcagacaccaggcgagatcgtagacgcaaattttggccagcagccttttctctttgatattgaagactatatgcgcgagtggcgagccaaggtgcaggggactgtgcactgctttccaatttcagccagattgggggagtggcaggctgtgctgcagaatatggtatctagttatctcgtgcaccatgggtactgtgccaccgctaccgccttcgcccgaatgacagaaacgccaatccaggaggagcaggcctccattaaaaatagacagtccaaggtgtactccacattcccttttccgttcctaacctgtccttag

SEQ ID NO: 237873 - DNA, 1785 bp, Artificial Sequence
  Description of Artificial Sequence: Synthetic coding sequence
atggccgctgctaccgctgaccccggagccggaaacccacagcccggtgacagttctggaggaggcgctggcggtggcctgcccagcccgggagaacaagaactcagtcgtcgcctgcagaggctctatccggctgttaatcagcaggagacacctctcccgaggtcttggagtcccaaagacaaatacaactacatcgggctgtcccaaggcaacctgcgggtccattataagggtcatggaaagaatcataaggacgccgcttctgtgagagcaacacaccctattcccgcagcctgtggcatctattattttgaagtgaagattgtatctaagggtagagacggctacatggggataggtttatccgctcagggtgttaacatgaatagacttcccggtatcgcgttcaccgaccttcctgccaacctgtaccccactgtaggccttcagacaccgggtgaaatagtggacgcgaattttggccagcaaccctttctgttcgatatagaggactacatgcgtgaatggcgtgcaaaggtgcagggcaccgtccactgtttccctatctcagcccgtttaggggagtggcaggcagtgcttcagaacatggtttctagctacttagtgcaccacggctactgcgcgacagccaccgccttcgctaggatgaccgagacgcccattcaggaggagcaagcatccataaagaatcgccaaaagattcagaagctcgttctggaaggaagggtgggagaggccatcgagaccacccagagattctaccctggcctcctggagcacaaccctaacctgctgttcatgttgaagtgccggcagttcgtcgagatggtcaatggtacggattccgaggtgaggagtctctcatcacgaagtccaaaatctcaggactcctatcctggttcgcctagtctgagtcctcggcacggcccatcatcgagtcatatgcataacactggcgctgactctccttcctgctcaaacggggtggcatcgaccaaaagcaagcaaaatcactcgaagtaccccgctccatcctcctcctctagctcctccagcagcagttcttcatcctcccccagctcagtgaattacagtgaatccaattcaactgacagcactaagagccagcaccactcctccacgtcaaatcaggaaacatctaacccatggctccagctcgagagacgtcctaaccaagccgctcctaccacgccgccagggcctacgccgacgtccacccctccacatagtgattctgaaatggagatggaggctgagcactacccgaatggagttctgggatcaatgtcgaccagaatcgttaacggggcttacaagcatgaggacctacagactgacgagagcagtatggatgaccggcatcctagaaggcagttatgtggcggaaaccaggctgcaacagaaaggatcatcctattcgggagagaacttcaggctctctctgagcaactgggtcgagagtacggaaagaatcttgctcacacagagatgttacaggacgcttttagtttgctggcgtattccgacccctggagctgccctgtgggacaacagctggacccaatccagcgggagccagtgtgcgccgcactgaatagcgccattctggagtcgcagaacttgcccaaacagcccccactgatgcttgcccttggacaggcctccgagtgcctgcgcctcatggcccgagcaggtctgggatcatgctctttcgcaagagttgatgactatcttcactag

SEQ ID NO: 237874 - DNA, 1176 bp, Artificial Sequence
  Description of Artificial Sequence: Synthetic coding sequence
atgagagagtggcgtgccaaggtacagggtacagtccattgcttccccatctccgctcgtttgggcgaatggcaggctgtcctgcagaatatggtgagtagctacttggttcaccacggctactgtgccactgctacagcatttgccagaatgaccgagaccccaattcaagaagagcaggcttctatcaaaaaccgccagaagatccagaagctagttttagagggtcgcgtgggcgaagcgattgagaccactcagaggttttatcccggattgttagagcataaccctaacctgcttttcatgctaaaatgtaggcagttcgtcgaaatggtgaatgggaccgattccgaagtgcgatcactttccagccggtctccgaaaagtcaggattcatatcctggttctccatcccttagtcctaggcacgggccaagttccagccacatgcacaatacaggggcagattccccctcatgctctaatggtgtcgcctccaccaaaagcaaacaaaaccacagcaaatatcccgctccgtcctcatcaagctcgtcctcctctagcagttcgagctcctccccttcctcagttaactactccgaatcaaattcaaccgattccaccaagtcccagcatcactcctccacctcaaatcaggagacaagcgattcggaaatggaaatggaagccgaacattatccaaatggagtgttagggtccatgtccactaggatcgtgaatggtgcatataagcacgaggatttgcagactgacgagtcttctatggatgataggcatcctcgcaggcagctgtgtgggggtaatcaagcggcaactgaacgaattatattgtttggcagggaattgcaggctctctctgaacaattaggccgagagtatggcaagaacctcgctcatacggagatgctgcaggacgcctttagtcttctcgcctattccgacccctggagctgtcccgtcggccagcagctggatcccattcagcgtgagccggtgtgtgctgcactgaactccgctatcctggagagccagaatctgccgaagcaacccccactgatgttagccctcggtcaggcctctgagtgtttgcgactcatggcacgcgcaggcttaggttcatgctcctttgccagggtggacgattatctacactag

SEQ ID NO: 237875 - DNA, 3267 bp, Artificial Sequence
  Description of Artificial Sequence: Synthetic coding sequence
atggcactgcattttcagtcactggccgagctagaagttctgtgcactcatctgtatattggtacagatttaacacagagaatcgaagccgagaaagccctgctggagctcatcgattcgccagagtgcctaagtaagtgtcagctgctgctggaacagggcactacctcctatgcccaattgctggcggctacttgtctcagtaagctagtgtctcgggtgagccctttaccagttgagcaacgcatggatatccgcaactacattctgaattatgttgccagtcagccaaagttggccccattcgtgatccaggccctgatacaagtgattgctaagatcactaaacttgggtggttcgaggtgcagaaagaccaattcgtgttcagagagattatcgctgatgtaaaaaaatttctgcagggcactgtcgagcattgtatcatcggcgtcataatccttagtgaactgacccaagagatgaacttagtggattacagccggccttctgcaaagcacagaaagatcgctacctccttcagggatacttccctgaaagatgtgttagtgctggcatgctctctcttgaaggaggtctttgccaagccactcaacctccaggaccagtgccaacagaatttagtcatgcaggtactcaaattggtcttgaactgcctgaattttgatttcatcggaagctctgccgatgagtcggcggacgacctgtgcaccgttcagattcccactacttggagaactatctttctggagcccgagactctcgatttgttttttaatttatatcatagtctacccccactgctttctcagctcgccctgtcatgtctcgtccaattcgcgagcaccaggagatccttatttaattctccagaaagggccaagtacctcgggaatctaatcaagggcgtgaagaggatactagaaaatcctcagggtctgagtgacccgggtaactaccatgagttctgccgctttcttgctcggctgaaaactaactaccagctgggggaactggtgatggtgaaagagtacccggaagtgatacggctaatagccaattttactatcacatccttacagcactgggagtttgctcccaattcagtccattacctcctcactctgtggcaaaggatggtcgcatccgtgccatttgtgaagagtaccgagccccatctgctggacacgtatgcccctgaaatcaccaaagcttttattacttctcgccttgatagcgtggccatcgtggtccgcgaccacctggatgaccctctcgatgataccgctactgtcttccaacagctcgaacagttgtgcacagtgagtcggtgtgagtatgagaagacttgcgccctgctcgtccagctattcgaccaaaatgcacaaaactaccagaagctgctgcacccttacagcggggttaccgtggacataacgatccaggaggggaggctggcctggctagtctacttagtggggaccgtcgtagggggaagactcacatatacctccacagacgagcacgacgcaatggatggcgagctgtcctgtagagttttccaactgatttcgctcatggatactggactgccccgatgctgcaatgagaagattgagctcgccatcctgtggttcctggatcagttccgcaaaacctatgtcggagatcagttgcaacggacatccaaggtgtacgcaagaatgagtgaggtgctcggcatcactgatgacaaccatgttctggagacgttcatgacaaagatcgtgacgaacctcaagtactgggggcgatacgaacccgtaatttcacggactctgcagttcttgaacgacttgtctgttgggtacatcctgctcaaaaagctcgtgaagatagacgcagtgaaatttatgctgaagaaccacactagcgagcactttcccttcttggggattagcgacaatcactcgctctctgatttccgttgtaggaccacattttatactgccctgactcgcttgcttatggtggacctaggagaggacgaggatgaatttgagaattttatgctcccattgaccgtggcctttgaaacagttctacagatcttcaacaacaactttaagcaggaagacgttaagagaatgctgatcggactagcgagagatctcagggggatcgcttttgcgctcaacactaaaaccagctacacaatgctttttgactggatgtaccctacttacctgcccttgcttcaaaatgccgtggaacgctggtacggcgaaccaacctgcactaccccaatcctgaagcttatggccgagctgatgcaaaatcggtcccagaggctgaactttgatgtaagctcccctaatggcatcctactgtttagagaggcttctaagatggtgtgtacatacgggaatcagatcttgtcactgggatcattgtccaaagaccaaatctatccaatgaaactgaagggaataagcatctgttactcggctctgaagtcagcactgtgcggcaattacgtgtccttcggtgtctttaagctctatggggacaaccacttcgataatgtgcttcaggcctttgtgaagatgctgcttagtgtttcccatagtgacctgctgcagtataggaagttgtcacaatcctactacccattgctggagtgtctcactcaggatcatatgtcctttattatcaatctggaaccgccagtgttaatgtatgtcctgacttccatttcggagggtctaactaccctcgataccgtcgtgagcagctcctgttgcacatcgctcgattacattgtgacctacctttttaagcatatcgcaaaggagggaaaaaagcccctgcgatgtagagaagcgacacaagctggtcagaggcttctacatttcatgcagcagaatcccgatgtgctacagcagatgatgtcagtgctcatgaacacaatcgttttcgaagactgccggaaccagtggagcgtgtccaggcccctcctgggcttgattctgctgaatgagaaatacttttcagagctgcgggcatccctaatcaactcccaaccgcttcctaaacaagaggtccttgctcagtgctttagaaatctgatggaaggcgtggagcaaaatctgtccgttaagaatcgtgatagatttacccagaatttatctgtatttcgaagggacgtcgctgaggcactacggtctgatggcaacaccgaaccttgtagtctagacatgatgagctag

SEQ ID NO: 237876 - DNA, 1557 bp, Artificial Sequence
  Description of Artificial Sequence: Synthetic coding sequence
gtgtacgcaaggatgagcgaagtgctcgggatcacggatgataatcacgtcttagagacatttatgaccaaaattgtgacaaacctgaagtactggggccgatacgagcctgtaatttcacggaccctgcaattcttgaacgacctatcagtaggatatatacttctgaagaaacttgttaaaattgatgccgtgaaattcatgctgaagaaccatacttccgagcacttcccttttctaggaatttcagacaatcactccttaagcgactttcgttgtcgcacgacattttataccgcactcactagattgctgatggttgaccttggtgaggatgaggacgagttcgaaaatttcatgcttcctttgaccgtggcttttgagactgtcctccaaatttttaacaataacttcaagcaggaggatgtcaaaaggatgctgatcggcctcgcgagagacctgcgtggaattgcatttgctctgaacacaaaaacgagttacaccatgctgtttgactggatgtaccccacatatctgcctctgctacagaatgcagtggagaggtggtatggagaacccacctgtacaacacccatcctcaagctcatggccgagctgatgcagaaccggtcccagaggctgaactttgacgtctcttccccaaatggaatcctgttgtttcgcgaggcctctaagatggtttgtacttatggcaatcagatcctgtccctgggatccctgagcaaggatcagatttatccgatgaagttgaaggggatatctatttgttattccgcacttaaatctgccctctgcggaaattacgtgagcttcggggtcttcaaactgtatggcgacaaccacttcgataatgtgctgcaggcctttgtgaaaatgctgctgtcagtttctcactctgatctgctgcagtaccggaaactgtcacaatcctactatccattgttggagtgcttgacccaggaccatatgagttttatcatcaatcttgagccccctgtcctcatgtatgtactgaccagcatctcagaaggattaacgacgctagataccgtcgttagcagttcatgttgtacatcgcttgattacatcgtcacatacctgtttaagcatatagctaaagaggggaagaaaccccttagatgccgcgaggctacacaggcaggccagaggttgcttcacttcatgcagcaaaaccccgatgtgttgcagcagatgatgtctgtgctcatgaataccattgtgtttgaagactgcagaaatcaatggagcgtttcccgaccgctgctgggactgattctcctcaacgagaagtacttttctgaactgcgtgcttctttgatcaactctcagcctctccctaagcaggaagtgctggcccagtgctttagaaatctcatggagggggtcgaacagaacttgtctgtcaagaaccgcgaccgattcactcaaaatctttcagtgttccggagagatgtggcagaagcccttcggagcgatggcaataccgagccttgctccctggacatgatgagctag

SEQ ID NO: 237877 - DNA, 1419 bp, Artificial Sequence
  Description of Artificial Sequence: Synthetic coding sequence
atggacatccgtaactacattctaaattatgtggcttcccagcctaagctagcgccatttgtgatacaagcgttaatccaggtcatagccaaaataacaaagctcggttggtttgaggtgcagaaagatcaattcgttttccgggaaatcattgctgacgtgaagaaatttctacaggtggactactcgaggccatcagccaagcacagaaagatagccactagctttcgggataccagcctgaaagacgtgctggtgcttgcttgctcgctgttgaaagaggtgtttgctaaaccattgaacctacaggatcagtgccagcagaacctagtaatgcaggtgttaaagcttgtcctgaattgtcttaactttgacttcatcggtagcagcgcagacgaaagcgccgatgatctgtgcactgtccagatcccaactacttggcgcaccattttcctggaacccgaaactctcgacctttttttcaatttgtaccacagccttcctcccctcctttcacagctcgcgttatcctgtctggtccagtttgccagcactaggcgtagtctgtttaatagccccgagcgggcaaaatatctggggaacttaattaaaggcgttaaaaggattctggaaaatccccagggcttaagcgacccaggcaattatcacgagttctgcaggttcctcgcgcgtctgaaaaccaactaccaacttggggagctggtcatggtgaaggaataccctgaagtgattaggctcatcgctaacttcacaatcacatccctgcagcattgggaatttgccccaaattcagtacattatcttcttactctatggcagaggatggtggcatcagtccccttcgtcaagtctaccgagccccaccttttagatacttacgcacccgagatcactaaggcctttatcacaagcaggctcgacagtgtggctattgtggtgcgggatcacctggatgacccgctagatgacaccgccacagtcttccagcaactagagcagttatgcaccgtgtctcgatgtgagtatgaaaagacctgtgccctgttagtccagctgtttgaccaaaatgcccagaactaccaaaaactcctacacccatactccggtgttaccgtggacatcacaatacaagaaggaaggttggcctggctagtgtatctagtgggcacagtcgtgggagggcgtctgacctatacaagtaccgatgaacacgacgccatggatggcgaactgagttgtcgagtattccagctgatttctttaatggatacaggcctgcccaggtgctgcaacgagaaaatagaactagctattctctggttcctggaccagttccggaagacctatgtgggcgatcaacttcagcgaacatcaaaaaagacatttatttacctctag

SEQ ID NO: 237878 - DNA, 9675 bp, Artificial Sequence
  Description of Artificial Sequence: Synthetic coding sequence
atgcgcagatctaaagccgatgtagaaaggtatattgccagtgtgcagggctcaactccatcaccacggcagaagtcgatgaaggggttttactttgctaaactgtattacgaggccaaagaatatgacttagctaaaaagtacatatgcacctacatcaatgtgcaagaacgagatcctaaagcccatagatttttgggtctcctttacgagttagaggaaaacacggacaaagctgtcgagtgctatcggagatccgtcgagctcaatcccactcaaaaggacctggtgctgaaaatcgcggaactgctgtgtaagaatgatgtgaccgatggcagggccaagtactggctcgaaagggcagccaagctgtttccaggctctccggcaatttataagcttaaggagcagctcctcgactgcgagggcgaagacggctggaacaaacttttcgacttaatccagtctgaactctacgtaaggcccgatgacgtgcacgtgaatatcaggctggttgaagtttacaggtctacaaaaaggcttaaagacgccgtcgctcactgtcacgaggccgagcgtaatatcgccctgagatccagcctcgaatggaactcttgcgttgtccagacactgaaggagtacctcgaatctcttcagtgtctggagtctgataagagcgactggagagccacaaatacagacctgctgctggcctacgcaaatctgatgctgctcactttgtcaactagggacgttcaggaaagtcgagagctgctgcagagcttcgattcagcactgcaaagcgtcaagtcccttggaggcaatgacgagttgtcagccacttttctggaaatgaagggtcatttctacatgcacgcgggtagcctcttactgaagatgggtcagcacagctctaacgtgcaatggagagcactgtccgaactcgcagcactttgctatcttatcgcatttcaggttcccaggccaaaaatcaagctaatcaaaggggaagctggccagaatctcttagagatgatggcttgtgacaggctgtctcaatcgggtcacatgcttctgaacctgtcccgtgggaaacaggacttcctgaaggagatcgtggagacttttgcaaacaaaagcgggcaaagtgctctgtatgatgcactcttcagttcacagagtccaaaagatacaagctttctagggagtgatgacatcgggaacatcgacgtccgagaacctgagcttgaagacctgacgcggtatgacgtgggagccatccgcgcacataacggatcactccagcatctcacctggttgggactgcagtggaacagtcttcccgctcttcccggaatacgcaaatggttgaaacagctgtttcatcatctcccccacgagacttcgagacttgaaactaacgcaccagagtcaatctgcatactagacctcgaggtgtttctcttaggtgttgtgtatacatcccatctgcagctcaaggagaagtgtaatagccaccacagctcatatcagccactgtgcctgcctctgcctgtttgtaagcagctttgtaccgaaaggcagaagagctggtgggacgctgtctgcactctgatccatcgaaaggccgtgcccggtaacgtagccaaattacgcctcttggtgcagcacgagatcaacacgctccgtgcacaggagaagcatggcctgcaacccgcactgctcgtgcattgggctgagtgtctgcagaagacaggtagtgggctgaattccttttatgatcaaagggagtatatcggccgatctgttcactattggaagaaggttttacccctgctgaagattattaaaaaaaagaactccataccagagccaattgacccgctttttaagcacttccacagcgtggatatacaggcctccgagattgtcgagtacgaggaagatgcacacataacctttgctattctggatgccgtgaacggcaacattgaagacgctgtgactgcatttgaatctataaagtccgtggttagctattggaatttggccttaatttttcatcgtaaggccgaggatatcgagaatgacgccctgagcccggaggagcaggaggaatgcaaaaattacctgcggaaaaccagagactatctgattaagatcatcgatgactccgactcaaatctctctgtggtgaagaaactgcccgtgcctctagagtctgtgaaagaaatgttaaattctgtgatgcaggagctagaagactactccgagggaggccctctatacaagaacggcagtctcagaaatgctgattcagagatcaagcactctactccaagcccaacccggtactctctgagccccagtaagtcctacaaatatagccccaaaacgcctccccgttgggcagaggaccagaatagtctgctcaaaatgatctgtcaacaggttgaggcgataaaaaaggaaatgcaggaactcaaactgaactctagcaattctgcgtcacctcacagatggccaactgagaactatggcccagattcagtacctgatgggtaccagggcagccaaacttttcacggagcccctttgacagtcgccactacaggtcctagtgtttactactcccaatctcctgcctacaattctcaatatcttctgcgcccagccgctaacgtgacccccacaaaaggccctgtgtacggcatgaaccggttacctccgcagcaacacatctatgcttatccacagcaaatgcatacaccccctgtccagtcctcatctgcttgtatgttttcacaggaaatgtacgggccacccgcactgagattcgagtccccagccacgggcatcctcagcccacggggtgacgactacttcaactataacgtccagcaaacttctactaatcctcctcttcccgagcccggttactttactaagccgcctatcgcagctcacgctagccgctctgcagaatctaagacgatagagttcggcaaaaccaatttcgttcaacctatgccaggcgagggattaagaccctccttacctacacaagcccataccacacaacctaccccattcaagttcaactccaattttaagtccaacgatggggattttactttcagcagtcctcaggtggtgactcaacctccacccgctgcatatagcaattctgaatcccttttgggactcttgacaagcgataagcccctgcagggcgatggctactccggagcaaaaccgatcccgggtggccagaccatcggacccagaaataccttcaatttcggtagcaagaatgttagtggcattagcttcacggaaaacatgggatcttcacagcagaaaaattccgggttcaggcggtctgacgacatgtttaccttccatggtccgggaaagagcgtctttgggacgccaactctcgaaactgcgaataaaaatcatgagactgacgggggatctgcccacggggacgacgacgatgacggaccacacttcgaacctgtggttcctcttcctgacaagattgaagtgaaaaccggcgaggaggacgaggaagagttcttctgcaaccgagccaagctgtttcggtttgacgtggagtcaaaggaatggaaagagaggggtatcggtaacgtcaaaatccttcggcacaagacgagcggcaaaatccgactcttaatgcggcgtgagcaggtgctcaagatttgcgctaatcactatatcagccccgacatgaagttgacacctaatgctggaagcgacaggagttttgtctggcacgccttagactatgccgatgagctgcctaagccagagcagctggcaatacgtttcaagaccccagaggaggccgcactgttcaagtgtaaatttgaggaagcccagtccatcttaaaggcccctggaaccaatgtagccatggcttcaaatcaggcggttcgcattgtgaaagaacccacgtcgcacgataataaggacatttgtaagtccgacgccggaaatctaaattttgaatttcaggtggccaaaaaagagggctcctggtggcactgcaattcttgcagccttaagaacgcttctaccgcgaagaaatgtgtgtcttgccaaaacctcaatccttccaataaggagctggtgggcccacccctggccgaaaccgtgtttaccccgaaaaccagccctgagaatgtccaggatcgttttgcactggtgactcccaagaaggagggccactgggactgttcaatttgtctggtgaggaacgaaccaacagtgtctcgctgcatcgcctgtcagaatacaaagagcgctaataagagtggctcttcttttgtgcaccaagcgtccttcaaattcggacaaggcgatctgcccaaacccatcaatagcgacttccgttctgtattttctacaaaggaggggcagtgggactgtagcgcctgccttgtgcagaatgagggttccagcaccaagtgcgcagcctgtcagaatccccgaaagcaaagtctgccagctacaagtattcccacccctgcctcattcaagttcggaacaagtgaaaccagcaagacgctgaaatccggctttgaggacatgtttgccaaaaaagaagggcagtgggactgctccagctgtcttgtgagaaacgaagcaaacgccacccggtgcgtggcctgccagaatcccgacaaacctagcccatccacgtcagtgcccgctcccgctagtttcaagttcggcacgtccgagacctcaaaagcccctaagtctggcttcgaaggcatgttcacaaaaaaggagggccagtgggattgcagcgtgtgcctggtacgcaacgaggcttccgcgacaaaatgcatcgcctgccagaatcccggtaagcaaaatcagaccacctctgcagtaagcaccccggcatcaagcgagacttccaaagccccaaagtcagggtttgagggcatgtttacaaaaaaagaaggccaatgggactgttctgtttgtttggtgcgcaacgaagctagcgcaaccaaatgtatcgcctgtcagaaccccggaaagcagaatcagacaaccagcgccgtcagtacacccgcatcctcagaaaccagtaaggctccgaagtcaggcttcgaggggatgttcactaaaaaggaaggacagtgggattgctccgtttgtctggttaggaacgaagcaagtgctacaaagtgtatcgcttgtcagtgccccagtaagcagaatcagacgacggcgattagcacacccgcatcatcagagatatccaaggcccctaagagcggttttgaaggcatgttcattaggaagggtcagtgggattgcagtgtctgttgcgtgcaaaatgagagttcgtccctgaaatgtgtggcctgtgatgctagtaaacctacacataagccaatcgctgaagccccaagcgcttttactctggggagcgagatgaagctccatgattctagtgggagccaagtgggtaccggattcaaaagcaatttctcagagaaggcctctaagttcggtaacacagaacagggattcaagttcggacatgtcgaccaggagaatagcccatcctttatgtttcaggggtcctctaacactgagtttaaaagcactaaggagggcttcagcatacctgtgagcgctgatggttttaagtttggtatcagcgagccgggaaaccaggaaaaaaagagcgagaaacctctggaaaacggcacaggtttccaggcacaggacatcagtggacagaaaaacgggaggggcgtgatctttggacagacctctagcacatttacctttgccgacctggccaagagcacaagcggcgagggttttcagttcgggaaaaaggatcccaattttaaaggattcagcggcgctggggagaaattattcagttctcaatatggtaaaatggccaacaaggctaacacctcgggggattttgaaaaagatgacgacgcgtataagacagaggacagcgacgacattcactttgagccagtggtacaaatgcccgagaaggtggaacttgtcactggggaggaggacgagaaagtgctgtatagccaacgtgttaaactgttcaggttcgacgccgaggttagccagtggaaagagaggggtctgggaaacctcaagatccttaagaacgaggtcaatggtaaacttcggatgctgatgagaagggagcaggtgcttaaggtgtgtgcaaatcactggataacgaccaccatgaatcttaaacccctttctggaagtgacagggcctggatgtggttagcttctgatttttctgatggggatgctaagctcgagcagctggccgcaaagttcaagacccccgagctggccgaggaattcaaacaaaagtttgaagagtgccagcgacttctgttagacatacccctacagactccgcataagctggttgatacaggcagagccgctaaactgatccagagagctgaagagatgaagagcggcctcaaggactttaagactttcctcacaaatgaccaaaccaaagtcaccgaggaagagaacaagggtagtggaaccggcgctgcaggcgcatctgatacgacgatcaaaccaaatcctgagaacaccggtccaaccctcgagtgggacaattatgacctgcgggaagacgccctggacgacagcgtgtctagtagcagcgtgcacgcgtcccccctggcgtcctcacccgtccgaaagaacctcttccggtttggagaatccaccactgggtttaatttttcttttaaatccgccctgagtccaagtaagtctcccgctaaactcaatcaatcaggaacatccgtgggaaccgatgaggaaagtgatgtgacgcaggaggaagagagggatggacaatattttgaaccggtcgtgccactgcctgacctggtcgaagtgagttcaggagaagagaatgaacaggtagtgttcagtcacagagctaaactgtaccggtatgacaaagacgtggggcagtggaaagaacgaggcatcggagacatcaagatcctccagaattacgacaacaagcaggtcagaatcgtaatgcgcagagatcaggttctcaagctgtgcgccaatcaccgcatcaccccagacatgacgctccagaatatgaagggaacggaacgcgtttggctatggactgcctgcgacttcgccgatggtgagcgcaaagtcgagcatcttgcggtcagatttaagctacaggacgtagccgactcttttaaaaagatttttgatgaagccaagacagcccaggaaaaggatagtttgattacgccccacgtatcaaggtcctcaactcccagagaatcaccttgcgggaagattgcagtggcagtcttagaggaaacaactagagagagaacagatgttatacagggggatgatgtggccgacgcaacaagcgaggttgaggtgagttcaacaagcgagacgacgcccaaggctgtggtgtccccgccaaaatttgtgttcggtagtgaatctgtaaaatctatctttagttccgagaagtcgaagccattcgcattcggtaatagcagcgccaccgggagcctctttgggtttagtttcaatgcgccattaaaatccaataacagcgagactagcagtgttgctcagtccgggtccgagtcaaaagtagaacccaagaagtgtgagttgagcaaaaattcggatatcgaacagtcatccgatagcaaagtcaagaacctttttgcgtctttccccaccgaagagtcttctatcaattataccttcaagaccccagagaaggccaaggagaagaaaaagcctgaggattcaccatcggatgatgatgtgctgatcgtctatgagctgacaccaacagctgagcagaaggccctggccacgaaactcaagctaccgccaacgttcttctgttacaagaaccgcccagactatgtgagtgaagaagaggaggatgatgaagactttgaaactgcagtgaaaaaactaaacggcaagctttatctggacggatccgaaaaatgccgccctctagaggagaacactgccgataacgagaaggaatgtatcatcgtgtgggagaagaaacccaccgtcgaagaaaaggcgaaagctgatactcttaagttgcctcccacatttttctgcggagtgtgcagtgacacagatgaagataacgggaatggagaggattttcagagcgaactgcagaaggtacaggaggcccagaaatcccagacggaggagatcacatccaccaccgattctgtgtacacaggcggtaccgaggtcatggttccctctttttgcaaaagcgaggaacctgattctatcacaaagtctatcagctctcctagtgtttcaagcgagaccatggacaagcccgtagatctctcgactagaaaggagatagacacagactccactagtcaaggagagtcaaagatagtctcattcggcttcggtagcagcacagggctctccttcgccgaccttgcttctagtaacagcggggatttcgccttcggcagcaaagacaagaactttcagtgggctaacaccggggcagctgtcttcggaacccagtctgttggaacccagagcgctggtaaggtgggggaagacgaagatgggtccgacgaggaggtggtccataacgaagacatccacttcgagcccatcgtctcactccctgaggttgaagtgaaaagcggggaggaagacgaggaaattctcttcaaagaacgggctaagctgtataggtgggatcgggacgtgagtcaatggaaagagaggggtgtgggggacattaagattctgtggcataccatgaaaaactattacagaattcttatgcgtcgtgaccaggtttttaaagtgtgcgccaatcacgtaattaccaaaacgatggagctaaagcccctcaacgtgagtaacaatgccttagtgtggacagcctctgactatgcagatggagaagccaaggtggagcagcttgccgtcaggtttaagacgaaggaagttgctgattgcttcaaaaaaacctttgaggagtgtcaacagaatctcatgaagttacagaaaggccacgtgtctctggccgcagaattatctaaggaaaccaatccagtggtctttttcgacgtgtgtgccgacggcgagcccctgggcaggatcactatggagttgttttcaaacatcgtccctcgaaccgctgagaattttcgcgctttgtgcacgggggagaagggcttcgggttcaaaaattcaatcttccacagagtgatcccagattttgtttgccaaggtggtgacatcaccaagcacgacggaaccgggggacagagcatctatggagacaagttcgaggatgagaatttcgatgtgaagcatactggccctgggctgctgtcaatggccaatcaagggcagaacaccaataatagccagtttgtgatcaccctcaaaaaggctgagcacctggactttaaacacgttgtcttcggatttgtgaaggatggcatggataccgtgaaaaaaatcgaatctttcgggagccctaaagggagtgtgtgccggagaatcaccattacagagtgcggccaaatatat

SEQ ID NO: 237879 - DNA, 1500 bp, Artificial Sequence
  Description of Artificial Sequence: Synthetic coding sequence
atggctgatctggccaacgaagaaaagcccgctatcgcccctccagtcttcgtgttccagaaggataagggacagaagcgaagcgcgggagggtccagtcctgaaggcggagaggacagcgacagggaggacgggaattattgccctcctgtgaagagggagaggacctcaagcctcacacagttccccccaagccagagcgaagaacggtcaagtggattccgacttaaaccgcctacactaattcacggacaagcaccatctgccggactcccaagccaaaagccaaaagagcagcaacgctccgtgctgagaccagcagttctgcaggccccacagcccaaggctctatctcaaaccgtcccttcaagcggcacgaacggagtgtctctgccagctgactgcaccggtgcagttcctgctgcctctcctgacacggctgcatggcggagtccatccgaggcagccgacgaggtgtgtgctctggaggaaaaggaacctcagaaaaatgagagcagcaatgcatctgaggaagaagcctgcgagaaaaaggaccctgctacccagcaggccttcgtgttcgggcaaaacctgcgggaccgagtgaaactcattaacgagagcgttgacgaagcagacatggaaaacgccggacacccaagtgccgatactccgacggctacaaactatttcctgcagtacatttcatcttcactggagaattctacgaatagcgcagatgcctcctccaataagttcgtgttcggtcagaatatgtctgaaagggtgctgagcccaccaaaattgaacgaagtgtcgagcgacgcaaatcgcgaaaacgctgccgcagaaagtgggagcgaaagctctagccaagaggctaccccggagaaagagagtctcgccgaatcggctgcagcctacacaaaggccaccgcacgaaagtgccttctggagaaagtcgaagtgatcacaggtgaagaggccgagtcgaatgtcctccagatgcagtgtaagcttttcgttttcgataaaaccagccagagttgggtagaacgtggacgcggacttctgcgactgaacgatatggcctccacagatgatggaaccctacagtcccgcctcgtgatgaggacccagggtagcctgagacttattctgaataccaagctgtgggctcagatgcagattgataaggccagcgagaaatcgattcggattactgcaatggacaccgaggaccagggagtgaaggtgttcctgatcagcgcctcctccaaggatacggggcagctatatgctgccctccaccataggattctagctttgagatcacgggtcgagcaggaacaagaagcaaagatgccagcgcctgagccaggtgccgcacctagcaacgaagaggacgactctgatgatgacgacgtgttagccccaagcggcgcaacagctgcaggggctggagatgagggagatggccaaactaccgggtccacgtag

SEQ ID NO: 237880 - DNA, 1194 bp, Artificial Sequence
  Description of Artificial Sequence: Synthetic coding sequence
gctgacgtgactaaggccgaaaagcctgccattgcccctcctgtcttcgtcttccagaaagataaaggtcaaaaaaggagcgctggaggaagctcaccagaaggaggtgaagactctgacagagaagacggtaactactgtcccccagtgaagagggagcgaacgtcatcactgacacagtttccaccgtcccagagtgaggagcgttcctcaggctttaggctcaagccgccaacactgattcacggacaggccccaagtgctggcctgccatcacagaaaccaaaagagcaacagcggtctgtgcttcggcctgcagtcctgcaagcccctcagcctaaagccctgtctcagacggtcccgtcgtccgggacaaatggcgtgtccctgccagcagattgtaccggtgcggtgccagcggctagtcctgatactgccgcatggcggagtccaagcgaagcagcggatgaagtatgcgccctcgaagaaaaggaaccacaaaaaaatgagagctcaaacgcttctgaggaggaggcatgtgaaaagaaagaccccgcaacccaacaagctttcgtgtttggtcagaatctcagagatagggtgaaactgattaacgagtctgtggatgaggctgatatggagaacgcaggacatccttcggcagacacgcccactgcaactaactacttccttcagtatattagttccagccttgaaaattcaaccaacagcgccgacgccagttcgaacaagttcgtctttgggcaaaatatgtctgagagagtcctgagtccgcctaagcttaacgaagtgtcttccgacgctaatcgggagaatgcagctgccgaatcaggatccgagagctcaagccaggaggccacccccgaaaaggagtccttagccgagtccgctgctgcgtacactaaggccaccgctagaaaatgtctgctggagaaagttgaagtaattactggtgaggaagcggaatctaatgtgctgcaaatgcaatgcaaactgttcgtgttcgacaaaacaagccaaagctggtggctcctacgacaccctcatccatcacatcctgctgtgggcccttgcctgtgtggggagcagcctgccctgtgcccatgtcctgggctgcctaattaccgtccagggacgcccgcacagctgggcggattgctcgttagggtgtag

SEQ ID NO: 237881 - DNA, 1704 bp, Artificial Sequence
  Description of Artificial Sequence: Synthetic coding sequence
atggctgacctggccaacgaagaaaagcctgccatcgccccaccagtctttgtttttcagaaggataagggccaaaagagcccggctgaacagaagaacctgagcgacagcggtgaggagccgaggggggaggcagaggctccacaccatggcacaggtcatccagagagcgcaggcgaacatgccttggagcctcctgccccagcgggagccagtgcatccacccccccacctcctgcccctgaagctcagctccctccgttccccagggagctcgctggccgatcagccggtggtagcagccccgaggggggtgaggatagtgaccgtgaggatgggaattattgtccaccagtcaagagagaaagaacctcttccctgactcagttccctccttcccaatctgaggagagaagttctgggttccggctgaagcctcctaccttaattcatgggcaggccccatcagcgggactgccctctcagaaacctaaagagcagcagcggtccgtgctgaggcccgcagtgttgcaggctccccagcccaaggctttgagtcaaactgtgccatcttccggcactaatggggttagtcttccagctgactgcactggcgcagtgcctgctgctagtcccgataccgccgcatggagatccccttcagaggcagccgacgaggtgtgcgctttggaggaaaaagagccacaaaagaacgagtcatccaacgcctcggaggaggaagcgtgtgagaaaaaagatcctgctactcagcaggcttttgttttcggacagaatctaagagatcgtgtcaagttgattaacgagagtgtcgacgaagccgatatggagaacgccggtcatccctcggccgacaccccaactgcaacgaattactttcttcaatatataagcagtagtctagaaaactctaccaattcagcagacgcctcttcaaataagttcgtatttggtcagaacatgagcgagagggtcctctcgcccccaaaactgaacgaggttagttccgatgctaaccgcgaaaatgcggctgctgaatccgggagcgaatcgtctagccaggaagccacaccggagaaagagtccctggctgaaagcgccgcagcttacaccaaggctaccgcgagaaaatgtctgctcgaaaaagtggaggtcatcactggagaggaagcagaaagcaatgttttacagatgcagtgtaagttattcgtcttcgataagacatctcaatcatgggtggagcgagggagaggactgctgaggctgaatgatatggccagcaccgacgatggcaccttacagtccaggttagtaatgcgcactcaagggagcctgcggcttatcttgaataccaaattgtgggctcaaatgcagattgacaaagcgagcgagaagtctatcaggataacagccatggataccgaagaccagggggtgaaagtttttcttatatcagcttcatctaaggataccggacagctgtatgcagcactgcatcatagaatattggcgcttaggagtcgcgtggaacaggagcaggaggctaagatgcctgccccagagccaggagccgctcccagtaatgaagaagacgattctgatgatgatgatgtgcttgcgccatctggtgcaaccgccgcaggcgctggcgatgagggagacggccagaccactgggtctacctag

SEQ ID NO: 237882 - DNA, 1689 bp, Artificial Sequence
  Description of Artificial Sequence: Synthetic coding sequence
atggctgacctggcgaatgaggaaaaacccgctatcgccccaccagtgtttgtctttcagaaggacaaaggccaaaagtccccagcagagcagaagaatctgagcgacagtggggaggaacctcgtggcgaagccgaggcacctcatcatggcactggccatcccgagtcggctggcgagcatgcgctggagccccctgcccctgcaggggcatcagcctccacaccccctccgccagcccctgaggcccagctcccccctttccccagagagctagccggtcggtcagcaggtggttcaagtcccgagggcggagaggattctgacagagaggacggaaactactgccccccagtaaaacgcgaaaggaccagtagtctgacccaatttcctccatctcagagcgaagagagaagcagcggattcagactgaagcccccaaccctgattcacggacaggccccttctgcaggattacccagccagaaacctaaagaacagcagaggtctgtgctgcgccctgctgtattgcaggcacctcaacctaaggctctgtctcaaactgtaccaagttccggcaccaatggcgtgtccctgccagcagactgcacaggagccgtgccagcagcctcacccgataccgctgcctggcgcagcccctccgaggcagccgacgaagaaaaagagcctcagaagaacgagtcttccaacgcttcagaggaggaagcttgcgagaaaaaggatcccgcaacccaacaggcctttgtgttcgggcagaacctgcgagatcgggtaaaactgatcaacgagagcgttgatgaagctgatatggagaatgctggacacccgtccgccgacacgccaactgccacaaattactttttgcagtatatctcatcgtcgctggagaactcaactaacagtgcggatgctagctctaacaagtttgtgtttggccagaacatgtcagaacgggtgctatcacctcctaagcttaacgaggtgtcatctgatgccaatcgcgagaatgccgctgccgaatctggctcagaatcatcctcccaagaagctacaccagaaaaagagtccttggcagaatccgcagcagcctacacgaaggccacagctagaaaatgcttgctggagaaggtagaggtcattactggagaggaggcagaatctaatgtgcttcagatgcagtgtaagctattcgtgtttgataagacgtcacagtcctgggttgaaagaggcaggggcctgctcaggctcaatgatatggcatcaacggacgatgggaccctgcagtcacgcctcgtgatgcggacccaaggatccctgcggttaatcctcaatacaaaactgtgggcacagatgcagattgacaaggcctcagagaagtcgatccgcatcacagcaatggacaccgaagaccagggagtgaaggtcttcctgatttcagcttccagtaaggataccgggcagctatatgccgcactgcaccacagaatcctagcgctgcggtctcgagtggagcaggaacaagaagctaaaatgcccgcacctgagcccggagcagcccctagtaacgaggaagatgactctgacgacgatgacgtgttggcacctagtggggctactgctgctggtgctggcgatgaaggcgacgggcagaccaccggtagcacatag

SEQ ID NO: 237883 - DNA, 1320 bp, Artificial Sequence
  Description of Artificial Sequence: Synthetic coding sequence
atggctgacctggccaatgaggaggaaaggtcgtcaggcttccgacttaaaccacctactttgattcacggccaagcaccttcagccggtctaccttctcaaaagcccaaagaacaacaaagaagtgtgctgaggcctgcagtccttcaagcaccccagccaaaagctctcagccagacagtgccctctagcggtacgaacggagtatcactgcccgctgactgtaccggagccgtccccgcagccagtcccgataccgctgcttggcgtagcccgagtgaggcagccgatgaggtgtgtgccctggaagagaaggaacctcagaaaaatgagagttctaacgcctcagaggaagaagcgtgtgagaagaaagatcccgcaactcagcaggcctttgtatttggacagaatctgagagaccgggtgaaacttatcaatgaatctgttgacgaggccgacatggaaaacgcaggccacccctccgccgacacacctactgcgactaattactttttgcagtatatttcaagtagcctagaaaactcaaccaatagtgctgacgcgagcagcaacaaatttgtcttcggccagaatatgtctgagagggtgctgtcccccccaaaattgaatgaagtctcatcagatgccaacagggaaaatgctgcggctgaatctggcagtgagtcttccagccaggaggcgactcctgaaaaggaatctctggccgaatccgctgctgcgtatacaaaggctactgccagaaaatgtctcttagagaaagtggaagtgatcactggtgaagaggcggagtccaatgtgcttcaaatgcaatgtaaactgttcgtgttcgacaaaacttcccagtcctgggtagaacgtggccgaggcttgctgcgactgaacgacatggcttctacggatgatggcaccttgcagtcccgccttgtaatgaggacccagggttcactcaggctgattctgaacacgaagctatgggcccaaatgcagatagacaaagcgagcgaaaagagcattcgcataacggccatggataccgaggaccaaggagtgaaagtttttttgatctcggcgtcatccaaagacaccgggcaactctacgccgctcttcaccatcgcatcttagcgttgaggagtagggtggagcaggaacaagaggcaaaaatgccagcacccgagcccggtgccgctccttctaatgaggaagatgacagtgatgacgacgatgtactcgccccttccggcgcaacggccgctggagccggagatgaaggggacgggcagacaacgggttctacgtag

SEQ ID NO: 237884 - DNA, 2190 bp, Artificial Sequence
  Description of Artificial Sequence: Synthetic coding sequence
atgagtggtcaaccaccccctccccctccgcagcagcagcagcagcaacagcaactttccccccctccccctgcagcacttgccccagtatcaggggttgtgctccccgctccgccagcggtcagcgcaggttctagccctgcagggtctcccggtgggggagccggtggggaggggctgggtgctgccgcagcggcactgctcctgcatccccctccacctcccccacccgcaacggcagctccaccaccccctccacccccaccacctccccctgcgagcgctgccgctcctgccagtgggccaccagcgcctcccggtctggccgcagggccaggccctgccggaggagctcccacgcctgccctggtcgctggttcctcggcggctgccccatttcctcacggcgatagtgctttgaatgaacaagagaaggaactacagagaaggctgaagcgactttaccctgccgtggatgaacaggaaacccctctccccagaagctggagccctaaggacaagtttagctatatagggctgagccaaaataacctcagagttcattacaaggggcatggcaaaacaccaaaagacgcagccagcgtcagagcaacccatccgatccccgctgcctgtggcatctattattttgaggttaaaattgtcagtaagggtcgcgatggctatatggggatcggcctcagcgctcagggcgtgaacatgaataggcttccaggatgggataagcattcatacggctatcacggtgacgacgggcactctttttgtagttccggtacaggtcagccctatggaccaacctttaccactggcgatgtcatcggctgttgtgtaaacctgattaataacacgtgcttctatacaaagaacgggcactctcttgggattgcgttcacagacctgcccccaaacttatacccgaccgtggggctgcagacgcccggagaagtggtggacgccaatttcggacagcaccccttcgtgttcgatatagaggattacatgagggagtggagaacaaagatccaggcccagatcgatcgatttccaatcggagatcgggagggtgagtggcaaactatgatccagaagatggtctcatcttatctggtccaccacggctactgcgccaccgcagaggcctttgccaggagtaccgaccaaacagtgctggaagagctggccagcattaaaaatcgccagagaattcagaagctcgtgctggctgggcgtatgggcgaggccatcgaaacaacccagcagctttaccctagtcttctggaacggaatcctaatcttttgttcacgttgaaggtgagacagttcattgaaatggttaacggcacagattcagaagtccgatgcctgggtggaagaagcccaaagagccaggacagttatcctgtttcacctaggcctttctctagcccttccatgagcccttcccatggcatgaatatccataacctggcttccgggaaggggtcaaccgcccatttctcaggctttgaatcatgttcaaacggtgttatttctaacaaagcacaccagagttactgccactccaacaaacatcagtcctccaacttgaatgtccccgagctcaacagtataaatatgagccgctctcagcaggtgaacaattttacttccaacgatgtcgatatggaaacagatcactactcaaacggggtgggtgagacttcgtccaatgggttcctgaacggctcctcaaagcatgatcacgaaatggaagattgtgacactgagatggaggtcgatagttcacagctcagaagacagctctgcgggggttcccaagccgctatcgagcggatgattcacttcgggagagagctgcaggcaatgtctgaacagctccgaagggactgtgggaaaaacaccgctaacaaaaaaatgttgaaagacgcgttctcactgctcgcttatagcgacccatggaatagccctgtgggaaaccagctggaccctattcagagggagccagtctgctccgctctgaattcagcaattttggaaactcataacttgcccaagcagcctcccctggctctggctatgggacaggctacccagtgccttggactgatggcccgtagtggaatcggcagctgtgctttcgccacggttgaggactacctacactag

SEQ ID NO: 237885 - DNA, 1176 bp, Artificial Sequence
  Description of Artificial Sequence: Synthetic coding sequence
atgtccggacaaccaccacctccgccaccccagcaacagcagcagcagcaacagctttccccgcctccacccgctgctctggcacccgtctccggcgtggtacttccagccccaccggcagtgagtgctgggagcagtccagccggatcccctggcggaggagccggaggtgagggcctgggcgctgcagccgctgcactcttgctccacccgcctcccccaccaccacctgcgaccgctgccccaccccctccacctcctccaccccctccaccagcaagtgctgcagcaccagcttccggacctccagccccacccggactagccgcaggccctggccctgccggaggagctccaacccccgcactcgtggctggttcctccgctgcagcaccatttcctcatggggattccgcccttaacgagcaggaaaaggaactccagcggaggctgaagaggctgtaccctgccgtggacgagcaggaaacccccctccctaggagttggtcacctaaggacaaatttagctatatcggcctgtctcagaacaatctacgggtccactataaaggacatggtaagacccctaaggacgccgcttccgtcagagccactcatccaatccctgccgcatgcggcatttattatttcgaagtcaagatcgtctctaagggcagagatggttacatgggcattggtctttccgctcagggtgtgaatatgaaccggctccctggatgggataaacacagctacgggtaccacggagacgatgggcacagtttctgtagcagcggtaccggccagccctatggaccgactttcacaacaggagacgtaatcggatgttgcgtgaatctgattaataacacttgtttctatacgaaaaatgggcactccttgggtatagcttttaccgacctccctcccttggattacccagtcagtcctagaccttttagcagcccctctatgagccctagtcacggcatgaatatccacaacctggccagtggaaagggaagtaccgcacatttctctggattcgaatcttgtagcaacggcgtcatctcgaacaaggcacaccagtcgtactgtcacagcaataagcatcaatctagtaacgagtgtacccgaaccaaacaatacaagtacgtaaaaattacagcttcatag

SEQ ID NO: 237886 - DNA, 1503 bp, Artificial Sequence
  Description of Artificial Sequence: Synthetic coding sequence
atgggtatcgggttgtccgcccagggtgtcaatatgaaccgattgcctggttgggataagcatagttatggctatcacggtgacgacggacattccttctgttcttctgggactggccagccgtatgggccaacttttaccactggtgacgtcatcggctgttgtgtcaacctgataaacaacacatgtttttacactaagaatggacacagtctggggatagccttcacagacctgccccctaatttatatcctaccgtaggcttacagacaccaggcgaggttgtggacgcgaacttcgggcagcaccctttcgtttttgatatcgaagactacatgcgcgaatggcgtacaaaaatccaggcccagatcgacaggtttcccattggcgatagggagggggaatggcaaacaatgatccaaaaaatggtttccagctaccttgtgcaccacggctactgcgccactgctgaagctttcgcgagaagtaccgatcagacagttttagaagagcttgcttccattaaaaatagacaaaggatacaaaagcttgtactcgctgggagaatgggggaagctattgagacaactcagcagttgtacccttccttgctggaaaggaaccctaacctgttgttcacactcaaagttagacagttcatcgagatggtcaatgggaccgattctgaagttaggtgtctgggcggtagaagtccgaaatcacaggactcttacccggtgtctcctcgccctttcagtagcccatcaatgtcccctagccacggtatgaacattcacaacttggcctctggcaaaggatcgactgcccacttttccggctttgagtcttgttctaacggagtaattagcaataaagctcaccaatcctactgtcattccaacaaacatcaatccagcaatctgaacgtgccagagctgaatagcatcaacatgtcgcgatcccagcaggtcaataatttcacaagtaacgatgtggacatggagactgaccactacagcaatggcgtcggagagacatcctctaatggtttcctgaatggcagtagcaagcacgaccacgaaatggaggactgcgataccgagatggaggtggacagcagccaactcaggcgccagctgtgcggtggctcccaggccgcaattgagcgaatgatccatttcggcagagagctgcaggccatgtctgagcagctgcgccgtgactgtgggaagaacaccgcaaacaaaaagatgcttaaggatgcattcagtctacttgcttatagcgacccttggaacagcccagtcggcaatcaacttgatccaatacagcgtgagcccgtgtgttccgctctgaattccgccatcttggagacacataacctgcccaagcagcccccactcgctctggccatggggcaagctacacagtgtttagggctgatggcacggagcgggataggaagctgcgccttcgccaccgtcgaagactacctccattag

SEQ ID NO: 237887 - DNA, 387 bp, Artificial Sequence
  Description of Artificial Sequence: Synthetic coding sequence
atgtttgatgtgacctctcgagtgacttacaagaatgttcctaattggcatcgcgacctcgtgagggtttgtgagaatattccaattgtcttgtgcgggaacaaagttgatatcaaagaccggaaggtgaaggctaagtctatcgtcttccaccgcaaaaaaaatctgcagtattatgatatcagcgccaaatccaactataattttgagaaaccgttcctgtggctggctcgcaagcttattggcgatccgaacctcgagtttgtcgccatgccagcgctggcacccccagaggtggtgatggacccagcactggcagcccaatatgagcacgacttggaagtcgctcagactactgccttaccagacgaagacgacgatctgtag

SEQ ID NO: 237888 - DNA, 702 bp, Artificial Sequence
  Description of Artificial Sequence: Synthetic coding sequence
atggctgcacagggagaaccccaggtgcagttcaagttggttctcgtgggtgacgggggaacaggcaagaccacctttgtgaaacggcaccttactggcgagttcgaaaagaaatatgtcgctacactgggagtcgaggtacaccctcttgtattccacacaaaccggggaccaattaagttcaatgtctgggataccgctgggcaggagaagttcggaggcctgagggatgggtattacattcaggaaatgggcatccatcacgttgctcatgctggacttgaactgatgagctcagcacaatgtgccataattatgttcgacgtaacgtccagggttacgtacaagaatgtcccaaattggcaccgtgatctagtgcgggtgtgtgagaacatccctatcgtcttgtgcggcaacaaagttgacattaaggaccggaaagttaaagccaagtcgattgtctttcaccggaaaaaaaatcttcaatactatgacatctctgcaaaaagtaactacaattttgaaaaacctttcctctggctagccagaaagctcatcggggatcctaacttggaattcgtagctatgccggcactcgcacctccagaagtcgtgatggaccctgcccttgcagcacagtatgaacacgacttggaagtggcccagacgaccgcccttccagatgaggatgacgacttatag

SEQ ID NO: 237889 - DNA, 651 bp, Artificial Sequence
  Description of Artificial Sequence: Synthetic coding sequence
atggccgcacagggggagcctcaagtccaattcaagctggtactggttggtgacggtggcaccggcaagacgacctttgtgaaacggcatctgaccggcgagtttgagaaaaaatatgtagccactctcggtgtcgaggtgcacccactggtttttcatacaaaccggggaccgatcaaattcaatgtgtgggacacagctggccaggaaaagtttggaggcctgagggatggttactacatacaggcacagtgcgccattatcatgttcgatgtaacttcccgagtaacttataaaaacgttccaaactggcacagggaccttgtacgggtatgtgagaacatacccattgtcttgtgtggaaacaaggtggacattaaggaccgcaaagtgaaggctaaaagtatagtgttccacaggaaaaaaaacctgcagtattatgacatatctgccaagagcaattataactttgaaaaaccgtttctgtggctagctaggaaactgattggagatcccaacctcgagttcgtcgctatgccagcactggcccctccagaggtggtcatggatccagcccttgccgctcagtatgaacacgacctggaagtcgctcagactacggccctgcccgatgaggatgatgacttatag

SEQ ID NO: 237890 - DNA, 705 bp, Artificial Sequence
  Description of Artificial Sequence: Synthetic coding sequence
cgaagaaggcgcttaaggttgcgtcgcctcaattgcgcgtccgccatcttccccgctagtgtgggccgtgcacgtaggaggttttggaagctcgtcttggtgggagacggcggaactgggaagacgacctttgttaagcgccacctaaccggcgaatttgagaaaaagtacgtagcaaccctaggggtcgaagtgcaccccctggtattccatactaaccgcggacctattaaattcaacgtgtgggacaccgctggccaggagaaattcggcggtcttcgtgacggatactatatacaggctcagtgcgcaattatcatgttcgacgttacctcacgggtgacgtataaaaatgtgcccaattggcacagagacctggtgcgcgtctgtgagaatatccctatcgtgctgtgtggaaacaaagtggatatcaaggatcggaaagtgaaggcgaaaagtattgtcttccataggaagaaaaatctccagtattacgacatatccgccaagtcaaactataactttgaaaagcctttcctctggctggccagaaaattaattggcgatcccaatctggaattcgtggccatgccagccctcgctcccccagaggtcgtcatggaccccgctttagccgcacagtatgaacatgatctcgaagttgcccagacaactgctttgcctgacgaagatgacgatctgtag

SEQ ID NO: 237891 - DNA, 387 bp, Artificial Sequence
  Description of Artificial Sequence: Synthetic coding sequence
atgtttgatgtcacgtctagggtcacctataagaatgtacctaactggcacagggatctagtcagagtgtgcgagaacattccgatcgtactgtgcgggaataaggtcgatattaaggaccgaaaagtgaaggcaaaaagcatagtgtttcatagaaagaagaaccttcagtactatgatattagcgccaaatccaattataacttcgagaagccatttttatggctcgcccgaaagctcattggcgacccaaatctggagtttgttgccatgcccgcactggcccctcctgaagtggttatggacccggcactcgcagcccaatatgagcatgacctggaggtcgcccagacaactgcgctaccggatgaggacgacgatctgtag

SEQ ID NO: 237892 - DNA, 651 bp, Artificial Sequence
  Description of Artificial Sequence: Synthetic coding sequence
atggcagcccagggggagccccaggtgcagttcaagttggttctggttggagacggtgggaccgggaagaccacctttgtcaagagacaccttacaggtgagttcgaaaaaaagtatgtggctactctgggcgtcgaggtgcacccactggttttccacactaatcggggtcccatcaagttcaacgtttgggacactgctgggcaggagaagttcggcggactccgcgacggatactatatccaggcccaatgcgccatcattatgtttgatgttacatcacgagtgacatacaaaaatgtgcccaattggcatcgcgatctggtacgcgtctgtgagaacattcccatcgtgctgtgtgggaacaaggtggacatcaaagatcggaaggttaaagcaaagtccatcgtgtttcatcggaagaaaaatctgcaatactatgatatctccgctaagagcaattacaactttgaaaaacccttcctctggttagctagaaagcttatcggtgaccctaacctagagtttgttgcaatgcctgccctggctccaccagaggttgttatggatccagctctggcagctcagtatgagcacgacctggaagttgcacagacaaccgctctgcccgatgaggacgacgacctgtag

SEQ ID NO: 237893 - DNA, 5270 bp, Artificial Sequence
  Description of Artificial Sequence: Synthetic coding sequence
atgcgacggtccaaggcttatggcgagcggtacttggctagtgttcagggatccgccccttcacctggcaaaaagttgcgcggattctacttcgcaaaactgtactacgaggctaaggaatatgaccttgctaagaaatatgtgtgcacctatctctccgttcaggaacgcgatccaagggctcatcgcttcctgggactgttgtacgagctggaggagaacaccgagaaggctgtggagtgctaccgccgaagtctggagcttaaccctcctcagaaggacctggtcctcaagatagcggaactgctgtgtaagaatgatgtgaccgatggacgtgccaagtactgggtggaaagggccgctaagctgttccccggatcgcccgctatctataagctcaaagaacatctgctcgactgtgagggcgaggatggctggaataagctgtttgattggattcagagtgagttgtacgtccggccagatgatgtacacatgaatatccgattggtggaactgtacaggtctaataaacgcttgaaagacgctgtagctagatgccatgaggcagagcgcaatatcgctctccgctccagcctagaatggaactcatgcgttgtccaaactttaaaggaatatctcgaatcactgcaatgtttagaatccgataagagtgattggcgggcaacaaatactgacttgctcttggcatacgccaacctaatgctgctcacgctgagtaccagggacgttcaggagtctcgggaattgctggagtcgttcgacagcgccttacaatctgcaaaatcctccctggggggaaacgacgagttgtcagctaccttcctggagatgaagggccacttctatatgcacgctggatctttattgctgaagatgggtcagcacggcaacaatgttcagtggcaggcattgtctgagttggccgcattgtgttatgtaattgcgttccaggtgcccagaccaaagatcaaactgattaaaggagaggccggacagaaccttctggaaatgatggcatgcgatcgcctttcacagtctggtcacatgctgttgaacttgtctagagggaagcaagattttctgaaagaagtggtggagacctttgccaacaaaagcgggcaatccgtgttgtacaatgctttgttttcctcacagagctccaaggatacatcttttctgggatctgacgatatagggaacatagatgtccaggagccagagttagaggatctggccaggtacgacgtgggcgctatccaggcgcacaacggttcccttcagcaccttacctggctcggcctccagtggaacagtctgcctgctctgcctggtatcagaaagtggctaaagcagttgttccatcacctgccacaagaaacgtctaggctcgaaacgaatgcccctgaatctatttgcatcttggacctggaagtgttccttctcggagtggtttacactagtcacctccagttgaaggaaaagtgcaattcacatcacagcagctaccagcccctatgcttacctcttcctgtctgtaagagactgtgcactgagaggcagaagtcctggtgggatgctgtgtgtaccctgatccaccgcaaagcagtacccggaaacagtgcggagcttcgtctggtagtgcaacacgaaatcaacactctgagagcccaagagaagcatgggctacagccagcactgctagtacattgggctaaatgcctgcaaaagatggggaggggcttaaactcttcttatgatcagcaggaatacattggacggtcagtgcactactggaaaaaagtgctccctctgctaaaaattatcaaaaagaattccataccagagcctatcgacccactgtttaagcacttccacagtgtagatatacaggcttccgaaatagttgaatatgaggaagacgcacatattacatttgcaatcttggatgccgtccacggcaacatcgaggatgccgtgacagcattcgaaagtataaagtctgtcgtttcctactggaacctggcactgatcttccaccgcaaggcggaagatattgagaacgacgccgtgttccctgaagaacaggaagagtgcaagaactatctgagaaaaacaagggattacttgatcaaaatcatcgacgattccgattctaacctatcggtggtgaaaaagctgccagtgccactggaatcggtgaaggaaatgctgaaatcagttatgcaagaactcgaggattattctgaaggtggcccactgtataaaaatggtagcttaagaaacgctgattcagaaatcaagcactcaaccccaagtcctactaagtacagcctcagtccttccaagtcatacaagtatagtccaaagacaccacctcggtgggccgaagatcaaaattcactgcgcaaaatgatctgtcaggaagtgaaagcaatcaccaagctaaattctagtaagtcagcaagcagacacagatggcctaccgaaaactatgggcctgacagtgtgcctgatggatatcaagggtctcagacatttcatggggcaccactcaccgttgcaactacaggtcccagcgtgtattactcccagtctcctgcctataactcacagtatctcctgaggcctgcagctaacgtgaccccaaccaaaggctcctccaatacagagtttaaatcaacaaaagagggcttttctatcgctgttagcgctgacggcttcaagttcggaatttcagagcccggaaaccaggagaaaaagtctgaaaagccacttgagaacgataccggcttccaggcacaggacatttccgggcagaaaaatggaagaggcgtgatctttggacagacctccagcacgtttacatttgccgacgtggccaagtccacttctggagaggggtttcagttcggcaaaaaggatcctaatttcaagggatttagcggggctggcgaaaagctgttttcttcgcagtgcggtaaaatggcaaataaggccaatacgagcggcgattttgagaaagatgacgatgcctgcaagacagaggatagtgatgacattcacttcgagccagtggtacagatgcccgaaaaggtggagctcgtcaccggggaagagggagagaaagtgctatactcacagggcgtgaagctgttcaggtttgatgccgaaattagccaatggaaggagcgcggactggggaacctgaaaattctaaagaacgaggtcaatggaaaaccccgtatgctgatgcggagggatcaggtcctgaaggtctgcgctaaccactggattacaacaacaatgaaccttaagcctttgtccggttccgacagggcttggatgtggttggcatccgacttttccgacggagacgctaagctcgaacgcctcgccgcacagtttaagacccctgagttggcggaggaattcaaacaaaaatttgaggaatgccagagactcttgttggatattccacttcagacacctcacaaactggtcgataccgggagagccgcaaagctgattcagcgggctgaggagatgaagtcggggctgaaggatttcaaaacgttcctgaccaacgaccagactaaggtcacggaggaggagaataagggatcaggcaccggagcagctggagcgagcgacacgaccatcaaacccaaccccgagaacacaggtccaaccttagaatgggacaattatgatctgagggaggatgcgcttgacgacaatgtaagcagttcctccgtgcacgattcgccactcgccagttcccctgttaggaagaacattttcagattcgacgaaagcaccactgggttcaatttttccttcaagtccgcactgtccctgagtaaatctcccgcaaaactaaatcaaagtggcacgtccgtgggcactgatgaagagagcgacgtaacacaggaagaagaacgcgacgggcagtactttgagcctgtcgtgcctctcccggaccttgttgaggttagcagcggggaggaaaatgaacaggtagtttttagtcaccgggctgaactgtaccgttatgataaagacgtgggccaatggaaggaacggggaattggggatataaagatccttcagaactacgataataagcaggtacgaatcgttatgaggagagatcaagtgctgaagctctgtgccaaccataggattaccccggacatgtctctgcagaacatgaaggggacagagagggtatgggtgtggaccgcatgtgactttgcagatggcgagcggaaagtggagcacttggccgtccggtttaagctgcaggacgttgccgacagcttcaaaaagatctttgacgaggccaaaacggcgcaagaaaaggactcgctgataacaccgcacgtgtccagatcaagcacgcctagagaatcaccatgcggaaaaatcgctgtcgccgtgctcgaagagactactagagagcgcacagacgtcatccaaggcgacgatgtggccgacgccgctagtgaagtggaggtgtcatcgacgagcgaaaccacgactaaggctgttgtctccccccctaagttcgtgtttgggtccgagtcagtcaaacgaatttttagctctgagaagagtaaccctttcgccttcggcaatagttcagctacagggagtctgtttgggttttcttttaacgccccactgaagtctaatgatagcgaaaccagcagcgtcgcacaaagtgggtcagaatcgaaagtggaacctaagaaatgtgaattatccaaaaacagtgacattgagcaatcatccgattcgaaagtgaagaacctttccgcctcatttcctatggaagagtctagcatcaactatacctttaagacccccgaaaaggaacctcctttgtggcatgccgagttcaccaaggaggaactggtgcagaagctctcctccaccaccaagagtgctgatcagttgaatggtctcctgagagagaccgaagctacaagtgcggttttgatggaacagataaagcttctgaagagtgaaatcagacgcctcgagaggaatcaggaagagagcgccgcaaatgtggaacacctgaaaaatgtccttttacagttcatcttcttgaaacccggatccgaaagagagtccctgctccccgtcattaacacgatgctgcagctgagtcctgaggagaaaggtaagttagcagccgtggcccaggggctccaggagacctcaatccctaaaaagaagta

SEQ ID NO: 237894 - DNA, 5246 bp, Artificial Sequence
  Description of Artificial Sequence: Synthetic coding sequence
atgaatgtcatgggtttcaacactgaccggctggcgtggacgcggaacaagctcagggggttctacttcgccaagctctattatgaagccaaagaatacgatctggccaaaaagtacgtgtgcacctatctttctgtccaggaacgggatcccagggcgcatagatttctgggacttctctatgagctagaagagaacaccgagaaagcggttgagtgttatcggagatctctcgagctgaatcccccacagaaggatctggtgctcaagattgctgagctgctgtgtaaaaatgatgtgacagatgggcgagctaagtactgggtagagcgagcagccaaactgtttccaggctccccagccatttacaagcttaaagagcatttgctcgactgtgagggcgaggatggatggaacaaactgttcgactggatccagtcagagctgtatgtgcggccagacgacgtgcatatgaatattagactagtagagctatacagatctaacaaaagactgaaggatgccgtagcacgatgccacgaagccgaaaggaatatcgcgttacgttccagcctggagtggaactcatgcgtggtgcagacattaaaagagtacctggagagcttacagtgcctggagtccgacaaaagcgactggcgggctactaataccgatctcctgctggcatatgctaacctcatgctcctgacattatctactagagacgtgcaggagagcagagaactactagagtctttcgacagcgcgctgcaatccgcaaagagctctcttggagggaatgacgaactttctgccacttttctggaaatgaaaggtcacttttacatgcacgccggatctttacttctgaagatgggacagcacggaaacaatgtgcagtggcaggcgttgagcgagctcgcagcactatgttacgtaattgccttccaggtccccagacccaagatcaaactgattaagggggaggctgggcagaacctcttggagatgatggcttgtgaccgactgtcgcaatctggacacatgttactgaacctgtccagagggaaacaggatttcctcaaagaggtcgttgagacgttcgccaacaagagcggtcagtccgttctttataacgccctgttctctagtcagtcttcaaaagatacctccttcctcggcagtgatgacattggaaatatagacgtgcaagagcccgagctcgaagacctggctagatacgacgttggcgctatccaggctcataacggaagtctccagcatctgacatggctcgggcttcagtggaacagcctgcccgcactgccgggaatccgcaaatggctgaagcaattgttccaccatttgccacaggagacgagtcgtcttgagacaaatgcccctgaatcaatttgcatcctcgatctcgaggtgtttttgttgggggtggtctatacctcccaccttcaattaaaggagaaatgtaatagtcatcactcaagctaccagcccctctgcctaccactgcccgtgtgtaagaggctatgtaccgagagacagaagagctggtgggatgcagtgtgtactctgattcaccgtaaagccgtccccggaaactctgccgagttgcggttggtggtccaacacgagatcaatactctcagagcgcaggagaagcacggtcttcaacctgcattactggtgcattgggccaaatgcctacaaaagatgggcagggggttgaactcatcttacgaccagcaagagtacatcgggagaagcgtccattactggaaaaaggtcctgcccctattaaaaataattaagaagaacagtatacctgaaccgatcgacccactgtttaagcacttccatagcgtggatattcaagccagtgaaatcgtagaatacgaagaggatgcacacataacgtttgccatccttgacgccgttcatggtaacattgaggacgcagttaccgctttcgaatctattaagagcgtggtaagctactggaacctcgccctgatctttcacagaaaggcagaggacatcgaaaatgacgcagtgttcccagaggagcaggaggagtgtaaaaattacttacgtaaaacccgcgactacctgatcaaaatcattgatgacagcgacagtaacctgtccgttgtgaaaaaattacctgtgcctttggagtccgtcaaagagatgcttaaaagcgtaatgcaggagctagaggactacagtgagggcggaccattatacaagaatggctccttgagaaatgcagatagcgaaatcaagcactctactccctcccctacaaaatacagcctttccccaagtaagagttataaatattcgcctaagacacccccacggtgggcagaggatcagaactccctgcggaagatgatatgtcaagaagtgaaagctatcactaagctgaactcgtcgaagtcggcatcaaggcatcgttggcccacggaaaactatggccctgacagtgtacctgatggatatcagggatcacagacattccacggtgctcccttgactgtggccaccacaggacctagtgtctattacagtcagtccccagcctacaattcccaatatctgttacgcccagcagccaacgtcaccccaactaaaggttccagtaacacagagttcaagtccaccaaagagggcttctctatcgcagtatccgctgatgggttcaaatttggtataagcgagcccggaaatcaagagaagaagtccgagaagcccctggaaaacgacaccggcttccaggcacaggatatctcaggtcagaagaacggcagaggcgttattttcggacaaaccagctccacttttaccttcgctgatgtcgctaagtcaacttccggcgaggggtttcagttcggcaaaaaagatcctaattttaaggggttttctggtgccggagaaaagctcttcagttctcagtgtggcaagatggccaataaagccaatacatccggagacttcgagaaggacgacgatgcatgcaaaaccgaggacagtgacgacatacactttgaacccgtggtgcagatgccagagaaggtagagctggtgaccggggaggaaggggaaaaagtcctgtacagccaaggtgtgaaactcttcagattcgacgctgagattagtcaatggaaagagaggggcctcggaaatctgaaaatcctcaagaatgaggtcaacggcaaaccgcgtatgcttatgcgaagggaccaggtccttaaggtctgcgctaaccattggatcacaaccacaatgaatctgaagcccctgtctggctctgaccgcgcttggatgtggctagccagtgacttctcagatggagacgcaaagctggagcgtcttgcagcgcagttcaagacacccgagctggctgaggagttcaaacagaaatttgaggagtgtcagaggttattattggatatcccactccagacccctcataaattggtggatacggggagggccgcaaaactaattcaacgggctgaggaaatgaagagcgggttgaaggatttcaagaccttcttgactaatgaccaaactaaagttacggaggaagagaataagggctctgggacaggagcggctggggcttccgacactacaatcaaacctaatccggagaacactggtccaacactggaatgggataactatgatctgagagaagacgccctggacgataacgttagcagcagctcagtacatgattctccattagcatcatctcccgttagaaagaatatattccgattcgacgagagtactacgggattcaacttcagctttaaaagcgctctttcgttaagcaaatctcctgccaagcttaatcagagtgggacctctgtcgggacagatgaggagtccgatgtgacccaggaagaggagcgggacggacagtacttcgaaccagttgtcccactgccagacctggtggaagtcagcagcggagaagagaacgagcaggtggtgttcagccacagggcagaactttacagatacgacaaggatgttgggcagtggaaggaacggggaatcggtgacattaaaatccttcagaattatgataataaacaagttagaattgttatgcggagggaccaagtgcttaaactgtgtgccaaccaccggatcactcccgatatgtcactacagaatatgaaggggacagagagagtctgggtgtggactgcctgtgacttcgctgacggagagcggaaagtagaacacctagcagtccggtttaagcttcaggatgtggccgattcctttaagaagattttcgacgaggccaaaaccgctcaagagaaggatagcctgattactccccatgtctcacggagtagcactcctcgagagagcccctgcggaaagattgcagtcgccgtgctcgaagaaaccacacgggagcgaacagacgtcatccagggtgatgatgtcgcagacgcagcgagtgaggtggaagtgtcctctaccagcgagacgactactaaggctgttgtgtcaccccctaaattcgtgtttggatccgaatctgttaagcgtatattctcatccgaaaagagcaacccatttgcgttcggcaacagttctgctaccggctcactatttggttttagttttaacgcccctctcaaaagtaatgactccgagactagctctgtcgcccagtctgggagtgaatcaaaagtcgaacccaagaagtgtgaactgagtaaaaattctgatatagagcagtcaagcgattctaaggtgaagaacctgagcgccagttttccaatggaggagtcgtccatcaattacacgttcaagacgcctgagaaagagcctcctctgtggcacgccgagtttaccaaagaggagcttgttcagaagctttccagcaccaccaaatccgctgatcagcttaatggcttactgcgcgaaacagaggcaacctccgccgttctgatggaacagatcaaattgttgaaatcggagattcgccgactagagcgaaatcaggaagaaagtgccgcaaatgtggaacacctaaaaaacgtgctgctccagttcatcttcttgaagcctggttcagaaagggaaagtcttctcccggtcataaatacaatgttacagctgtcccctgaggagaagggaaaactcgccgcagtggctcagggactacaagagacgagtattcccaagaagaaata

SEQ ID NO: 237895 - DNA, 1935 bp, Artificial Sequence
  Description of Artificial Sequence: Synthetic coding sequence
atgctcatgcgcagggatcaggtgctcaaggtgtgcgccaatcactggattaccacaacaatgaatctcaagcccttgtcaggatcagacagggcctggatgtggctggcttcggatttcagtgacggggatgccaaactcgagcgacttgctgcacagtttaagacacccgaacttgccgaagagttcaagcaaaagtttgaagaatgccagagactgttgctggatattccacttcagacccctcacaaactggtggatacaggcagagccgctaaactcattcagagggctgaagaaatgaaaagcggcctcaaggatttcaagacgtttctcacaaacgatcagaccaaggtaaccgaggaagagaacaagggaagtggcacaggcgcagcaggggctagtgacaccactatcaagccgaaccccgaaaataccggcccaacactggagtgggataactacgatttacgggaggacgctctcgacgataatgtatctagctctagcgtgcatgacagcccgctcgcaagtagccctgtccgtaaaaatatattccgttttgatgagagcacgactggatttaacttttctttcaagtccgccctttccctgagtaagtcaccggcaaagctcaaccagtccggaactagtgtgggcacagacgaagagagcgatgtgactcaggaggaggagcgtgatgggcagtatttcgagcctgttgttcccctaccagatctagtcgaggtgagctcaggtgaagagaacgagcaggtagtgtttagccaccgtgcagagctttaccgctacgataaagacgtcggacagtggaaggaacgcggaatcggggacatcaaaatcctgcagaactacgacaataagcaggtaagaattgtaatgcgcagagaccaggtactgaagctctgcgccaaccacaggataacccccgacatgagcctccagaatatgaagggtaccgaaagggtttgggtgtggaccgcatgcgacttcgccgatggcgagcgaaaagtggagcatctggccgtgagattcaaactccaggatgtcgccgattcttttaaaaagatcttcgatgaagcaaagacagcccaagaaaaggattcactgatcacaccacacgtgtcccggtccagtacaccacgcgaatctccgtgtggtaaaattgccgtggccgtgttggaggagaccacccgtgagaggaccgacgtaatacaaggcgatgacgttgccgatgcggcatccgaggtagaagtgtctagcacttccgaaacaacgaccaaggcagtggtaagccccccaaaattcgtctttggaagcgaaagtgtcaaaagaatcttcagcagtgagaagagcaaccccttcgccttcgggaactcatccgctaccggcagcctgttcggcttcagctttaacgctccactcaagagcaacgactcagaaacttcctccgtggcccagagtggcagtgagagcaaagtggagcccaagaagtgtgagctgtctaagaactcagacatcgaacagagctccgatagcaaggtcaagaacctctcggcctcattccccatggaagaaagctcaatcaattatacatttaaaacccccgagaaagaacctcctttatggcacgccgaattcactaaggaggagttggtgcagaagctcagttcgaccacaaagtccgccgatcaattgaatggactgctgagagagacagaagccacgtccgcggtgcttatggagcagatcaaacttctcaagagcgagatacggcgattggaacggaaccaggaagagtcagcagcaaatgtggagcatctgaagaatgttctgcttcagtttatctttctgaagccgggtagcgagcgcgaaccctcgtcatgctataagtatgacgtggcagcccagccttag

SEQ ID NO: 237896 - DNA, 5246 bp, Artificial Sequence
  Description of Artificial Sequence: Synthetic coding sequence
atgaatgtgatgggtttcaatactgatcggcttgcttggactagaaacaagttaaggggtttttacttcgccaaactgtattacgaagcaaaggagtatgacctggctaaaaagtatgtgtgtacctacctgtctgtccaggagagggacccccgtgcccacaggttcctggggttgctgtacgagctcgaagagaataccgaaaaggccgttgaatgctaccgaagaagcctggaattgaatccacctcagaaagatctagtcttgaagatcgcagaactactgtgtaaaaacgacgtgacagacgggagagcaaagtactgggtggaacgtgctgcaaagttattccccggttctcccgcaatctataagcttaaggagcatctcctggattgcgaaggtgaagacggatggaacaaactgttcgattggatacagtccgaactgtatgtccgaccagacgacgtgcatatgaacatcaggttagtcgaattgtatcgcagcaacaaacggctgaaggatgcggtggctcgctgccatgaggctgagcggaatattgcgctgagaagtagccttgagtggaactcttgcgtggttcagacactaaaggagtatttggagtccctacagtgtctggagtccgataagtctgactggcgcgcaacaaataccgatctcctgctggcttatgcaaatctgatgctcctgaccctctctacgagggatgtgcaggagagtcgcgaattgctcgagagttttgactctgccctccagtcagccaaaagttccctgggtgggaatgacgaactgtctgcaactttcttggaaatgaagggtcatttttacatgcacgctggaagcctgctgttgaaaatgggccagcatggcaataacgttcagtggcaagccctttcagaattggcggctctgtgctacgtgatagcttttcaggtccctaggccaaagattaagttgataaagggagaagcgggacagaacctccttgagatgatggcatgtgataggctgtcacagtctggtcacatgttgctgaacctgtctcggggaaagcaggattttcttaaagaggtggtggaaacatttgcgaacaaatctggacaaagcgtgctgtataatgccctgttctcgagtcagtcaagcaaggacacctcattcttaggcagcgatgatatcggcaatatagatgtgcaggaacccgaattagaagacctggctcgatatgacgtcggcgcaatccaggcgcacaacggaagtctgcaacacctgacttggctcggcttgcagtggaattcgttgccggctctaccaggaattcggaagtggcttaagcagttatttcatcatctgccccaggagacctcacggctagagactaacgcaccagagagtatctgtatactggatctggaggtgtttctgctgggcgtggtgtataccagccacctgcagctcaaggagaaatgcaatagccatcacagtagttatcagcctttatgcctgcccctaccagtctgcaagaggctgtgcaccgagagacagaaaagctggtgggacgccgtttgcactttgattcaccgaaaagccgtgcccggaaatagcgctgagcttagacttgtcgtgcagcacgaaattaacactcttcgggcacaggagaaacacggactccagcctgccctgctggttcactgggccaagtgcctgcagaaaatgggcagggggctgaacagctcttacgaccagcaggagtacataggtcgctccgttcattattggaagaaggtgcttcccctgctaaagatcattaaaaagaactctatccctgaacccatcgaccctctttttaagcacttccattcagtggatatccaagccagcgagatcgttgaatacgaagaagatgcccatattacttttgctattctcgacgcagtccatggcaacatcgaggatgctgtgaccgccttcgaatctattaagagcgtcgtttcttattggaacctggccctgatatttcatcgcaaggccgaggacatagaaaatgacgccgtattcccggaagaacaggaggagtgtaaaaattaccttcgaaaaacccgggactacctcatcaaaatcatcgatgattctgactcgaacctgtctgtggtgaagaagctacccgtccctctggagtccgtaaaagaaatgctgaaatccgtgatgcaggaacttgaggactattccgagggagggccactctacaaaaacggatccctgcgcaacgcagattccgagataaagcactctactccttcacctaccaagtatagtctctctccgtccaagtcctataagtattcccctaagacaccccctaggtgggccgaggaccagaattctctgcgcaagatgatttgccaggaagtcaaagcaattaccaaactcaactcatccaaaagcgcatcacgtcaccgatggcccactgaaaactatggccctgactccgtccctgacggatatcagggctctcagactttccatggcgcaccactgacagttgcgactacaggtcccagcgtgtactattcacaatctccagcatataactcccagtatctgctaagacccgcagcgaacgtgacgccaacaaagggttcttccaacactgagttcaaatccaccaaggaaggttttagcatcgccgtgtctgcggacggattcaaatttgggatcagtgaaccaggcaaccaggagaagaaatcagagaagcctcttgagaacgacacgggcttccaggcccaggacatatctggacagaagaacgggagaggcgtaatcttcggccagacgtcaagcacttttacgtttgccgatgtagcaaagtcaacctctggtgagggattccagtttgggaaaaaagatcccaatttcaaaggcttctccggagctggcgaaaaactattcagttcccaatgtgggaaaatggccaacaaggcgaataccagtggcgacttcgaaaaggacgatgacgcgtgtaagaccgaagactctgatgatatccacttcgagcccgtggttcagatgcccgaaaaggttgagctagtgacaggtgaggagggtgagaaggtcctatattcccagggagtcaaactgtttaggttcgacgccgagattagccaatggaaggaaagggggctaggcaacctgaaaatccttaagaacgaagtgaatggtaagccccgaatgcttatgcgccgtgaccaggtgcttaaagtgtgtgctaaccattggatcactaccacaatgaatctgaaacccctcagcgggtccgacagagcgtggatgtggcttgcatctgacttctccgacggagacgccaagttggaaagattagctgcacagttcaaaaccccagaattggccgaagaattcaagcagaaattcgaggaatgtcagcgactgctactagatatacccctccaaaccccgcacaaactcgttgataccggccgagcagccaagctcatccaacgagcagaggagatgaagagtggtcttaaggatttcaagactttcctcacaaatgatcagaccaaggttaccgaggaggaaaacaaaggttcagggaccggggctgccggagcttctgatacaacaattaagcccaatccagagaacaccggcccaacccttgagtgggacaactacgatctgcgcgaggatgccctggacgacaacgtgtcctccagctctgtccacgatagtccacttgccagttcccccgtgagaaaaaacatatttaggttcgacgagtcaacaacgggcttcaatttttcctttaaatcagcattatcactgtccaaatcccccgcaaaactgaatcaatcaggcacctcagtaggaactgatgaagagtcagacgtgacccaagaagaggagcgggacgggcagtatttcgaaccggtggtgcctctgccagatcttgtggaggtgagtagcggcgaggagaatgagcaggtggtgttttctcatagggccgagctatatcgatatgataaagatgtgggtcagtggaaagaacggggaatcggggacatcaaaattctacagaactatgacaacaaacaggtcaggattgtcatgcgtagagatcaggtactgaagctgtgcgctaaccaccgcataacaccggacatgtcccttcagaacatgaagggcaccgagagagtatgggtctggacagcctgtgatttcgccgatggtgagaggaaggtggaacatctggccgtgcgattcaaattgcaggatgttgccgacagctttaagaagatctttgacgaggcaaaaactgcccaggaaaaggactctctcattacgccacatgtgagtcggtcctccacgccacgggaatctccctgcgggaagatcgcagtggccgtgctcgaggaaactaccagggagcgaaccgacgtcattcagggggacgacgtagccgatgccgcatcggaagtggaagtttcatccacttccgagaccactacaaaggctgtggtgagtccacccaaatttgtgtttggcagtgaaagtgtgaaacgcatattttcgtctgaaaagagtaatccttttgctttcggaaactcaagtgccactggatcattgttcggtttttctttcaacgcgccattaaagtctaacgactccgagacctcttctgtggcacaatccggttcggaaagtaaagttgagccgaaaaagtgcgagctctccaagaacagcgacatcgagcaaagttctgattctaaggttaaaaatctctcagcctcttttcctatggaagagagctcaattaattacacctttaagacccccgagaaggagcctcccctttggcacgccgaattcaccaaagaggagctggtccagaagctctccagcacgaccaaatccgcagatcaattgaacggactcctgcgcgaaacagaagccacctctgcggttctgatggagcagattaagttgctcaagagcgagattcggaggctggagcgcaatcaggaggagtccgcagctaatgtggagcatctgaaaaacgtacttctccaattcatatttctgaaaccagggagtgaaagagaatctctgctccctgtcattaatactatgcttcagcttagtcctgaagaaaagggaaagttagcggctgtagcacaggggttgcaggaaacgagcataccaaagaaaaaata

SEQ ID NO: 237897 - DNA, 3042 bp, Artificial Sequence
  Description of Artificial Sequence: Synthetic coding sequence
atgctgaagtccgttatgcaagaactcgaggattattccgagggaggacctttgtacaaaaacggaagcctgagaaatgccgattctgaaattaaacattctactccgtctccaacgaagtatagcttatcaccaagcaaatcctacaagtatagtccaaaaactcccccacggtgggccgaggaccagaactccctgaggaagatgatttgtcaagaggtgaaggccataactaaactcaactcctcaaaaagcgcgagccgccacaggtggcccactgagaactatggcccagactccgttccggacggatatcaaggaagccagactttccacggcgctcctctcacagtcgccactacagggccttctgtgtactatagccagtcccctgcctataactcgcagtacctgctgcgacccgctgcaaacgttactccaacaaaaggcagtagcaacactgagttcaaatctaccaaagagggtttctccatcgccgtgtcagccgacggttttaaatttggcatatccgaacccggtaatcaagagaagaagagcgaaaagcccctggagaacgacaccgggttccaggctcaggatatcagcggacaaaagaacggcagaggggttatcttcggccagacgtcgagtactttcaccttcgcagacgtggcaaaaagtacgtctggggaaggtttccagttcggaaaaaaagacccaaatttcaaggggttttctggtgccggtgaaaaactgttttccagtcagtgtggcaagatggctaacaaagccaacacatccggcgatttcgagaaggatgatgacgcctgtaagaccgaggactccgatgacatccatttcgagcctgttgtacaaatgccggaaaaggtagaactggtgacaggcgaggagggagagaaggtgttgtacagccagggcgtcaagcttttccgtttcgatgccgaaatttcccagtggaaagagaggggcctggggaacctgaaaattctgaaaaacgaggttaacggcaaaccccgaatgctgatgagacgcgaccaggtactcaaagtgtgtgctaaccactggattaccacaactatgaatctgaagcctttgtctggatccgacagagcctggatgtggctcgccagtgatttctctgacggtgacgcaaagttagagcgattggccgctcagttcaagactcccgaactcgctgaagagttcaaacaaaaattcgaagagtgtcaacgcctactgttggatataccattgcaaactccccacaaactggtcgatactgggagagccgcaaagctcatccagagagctgaagagatgaagtcaggtcttaaagacttcaaaaccttcctcacaaacgatcaaactaaggtcaccgaagaagagaacaaaggctctggtactggcgctgccggagctagcgataccaccattaaaccaaacccagaaaacacaggcccaacccttgaatgggataattatgatctgcgagaggacgcccttgatgacaacgtgtcttcctcttcagtgcacgatagtccattagcctcctctcccgtgcggaagaacatcttcagattcgatgaaagcaccacaggattcaacttcagtttcaagtcagctctcagtttgtccaaaagtcctgctaagctgaaccagtccggaacatcagtgggtactgacgaggagagcgacgtgacgcaggaggaagagagagacggccagtacttcgagcctgttgtccctctccctgacctggtggaggtgagttccggtgaggagaacgaacaggtcgtcttctctcatatggcagaactctatcggtacgacaaggacgtaggacagtggaaggaaaggggcattggcgatatcaagatcttgcagaattacgataacaagcaggttagaattgtgatgaggcgtgaccaagtcttaaaactgtgcgcaaatcatcggataacgcccgacatgagtcttcagaatatgaaaggtacggagagggtgtgggtctggacggcttgtgattttgcggatggagagcggaaagtagagcatctagctgtacgcttcaagctgcaggacgttgccgacagctttaagaaaatcttcgacgaggctaagacagcccaagaaaaagatagccttattaccccccacgtgagccgctcaagtacccccagggagtctccctgtggaaaaatagccgtggccgtgcttgaggaaaccaccagagaacggactgacgtgatccaaggcgatgacgtagctgacgctgctagcgaggtggaggtgtcttcaaccagtgagacaacaacaaaggcagtggtctccccacctaaattcgttttcggcagcgagtccgttaaacggattttcagcagcgaaaaatccaatcccttcgccttcggcaacagctccgctaccggctccctgtttggattcagctttaacgctcctcttaaatcaaatgactccgaaacctccagcgtcgcacagtctgggtctgagagtaaagtcgaacctaaaaagtgtgagttgagtaagaacagtgatattgaacagtctagtgattccaaagttaagaacctgtctgccagcttccctatggaggaatcttcaattaattacacttttaaaacacctgaaaaggaacccccactgtggcacgcagaatttaccaaggaggagctcgtacaaaaactgagctccacgaccaagagtgctgaccagttgaacggtctgctgcgggagaccgaagcaacctcagccgtgcttatggagcagatcaagctgctgaagtcagagatcaggcgcttggaacggaatcaggaagaaagtgcagctaacgtggagcatctcaagaatgtgttgctgcagtttatctttctgaagcccggttcagagagggaaagcctcctgccagtcatcaataccatgttacagctttctccagaggaaaaggggaagctggccgctgtggcacagggattgcaggagaccagcatacccaaaaaaaagtag

SEQ ID NO: 237898 - DNA, 5270 bp, Artificial Sequence
  Description of Artificial Sequence: Synthetic coding sequence
atgagaaggagtaaggcttatggtgagaggtacctggccagcgtccagggtagtgctccatcccccggaaagaaactgcggggattttatttcgccaagctgtactacgaggccaaagagtatgatctcgccaaaaagtacgtgtgtacttatctatctgtgcaggagagagaccccagagcacatcgctttttggggctgctctatgagttggaagaaaatacagaaaaggctgtagagtgctatcggcgttctctggagttaaatcctccacagaaggatctggtgctgaagattgccgaactgttatgcaagaacgatgttactgatgggcgtgcaaaatactgggtcgaaagagcagccaaactctttcctggttctcccgctatatacaagttgaaggagcacctgctggactgcgagggcgaggacggatggaacaagctgtttgactggattcaaagcgagctatatgtgcggcctgacgacgtgcacatgaacattcgtctcgttgagttatatcgcagcaacaagcggctgaaggacgcggtggccaggtgccacgaagcagaacgcaatatagctcttcgctcctcccttgagtggaactcatgtgtcgtacaaactctcaaagagtaccttgaaagtctgcagtgtctggagagcgacaaaagcgactggcgcgctaccaacacagacctcttgttggcgtacgccaaccttatgcttttaaccttgtcaacaagagacgtgcaggagagccgggagttactggagtcttttgatagtgcattgcagtcggcaaaatcgtcgcttgggggtaatgacgagctcagcgctacattcctggagatgaagggccacttttatatgcatgcgggatccctgcttctgaagatggggcaacatgggaataacgtgcaatggcaagcactctcggagctagcagccctatgttacgtgattgcctttcaggttcccagacctaaaattaaactgatcaagggcgaggcgggacagaatctcctggaaatgatggcgtgtgataggctctcacagtccggacacatgctgttgaatctttccagggggaaacaggacttcttgaaagaggtggtggagacattcgccaataagtcgggacagagcgtcctctacaatgccctattttcatctcaatcctccaaagatacgtcatttctggggtcagacgacattgggaatattgatgtgcaagaaccggaactggaagatctcgccagatacgacgtgggtgctatccaggcccataatgggagcctccagcacctgacttggcttggcctacagtggaatagcttaccagctcttcctgggattcgaaagtggcttaaacaactctttcatcatctgccccaggagactagtcgtctcgaaacaaacgcaccagagtccatatgcattctggatctcgaagtgtttctgctgggcgtggtctacacgagccacctgcagttaaaggaaaaatgtaattctcaccattccagctaccagcccctctgcctgcccctgccagtgtgcaagcggctttgtacagagaggcagaaaagttggtgggatgcagtttgtactttgatacatagaaaggcagttcctggcaatagtgccgagttgagactggttgtacaacacgagattaataccctccgcgctcaggagaagcacggacttcagcctgccctgctcgtgcattgggcaaaatgcctccagaagatgggccgaggtctcaatagctcttacgatcagcaggagtacataggtcgctccgttcactactggaagaaggttttgcctttgttgaaaattattaaaaagaacagcatcccagagcctatcgaccccctatttaagcactttcactcagtcgacattcaagcctccgaaatcgtcgagtatgaagaggacgcgcacatcacttttgccatcctggacgccgtgcacggcaacattgaagatgccgtgaccgcttttgagtccataaagtcggtggtgagctattggaacttggccttaatctttcacaggaaagctgaagacattgaaaacgacgcagtatttcccgaggagcaggaagaatgcaagaattatcttcgcaaaacaagagactatcttattaaaataatagatgacagcgacagtaatctaagtgtggtgaaaaaactacctgttcctcttgagagcgttaaggaaatgctgaagagcgtaatgcaagagctagaggactacagcgagggagggccactctacaaaaatggctctttaagaaatgcggattcggagattaagcacagcactccctccccaacgaaatacagtctgagtccctcgaagtcttataagtatagccccaagactccacccaggtgggccgaggatcaaaattcacttaggaaaatgatctgccaagaagtgaaggcaatcacaaagctgaattcttccaaaagtgcatcccgccaccgttggcccaccgagaattacgggccagactcggtgcccgacggctaccaaggcagtcagacctttcatggtgcccctttgactgtggcgacgactggtccttctgtgtattatagtcagagcccggcttacaactctcaatatcttctacgcccagccgctaacgtcacccctacgaagggcagttcaaataccgagtttaaatcaaccaaggagggcttcagcatcgccgtaagcgccgacggcttcaagtttggaatctccgagccaggaaaccaagagaagaagtccgagaaaccattagagaacgataccggctttcaagcacaggacattagcggccaaaaaaacggtcgaggtgtgatttttggacagacttccagtacattcacatttgccgatgtagccaagagcacctcaggggagggatttcagtttgggaagaaggatcctaactttaagggctttagtggcgctggagaaaaacttttcagttctcagtgtgggaagatggctaacaaggctaacacatctggcgattttgaaaaggatgacgatgcttgtaagacggaagacagtgatgatatccatttcgagccggttgtacagatgcctgaaaaggttgagctagtgacaggcgaagaaggagagaaagttctctattctcaaggggtcaaactctttcggttcgatgcagaaattagccaatggaaggaacgaggcctgggtaacctcaaaattctgaaaaatgaagtaaatggaaagccgagaatgctgatgcggagggatcaagtactgaaggtttgtgcgaatcactggattaccaccaccatgaatcttaaaccactgagtggaagcgatcgcgcatggatgtggctggcgtccgacttttcagatggcgacgcaaagttagagaggcttgccgcacaatttaagacccctgagcttgccgaagaatttaagcagaagtttgaagagtgtcaacggcttcttctcgacatcccgctgcaaacccctcacaagttggtcgacaccggcagggcagccaagctgatccaaagggcagaggaaatgaaatccggattaaaggactttaagacctttctgaccaatgaccagacaaaggtgaccgaagaagagaataagggctccggtacaggggctgctggtgcctctgacaccacgatcaagcctaatcccgagaacactggccctaccttagagtgggacaattacgatttgcgcgaggacgcactggatgataacgtcagctctagctcagtgcatgattcccctctggcctcatcgcccgttcgcaagaacatattccggttcgacgagagcaccactggcttcaattttagctttaagtccgctttgagtctgtctaaaagtcctgccaagttgaatcagtctgggacgagtgtgggaacggatgaagagtcagacgtgacacaagaggaagaacgagacgggcagtactttgagccggtagtgcctctgccagacttggtagaagtgagctccggtgaagagaacgaacaggttgttttcagccacatggctgaactgtacagatatgacaaggacgtgggtcagtggaaggagcgaggcatcggggatatcaaaattctgcagaattacgataataaacaagttaggatcgttatgcgccgagatcaggtgctcaagctttgtgctaaccacaggattacccctgacatgtcattgcaaaacatgaagggtacagagcgcgtgtgggtgtggacggcatgtgatttcgcagacggcgaaaggaaagtggagcaccttgccgtcagatttaagctccaggacgttgcggattcttttaaaaaaatctttgacgaggcgaagaccgcccaggaaaaggactccctgataacaccccatgtctctagatcttctacaccccgtgaatccccctgtggcaaaattgcggttgccgtcctcgaggagacgacgagagaacgtactgatgtgatacagggggatgacgtcgctgacgccgcttctgaggtggaagtgagctctacgtccgaaacgaccacaaaggccgtggtgtcccctccaaaattcgtgtttggttctgagtccgtcaagaggatttttagttccgaaaaatccaatccctttgcctttgggaattcatcagcaacaggctcactgtttggctttagcttcaatgctccccttaagtccaacgacagtgaaacgtcatcagtggcccagagcgggtccgaatccaaggtggagcctaaaaaatgcgaactgagcaagaattccgacatcgaacagtcttcagacagcaaggttaagaatctcagcgcctcctttccgatggaggaatcctctattaattacaccttcaagacccccgagaaagaacctccgttgtggcacgcagagtttactaaagaggagctcgtccagaaactgtccagtacaaccaagagtgctgatcaactcaatggcttgctcagggagaccgaggccactagcgcagtcctcatggagcagatcaaactgctcaagtctgaaataagaaggctggagcgcaaccaggaggaatccgccgctaatgtagaacatctcaaaaatgttctgcttcagtttattttcctcaagccaggatccgaacgggaatccttgttgcccgtcatcaatactatgctgcagctatcacctgaagagaaggggaagctggcagctgtagcccagggtctgcaggaaacttccatcccaaaaaagaagta

SEQ ID NO: 237899 - DNA, 5246 bp, Artificial Sequence
  Description of Artificial Sequence: Synthetic coding sequence
atgaatgtgatgggcttcaataccgaccgtctcgcctggactcgtaataagctgcggggattctattttgccaagttatattatgaagctaaagaatatgatctggccaagaagtatgtatgtacctacctatccgtgcaggaacgagatccgagggctcaccgattcttagggctgctgtacgagctcgaggaaaacacagagaaagccgttgagtgttaccggagaagtctggagctcaatccaccccagaaggatctcgtgctgaaaatcgcagaactgctctgtaaaaacgacgttacagacgggcgagcaaagtactgggtcgaacgggctgccaagctgtttcctgggtcacccgctatatacaaactcaaggagcatctcctagactgtgaaggtgaggatggatggaacaaactttttgactggatccagtccgaactatatgttagacccgacgatgttcacatgaacattagattggtcgagctgtacagatccaataagcggctgaaagatgccgtggccaggtgccacgaggccgagcgaaatatcgccctccggagctccctggaatggaatagctgtgtggtgcagacacttaaggaatacctcgagagcctccagtgtttggagtctgacaagtctgattggcgtgctactaataccgacctcctattggcttacgctaatctcatgctgttgacactgtctacaagggatgtgcaggagtctcgggagctcttagagtcttttgactcagccctacagagcgcaaagagctctttagggggaaatgacgagctttctgccacgtttctggaaatgaagggtcatttctacatgcacgccggatccctgctcctgaagatgggacagcacggcaataacgtccagtggcaggccctgtccgaactagctgccctttgctatgtcatcgcgtttcaggtcccaaggccaaagatcaagcttatcaagggggaagccggtcaaaaccttcttgagatgatggcatgcgatcggctgtcacagagtggccacatgctgctgaacctttccaggggcaaacaggattttctgaaagaagttgttgaaacttttgccaacaagtcgggtcagagcgtcctctacaacgccctgttctcaagccagtctagtaaagacacctccttcttggggagcgatgatattgggaatatcgacgtgcaggagccagagctggaagacttggcaaggtatgatgtgggagccatacaagcacacaacggttcactgcagcacctgacgtggctgggcctacagtggaactctttaccagctcttcctgggattcggaagtggctgaaacagctgtttcaccacctgccacaagaaactagtaggctggaaactaacgcaccagaatccatttgcattctcgacctggaagtgtttttactaggtgtggtatacacaagccacctgcagttgaaggagaagtgtaactcccaccattcttcctaccagccactgtgtttgcctctcccagtgtgtaaacggctatgcaccgagcgacagaagtcttggtgggatgcagtgtgtacgcttatacaccgaaaggctgtaccgggaaacagcgcagaactgaggctcgtggtgcagcatgagatcaacaccttgagagcacaggaaaaacacggcctccagcctgctcttctcgttcattgggcgaagtgtctccaaaagatgggccgagggcttaacagctcctacgatcagcaggaatatataggcaggagtgttcattactggaaaaaggttttgcctttattgaagatcatcaaaaaaaattctattccggagccaatcgatcccctgttcaaacatttccacagcgtggacatccaggccagtgagatagtagaatatgaagaagatgcccacatcacctttgcaatcctcgatgcagtccacggaaatatcgaggacgccgtcaccgcctttgaatcaatcaaatcagtagtcagctactggaacctcgccctgatattccacaggaaggccgaggatattgaaaatgacgctgtcttccctgaagagcaagaagaatgtaagaactacttacggaagacccgggactatctgatcaagattattgacgactcagactcaaatttgtcagttgtgaagaagctccccgtgcccctcgagtctgtcaaagagatgctgaaaagcgtgatgcaagagctggaggattattccgaagggggaccactatacaagaacggatccctgcgaaacgctgatagtgaaattaagcactctaccccaagcccgaccaagtactctctcagcccctcaaagtcttataagtactctccaaaaactcctcccagatgggccgaggaccaaaactctctgcgcaaaatgatatgccaggaggttaaggcgataaccaagttaaatagcagtaaaagcgcttctcggcacagatggcccactgagaactatggacccgacagcgtaccagatggctaccagggctctcagaccttccatggcgctcctttgactgtcgctacaacgggaccttctgtgtattactcccagagtcccgcttacaacagccagtacctgcttcgcccagccgcaaacgtgactccgacgaagggaagctctaacacggagttcaaaagtaccaaagagggattctcaatcgccgttagtgcagatggtttcaaattcggaattagtgagcctggtaatcaagaaaagaagtctgagaagcccttggagaatgacaccgggttccaggctcaggatatttcagggcagaagaacggcagaggggttattttcggccagacctcttcaacctttactttcgcagatgtagctaagtccaccagcggggaaggcttccagtttggcaagaaagaccccaactttaagggcttcagcggagcaggcgagaaactcttctctagccagtgcggaaaaatggcaaacaaggccaatacatccggcgacttcgagaaggatgacgacgcctgcaaaactgaggacagcgatgatattcactttgaacccgtggtgcagatgcctgagaaagtggagctggtgactggcgaggaaggggaaaaagtcctctacagccagggcgtgaagcttttcaggttcgatgctgagatctctcagtggaaagagcggggtcttggcaacctgaaaatcctgaagaatgaggtcaatgggaaaccgaggatgttgatgcgccgtgatcaagtgctcaaggtatgcgccaatcactggatcactacaaccatgaatctgaagccgctgtcaggctctgatagagcttggatgtggcttgccagcgatttctcagatggcgacgcgaaattggagcgattagctgcccagtttaagacacccgaacttgcagaagagtttaagcagaaattcgaggagtgtcaaagactgctgctcgacatcccccttcaaacaccacacaaattagtggatacaggaagggcggcaaagctgatccaaagggctgaggaaatgaaaagtggcctgaaggactttaaaacatttctgactaatgatcagactaaagtgactgaggaggagaacaaaggatccgggaccggagctgccggagcttcagacacgactattaagcccaaccccgagaatactgggccaaccctcgagtgggacaactatgacctcagggaagacgccttggacgacaatgtaagctcctcctccgtgcatgactcgccattggcatctagtcccgtcagaaagaatatcttcagattcgatgaatctacaaccggctttaatttttccttcaagtctgcgctgtccctgagtaaatcccccgctaaactaaaccagagcggaacaagcgtgggtacagatgaggaaagtgatgtcactcaggaggaagagcgggacgggcaatactttgagccagtggtgcccttgcccgatttggttgaagtctctagcggtgaagagaatgaacaggttgttttttcacacatggcagagttatataggtacgacaaggatgtgggacagtggaaggaaaggggcataggcgatattaagatactccaaaattacgacaacaagcaagttcgaatcgtgatgaggcgggatcaggttcttaaattgtgtgccaatcataggattactcctgatatgtcactccaaaacatgaaggggactgaaagagtgtgggtgtggacagcttgcgacttcgctgatggcgagcggaaggtagagcatcttgccgtaagattcaagttacaggacgttgcagacagctttaaaaaaattttcgacgaggctaagacggcccaggagaaagacagcctgataaccccgcacgtgtctaggtcttcaacgccgcgtgagagtccatgcggcaagatagcagtcgccgtactggaggagactacgcgtgagcgaacagatgtcatccaaggcgatgacgtcgcagacgccgctagcgaagtggaggtctcatcaacttctgaaacaacaaccaaggcagtggtctctcccccaaaatttgttttcggcagcgagtccgtcaaaagaatcttttcctccgaaaaatctaaccccttcgcctttggcaactcttccgctaccgggtccctgtttggattttccttcaacgcaccacttaagagcaacgattcagaaacgtcaagcgtagcgcaaagcggctcagagtcaaaagtcgaacctaaaaaatgcgaactttcaaagaattccgacattgagcagtcctctgactccaaagtaaagaacctgtccgcgtccttcccaatggaggaatcatcaattaattatacctttaagaccccagaaaaggaacccccactgtggcacgccgagttcacgaaggaagagctagtgcagaaactcagctcaacgacgaagtccgccgatcagctcaacgggcttctcagagagacggaggcaacctcggccgttctgatggaacagattaagcttctcaagtcagagataagacgcctggagagaaaccaggaagagtccgcagctaatgtggagcacttaaagaatgttctcctccagtttatatttttaaaaccaggtagcgagcgagagtccctcctgcccgtcattaacaccatgctgcagctaagtccagaagaaaagggaaagctcgccgctgttgcccagggcctacaggagaccagtatcccaaaaaaaaaata

SEQ ID NO: 237900 - DNA, 1935 bp, Artificial Sequence
  Description of Artificial Sequence: Synthetic coding sequence
atgctgatgcggcgagatcaagtcctcaaagtgtgtgcaaatcactggatcactacaactatgaatctgaagccccttagtggttccgatagagcatggatgtggcttgcttcggatttctctgacggcgatgcgaagctggagaggctggccgcacagttcaagactcctgagctggcagaagaattcaagcaaaagttcgaggagtgtcagcggcttcttcttgatattccattacagactcctcacaagctggtagatacaggccgtgccgcaaagctgatacagagggccgaggagatgaagtccggcctcaaagacttcaagactttcctgacaaacgatcaaacgaaggtgaccgaggaagagaataaaggttcaggcacaggggcagctggcgcaagcgacacgactatcaagcccaatccagagaacactggccctacgctagaatgggacaattatgacctccgcgaggacgccctggacgacaacgtttcttcctcctccgtccatgattcacccctggcctcatctccagtgcgcaaaaatatcttcagattcgatgaatcgaccactggcttcaacttcagctttaaatcagctctgtccttgtctaagagtccagccaaattgaaccagagtggcacctccgtgggcactgacgaagagagcgacgtgacgcaagaggaggaaagggacggacagtattttgaaccagtcgtgcctctgcccgatctggtggaagtatcttcaggagaggaaaacgagcaggtcgtgttttctcacatggctgaactgtacagatacgacaaggacgtaggacaatggaaagaaaggggaattggtgacatcaaaatcctacaaaattacgataacaagcaggtccggattgtaatgcgcagggaccaggtgcttaaattgtgcgctaatcaccggattacacccgacatgtccttacagaatatgaaggggaccgagcgtgtctgggtgtggaccgcatgcgattttgcagacggtgagcgcaaagtcgagcacctcgccgtccggttcaagcttcaagatgtcgcagatagctttaagaagatcttcgatgaggccaagacggcccaggaaaaagattcgctcatcacaccacatgtctcaagatcgtccacaccgagagaaagtccgtgcggtaaaatcgcagtagcagtactcgaagagacaactagagaacggacagatgtcatacagggtgacgatgtggcagacgcagcatcggaggtggaggtgtcctctacttcagagacaaccacaaaagccgtcgttagcccaccaaagttcgtctttggttccgagtccgttaagcgcatattcagctcagagaagagcaatcccttcgcatttggcaactcaagcgcaactggcagtctgtttgggttcagcttcaatgctcccctcaaatcgaatgattctgagaccagttccgtggctcagagtggctccgagagcaaggtggaacctaagaagtgtgagctatccaaaaacagtgatatcgagcagagttcagactctaaggttaagaacctgtctgcatccttcccaatggaagaaagcagcattaactacacattcaagactcctgaaaaggagcccccactttggcatgcggagttcacaaaagaagagttagtgcagaagctctcctccaccacaaagagcgctgatcaattgaatggtctgctgcgggaaactgaagctaccagcgccgtcctaatggaacagattaagctgctgaaaagcgagatccggagacttgagaggaatcaggaggagtccgctgcaaatgtggaacatctgaagaacgtgctcctccagtttatatttctcaagcccggaagtgagagagaaccttcctcttgttacaaatacgatgtagctgcacagccctag

SEQ ID NO: 237901 - DNA, 5300 bp, Artificial Sequence
  Description of Artificial Sequence: Synthetic coding sequence
atgtcttgcagtaaagcctacggagaacgctacgtagcctcagtgcagggatccgcccctagcccacggaaaaaaagcacaagggggttttactttgccaaactctactacgaggctaaggagtatgatcttgctaagaagtacatctgcacgtatatcaatgttagggaaatggacccgcgtgcccatcgtttcctggggctcttatacgagttagaggaaaatacagaaaaagccgttgagtgctatcggagatctgtggagttgaatcccacccagaaggatctggtcctgaaaatcgctgaactgttgtgtaaaaatgatgtcaccgacggcagggctgaatactgggtggaacgggctgccaagctgtttccaggcagtccagccatatacaaactgaaggagcagctgttagattgcgagggcgaagacgggtggaacaagttatttgacctgatccagtccgagctgtacgtgcggcctgacgacgtgcatgtgaatatacgcctggttgaattgtaccgctctacaaagagactaaaggacgcagtggctcgctgtcatgaagcggaaaggaacatcgctttgagatcatcccttgagtggaacagctgcgtggtgcaaacactcaaggagtacctggaaagccttcagtgcctggagtctgacaaatcagattggagagctacgaatactgacctgctcctggcatatgccaatctgatgcttttaacattgagtaccagagacgtccaggagtcaagagaactcctcgaatctttcgactctgccctacagagtgccaagagctctctcgggggtaatgacgagttgagtgctacattcctcgagatgaagggccacttctatatgcatgccggatcactgctgcttaaaatgggtcaacacggtaacaatgtccaatggcgcgcactgagtgagctcgccgcactctgttacctgatcgcttttcaggtacctagacccaaaattaagctgatcaagggtgaggcaggccagaatttgctggagatgatggcgtgcgatcggctctcccagagtggacatatgcttctgaacctgagcagaggcaaacaagactttctgaaagtcgtggtcgaaacctttgcaaataagagtggtcagagtgccttgtatgatgccctcttttcctctcagagccccaaggatactagcttcctgggcagcgacgacatcgggaacatcgacgtgcaggagccggagctggaggacctggctcggtacgacgtcggcgcaattagagcacataatggcagcctccagcacttgacttggttgggactgcagtggaactctttgcctgcactgccaggtattaggaagtggctgaagcaactctttcaccacctccctcaggaaacatccagattagagacaaacgctcctgaatcaatctgtatcctcgacctggaggtgttcctgctaggcgttgtatacacaagtcatctgcagttgaaggagaaatgcaacagtcaccacagctcttaccagcccttgtgtttgccattgccagtctgtaagcagctgtgcaccgaacgacagaagagctggtgggatgccgtttgtactctgatccatcggaaggccgtacctggaaatagtgctaagctccgcctcttagtgcagcatgagataaacactctacgagcccaggaaaagcatggtttgcaacctgcattacttgtgcattgggctaaatgtcttcagaagatgggatccgggcttaattcattctacgaccagcgcgaatacatcggacgcagcgtgcattactggaagaaggtgcttcccttgttaaagattatcaagaaaaagaactccataccagaacccattgatcctctctttaaacactttcacagcgtcgatatccaggccagcgaaattgttgagtacgaggaagatgcgcatgtgaccttcgcgatcctcgacgctgtcaacggtaacattgaggacgctatgactgcattcgagagtattaagagtgttgttagttattggaatctcgcccttatcttccacagaaaggccgaggacatcgctaatgacgctctgtcccccgaggagcaggaggagtgtaagaattatcttcgtaagacacgaggctacctcattaagatattggacgactcagatagcaacctatcagtcgtcaagaaattacccgtgcctctggaatcggtaaaggaaatgctgaagtccgtgatgcaagagctcgagaattacagtgagggcggacctctctacaagaacggatccctaaggaacgccgactcagagatcaagcactcaaccccttcccctacaaagtattccctgagtccttcaaaatcctacaagtatagccccaaaacacctccaagatgggccgaggaccagaattctttactgaagatgatccggcaggaggtaaaagctattaaagaagagatgcaggaactcaaacttaacagctcaaaatcagcatcccatcatcgctggccgaccgagaattatggccctgattctgtgccggacggataccagggctctcagacctttcatggggcaccactgacagttgctacgaccgggccttctgtttattatagccagtcaccagcatataacagtcagtatttgctgagacctgctgccaatgttacaccaactaaaggcagcagcaacacagagttcaaatctactaaagaggggttctctatcccagtgagcgcagacggatttaagttcgggatcagcgagcccggaaaccaggagaagaaatctgagaagccgctggagaacgacacaggactgcaggcacaggatatcagcgggagaaagaagggcaggggcgtcatcttcggacagacgtcttccacgtttactttcgctgacgttgcaaaatccactagcggcgaggggtttcagttcggaaagaaagaccttaactttaagggcttcagcggggcaggtgaaaagctctttagcagtcagtacggaaaaatggcgaataaagccaatacatccggagactttgagaaagacgatgacgcttacaagacagaggattccgacgacatccatttcgagccggtggtccaaatgccagagaaggtggagctagtgacgggtgaggaaggtgagaaggtcctatactcccagggggtcaaacttttcaggtttgatgctgaggtatcccaatggaaagaacggggtctgggaaaccttaaaattctgaaaaacgaggtaaatggcaaagttcggatgctcatgcagagagagcaggtgctcaaggtatgcgccaatcactggattacaaccacaatgaatctgaaacctttgtccggttcagatagggcctggatgtggagcgcctccgacttctcagacggagatgccaaactggagagactggccgctaaattcaagactcccgagttggccgaggaattcaagcaaaagtttgaagaatgtcagagattgctgttggacatccctttgcagacacctcataaattggtggacaccggacgagccgcaaaattgattcagagagcagaagaaatgaagtctggtctgaaggacttcaagactttcctaacgaatgaccagacaaaagtggcggaggaggagaacaagggaagcgggactggcgctgcaggcgcttctgacaccactatcaaaccaaatgccgaaaacacaggaccaacgcttgaatgggataactacgatctgagggaggacgccctcgacgattccgtgagttcatcatccgtgcatgctagccctctggcttcctctcccgttcggaagaatctgtttcacttcgacgaatccactaccggctcaaacttcagcttcaagagcgccctctccctgagtaagtcccctgccaaacttaaccagtcaggcacatcagtgggcaccgatgaggagagcgacgtgacacaggaggaagagagggatggacagtacttcgagcctgttgtcccgctccccgatcttgtagaagtgtcaagcggagaggaaaacgagcaggtggtattttcacaccgcgcagaattttaccgttacgacaaggatgtgggacagtggaaggagagaggaattggggatatcaagattctgcaaaattacgacaacaagcacgtgcgtatcctgatgcgcagggatcaggtactaaagttatgtgctaatcacagaatcacccctgatatgagcttgcaaaacatgaagggtactgaacgagtttgggtgtggacagcgtgcgacttcgcggacggcgagcgcaaagtagaacacctggctgtgcgcttcaaactccaagatgtggcagatagctttaagaagatcttcgacgaggctaagaccgcacaggaaaaggatagtctcatcactccgcatgttagcagatcgtctaccccacgagaatccccttgcggcaagattgccgtagctgtcctggaggaaaccacaagggagcgaaccgatgttatacagggggatgatgtggccgacgctgctagcgaggtcgaggtctcctcaacctcggaaaccaccaccaaggccgtcgtgagccccccaaagttcgtgtttggaagcgaatccgtcaagcggatcttctcctccgaaaaaagcaagccctttgcgtttgggaattcctctgctacggggagcctgttcggcttttctttcaatgctccattgaaaagtaacaatagcgagacctcttctgttgcacaatctggatccgagtcaaaggtagaacctaagaagtgtgagctgagcaaaaattccgacattgaacaatcatccgactccaaggtcaaaaatctttctgcgagtttcccaacagaagaatcgtccatcaattacacctttaaaaccccggagaaagagccaccattgtggtatgcagaattcactaaagaagaattggtgcagaagttaagttccacaaccaaatccgcggaccacctgaacggactcttacgggagattgaggccacaaacgctgtgctgatggaacaaatcaagctccttaagtcagagataaggagacttgaacgcaatcaagagcaggaggtttccgcagctaatgtcgaacatcttaagaacgtgttactgcagttcattttcctgaaaccaggctcggagcgtgaaaggctcctccctgtcatcaatacgatgctacagctctcactggaagagaaagggaagctggccgctgtcgctcaagcagagaggggcttcgtgttaaactccacctttta

SEQ ID NO: 237902 - DNA, 471 bp, Artificial Sequence
  Description of Artificial Sequence: Synthetic coding sequence
atggacccacgtgcccatagatttttaggcctgttatatgaacttgaggagaataccgagaaagcagttgagtgctaccgaaggtctgtggagctgaaccccacacagaaggacctggtccttaaaatagcagagttgttgtgcaagaatgatgtaacagacggccgtgcggagtattgggtggaacgtgcagccaaactctttcccggatcgcccgcaatatacaaacttaaggaacagctgctggactgtgagggtgaggatggctggaataaactgtttgatctgatccagagcgaattgtacgtccgcccagacgacgtgcacgtgaacatccgcttggtagagctgtatagatctaccaaaagattaaaagacgccgtcgctagatgtcatgaggcggaaaggaacatcgcactcaggtcaagtttggagtggaactcatgcgtggtccagacccttaagttctag

SEQ ID NO: 237903 - DNA, 3378 bp, Artificial Sequence
  Description of Artificial Sequence: Synthetic coding sequence
atgctgctgactctgagcacgcgtgacgtacaagaatcacgtgaacttctggaaagcttcgactccgccctgcagtccgccaagtcgtcattggggggaaacgacgaactgagcgcaactttcctcgaaatgaaaggccatttctatatgcatgctggctcgctgctgttgaaaatgggacaacacggtaacaacgtgcagtggcgagccctgtcagagttagcagcgctgtgttatcttattgcatttcaggtccctaggccaaaaattaagctgatcaagggagaagccggtcagaatctcctggaaatgatggcctgcgaccgcctctctcaatctggccatatgctactaaacttaagtcgcggaaagcaggactttctaaaagtggtggtcgagacattcgccaacaagtcaggccagtccgctctgtacgatgccctgttttcctcccagtcacctaaggataccagtttcctaggctccgatgatattgggaatatcgacgtacaggaaccagaacttgaggatctggctaggtatgacgtgggtgccatccgggctcacaatggctccttgcagcacttgacctggctgggacttcagtggaactcgttaccagccttacctggaatcaggaagtggctcaaacagctttttcaccatttgccccaggaaacatcacgacttgagacgaatgcaccagaaagcatatgcatcctggaccttgaggtgttccttcttggtgtggtttacactagtcatctccagcttaaggaaaagtgtaatagccatcactcatcctaccagccgttatgtctgcctctgcctgtttgcaagcagttgtgcactgagcgccagaagagctggtgggacgctgtctgtactctgattcataggaaggcagttcctggcaactccgccaagcttaggctactggtgcaacacgagatcaatacactcagagcacaggaaaaacacgggctgcagccggctctgttggtccactgggctaagtgcctgcaaaagatggggagcggccttaactccttctatgatcagagggaatatatcggtaggtcagtccattactggaagaaggtcctccctctgttgaaaatcatcaagaaaaagaatagcattcctgaaccgatcgatccacttttcaagcattttcattctgtggacattcaggcctcggaaattgtggagtacgaagaagatgctcatgtgaccttcgctatattagatgctgtcaatgggaacatcgaggatgcaatgaccgcctttgagtccattaagagcgttgtgtcctattggaacctggcccttatattccaccgaaaggcagaagacattgctaacgacgccttaagcccagaagaacaggaggagtgtaagaattacctcagaaaaacacgaggatacctgataaaaatcctcgatgactcagactcaaatctctccgtggtcaaaaaattgcctgtgcccctcgagagcgttaaagaaatgcttaagtccgtcatgcaggaacttgagaactattcagaaggagggcctctgtataagaatggaagcctgcggaatgcagatagcgaaatcaaacactctaccccaagccccactaagtattccttgtcgccaagtaagtcatacaagtatagcccaaagacccctcccagatgggctgaagatcagaattcattactgaaaatgattagacaggaagtgaaagccattaaggaagaaatgcaggagttgaagttgaactccagtaaaagtgcctcacaccatcgctggcctaccgagaattacggcccagactcggttcctgatggttatcagggtagccagacatttcacggtgcacccctgaccgtcgctacaactggcccaagtgtgtactattctcagtcgccagcctacaattcccaatacctcctccgccctgcagccaacgtaacaccaacaaaaggttctagcaacacagagttcaaatccaccaaggaggggttctctatccctgtttccgctgatgggttcaagttcggcatctctgaacctggcaatcaagaaaagaaatctgagaaacctctggagaacgatactggtctccaggctcaggatataagcgggaggaagaagggaagaggcgtgatattcggccagacctcctccacatttacatttgcggacgtggcgaaatctacctcaggcgaaggatttcagtttggaaagaaggatttgaattttaaaggcttttcaggggcaggtgaaaaactttttagcagccagtatggcaagatggcgaacaaggctaacacctctggcgacttcgagaaggatgacgatgcctataaaaccgaagacagtgacgatattcacttcgaacctgttgttcagatgccagaaaaggtggagctcgtgaccggggaggaaggcgaaaaagtcttgtatagtcagggcgtgaaactgtttcggtttgatgccgaggtcagccagtggaaagaaaggggtcttgggaatctgaagattctgaaaaacgaggtcaatggaaaggtgaggatgttgatgcagagggagcaggtattgaaagtatgtgccaatcactggatcactacgacaatgaacctcaagccactcagcgggagcgatcgagcatggatgtggtccgcctcagacttttcagatggagacgctaaactcgagaggctggcggctaagttcaagacacccgaactcgctgaggaatttaagcaaaagtttgaagagtgccaacgcctgctcctagatattccgctccaaaccccacacaagctagtggataccggcagagctgcgaaacttattcagcgggctgaggagatgaagagtggctcagagtcaaaggtggaacctaaaaagtgtgaacttagcaagaatagtgacatagaacagtccagtgattccaaagtgaaaaatttgagcgccagttttcccacagaagagagctccattaattacaccttcaagactccggagaaggagccacctctgtggtatgcggagttcactaaggaggaactggtgcaaaagctgagctccactactaaatcagccgaccacctaaatggcctgctgagagagatcgaggcaactaatgcagtcctgatggagcagattaagcttcttaagtctgaaattcggcgacttgagcgtaatcaggaacaggaagtgtccgctgcgaacgtggagcacctgaaaaatgtgctcctccagttcattttcctgaagcctgggtcggaacgggagcgactcctgccagtgataaacaccatgctgcagctgtccctggaggaaaaaggcaagttagccgctgtggcacagggcgaagagtag

SEQ ID NO: 237904 - DNA, 423 bp, Artificial Sequence
  Description of Artificial Sequence: Synthetic coding sequence
accgaggaatctagtattaattatacatttaaaacacccgaaaaggagccacctctctggtatgcagagttcaccaaggaggaactcgtgcagaagcttagcagtaccactaagtcagccgatcatttgaacggtctactgagggagattgaagcaacgaatgctgtcttaatggagcaaatcaaattgctgaaatctgaaattagaagacttgagcgcaatcaagagcaggaagtgagtgctgctaatgtggagcatttgaagaacgtgctgttgcagtttatttttctcaagccaggcagcgagagagaacgcctgttgcctgttattaataccatgcttcagctgtctctggaggaaaagggtaaactggccgctgtggctcagggtctgcaggagacttctatccccaagaagaagtag

SEQ ID NO: 237905 - DNA, 5276 bp, Artificial Sequence
  Description of Artificial Sequence: Synthetic coding sequence
atgagctgttctaaagcctatggcgagagatacgtggcctctgtccagggcagcgcaccatctcccaggaagaagtctacccgcggtttttatttcgcaaagctgtattacgaagccaaggaatacgatctggcaaagaaatatatttgtacctatattaatgtacgggagatggaccccagggctcaccggtttctggggctgctgtatgagctcgaggagaacaccgagaaagccgtggagtgctatcggcgatcagttgaactgaatcccactcagaaggaccttgtgttgaagatagcagaacttctttgtaagaatgacgtgacagatggccgagctgagtattgggtggaacgggcagctaagctcttcccgggatctcccgctatttataaacttaaagagcagttactagattgcgaaggtgaggacggctggaataagctcttcgacctgatacagagtgaactttacgtgcgacctgatgatgtccatgtgaatataaggttggtggagctctaccggtcaaccaagcgcctcaaagatgctgttgcaagatgtcacgaggccgagcggaatatcgccttgaggagctccctcgagtggaactcctgtgtcgttcagacgctcaaagaatacctggagtcactgcagtgtcttgagtcagacaaaagcgattggcgggcaaccaatactgatttgctgctagcctatgccaacctgatgctgctgacattgtcaacccgtgacgtgcaggagtcacgggagctgctggaatcctttgactcagccttgcagtcagccaaatcaagcctggggggtaatgacgagctttcagctacgttcctcgaaatgaagggccacttttacatgcacgccggtagccttctgttaaaaatgggacagcatggcaataacgtccagtggcgggctctcagtgagcttgcagcactgtgttacctaattgctttccaggtaccacgaccaaagatcaaactcattaagggggaggccggtcaaaatctgttggaaatgatggcttgtgacagacttagtcagagtggacatatgttattgaatctctccaggggtaagcaggactttttgaaggtcgtggtggagaccttcgccaataaaagcgggcagtctgccctttacgatgccctcttttcgtctcaatcacccaaggatacatcattcctggggtcggacgacatcggaaacatagatgtccaggaacctgaacttgaagacctggctaggtatgatgtcggagcaatcagggcccacaatggctccctgcaacacctgacttggctgggcctgcagtggaacagccttcccgctttgcctggaatacgtaagtggctcaaacagttattccaccacctaccacaggaaacctcccgcctggaaactaacgcccctgaaagcatttgtatattggacctcgaggtgtttctgctgggcgtagtgtatactagtcacttacaacttaaggaaaagtgtaattcacaccatagctcataccaaccattgtgcctgcccctccctgtttgcaagcaactgtgcactgaacggcagaaaagctggtgggacgccgtgtgcacgcttattcatcggaaagcagtccccggaaattctgcaaagctgcggctcttagtccagcacgagattaacacattgcgggctcaagaaaaacacggcctgcagccagcattgctcgtacattgggctaagtgcctgcaaaagatggggtctggtctgaactcgttttacgatcagagagagtatataggacgttcagtacattactggaaaaaagtcctccctcttcttaaaattatcaaaaagaaaaacagcatacccgagcccatagatccactgtttaagcacttccattcagttgatatacaggcatcagagattgtggaatacgaggaggacgcacatgttacatttgcaattctggatgcggtcaatggaaatatcgaagacgcaatgaccgccttcgagtcaatcaagtccgtggtgagttactggaatctcgctctcatcttccacaggaaagccgaggatatcgctaatgatgctttgagccccgaagagcaagaagagtgtaagaactacctgagaaagaccaggggatatctaatcaagattctggacgactctgacagcaatctgagcgttgtcaagaaacttcctgtccctcttgagtccgtcaaggagatgttgaaaagcgtgatgcaggagcttgaaaactacagcgagggcggtcccctgtataaaaatggctcactgcggaacgccgacagtgagataaaacactctaccccgagccctaccaaatacagcctatcaccgtccaaatcctataagtacagtcctaaaacccctcccagatgggctgaggatcagaattcccttctgaaaatgatcaggcaggaagtcaaggccattaaggaggagatgcaggagttaaaacttaacagctcgaagtcagcatctcaccataggtggcctactgagaactatggcccagattcagttccagacggctaccaggggtcgcaaacctttcacggtgccccattgactgtcgctaccacgggaccaagtgtttactattcacagagcccagcatataatagccaatacctgctcaggcccgcagcgaacgtgacccccactaaaggcagtagtaataccgagtttaagagcactaaagaggggttcagtattcccgtgtcagcagacggttttaaatttggaatttccgagccagggaatcaagaaaaaaaatccgaaaagccactggagaacgacactggcctgcaggctcaggatatatcaggccgaaaaaagggtcgaggcgtgatcttcggccagacctcaagtacttttacttttgccgacgttgcaaaatccacgtccggcgaaggattccagtttggtaagaaggacctgaacttcaaaggcttctctggcgcaggggaaaaattattttcttctcagtacggcaaaatggctaataaggcaaatacatccggggacttcgaaaaggacgacgacgcatacaagaccgaggattcggatgacatacactttgagcccgtggtacagatgcccgagaaagtcgagcttgtcacaggagaagagggcgagaaggtgctgtatagtcagggtgtgaagctgttccgttttgacgcagaggtttcccagtggaaggaacggggactgggtaacttaaaaatcctcaagaatgaagttaacggcaaggtgcgtatgctgatgcagagggagcaggtgctcaaggtgtgcgctaatcactggatcactactactatgaacctgaaacccttaagtggcagtgatcgcgcatggatgtggagtgcgagcgattttagcgacggcgatgcgaagttggaaaggttagcagcaaaattcaaaactcccgagttagcagaagagtttaagcagaagtttgaagagtgccagaggctcctcctggacatccctctgcagaccccacataagctggtcgacaccggcagagccgcaaaacttatccagagggccgaggaaatgaagtccgggctgaaggatttcaagacttttcttaccaatgatcagacgaaggtggccgaggaagagaataaaggaagtggaaccggggcagcaggcgcatccgacactaccattaaacctaatgccgaaaataccggaccaactcttgagtgggacaactatgacctccgagaggacgcacttgatgattccgtgagctcgtcttccgtgcatgcctctccgttggccagttctcccgtccgcaagaatctgttccactttgatgagtcaaccactggatcgaatttttcctttaagtctgctctgtccctttctaaatctcccgctaaactcaatcagagcggcacatccgttgggacagacgaagagagcgacgtcacacaggaggaggagcgcgacggacagtactttgaacctgtggtgccgcttcccgacctggttgaggttagtagtggcgaggagaacgagcaggtcgtgttctcacatcgtgccgaattttatcgctacgataaggacgtgggtcagtggaaagaacgaggcattggagacataaagatcttacagaattatgacaataaacacgttcggatacttatgaggagagaccaggtccttaagctatgcgccaaccatcgcatcaccccagacatgagcttgcaaaatatgaaaggtacggagagagtgtgggtgtggacagcgtgtgacttcgccgatggagagagaaaggtagaacatttagcagtgagattcaaattgcaagacgttgctgactccttcaaaaagatctttgatgaggcaaagaccgcacaagaaaaagatagtctgatcacacctcatgtctccaggtcctctactcccagagagtctccgtgtggtaaaatagccgttgcggtgctcgaggagactacacgtgaacgcaccgacgttatacaaggagacgacgtagcagacgctgctagcgaggttgaggtaagttcaactagtgagactaccaccaaggctgtggtctcccccccaaagttcgttttcggatctgaaagcgtaaaaaggatcttctcctccgagaagtccaaacctttcgcattcggtaactctagcgccaccgggagtctgtttggcttcagctttaatgcaccacttaagtctaacaacagcgagacctcttccgtcgcgcagtcagggagtgagtccaaagtggaacctaagaagtgcgagttatcaaaaaatagcgatattgaacaaagtagcgatagcaaagtgaagaacttgtcagcctcttttcctactgaggagagctctataaactataccttcaagacccccgaaaaggagccacccttatggtatgccgaatttaccaaagaagagctggtgcaaaagctgagttctaccacaaagagtgcagatcacttaaatgggttgcttcgcgagattgaggcaacaaacgccgtgttgatggagcaaatcaaactacttaagagcgaaataaggcgacttgaacgcaatcaggagcaggaggtatcggccgctaatgtggagcacctgaaaaacgtactattacagttcatctttcttaagccagggtcagagcgagagcggctgctacccgttataaacaccatgctgcaactatcactggaagagaagggcaagctggctgcggtagcgcagggggaagagta

SEQ ID NO: 237906 - DNA, 5300 bp, Artificial Sequence
  Description of Artificial Sequence: Synthetic coding sequence
atgtcctgctcaaaggcatacggagagcggtacgtggccagcgtgcaaggtagcgcgcctagccctaggaagaaaagtactcgtggcttttatttcgcaaagttatactacgaggccaaagagtatgacttagccaagaaatacatctgtacgtacatcaatgtcagagaaatggacccacgcgctcaccggtttctgggtctcctttatgaactggaggagaataccgagaaggcagtggaatgctaccggagatctgtggagttaaaccctacccagaaagatctggtgctcaaaatagcagaacttctttgtaagaacgatgtgacagatggccgagctaagtactgggtggaacgggctgcaaagctgtttcccggtagtccagcaatctacaagttaaaggagcagctgctggactgcgaaggtgaagacggctggaacaaactttttgatctcattcagagcgagctctacgttcgccctgacgacgtccacgtgaacatccggcttgtggaattgtaccggtctacaaagagactcaaggatgccgtggcgcgatgtcatgaggccgagagaaatatcgccctccgtagctctctggaatggaatagctgtgtggtgcaaacgctgaaagagtacttggagtctttacaatgcctggagtctgataagagtgactggcgggcaaccaacaccgatttgcttctggcctatgccaacctaatgttgttgacgctaagcacacgcgacgtgcaggagagtcgggagctcctggagtcttttgatagcgctctgcagagcgctaagtcaagcctgggcggtaacgatgagttaagtgccaccttcttagaaatgaaaggccatttctacatgcacgccggaagccttctgctgaagatggggcagcatggaaacaacgtgcaatggagggccctgagtgaacttgcagccctatgctacctgatagcctttcaggtgcctagaccaaaaatcaagctgatcaagggggaggctggccaaaacctcttggagatgatggcttgtgacagactgtcccaaagtggccacatgcttctcaatctaagccgaggaaagcaggatttcttaaaggttgttgtcgagacctttgctaataagagtgggcagagcgccctgtatgatgcgctattttcatcccagtcccctaaggacaccagctttctgggctccgacgacatcgggaacattgatgtgcaagaacctgaactggaagatctggcaaggtacgacgtgggagctataagagctcataacgggagcctgcagcaccttacatggctgggtctccagtggaattccctgcctgccttgccaggcatcaggaaatggctgaaacagctgtttcatcaccttccacaagagacaagccgcctggaaactaatgcccctgagagcatctgcattctggacctggaggtgtttcttctcggggttgtctacacctcacacctgcagctaaaggaaaaatgcaacagtcaccattcctcctaccaacctctttgcttaccgttgcccgtttgtaagcagctgtgcacggaaagacagaagagttggtgggacgcagtttgtacacttatacaccgcaaggcagtgcctggaaactcagctaagctcaggctcttagttcaacacgagatcaacaccctcagagctcaggaaaaacatggtctacagccagctctgctggtgcattgggctaaatgccttcagaagatgggtagcgggcttaacagtttttacgaccagcgggagtacatcggaaggagcgtacactattggaagaaggtactgccgctactgaagattatcaaaaaaaaaaactctataccagagcccatcgacccactcttcaaacatttccactccgtcgatatccaagccagcgagattgttgaatacgaggaagatgcacatgttacctttgcgatcctggacgctgttaatgggaatattgaagacgccatgaccgcattcgaatcaatcaagtccgtggtttcttattggaatctcgctcttattttccacaggaaggccgaggatatcgcaaatgacgctttgtcacccgaagagcaggaagagtgcaagaactacctccgtaagacaagaggctatctgataaaaattttggatgattctgactcaaacttgtccgtggtgaagaaactgcccgttcccctagagtctgtgaaggagatgctgaagtcagtaatgcaggaactggagaactactccgagggagaccctctgtacaagaatggctcactccggaatgccgattcagagatcaagcattcaacaccgtcccccaccaaatatagcctgagcccgtctaaatcctacaagtactcaccaaagacacccccacggtgggccgaagaccagaattcactccttaaaatgattagacaagaggtaaaagccataaaagaggagatgcaggaactgaagctcaactcgtccaagagtgcctcccaccacaggtggcctacagagaactacggaccagacagtgtcccagacggttatcaggggagccagacgttccatggagctccccttacggtggctaccaccggcccatccgtctactatagccaaagccccgcttataacagtcaatacttgctgcggcctgcagctaacgtaacacccactaagggctcatcgaatacagagttcaagagcacaaaagagggcttctcgattcccgtgagtgcggatggttttaagtttggcatttcagagcctggcaatcaggaaaaggaatcagaaaagcctcttgagaacgataccggcttccaggctcaggatattagcggccagaaaaacggtcggggagttatcttcggacagacatccagcacgttcactttcgccgacgtggctaaatccacctccggggaggggttccagtttggaaaaaaggatccaaattttaagggctttagtggagccggagagaaacttttctcctcgcaatgtggtaagatggccaataaagccaatacctcgggagacttcgagaaggacgacgacgcatacaagaccgaggacagtgacgacatccattttgaaccagtggtccaaatgccagaaaaggtggagctggtgataggcgaagaaggtgagaaagttctgtactcccagggcgtaaaactttttcggttcgatgcagaggttcgccagtggaaggagcggggactaggcaatctaaagattctaaagaatgaggtgaatggcaagcctagaatgctgatgcgtcgcgagcaagtcctgaaagtgtgtgcgaatcattggataacgactacgatgaaccttaagcccctgtcaggttcagatcgcgcttggatgtggtcggcgtcggatttctcggatggcgatgccaaactggagcggctagcggcaaaattcaaaactcccgaactggcagaggaattcaagcagaaattcgaggaatgccagcagctgcttctggacatccccctgcagactccccacaaacttgtcgacaccggacgcgctgccaagcttatccagagagccgaagaaatgaaatctggattgaaggacttcaaaacgtttctgaccaatgaccaaacaaaggttacagaagaggaaaataaaggctccggaacgggagcagcaggagctagtgatactactatcaagcctaatccagaaaatacaggtcccactttggaatgggacaactgtgatctacgcgaagatgcactcgacgactccgtcagctccagtagcgtgcacgcaagccctctcgcaagcagccccgttaggaagaatctcttccatttcggtgaaagcactacaggatccaacttttctttcaagtctgccctgtcaccctcaaagagccctgctaagcttaatcagtctgggacctccgtcgggaccgacgaggagtcggacgtgacccaggaagaggagagagacggacaatactttgagcctgtagttcccctgcccgatcttgtggaggttagctccggcgaagaaaacgaaaaggtagtgtttagccatcgggcagaactttaccgatacgataaggacgtggggcagtggaaagaaaggggaatcggcgatataaaaattttacagaattacgataacaagcaggttaggattgtgatgcgcagagaccaggtcctaaaactttgcgcaaaccacacaatcaccccagacatgagcctccagaacatgaagggcaccgaacgggtgtgggtctggaccgcttgtgatttcgccgatggagaacgaaaggtcgaacatctcgctgtgcggtttaagctgcaggacgtagctgacagctttaaaaagatctttgatgaagctaagaccgcgcaggaaaaggattccctcatcacaccacatgtctccaggtcatcgactcctcgcgagtccccatgtggcaagatcgccgtcgcagtcctggaagaaactactcgagaacggaccgacgtcatccagggagatgacgtagctgacgcagcctccgaggtggaagtgagcagcactagcgagacaactacaaaggccgtggtaagtcctcctaagtttgtgttcggctctgagtctgtgaagcggatcttcagttccgagaagagcaagcccttcgcgttcggaaattctagcgctaccgggtcactctttggattctcattcaatgcatctctgaaaagcaataatagtgagacaagctccgtcgctcagagtggatctgaatctaaggtcgaacctaaaaagtgcgaactttctaagaactctgacatcgaacagagttccgacagcaaagtgaaaaacctgtctgcttccttccccatggaagagtcaagcattaactacacttttaagactcctgagaaagaacctcccctgtggcatgccgagttcaccaaggaggaactggtccagaagcttagctccaccaccaaaagcgcagaccatttgaatggactgctgcgagaagccgaggccaccagtgccgtgctgatggagcagatcaagctgttaaagagcgagattaggcgccttgaaaggaaccaggagcaagaagagtcggctgccaacgtagagcacttgaagaacgtgctccttcagttcatcttcttgaaacccggatccgagagagagagactgcttcctgtgattaataccatgctgcagctttccccggaggaaaaagggaaactggcagccgtggcccaagctgagcggggtttcgttctgaattcaacattcta

SEQ ID NO: 237907 - DNA, 3378 bp, Artificial Sequence
  Description of Artificial Sequence: Synthetic coding sequence
atgctcttaaccctgagcaccagagacgtgcaggagtcaagggagttgctcgagtccttcgactccgccctacagagcgctaagtcctccctaggcggaaatgatgaactgtcagccacatttctggagatgaaaggccacttctatatgcacgccggatccctcctgcttaagatgggccagcatgggaataacgtgcagtggagagccctatctgaactggcggcattgtgttatttgattgcatttcaggtgccacgtccaaaaatcaaactgatcaaaggagaggcgggtcagaatcttctggaaatgatggcctgcgaccgactgtctcagagtggccatatgttactgaacttgagccgcggtaaacaggactttctgaaggtggtggtcgagacctttgccaataagtcgggacagagtgcactttatgatgctctgtttagttcacagagtcccaaagatacttcatttttggggagtgatgacatcggcaatattgatgtacaggaaccagagcttgaagaccttgcaaggtacgatgtcggcgctatcagagcgcacaacggctcgttgcaacacctgacgtggctcggtttgcaatggaactccttgcctgccctgcccggtattcgcaaatggttaaagcaactattccatcatctcccacaggaaacctctagactggagactaacgcccctgaatccatttgtatcctagacctcgaagtcttcctgttgggggtggtttacactagccacctgcagttgaaggagaagtgcaactcgcatcattccagttatcagcccctctgcttgcctctgccagtttgtaaacagttgtgcaccgaacggcagaaaagttggtgggacgcagtgtgtaccctaatacacaggaaagcggtcccagggaactccgctaaattacggctgctcgtgcagcatgagatcaatacacttcgggctcaggaaaaacatggcttgcagccagccctcctggttcactgggcaaaatgcctccagaagatggggtccggcctgaacagtttctatgaccagcgcgagtacataggcaggagcgtgcattattggaaaaaggtcctccccctgctgaaaattataaagaagaagaattccatcccggaacccatcgatcctctcttcaaacattttcacagcgtcgatattcaggcttcagaaatcgtcgagtacgaagaggacgctcacgttacttttgccattctggatgctgtcaatggtaacattgaggatgccatgaccgccttcgaaagtatcaaatcagttgtgtcctattggaacctggccctgatcttccatagaaaggccgaggacattgccaacgacgcactgtctcctgaggagcaagaggagtgtaaaaattacctgaggaagacccggggatatctaatcaaaattttggatgactctgactcaaatctcagtgtcgtgaagaagttgcccgtccctcttgagagcgtgaaggaaatgctcaagtccgttatgcaggagcttgagaactactctgaaggggatcccttgtacaaaaacggatcactgcgcaatgccgacagtgaaatcaagcactccacgccatccccaacaaaatacagcctttctccttcaaagagttacaagtactcaccaaagacgcctccacgctgggccgaagatcagaattcccttttaaagatgatcagacaggaggtgaaggccatcaaggaagagatgcaagaactgaaattgaatagctccaaaagcgcctcccatcaccgctggcctacggaaaattatggacctgatagtgtcccagatgggtaccaagggagccagacttttcatggggctcctcttaccgtggcaactactggccctagcgtctattacagccagtcccctgcttacaactcccagtatttgcttcggccagcagctaacgtgacccctaccaagggtagttctaatacggagttcaagtccaccaaggaaggattctctataccagtctcagcagacgggtttaaatttggaatttcagaacctggaaatcaggaaaaagaatctgaaaagcctttggagaacgacacgggtttccaggcccaggacattagcggacaaaagaatggaaggggcgttatcttcgggcagacttcgtccacatttaccttcgctgacgtggcaaaatcgacctctggggagggattccagtttggtaaaaaagaccccaatttcaagggcttctctggagctggggaaaagctgttttcaagccagtgtggcaagatggcaaacaaagcaaacacatctggagacttcgaaaaggacgacgacgcctataaaaccgaagattctgacgacatccactttgaaccggttgtgcagatgcccgagaaggtggaactggtgataggagaagagggcgagaaggttctgtacagccagggtgtgaagctctttaggttcgacgctgaggtgaggcagtggaaagaaagaggactcggcaatctaaaaattctgaagaatgaggtgaacggcaaacctcggatgctcatgagacgcgagcaagtgctgaaggtgtgtgccaatcactggataacaacaaccatgaatctgaaacctttatccggctcggacagagcgtggatgtggagcgcttccgatttttcagacggtgatgccaaactggagagactcgcagcgaagtttaaaacgcccgaactggcagaagaattcaagcagaagtttgaagagtgtcagcaactccttttagatatcccactccagacgccacacaagctcgtagacacgggacgggctgccaagcttatccagagagctgaggaaatgaagtccggttccgaatcgaaagttgagcccaagaagtgtgagctgtccaaaaacagcgacattgagcagtccagtgactccaaggtgaagaatctcagcgcatccttcccaatggaggaaagtagtatcaactatacctttaagacccccgagaaagagcctcctctttggcacgccgaattcaccaaagaggaactcgtgcagaaactgtcttctaccactaagagtgccgaccatctgaatggtctcctccgcgaggctgaggcgacatcggccgtattgatggagcagattaagctgctgaagagcgagattcggagattggagaggaaccaagagcaggaagagtcagccgctaatgtggaacacttaaaaaatgtgctgctccaattcattttccttaagccgggaagtgagagagagcggctcttgccggttattaacacgatgctccaactgtctccagaggagaaaggtaagctcgctgccgtggcccagggcgaggaatag

SEQ ID NO: 237908 - DNA, 471 bp, Artificial Sequence
  Description of Artificial Sequence: Synthetic coding sequence
atggatcctcgcgctcaccgatttcttggccttctgtacgagctggaagagaacactgagaaggcagtagaatgctatcgccgaagtgttgagctgaatccaactcagaaggacctggtgttgaaaattgccgaactgttatgcaaaaatgatgtgacagacgggcgagccaagtactgggtagagagggccgctaagctgttcccagggtccccagctatatacaagttgaaggaacagcttctcgactgtgagggcgaagacggttggaacaaactgtttgacctgattcagagtgaactgtatgtgagacctgacgacgtacacgtgaatattcgactcgttgaactctaccgtagtactaagcggctcaaggatgcagtggccaggtgtcacgaggctgagcgcaacatcgcccttcgaagctcactagaatggaattcttgcgtggtccagactcttaaattttag

SEQ ID NO: 237909 - DNA, 5276 bp, Artificial Sequence
  Description of Artificial Sequence: Synthetic coding sequence
atgtcctgcagcaaggcttacggagagcggtatgtcgcttcagtgcagggtagcgctccctctccgcgtaaaaagtccactagggggttttatttcgctaagttatactacgaagccaaggaatatgatctcgcgaagaagtacatctgtacctatatcaatgtgcgggaaatggatccgagggcccaccgttttttggggctgctttacgagctcgaagaaaataccgagaaggcggtggagtgctaccgcagatccgtggaactgaaccctactcaaaaggatctggtgttgaaaattgctgagttgctgtgcaaaaatgatgtcactgacggaagggctaagtattgggtcgaaagggcggctaagttgtttccagggagcccagccatctataagctaaaggagcagctgttggattgtgaaggagaggatggatggaataagttgttcgatttaattcagagcgagctctatgtgcgacccgacgatgttcacgtaaatatccgcctggtggagctctaccggtcgacaaaaagacttaaagatgcggtagccagatgtcatgaggccgagcgcaacatagctctccgttcaagcctggagtggaactcctgcgttgtgcagaccctgaaggaatacctggagagtctacagtgcctcgaatcagataaaagtgattggagagcaacgaatactgatctgctgttagcatatgccaacctgatgctgctaacgctgtcaacccgggacgtgcaggagagtcgagagctgcttgagagcttcgactcagccctacagagcgccaagtcgagtctgggagggaacgacgagctcagcgcgactttcctggaaatgaaaggccatttttatatgcacgcgggatctttactgttgaagatgggacaacacggtaataacgtgcagtggagggcactgtccgaactggccgctttgtgttatctcatcgccttccaggtgcccagaccaaaaatcaagctgattaaaggagaagcaggacaaaatctgctggagatgatggcctgcgaccgactgtcccaatcaggacatatgctgctcaacctgagccgcggtaagcaggactttctaaaggtcgtggtcgaaacgttcgcaaacaagtctggacagagcgcgctgtacgatgcactatttagctcccagagccctaaagacacgtcttttctgggaagcgacgacattggaaacatagacgttcaagagcctgagctcgaggatctcgcaagatacgacgtaggagcgatcagggcccacaacggatctttgcaacacttaacctggttaggactccagtggaattccctgccagccttgcccggaatccgcaagtggcttaagcagctgtttcatcaccttccccaggaaacttctcgcttagagaccaatgcacccgagtccatttgcatcctggatctggaagtgttcctattaggtgtcgtctataccagccaccttcagctcaaggaaaagtgtaactcccaccattcctcttatcagcccctttgcctgcctctgccggtctgtaagcagctgtgtacagagcgccagaaaagttggtgggatgctgtctgcactttgatccacaggaaggccgtcccaggcaacagtgcgaagcttcgcttgctggtgcagcacgaaatcaataccctgcgcgctcaggaaaaacacggcctccagccggctttgctggttcattgggccaaatgtctgcagaaaatggggagcggtctcaactcattctacgaccagagggaatacatcggcaggtctgttcattactggaaaaaggttctacctttgctaaagataattaaaaaaaagaattcgatccccgagcctatcgatcctctgtttaagcactttcattctgtggacatccaggcctccgagatcgtggagtacgaggaagatgcccacgtcacctttgcaatactggatgccgtgaatgggaatatcgaggatgcaatgaccgccttcgagtcaattaagtcagtggtttcctactggaacctggccctcatctttcatcgcaaggcggaggatatagccaacgatgcgttgtctccagaggagcaggaggaatgtaaaaattatcttcggaagaccagggggtacctaatcaagatcctggatgacagcgatagcaatctaagtgtggtgaagaaactgcccgtcccactggaaagtgtgaaggaaatgctgaaatcagtgatgcaagagttagaaaattacagcgagggcgatcccctttataaaaatgggagccttcggaatgcagactccgagatcaaacacagcaccccgagtccaactaaatattctctgagcccgtcaaaatcttacaagtactcgcccaaaacacctccacgatgggctgaagaccaaaatagccttttgaagatgatccgtcaggaagttaaagccataaaagaagagatgcaagagcttaaattaaatagtagtaaatctgcttcacaccaccgttggccaacggaaaattatggcccagactcggtccccgacgggtatcaggggagtcagactttccacggagcacctctgaccgtggctacaacgggaccctccgtgtactactcacagagcccggcttataatagccagtatctcctcagacctgccgcaaatgtgaccccaacgaaaggatcttcaaatactgaatttaagtcgacaaaggagggttttagcatcccagtgtctgctgatggctttaaattcggcatctccgagccaggcaaccaggaaaaggaatccgagaaacccctcgaaaacgataccggattccaagcacaggacattagcggtcagaagaatggtcgaggcgttattttcgggcaaacatctagcaccttcaccttcgcagacgtcgctaaaagcacaagcggggaggggtttcagttcggaaaaaaggaccccaattttaaggggttctctggggcaggcgagaagctgttttcatctcagtgcggcaaaatggcgaataaggccaacacatctggagactttgagaaggatgacgacgcctataaaacagaggactctgatgatattcatttcgaacccgtggttcagatgccagagaaagtggaattggtaatcggcgaggagggggagaaagtgctgtacagccaaggagttaaactgtttcgattcgacgccgaagtgcgacagtggaaggaacgcggtcttggcaacctcaagatccttaaaaatgaagtgaatgggaagccaagaatgctgatgagacgcgagcaggtgttaaaagtctgcgctaatcattggattacaaccacaatgaatctgaaacccttgtcaggaagcgacagagcgtggatgtggtccgcctcggatttttccgacggtgacgccaaactggagaggctcgcagcaaagttcaagactcccgaactcgccgaggagtttaaacaaaaattcgaggagtgccagcagctccttctggacattcctcttcagacgccccataagctggtcgacaccggtcgtgccgctaagctgattcaacgagccgaagaaatgaagtctggcctgaaagatttcaaaacattcctgactaatgaccaaaccaaggtcacggaagaggagaataagggctcaggaacgggggcagcaggggcttccgatacaacaattaagcctaacccggagaatactgggcctaccctcgagtgggacaattgcgatctcagagaagacgccttggatgattccgtgagctcgagtagcgtgcatgcaagcccactcgcatcttcccctgtcaggaagaacctttttcatttcggagaatccaccacgggttctaatttttcgttcaagtcagcccttagccctagcaaatcacccgctaagttaaatcagagcggcaccagcgtgggcactgacgaggaaagcgacgtgacccaagaggaagaaagagatggccagtacttcgagcccgtggtgcctttgcccgacctagttgaggtgagcagcggtgaggaaaacgaaaaagttgtcttctctcaccgcgcagagctgtatcgatacgacaaagacgtgggccagtggaaggaaagggggattggtgatatcaagattttacaaaattatgataacaagcaggtgcggattgtcatgagaagggaccaggtgctgaagctgtgtgccaatcacaccattacccccgacatgtccctgcagaatatgaaaggaactgaacgcgtgtgggtgtggacagcttgtgacttcgcagacggtgagaggaaagtggagcatctcgcggtccgatttaaactgcaggatgtggctgacagctttaaaaaaattttcgatgaggcaaagacagctcaagaaaaggacagcctgataaccccccacgtgtcaagatcatctactcctcgcgagtccccctgtggtaagatcgctgtggccgtgttggaagaaacaactcgggagcgcactgatgtcattcagggcgatgatgtagctgacgctgccagcgaggtggaagtgtcctctacttccgagaccacaaccaaggctgtcgtctccccccctaagtttgtgttcggcagcgagtccgtgaaaaggatcttttctagtgagaagtctaagccatttgccttcggaaacagttccgctaccggcagccttttcggtttctccttcaacgcaagcctgaagtctaataatagtgaaaccagtagcgttgcccaaagtggatcagagagcaaagtggaacctaagaaatgcgaactgagcaaaaactccgatattgagcaaagcagcgactcaaaagttaaaaatctctcagcaagcttcccaatggaagagagcagtatcaactacacatttaagacacccgagaaggaaccacccttatggcatgcggagtttacgaaggaggagctcgtgcagaaattatcttctacaactaaatctgcggaccatctgaatgggctgctcagggaagctgaggccacttcggccgttctcatggaacagattaaactgctgaagtccgagatccgcaggcttgaacgcaatcaggaacaggaagaatccgccgcaaacgttgagcatctgaaaaatgtgctgttacagttcatctttctgaaacccggttctgaaagagaaagacttctcccagtgatcaacacaatgctgcagctgagtcccgaggaaaagggtaagttggccgctgtggcacagggggaggaata

SEQ ID NO: 237910 - DNA, 5298 bp, Artificial Sequence
  Description of Artificial Sequence: Synthetic coding sequence
atgaggagatccaaggctgatgtggaaagatatgtggcttctgtgcttgggctgacccctagtcccagacagaaaagcatgaagggattttacttcgccaagctttattacgaggctaaggagtatgacctggctaaaaagtacatctgtacttatatcaatgtgcaggagcgcgaccctaaggctcacagatttttagggctcctgtacgaactggaagaaaacaccgagaaagccgtggaatgctacaggagatctgtagagctcaaccctactcagaaagatctcgtgctcaagatagccgaactcctctgcaagaatgatgtcactgacggccgagctaagtactgggtcgagcgcgcagccaaactcttccccggttcaccagccatctataagttaaaggaacagctcctggactgcgagggggaagacgggtggaacaagttatttgatctgattcagtccgaactctatgtcaggcccgatgacgtgcacgtgaacatccggctggttgaactgtacagaagtacgaagcggctcaaagatgcagttgcacactgccacgaagcagagcggaacatcgccttgcggtccagcctagagtggaacagttgtgtggtccaaacgcttaaggaatacttagagtccctccagtgcctagagtccgacaaatcagactggcaagccactaacactgacctcctgcttgcctatgcaaatttgatgctcctgacgctgtccacacgggatgtgcaggaaaaccgggagctccttgagtcttttgacagcgctcttcagtctgcaaaaagtagtctgggaggcaatgatgaactttctgctacctttttggagatgaagggtcatttctacatgtatgctgggtcactcctcctgaagatgggccaacacgggaataatgttcagtggcgtgctctctctgagctggccgcactgtgttatttgattgcgttccaggtgcctcgacccaaaatcaagctgagggaaggcaaagccggtcagaaccttctggaaatgatggcatgtgatcggctttcgcagtccgggcatatgttgttatccttgtcccgcggaaagcaagattttctgaaggaagtggtggagacatttgccaacaagattggtcagagcgctctgtatgatgcactgttctcatctcagtcccctaaagacaccagttttttgggctccgatgacataggtaagattgatgtgcaagagcctgagttagaggatttggcacgctatgacgttggggctatcagggctcacaacgggtctctccaacacctaacctggctggggctgcaatggaattctctaccggctctgccgggaataagaaagtggttaaagcaattattccatcgcctgccccatgagaccagtcgcttggagacaaatgcgccagagtccatttgtattttggatttggaggtgtttctcttaggcgtagtgtatacctcccacctgcagctgaaagagaaatgtaactcacatcatagctcatatcagccgttatgccttccatttcctgtgtgtaagcagctgtgtaccgagcgccagaagagctggtgggacgctgtctgcaccctcatacacagaaaagccgttccagggaaccttgcaaaattgcgcttgctggtgcaacacgaaattaacacattgagagctcaggagaagcatggactgcagccagccctgctggtccactgggccaagtatttgcagaaaaccgggtcaggccttaactccttctacggccagctggaatacatcggtcgttccgtgcactactggaagaaagtgttacctcttttaaagatcatcaagaagaactcaatcccagaaccaatcgaccctctgtttaaacacttccactctgtagatattcaggcaagcgaaattgttgagtacgaggaggatgcccatattacgtttgccatgttggatgctgttaatgggaatatcgaggatgctgttactgctttcgagtccattaagtcagtggtgtcatattggaatttggcgctgatttttcaccggaaggcggaggatatcgaaaatgatgcactcagcccagaggagcaggaggagtgcaggaactatctgactaaaacccgcgactacctaataaagattatcgatgatggagacagcaatctttcagttgtaaagaaacttcctgtgcctttggaatctgtgaagcagatgttaaattcagtgatgcaggaattagaagactactccgaaggcggacccctctacaaaaatggttccctgcgcaacgccgactctgaaatcaagcattcaactcccagccctactaaatacagtctaagcccctctaagagctataagtatagccccgagacccccccacggtggaccgaagatagaaactccctgctgaacatgatctgtcagcaggtggaagcaattaaaaaggagatgcaagagcttaagctgaactcatcaaaatccgctagccgccatcggtggccaacggaaaattacggccctgattccgttcccgacggctatcagggaagccaaaccttccatggggctcctctgactgtggctacaaccggtccttccgtgtattacagccagagtcctgcctataactcacaatatttactgagacctgcggctaatgtaacgcccaccaagggaagttccaacaccgagttcaagtcaacgaaggagggattttccattcccgttagcgcagacggcttcaagttcgggatctccgagccaggaaatcaggagaagaagcgagagaagccgctggaaaatgataccggctttcaggcccaggacatttctggcaggaagaagggcagaggcgtcatcttcggccagacatcaagcaccttcactttcgctgatgtcgccaaaagcactagcggggaaggttttcagtttggtaaaaaggacctgaactttaagggcttctccggagccggagaaaagctttttagctcgaggtacggcaaaatggctaataaggctaacacatccggcgacttcgagaaggatgacgacgcttacaaaaccgaggattcggatgacatccactttgagccggttgtgcagatgcccgagaaggttgagctggtcacaggggaggaaggcgaaaaggtcctgtactctcagggtgttaagctgtttaggttcgacgccgaggtccgacagtggaaggagcggggtctgggaaatcttaaaattctcaagaacgaagttaacggcaagcttcggatgctgatgcgcagagagcaggtgcttaaggtttgcgcaaatcattggatcacaaccacgatgaacctgaaaccgctgtccggctccgatcgggcttggatgtggtccgcgagtgattttagtgacggcgatgctaagctggaaagattggccgcaaaatttaaaacgcctgaactggcggaagaattcaagcagaagttcgaggagtgtcagcggttgcttctagacataccattgcagactccccataagttggtggacaccggaagggccgcaaagctgatacagcgagctgaggagatgaaaagcggcctgaaggacttcaaaaccttcctgactaacgaccagactaaagtgactgaagaggaaaataaaggctcggggacgggggctgccggtgcctctgacacgactatcaagccaaacgccgaaaacacgggaccaacacttgaatgggacaattatgacttgcgggaagacgcactcgatgattctgtctcttcctcttctgtccacgcatcgcctttagccagttctccagtccgaaaaaacctgtttagatttgatgagagcaccactgggtcaaatttttctttcaaaagcgcgttgagcctgtcaaagagtcccgcaaaactcaaccagtccggaactagcgtagggacggatgaggaatccgtggtgacccaggaggaggagagggacgggcaatacttcgaacccgttgtccccctgccggaccttgtggaggtaagttcaggagaagagaacgaacaggtggtgtttagtcatagagccgaaatttaccggtacgataaagacgtgggccagtggaaggagaggggcatcggtgatattaaaatactgcagaactatgacaacaagcaggtgcgcatcgtgatgcgtagagaccaggtcctgaaactatgtgccaaccaccgcatcacccccgatatgtcactgcaaaacatgaaagggacagagagagtgtgggtatggaccgcttgcgatttcgccgacggcgagcgaaaggtggaacacctcgcagtgcgatttaagctgcaggatgtcgccgactctttcaagaagatatttgatgaggcaaagacagcacaggagaaagatagcctgataaccccacacgttagtagaagtagtacccccagggagtccccttgcggtaaaatcgcggtagcgattctggaggagacaacgcgggagcgtacagacgtcatacagggtgacgacgtggccgacgccgcaagcgaggtcgaggtgtctagtacaagcgagactaccacaaaagccgtcgtgtctcctccgaaatttgtcttcgtctccgaaagcgtgaagaggattttctccagcgaaaaaagcaagcccttcgttttcggcaactcttctgcaaccgggtccctcttcggcttcagctttaacgcccctctcaaaagtaacaattctgaaactagcagcgtggcacagtcagggtccgagtccaaggtggagccaaaaaaatgtgaactgtccaaaaattccgacatcgagcagtccagtgatagcaaagtgaagaacctctccgcatctttcccaacagaggagtcctccatcaactatacctttaaaacccccgaaaaagagcctcctctttggcatgctgagtttacgaaagaggagctggtgcaaaagctcagatcaaccaccaagtccgccgatcatttaaacgggttgctccgagagatcgaggcaacaaacgccgttctaatggaacagataaaattactgaagtcagagatcaggcgtctggaacgaaaccaggagcgcgaaaaaagcgccgctaacctggagtatctgaaaaatgtgttgttgcagtttatcttcctaaagccagggtcagagagagaacggcttttgcccgttatcaataccatgctacagctgtcgcctgaagaaaaggggaaactggcggctgtggctcaggacgaagaagaaaatgcctcccgctcttcaggctaa

SEQ ID NO: 237911 - DNA, 2715 bp, Artificial Sequence
  Description of Artificial Sequence: Synthetic coding sequence
atgaggcgctccaaggccgacgtggaacggtatgttgcctccgtcctgggcctgaccccctctccaagacagaaatccatgaagggcttttactttgcgaagttatactatgaagccaaggagtacgacctcgcaaagaaatacatctgtacctatatcaacgtccaagaacgtgatcccaaagctcatcgcttcctggggctactttatgaactcgaagagaataccgaaaaagccgtcgagtgttatcgcaggtcagtcgagctgaacccaactcaaaaggatttagtccttaagattgcagaattgctctgcaaaaacgacgtgaccgacggccgagccaaatactgggttgagcgcgcagctaagctgttccctggaagtcccgctatctataagctgaaggagcagctgctggattgcgaaggagaagacggttggaataaactgtttgacttgatacagagtgagctgtacgtacgccctgacgatgtccacgtgaatatcagactggtggaactctatcggtctactaagaggctgaaagatgccgtggcacactgtcatgaggctgagcgcaatatcgctttgcgctcaagtctagagtggaatagttgcgtggtgcagaccctcaaggaatatctggaaagcctccagtgtctcgagagtgacaagtccgattggcaggccaccaataccgacctgttgttggcttatgcaaatcttatgctgcttacactatcaacgagggacgtgcaggagaaccgggagctcctggagtccttcgatagcgccctccaatccgctaagtcatcactcggcggaaacgatgagctctcagccacctttctcgagatgaagggacatttctacatgtatgctgggagcttactccttaagatggggcagcacggcaataacgttcaatggagagctctatcagaacttgccgcactatgctatttaatcgctttccaggtgcccaggccaaaaattaagctgagggaaggcaaagccggtcaaaatttactagaaatgatggcgtgtgaccggttgtcacaaagtgggcatatgctcctgagtctcagccggggaaaacaggactttctcaaagaagtggtggaaacatttgcaaataagattggacagtcagcactgtacgatgcactctttagttctcagtcacctaaagacacctccttcttgggatctgacgatatcggcaaaatcgacgtccaagagccagaactcgaggacctagcacggtatgacgtgggggcaatacgcgcacataatgggtctctgcagcaccttacttggctggggttgcagtggaattctctgcctgccctcccagggattagaaagtggcttaaacaattatttcacagattgccccacgagacatctcgcctagagacgaatgctcctgaatctatctgcatccttgatctggaggtgtttctgctcggagtggtgtacacctcacacctgcagttgaaagaaaaatgcaattcccatcactctagttatcagccactgtgtctcccgttccctgtgtgcaagcagctctgcacggaaagacaaaagagctggtgggatgctgtatgcactttaatccaccgaaaggcagtgcccggtaatctggcgaagctcaggctcttagtgcagcatgagattaacaccctccgggctcaggagaagcatggtctgcagccagccttattagtccactgggcaaagtacctgcaaaaaacaggtagcggtctgaactccttctacggacagctcgagtacattggacgcagcgtccactactggaagaaggtacttcccctcctgaaaattatcaagaagaatagcatccccgaacctattgatcccttattcaagcactttcattccgtggacatacaggcaagtgagatcgttgaatacgaagaggacgctcacattactttcgccatgctggacgctgtaaatggtaatattgaagatgcagtgaccgcatttgagtctattaagtccgtggtcagttactggaacctcgccctcattttccacagaaaagccgaggatattgaaaacgacgcactgtctcccgaagaacaagaggagtgcaggaactacctcaccaagacccgagattacctcattaaaatcatcgacgatggagacagtaatttgtccgttgtgaagaagttgccagttcctttggaatccgtaaagcagatgctgaactctgtgatgcaagagttggaggactatagcgaaggcggacccctctataagaacggaagtctgaggaatgcagattcggagatcaagcattctacaccatctcccacaaagtatagtctcagtcccagtaaatcgtataagtacagccctgaaacccccccaaggtggaccgaggaccgcaacagcctgctgaacatgatctgtcaacaggtggaggcaattaagaaagagatgcaggaacttaaacttaattcaagtaagagtgccagccgccacagatggcctacagaaaactacggccctgacagcgtgcctgatgggtatcaaggctctcaaaccttccacggcgctccattgactgaagctgcccatcggcacttcaccattgagaaacacggagattcgaaatggatcatataccggtttactaaacaattgtgtggtacagagcgggcacgggcaaaaatctcatag

SEQ ID NO: 237912 - DNA, 459 bp, Artificial Sequence
  Description of Artificial Sequence: Synthetic coding sequence
atgtggtctggaacctctccaagatgctgggtctcacctcgcagattggataggtatatctgtacatatatcaatgtacaggagagagacccgaaggcacatcgcttcctggggcttctttacgaacttgaagagaacacagagaaagctgtcgagtgctaccggaggtcagtcgagctgaatcctactcagaaggacctcgtgctgaagattgccgagttgctttgcaagaacgacgttaccgacggcagagctaagtattgggtagagagagccgcaaaactctttccaggatctcccgctatctacaagctcaaggagcagctgctggattgtgagggagaggacggatggaacaagctctttgacctgatccaaagcgagctatatgtcaggcccgatgacgtccatgtcaacattcgccttgttgaactgtatcgatccactaaaagactgtag

SEQ ID NO: 237913 - DNA, 2715 bp, Artificial Sequence
  Description of Artificial Sequence: Synthetic coding sequence
atgagacggtccaaagcggacgtggagcgttacgtggcctcagtgctgggcctcacgcctagcccgagacaaaagtcaatgaagggcttctattttgcaaagctgtattacgaagctaaggagtatgatctcgcgaagaagtacatttgtacatatatcaacgtgcaggaaagagaccccaaagcccacagattcctcggtctgctctacgaactggaagagaacacagaaaaggccgtggagtgctatagaaggagcgttgagttgaacccaacccaaaaggacttagtcctgaagattgctgagctgctgtgtaaaaacgacgtgactgacggcagggcaaaatactgggtggagagggcagcaaaactcttccccggaagccctgctatttataagctgaaggagcagctgctcgattgtgaaggggaggacggatggaacaagctctttgacctgatccaatccgaactgtatgtgagaccagatgacgttcacgtcaacatccggctggtggagttgtaccggtccacaaagaggttgaaagacgccgtggcccattgccatgaggccgagagaaatattgccttacgtagctctctagagtggaactcttgtgtcgttcagactttaaaagagtatctggagagccttcagtgtcttgagagtgataaatcagattggcaagccaccaataccgatctcttactagcttacgcaaatctcatgctgttgacactgtcgactagagatgtccaggagaaccgggaattactagaaagttttgactccgctcttcagtcagcaaagtcttctctggggggaaacgatgaattaagtgccacgtttctggaaatgaaaggtcatttttacatgtacgcaggcagccttctgctcaaaatggggcagcacggcaacaatgtacagtggcgagcgttaagtgagttggccgctctgtgctacttaatagccttccaggtgcccaggcctaaaattaagcttcgggagggtaaggccggacaaaacctgctggagatgatggcttgcgatcgtctcagccagagcggccacatgcttctatctctttcgagaggaaaacaggactttctgaaagaggtggtcgaaacgttcgctaacaagataggacaaagcgccctatacgatgccttattctcctcacagtccccgaaagacacttcgtttcttgggagcgatgatatcggcaagatcgatgtacaggaaccagagctggaggacctggccaggtatgatgtgggggcaattcgggcacacaatggctccctccagcacctcacctggctcggcctgcagtggaattcactgccagctttgcccggaattaggaaatggttgaaacaattgttccaccgactgccccatgagacctctcggctggagacaaatgcccctgaatctatctgtatcctggacctggaggtcttcctgttgggcgtggtgtatacgtctcatttgcaactaaaggagaagtgtaattcccatcacagctcttaccagccgctatgcttaccttttcccgtctgtaagcagctttgcacagagaggcaaaaaagctggtgggacgcagtgtgcactcttatacataggaaagcggttccgggaaacctcgccaagttgcggctgcttgtccaacatgaaattaacactctcagagcacaggaaaagcatggcctgcagcccgctctcctggttcactgggcgaaatatttgcagaagactggatctgggctgaattcattctatggccagctggagtatatcggcagaagtgtccattactggaaaaaagtgctgccactgctcaagataattaagaagaattccattcctgaacctattgatcctctattcaagcacttccactctgtggatattcaggccagcgaaatcgtggaatacgaagaggacgctcacattaccttcgccatgctggacgcagtgaatggtaacatcgaggacgccgtgacggccttcgagtccataaaaagcgtagtaagctactggaatctcgccttgatcttccataggaaagccgaggatatcgagaacgacgctctatctcccgaggaacaggaggaatgtaggaattacctgaccaaaacaagagattacctcattaagatcattgatgatggcgactcgaatttgagtgtggttaagaagttaccagtcccactggaaagcgtgaaacaaatgttaaattctgtgatgcaggagctcgaagattattcagaggggggacccctgtacaaaaacggaagccttagaaatgcagacagcgagatcaagcactccactccgagccccactaaatattctctgagcccctccaagagttacaaatactcccctgagactcccccacgttggactgaagacagaaattccctgctcaacatgatctgtcaacaagtcgaggctatcaagaaagaaatgcaagagctcaaacttaattcatccaaatcggctagcaggcacagatggccaaccgagaattacggcccagactcggtgccagatgggtaccaggggagtcagacctttcacggagcccctctgaccgaggccgctcaccgtcactttaccatcgaaaagcatggagactctaagtggatcatctatcggttcacaaaacagttgtgcggtaccgagagggcacgggcaaaaataagctag

SEQ ID NO: 237914 - DNA, 5297 bp, Artificial Sequence
  Description of Artificial Sequence: Synthetic coding sequence
atgcggagaagcaaagcggatgtagaaagatatgttgcatccgtcctaggacttacaccctccccacggcagaaatctatgaaggggttttactttgctaagttgtactacgaggcaaaggaatacgatttagccaaaaaatatatctgcacatatatcaatgtccaggaacgggatccaaaagctcatcgatttctgggactcctgtacgaactggaagagaacacagaaaaggctgttgagtgctaccgaaggagcgttgagctgaatccgacccaaaaggatctggtactgaaaatcgccgaactgttgtgtaaaaacgacgtcacggatggacgggcaaagtactgggtcgagagggccgctaaactctttcccggtagtcctgctatttacaaacttaaggagcagcttcttgactgcgagggagaggacggctggaataaactttttgacttaattcagtcagagctgtacgtgagaccagacgatgtgcatgttaacataaggcttgttgagttgtatcgctcaaccaaacgactgaaggacgccgttgctcattgtcatgaggcagaaagaaacatcgctttaagaagttctctagagtggaatagctgcgtagttcagaccctgaaggaatacctggaatccctccagtgccttgagagtgataaatccgattggcaggcaaccaatacggatctccttctggcgtacgccaacctgatgttgcttactctgtccaccagggacgtccaagagaacagggaactcctggagagtttcgatagcgctctgcaatctgccaaatctagcctgggagggaacgacgaactgagtgcaactttcctcgagatgaagggccatttctacatgtatgctgggagtttacttttgaagatgggccagcacggcaacaacgtccagtggcgcgctctgtcagagctagccgctctttgctacctgatcgctttccaggtcccacgcccaaagataaagctgcgggagggcaaggcgggtcagaatctcctggagatgatggcatgtgaccggctaagtcaatcaggccacatgctcctgtctctaagcaggggtaaacaagattttctaaaggaggtggtggagaccttcgcaaataaaattggccaaagcgccctttatgacgctctgttctccagccagtcgccaaaggacacttcttttctgggctcggatgacataggaaagatagacgtgcaggagcctgaactggaagatctggctcgctacgacgtgggggctatacgcgcacacaatggttctctgcaacacctgacctggcttggattgcagtggaattcactgccagccctgcctggtatccggaaatggttaaaacagctgtttcacaggctaccacatgaaacttcaagactggagacgaacgcccctgagagcatttgtatactggacctcgaagtgttcctcttaggagtggtgtacacgagccacctccaactgaaggaaaagtgtaatagtcaccacagctcttatcagccgctgtgcctccctttccccgtgtgtaaacagttatgtactgaacgccagaaatcttggtgggatgctgtgtgtactctcattcacagaaaagccgtcccgggtaatcttgccaaactccggctgctggtacagcacgaaattaataccctgagggctcaggaaaaacacggcctgcagccagctctgctggttcactgggccaagtacctgcagaaaacggggtcaggtctaaattctttctatggacagctggagtacataggcaggtctgttcattactggaagaaagttctgccactactaaagattatcaagaaaaactctataccggaaccaatcgatcctctttttaaacacttccactctgtagacatacaagcatccgagatagttgagtacgaagaggacgcacatatcacctttgccatgctcgatgctgtgaacggaaatattgaggacgcggtcaccgcattcgagagcatcaaatctgtggtcagttactggaatttggcgctcatcttccacaggaaagctgaggatattgagaatgacgccctgagtccagaggaacaggaggaatgtagaaattacctcacgaagacccgggattatctgataaaaattatagatgatggcgactccaatctgtccgtggtcaaaaaactccccgtaccactggaaagcgtgaagcagatgctgaactccgttatgcaagagctggaagactattcagaaggcggtcccctatacaaaaacggatccctgcggaatgccgattcagagattaagcattcaaccccctctcccactaaatactccttgtctcctagcaaatcctacaagtactcaccagaaacgcccccacgctggaccgaggaccgcaacagcctgctgaatatgatctgtcagcaagttgaggccatcaagaaggagatgcaggagttgaagctgaattccagtaaaagcgctagccgtcacagatggccaacggagaattatggaccagatagcgtccccgatggataccagggcagccaaaccttccacggggctccactgactgtggcaacaaccggaccatctgtctattactcacagagcccagcctacaactcgcagtatctgctgagaccagctgctaacgtcacgccaactaaaggcagttccaacacggaattcaaatctacaaaggaagggttctcaatacctgtgagcgcggatggcttcaaattcggcatttccgagccgggaaaccaggagaaaaagagggagaagcccctggagaacgatacaggatttcaggctcaggacatatcaggtcgcaaaaaggggagaggggtgatatttggccagacatccagcactttcacattcgctgacgtagcaaagagtacatccggggagggattccagttcggcaaaaaagacctaaattttaagggcttttccggcgctggagaaaagctcttcagttctcgctacgggaagatggccaacaaagctaatacgtccggggatttcgaaaaagacgacgatgcttataagacagaggactctgacgacattcacttcgaacctgtcgtgcaaatgcctgagaaagtggagctggtaacaggagaggagggggaaaaagtgttatattctcagggagtaaagctgttccggtttgacgcggaggtacggcaatggaaagaacggggattagggaatctgaagatcctgaagaacgaagtgaatgggaaactgcggatgcttatgcgccgtgagcaggtcctgaaggtttgcgccaatcactggatcacgaccactatgaacttaaagcccttgtccgggtccgacagggcctggatgtggtccgcctcagactttagcgacggcgacgctaaactcgagcggttagctgccaagttcaaaacaccagagctggccgaggaatttaagcagaaatttgaggagtgccagagattgcttctggatattccacttcaaactccgcacaaactagttgatactggcagagctgccaagctgatacagcgggcagaggaaatgaaatctggcctgaaggacttcaagacatttctgactaacgaccagaccaaagtaactgaagaggaaaataaagggtcaggcaccggcgctgctggagcttccgacacgactattaagcccaacgccgaaaacaccgggccaaccctcgagtgggataactacgatctgcgcgaggatgcattagacgactcggttagcagtagctcggtacacgccagtcctctggcatcgagcccagtccggaaaaacctgttcagatttgatgaatccactaccggatcaaactttagtttcaaaagcgctctctctctttctaagtcaccagctaaactgaatcagagtggtacttcagttggcacagacgaggaatctgtggtgacccaggaggaggagcgcgatgggcagtactttgaacccgtggtccctctgcctgacctggtcgaagtgagcagcggggaagaaaatgaacaagtggtatttagtcatagagccgagatttacaggtacgacaaagatgtgggacagtggaaagagcgaggaatcggggatattaagatcctgcaaaattatgataacaagcaggtgagaatcgtcatgcgacgcgatcaggtgctgaagctctgcgctaaccacagaatcacgcccgatatgtctttgcagaacatgaaaggcacagagcgcgtgtgggtgtggactgcatgtgatttcgcagatggggagcgcaaggttgaacatctcgctgtgcgctttaaactacaggatgtggctgattcatttaagaagatcttcgatgaagctaagaccgcccaggaaaaggatagcttaattactccccacgtgagcagatcttctacaccgagagaatctccctgtgggaagatcgcagtggccatcctcgaggaaaccacacgcgagagaaccgacgtcatccagggagatgatgtcgctgacgccgcttcagaagtcgaagtatcctctaccagtgaaaccacgactaaggcagtggtgtccccacctaagtttgtcttcgtgagcgagtctgtcaagcggatatttagctcggagaaatctaagccttttgtctttggcaattcttccgcaaccgggagcctattcggttttagctttaatgccccactgaagagtaataattccgaaacttcgagcgttgctcaaagtggctcagaatccaaggtcgaaccgaagaagtgtgagctgagcaagaactccgacattgagcaaagttctgactccaaagtgaaaaatctgtccgcctcgttccctacagaggaatccagcattaattacactttcaagactcctgagaaggaaccccctctgtggcatgctgagtttactaaggaagagcttgtgcaaaaactgcgctcaacaactaaaagcgccgatcatctgaacggcctcctgcgcgagattgaggctacaaatgctgtgctcatggaacagatcaaacttctgaagtccgagatacgcaggctagaacgaaatcaggagagagagaagtcagcagcaaacttagaatacctcaaaaacgtactactgcaattcatatttctgaaaccaggatcggaaagggaaagactcttacctgttatcaatacgatgctccagctgtcaccagaggaaaagggaaaattggccgcagtggcccaggacgaggaagagaacgcctccagatcatcaggata

SEQ ID NO: 237915 - DNA, 2715 bp, Artificial Sequence
  Description of Artificial Sequence: Synthetic coding sequence
atgagacgctctaaggccgatgtggaacgatatgtagcaagtgttcttggcttaaccccctcgcctagacaaaagagcatgaaaggcttttattttgccaagctatattacgaagctaaggagtatgacctggctaaaaagtacatttgtacttatataaacgtccaagagcgcgatcctaaggctcatcgcttcctgggccttctgtacgaactggaggagaatactgagaaagccgtagaatgttatcggcgatctgtcgagctgaacccaacccagaaagacctggtgttgaaaattgccgagctcctatgtaagaacgacgttaccgatggacgagcaaaatattgggtggaaagagcagcaaagctgtttcccggaagccccgcaatctataagctgaaagagcagctcctggactgcgagggagaagatggttggaacaaactgtttgacctgatccagagcgagctgtatgttagaccagacgacgtacatgtgaacattcgtctggtagagctgtataggtcgaccaaaaggctgaaagacgcggtagcacactgccacgaggccgagcgcaatatcgccttgcgaagctctctggaatggaactcctgcgtggttcagaccctcaaggaatacttggagtcattacagtgtctcgagtccgacaaatccgactggcaggccaccaataccgatctactcctcgcctatgccaacctgatgctgctgaccctgagtacccgtgacgtacaggagaatcgcgaacttttagaaagctttgacagtgcactgcaaagcgccaagtcaagcctggggggaaatgatgaattgagcgccacgtttctcgaaatgaaggggcacttctacatgtatgcaggctctctcctcctgaagatgggtcagcacggtaataacgttcagtggcgcgcactcagtgaactagccgcactgtgttatctcattgcttttcaggtgcctagacctaagatcaagttgcgcgagggcaaggcaggccaaaatcttctggagatgatggcgtgtgacagactttcccagagtgggcacatgctcctgtcgcttagccggggaaaacaagacttcttgaaagaggtggttgagaccttcgcaaacaagatcggacaatctgcactgtatgacgctcttttttcatcgcagagtcccaaggatacctcattcctcggatctgacgacataggaaagattgatgtgcaggagcctgagctggaggatctggcacgctatgatgtgggtgcgatcagggcacacaatggctctctgcaacatctaacctggcttgggctgcagtggaattccttgccagctcttccaggaatacgaaagtggctcaagcaactttttcatcgccttccacatgagaccagtcggctggagactaatgcaccggagtcaatctgtatcctggacctggaggtgtttcttctcggagtggtatacacctcccacttacagctgaaggagaagtgcaatagtcatcactcaagttatcaacccctgtgtctcccttttccagtgtgtaaacagttgtgtaccgaaaggcaaaaatcctggtgggacgccgtctgcacactgatccatagaaaggccgtgccaggaaacctggcaaagctcaggctgctggtgcagcatgagataaacacattgcgggctcaggagaagcatggcctgcaacccgctctcctcgtgcattgggcgaagtacctccagaagacgggatcgggactgaacagtttctatggccaactagagtatatcggtcgaagtgtacattattggaaaaaagtccttcctctgttaaagattattaaaaaaaacagcatcccggagcctatcgatccactctttaaacattttcattcagtggacattcaggcctcagagatcgtcgagtatgaggaggatgcgcacatcacctttgctatgttagatgccgttaacggaaacattgaggatgccgtaaccgctttcgagtcaatcaagtctgtggtctcctattggaacttggccctgatattccatcggaaagcagaagacatcgagaacgacgctctgtcacctgaagaacaggaagagtgccgcaattacctgacaaaaacccgagactacctaattaagatcatcgatgacggcgattccaacctgagcgtggtcaagaaactgcccgtgccgctcgaaagcgtgaagcagatgttgaacagtgtgatgcaggagctcgaagactactccgagggagggccattgtacaagaacgggagcctgagaaacgcagactcagagattaagcattctacaccgtcccccacaaagtattcgttgtctccctctaagtcttataagtacagcccagaaaccccccctcgatggacagaggatagaaacagcctgctcaatatgatctgtcagcaggtagaggccatcaaaaaggagatgcaggagttaaagctgaactccagcaagagcgctagccggcatcgttggcctacagagaattatggtcctgatagtgtacctgacggataccaggggagtcagacatttcacggggctcccctcacagaagcagcccacaggcatttcactattgaaaaacatggagattccaagtggattatctataggttcacgaaacagctgtgtggtacagagcgggctcgagctaaaatttcttag

SEQ ID NO: 237916 - DNA, 5297 bp, Artificial Sequence
  Description of Artificial Sequence: Synthetic coding sequence
atgcggaggtcaaaggcagatgtggagcggtatgtagcgtctgttctcggcctgaccccgtctccacgacaaaagtcaatgaagggcttttatttcgcaaagctttattacgaggccaaggagtacgatctggctaaaaaatacatctgcacctacatcaatgtacaagagagggaccctaaagctcatagattcttggggctgctctacgaactagaagagaacactgaaaaagctgtcgagtgctatcgcaggtcagtcgaattgaatcctacccaaaaagaccttgtccttaaaattgctgaactgttgtgtaaaaatgacgtcactgacgggagagccaagtactgggttgaacgcgcagccaagttgtttcctggatctcctgccatctacaagcttaaggagcaactcctggattgcgaaggcgaggacggatggaacaagctgttcgatcttatccagtctgaattatacgtacgccctgacgatgttcatgtgaatatccgtctggtagagttatacagatcaactaaacgcctcaaggacgctgtcgcccactgtcatgaagcagagcggaacatagcactgaggtcttctctagaatggaatagttgcgtggtccaaacattgaaggagtacctcgagagtctgcagtgtctcgagtccgacaagagcgattggcgagccaccaacaccgatctgcttttggcttacgccaacctgatgctgctgacactgtccaccagggatgtgcaagagaatcgggaactcctggaaagtttcgactcagccctccaaagtgcgaagtccagcttgggcggaaacgacgagttgtcagctacctttttagaaatgaagggtcacttctacatgtacgcaggatccttgttgctgaagatgggtcagcacggaaataatgtgcaatggcgcgctttatctgaacttgctgcgttgtgctacctcatcgcttttcaggtcccacgtcccaagatcaaacttagggagggaaaagctggtcagaatctgctcgagatgatggcctgcgacaggcttagccagagcgggcacatgctgctgtccctctctaggggtaaacaggactttctcaaagaggtggttgagactttcgctaacaaaatcggccagagcgctttgtacgacgctctgttctctagtcagtctccgaaggatacttcattcctcggcagcgacgatatcgggaagatcgatgtgcaagagcccgagctggaggacctggccagatacgacgtgggcgcaatccgggctcataatggttcattacagcacctgacatggctcggactgcagtggaacagccttcccgcattacctggtatacgcaaatggctgaagcagctgtttcacagactgccacatgagaccagcaggctcgagacaaacgcgccagaaagcatttgcattctggacctggaagtgtttttattgggcgtggtctatacaagccacttgcaactgaaagaaaagtgtaattcccaccacagctcctatcagcctctgtgcttgccgtttcctgtgtgtaagcagctgtgcactgaacgccaaaagtcctggtgggacgctgtctgcaccttaatccacagaaaagccgtgcctgggaacctggccaagttaaggctgctggtgcagcatgaaatcaacacactgagagcccaggagaagcatggccttcagcctgcacttctggttcactgggcaaaatatctccagaaaaccgggagcgggctcaattcattttatggccagctggaatacattggacgcagcgtgcactactggaagaaggtgcttcccctgctaaagatcatcaagaagaactctatacccgagccgatagacccattatttaaacatttccactcagtggacatccaggctagcgaaatagttgagtacgaggaagatgcacacataacttttgctatactggatgctgtcaatggtaacatcgaagatgccgtgactgcctttgagtccatcaaaagtgtggtgtcatattggaacttggccctgattttccaccggaaggctgaagacatagaaaacgacgcccttagcccggaggagcaggaggaatgcaggaactacttgacaaagaccagagactacctgattaagatcatagacgatggagactccaatctgagtgtcgtgaagaaactccctgtgccactcgagtccgtcaagcagatgttgaactcagtgatgcaggaattggaggactatagcgaagggggaccgctgtataaaaacggatccctgagaaacgccgattcggaaatcaagcatagcactccatcgccgaccaaatactcactctcccccagcaagtcctacaaatactctccagaaaccccccctcgctggacggaagacaggaatagcctcctaaacatgatatgccagcaagtggaggctattaaaaaggaaatgcaggaactcaagctgaattcaagcaagtcagcttcaaggcacagatggccaaccgaaaactacggtccagatagcgtgccggacgggtatcaagggtctcagacttttcacggggctccgctgactgtggccacgaccgggcctagtgtgtattacagccagagtcccgcatacaacagccaatatctcctgagacccgcagccaatgtgactccaactaaaggctccagcaataccgagtttaagtccactaaggagggatttagtatcccggttagcgctgatggctttaagttcggaatatcagaacccggtaaccaagaaaaaaaaagggaaaagcccctagagaacgacactggactgcaggcacaggatataagggggaggaaaaagggaaggggcgtgatttttggacagacttcatccactttcacattcgcagatgttgcaaagtcgactagcggagaggggtttcaattcggcaagaaggatctaaacttcaaaggcttttccggagcaggggaaaagttgttcagcagccgttatggtaagatggccaataaagccaatacctccggggatttcgaaaaggacgatgacgcctacaaaacggaagactcggatgacatccacttcgaacccgtcgtgcagatgcctgagaaggtggagcttgtgactggtgaagaaggcgagaaggtcctgtactcccagggcgtgaagctgttcagatttgacgctgaagttagacagtggaaggagagaggcctgggcaaccttaagatcctgaaaaacgaggtaaatggcaaacttaggatgctgatgcgcagggaacaagtgctcaaagtgtgtgcaaatcattggattacgactactatgaacttaaagcccctttcaggcagcgatcgggcatggatgtggagcgccagcgacttctctgatggtgacgccaaattggagcgtctggccgcaaagtttaagaccccggagctcgccgaagaattcaaacaaaagttcgaggagtgtcagaggcttctcttggacatcccattgcagactcctcacaagttggtcgacacagggcgtgccgctaagctaatccaacgagcagaagagatgaagtccggactgaaggatttcaagacattccttacgaatgaccaaactaaagtcacagaggaggagaacaaagggagcggaaccggggttgcgggtgcaagtgacacaactattaagcccaatgccgaaaacaccgggccaacacttgaatgggataactacgacctacgcgaggatgccctagacgacagcgtgtcctcaagctccgtccatgcctctccattagcatccagtcccgtgaggaagaatcttttccgctttgacgagtctacaacaggatcaaacttcagttttaagagtgccctgagcctttcaaagtcccctgctaaattgaaccagagcggaacatcagtcggtaccgatgaggagagcgtggtgacacaggaagaagagagggacggtcagtacttcgagcccgttgttcctctgccagacctggttgaagtatcatctggtgaggagaatgaacaggtggtttttagccatagggcggagatttaccgatacgacaaagacgtgggacagtggaaagagagaggaatcggggatataaagatccttcaaaactacgacaataagcaggtgagaatcgtgatgaggcgagaccaggtacttaagctgtgtgcaaaccaccgaattaccccagacatgtccttgcagaacatgaagggtactgaacgggtctgggtttggacagcctgcgattttgcggacggagagcggaaggttgagcacctcgctgtacgctttaagctgcaagatgtggccgacagctttaagaaaatattcgacgaggctaaaactgcgcaggagaaggacagccttatcactccacacgtgagcagaagcagcactcccagggagagcccctgcggcaaaatcgccgttgccgtgcttgaagaaatcacgagagaacgcaccgacgtcattcagggggacgatgttgccgatgccgcatccgaggtagaagtgagcagcacgagtgaaaccaccacaaaggcagtcgtgtctccacccaagttcgtctttgtctccgaatcagtgaagcgtatatttagctctgaaaaaagtaaaccattcgcctttggcaactcatcagctacaggatctctgttcgggtttagttttaacgcacctcttaagagcaataatagtgagacctcttctgtggcgcagtcgggttctgaaagcaaggttgaacccaagaaatgtgaactctcaaaaaactccgacatcgagcagtcgagcgatagcaaggtgaagaacctgagcgccagcttcccgacggaggaaagctcaatcaattacaccttcaaaacacccgaaaaagaacctcctctgtggcatgcagagtttactaaggaggagctggtgcagaaactgagatcaacaaccaaatccgcagaccacctcaacggtttgttaagggaaatagaggctacaaacgccgtattaatggaacagatcaagttactcaaaagtgagatacgcagattggagcgaaaccaagagcgggaaaagagcgccgctaatctggaatatctgaagaacgtgctgttgcaattcatttttctgaaacctggtagcgagagagaacggctcttgccggtaatcaacacaatgctgcagttgagtcctgaagagaaaggcaagctcgccgctgtcgcccaggatgaggaggaaaatccttctagatcaagtggtta

SEQ ID NO: 237917 - DNA, 1407 bp, Artificial Sequence
  Description of Artificial Sequence: Synthetic coding sequence
atggggacagccactcctgacggcagagaggatcaagagcgtctgtgggtttcagtggaggatgctcagatgcatacagtgacaatctggctcaccgttcgccctgacatgacagtggcctccctgaaggacatggtgtttctggactatggatttcccccagtccttcagcagtgggttattggtcagcgacttgctcgcgaccaggagacccttcattcccatggagtgcgacagaatggcgactctgcttatctgtatcttctgtctgctcgtaatacaagcttgaatccacaggagctgcagcgggagcggcagctgcgtatgctggaagatttaggctttaaggacctgactctccaacccaggggccctcttgagccagggcctcctaagcccggtgttcctcaggaaccaggcaggggccagcctgacgctgtgcctgagcccccacctgtggggtggcagtgccctggctgtaccttcattaataagcccacaagacccggttgcgaaatgtgttgtcgcgctcgaccggaagcgtatcaagtccccgcatcttaccaaccagatgaggaggaacgagccagattggccggagaagaggaagcgctaagacagtaccaacagagaaagcagcagcaacaggagggaaactatctccaacacgtccagctcgaccaacgttctctcgtactaaatactgagccagcagagtgtccagtgtgctactccgtgctggcgcctggcgaagcggtggtcctgagagagtgtcttcacaccttttgtagggagtgtctgcaagggacaattcgcaatagccaggaagcggaggtctcttgcccgtttattgacaacacctactcatgcagtggaaagctcctagagagggagatcaaagctctgctcacccccgaagattaccagcgctttctggatttgggtatttcgattgccgaaaacagatctgcgtttagctaccactgtaagacacctgattgtaaaggctggtgttttttcgaagatgacgtgaatgagtttacatgcccggtgtgtttccatgtgaactgtctgctctgtaaggcaattcacgaacagatgaattgtaaggagtaccaggaagatctagcgctccgcgcacagaacgatgtggcagccagacaaacaaccgagatgctcaaagtgatgctgcagcagggagaggcgatgcggtgccctcaatgccagattgtggtccagaaaaaagatgggtgtgactggatccgttgcacagtgtgccacaccgagatctgctgggtgactaaggggccaagatggggcccaggcggtcctggtgacacatctggcggttgtcggtgtcgggtgaatggcattccgtgtcatccaagctgccagaattgccactag

SEQ ID NO: 237918 - DNA, 1533 bp, Artificial Sequence
  Description of Artificial Sequence: Synthetic coding sequence
atggacgagaaaacaaaaaaagctgaagagatggccctgtcactgacccgcgctgtggcaggcggagatgaacaggttgctatgaagtgcgcaatatggcttgcggagcagcgagtccccctgtcggtgcagctgaaacctgaggtatcgccgacacaggacattaggctgtgggtgtcagtggaagatgcccagatgcataccgttaccatatggctcacggtgcgtccggacatgactgtcgccagcctgaaagatatggtgttcttggactacgggtttcccccagtcctgcaacagtgggtgataggccaacggttagctagagatcaagaaaccctgcactctcatggagtgcgccaaaatggagactctgcatacctatacttattatctgctcggaatacttccttaaatccccaggagctccagcgtgagcggcagcttcggatgctggaggatctgggtttcaaggaccttactctgcagccaagagggcctcttgagcccggacccccaaaacccggagtgcctcaggagcccggaagagggcagccagacgcagtcccggaaccccctccggtgggatggcagtgtcctggatgtacattcatcaacaaacctactcgacccggatgtgaaatgtgttgccgggcacggccagaagcctaccaggtgcctgcttcctaccagcccgatgaagaagaaagggcacgcttggctggagaagaagaggcacttagacagtatcaacagcgtaagcagcaacagcaggaaggcaattatcttcagcacgttcagcttgaccagcgttctctcgttctgaacactgaaccagcagaatgcccagtttgctattccgttctggcgccaggagaggccgtggttttgcgcgagtgcttgcacacattttgccgggaatgcctccagggtacaattcggaattctcaagaagccgaagtaagctgccctttcatcgataatacctatagctgcagcggtaagctcttagaacgcgaaataaaggccctgctcactcccgaggattaccaacgattcctcgatctaggcattagtattgccgagaaccgatcagcctttagctaccattgtaagacccctgattgtaaggggtggtgcttcttcgaggatgatgtgaacgagtttacctgtccagtgtgtttccacgtcaactgtctgctatgcaaagcaatccatgagcagatgaactgtaaagagtaccaagaggacttagcgctcagggcgcaaaacgacgtggcggctcggcagaccaccgagatgctgaaggtaatgctccaacagggcgaggccatgagatgtcctcagtgccaaatagtggtgcagaagaaagatggttgcgactggattcgatgcacggtgtgtcacacagaaatctgttgggtgaccaagggcccacgttggggcccagggggacccggtgacacctccggtggctgtaggtgtcgcgtcaacgggataccgtgtcatcccagctgccagaattgtcactag

SEQ ID NO: 237919 - DNA, 1011 bp, Artificial Sequence
  Description of Artificial Sequence: Synthetic coding sequence
atggatgaaaagacaaaaaaggccgaggaaatggcgctgagtctcacccgggcagttgctggaggtgacgagcaggtggccatgaaatgcgcaatttggctggcggagcagagggtccccctgtctgtccaattgaaacctgaagtaagtcccactcaggatatcagattatgggtttcggtagaggacgctcagatgcacaccgtcactatttggcttaccgtaagacccgatatgaccgtggcaagcctgaaggacatggtcttcttagactacggcttccctcctgtcctgcagcaatgggtcattggccagcgcctcgcccgagaccaggaaaccctccatagtcacggcgtgcggcaaaatggggactccgcttatctgtacctgttatcagcccgaaatacctcccttaacccacaggagttacagagagagaggcaacttagaatgctggaggatctcggctttaaggatctgaccctgcaaccacgagggcctctggagccaggcccacccaaacccggagtccctcaggagcccggtcggggtcagccagacgcagtgcctgagccgcctcccgtggggtggcagtgtcctggctgtaccttcatcaacaagccaacgcgaccgggatgtgaaatgtgctgccgggctagaccagaggcctaccaggtaccagcttcataccagcctgacgaggaagagagggccagattagccggtgaggaagaggccctgcgccagtaccagcaaagaaaacagcaacagcaggaaggcaactatttgcagcacgtacaattggatcagcgcagtctcgttctcaatacagaacctgccgagtgcccagtctgttacagtgttctggcgccaggtgaggcagttgtgttgcgctctgcctgcagggctccgtccgccaccgccaggcgccgacggtcacccgctccaagcctgaccactccaacccgggctagggccagctgttggcgcggaaggtccaggagaagctag

SEQ ID NO: 237920 - DNA, 792 bp, Artificial Sequence
  Description of Artificial Sequence: Synthetic coding sequence
atggatgagaagaccaagaaggcagaggagatggcactcagcctgaccagagccgtggccggaggagacgaacaggtggctatgaagtgcgctatctggttggcggagcagcgcgtcccgttaagtgtacaactgaagcctgaagtttcacctacgcaggacattcgctcaaggggggagaagactgaagaggtcggggaagttagggaggtacccgaccacggtgggccacgcgttctacctagagtggatagtaagtctagcgtggagcctctcgaaggcccaaattggttgtgggtctccgtggaagacgcgcagatgcacacggtcactatttggctcactgttaggcccgatatgacagtcgcctcactgaaggacatggtcttcctggactatggattccccccagttctccagcaatgggtgataggacagcgcctggcaagggaccaggaaactcttcattcacatggagtgcgtcaaaacggtgattctgcatatttgtacctgctgtccgcaaggaacacttcactgaatcctcaggaactccaacgagagagacagctgagaatgctagaggaccttgggttcaaggacctgaccctgcaaccaagaggcccactggagcccggtcccccaaagccgggtgtaccacaggagccaggccgaggccagccagacgcagttcctgaaccacccccagtgggctggcagtgtcctggttgcacgttcattaataagccgacacgaccagggtgtgagatgtgctgtcgggctcgacctgaatag

SEQ ID NO: 237921 - DNA, 819 bp, Artificial Sequence
  Description of Artificial Sequence: Synthetic coding sequence
atggacgagaagacaaaaaaggccgaggagatggccctttctcttactcgcgctgtggcgggaggagatgaacaagtggccatgaagtgtgccatttggttggcagaacaacgggtgcccctttcagtgcaattgaagccggaggtctctccaactcaagatattaggctgtgggttagcgtcgaagacgcccagatgcacaccgtcactatctggctgaccgtgcgacccgacatgaccgtcgccagcttgaaggatatggtgtttctcgattatggtttcccccctgtccttcaacagtgggtgataggtcagcggcttgcgagggatcaggagacactgcatagccacggagtgaggcagaatggggatagtgcgtacctctaccttctttctgcacggaatacatctctaaaccctcaggagttgcaacgagaaaggcagttgagaatgctggaagatctgggatttaaggacttaaccctgcagcctaggggtcctctggaacctggaccacctaaacccggagttccacaggagccaggcagaggacaacctgacgcagtgcccgagccaccccctgtgggttggcagtgtcctggctgcaccttcattaacaagcctacgaggccaggctgtgagatgtgttgtcgggcacgcccagaagcctatcaggtgcctgcttcctaccagcctgatgaagaggagcgagcgcgactggcaggcgaagaggaagccttgaggcagtaccagcagggggtgccagcgggacaccatccccagcagcccggtggcggtggcttgctccctctgcactag

SEQ ID NO: 237922 - DNA, 354 bp, Artificial Sequence
  Description of Artificial Sequence: Synthetic coding sequence
atggacgagaagaccaaaaaagctgaagagatggccctgagtctcacaagagcggtggcgggtggcgatgaacaggtggccatgaagtgcgctatctggctggccgagcagagagtgccactgtccgttcagttaaagccagaggtctctccaactcaggatatccgcctgtgggttagcgttgaggatgcacagatgcatacagtgactatctggcttacagtgcgcccagatatgacagtggcctctctgaaggatatggtgttcctcgattacggattcccccctgttcttcagcagtgggtaatcggacagagactggctagagaccaggagacattgcactctcattag

SEQ ID NO: 237923 - DNA, 768 bp, Artificial Sequence
  Description of Artificial Sequence: Synthetic coding sequence
taagagatggcactgagcctgacgagggccgtagcgggtggtgacgaacaagtggcaatgaagtgcgcgatatggctggccgagcaacgcgtccccttatctgtgcagctaaagccagaggtgagtcctacccaggatattcgaagccggggagaaaagactgaagaagtcggcgaggtgagggaggtccctgaccatggaggtcctcgggtgctgccgagggtggattccaaatcatccgtagagcccctcgaaggtccgaattggctgtgggtgagcgtggaagatgcccaaatgcacaccgtcactatatggttgactgttcgaccggacatgaccgtggcttcgctgaaagacatggtcttcctcgactatggcttccccccagtactgcagcagtgggtgatcggacagcgcttggctagggaccaggaaaccctgcactcccacggagtccgccagaatggagattccgcatacctgtatctcctgagcgctagaaacacttctctaaacccacaggagttacagagagaacggcagctccggatgctagaagacctgggttttaaggacctcacgcttcagcccagggggcctctcgaacccggaccacctaaacctggggtgccccaagagcccggacgtgggcagcccgatgctgtgcccgagcccccaccggtcggatggcagtgcccaggctgcacctttatcaacaagcctactcggcctgggtgtgaaatgtgttgtagagcaaggccggagtag

SEQ ID NO: 237924 - DNA, 819 bp, Artificial Sequence
  Description of Artificial Sequence: Synthetic coding sequence
atggatgagaaaaccaagaaggccgaggaaatggctctctcccttaccagggccgtggcagggggagatgaacaagtggcaatgaagtgtgccatttggcttgctgagcagcgagtgcccctttcagtgcagttgaaacccgaggtttcccctacgcaggacattaggctgtgggtaagcgtggaagatgctcagatgcataccgtcaccatttggcttaccgtgcgcccagacatgacagttgccagcctgaaggatatggtgtttctggattacgggttcccgcctgtgctacagcagtgggttattgggcaaaggctggccagggaccaagaaactctgcacagccacggtgttagacagaatggcgactccgcctatctttatttgctgagcgctcggaacaccagtctgaatcctcaggagctccagcgcgaacgacagctccgcatgctggaagaccttggctttaaggaccttacgctgcagcccaggggtcccttggagccaggccctcctaaacccggtgtgccacaggagccaggcaggggtcagcccgacgctgtaccagaacctccgcctgtgggctggcagtgtcccggatgcaccttcattaataaaccaaccagacccggttgtgagatgtgctgtcgagcgaggccagaagcgtaccaggtccctgcctcttaccagccggacgaggaggaaagggccaggctggccggtgaggaggaagcactccggcagtaccagcaaggcgttcctgccggacatcacccacaacagccaggagggggtggcctgctgcctctccattag

SEQ ID NO: 237925 - DNA, 4830 bp, Artificial Sequence
  Description of Artificial Sequence: Synthetic coding sequence
atgaatagtccggtggatcccggtgctagacaggccctacggaaaaaacccccagaaaggactccagaggatctcaatacaatttatagctatctgcatggcatggaaatcctgtctaacctacgagagcatcagctccgtctgatgtcagctcgggctcggtacgaaaggtatagtgggaaccaggtgttgttttgctccgagacaatcgcacgatgctggtacatactgctgtcaggctctgtactagttaagggcagcatggtcctgcctccctgtagttttggcaaacaatttggcggaaagcgcggttgcgactgtctcgtcctggaaccttccgaaatgatcgtggtcgagaatgctaaagataacgaggattccattctccagagggagataccggcacgacagtctcgccgtaggttccgcaagattaactacaaaggcgaaagacaaacgattacagacgacgtggaagttaacagctacctgtcattacccgctgatctgaccaaaatgcaccttaccgaaaaccctcatcctcaggtgacccacgtttctagttctcaaagtgggtgctctatagcttcggatagtggctcttctagtctctctgacatttatcaggctacagagtccgaagtaggtgacgtggatctgacacgcctccctgaggggcctgtagattcggaggacgatgaagaggaagacgaagaaatagataggaccgacccactgcagggtagagatcttgtcagagaatgcctggaaaaagagcccgctgacaagacagacgacgatatcgaacaactgctcgagttcatgcaccagctgcccgctttcgccaatatgaccatgagcgtgagacgggagctgtgctcagttatgatctttgaggtcgttgaacaggcaggagctattattctcgaagacggacaggaattagactcatggtacgtcatccttaacgggactgtcgaaatctcccaccctgatgggaaagtggagaatttatttatggggaatagcttcggcatcaccccgacattagataagcagtacatgcacgggattgtgcgaacaaaggtcgacgactgtcagttcgtgtgcatcgcacagcaggattattggcgcatcttgaaccatgtcgaaaaaaatacccataaggtggaggaagagggcgagatcgttatggtccacgaacaccgcgagctggatcgaagtggcaccaggaagggccacatcgtgattaaggcaacgccggaacgcctgattatgcatctgattgaagagcacagcatagtggatcctacttacatcgaggacttcctgcttacctatcggacattcttggaaagtccgctggatgtcggtatcaaacttctcgaatggttcaagatcgattccctccgggacaaggtaaccaggatagtactcttatgggtaaacaaccactttaatgattttgagggagacccggcaatgacccgctttcttgaggagtttgagaagaatctcgaggataccaaaatgaatggacatcttaggttgctgaatatcgcgtgcgccgcaaaggcgaagtggcggcaggttgtcctccagaaggcatctcgcgaaagcccactgcagtttagcctgaatggcggtagtgagaaaggattcggtatcttcgtggaaggggttgaacctgggtctaaggccgctgactcaggactcaagcgaggggatcaaatcatggaagttaatggccagaattttgaaaatattacattcatgaaggccgtggaaattttgagaaacaacacccatcttgccctgactgtcaagacaaatatatttgtgttcaaggaactcctgttccggacagaacaggagaagagcggtgttccgcacattcccaagattgccgagaagaaatccaataggcacagtattcagcatgtcccaggggatatcgaacagaccagtcaggagaagggttctaaaaaagtaaaggccaatacagtatccggcggaagaaacaaaattaggaagatccttgataagacacgtttctcaattctgccacccaagttattctccgacggcggtctcagccagagccaggacgacagtatcgtcggaactcggcactgtcggcatagcctggccattatgcctataccaggtactctttcctcttcctcgccagaccttctgcagcctacaacaagcatgctcgatttcagcaaccccagtgacattcccgatcaggttattagagtcttcaaagttgatcagcaatcctgttatataataatttcaaaagacaccactgccaaggaggtcgtttttcatgccgtgcatgagttcggcctaaccggtgcttctgacacatactccctctgtgaagttagtgtgaccccagaaggggtgattaaacaaagaagattgcctgaccagttctccaagctggccgacagaatacaactgaacggcagatattatctcaagaataatatggaaactgaaaccctgtgcagcgatgaagacgctcaggaattggtcaaggagtctcagttaagtatgctgcagttatccaccattgaagtggccacacagttatctatgagggactttgatttgttccgaaacatcgaaccgacagagtatatcgacgatctgttcaaactgaatagcaaaacggggaatacacatctcaagagatttgaagacatcgttaatcaagagacgttttgggttgccagtgaaatcttgaccgaggctaatcagttgaagaggatgaaaattattaagcatttcatcaaaattgcactccattgcagagagtgtaagaatttcaattctatgtttgccattatctctggcctaaacctggcgtcagtcgcccgattgaggggtacctgggaaaagcttccatccaagtacgaaaaacatctgcaggacctgcaggatatattcgaccccagccgcaatatggccaagtacaggaacatcctgtcctcccagtcaatgcaaccccctataatcccactgttccccgtcgtaaaaaaagatatgaccttcctgcacgaaggaaatgacagcaaggtggacggtttggtgaacttcgagaaacttaggatgatctccaaggaaattcggcaggtggtgcgcatgacttctgccaacatggaccccgctatgatgtttcgacagaggaaaaagcggtggcgaagtttagggtccctgtcgcaaggctcaacgaattcaaatatgctggacgtgcagggaggcgcacacaagaagagggcacgccgaagttcactgctgaatgccaagaaactatacgaggatgcccaaatggctcggaaagtgaagcagtatctgtcctctttagacgtggagacagatgaggaaaaattccaaatgatgagcctgcagtgggagccggcatatggaactcttactaagaatctgtctgagaaacggagcgccaagagctctgagatgtctccggtgcccatgcggagcgcgggtcaaactacaaaggcacatctgcaccagccccatcgggtgtcacaggtgttacaagtccctgctgtcaatctgcatcctatccgaaaaaaggggcaaacaaaggaccctgccctgaatacgtctctgcctcaaaaggtccttggtactacagaagaaatctccggaaaaaagcacacagaagacacaatctcagtggccagctctctgcatagcagtcccccagccagcccacaaggctctcctcacaaaggatacacattaatcccttccgccaagagcgataacctgtctgacagctcccactcagaaatctccagtaggtcatcaatagttagcaactgttctgtggattctatgtcagccgctctgcaggacgaacggtgcagcagccaggccctggcggtacccgagagcacaggcgctctggaaaagaccgagcacgcctctgggatcggggaccactcgcagcatgggcctggctggaccctcctcaagccgtcactcattaaatgcctggctgtaagctcctccgtgagtaatgaggagatttcccaggagcatattattattgaggccgcagatagcggcaggggaagctggacgagctgtagcagctcctctcatgataatttccagagcttgccaaatcctaaatcttgggactttctgaattcctatcggcatacccatcttgacgaccctatagctgaagtagagcccacagattctgagccctactcctgttctaaatcttgcagcagaacatgcggccagtgcaagggaagtctggaaaggaaaagttggacctcttctagcagtctgtcagatacctacgagcccaactatggcaccgtgaaacagcgcgtcctcgagagcacccccgcagagagtagcgaaggcctggatcctaaagacgctacggacccagtttacaaaacagtgacatctagcaccgagaaaggtcttatagtgtactgcgtgacctctccaaagaaagatgataggtacagagaaccccctcctactccccctggatatctggggataagtttggcagacctaaaggaaggacctcacactcacctcaaacctcctgattactcagtcgccgtgcagcgtagcaagatgatgcacaattctctctcccgcctgcccccagcgtcattgtcctctaatctggtggcttgtgtgccatcaaagatcgtgactcagccgcagaggcacaacctccagccgtttcatccaaaactgggggacgttacagacgctgattccgaagcggacgagaatgagcaagtgtctgcagtatag

SEQ ID NO: 237926 - DNA, 4530 bp, Artificial Sequence
  Description of Artificial Sequence: Synthetic coding sequence
atgaactctcccgtggatccaggagctcgccaagcccttcgcaagaagccgccagagcgaacccccgaggacctgaataccatctactcatatctccatggaatggaaatattaagcaacttaagggagcaccagctcaggctgatgagtgcgcgtgctcggtatgagcgctattctggcaatcaggtcttgttttgctcagagacaatcgccaggtgctggtacattcttctgagtggttcagtgttggtcaaagggagtatggtacttcccccatgctcattcggaaagcagtttgggggtaagcggggttgtgattgtttggtactggaacccagcgaaatgatcgtggtagagaatgctaaggacaatgaggattcaatcttacagagggagattcccgcaaggcagagcaggcggagatttcgtaaaataaattacaaaggagaacgacagactataactgacgatgtggaagtgaactcctacctgtccttgcccgctgatctgacgaagatgcacctcaccgagaacccccaccctcaggtgacacatgtgagctccagtcagtctggttgcagcatagccagcgatagtgggtcatccagcctgagcgacatatatcaggctactgaatccgaagtcggggacgtggacctcacaaggcttcccgaagggcctgtggatagcgaggatgacgaggaagaagatgaggagattgacagaacagatcccttgcaaggcagggacctggtccgggaatgcctggagaaggagccagcagacaagaccgatgacgacattgagcagttgctggagttcatgcatcagctgcccgcattcgctaatatgaccatgagcgtgcgtcgtgagctctgctctgtcatgatctttgaggtagtagagcaggctggcgctatcattttagaggacggacaagagctggattcatggtacgtcatccttaacggaaccgtggagatcagccatcccgatggcaaggtcgagaatctgttcatgggcaactccttcggcataacacccacgttggacaagcagtacatgcacgggatcgtccgcacaaaggttgacgactgtcagttcgtctgcatcgcccaacaggactactggaggatcctcaaccatgtcgagaaaaacacccacaaagtcgaggaggaaggggaaattgttatggtgcacgagcatcgagagctggaccgcagtggtactcggaaagggcatattgtcattaaggctaccccagagcgccttattatgcatctgattgaggaacattctatcgtggaccctacatacatcgaagactttcttctgacttacaggacattcctagaaagccccttagacgtgggcatcaaactcctggaatggtttaagattgactcactccgcgacaaggtcacccggatcgttcttctatgggtgaacaaccatttcaacgatttcgaaggagatcctgctatgacgcgcttcctcgaggaatttgaaaagaatctagaagacactaagatgaatgggcacttgagactgctgaacattgcctgcgctgccaaggccaaatggcggcaggttgtattgcaaaaagcaagcagagagtcccccctgcagttcagccttaatggcggaagcgagaaagggttcggcattttcgtggagggagtagagcccggtagcaaggcggcagacagtggtctgaaaagaggcgaccaaattatggaagtcaacgggcagaactttgagaacatcaccttcatgaaagctgtcgagattcttaggaacaatacacatctggcgctcaccgttaaaaccaacatcttcgtgttcaaggagcttctttttcgtactgagcaagagaaaagcggggtgccccacataccaaagatcgctgaaaaaaagagtaaccggcattccatccaacatgtccctggcgacatcgaacagaccagtcaggaaaaaggatctaagaaagtgaaagccaatactgtctccgggggaagaaacaaaatacggaagatccttgacaagaccaggttctcgatcttgcccccaaagctgttctcggatggaggcctgagccagagccaagacgattccatcgtcggtactagacactgtcgacactcgcttgccatcatgcctatccctggcacactgagctcatccagccctgacctgttacaacccaccacctccatgttagatttttccaacccctcagccgtcggcttctactatattcccgaccaggtgatccgcgtgtttaaagtggaccaacaatcatgttacatcataattagcaaagataccaccgctaaggaagtcgtgtttcatgctgtccatgaatttggactgacgggggcatctgacacttatagcttatgtgaggtctcagtgacacccgagggcgtgattaagcagcggcgattaccagatcaattcagtaaactagcagatcggatccagcttaacggtcggtactacttaaaaaacaatatggagactgagaccctctgtagcgatgaggatgcacaggagctggttaaggagtcacagctgtctatgctgcagctgtccacaattgaggtagcaacccagctgtctatgagggattttgacctgtttagaaacatagagcctaccgagtatatcgacgatctttttaagttgaacagtaaaacgggcaacactcatctaaaacgttttgaggatatcgtgaatcaggagacattttgggtggcttctgagatcttaactgaggctaaccagcttaaaaggatgaagattattaaacacttcattaagatcgctcttcattgccgggagtgtaagaacttcaatagtatgtttgcaataatctccggcctgaacttagcatctgtggcaagactacgagggacatgggagaagttaccttccaagtacgagaagcacctccaagacctccaggatatttttgaccccagccgtaatatggccaagtaccgaaatatcctgagctcacagtcaatgcagcccccaattatcccgctttttcctgtggtcaagaaagatatgacgtttctccatgaaggtaacgactctaaggtagatggactcgtcaattttgagaagctgagaatgatttctaaagaaatccgccaggtagtgcgtatgaccagcgcaaatatggatcccgcaatgatgttcaggcagaggaaaaaaagatggaggtccctcgggagcctcagtcagggcagcaccaattcgaatatgctcgacgtgcagggcggagcccacaagaagcgcgctcggaggagtagtctgctgaacgctaaaaagctgtacgaagacgctcagatggccagaaaggtgaaacagtatctttcatcactagatgtggaaacggacgaagaaaaatttcagatgatgtcacttcagtgggaacccgcatacgggactcttaccaagaacctgagcgagaaacggtctgctaaaagcagcgaaatgagtcccgtccctatgcggtccgctggtcagacgacgaaagctcaccttcaccaaccacacagagtgtcccaggtgctgcaggtccctgccgtcaatctgcacccaattcgaaagaagggtcagacaaaagatcccgctctcaacacttctctgcctcagaaagtgctgggcactacggaggagatcagtgggaaaaagcacactgaggacaccatttccgttgccagctcactgcatagcagtcctcccgcatcgccccagggctcaccccacaagggttatacccttatcccttccgccaaaagcgacaatctctcagactcttcccactctgaaatctcgagtagatcttccattgtgtctaattgctcagtggactccatgagcgccgctttgcaggacgagagatgcagttcgcaggccctcgctgtgcctgaaagtactggcgcattggagaaaacagagcacgcttcagggatcggggatcacagtcaacacggcccaggatggactctactcaaaccaagccttatcaagtgcctggccgtatcctcatctgtaagcaatgaggagattagtcaggagcacatcatcatcgaggcagccgattccggccgagggtcctggacaagctgttcctccagctctcatgacaactttcagtccttaccgaatccaaagagctgggactttctaaattcctataggcacacacacctggacgaccccatcgccgaagtggagccaactgactctgaaccctacagttgtagtaagagctgctcccgcacctgcggccagtgtaaaggtagcctcgagcgcaaaagctggacatcatcgtcgtctctgagcgacacatatgaacccaattacggtaccgtgaaacagcgcgttctggagtctacaccagcagagagctccgaagggctggacccgaaagacgcaaccgatccggtctacaaaacagtgaccagctctaccgaaaagggccttattgaaaatgagcaagtatccgctgtgtag

SEQ ID NO: 237927 - DNA, 4530 bp, Artificial Sequence
  Description of Artificial Sequence: Synthetic coding sequence
atgaacagccccgtggaccctggggctaggcaagccctcagaaagaaaccccctgaacggacccctgaagacctcaatacaatctattcctatttgcacggaatggaaatcttgtctaacctgagggagcaccaactgcgactgatgagcgcacgggcacggtacgagaggtattcagggaaccaggtgcttttttgctctgagacaatcgccaggtgctggtacatcctgttatcggggagtgttctcgtgaaggggtccatggtcctccctccttgctccttcgggaagcagtttggtggcaaaagaggctgtgactgcctggtgctcgagcccagcgaaatgatcgtggtagagaacgcaaaggataatgaagattcaatactccaacgcgagatcccggctcgccagagccgcagacgattccgcaagatcaactataaaggagagcggcagaccattactgacgacgtcgaagtgaattcctacctgagtctgcctgcagatctgactaagatgcacctcaccgagaatccccaccctcaagtgacacatgtttcaagctctcagagcgggtgttctattgctagcgactctggttcgagctctctctccgacatctaccaagccaccgagagcgaggtgggagatgtagacctaaccagactcccagagggtcctgtcgactctgaagacgacgaggaagaagacgaggagatagacaggactgatcctctacagggcagagacctggtgcgtgaatgtctcgaaaaggaaccagcggacaagactgacgatgatattgaacagcttctggaattcatgcatcagctgccagccttcgcaaacatgacgatgtcagttcggagagagctgtgcagcgtcatgatttttgaggtggtggagcaggccggagctatcatcctggaggacggtcaagaattggatagctggtatgtgattctcaacggaactgtagaaatctctcaccccgacgggaaggtggagaacctctttatgggtaactctttcggcatcacacctactctggataagcagtacatgcacggaatcgtaagaaccaaggtagacgattgtcagtttgtatgcattgcccagcaggattactggcgcatccttaatcacgtggagaagaatactcacaaggttgaagaagaaggagaaatagttatggtgcacgaacaccgcgagctcgacagaagtggaacgcgaaaaggccatattgttattaaagctacccccgagcgcttgattatgcacctcatcgaggagcactctattgtcgatcctacatacattgaagatttcctgttaacttacagaaccttccttgagagccccctcgatgttggcataaaactcctagagtggttcaagatcgactcccttagggataaggtcacccggatcgttttgctttgggtgaacaatcattttaacgatttcgaaggtgatccggcaatgactcgctttctggaagaatttgaaaaaaacctagaagacaccaagatgaacggacatttgcgactgcttaatatagcatgtgctgctaaagctaagtggcggcaggtggtcctgcagaaagcttcaagggaaagtcccctgcagttttctctaaatggcggatccgaaaaggggttcggcatatttgttgaaggggtcgaacctggttcgaaggctgcagacagtgggcttaagcggggagaccagatcatggaggtcaatggccagaattttgagaatatcacatttatgaaagctgtggaaatcttgaggaataacactcacctcgcactgactgtgaagaccaatatcttcgtcttcaaagagctactgtttagaactgagcaggagaaaagcggggtaccccacatacctaaaatagccgaaaagaagtcaaatcggcatagcatccagcatgtgcctggggatatcgaacagacctcccaggaaaagggctctaaaaaggtgaaggcgaacactgtcagtggcggacgtaataagatcaggaagatcctggataaaacgagattctcgatcctaccaccaaaactgttctcggatggaggactgtcgcagagtcaagatgattcgatagtcggcaccaggcattgtaggcacagtctcgccattatgcccatccccggaactctgtcctcaagcagcccagacctgttgcaacctacgaccagcatgcttgatttttccaatccaagcgccaagggtttcaaaaatatacctgatcaggtaatcagggtgtttaaagtggaccagcagtcatgttacataattattagtaaggatactacagcgaaagaggtggtcttccatgcagtgcacgagttcgggctgaccggcgcttctgacacatactcactttgtgaggtctcggtgacacctgagggcgtgatcaagcagcgcaggttgcctgaccagttcagtaagctggccgatcggattcaactgaacggacgctattacctgaaaaacaatatggaaacagagactttatgttccgacgaggacgctcaggagcttgttaaagaaagtcagctcagcatgttgcagctgtcgacaattgaagttgcaacccagctgagcatgagagattttgatttgttcaggaatatcgaaccaaccgaatatattgatgatctatttaagcttaacagtaagacaggcaacacacatctaaaacgctttgaagacatagtgaatcaggagaccttctgggtagctagcgaaattctcaccgaggccaaccagcttaagcggatgaaaattattaagcacttcatcaagattgcccttcactgccgggaatgtaagaatttcaattccatgttcgctattattagcggcctgaatcttgcctccgtagccaggctacggggaacctgggaaaagttaccatccaaatatgagaagcatttgcaggatctgcaggacattttcgatccttcccgcaacatggctaaatacagaaatattctgagcagccagtcaatgcagcccccaatcatccctctctttcctgtggtgaaaaaggatatgacattcctgcatgagggaaatgattcaaaagtggacggactggtgaactttgagaagctgagaatgatctcaaaagaaattagacaggtggtacggatgacttccgccaatatggatcccgctatgatgtttcgacaacgcaaaaaacgctggcggtccctgggttctctcagccaggggtcaacaaatagtaacatgcttgacgtgcagggaggtgcgcataaaaaaagggctagacggtcttccttgctgaacgccaagaaactgtatgaagatgcccagatggcgaggaaggtgaagcagtatttgtcttcactcgatgtggaaacggatgaagaaaaattccagatgatgtccctccaatgggagcctgcctatggtacattgaccaagaatttgtctgaaaaaagatcagctaagtcatcagagatgtcacctgttcccatgcggtccgccggacagactaccaaggctcatctgcaccaaccacacagggtgtcacaggtccttcaggtaccagccgtcaacctccatcctataagaaagaaagggcaaactaaggatccagcgctcaatacctctctcccccaaaaagtccttgggacaacagaggagattagtggcaagaagcataccgaggatacaatctccgtcgcctcttctctacactcctcgccgccagcttcgccccaaggttcccctcataaaggatatactcttattccaagcgctaagtccgacaatctttccgactccagccactccgaaattagttcccggtcatccatcgttagcaactgttctgtggacagcatgtccgcagccttgcaggatgaacgatgtagtagccaggcacttgccgttccggagagcaccggagccctggagaagacagaacacgccagtggaatcggagatcacagccagcacgggccaggctggaccttgctgaagccttcactaataaaatgtctcgccgtgtcctctagcgtaagcaatgaagagatatcccaggagcacatcataatagaagcagccgattcaggcaggggttcttggacctcctgcagctcgagcagccacgacaactttcagtcgctaccaaaccccaagtcctgggactttctgaattcttaccggcatacgcacctcgacgatcctattgctgaagtcgagcccaccgattccgagccatatagctgcagcaagtcttgttctaggacatgtggacagtgtaaagggtcgctggaaagaaaatcctggaccagtagttcttcactgtccgacacatatgaaccaaattacggaaccgtgaagcagcgtgtactcgagtcaacacccgcagagtccagtgagggtctcgatccaaaagacgctactgatcccgtgtacaaaacagttacctctagtaccgagaaaggcttaatcggcaagaagcagaccagctatttctag

SEQ ID NO: 237928 - DNA, 4515 bp, Artificial Sequence
  Description of Artificial Sequence: Synthetic coding sequence
atgaatagccccgtcgaccccggagcaagacaagctcttcggaagaaaccacctgagaggacccccgaagatctgaatacgatctactcctaccttcatggcatggaaatcttaagtaatctccgagagcaccagctgcggttgatgagtgcccgagctagatacgaacggtactcggggaatcaggtcctcttctgctccgaaactatcgccagatgttggtatattcttttaagcgggtcagtactggtaaaagggagtatggttctgcccccatgttcttttgggaagcaattcgggggaaagagggggtgcgattgcctggttttggagccgagtgaaatgattgttgtggagaacgctaaggataacgaagactccatcctgcaaagagaaatccccgcaagacaaagccgaaggaggttccgtaagatcaattacaaaggagagcgtcaaacaataaccgatgatgtagaagtcaattcgtatctgagtctgcccgcagacctgaccaaaatgcacctcacagaaaaccctcacccccaggtgacacacgtttccagcagtcagtccgggtgctccatcgcttccgattctggatcctctagtttatccgacatttatcaggccaccgagagtgaagtaggcgatgtggatttaacacggctgcctgagggacccgtggattccgaggatgacgaggaggaggacgaagaaatagatcgcactgacccgcttcagggccgagacctggtgagagaatgcctcgaaaaagaaccggcagacaaaacagacgacgatattgagcagctgctcgagttcatgcaccagctcccagccttcgccaatatgaccatgagcgtgcgcagagaactctgcagtgtgatgatatttgaagtcgtagagcaggcgggtgccatcatcctggaagatggccaggagctcgatagctggtatgtcattctgaacggtactgtggaaattagtcaccctgacggcaaggttgagaacctattcatggggaatagtttcgggattacaccgacactggataaacagtacatgcacggcatcgtgagaaccaaggtggacgactgtcaatttgtttgcatcgcacagcaagattattggagaattttgaatcatgttgaaaaaaacacacacaaagtggaagaagagggggaaatagtgatggtacatgaacaccgcgaactagataggtcaggcacacggaagggtcacattgtcattaaggcaactcccgagcgtctcatcatgcatttgattgaggagcatagtatcgttgatccaacttatatagaggatttcttgttgacatatagaacattcttagaaagccctctcgacgtgggcataaagttgctggaatggttcaaaatcgattcattgcgggacaaggttacccgcatcgttcttctgtgggtgaataaccattttaacgattttgagggcgatccagcaatgactcgattcctggaagagtttgagaagaatttggaggacacaaagatgaatggccatctgaggctgctgaacatagcttgcgccgcaaaagcaaagtggagacaagtagttttgcagaaagcgtcgcgtgaatcacctctgcagttctccctgaacggtgggtctgagaagggcttcgggatattcgtcgagggtgtcgaacctggcagtaaggccgctgacagcggcctcaaaaggggcgaccagatcatggaagtgaatggccagaacttcgagaacattacatttatgaaagccgtagagattctgagaaataacactcatctcgcccttactgtaaagaccaatatttttgtcttcaaagaactcctgttcagaacagagcaggagaagagcggagtgccccatatcccgaagattgccgagaaaaagagtaaccggcattccatccagcatgtgcctggggacatcgaacagacctcccaggagaaggggagcaagaaggtaaaagcaaacaccgtttccggcggacgcaacaagattcgcaagattctggacaaaacgagattttcgatactcccaccaaagctgttctcagatggtgggttgtcccagtcccaggatgactccatagtggggaccagacactgccgccatagtctcgctatcatgcctatcccgggaaccctctcttcatcatccccagatctgcttcagcccactacctcgatgctggatttctcaaacccaagcgatattcccgaccaggtaatccgagttttcaaagtagaccagcagtcttgctacataattatctctaaagatacaacagcaaaagaagtggtgtttcacgctgtgcatgagttcgggctgactggcgcaagcgacacgtatagcctttgcgaggtctccgtaacgccagaaggcgtaataaagcaacggagactaccagatcagttcagcaagttagctgacaggatccaactgaatgggcgttactatctgaaaaacaacatggagacggagacactgtgctccgacgaagatgcccaggaactcgtgaaggagagccagctgtctatgttgcagctgtccaccatcgaggttgctacacagctttccatgcgcgatttcgatctgttcagaaatattgagccaaccgagtatattgacgacctgttcaagctcaattctaaaacaggcaacacccacctgaagagattcgaggacattgtgaatcaggaaacgttctgggtggcatccgaaattttaactgaggcgaaccaacttaagagaatgaaaatcataaagcacttcatcaagatcgcgttacactgtcgggaatgcaagaacttcaactcaatgtttgcgataatctcaggcctgaacctcgcctcagtcgctagacttaggggcacttgggaaaaactgcctagcaagtacgaaaaacatctccaggacctccaggatattttcgatccatcaaggaacatggctaaataccgaaacattctgagcagccagagcatgcaacccccaattatcccactttttccagtagtgaagaaagacatgacatttctgcacgagggaaatgattccaaggtggacggattggtcaacttcgaaaaactgcggatgatctctaaagagatccgccaggtggtcaggatgaccagcgccaacatggaccccgcaatgatgttccgccagaggaaaaagcgttggcggtcactggggtcattgagtcagggatccacgaattctaatatgctggatgtgcaaggcggtgctcataagaagagagcaagacgctctagcctgttaaatgccaagaagctctacgaagacgcccagatggcaagaaaggttaagcaatacttgagtagccttgatgtggaaaccgatgaagaaaagtttcagatgatgagtttgcaatgggaacccgcatatggcactctcactaaaaatctgagtgaaaagcggtcggccaagagttcagaaatgagcccggtgccaatgcggtctgcaggtcagaccacgaaggctcatttgcaccagcctcatagggtgtcacaagtattgcaggtgccagccgtgaacctgcatcccatccggaagaagggccagactaaagatcccgcactgaacactagcctgccccaaaaggttctgggcacaacagaggaaattagcggtaaaaagcatacagaggacactatcagtgtagccagttcacttcactctagcccacccgcaagccctcagggctccccacataaggggtacacgctcatcccctcagcaaagagcgacaacctgtccgactcatcccacagtgaaatcagcagccggagcagcattgtatccaattgttcagtagactccatgagcgcggcattgcaggatgagaggtgcagcagccaggctctggcagtgcccgaatcaacaggcgctcttgaaaagacagaacacgcaagcggcattggcgaccattcacagcatggaccaggatggaccttattgaaaccctcactaatcaagtgcctcgctgtgtcaagtagtgtcagtaatgaagaaattagtcaggagcatatcatcatcgaggctgctgactccgggaggggaagttggacctcctgcagttccagcagtcatgataattttcaatccttgcccaaccccaaatcatgggacttccttaattcctataggcacacccatctggacgatcccattgccgaggtggaaccgaccgattctgagccttatagctgctctaagtcatgttctcgcacgtgcggtcagtgtaagggatccctcgagaggaaatcatggaccagcagctcctctctgtcagatacatacgaacccaactacggcactgtaaagcaacgcgtgcttgaaagcacccccgctgagtcgtctgagggtctggatccaaaagatgcaactgatccagtgtataaaacggtgactagcagcactgaaaagggactgattgaaaacgaacaggtgagcgccgtttag

SEQ ID NO: 237929 - DNA, 4805 bp, Artificial Sequence
  Description of Artificial Sequence: Synthetic coding sequence
atgaattctcccgtggatcctggtgctcgacaggccttgcgcaagaagcctccagaaagaacccccgaagacctgaataccatttactcctacctacacggtatggaaattctctccaacctcagagagcaccagcttcgactgatgtctgccagagcaaggtatgagcggtactctggaaaccaagttctattctgtagcgagaccattgcacgatgctggtatatcctcttgtccggaagcgtactggtcaaagggtccatggtgctgcctccctgcagtttcggcaagcaattcggcggaaagcggggatgtgactgtctggttctggagccctctgaaatgatcgtcgttgagaacgccaaggacaatgaagatagcatcctgcagcgagaaatccccgctcgccagagcaggaggaggttccgtaaaatcaactacaagggagagcgccaaacgatcaccgatgacgtcgaagttaattcttatttgtctttacctgccgacttgaccaagatgcaccttaccgagaaccctcacccacaagtgactcatgtttccagctcacaatcgggttgtagtattgcgtccgattccggatcatcctcactgagtgatatctatcaggcaactgagtctgaggtgggcgacgtggacctgacacggctgccagagggcccagtggattctgaggatgatgaggaggaagacgaggagatcgatcgaacggatccattacagggcagggatctggtacgggagtgcctggagaaagaacctgccgacaaaacagacgacgatatagaacagttgctggaattcatgcatcagctgcctgctttcgccaacatgacaatgagtgttcggagagagctctgctcagtgatgattttcgaagtagtggaacaggccggtgccatcatactggaggacggacaggagctggactcttggtatgtcattctcaatggtacggtagagatctcccatcctgacgggaaagtcgagaatctcttcatgggtaattcattcggaatcacccccaccttggataaacagtatatgcacggcatagtccgcaccaaagtagacgattgtcaatttgtatgtatcgctcagcaggattactggcgcatcctgaatcacgtcgagaagaacacccacaaggtggaagaggagggagaaatagtgatggtccacgaacatcgggagctggaccggagtgggaccaggaaaggtcacattgtgatcaaagcaaccccagaaaggttgattatgcaccttatcgaggagcatagtatcgtcgatccaacatatatcgaggacttcttgcttacctaccgaaccttcctcgaatcccctctggatgtgggtattaaactccttgaatggttcaaaatcgactcactcagagataaggtaactaggatcgtgcttctatgggtaaacaaccactttaacgatttcgagggcgacccggcaatgacccgattcctcgaggagtttgaaaaaaatctagaagacaccaagatgaacggtcaccttcggctgcttaacatcgcatgcgcggctaaagctaagtggcgccaagtcgtgcttcaaaaggcctcacgagagtcacccctgcagttctcactgaatggtggatccgagaaaggtttcggaatttttgtggagggtgtggaacccggttcgaaagctgctgatagcggcctgaagcgaggagatcagattatggaggtgaatggccaaaattttgagaacataacctttatgaaagcagttgagattttgcgcaacaatacgcacctggctctgaccgtgaaaacaaatatattcgtctttaaggaattgctgttcaggaccgagcaagaaaaatccggagtgccccatatacctaagattgctgagaaaaagtccaatagacactcaattcagcatgtgcctggtgacattgagcagaccagccaggagaaagggtctaagaaggtaaaagcaaacactgtgtcggggggaaggaacaagatccgtaagatcttggacaaaacaagattcagtatcttgcctccaaagctgtttagcgatggtggtctgtcccagagccaggatgattcaattgtaggcacgagacattgccggcatagtctagcgattatgcctattcccggtacgcttagttcgtcgagtcctgatctactgcagcccacgacctccatgctggacttctctaacccctccgacattcccgatcaggtgattcgcgtgtttaaagtcgatcagcagtcttgttacatcattattagcaaagataccaccgctaaggaggttgtttttcatgccgtccacgaattcggcctgacgggcgcatccgatacctactccctgtgtgaggtcagcgtgacgcctgagggggtaatcaagcagcgcaggttgcctgaccaattttccaagctcgctgatcggattcaactcaacggacgttattacctgaagaacaatatggagacggaaaccttgtgctctgacgaggacgctcaggaactggtcaaagaatcccaactatcaatgctgcagctgagtaccatcgaggtcgcgacccagctgtcgatgcgggatttcgacctgtttagaaatattgaacctaccgagtatatcgacgacctatttaaacttaactccaagaccggcaacacacacctaaaaagatttgaggatattgtgaatcaggaaactttttgggtcgcttcggaaatcttaaccgaagcaaatcaactgaaacgcatgaaaataattaagcattttattaaaatcgctctgcattgccgggaatgcaagaactttaattcgatgtttgctataattagcggattgaatttggcatctgtagctagactgcgcggaacctgggaaaagctgccaagcaaatatgagaagcatctgcaagacctacaggatatcttcgacccatcccgcaatatggcaaagtaccgaaacatcctgtcatcgcaaagcatgcagccacccattatccccctgtttccggtcgtcaagaaggacatgactttcttgcacgaaggtaatgactccaaggtggatggtctcgtgaacttcgagaaacttcgtatgatctccaaggagattaggcaggtggtccgaatgacaagcgcaaatatggaccctgcaatgatgtttcggcaaagatcgctgagccagggctctacaaattcgaacatgctggacgtgcaggggggagcccataaaaaacgagcgcgacgcagttccctccttaacgctaaaaagctgtatgaagacgcccagatggctcgcaaggtgaagcagtacttatcctcccttgatgtcgagaccgatgaggaaaagtttcagatgatgtctctccagtgggagcctgcgtacgggaccctgaccaagaacttgtccgaaaaaagaagcgcaaagtcgtctgagatgtcaccagttccaatgcggtctgcagggcagaccacaaaagcacacctacaccagccccatagggtatcacaggtactccaggtgcccgctgtgaatctgcacccgattagaaaaaagggacaaactaaagaccctgctctgaacacatctttgcctcagaaggttctgggcacaactgaagaaatctcgggcaagaaacacactgaggatacgatttctgtggcatctagccttcactctagtcctcccgctagcccacagggaagcccccacaaaggctacacattgatcccttccgcaaagtccgataatctgagcgacagttcgcactccgaaatttccagcagatccagtattgtgtccaattgtagtgtggactctatgtccgctgcacttcaggacgaacgctgttccagccaggcactcgccgttcccgaatctaccggtgccctggaaaaaactgagcatgccagcggcattggcgatcactcccagcatggccctggctggacattgctcaagcccagccttattaagtgtctggccgtgtcatcgtctgtgagcaatgaggaaattagtcaagagcatattataatagaggccgctgatagcgggcgtgggagctggacctcctgctcatcttcttcacatgacaacttccagtcactccccaaccctaaaagttgggatttcctaaatagctatcgacacacccatttggacgacccgattgccgaagtagagcctactgactctgaaccatatagttgctccaaatcttgctctcgtacttgcggacagtgtaaaggatcgctggagaggaaatcttggacatctagctcctctctgtctgacacgtacgaaccgaactatggtaccgtgaaacagagagtcttagaatctactcccgcagaatcttctgaaggcctggacccaaaagacgctaccgaccctgtatacaagacagttaccagctccacagagaagggactcatcgtatactgtgtcacctccccgaagaaggacgatcgctacagagaacccccaccaacacctcccggttacctaggcataagcctggcagacctgaaagagggcccacatacacacctcaagccaccagattacagcgtggcagtgcagcggtctaaaatgatgcataattcgctcagccgtttacccccagcctccctgagcagcaatctggtagcgtgtgtcccttccaaaattgtaacacagcctcaacgacataacctgcagccatttcatccaaagctgggagacgtgaccgacgcagacagcgaggcagatgagaacgagcaggtttcagcagttta

SEQ ID NO: 237930 - DNA, 3615 bp, Artificial Sequence
  Description of Artificial Sequence: Synthetic coding sequence
atgaatagccctgttgaccccggagccagacaggccctgaggaagaagccaccagagcggacccccgaggacctgaacacgatctatagctacctgcacgggatggagatcctgagtaatttgcgcgaacaccagctaaggctgatgtcagcccgtgcgagatacgagcggtactcagggaaccaggtgctgttttgcagcgaaactatcgctcggtgctggtacatcctgctgtctggttccgtactggtaaaaggatccatggtgctgcccccatgttccttcggaaaacagttcggagggaaacgaggctgtgactgtctggtgctggagccctccgagatgatcgttgtagagaatgccaaagataacgaagatagcatcctccaacgagaaatcccagccaggcagagccggagaaggtttagaaaaatcaattataaaggggagcggcaaacaattactgatgatgtggaggtgaattcatacctgtcccttcctgccgacctgaccaagatgcatttgacggaaaatccacatccccaggtaacgcatgtgagttccagccaatccggctgtagtattgcctccgattcaggctcctcgagtctgtcagacatctatcaggctactgagtctgaggtaggcgatgtcgaccttaccagactgcctgaaggccctgtggatagcgaagacgacgaagaagaagacgaggaaatcgataggacagatccacttcaaggccgagacctggtgcgggagtgtctggaaaaagaacctgcagataagaccgacgatgacattgagcaactactggagtttatgcaccagcttccagcctttgccaacatgacaatgagcgtacgtcgagagctctgctccgtcatgatctttgaagttgtggagcaagcaggagccataatattagaagacggacaggaattagatagctggtatgttatcctgaatggcacagttgagatttcccaccctgatggaaaagtggagaacttgtttatgggaaatagtttcggcattactcccacattggataagcagtatatgcacggcatagtgcgaactaaggtagatgactgccagtttgtgtgcatcgctcagcaggactactggagaatcctgaatcatgtggaaaaaaatacccataaggtcgaggaggagggtgagatcgtaatggtacatgagcaccgagagctggaccggagtggcactcgcaaggggcacatcgtgatcaaggccacaccagagagactgatcatgcacttgatcgaggaacattctattgttgaccccacctatatcgaagatttcttgctgacatacaggacctttttggagtctcccctggacgtggggatcaagctgcttgagtggttcaagatcgattctctgcgggacaaggtgacccgcatcgtgctgttatgggtaaacaaccactttaatgacttcgaaggcgacccggctatgacacgattcctcgaggaattcgagaaaaacctcgaagatactaagatgaatggacacttgagactgctaaacatcgcatgcgctgcaaaagctaaatggagacaggtcgtgctgcagaaagcctcaagagagtcgccactccagttttctctgaatgggggaagcgagaaaggcttcggcatttttgttgagggggtcgaacccggaagcaaggccgctgattctggactgaagcggggtgatcagatcatggaggtcaatggacagaattttgaaaacataactttcatgaaggcagtggaaatcctacgaaataatactcatctggctttgacggtcaaaactaatattttcgtttttaaggaactactttttagaacagaacaagagaaaagcggagtgccccacatccccaaaatcgccgaaaagaaaagcaacaggcattcgatccaacacgtccctggggacattgagcagacaagccaggaaaaggggtcaaagaaggtgaaagccaacactgtgtctggaggccgaaacaagatccggaagatcctggacaagacaagatttagtatcctgcccccaaagttgttcagcgacggtggcttgagtcagtcccaagatgactcaattgtgggaaccagacattgtcgccatagtctcgccatcatgcccatcccgggtactctgtccagcagctccccagatttgttgcagcctacaacgtccatgctggatttcagcaacccctctgacatccctgaccaagtgatcagagtgttcaaggtggaccagcagagctgctatatcatcattagtaaagatacaactgcaaaggaagtagtgttccatgcagtccacgagtttggattaactggtgcctctgatacctatagcctgtgtgaagtgtctgtgacccccgagggggtgataaagcagaggaggcttcctgaccagtttagtaaactggccgaccggattcagcttaacggcagatattatctcaagaataacatggagactgagaccctctgtagtgatgaggatgcccaggaattagtgaaagagtcacagctgtcaatgctgcagctgtccacaattgaggttgcaactcaactgtcaatgagagacttcgatctgttccggaatatagaacccaccgaatacattgatgacctgtttaagcttaactccaaaacggggaacacacacttgaagcgcttcgaggatatcgtgaaccaggagacgttctgggtggcttccgagattctcactgaggctaaccagctaaaaaggatgaaaatcattaaacattttatcaaaatagctctgcactgtagggaatgtaagaacttcaacagcatgttcgcgataatctccggcttgaacctagctagtgtggctaggctgagaggaacatgggagaagctcccttctaaatacgaaaagcacttgcaggacctacaggatatcttcgacccatctagaaatatggcaaagtacaggaacattctgtccagccaatccatgcagccgccaatcatacctcttttcccagttgtgaagaaggacatgacctttctccatgagggtaatgactcaaaggttgacgggctcgtgaactttgaaaaattgcgcatgatcagtaaggagatccggcaggtggtacgaatgacatcggccaacatggatccagcgatgatgtttcgacaacggagtctctcgcagggctcaacgaactctaacatgttggatgtgcagggaggcgcacacaagaaaagggcccgaaggagtagcctgctcaatgcgaagaagctgtacgaggacgcccagatggctcggaaggtgaagcagtacctcagtagcctggatgtggaaacagacgaggagaagttccagatgatgtcattgcagtgggagcctgcgtacggcaccctgaccaagaatctgtcagagaaaaggtcagcaaaaagcagcgaaatgtcacccgtaccgatgagatcagctggtcagacaactaaggcccatctgcatcagccccatagagtttcccaagtcctgcaagtgcctgcagttaatctccaccctataaggaaaaagggccaaacaaaggatcccgctctgatgtag

SEQ ID NO: 237931 - DNA, 4176 bp, Artificial Sequence
  Description of Artificial Sequence: Synthetic coding sequence
atgaactcacccgtggaccccggagctaggcaagccctcaggaagaagcctccagagaggactcctgaggaccttaacactatttactcctacttgcatggcatggaaattctgtctaatctgagagagcaccaactgagactgatgtccgccagagcgcgttatgaaagatatagcggaaatcaggtcctgttttgtagcgaaacaatcgcacgatgctggtacattctactgtccggatccgtgttggtaaagggcagtatggtccttcccccatgttctttcggcaaacagttcggaggcaagcgcggatgtgattgtttagtgttggagccctctgaaatgatcgtggtggaaaatgctaaggacaacgaggactcaattctgcagcgggagattcctgcacgacagtcccggaggcggtttcggaaaatcaactataaaggtgaaaggcagactattacggacgatgtcgaagtcaactcttatctcagtctgcctgcggatttgactaagatgcacctgacagagaatccccatccgcaggtgacgcatgtgtcgtccagtcagtccgggtgtagtattgcatccgacagtggttcctcatccctttctgacatctaccaagccacagaaagcgaggtgggtgacgtggatctcacacggttgcccgaaggacctgtcgactctgaggacgacgaagaggaggatgaggaaattgatcgtacggatcccctgcagggaagagacctcgtgcgcgaatgcctcgagaaagaacccgctgacaagaccgacgacgacattgaacagcttcttgagtttatgcaccagctcccagcctttgctaacatgacgatgagtgtccgacgagagctgtgctccgtcatgatattcgaggtcgtagagcaggccggagcgataatcttggaagacggccaggagctggacagctggtatgttatccttaacggcacagttgagattagccaccctgatggaaaagtggaaaacctctttatgggcaactcctttggtatcacacctacactggacaaacaatacatgcatgggatcgttagaacaaaggttgacgattgtcagttcgtgtgcatcgcccagcaagactactggcgcatcctgaaccatgtcgagaagaacactcataaggtggaagaggagggggaaattgtcatggtccacgaacaccgcgagctggacaggtcgggaaccagaaaaggccacatagttattaaagctactcccgagcgcctaatcatgcacctgatcgaggaacatagcatcgttgatccaacttacatcgaagatttcctgctgacttaccgaactttccttgagtccccattggatgtaggtatcaagctgctggagtggttcaagattgattccttgcgagacaaggtgaccagaattgtgctgctatgggtgaataatcatttcaacgactttgagggtgaccccgctatgacccgcttcctggaagagttcgagaagaacctggaagatactaaaatgaacggccacctgcgcctgctaaatatcgcctgcgcagctaaggctaaatggcggcaagtcgtcctccagaaggcttctagagagtcacctttgcagttttccctcaacggtgggagtgagaaggggtttggaatatttgttgagggtgtggagccaggctcaaaagcagccgactccgggctcaaacgaggagatcagataatggaagttaatggacagaattttgagaacataacgtttatgaaagcagtagaaatcctgagaaacaatacccatctggctctgaccgtgaagactaatatattcgtattcaaggaattgcttttccgtaccgagcaggaaaagagcggggtccctcatatcccaaagatcgcagagaaaaaatcaaaccggcacagtatccagcatgtgcccggagacatcgagcagacctctcaggaaaagggctccaagaaagtcaaggccaatactgtttccggcggaaggaacaagatccgcaaaatcctggataaaactcgtttcagcattcttccacccaagctgttttctgatggtgggttaagccagtctcaagacgactccattgtcggtaccaggcattgtcggcactcactggcaatcatgccgatacccggaactcttagctctagttccccagacctcctgcagcctactactagcatgctcgacttcagtaatccttctgatattccggaccaggtcatcagagtttttaaagtggatcagcagagctgttacatcatcatttcaaaggacaccaccgccaaggaagttgtctttcatgccgtgcatgaattcggactcaccggtgcatccgatacatattctctgtgcgaggtgagtgtgacccccgagggtgttatcaagcagcgtagactcccggaccagtttagcaagttagctgataggatccagctgaacggtaggtattatctcaagaacaacatggaaacggagactctgtgttctgatgaagacgcccaggagttggtgaaagagagtcagcttagtatgttgcagttgtccacaatcgaggtcgctactcagctgtcaatgagagattttgacctttttagaaatatagagcccactgagtatatcgacgacctctttaaactaaacagcaagactggcaacacccatcttaaaagatttgaggacattgtcaaccaggagactttttgggtggcatctgaaattctgaccgaagccaaccagctgaaaagaatgaagatcatcaagcacttcatcaagattgcattacactgccgggagtgcaagaattttaatagcatgttcgctatcatctccggactcaatctggcttctgttgctagactgcgcggtacttgggaaaaacttccctccaagtatgagaaacatttgcaagacctccaagacattttcgacccctctcggaatatggccaaataccgcaacatcctgtcatctcagtccatgcagccacccattatccctctcttccctgttgtgaaaaaggatatgacttttcttcatgaaggaaatgactctaaagtggacggcctcgtgaactttgaaaagctgagaatgatctccaaggagatccggcaagtggtgcgaatgacctctgctaacatggacccggcaatgatgttcagacagcgctcacttagccagggctctaccaactccaacatgctggatgtgcagggcggtgcgcacaaaaaacgggcaagaagatccagtctactgaatgctaaaaagctgtatgaggatgcacaaatggctcggaaagtgaagcaatatctgtcatcactagatgtggagacggacgaggagaaatttcagatgatgtccttacagtgggagccagcctatggcacactgaccaagaacctgtctgagaagaggtctgcaaaatcttctgagatgagtcctgttcccatgcgatccgccggtcaaacaactaaagcccacctccaccagccacacagagtgtcacaggttctgcaggtgcctgccgttaacctacaccccatcaggaagaagggacagacaaaggacccggctctgaacacatcgctaccacagaaggtgctcgggaccacagaggaaatctcaggaaaaaagcacacggaggacaccattagtgtcgctagttctttgcactcaagcccccctgctagcccacagggatccccccataaagtagggtcaattattagtgaccacagctcaaagatttcgggccagagttgcccaggaatcggcggtgcctatctccagaagaaaattctccaaatcactcgcagtaccgccaagcggaccgattccaccgaaaaagccactgaagagaaccgcgaccgcacaagttgtgagaacacaacccgcaagcgaatgaccagccccttccggagactcagagaaaggatgctttcccgggagcggctggtgaacagccagaaggaggataccgatcacaaccaggcaacagagtcttgcgagaaggtgaaagacgtcggatctaacattaaggacgagaaaggatcagcaatcttcaatagtaattcccaggggaatagcaacacccttaattgtttttatacacgcttcaagagtaaaagacgcaagactttgtag

SEQ ID NO: 237932 - DNA, 2484 bp, Artificial Sequence
  Description of Artificial Sequence: Synthetic coding sequence
atgaacagtccagtggacccaggcgctagacaggcactgaggaaaaagcctccggaaagaactcccgaggacctgaataccatctactcatatctgcacgggatggaaatcctgtcaaacctgcgagaacatcagctgcggctgatgtccgccagagcccgatacgaaagatacagcgggaatcaagtgcttttctgctccgagaccattgctaggtgttggtacatcctgctgagcggctctgtgttagtgaagggttctatggtgctccctccttgtagtttcggcaagcagtttggcggaaaacggggttgtgactgcttggttctggagcctagcgaaatgatcgtggttgagaacgctaaagacaacgaggacagcatactccaaagagagatccccgcacgccagtccaggagacggtttcgcaagattaactataagggtgaacggcaaaccattactgatgacgtggaggttaattcctacctgagcctgccagcagacctgactaagatgcacctgactgagaaccctcacccgcaggtgacgcatgtgtcttcctcccagagcggatgttccatcgccagcgactccggctccagctctctgtccgacatctatcaggctacagagtctgaggtgggcgacgttgacttgaccagactccctgagggccctgtagacagcgaagacgacgaggaagaggatgaggaaatcgaccgcacagatcctctgcagggaagggatttggtgcgggaatgcctcgagaaggagcccgctgataagacggatgacgacatcgagcagcttctcgagtttatgcaccagttaccagcctttgctaatatgactatgtcggttcgcagggagttgtgcagcgtgatgatcttcgaggtcgttgaacaggcaggtgccatcattctggaggacggacaggaactcgatagttggtacgtcatactaaatggcacggtagagataagccatcccgatgggaaggtggaaaatctgttcatgggcaattctttcggcatcacgcctactttagacaaacaatacatgcacggcattgtgcggaccaaggtggacgattgtcagtttgtctgtattgcccagcaagattactggaggattcttaatcacgtggaaaaaaacacccataaagtcgaagaggaaggtgagattgttatggtgcacgagcaccgcgagctggaccgctcaggcactagaaagggccacatagtgatcaaagccaccccagagaggcttattatgcacttgatagaagagcatagtatcgtagatccgacctatatcgaagatttcttgctgacgtacagaacttttttggaatctcctctggacgtgggaatcaaattgctggaatggtttaaaatcgacagcctacgagacaaagtgacaaggatagtcctactctgggttaataatcacttcaacgacttcgaaggcgacccagccatgacacgcttcttggaagaattcgagaagaacctcgaggacactaaaatgaatggccacctacgcttactcaatattgcatgtgctgcgaaagccaagtggaggcaggttgttcttcaaaaagcctccagggaatcccccctgcaattctctctgaacggcggaagcgaaaagggatttggtatttttgtggagggagtcgagccgggtagcaaggccgcagattctggcctcaagagaggggaccaaataatggaggtgaacggccagaattttgagaacatcacattcatgaaagcagtagaaatcctgcgtaataacacacatctggctctgactgttaagaccaatatcttcgtatttaaggaactcctgtttagaactgagcaggaaaagtccggcgtaccacatatccccaaaattgctgaaaagaagtcaaaccggcacagcatccaacatgtgcccggtgacattgagcagacatctcaagagaaagggagtaaaaaagttaaggccaacactgtgtccggaggcagaaacaagatcagaaagatccttgataaaactaggttctccattctacctccaaagctgttctctgacgggggactgagccaaagccaagatgattccattgttggaacccgacattgccgccactccctagcaattatgccaatccctggaactctgtctagtagcagcccagacctgcttcagcctactacttccatgttggacttctccaacccaagcgacatccccgaccaggtgatccgggtcttcaaagtcgaccagcagtcttgctacattattatcagcaaggatacgactgcaaaagaggtagtgttccacgccgtccatgaatttggccttacaggggctagcgacacctactcattgtgcgaagtctcagttacaccagagggcgtgattaaacagcgcagattgccagaccagttcagcaagcttgctgaccgcatacagctcaacggtagatag

SEQ ID NO: 237933 - DNA, 1551 bp, Artificial Sequence
  Description of Artificial Sequence: Synthetic coding sequence
atggcagataacctcagcgacaccctgaaaaaattgaagattaccgcagtcgataagactgaggactccctggagggatgcctcgactgtcttttacaggctctggcgcagaataatacggagacctctgagaaaattcaggcgtcaggaatcctgcaattatttgcatccctgctcaccccccaaagctcctgtaaggcaaaggttgccaacatcatcgccgaagttgctaagaatgaatttatgagaatcccatgtgttgacgctgggctgatcagcccccttgtgcagcttttgaacagtaaggaccaagaagttctgctgcagactggcagggccttgggaaacatatgctatgactcacagtccagtaaggagcagtttgcatccactaacatcgccgaggaactcgtgaaactctttaagaaacaaatcgagcatgacaaacgagagatgatattcgaggtcttggccccactggccgagaacgatgccataaagctgcagctggtggaggcaggcctagttgaatgtttgctcgaaatcgtccagcagaaggtagactctgataaggaggatgacattacggagttgaagaccggaagcgacctaatggtcctgctgctactcggcgacgagagtatgcagaaactgttcgaaggaggcaaaggaagtgttttccagcgggtactgtcgtggatccctagcaacaaccaccagctccagctcgcaggagccctggccatagccaatttcgctagaaatgatgcgaactgtattcatatggttgataacggaatcgtggaaaagctgatggatctccttgaccgccatgtcgaggatggcaacgtgacagtccagcacgcagcgctgagcgcactccgcaacttggcgatcccagtgatcaacaaggcgaaaatgctcagcgcgggtgttacagaggctgtgctgaagtttctaaaaagcgaaatgccacccgtgcaatttaagctgttgggtactttacgcatgctcattgatgcacaggccgaggctgcggaacaattgggaaagaacgtgaaactagtggaacgcctggttgagtggtgcgaggctaaggaccacgctggtgtcatgggtgaatccaaccgcctgttgtcagctctcatcaggcacagcaagtcaaaagacgtgattaagactatcgttcagtcgggaggtattaagcacctcgtcactatggcgacaagtgaacatgtaattatgcagaatgaggcactggtggccttggccctgattgccgctctggagctgggtaccgcagagaaagatctggaaagcgctaagctcgttcaaatcctgcaccggcttctcgccgacgagcgctcagccccagaaattaagtacaattctatggttctcatttgtgccctgatgggctcagaatgtctgcacaaagaggtccaggatctagcctttctggacgttgtgtctaagctccggtctcatgagaataagagcgtggcccaacaggcatccctaaccgagcagcgcctgactgtcgagtcttag

SEQ ID NO: 237934 - DNA, 1827 bp, Artificial Sequence
  Description of Artificial Sequence: Synthetic coding sequence
atggcagacaatctgtccgatactcttaagaaactgaaaatcactgcagttgacaagacggaggactctcttgaaggatgcctcgactgccttcttcaggcactagcacagaataatacggaaactagcgaaaagattcaggcctctggtattctgcagctgttcgctagcctgctgacgcctcagtcatcttgtaaggcaaaggtggcaaatatcattgcagaagtggcgaaaaatgaatttatgcggatcccctgcgtcgatgccggattgatttccccactggtacagctgcttaactccaaagaccaggaggtgctgctccagacaggtagagccctgggaaacatatgttatgacagccacgaaggacgtagcgcagtcgaccaggccggaggggctcagatcgtgatagaccacctgagatctctctgttcgatcacagatcccgctaatgaaaagctgctgaccgtgttctgtgggatgttaatgaattacagcaatgaaaatgacagcttacaggcccagctcatcaacatgggtgtgatccctacccttgtgaaactactgggaatacattgtcaaaatgcagccctgactgagatgtgcctggtagctttcggaaacttggccgaactcgagagcagtaaggagcagtttgcctccactaatatcgccgaggagttagttaagctgtttaagaaacagatcgaacacgacaaacgcgagatgatctttgaagtgctcgctcccctggctgagaatgatgctatcaagctgcagttggtggaagctggactcgtagagtgcttattggagatcgtgcagcagaaggttgattccgacaaggaggacgacattactgaattgaaaacaggctcggatttgatggttttgttgctcctcggagacgaaagcatgcagaagttgtttgagggcggaaagggcagcgttttccagagggtgctctcttggatcccatccaacaaccaccagctgcaactggccggagccctggcaatagcaaacttcgcacgcaatgatgcaaattgtattcacatggtggataatggtatagtggaaaaactgatggatctactcgatcgccacgtagaggatggaaatgttactgtgcagcacgccgcactgtcagcattgagaaacctcgctattcccgtcatcaacaaggccaaaatgctcagtgctggagtaactgaggccgtactgaagttcctgaagtccgaaatgcctcctgtccaattcaagctcttaggaaccctgcgaatgttaatcgacgctcaggctgaagcagcagagcaattgggaaaaaatgtgaagttagtggagcggctggtggagtggtgtgaggctaaggatcacgcaggagttatgggggagagtaatcggttacttagcgcccttatccgccactccaaatccaaggatgtgataaaaaccatagtgcagtccggaggcattaaacatctcgtcactatggctacatcagaacatgtcattatgcaaaacgaggctctggtcgcactggcacttattgctgctttagaactgggcactgcggaaaaggatctcgagtcggccaagttggtgcagatacttcatcgcctcttagccgatgagaggtccgctccggaaattaaatacaattctatggttctaatctgtgcccttatggggtccgagtgtctgcacaaggaagtgcaggatctggccttccttgatgtggtgagtaagttaagatcacatgaaaacaagtctgtcgctcagcaggcatcattaacggagcagcggctgacggtggaatcatag

SEQ ID NO: 237935 - DNA, 1680 bp, Artificial Sequence
  Description of Artificial Sequence: Synthetic coding sequence
atggcagacaatctctcagataccttaaagaagttgaagatcacagccgtggataagactgaggattcattggagggctgcctggattgtctgctgcaggctctggcccaaaataacaccgaaacatctgagaaaattcaagctagcggaatcctccagttgttcgcgtcgctgctgacgcctcaaagtagttgcaaagcgaaggttgccaacatcatagcagaagtcgcaaagaatgagtttatgagaataccatgcgtcgacgcgggactgatctcacctctggtccagctgctgaatagtaaggatcaggaggttctccttcagactggccgtgccttaggaaatatatgctacgattcccactcactccaggcacagctgattaacatgggcgtgatccccactctggttaagcttcttggaattcattgccaaaacgctgcccttaccgagatgtgccttgttgctttcggaaacctagccgaactggaatcctccaaagaacagtttgcctctacgaatatcgcagaagaattagtgaaattgtttaagaaacagatcgagcatgataaacgtgagatgattttcgaggttctggctccgctggcggagaacgatgcaattaagctacagctcgtggaagctgggctcgtagaatgtctgctcgaaattgtccagcagaaagtcgactcagataaagaggatgatatcactgagctgaagacagggagcgatctgatggtcctgctgctccttggggatgagagtatgcagaaactcttcgagggcggtaagggatcggtttttcagcgggtgctttcctggatcccctcaaataaccatcagttgcagctggctggcgcactggccatcgcaaacttcgctcggaatgatgccaactgcatccatatggtggacaacggcatcgtggaaaagctcatggatctgctggatcgtcacgtcgaagacggtaacgtgaccgttcaacacgctgccctgagtgctctccggaatcttgctatcccggtgattaataaggctaaaatgcttagcgctggtgttacagaagcagttttgaaattcctaaagtctgagatgcctcccgtccagttcaagctgctgggtacactacgcatgttgattgacgcacaggcagaggctgctgagcaactgggaaaaaatgttaagctggtggaacgcctggtggagtggtgcgaggcgaaagatcacgcaggtgtgatgggcgagtcgaataggctgctgtcagcacttattcggcacagcaagagtaaagatgtaattaagactatcgttcagtccggtggcattaagcacctcgtgacaatggccacaagcgagcacgtgatcatgcaaaatgaggcactggtagcgttggcattaatcgctgcccttgaactggggaccgcggagaaagaccttgagagtgctaagctggtacagattttgcatagactattggcagatgaacgctccgctccagagattaaatacaactctatggtcctaatctgtgccctcatggggtccgaatgcctccataaggaggtgcaggacttggcattcttggacgtagtctccaaactccgcagccatgaaaataagtctgtggctcagcaagcctcactcacagagcagagactgacggtggagtcttag

SEQ ID NO: 237936 - DNA, 1677 bp, Artificial Sequence
  Description of Artificial Sequence: Synthetic coding sequence
atggataacttatctgataccctaaagaagcttaaaattacagccgtggataaaacagaggactccttggagggttgcctcgattgcttgctgcaggctttggctcagaacaatacagaaacctcagaaaagattcaggcatcaggaattttacaattattcgcctctctgctaaccccccaaagctcatgcaaggctaaagtcgctaatatcatcgctgaagtggctaaaaacgagttcatgcgcattccatgtgtcgatgcaggactgatttctccactggtgcagttgctgaactcaaaagaccaagaggtcctgctgcagacgggtcgggctctgggtaacatctgttacgattcgcattccctacaggcccagttaataaacatgggagtgattcccacactggtcaagctactagggatacactgtcagaacgcagctctgacagagatgtgcctcgtcgccttcgggaatctcgctgagctcgaaagttctaaggagcagtttgccagtaccaacattgcagaagagctggtgaagctgtttaaaaagcagatcgaacacgacaaacgggaaatgattttcgaggtgttggccccactggccgagaacgatgccatcaagctgcaattggtggaagccggtttagttgagtgtttgctcgagatcgtgcagcagaaagtggattccgacaaggaggacgacatcaccgaacttaagaccggaagcgatttgatggtgctgctacttctcggtgacgagtctatgcagaaactattcgagggtggcaagggttcggtgttccagagggtactatcctggatcccctctaacaaccaccagttgcagttggctggcgctctggctatcgctaacttcgctcggaatgatgcaaattgcattcatatggtcgacaacggaatcgttgagaagctgatggacctccttgaccgtcacgttgaggatggaaatgtgacggtccagcatgctgcattaagcgccttgcggaacttggcaattccagtgataaataaggccaaaatgctcagcgcgggagttacagaggccgtgttaaaattcctgaagtctgagatgcccccagtgcagtttaaactgctagggacactgcggatgttgatcgacgcccaagccgaggcagctgagcagctgggaaaaaacgttaagctggtggagcgactggtggaatggtgtgaggcgaaggaccacgccggtgtgatgggtgaaagcaataggctcctttcagccctaattaggcactctaagtcaaaggacgtcatcaaaaccatagtgcaaagtggagggatcaagcatctcgtcaccatggcgacttctgagcatgttatcatgcagaatgaagctctggttgcactggctctcatcgccgcactggaactgggaactgccgaaaaggacctcgagtccgctaagctggtgcagattctgcatcggctactggccgatgagcgcagtgcccctgaaatcaaatacaattctatggtcttaatttgcgccctcatgggaagtgagtgtttacataaagaagtgcaggacctggctttcttggacgtggtgtccaagctcaggagccatgaaaataagtctgttgcccagcaggcgagcctgactgagcagcgtctgactgtagaaagctag

SEQ ID NO: 237937 - DNA, 1824 bp, Artificial Sequence
  Description of Artificial Sequence: Synthetic coding sequence
atggataacctaagcgatactctcaagaagctcaaaatcaccgcagttgataagacagaggattcgttggagggatgtcttgattgcctgctgcaggcactggcacagaacaatacggagacaagcgagaaaatccaggcatccggaattctccaactatttgccagcctgctcacgcctcagtcttcttgcaaagccaaagtggccaatatcattgccgaggtggctaaaaacgaatttatgagaatcccttgcgtcgacgcaggcctcatctcacctctggtgcaactacttaattcaaaagaccaggaggtcctgttgcagaccggccgagccctgggcaacatctgttacgattctcacgaagggaggtccgccgtcgaccaagcgggtggggcacaaatcgtcatcgaccatctgagatcactgtgcagtatcaccgaccccgcaaatgaaaagcttctcaccgttttctgcggaatgttaatgaattactccaacgagaacgactctctgcaggctcagctcatcaatatgggtgttatacctacactggtaaagttactgggaatacactgtcagaatgctgccctgactgagatgtgcctggttgcattcggcaacctggctgagctggaatcttctaaggaacagtttgcatccacgaacattgccgaagagctcgttaagctgttcaaaaagcagattgagcacgacaaaagggaaatgattttcgaggtgctcgcacccctggcggaaaatgacgcaatcaaactgcagctagttgaggctgggctggtggaatgtttactggagattgtgcagcagaaggtcgactccgataaggaagacgacattaccgagcttaaaaccggtagcgacttaatggtgttactccttttgggcgatgagtctatgcaaaagctttttgagggcggaaaaggatccgtgtttcagagagtactgagctggatcccttcaaacaaccatcagctgcagctggctggagcacttgccatagcaaattttgcacgcaatgacgcgaattgtatccacatggtcgacaacgggatcgtagagaaactcatggaccttctggatcggcacgtggaggacggtaatgtgacggtgcaacatgctgccctttcagccctccggaaccttgcaatacccgtcataaataaagccaaaatgttgtcggccggagtcaccgaagccgtgctgaaattcctgaagtctgagatgccccctgtgcagtttaaactactcggaacgcttcgtatgctcatcgacgctcaagcggaagcagcggaacagctcggaaaaaatgtgaagttagtggagcggctcgtagagtggtgcgaagctaaagaccatgctggagtcatgggagaatccaataggttgttatccgctctcatccggcactcaaagtctaaagacgtaatcaagacgatcgttcagtctggtggaataaagcacctcgtgacaatggcgacaagcgagcatgtcatcatgcagaacgaagcgcttgtcgcacttgcgttaatcgcggctctggagttgggaactgctgagaaagacttggagagtgccaaactcgtccagatcttgcatcggctgctggctgacgagagatctgctcccgagatcaaatataacagtatggtgcttatctgcgcgctcatgggcagcgagtgcctccacaaagaggttcaagatctggcattcctcgacgtcgtgagcaagcttcgctcacatgaaaacaaatccgttgcgcagcaagcaagcctgaccgaacagagactgactgtggagagctag

SEQ ID NO: 237938 - DNA, 1824 bp, Artificial Sequence
  Description of Artificial Sequence: Synthetic coding sequence
atggcagataatctcagtgacactttaaaaaagctcaaaatcaccgcggtcgacaagactgaggacagtctggagggatgcttagattgccttctacaggccctggctcagaataacaccgaaacttctgagaagattcaagcatcaggaatcttacagctcttcgccagtctgctgacgccccagagttcctgcaaggcaaaggttgccaatattattgcagaggtggccaaaaacgagttcatgcgaatcccatgcgtggatgctgggctgatttcacccctcgtgcagttgcttaacagtaaggaccaggaagttcttttgcagactggccgagctctggggaatatatgctacgattcacatgagggcagatcggccgtggaccaggcaggcggagcccagattgtaatcgaccacctgcgttcactgtgtagcatcactgatccggctaacgaaaagctgttgacagtgttctgtgggatgctgatgaactattccaacgaaaacgattcactgcaggctcagctcattaatatgggcgtgatccccaccttggtgaaactccttggaattcactgtcagaacgctgccctcaccgaaatgtgtcttgtggccttcggcaatcttgccgagttggaaagctctaaggagcagttcgcttctacaaacatcgctgaagagctggtgaaactgtttaaaaagcagatcgaacatgataagcgggaaatgatttttgaggtattggcgccacttgccgaaaatgacgccatcaagcttcagctggtagaagcaggcctcgtggaatgccttctggaaattgttcaacagaaggtcgacagcgataaggaggacgatattacagagctcaagactggcagtgatcttatggtactcctgttactcggggatgagtccatgcagaaactctttgaaggtggcaagggatccgtgtttcaaagggttctgagttggattccctctaataaccaccagctgcaattggctggcgctctcgccatagccaactttgctcgtaacgatgccaactgtatccacatggtcgacaatggcattgtggaaaaactgatggatctactggaccggcacgtcgaagacggaaatgttaccgtgcaacacgccgcactttctgccctgcgcaatttggccatcccagtgatcaacaaggctaaaatgctgtcagcaggtgttacagaagctgtgctgaaattcctgaagtctgagatgcccccagtgcagtttaaactcctgggaactctgagaatgctaatagatgcccaggaggctgcagagcagttaggaaaaaacgttaagctggtggagcggctcgtggagtggtgcgaggccaaggatcacgctggggtgatgggggagtccaataggctactgagcgctctcattcggcacagtaagtctaaagacgttattaagaccatcgttcaatctggcggaattaaacacttggtcacgatggccacatcagaacatgtgatcatgcagaatgaagctcttgtggccctggccctcattgctgctttagagttagggaccgctgagaaagacctggaaagtgcgaagctggtccagatcctacatagactgctcgcagacgaacggtccgcgcctgaaatcaaatataattcaatggtacttatatgtgcccttatggggtccgaatgcttgcacaaggaggtgcaggatctggcgtttctggacgtggtctctaaactgcgtagccatgaaaacaaaagcgtggcccagcaggccagcctgaccgagcagagactgacagtagagagctag

SEQ ID NO: 237939 - DNA, 555 bp, Artificial Sequence
  Description of Artificial Sequence: Synthetic coding sequence
atgcgagaatataaactggtcgtgttaggaagcgggggagttggcaagagtgccctgaccgtgcagtttgtgcagggcattttcgtggaaaagtatgatcctacaatagaggactcttacagaaaacaggtggaggtggatgcgcagcagtgcatgctagagatcctggatactgctgggactgagcagtttacagccatgcgtgatctgtacatgaaaaacggtcagggattcgccttggtatactcaatcacagctcagtccacgtttaacgacctccaggacttgcgggaacagattcttcgtgtcaaagacacagatgacgtgcctatgatactggtggggaacaagtgcgatttggaggacgaacgggttgtcggtaaggagcaaggacaaaatctggcccgacaatggaataactgcgcatttttggagtcctctgcgaaatctaaaatcaatgtgaatgaaatcttctatgacctcgtgcggcagattaacaggaagactcctgttcctggcaaagctaggaagaagtcctcatgccagctgctgtag

SEQ ID NO: 237940 - DNA, 555 bp, Artificial Sequence
  Description of Artificial Sequence: Synthetic coding sequence
atgcgtgaatataagctcgtggtcttagggtcagggggagtgggcaaaagcgccctgacggtgcaattcgttcagggaatattcgttgaaaagtatgatcccactatagaggacagctaccgaaagcaggtcgaggttgatgctcaacagtgcatgctggagattctcgacactgcaggtactgaacagtttaccgcaatgagagacttatacatgaagaacggacagggcttcgcccttgtctacagcataaccgctcaaagcaccttcaacgacctacaggacttaagggagcaaattttgcgtgtcaaagataccgacgacgtacctatgatcctggtgggcaataaatgtgatctggaagacgagcgcgttgtgggaaaagaacagggccaaaacttagctcgccagtggaacaactgcgccttcctagaatcgtccgctaagtcaaagattaacgtcaatgaaattttctacgaccttgtcagacagataaacaggaagacacccgtcccaggcaaagccagaaaaaaaagctcatgtcaattgctatag

SEQ ID NO: 237941 - DNA, 357 bp, Artificial Sequence
  Description of Artificial Sequence: Synthetic coding sequence
atgagggatctctacatgaaaaacggacagggatttgccctggtgtactccatcacagcccagagcacattcaatgacttacaggacctgagggaacagattctgcgcgtcaaagatacggatgatgtccccatgatcttagtgggaaacaaatgcgaccttgaggacgagagggttgttggtaaggaacagggccagaatcttgcgagacagtggaacaactgtgcctttttggaatcatcagcaaagtcaaaaattaatgtcaacgagatcttttatgatctcgtccgccagatcaacaggaagacccctgtccccggaaaggcacgtaaaaaaagctcttgccagcttttatag

SEQ ID NO: 237942 - DNA, 555 bp, Artificial Sequence
  Description of Artificial Sequence: Synthetic coding sequence
atgcgagagtacaagctggtagttcttgggtccggcggagttgggaagtctgcattgaccgttcaattcgttcaaggcatattcgttgaaaagtatgaccccactatcgaagactcttatcgcaaacaggtggaggtggacgcgcagcaatgtatgctcgaaatcctcgacactgctggaaccgagcagttcacagctatgagggacctgtacatgaagaatggtcaggggtttgccctggtctactcgatcaccgcccagtctacttttaacgatttgcaggacctgagagagcaaattctgcgggtcaaggacactgatgacgttcccatgatcctggtcgggaacaagtgcgatctggaggatgaacgagtagtgggcaaagaacagggacaaaatcttgctcggcaatggaacaactgtgcttttctggaaagttccgctaagagcaaaattaatgtgaatgagatattttatgatctggtgaggcagatcaatcggaagacacccgtccccggtaaagcgcgaaagaagagttcttgtcagctcctctag

SEQ ID NO: 237943 - DNA, 99 bp, Artificial Sequence
  Description of Artificial Sequence: Synthetic coding sequence
atgagggaatacaaacttgtggttttaggctctggcggtgtgggaaagtccgccctgacagtgcaattcgtacaggggatcttcgtcgaaaagtactag

SEQ ID NO: 237944 - DNA, 429 bp, Artificial Sequence
  Description of Artificial Sequence: Synthetic coding sequence
atgcgggaatacaagctggtggtgctcggctctgggggagtcggtaaatcagcactggaacagttcaccgctatgagagacctgtatatgaagaacggtcaagggtttgctttggtatacagcatcaccgcccagtcaactttcaacgacctgcaggatctgagggagcaaatactgcgcgtgaaagacaccgacgacgtacctatgatcctcgtggggaacaagtgcgacctcgaggatgagagagtggtcggcaaggaacagggccagaatctcgcccgtcagtggaataactgtgcctttctggaaagctctgccaagagcaagatcaacgttaacgagatcttctacgaccttgttagacagattaatagaaagactcctgtgcctgggaaggctcgcaaaaagagttcctgtcaattattgtag

SEQ ID NO: 237945 - DNA, 384 bp, Artificial Sequence
  Description of Artificial Sequence: Synthetic coding sequence
atgagggaatataagctggtggtactgggcagcgggggagtaggaaagtcagcactgaccgttcagttcgttcaagggatctttgtagaaaaatacgaccctacaatcgaggacagctaccggaagcaagtggaagttgacgctcagcagtgcatgctggaaattcttgatacagctgggacggagcagttcacagcaatgcgcgatctttacatgaaaaacggacaggggttcgccctagtatactctattaccgcacagagcacattcaacgatttacaggatctgcgcgaacagatcctgagagtcaaagacactgatgatgtccccatgattctcgtaggaaataaatgtgatctagaggatgaaagggttgttggctag

SEQ ID NO: 237946 - DNA, 429 bp, Artificial Sequence
  Description of Artificial Sequence: Synthetic coding sequence
atgagagagtacaaactggtggtgttagggagcggtggcgtgggcaaaagcgctctgactgtacaattcgtacaggggatctttgtggagaaatacgaccccacaatcgaggactcgtaccggaagcaagtggaagtggatgcccagcagtgtatgctggaaatccttgacaccgccggtaccgagcaattcactgctatgagagatctctatatgaagaacgggcagggattcgctttggtgtactctatcacagcacagtcaacttttaatgatctgcaggatctacgagagcagattttgcgggttaaagatacagacgacgttccgatgattctggttggcaacaaatgtgaccttgaggacgaacgtgttgttggcaaggaacagggccagaacttggataatggtaccaccgttcattcctag

SEQ ID NO: 237947 - DNA, 147 bp, Artificial Sequence
  Description of Artificial Sequence: Synthetic coding sequence
atgcgagagtataagctcgtggtcttgggaagtggaggggtgggcaaatccgctctgaccgtgcagttcgtgcaggggatcttcgtcgagaagtatgatccaacaatagaagatagctaccgaaagcaggtcgaggtggacgcttag

SEQ ID NO: 237948 - DNA, 36 bp, Artificial Sequence
  Description of Artificial Sequence: Synthetic coding sequence
atgcgtgagtataagttggtggtattgggatcctag

SEQ ID NO: 237949 - DNA, 264 bp, Artificial Sequence
  Description of Artificial Sequence: Synthetic coding sequence
atgcgggaatacaagctggtagtgcttggctccgggggagttgggaagtcggccctgaccgtacaatttgtgcagggtatttttgtcgaaaagtatgatcctacaatagaagactcttaccgaaaacaagtggaagtcgacgcccagcagtgcatgcttgagatcctggacacggctggcaccgagcagttcaccgccatgcgcgacctgtacatgaagaatggccaagggtttgcattggtgtactcgatcaccgcgcaatag

SEQ ID NO: 237950 - DNA, 555 bp, Artificial Sequence
  Description of Artificial Sequence: Synthetic coding sequence
atgagagaatataaactcgttgtactgggctctggaggagtcggaaagtccgccctgacagttcagtttgtccaggggatctttgtggaaaaatacgatccgaccatagaggacagctacaggaagcaggttgaggttgacgctcagcagtgcatgcttgaaatcctcgacaccgcaggcactgagcagtttaccgccatgagagatctgtatatgaagaacggacagggcttcgcccttgtgtatagcattacagcgcagagtaccttcaacgatctgcaggaccttagggaacagatcttgagagtgaaagacacagatgatgtgccaatgattctagttgggaataaatgtgaccttgaagacgagagggtggtcggtaaagagcagggtcagaacctcgcgcgtcaatggaacaattgcgcttttctggagtcctcagccaagagcaagataaacgtaaatgagattttctacgatctggtgaggcagattaaccggaagacacccgtgccaggcaaagcaagaaaaaaaagttcctgtcagctgctgtag

SEQ ID NO: 237951 - DNA, 306 bp, Artificial Sequence
  Description of Artificial Sequence: Synthetic coding sequence
atgcgcgaatacaaacttgttgtccttggtagcggcggagtgggaaagagcgcattgacagtacaatttgtgcaggggattttcgtcgagaaatatgatcctacaatcgaagattcctatagaaaacaagtcgaagtcgatgcacaacagtgcatgttagagatcctggacaccgccggaacggagcagttcactgctatgcgggatctatatatgaaaaacggccagggctttgccctggtatattccattacagcccagtccacgttcaacgacctccaggatctccgggaacagatactgtag

SEQ ID NO: 237952 - DNA, 162 bp, Artificial Sequence
  Description of Artificial Sequence: Synthetic coding sequence
atgagagagtacaaacttgtggtactgggaagcggcggtgtggggaagtctgcactcaccgtgcagtttgtccagggcatctttgtggagaagtacgacccaactattgaggactcttaccggaaacaggtggaggtcgatgcacaacagtgtatgctctag

SEQ ID NO: 237953 - DNA, 429 bp, Artificial Sequence
  Description of Artificial Sequence: Synthetic coding sequence
atgcgggaatacaaactcgttgtccttggctctgggggtgtcgggaagtcagccttggagcagttcacagccatgcgggacctgtatatgaagaacgggcagggcttcgcactggtctattccatcactgctcagtcaacattcaatgacctgcaggacctgcgggagcagattttacgggtgaaagacaccgacgatgtgcccatgattcttgtcggcaacaaatgcgacctggaagacgagcgggtggtcggcaaagagcagggccagaatttggctcgtcagtggaacaattgtgctttcctcgaatcttcagcaaaaagtaagatcaacgttaatgagattttctacgaccttgtaagacagataaaccggaaaacacctgtcccaggcaaggccaggaagaaatcatcatgtcagctgctgtag

SEQ ID NO: 237954 - DNA, 498 bp, Artificial Sequence
  Description of Artificial Sequence: Synthetic coding sequence
atgagggagtataagctagtggtactcggctccggtggagtgggaaaatcagccctgaccgtgcagttcgttcaggggatcttcgttgagaagtatgatccgactattgaagattcctaccgaaaggaacagtttaccgctatgcgcgatctgtatatgaagaacgggcagggctttgcccttgtctatagcattaccgcacagagcacattcaacgatctgcaggatctaagggaacagatcctccgtgttaaggacaccgacgatgtgcccatgattctggttggaaataagtgcgatctcgaagatgagagagtggtagggaaagagcagggacagaacttggctcgacagtggaataattgtgcttttctggagtcatcagctaaatctaagattaatgtcaacgaaatattctatgatctggttcgtcaaatcaaccgcaagacaccggtgcctggtaaggctcggaaaaagtcttcctgtcaactactctag

SEQ ID NO: 237955 - DNA, 420 bp, Artificial Sequence
  Description of Artificial Sequence: Synthetic coding sequence
atgcgggagtataagctggtggtgcttgggtccggcggagtggggaagagcgcactgacggtgcaattcgtccagggcattttcgtggagaaatatgatccgaccatcgaagattcatatagaaaacaggtggaggttgatgcgcagcaatgcatgcttgagatcctggataccgctgggaccgaacaatttactgctatgagggacctttatatgaagaatggacagggattcgcgttagtgtatagtatcacagcccagagtacattcaatgacctccaagatcttcgcgagcaaatcctgcgggtaaaggacactgacgatgtcccaatgatcctcgtaggaaataagtgcgacttagaggacgaaagggttgtaggcaaagagcagggtcagaatcttgctaggcagtggaattag

SEQ ID NO: 237956 - DNA, 282 bp, Artificial Sequence
  Description of Artificial Sequence: Synthetic coding sequence
atgcgagagtacaaactggtcgtgttgggttctggcggagtcgggaagtctgctctgactgtgcagttcgtgcaaggcatatttgtcgaaaagtatgatcctaccatcgaagattcataccgtaagcaggtggaagtcgatgcacagcagtgcatgctggaaatactcgatacagccggaactgagcagttcactgccatgcgcgatctgtatatgaagaacggccaggggttcgctttggtttactccattacagcccagagcacttttaatgatctttag

SEQ ID NO: 237957 - DNA, 36 bp, Artificial Sequence
  Description of Artificial Sequence: Synthetic coding sequence
atgagagagtacaaacttgtagtgcttggttcttag

SEQ ID NO: 237958 - DNA, 297 bp, Artificial Sequence
  Description of Artificial Sequence: Synthetic coding sequence
atgcgcgagtacaaactcgttgtcctgggcagtggcggtgttggcaagtctgccctcaccgtgcaatttgtgcaggggatttttgtggagaagtatgatcccacgatcgaggatagttaccggaaacaggttgaagtggatgcacagcaatgcatgctggaaatcctggataccgccggaaccgaacagttcaccgcaatgagagatctttacatgaaaaatgggcagggcttcgctctcgtttatagcatcacagcccagtcgacctttaacgacctccaggatcttagagaatag

SEQ ID NO: 237959 - DNA, 414 bp, Artificial Sequence
  Description of Artificial Sequence: Synthetic coding sequence
atgcgcgagtacaaactcgttgttcttgggtctggcggagttgggaagtcagctcttacagtgcaatttgtgcagggtatttttgtggaaaagtacgaccctactattgaggattcctaccgcaaacaggttgaggtagatgcacagcagtgtatgctggagattctcgacaccgcaggcactgtgcccatgatcttggtggggaacaagtgcgacctggaggacgagagggtggtgggaaaagaacagggtcaaaacctcgcacgtcagtggaataactgtgcttttttggagtcatctgccaaatcaaaaattaacgtgaacgagatcttctacgaccttgtgcggcaaatcaataggaagacacctgttcccggtaaggccaggaaaaaaagctcatgccagctgctctag

SEQ ID NO: 237960 - DNA, 357 bp, Artificial Sequence
  Description of Artificial Sequence: Synthetic coding sequence
atgagggacctgtatatgaagaatggccaaggcttcgccctggtctattcaatcacagcccagtccactttcaacgacctgcaggatctgcgagagcaaattcttcgtgttaaggacacggatgacgtccctatgatcttagtgggtaataagtgcgacctcgaagatgagcgtgtggtggggaaggaacaaggccaaaatctggcgcgacaatggaataactgtgcgtttctggagagtagcgctaagagcaagatcaacgtgaacgagatattttacgacctggtgcgccaaatcaaccgcaagacaccggtcccaggaaaggccaggaaaaagtcctcctgccagctgctttag

SEQ ID NO: 237961 - DNA, 369 bp, Artificial Sequence
  Description of Artificial Sequence: Synthetic coding sequence
atgagggagtataagctcgtggttcttggatctggtggcgtgggaaaatcagcactgactgtccagtttgtgcaaggtatcttcgttgaaaagtatgaccctaccatagaagatagctatagaaagcaggttgaagtcgacgctcagcagtgtatgttagaaattttggacactgcaggtacagaacagtttaccgccatgcgagacctctatatgaaaaatggacagggctttgctttggtgtatagtatcaccgctcagtccaccttcaacgacctgcaggatctacgagaacagatcctgagagttaaggacacggatgacgttccaatgatccttgttggaaacaagtgcgacctcgaagactag

SEQ ID NO: 237962 - DNA, 258 bp, Artificial Sequence
  Description of Artificial Sequence: Synthetic coding sequence
atgcgagaatacaaattggtcgtgttaggttccgggggtgtcggtaagagtgctctcactgtccaattcgtccaaggtatcttcgtggaaaagtacgacccgacaattgaggattcttatagaaaacaggtcgaggtagacgcccagcaatgcatgctggaaatcctggacacggctggcacagaacagtttacggccatgagggacctgtacatgaaaaacggtcaggggttcgcattagtctattctatcacttag

SEQ ID NO: 237963 - DNA, 552 bp, Artificial Sequence
  Description of Artificial Sequence: Synthetic coding sequence
atgagggagtataaggtcgtggtcctgggatccggcggtgtgggcaagtccgcgctgactgtgcagttcgtcacaggaacttttatagagaagtacgaccccaccatcgaggacttttaccgtaaggagattgaagtggactcctctccctccgtgttagaaatactggataccgccggaacagagcagttcgccagtatgagggacttgtacatcaaaaacggccaggggtttattctcgtttatagccttgtcaaccaacagagctttcaggatattaaacctatgcgagaccagataattagggtcaaacgatacgagaaagtcccggtgattctggtggggaacaaggttgacttagaatctgaacgcgaagtatcctctagcgaaggcagggctctcgccgaggagtggggctgcccatttatggagacgagtgcaaagagtaaaactatggtagatgagctcttcgccgagatagtgcgccagatgaactatgctgcacagccagataaggatgatccatgttgctctgcttgcaacatccagtag

SEQ ID NO: 237964 - DNA, 1671 bp, Artificial Sequence
  Description of Artificial Sequence: Synthetic coding sequence
atgaatgagggagcacccggagactccgatctggagacggaagccagagtgccctggagtatcatggggcactgcctgcggacgggccaggccagaatgagcgctaccccaactccagcgggagaaggcgcacgcagagatgagctgttcggcatcctccagattctgcatcagtgcatacttagctctggggatgcttttgtgctgacgggggtctgctgtagctggcggcagaacggcaagccaccatactctcagaaagaggataaggaagtccaaacaggatatatgaatgcacagattgaaatcatcccctgtaagatttgcggagataagagctccggcatacactacggcgtaattacctgcgagggttgcaagggctttttccggaggtcacagcaatcaaacgccacctattcctgccctagacagaaaaactgtctcatagacaggacgtccaggaatcggtgtcagcactgtcggcttcagaagtgtctagcggtaggcatgtcgcgagatgccgtcaagttcggacggatgagtaaaaagcagagggacagcctgtatgcagaagtccagaagcaccggatgcaacagcaacagcgagaccaccagcaacagcctggagaggccgaacccttgacccctacttacaatatttcggctaatgggcttacagaactgcatgatgacctgtcaaattacattgacggacacactccagagggctctaaggccgacagcgccgtgtccagcttttatctggatatccagccctcccccgatcagtccggactggatattaacggcatcaaacccgagccaatatgcgactatacaccggcaagtgggtttttcccatactgtagttttacaaacggcgagacgtctcccacggtctcgatggccgaactggagcatttggcccagaatattagcaagtcccacctggagacctgtcaatacctgagagaggaactccaacagattacttggcagaccttcctccaagaggaaatcgaaaactatcagaataagcaacgggaagtcatgtggcagctgtgcgccattaagattaccgaggcaatccaatatgtggtggaatttgctaagcgtatcgatgggttcatggagctttgtcaaaatgatcagatagttctcttgaaagccggttccttggaagtggtctttatccgcatgtgccgagcttttgattctcaaaacaatacagtatacttcgacggaaaatacgcatctcccgacgtgtttaagagcctcggctgcgaagacttcatttcattcgtctttgagttcggcaaaagcctgtgcagtatgcatctgaccgaggatgagatagccctgttcagtgcattcgtcctgatgtccgccgacagatcatggttgcaggagaaggtgaaaattgaaaagctacagcagaaaatacagctagctctgcagcacgtgctgcagaaaaatcatcgcgaagacggcattctgactaaattaatctgtaaggtctcgacactgcgagccctttgcggtaggcacactgaaaagttgatggcattcaaggccatctaccctgacatcgtgagactgcacttcccccctctgtataaagaattgttcacatctgagttcgagccagccatgcagattgacggatag

SEQ ID NO: 237965 - DNA, 1647 bp, Artificial Sequence
  Description of Artificial Sequence: Synthetic coding sequence
atgaacgaaggagctccaggtgactcagacttggagaccgaggctagagttccctggtcgatcatgggtcactgtctccggaccggccaggctcggatgagtgccaccccaaccccagcaggcgagggcgcaagaagctcctccacctgttccagcctgagccgtttgttctggtcacagctagagcacatcaactgggacggcgctactgctaagaacttcattaatttgcgcgaatttttcagtttcctgcttccggcacttagaaaggctcaaatcgaaatcatcccgtgtaaaatctgcggcgacaagtcttctggcatccactacggagttattacatgtgagggatgcaaaggattcttcagaaggtctcaacagtctaacgctacgtactcctgtcctagacagaagaactgcttaattgatcggacatcacggaatcgttgccagcattgcaggctccagaagtgcctcgcggtgggtatgagccgcgacgccgtgaaattcggacggatgtctaaaaagcagagagacagtctgtatgcggaggtgcagaaacatcgcatgcaacagcaacagcgggatcaccagcagcagcccggtgaagctgaaccacttaccccaacctacaatattagcgcaaatggcctcacggagctgcacgatgacctctctaattacattgacgggcacacccccgagggctccaaggccgacagcgccgtgtctagtttttacctcgacattcagccctcccctgatcagtcaggactggacataaacggcattaagcccgaacccatctgcgattatactcctgcctcaggcttcttcccttattgcagttttactaacggtgaaacttctcccacggtttccatggcggagctcgagcacctggctcagaatataagcaagtcacatcttgagacttgtcaatacttgcgcgaggagctgcagcagattacctggcaaacctttctccaggaggagatcgagaactatcagaacaaacagagggaagtgatgtggcagctttgcgctataaaaataactgaagccatccaatatgtggtggagtttgctaagaggatcgacggattcatggagctgtgtcagaatgaccaaatagtccttctgaaggctggttctctggaggttgtattcatacgaatgtgtagagctttcgactcacagaataataccgtttacttcgacgggaaatacgctagccctgatgtgtttaaaagcctaggctgcgaggatttcatcagttttgtttttgagttcggcaagtcactatgcagcatgcacctgaccgaggacgagatcgcgctcttcagtgcctttgtactcatgtcagccgaccgctcgtggttgcaagagaaggtaaaaattgagaagctgcagcagaagatccaactggcattacaacatgtcctgcagaagaatcaccgagaagatggcatactgacaaagttaatttgtaaggtcagcacattaagagcactgtgtggcagacacacggagaagctgatggccttcaaggccatttaccccgacatcgtgcggctgcactttccgccactatacaaggagctctttacctcagagttcgagcctgccatgcagattgatggctag

SEQ ID NO: 237966 - DNA, 1572 bp, Artificial Sequence
  Description of Artificial Sequence: Synthetic coding sequence
atggagagcgcgccagcagctccggacccagccgcatctgagccaggctcctccggagccgacgccgctgccggatccagggagaccccgttgaatcaggaatctgcccgaaagtcagagccaccggcaccagtccgcagacaatcctattcaagtacatcccgtggtatttccgttactaagaaaacccataccagccagattgaaatcatcccatgcaaaatctgtggcgacaaatcttccggaatccactatggtgtaatcacctgcgaaggttgtaagggattctttcgacggagccagcagagcaatgccacctacagctgtccaagacaaaaaaattgcctcatagacagaacttcccgcaaccggtgtcagcactgtcggctgcagaagtgcctggctgtgggcatgtctagggacgcagtaaagtttgggcgaatgtcgaaaaagcaaagagactctctctatgccgaggtccagaagcatagaatgcaacagcagcaacgggaccatcagcagcaaccaggagaggcagaaccactaactcctacctacaatatctcagcaaatggcctcaccgagctgcacgacgacctgtctaactacattgatggtcacactcccgaaggctccaaggctgacagtgctgtcagcagtttttacctggacatccaaccttcccccgatcaaagtggcctggacatcaacggcatcaaaccagagccaatttgtgactataccccagccagcggtttcttcccttattgctcattcactaacggcgagacttctcccaccgtgtctatggccgagctcgagcacctggcgcagaacatcagcaaatcacacctagagacgtgccagtatctgcgggaggaactgcagcagattacatggcagacgttcctgcaggaggagattgagaattaccagaacaaacagagggaagtaatgtggcagttgtgcgcaataaagatcactgaggcgatacaatacgtcgtggagtttgccaagagaattgacgggtttatggagctgtgccagaatgatcagattgtcttgctcaaggcaggctcgctggaggtcgtatttattcgaatgtgcagagcctttgacagtcagaataataccgtgtattttgacggcaaatacgccagtcctgacgtcttcaaatcccttggttgcgaagacttcatctcttttgtatttgaattcggcaagagtttgtgttccatgcatctgaccgaagatgaaatcgcactgttcagcgcttttgtgctgatgtctgcagatcgctcatggctccaagagaaagtcaagatcgaaaagttacagcagaaaatccaactggctttgcagcatgtgctacaaaagaaccatcgggaagatggcatcttgaccaaactgatctgtaaggtctctaccctacgtgctctgtgcggacgtcataccgaaaagctgatggcttttaaggcaatctaccccgatatcgtgcgattgcacttccccccactgtacaaggagctgttcaccagcgagtttgaaccagctatgcagatcgatggttag

SEQ ID NO: 237967 - DNA, 1407 bp, Artificial Sequence
  Description of Artificial Sequence: Synthetic coding sequence
atgatgtatttcgtaatcgccgcaatgaaggctcagattgagattattccatgcaaaatctgtggcgacaagtctagcggaatccactacggggtcattacctgcgaaggctgtaaagggtttttcagaaggtcccagcagagtaatgcgacctatagctgtcccagacaaaagaactgcctcatcgaccggacctcacgaaaccgatgccagcactgtcggttgcaaaaatgtcttgccgtagggatgtcacgcgatgcggtgaaattcggccgtatgagcaaaaaacagcgggattctctgtacgctgaggttcagaagcataggatgcagcagcagcagagggatcatcagcagcagcctggggaggccgagcccttaacccctacgtacaacatatctgctaacggactgaccgaactgcatgacgacctgagtaattacattgacgggcacaccccagaagggtctaaggcagattccgcagtttctagtttctatttggacatccagccttcccccgaccagtctgggctggacatcaatgggattaagcccgaaccaatctgcgattatacacctgcaagtggctttttcccctattgcagtttcaccaatggagaaaccagcccaacagttagtatggccgagcttgaacacttggcacaaaacatttcgaagagtcacctggagacgtgccagtacttacgtgaagagctgcaacagataacttggcagacctttctgcaagaggagattgagaactatcaaaacaaacagagagaggtcatgtggcagctgtgcgcaattaaaatcacagaggccattcagtatgtagttgagtttgctaagcggattgacggcttcatggagctttgtcaaaatgaccagattgttctgctaaaggcgggatctcttgaagtggtgtttatccgaatgtgccgagccttcgattcccagaataatacggtgtattttgatggtaagtacgcctctccagatgttttcaaaagtttggggtgtgaagactttataagcttcgtgttcgagttcggaaaatctctatgctctatgcacctcacagaggacgaaattgccctcttctctgcatttgtcctcatgtctgccgatcgcagctggcttcaggaaaaagtgaagatcgagaagctgcaacagaaaatccagctagctctgcagcacgtcttacaaaagaaccatagggaggacggaatcctgacaaagctaatctgtaaggtgtccacactgagggccctgtgcggtagacacacggaaaaactgatggcctttaaggctatataccccgacattgtgcgactccacttcccacctctgtacaaggagctgttcacctcagaattcgaacccgctatgcagatagatggatag

SEQ ID NO: 237968 - DNA, 1557 bp, Artificial Sequence
  Description of Artificial Sequence: Synthetic coding sequence
atggatcgcgcaccgcagaggcagcaccgcgcttcccgcgaactccttgctgcaaagaaaacacatacgagtcagattgaggtcatcccctgcaagatctgcggcgataagtcttccgggatacactatggtgttatcacatgcgagggctgcaagggcttcttccgcagaagtcaaagatgcaacgcggcttactcttgcaccaggcagcagaattgccctatagatcgaacaagcagaaacagatgccaacattgtcgcctacagaagtgcctcgcgctaggtatgagcagagatgctgtgaagttcggaagaatgagtaaaaagcagagagactccctgcacgcggaagtacagaaacagctgcagcagcggcagcagcagcagcaagagcctgtggtgaagacaccaccagctggtgcacaaggcgcagatacgctcacgtacactctgggattgcccgatggccagctgccattgggtagtagtccggatctgcctgaggccagcgcttgccctcctggcctcctgaaggcatcgggctccggcccaagctacagcaataacctggctaaggctggcttaaacggagccagttgtcacctggagtacagcccagaaagaggaaaggctgaaggtcgggagagtttttattctactggtagccagctcaccccagacagatgcggtctgaggttcgaagaacaccgccaccctggcctaggcgagttgggtcagggacctgatagttacggctcccccagctttagatccactcctgaggccccatacgctagccttaccgagatagagcacctggttcagagcgtgtgtaagtcctatcgagagacatgccagctgcggctggaggatctgttacgccagaggtctaatatcttttcacgggaagaagttactggttatcagcggaaatccatgtgggagatgtgggagaggtgcgcccaccacctgaccgaagctattcagtacgtcgtggaatttgcaaagcgattgtccggattcatggaactgtgccagaacgaccagattgtgctgctcaaggccggtgccatggaggtagttcttgtccggatgtgtagggcttataacgccgataacagaacagtcttctttgagggaaaatatggagggatggagctgttccgggctctgggctgcagcgagctgatctcaagcatcttcgatttcagccattccctgtctgccctgcacttctctgaagacgagattgccctgtacactgcgcttgtgctgattaacgcccatagacctgggctgcaggagaagagaaaggtggagcagcttcaatataatctggagttggcttttcaccatcatctatgcaagactcaccgccagtcgatcctcgctaagctccctcccaaggggaagctgcgtagcttgtgctctcaacacgttgagcgtctgcagatcttccaacacctccacccaatcgttgttcaggccgcttttcccccactctataaagagctgttttcaaccgaaaccgagtccccggtgggactgtccaagtag

SEQ ID NO: 237969 - DNA, 1494 bp, Artificial Sequence
  Description of Artificial Sequence: Synthetic coding sequence
atgcgaacccagattgaggttataccgtgcaagatatgtggagataagtccagcggaatccattacggtgtgatcacatgcgaaggttgtaaagggttctttcgcagaagccagcggtgcaatgctgcttattcatgtactcgtcagcaaaattgcccaatcgatagaacctccagaaataggtgtcagcactgccgtctgcagaagtgtctggccctggggatgtcgagggacgcggtgaaattcggacgcatgagcaagaaacagagggacagcctgcacgccgaagtccagaaacagctgcagcagcgccaacagcagcagcaagagccagtagtcaagacacccccagccggagctcagggggcagatacactcacctataccctcgggctccccgacgggcaactcccactgggttcctctccggacctgcctgaagcttcggcttgtcccccaggcctgttgaaggcttccgggtccgggccttcctacagcaacaaccttgccaaggcaggcctcaacggagcttcatgccatctagagtacagtcccgagagaggcaaggctgaagggcgagagagcttctatagcactgggagccagctgaccccagatagatgtggtcttcgattcgaggagcaccgccaccctggattaggagagctgggccaaggcccagatagctatggctctcccagcttccgctccacaccagaagccccatatgcgtcactgacagaaatcgaacacctggttcaatctgtgtgtaaatcctatagagagacatgccaactgaggctggaagacctgttgcgtcagagatccaacattttctcccgggaggaagtgacgggatatcagaggaaatcgatgtgggagatgtgggaaaggtgcgcacatcatctgaccgaggccatccagtatgtcgtggagtttgcgaaacggttgtctggtttcatggaactatgtcagaacgaccagatcgtgctcctgaaggctggagctatggaggtggttctggtgcggatgtgccgggcatataacgccgacaacagaactgtcttcttcgaggggaaatatggtggcatggaactgttccgcgcacttggttgctccgagctcattagctccatcttcgacttttcccacagcctgagcgctctacacttcagtgaggatgagatcgccctctataccgccctggtcctgattaatgcccatcgccctgggttgcaggaaaagcggaaagtggagcagcttcagtacaacctggagcttgcttttcatcatcacctgtgtaagacacatcgacaatctattttagctaagctccccccaaagggtaagcttcgttctctttgtagtcaacatgtagagcgtttacagatttttcagcacctccacccaattgtcgtgcaggcagcctttccaccgctgtacaaagagctgttcagtacagagaccgaaagtcctgtgggtctctccaagtag

SEQ ID NO: 237970 - DNA, 1719 bp, Artificial Sequence
  Description of Artificial Sequence: Synthetic coding sequence
atgtggggaacaggaccttccgcaggcaaggaccgcatgtcaggtcgcccatggccacacccttggagcaagtctgggacccccagtgaacaggatcgtcgggcaacggggctggtctcatgcgagcacggcggtggaaagttcgagggccagtctcaccaggctcccggacccccagggggtggaagaactgggtgtttggagctgctggctgccaaaaaaactcatactagtcagattgaggtgatcccctgcaaaatttgtggggacaagtctagtggaatccactacggcgtgattacctgtgagggatgtaaaggcttcttccgtcgctctcagcgttgcaacgccgcatactcctgcactcgccagcaaaactgtccgattgatcgcacctcaaggaatagatgtcagcattgcaggctgcagaagtgcctggctcttggcatgtctagagacgcggtgaagtttgggaggatgagcaaaaaacaaagggattcattgcatgctgaggttcagaagcaactgcagcagcgtcagcagcagcagcaggagccagtcgtgaagaccccgcctgccggtgcacagggcgctgacaccttaacatacaccctgggcctacccgacgggcagctccccttaggtagctccccagatctcccggaagcctctgcatgcccgcctggcctgctgaaagctagtggaagtggacccagctactcaaacaatctagcgaaggcagggctcaatggggcttcttgccacctggagtactcacctgagagaggcaaagcggaagggagggaatccttctattctactggcagccagttaactccggacagatgtgggctgcgcttcgaggagcatcgacaccctgggttgggagagcttggacagggacccgatagttatggatctccaagcttccggagcacccctgaggcaccatatgcttcactgacagagattgaacatctggtccagtccgtgtgcaagtcctaccgcgaaacctgccagctgcgcctggaagatctgctgcgccaaagatcaaacattttcagcagagaggaggtcacagggtaccagcgcaagagcatgtgggagatgtgggaacggtgtgcccaccacctgacagaggctatacagtatgtggtggaattcgccaaacgtctgtctggattcatggagctctgccagaacgatcagattgttttgctgaaagcaggagccatggaagtggtgctggtcagaatgtgtcgcgcatacaacgctgacaatagaactgtgttctttgagggcaagtatggcggaatggaactgttcagagccttaggatgctctgagttaattagttcaatcttcgatttttctcactcactgtcagctctgcatttcagtgaagacgagatcgcgctgtacaccgcgctagtattgatcaatgcacaccgcccaggccttcaggagaagagaaaggtcgagcagctacagtataatctggaactggcgtttcaccaccacctgtgcaagacacacagacaaagcatccttgctaagctgccacctaaaggaaagttacgcagtttgtgctcacagcatgttgagaggctccagatttttcagcatttgcaccctattgtggtgcaggccgcattccctcctctgtacaaggagctgttcagcacagagaccgaatcgcccgtaggcttgtccaaatag

SEQ ID NO: 237971 - DNA, 2835 bp, Artificial Sequence
  Description of Artificial Sequence: Synthetic coding sequence
atgcttgattccttcagtcaggagtccaccctgccctttcgggaggccagaaaaagaacaagctttcagccagtgcaggtgtggcgaaattttacagcctctcaaacaactgagagccctgcttgtagcggggcaagcctgggcgagatgacagcttggactatgggcgcacggggactggacaaaagaggcagcttctttaagttaattgatactatagcctccgagatcggggagctgaagcaggaaatggtgcgtacagatgtgaatcttgagaatggtctggaacctgcagaaactcactctatggttcgccacaaagatggcggatactctgaggaagaagacgtgaagacttgcgctagagactccgggtacgactccctttcgaatcgtctgtccatactggaccgtttgctgcatacgcaccccatttggctgcagctgtctctaagcgaagaggaggccgctgaggttctgcaggcccagccccctggaattttcctggtccacaagtcaacaaagatgcagaaaaaagtcctgagtctgcgtctgccgtgcgaatttggagctccattaaaagagttcgccattaaagaatctacctacacattctcattggaaggaagcggcatcagcttcgctgacctgttccggctgatcgctttttactgcattagccgcgatgtgctgcccttcactttaaaactaccctatgcgattagtacagctaagtcagaagcacagcttgaagagctcgctcagatggggctgaatttctggtcctctcctgctgactctaaacccccaaatctgcctccaccacaccgacctttgtcttctgacggagtgtgtccggctagtctcaggcagctgtgcctcatcaacggtgtccactcaatcaaaacaagaacacctagcgagctcgaatgctcccagacaaatggcgcactctgttttatcaatcctcttttccttaaagtgcactcacaggacctctctggaggactgaagcgacctagcactcgcacaccaaatgcaaacggtactgaacggacccgcagccctccccctcgaccgcctccgcctgcaataaattctctgcataccagtcctagattggccagaactgagacccagacatccatgcctgagactgttaatcacaataaacacggcaacgtcgccctgcccggtacaaagcctacccctatacccccacccaggctgaaaaaacaggcttcattcctggaagctgagggcggagccaagaccctgtcaggtggccgacccggtgcgggtcccgaactggaactgggcactgccggaagcccaggaggagcacctcccgaagctgctccgggagactgcacacgggcaccccctccatcttccgaatcaagacctccttgccatggaggccgtcagcgattgtcagatatgtcaatcagcacgtcatcgagcgactctttggagttcgatcggtccatgccactgttcgggtatgaagccgacactaactcgtcccttgaggactatgaaggggagtctgatcaggaaactatggcccctcctatcaagagcaagaagaagaggagttcatcatttgtccttcctaagttggttaaaagccagttgcaaaaggtttccggcgtattctcctcgttcatgacccccgagaaacgaatggttaggaggatcgctgagctcagcagggacaagtgtacatattttggctgcctcgtgcaggactacgtgtctttcttacaggaaaacaaagaatgtcatgtgagctccaccgatatgctgcagaccattagacagttcatgactcaggttaagaattacctctcacaaagctccgagctcgatcccccaatcgaatcgctgatacctgaggaccagatcgacgtggtactggaaaaggccatgcacaagtgtatactaaaaccattgaaagggcacgtggaagcgatgcttaaagatttccacatggctgacggttcatggaagcagctcaaagagaatctccagctggtgaggcaacgtaatcctcaagagctgggcgtctttgcccctaccccagacttcgtggacgtggagaaaatcaaggtgaaattcatgaccatgcagaaaatgtatagtccagagaagaaagtgatgctgttgttaagagtgtgcaagctcatatacaccgtcatggagaacaacagcggcagaatgtatggagcagatgattttctgcccgtcctgacgtacgtgatagcccagtgcgacatgctggagttggacacagaaatcgaatacatgatggagctcctggatccatctcttttgcatggggaagggggatactatctaacaagcgcttacggagccctatcactcatcaaaaactttcaggaagagcaggcagcaaggctattgagctccgagactagagacacattgaggcagtggcacaagcggcgtaccacaaacagaaccattcctagtgttgatgatttccagaactacctgcgagtggcttttcaggaagtgaattccggctgcacaggcaaaaccctacttgttcggccttacatcacaaccgaggatgtgtgtcagatctgtgctgaaaagtttaaggttggagacccggaggaatattctctcttcttatttgtcgacgaaacctggcagcaattggccgaggatacttatccgcagaaaattaaagctgagcttcatagtcgcccacagccacatatttttcacttcgtctacaagaggattaagaatgacccctacggaataatattccaaaacggcgaagaagacctaacaacatcctag

SEQ ID NO: 237972 - DNA, 1389 bp, Artificial Sequence
  Description of Artificial Sequence: Synthetic coding sequence
atgacagcctggactatgggcgcacgcggattggataaacggggatctttcttcaaattgatcgacaccattgcatccgaaattggagagctgaagcaggaaatggttcggaccgacgtgaacttagagaacggtctggagccggctgagacccactcgatggtcaggcacaaggacggtgggtattccgaggaagaggacgtaaaaacatgcgcgagggatagcggttacgatagcctctcaaataggttgagcatcttagatagactgctgcatacacacccaatctggctgcagttatcactgagcgaggaagaggccgctgaggtcctccaggcacaacccccaggaatttttctcgtgcataaatccaccaagatgcagaaaaaggttctcagtctgcggttgccatgcgaattcggtgcaccgctgaaggagttcgccatcaaggaatctacatacaacgtagtgctggaaaaggctatgcataaatgcatcctcaagccacttaagggacatgtggaggctatgctgaaagattttcacatggcagacggttcatggaagcagctgaaagagaatttgcagttggtaaggcagcgcaatccacaggagctcggcgtgtttgcaccaactcccgacttcgtggacgtggagaagatcaaagttaagttcatgacaatgcaaaagatgtatagcccagagaaaaaggtcatgctactgcttcgggtatgcaagctgatctatactgttatggaaaataattccggcaggatgtacggcgctgatgactttctgcctgtccttacttatgtgatcgcccagtgtgatatgctagaattagataccgaaatcgaatatatgatggagctgctggatccctccttactgcacggcgaagggggatactatctgaccagtgcctacggcgctctcagcctcattaagaatttccaggaagagcaggccgcaagactgctttcttctgagacaagagacacacttcggcagtggcataagcgtaggactaccaatcgaacgatcccttccgtagatgatttccaaaactatctaagagtggccttccaggaagtgaactccggatgtacaggcaagaccttgttggtccgtccctatattaccaccgaggacgtgtgtcaaatctgtgccgaaaaatttaaggttggcgaccccgaagaatacagtttatttctgttcgttgacgagacctggcagcaattagcggaggatacctacccacagaaaattaaggctgaactgcacagcaggccccagccgcacattttccattttgtgtacaagagaataaagaacgatccctacggcatcatctttcaaaacggggaggaggacctcacaacaagctag

SEQ ID NO: 237973 - DNA, 717 bp, Artificial Sequence
  Description of Artificial Sequence: Synthetic coding sequence
atgtcctccgggtattcttctcttgaggaagacgccgaagattttttcttcaccgctagaacctcattctttcgcagagcaccacagggaaaacccagatcgggacaacaagatgttgagaaggagaaggaaacacatagctatctgagcaaagaggagattaaggaaaaggttcacaaatataatctagccgttactgataagctgaagatgacactcaactcgaatggcatttacaccgggtttatcaaggtgcaaatggaactatgtaagccccctcaaacttccccaaattctggcaagttgtccccttcctctaacggatgtatgaatacactgcatatcagctctactaacacggtcggggaagttatcgaggccctgctgaaaaaattccttgtaaccgaatcccctgcaaagttcgccctctacaaacggtgccaccgtgaggatcaggtgtacgcctgtaaactctcagacagggaacatcccctgtatctgcgtttagtggccggaccaaggacagataccttgtcgttcgtgttgagagaacacgagatcggagagtgggaagcctttagcttaccagagctgcaaaactttttgcgtatcctggacaaggaggaagatgagcagctgcaaaacttgaagagacgatacacagcctacaggcagaagctcgaggaggccctgcgcgaggtgtggaagccagattag

SEQ ID NO: 237974 - DNA, 507 bp, Artificial Sequence
  Description of Artificial Sequence: Synthetic coding sequence
atgaccttgaatagtaacgggatttacaccggcttcattaaagtacagatggagttgtgcaagcctccccagacaagtcccaatagcgggaaactatcaccatcctctaacggttgcatgaacacactgcatatttcttccactaataccgtgggggaagttatcgaggcacttttgaagaagttcctcgtcacagaaagtccagccaagttcgcattatacaagcgatgccatcgggaggaccaagtttacgcctgcaaacttagcgatagggagcaccctctgtatttgcggctcgtggcagggccacggacagacactctctctttcgtgctcagggaacatgagataggtgaatgggaagccttcagccttcctgagttgcagaactttctgcgaatcttagataaggaagaggacgaacaactgcagaatctaaaaagaaggtacacagcttatagacagaagcttgaggaggccctgcgagaggtatggaaacctgactag

SEQ ID NO: 237975 - DNA, 717 bp, Artificial Sequence
  Description of Artificial Sequence: Synthetic coding sequence
atgagcagcgggtattcgtccctcgaagaggatgctgaggacttctttttcactgcacgcacctcttttttccggagagccccacagggtaagccacggtccggccagcaggatgtcgagaaggaaaaagaaacccatagttacttgtcgaaggaggagattaaggagaaagtacacaagtacaatctcgcggttacggataagctgaaaatgactctcaattctaatggtatctacacaggctttattaaggtccaaatggaactgtgtaagccccctcagaccagtccaaattccgggaagctcagtccctcatctaacggatgcatgaacacattacatatttccagcactaatactgtgggagaagtgatagaagccctgcttaaaaagttcttggttacagaatcccctgcaaagtttgcactgtataaacgctgccacagggaagaccaggtgtacgcctgcaagctgtccgacagggagcatccgttgtacctgaggctcgtggccggacctaggaccgataccctttccttcgtcctgcgggagcacgagattggcgagtgggaagcttttagcctccccgagctgcagaattttctgagaattttagataaggaggaagacgagcagctgcagaacctcaagcgtcggtatacagcctacagacagaagcttgaggaagcgctccgggaggtttggaagccggattag

SEQ ID NO: 237976 - DNA, 1014 bp, Artificial Sequence
  Description of Artificial Sequence: Synthetic coding sequence
atgacaatgatggcgcaccaatacccttcatggatcttcattaatgaaaaaacttttataaccagagaacagttgaattcactgttgaaaacctacaatatattttatgagaatcagaaaaacctccatatcctatacggggagaccgaagacggaaagctgatagttgagggtatgctcgatatcttctggggggttaagagaccgattcagctcaaaatccaagacgaaaaacccttcagctccttcacctcaatgaaatcgtccgacgtgttcagcagcaaagggatgacaaggtggggggaatttgatgacctgtacagaatctccgagctggatcgcactcagatcccaatgtcggagaaaagaaactcacaggaagactacctatcctaccattccaacaccctcaagccacacgcaaaggacgagccagatagcccagtcttgtatcgtaccatgagtgaagccgcactggttaggaagagaatgaaaccgttgatgatggacaggaaggaacggcagaagaatcgtgcctcaatcaacgggcacttttataatcatgaaacgtcaatttttattcctgcattcgaaagcgagactaaggtcagagttaacagcaatatgcgcactgaagaggtcatcaaacagctcctgcagaagtttaaaattgaaaatagcccacaggacttcgcgctccacattatttttgctacgggggagcaaagacggctcaagaagaccgacattccgctcctgcaacgtctcctgcagggaccttcggaaaaaaacgctcgcatctttttaatggacaaggatgctgaagagatttcgtccgacgtggctcagtatatcaattttcacttttctctccttgagtcaatcctacaacgcttgaatgaagaagagaaacgcgaaattcagaggattgtgaccaaatttaacaaggagaaggctatcatactgaagtgcctgcagaacaaactggtcataaagacggaaacaacggtgtag

SEQ ID NO: 237977 - DNA, 978 bp, Artificial Sequence
  Description of Artificial Sequence: Synthetic coding sequence
atgctgtgggaggaaaccggtgccgctcccgctcctgcacgagcttcagatcttccctaccgcattcactttttaagcagcggtctgatcctcgtgaccaggcagctcactgaggatgggaagctgatcgtggaaggcatgctcgacattttttggggggtaaagcgccctatccagctaaagattcaggatgagaagcctttcagctcctttacgtcaatgaagagctctgacgtcttcagctccaaaggaatgacccgctggggggagttcgacgatctctaccggattagcgagctagaccgcacgcaaatcccaatgtcggaaaagaggaactcacaggaggactaccttagttatcacagcaacacactgaagccccacgccaaagacgagccagatagcccggtactgtacaggaccatgtcagaagccgctttggttcgaaaacgaatgaagccattgatgatggatagaaaggaacgtcagaagaacagggcctccattaacggccacttctataaccacgaaacatcaatttttataccagcctttgagagcgagactaaggtacgggtgaattctaacatgcggacagaagaggtcattaagcagctgttgcagaagttcaagatcgaaaattctccacaagacttcgcgcttcatatcatttttgctaccggcgagcaacgccgtctcaaaaaaaccgacatcccattactgcagcggttactacagggcccatcggaaaaaaacgcgcgtatcttcctcatggataaagacgctgaggagattagttcagacgtggcacagtacatcaactttcattttagtctcctggagtctatcttgcagcggctcaacgaagaggagaagcgggagatccagcggattgtcacaaagtttaacaaggagaaagccattatccttaaatgtctacaaaataagttggttatcaagacagagaccacagtgtag

SEQ ID NO: 237978 - DNA, 1110 bp, Artificial Sequence
  Description of Artificial Sequence: Synthetic coding sequence
atgctctgggaggagactggtgcagccccagcacccgctagggccagtgatctcccttaccggatctcttccgatcatctcaaaaaagaggagaagatgaccatgatggctcatcagtatcccagctggatttttatcaatgagaagaccttcatcacaagagagcagttgaactccctgctgaagacctataacatcttttatgagaatcaaaaaaacctgcatatcctctacggtgagacggaggacggcaaactgattgtggaaggaatgctagacatcttctggggtgtaaagcggcctatccagctgaaaatccaggacgagaagcccttctccagtttcaccagtatgaaaagctcggatgtgttctctagcaagggcatgacaagatggggggagttcgatgatctgtatagaatatcagagctcgatagaacgcagattccaatgtctgaaaagagaaactcacaggaggactacttgtcctaccattctaatacactgaaaccgcatgcaaaagatgaaccagatagcccagtgctttaccggacgatgagcgaagctgctctagtgcgcaaaaggatgaagcccctgatgatggaccgcaaggaaagacagaaaaacagagccagtatcaacggacatttttacaatcacgaaacgtcaattttcatccctgcattcgaaagtgagactaaagtgcgggtgaactctaacatgaggacagaggaggtgatcaagcagctgcttcagaagttcaaaattgaaaactcccctcaggatttcgcactccacatcatcttcgcaacaggagaacaacgacgactgaagaaaacagatataccgctgctgcagagattgctgcaaggaccatccgagaagaacgcaaggattttcttgatggacaaagatgctgaagaaatttctagcgacgtggcacagtatatcaactttcactttagcctgttggagtctatccttcaacgactcaatgaggaggaaaagagggaaatacaacggatcgtaacaaaatttaacaaggagaaagcaatcatattgaagtgcctgcagaacaaactggtaattaagactgaaactacggtatag

SEQ ID NO: 237979 - DNA, 912 bp, Artificial Sequence
  Description of Artificial Sequence: Synthetic coding sequence
atgaccatgatggctcaccaatatcccagctggattttcatcaatgagaagacttttatcacccgggaacagctgaactcactgctgaagacctacaatatattctacgagaaccagaagaacctgcacatcttatacggtgagacagaagatgggaagctgatagtcgaaggaatgttagatatcttctggggagtcaaacgcccaatacagcttaaaatccaagacgaaaagcctttctcttcttttacgtcgatgaaatccagcgacgtgtttagttccaaaggtatgactaggtggggcgagtttgatgatttgtaccgaatctcggagctggatcgtactcaaatccccatgtcggagaaacgtaatagccaggaagactatctgagctatcactccaacacacttaagccgcacgctaaagatgagccagattcccccgtcctttatcgcaccatgagcgaggcagcattagtgaggaagcggatgaaacccctgatgatggataggaaggaaaggcagaagaatcgcgcttccataaacgggcacttttacaaccatgaaattgagaattctccccaggattttgccctacacatcatttttgccactggggagcagagacggctgaagaaaacagacatacctttgttacagcgcttgttgcagggaccctccgaaaagaacgcacgcatttttctcatggataaggacgctgaagagatttcttccgacgttgcacagtatatcaactttcacttctccctgctggaaagcatactgcaaagacttaatgaggaagagaaacgtgagattcagcgtatcgtcactaaatttaataaggagaaggctatcattctcaagtgccttcaaaacaaactggttatcaagacagaaacaacagtgtag

SEQ ID NO: 237980 - DNA, 3141 bp, Artificial Sequence
  Description of Artificial Sequence: Synthetic coding sequence
atgctgtccaggaccctgtcttacaagtatcgtgatctggactctacattttcctccctcggagcctcggacgatcccgctgaattatcaacccagctgagtgcacctggcgtcttaaaggtgttcggcgactctgtgtgtaccggaacccattacaagagcgttctggctaccggaacatccagcgctagggagctggttaaggaagctctggaaagatacgctctcgacccgaggcaagctggccagtatgtcctgtgtgacgtggtcggccaggccggagatgccggacagaggtggcaagcaaggtgttttcgcgtattcggggactccgaaaagcctttgctcatccaagaactgtggaagcccagagagggtctgtcccgccgatttgaacttagaaaacgtagcgatgtcgaagagctggctgcaaaagaggtggacacgatcacagctggcatcaatgcccaggcacggaggttacagcgcagtagagccaaaggaacgcctacgcctgcccttggtgacgccagaagcagccccccaccaaggcttagacgtacagttagcgaaaccagcctttctcctgtaaacgctctgccggctgccgcacaggggcctgaggaacccggacccgacgcaatgaggtacagtctttaccagtcccctcacctgctgttattgcaaggctattcgcagcagcatccaggcgtctgcgctcagcccggtccggctcatgggggacccgctgatccaagcaaacctagcattagcctgagcgctcctgacattctgcctctccattgtacaattcgacgccagcccctgcctgactcaggccaagccgctgggaggcttgtgctcgagccgatcccaggggctcatatttcggtgaacttctcagaggtaggccataggactgtggtgctccatcacggtgatctgctgagcttgggtctttactatctattgttgtttaaagatcccgctcaggctcagccattgcctgccagagcactcgctaggttaagagcagtgcctcagagttgtcggttatgtggtgccgcactgggagctcgtggagcagcctcccccacccaggcagcgcttccgcgacgccagcaactcctgctggaatttgagccgcacctggaggatactctgctccaacgtatcatgaccctgattgagccaggcggagacgaccacaagttgacccccgcttttttactctgcttgtgcatccaacactcggccacccatttccagcccggaacctttggacagctcttgttaaaaatcgccaggctgatacgcgagactgtctgggaaaagactaaggaactcgccgaaaagcaggcccaacttcaggagcctatatcgctcgccagctgtgccatggccgacctagtacctgaccttcagccgattctgttttggatgtccaacagtatcgagcttctgtacttcattcagcagaaatgcccgctctacatgcagagcatggaagaacagctcgacatcaccggatccaaggagagcctcttcagttgcactcttaccgcatctgaggaggctatggcggtgcttgaagaagtggttctgtacgcttttcagcagtgcgtttattatgtgtcaaagagcctgtacatatgtcttcccgcattgcttgaatgtccaccgtttcagaccgaaaggcgagagtcatggagcagcgccccagaactgcccgaggagttaaggagagtagtgtctgtgtatcaggccgctctggacttgctgcgtcagctgcaggtacaccccgaagtagcttctcaaatgttggcatacctgtttttcttctctggaacgctactcctcaatcagttgctggataggggcccatcactaagctgcttccattggcctaggggtgtccaggcttgcgctagattacagcaactcctggagtggatgcgttcagccggttttggagctgccggtgagcacttcttccagaaactgtcctgcaccctaaacttactcgctacgcctcgagctcagttgatacagatgagctggaccgcacttagagccgcattccccgctctcagcccagctcaactgcacaggttactgactcactaccagctggcttcagccatggggccaatgagtacttgggagcctggagcgcaggactccccggaagcttttcgctcagaagacgtactggaaagctatgagaacccaccccctatcgtcctgcccagcgacggcttccaggtggacctcgaggccaactgtctagacgattcgatatatcaacacttgctatacgtcagacactttctgtggggcctcaggagcagggcctcccctggatctcccggaaggccagggagcggggcttcacaacccgtttgccccgagggaatgcatcacgtggttctcgatggtcatctggaggcccctagctgcccactcgcacccagggaccccggacccgcagcacgcgaagtcgcaccagagaggactctgccactgagaggtgcgccttgggctcaagctccgccaggtcggcagccatctcgcggaggctcccaggcaggcccacctcacaccgacagttcttgccttctgactcctccatcaacgcctctcggcccagaacctggcgatcctgattggcctgagtctggtgggccttgtggcaaggccctgcctgaaagacagcgcaatggcctatctggcttacggggtgccgcaccagagggggattcagcagccctggcggaggaatcccccccagccccatcatcacggagctcctccaccgaagatttctgctatgtgtttaccgtggagctggagagaggtccatcggggctagggatggggctgattgacggaatgcatactcacctgggtgccccaggcttatacatccagaccctcttgcctggctcccccgctgctgccgacggcaggttgtccctcggagacaggatcctggaagtgaacggctcctcgttgctgggcttaggctatctgcgggcagttgatcttatccggcatggcggaaagaagatgcgtttcctggtcgcaaaaagtgacgtggagaccgctaagaagatccactttcgcactcccccactctag

SEQ ID NO: 237981 - DNA, 3228 bp, Artificial Sequence
  Description of Artificial Sequence: Synthetic coding sequence
atgttctacggaacccactttatcatgagtcctcctaccaagtcaaaactcaagcgccagtctcaactgctctcaagcatgctaagccgaacactgtcatacaaatatcgcgatttggactctacattcagttccctcggagccagcgatgaccctgccgagctctctacccaattatccgcacctggcgtgctgaaggtcttcggagatagcgtttgtacaggtacccactacaagagcgtacttgctacagggactagtagcgcgagggagctggtgaaggaagctctcgagcgttacgccttggatccaagacaggcaggccagtacgttctgtgcgatgtagtgggccaggcaggagatgctggccagaggtggcaggcacgctgctttcgggtctttggcgattccgaaaagcccctgctgatccaggagctttggaagccaagagagggccttagccggagatttgagctgcggaaaaggagcgatgtggaagaactggcagctaaggaggtagacacaataactgctgggatcaacgcccaggccagacgtctgcagaggagcagggccaagggcacccctactcctgcactgggagatgcacgttcctcccccccacccagattgcgaagaaccgtatcagagacctcgctgagtcccgtgaacgccttaccggcagccgctcagggccctgaggagccaggacctgacgccatgcggtactccctttaccaatccccacatttgctgttactgcagggatactcccagcagcatgacagcttggtgtatgtactgaacagagatcggcacacagtggggcagcgaactcctagcagtaagccgagtattagtctgagcgcaccggacattttacccctacattgcacaatacggcgacagccgctgcctgatagtggacaggctgccggtcggctcgtgcttgaaccaatcccgggagctcatatcagcgttaacttcagcgaggtggggcacagaacggttgttctgcaccacggagacctcctgtccttgggcctgtactacctgctgctcttcaaggaccccgctcaagctcaacccctgcctgcacgtgcgctggctaggttgcgagccgtgcctcagtcttgtaggctttgcggggcagccctgggcgctcggggtgccgcaagcccgacgcaggcagccctaccgaggcgtcaacagctgcttcttgagttcgaaccacacctcgaagatacgctcctacaacgaattatgacacttatagaacctggcggagatgaccataaactgacacctgcattcctgttgtgcctgtgtatccaacattccgccacacatttccaaccgggaacgtttggccaattactgcttaagatcgctcggctcattagagagaccgtgtgggagaaaaccaaggaactggctgagaaacaagcccagctccaggagccgattagcctcgcttcgtgcgctatggcagatctggtcccggacctccagcctatcctgttctggatgtcaaacagcatcgaactgctctactttattcagcagaaatgccccctctacatgcagagcatggaggagcagctcgatatcacgggcagcaaggagtctcttttctcttgtacactgaccgccagtgaggaggcgatggctgtcctcgaggaagttgtactctacgctttccaacaatgcgtgtattacgtgtctaagtccttgtacatctgtttgccagcgctgctggaatgcccaccatttcagaccgagagaagagagagttggtcctcagcccctgagttgcctgaggagctcaggcgggtggtgagcgtctaccaggccgctcttgacctgctccggcagctccaggtccatccggaggtggcttcccagatgttggcttacctgtttttttttagtggcaccctgctgctcaatcaacttttggaccgcggaccttctctctcttgtttccactggcctaggggagtgcaggcctgcgcgcgacttcagcagctgctggagtggatgagatcagcaggcttcggggctgcaggggagcactttttccagaaacttagctgtaccctaaacttattggcgactccaagggcacagcttattcaaatgagctggaccgcactccgggctgcgtttcctgcactttctcctgcacagctgcaccgactgctgactcactaccaactagcctccgcgatgggcccaatgtccacttgggagccaggcgctcaggattctcctgaagctttccgctcagaggacgtactcgagtcctatgagaacccgccacccatcgtactccctagtgatggtttccaggtcgacctcgaagctaattgtctggacgactctatctatcaacatcttctctatgtccggcattttttatggggccttaggtctagggcttccccaggatcgcctgggagacctgggtccggcgctagtcagccagtatgccctgaggggatgcatcacgtagtcctggatggccatctggaagcacccagttgccctctggccccacgggatcctgggcctgcagctcgggaagtggcccctgaacgaacactccctctcagaggggctccctgggcccaggctccccctgggaggcaaccgtctaggggcggtagccaggccggaccgcctcataccgactcctcctgcctgctcacaccaccctccacgcccctcgggccagaacccggagatcccgactggcctgagtccgggggaccttgcggcaaagcactgcctgaacgacagagaaacgggctgtctggattgagaggagccgctcctgagggggattcagccgcactcgcagaagagtcccctccagctccctctagtcggtcttcttctacagaagacttttgctacgtgtttaccgttgagctcgaacgcggaccatcaggactgggaatgggcctgattgatgggatgcatactcacctcggcgcacccggtctatatatccagacattattacccggatcccccgcagccgctgacggaagactgtcattgggggacagaatactggaagttaatggctcttctttactgggactcggatacctgagagcagtggatctcattcgccacggaggaaagaagatgcgttttctggtcgctaaatccgacgtggaaacggccaagaagatccactttaggacccctcctctgtag

SEQ ID NO: 237982 - DNA, 405 bp, Artificial Sequence
  Description of Artificial Sequence: Synthetic coding sequence
atgttttacggcacccacttcataatgagcccacccacaaagtccaaactgaaacgccaatcccagttgctcagctccatgctttctcgtaccctgagttacaagtatagggacttagatagcaccttcagctcactaggcgcaagtgacgaccccgctgaacttagcacccagcttagtgcccctggtgtcttaaaggtgttcggagactccgtttgtactggcacacactacaagagtgtcttggccactggaacttcatcagcaagagaattggtaaaagaggccttagaacgctatgcgttggatccgagacaggctggacagtacgtcctgtgtgacgtggtggggcaggctggtgatgccggacagcgctggcaggccagatgcttccgggttttctag

SEQ ID NO: 237983 - DNA, 1629 bp, Artificial Sequence
  Description of Artificial Sequence: Synthetic coding sequence
atgttctacggaacgcatttcataatgtcgccgccaacgaaatccaagctgaagcgccagtcacagctgctgagttcaatgctaagtcgcactctgtcctataagtatcgggatctggactctacctttagttcgttaggcgctagtgatgaccccgcagagctctctactcaattatctgccccaggcgttctaaaagtcttcggtgacagcgtgtgtactggcactcactataagtccgttctcgcgaccggtacttctagtgcgagggagcttgtgaaagaggccctagagcgatacgccctcgatcctcgacaggccggacagtacgtcctctgtgatgtggtaggacaggctggagatgctggacagaggtggcaggcccgatgtttccgagtgttcggcgacagtgaaaaacctttgctcatacaagagctctggaaacccagggagggactgagcaggaggtttgagctccgcaaaaggagtgatgtggaagaacttgcggctaaggaggtcgataccattactgcaggcattaatgcgcaggccaggaggcttcaaaggagcagggctaagggaacaccgactcccgcattgggggacgcgagatcatcccccccaccgaggctgcggcgaacagtaagcgaaactagcctgagtcccgtcaacgctttgccagcagccgcacagggcccagaggagccaggaccagatgctatgcgctatagcctgtatcagtccccccacctgctgctgttacagggctactcccaacagcacgactctctggtgtatgttctcaatcgcgatcgtcacacagtgggccagagaacaccatccagtaaaccatccatctcactgagcgcgccagacatactgcccctccactgtacaatcaggcgtcagccgctgccggattccggacaggccgcaggacgattggtgctggagcctattcctggggctcatatttccgtgaatttttcagaggtgggtcacaggacagttgtactgcaccacggcgatctgctaagccttgggctctactatctcttgttgttcaaggatcccgctcaagctcaacccttgccagctcgagcattggctcggctgcgagccgtaccacagtcttgccggctgtgcggcgctgcattgggcgcaaggggcgctgcctctccaacacaggctgccttgccacgacggcagcagctcctcctggaattcgaacctcatctggaggacactctcctccagcggattatgaccctgatagagccaggcggagatgatcacaagctcaccccagcctttctgctctgtctctgcattcagcatagcgcgacgcactttcaacccggaacattcggtcagctgctgttaaaaatagcaaggctgataagggagaccgtatgggaaaaaactaaagagctggccgaaaagcaggctcaacttttggagggaatcgcggtgctgctccacgccgatgggcaacgtgggggtcatggaggggctggtgggggaggagccgttagattgcctgccgtgcggctgctatgtcttcaggtgcccgtgcacctgccgccaggaacacctggcgtgcctgccatacccgatggcgctccgtag

SEQ ID NO: 237984 - DNA, 2508 bp, Artificial Sequence
  Description of Artificial Sequence: Synthetic coding sequence
atgcggtatagcctgtaccaatcacctcatcttctgttattacaagggtactcccagcagcatgattcactggtctatgtgctcaacagagacagacatacagtcggccagcgcactccaagctctaaaccgtcaatttcgctgagtgcccctgacatcctgcccttacactgtactataagacggcagccgctgcccgatagcggacaagccgcaggcagactcgtattagagcccatccccggagcccacataagtgtgaatttcagcgaggtgggtcataggacagtagttctgcaccatggggatctgctaagtctgggactctattatctgcttctcttcaaggatcctgcacaggctcagcctttgcctgctagggccctggccagacttagggccgtcccccagagctgtagactctgtggagcggctctgggtgctcgtggagcagccagtcctacccaggccgctctccccagaaggcagcagctccttctggagttcgaaccgcatcttgaggataccctcctgcagcggatcatgactttgatcgagcccggaggggatgatcataaacttaccccggcatttctcctctgcttatgtatccaacatagtgcaacgcattttcaacccggtacattcggccagttgctgctgaagattgctcggctgatcagagagaccgtctgggagaagaccaaggagctggccgaaaaacaggctcagcttcaggagccaataagtctcgctagctgtgcaatggcagatctggtacctgacctccagcccatactgttctggatgagcaatagtattgagctcctgtacttcattcagcagaagtgccctctttatatgcagtcaatggaagaacagttggatatcaccggatcaaaggagagtctgttttcttgtacactcaccgcctctgaggaagccatggcagtgttagaggaggtggttctttatgcttttcagcagtgcgtatattacgttagtaagtccctgtatatatgtttacctgcacttctggagtgccccccatttcagacggagaggcgggagagctggagctctgcacccgagctaccagaggagctacgcagagtggtgtcagtgtatcaggcagccttggaccttctccggcagctgcaagtccacccggaggtagcttcccagatgctggcctacctttttttcttcagcggcacgctgctgttgaaccagctcctggaccgagggccaagcctgtcctgttttcattggcccaggggtgttcaggcttgcgcccgtctccagcaattgctcgaatggatgagatctgcgggttttggggctgccggtgagcattttttccagaagctctcctgtactctaaatttgctggctacccctcgggctcaactgatccaaatgtcctggacagccttgcgggcagccttccctgcactgtcacctgcacagcttcatagattgctgacacactaccagcttgccagcgcgatgggaccaatgtccacctgggaaccgggagcgcaagattccccagaggctttcagaagtgaagacgtgctggaatcctacgaaaatccgcctcccattgtgcttccatcagacggatttcaggtggatctcgaagcaaactgcttagatgactccatctaccagcatctgctgtatgtgagacactttttatggggactgcggagcagagcttctcccggaagtcctggcagacccggatcgggcgcttctcagccagtctgccctgagggaatgcatcatgtagtgctggacggtcatctggaagctccgtcatgccccctggcgccaagggatcccggtcctgctgctcgcgaggtagcccctgaaaggactctgccactgagaggggcaccttgggcacaggccccacctggcagacagccctcgagggggggaagtcaagccggaccaccccatacggatagctcgtgtttgttaacccccccttctactcctcttggacccgaacctggagatcccgattggccagagtcggggggtccatgcggcaaagctctgcccgaacgccagaggaacggactgtccgggctgaggggggcagccccagagggtgacagcgcagcactggcagaggagagcccgccagccccatccagcagatcctccagcacagaggacttctgttatgtattcaccgtcgaactcgagcgcggtccctccggcctgggaatggggttgatcgacgggatgcacacacatttgggagcaccaggactatacattcagacacttcttcccggttcccctgcagctgccgacggcagactgagtctgggagaccgcatccttgaggtgaacgggtcatccctgctggggttgggttatctgcgggctgtcgacctgatcaggcacggcggaaagaaaatgaggtttctcgttgccaagagcgatgtggagaccgcgaagaaaatccacttcagaacacctcccctatag

SEQ ID NO: 237985 - DNA, 2085 bp, Artificial Sequence
  Description of Artificial Sequence: Synthetic coding sequence
atgtgctccacagggaccgggactcggtgggcaagtgggccacccccagcatctccagcctctgcaagtcagcccccaaccagctgcctgtacaccgctccatccgccggtaatcgttcacgaacagccgctcggcctagaggcggttggttagagccgatccccggtgctcatatcagcgtgaacttctcagaagtcgggcaccggactgttgttctccaccacggcgatcttctttctctgggactttattacctgcttctttttaaggaccccgcacaggctcagcccttacctgccagggccttggccaggctgagggccgtgccacagagctgccggctgtgcggggcagctctgggtgcccgaggggcagccagcccgacacaggcggcactgccccgacggcagcagctcctgttggaatttgaaccccatctcgaagacacattgctacagagaatcatgacacttattgaacccggtggcgacgatcacaagctgacaccagccttcttactgtgtttatgcatccagcactctgccacacattttcagcctggaaccttcggccaactcttactcaagattgcacgcctgatccgcgagactgtgtgggaaaaaacaaaagaactggctgaaaaacaggcccaactccaggaaccaattagtctggcatcgtgtgccatggccgatctggtccctgatctccagccgatcctcttctggatgagcaacagcatcgaattactctatttcattcaacagaaatgccccctgtatatgcagtccatggaggaacaactggatatcacaggaagtaaagagtcccttttttcttgcactttaactgcctccgaggaggcaatggccgttctggaggaagtcgtgctatatgcctttcaacagtgtgtgtactatgtcagcaaaagcttgtatatctgtctgcccgctctgctggagtgtccgcctttccagactgaaaggcgggagagttggagtagcgccccagagctgcctgaagaattgcgcagggtcgtgtctgtttaccaagctgcgctggacctcctcaggcagcttcaagtccacccagaggtggccagccagatgttggcttatcttttcttcttctctggcactttgctgctgaatcagttgttagaccggggaccttcgttatcatgttttcactggcctcggggagtccaggcgtgcgctcgtctccagcagttgctggagtggatgcgttcggcaggatttggagccgcaggcgaacatttcttccagaagttgagctgcactctcaaccttctggcaacacccagagctcaacttatacaaatgagctggaccgccctccgggctgcattccctgccctctccccagcccagctccataggctcctcactcattaccaattggctagcgccatgggacctatgtcaacatgggagcccggtgcccaggatagccccgaggcattccgcagtgaagatgtattagaatcgtacgaaaatcccccacccatagtgctcccatccgatggctttcaggtagatctggaggcaaattgcctggacgatagcatataccagcatctactctacgtccggcatttcctgtggggcctgcgatcccgggcttcaccgggttcaccaggcaggccaggcagtggagcttcacagcctgtgtgcccagaaggcatgcaccatgtcgtcctcgatggccaccttgaggccccaagctgtcctttagcccctcgcgatcccggacctgcagcacgggaggtagcacccgagcggactctgcctttgcggggagctccgtgggcacaggctcccccagggcgacagccccctggcctatatatacaaaccctcctgcctggatcacccgctgccgctgacggtaggctatccctgggagacagaatactcgaagtgaatggaagcagcctcctaggcctggggtatctcagagccgtggacctaataaggcacggcggtaagaagatgagatttcttgtggccaagtcagatgtagagacagccaaaaaaattcattttcggactcctccgttgtag

SEQ ID NO: 237986 - DNA, 369 bp, Artificial Sequence
  Description of Artificial Sequence: Synthetic coding sequence
atgaaattggcagctatgatcaagaaaatgtgcccgtctgattcagaactgtccatccctgctaaaaactgttatcggatggtgattctgggtagttcaaaagtgggaaagaccgcgatcgttagtagatttcttactggacgctttgaagatgcttacaccccaacaattgaggactttcatcgcaagttttactccattagaggtgaggtataccagctggatatcctcgacacaagcggcaatcatccttttcccgcaatgagacgtctttcaatccttacagatcctcgtcaccaggtgctgccccaagaacagaaccagggcgagcgcggtagggctccaggccatctcagacagcaggggtag

SEQ ID NO: 237987 - DNA, 2394 bp, Artificial Sequence
  Description of Artificial Sequence: Synthetic coding sequence
atgggtaccctggggaaggcccgagaagcaccacgaaaaccatcacacggttgtcgcgctgccagtaaagcccgattagaggccaagcctgctaattctccctttcctagtcatcctagcctagcccacattacgcagttcagaatgatggtgagcctgggacacctggccaagggtgcgtctctggacgacctgattgatagttgcatccagagttttgatgcggacgggaatctttgtcggtccaatcagctgttgcaggtaatgctgacaatgcaccgcatcgtgatctcatcggcagagttgctgcagaaggttatcaccctgtataaagacgctctagccaaaaattcccctggcttgtgccttaaaatctgctattttgtacggtactggatcaccgaattctgggtgatgttcaaaatggacgcgtcgctcaccgataccatggaggagtttcaggaattggtgaaagctaaaggcgaagagctgcactgtaggttaatcgatacaacacaaataaatgccagagactggtcaaggaagctcacccagcggatcaagagtaacactagcaagaagaggaaagtgagcttgctctttgaccaccttgagcccgaggaactttctgagcacctcacatatctcgagttcaagtcctttaggcgtatctctttctctgattatcagaattaccttgtgaactcctgcgtgaaggagaatccgactatggaacgctccatcgcgctgtgcaacggaatctctcagtgggttcagctgatggtgcttagcaggcctacaccccagctgagggcagaagtttttatcaaatttatccaggtggcacaaaagctccatcaactgcagaactttaataccttgatggcagttatcggcggactttgccatagctctatttctcgattaaaggaaaccagcagccacgtccctcacgagattaacaaggtattgggcgagatgacagagctgctgtccagttcccggaactatgataattacaggcgggcttacggcgaatgtactgatttcaaaatcccaatactgggcgtacatttgaaagaccttattagcctttatgaagcaatgccggactatctggaagatgggaaagtgaacgtacacaagcttctggctctgtataaccacattagtgagctagtacagcttcaggaggtggccccacctctcgaggctaacaaggaccttgtccacctcctgacgctttctctggatctgtattacaccgaggacgagatatatgagctgagttacgctagagaacccagaaatcacagggctccccctcttacacctagcaagcctccagtcgtggttgattgggcaagcggagtcagccccaaacctgatccaaaaaccattagcaaacatgttcagagaatggtcgattccgttttcaaaaactacgaccatgatcaagatggctacatatcccaggaggagttcgaaaagattgccgcatcatttcccttctcattttgcgtgatggataaggaccgcgagggtctcatttctagagatgagatcaccgcttatttcatgcgggcaagcagcatctatagtaaactggggttaggctttcctcataactttcaggagactacctacctgaagccgactttttgtgacaactgcgccggtttcctatggggagttattaagcagggttataggtgcaaagattgcggcatgaactgtcataaacagtgtaaagacctggtcgtattcgaatgtaagaagcgggctaagaacccagttgcacctactgaaaacaatacctctgtcgggccagtgagtaatctgtgttcgcttggagccaaagatttgttacacgcacccgaggagggcccattcacttttccaaatggagaagccgttgagcatggggaggagtcaaaggatcggaccattatgcttatgggggtaagctcccagaaaattagcctgagactgaagcgcgcagtcgcccacaaggccacgcagacagaatcccaaccctggatcggctccgaagggcctagcggcccattcgtgctgtcatctcccagaaagaccgctcaggacacactgtacgtgctcccttcccctacctcaccgtgtcccagccccgtgcttgtgcgaaaacgtgcgtttgtgaaatgggagaacaaagacagtctaataaagagcaaggaggagctgaggcacctgcgcctgccaacctatcaggaattagagcaggagataaatactcttaaagccgataatgatgctcttaagatccagttgaagtacgcacagaaaaagattgagagtctccaattggagaagtccaatcacgtcctggcacagatggagcagggtgactgctcctag

SEQ ID NO: 237988 - DNA, 1794 bp, Artificial Sequence
  Description of Artificial Sequence: Synthetic coding sequence
atgggcactctgggcaaagccagagaggcgcctaggaaaccgagtcatggctgtcgagctgcctccaaagccagactcgaggcaaaacctgccaacagtccctttccttcccaccctagcctcgcacacatcactcagttccgcatgatggtgtctttagggcaccttgctaagggagcctctctggatgacttgattgacagctgtattcagtcttttgatgcagacggcaatttgtgcaggagcaatcagctcctgcaggtgatgctgaccatgcataggatcgtaatctcttcagctgagctgctgcagaaagtgatcactctatatcccgatgccctcgctaaaaattctcctggcctgtgtctgaaaatttgttactttgttaggtactggatcacagagttttgggtgatgtttaagatggatgcctcactcacagataccatggaagagtttcaggaacttgttaaagctaagggcgaggaactccattgtaggctgatcgacacgacccagatcaacgccagggattggagtcgtaagttgacacagcgcataaaatctaatacatctaagaagagaaaagtgtccctgctttttgaccatctcgagcctgaggagctctcagaacatcttacctatttagaattcaagtcatttcggagaatctcctttagcgattatcagaactacctggtgaatagctgcgtcaaggagaaccccacgatggagcgctcaatcgccttgtgcaacggaatcagccagtgggttcaactgatggttctctctcggccaacacctcaactacgcgctgaagtgttcatcaaattcattcaagttgcccagaaattgcaccaattgcagaactttaatacactgatggcagtgattggagggctctgccatagctctatcagccgcttaaaggagacctcaagtcacgtgccccacgagataaataaggtactgggagagatgaccgagttactcagctcctctcggaattacgataactaccggagggcatacggggaatgcactgacttcaagattcccattctgggggttcatctaaaagacttgatttccctgtatgaggcaatgcccgactacctggaagatggcaaagtcaatgtgcacaagcttctggcgctctataaccatatcagtgaactggtacagctgcaggaggtggctccacctctagaagccaataaagacttggtgcatttgctcacactatcactggatctatactacaccgaggacgagatatatgagctgtcctacgcccgagagcctaggaatcatcgggcacctagcgttttcaaaaattacgatcatgatcaggacggttatatttcccaggaggaatttgaaaagatcgctgcaagttttcccttctcattttgtgttatggataaagatagagaaggactcatcagccgcgacgagatcacggcctattttatgagggcttctagtatatacagcaaactgggtctgggttttcctcataattttcaagaaaccacgtatcttaagcccactttttgcgataactgtgctggcttcttgtggggtgtgattaagcagggctacagatgtaaggactgcggcatgaactgccataagcagtgcaaggatctggttgtatttgaatgcaagaagagagctaagaatccagtggccccaaccgagaacaacactagcgtggggcctgtgtccaacttgtgcagcctcggtgccaaggacctactgcacggcaacaaatactctgaaagcagatag

SEQ ID NO: 237989 - DNA, 1641 bp, Artificial Sequence
  Description of Artificial Sequence: Synthetic coding sequence
atggggactttgggcaaggcaagggaagcacctcggaagcccagccatggatgtagagcagcttctaaagcccgactcgaagctaaaccagccaactcaccgttccccagccacccaagcctggctcacatcactcagttccggatgatggtgtctctgggccacctcgccaaaggggcttcattagacgatctgattgattcttgcattcagtcctttgatgccgatggcaacctctgccggagcaatcagttgctccaggtgatgctgaccatgcataggatcgtcatctcctccgctgaactgctccagaaggtcattacactataccccgacgccttggcaaaaaattctccaggcttgtgcctaaaaatctgttatttcgtacggtattggattactgagttttgggtcatgttcaaaatggatgcttctttaacagataccatggaagagtttcaggagctggtcaaagccaaaggcgaagagctgcattgtagactgatcgatacaacccaaatcaacgctcgagactggtctagaaagttgacccagcggattaagtccaacacctctaaaaagcgcaaagtcagtctgctcttcgaccacctcgaaccagaagagctttccgagcatctcacttacctggagtttaaaagcttccgcagaattagctttagcgactatcaaaattatcttgtgaacagttgtgtaaaagaaaatcctacgatggaaagatccattgcactttgtaatggtatttctcagtgggttcagctcatggtactgagcaggccaacccctcaacttcgtgcggaggtgtttattaagttcatccaggtggcccagaagctgcatcaactgcagaattttaatacgctcatggcagtgatcggtggtttgtgtcatagcagcatatctaggctcaaagaaaccagctcacacgtgccacatgagataaacaaagtcctcggcgagatgacagagctcctgagcagttccaggaactacgacaattaccgtagggcgtacggagagtgtacagactttaaaatcccgattctcggagtgcatctgaaggacctgatttccttgtacgaggcaatgcctgactacctggaggacgggaaggtgaacgtgcacaaattgttagctctctataatcatataagtgaactcgtgcaactgcaagaagtggctcctcctctcgaggctaacaaagacctggtgcatctgctgacgctcagcctagacctctactacacagaagacgagatttatgagctttcttatgccagagaaccaaggaatcaccgggctccctctgttttcaagaattacgatcacgatcaggatggttatattagccaggaagaattcgagaagatagctgccagctttccgttttccttttgtgtgatggacaaagatcgtgaaggcctgatttcacgagatgaaattactgcatacttcatgcgtgccagcagtatctactctaaattaggactgggcttcccccataattttcaggaaaccacttacctcaagcccactttctgcgataactgtgccggtttcctgtggggggtgataaagcagggatatagatgcaagggcaataagtactcagaatcccgctag

SEQ ID NO: 237990 - DNA, 2289 bp, Artificial Sequence
  Description of Artificial Sequence: Synthetic coding sequence
atgggaacacttggcaaggcgagagaggcgccaagaaagccttcccacgggtgccgggcagcgagtaaagcaaggttggaggccaagccagcgaattccccctttccgtcccatccttcactagcccatataacacaattccgcatgatggtcagcttgggccacctggccaagggcgcttctctggacgatcttatcgattcctgcatccaatctttcgacgccgatggcaatctgtgtcgctcaaatcaactccttcaggtgatgctcacaatgcatcggatagttatcagcagtgccgaactactccaaaaggtgataacattgtacaaggacgccctcgcaaagaacagtcccggtctatgtcttaagatctgctactttgtccgctactggatcaccgagttctgggtcatgtttaagatggacgcatctctcactgacactatggaagaattccaggaactggttaaagcgaagggggaagagctgcactgtcgtttaattgatactacccagatcaatgctcgagattggagtcgcaaactgacgcaaagaataaagtcaaatacgagcaagaaaagaaaagtgtccctgcttttcgatcatttagagccggaagaattgtccgaacacctgacatacttagaattcaagagtttccgtaggatctcatttagcgactaccagaattacctcgtcaatagctgtgtgaaagaaaacccaactatggagaggagcattgccctgtgtaacggtatctctcagtgggtgcagttaatggtactgtccagaccaactccccagttgcgcgctgaggtcttcatcaaattcattcaagttgctcagaaactacaccagctccaaaactttaacacactgatggctgtgattggaggcctatgtcacagttcaatctcaagacttaaggagaccagcagccatgtgccacacgaaatcaataaggtgctgggagagatgaccgaactcctgtcgagctccaggaattacgacaactatcgtagggcctatggggagtgcactgacttcaagatccccattctcggcgttcatctgaaggaccttatcagcctttacgaggccatgccggactacctggaagacgggaaagtgaatgtgcacaaattgctggcactgtacaatcacatatctgaattggtgcaattacaagaggttgctccacccctggaagcgaataaagatctagttcacttgcttactctgagtcttgacctatattataccgaggacgagatttatgagctaagttatgctagggagccccgtaaccacagagctccgtccgtttttaagaattacgatcacgatcaagacggatatatcagtcaagaggaatttgagaagattgccgcttcatttcctttcagcttttgtgtcatggataaagatcgcgaggggttaatcagccgggatgagattactgcctatttcatgcgtgcctcttcaatatactcgaagctgggcttgggctttccccataatttccaggagactacttacttgaaaccaacattttgtgacaactgtgctggtttcctgtggggagtcattaaacagggttaccggtgtaaggactgcgggatgaactgtcataaacaatgtaaggatttagttgtgttcgagtgtaaaaagcgggcaaaaaatcccgtggcacccacggagaacaatacatctgtcggacccgtttcaaacctgtgctctctcggagcaaaagatctgttgcatgcccctgaagaagggccttttacttttccaaacggggaagccgtggagcacggggaagaatcaaaagacagaacaataatgctgatgggggtgtcttctcaaaaaattagcctgagacttaaacgcgctgtggcacacaaagcaactcagactgaatctcagccttggatcgggtccgaaggaccttctgggccattcgtcctgagctctccaaggaaaaccgctcaggacaccttatatgtgttgccaagccccaccagtccatgtccttccccagtgttggtgagaaaacgtgcctttgtcaagtgggaaaacaaggactcactgattaagagcaaagaggagctgaggcatttgcggctccccacatatcaggagctagagcaagagattaatacccttaaggccgataacgatgccctgaaaatacagctgaagtacgcgcagaaaaagattgagagccttcagctggagaagtctaaccacgtcctggcccaaatggagcagggtgactgtagctag

SEQ ID NO: 237991 - DNA, 2250 bp, Artificial Sequence
  Description of Artificial Sequence: Synthetic coding sequence
atgatggtgtctctaggtcatcttgctaagggtgcttcattggatgatctgattgatagctgtatccaatcatttgatgccgacgggaatctctgtcggagcaaccaactcttacaggttatgttgaccatgcatcgtatcgtaatttcctcagccgaactactccaaaaggtgatcaccctgtacaaggacgcactggcaaaaaattcaccaggcctctgtttaaaaatctgctatttcgtaaggtactggatcacagagttctgggttatgttcaaaatggacgcatctcttactgacaccatggaagagtttcaggagctggtgaaggcaaagggggaagaattacactgtcgactaattgacacaacccagattaatgcacgcgactggtcccgtaagcttactcagcggatcaaaagcaacacatcaaagaaaaggaaggtgtctcttttgtttgaccacctggaaccagaggaactgtccgaacacctgacttacctggagtttaagtcctttaggcggatctcttttagcgactatcagaactacctggtgaatagctgtgtaaaagaaaaccccacgatggagagaagcatcgctctttgcaacggtatcagccaatgggttcagttgatggtgctgagcagacccacacctcagctacgcgctgaagtattcatcaaattcatccaggtcgctcagaaactgcatcagctccaaaatttcaacacactaatggccgtgatcgggggtctctgtcacagttcgatctctagattaaaggaaacctcttctcatgtgccacatgaaattaacaaggtgctaggtgagatgacggaactgctgtcctcctctaggaactatgacaattaccgccgtgcatatggcgagtgcactgactttaagattcccatactgggagtgcatctcaaagatttgataagtctttacgaagctatgcctgactacctggaagatggtaaagtcaatgttcacaagctcttggccctttacaaccacatcagcgaactggtccagctacaggaagtggctcccccactagaggccaacaaggacctggtgcatttgctcacactctcactcgatctgtattataccgaagacgagatttatgaactctcatacgcccgtgagcctcgaaatcacagagcccctccccttactccaagcaaacccccagttgtggtggattgggcgagcggagtgagtcccaaaccggatcctaagacaattagcaaacatgtgcagaggatggtggattccgtgttcaagaactatgatcatgaccaggatggatacatatcacaggaagaatttgaaaaaatcgccgctagcttccctttttctttttgcgtgatggataaggacagagaggggcttatctcaagggacgaaattaccgcctacttcatgagagcatcctcaatctactccaaactggggctgggattccctcacaacttccaagagacaacatacttgaagccaacgttctgtgataattgtgccggttttctgtggggtgttatcaaacaggggtatcgttgtaaagactgtggtatgaattgtcacaaacagtgcaaggacctagtagtgttcgagtgtaagaagcgggcaaagaaccctgtcgccccaaccgagaataatacctcagtgggacctgtgtcaaacctctgcagcttgggtgctaaagacctcttgcatgctcccgaagaggggcctttcacctttcctaacggcgaggcagtggagcatggagaggagagcaaggaccgaacaattatgctaatgggcgtttcaagccaaaagatttccctgagactgaaacgcgctgttgcacacaaggcaactcaaaccgaaagccagccgtggataggaagcgaggggcctagtggtccatttgtgctatcttccccacgaaagactgcacaagatacgctgtatgtgctgccctccccaaccagcccctgcccaagccctgtgttagtgcggaagcgggcatttgtgaagtgggagaacaaagattccctgatcaaatctaaggaggaacttcgccatctacgattgcctacataccaggaactcgaacaggagattaataccctcaaagccgataatgatgctcttaagatccagctaaagtatgcccagaagaaaattgagtctttgcagttagagaagtcaaaccacgtgttagctcagatggagcaaggcgactgctcttag

SEQ ID NO: 237992 - DNA, 1446 bp, Artificial Sequence
  Description of Artificial Sequence: Synthetic coding sequence
atgggcactctggggaaagctcgggaggcaccgagaaagccctcgcatgggtgccgtgcagcatccaaggcaagactcgaagccaaacccgcaaattctccattcccttctcacccgagtctagcccacattactcagtttagaatgatggtaagtcttggtcacctggctaaaggagcctctctagacgacctgattgacagttgcattcagagtttcgacgctgatggcaacctgtgtaggagtaaccagctcttgcaggtgatgctgactatgcatcgaattgttatctcatccgccgaactgctacagaaagtgattacgctctatccagatgctctggcaaagaattcccccggactctgcctgaaaatttgttactttgttagatattggattaccgaattttgggtcatgttcaagatggacgcatctttgaccgatacaatggaggagttccaggagctagttaaggctaagggcgaggagctacattgccgcctcatcgacacaacccaaataaatgctcgagactggagccgtaagcttacccagagaattaaaagtaacacaagcaaaaagcggaaggtcagcctcctgtttgatcatttggagccagaggagctctcagagcacctcacatatttagagttcaagagctttcgaaggatttctttttccgactaccagaattatctggtgaactcttgtgtaaaggaaaaccccaccatggagaggtctattgcactgtgcaacggtataagtcaatgggtgcagttgatggtgctttcccggccaactcctcaattgcgagctgaggtgtttatcaagttcatccaggttgcacagaaattacatcaattacagaattttaacaccttgatggctgtcattggcggtttgtgtcatagctcaatatcacggctaaaagaaaccagcagtcacgtgccacatgagatcaataaagttttgggggaaatgaccgaactcctctcttcgagcagaaattacgacaattaccggagagcctatggtgagtgtacagatttcaagattcccatcctcggggttcatctgaaggatttgatttccctgtacgaggctatgcctgactacttagaggacggaaaagtgaacgtgcacaagctccttgcactatacaaccatatatctgagctggtccaacttcaagaggttgcaccccctctggaagcgaacaaagacctagtgcacttacttacacttagcctcgacctgtattacaccgaagacgagatctacgagctttcctacgcgcgagagccccgaaaccatcgcgcaccttctgtgtttaagaactacgatcacgaccaagatgggtatatttctcaagaggaattcgagaaaatcgcagccagttttccgttctcattttgcgtcatggataaggatcggagcggcgcatag

SEQ ID NO: 237993 - DNA, 1641 bp, Artificial Sequence
  Description of Artificial Sequence: Synthetic coding sequence
atgggaaccctgggaaaggcccgtgaggcccctcggaaacccagccatggctgtcgcgcagccagcaaagcacggttggaagcgaagccagcgaacagtccgtttccctctcatccctcccttgcccatatcacccaattcagaatgatggtgagcctgggccacctcgcaaagggcgctagtctggatgatctcatcgactcgtgtatccaaagttttgacgctgacggcaatctctgtaggtcaaatcagctgttgcaggtcatgctgactatgcaccgaatcgttatctcatccgccgagcttctgcagaaggtgattacactgtacaaagacgctctggccaagaatagcccaggtttgtgtctcaagatctgttatttcgttcgatactggattaccgaattctgggttatgttcaagatggacgcctctcttactgacactatggaggagttccaagagcttgtgaaagccaagggcgaagaattgcactgcaggctgattgacaccactcagattaatgctagggactggagtagaaagctgacccagaggatcaagtcaaatacctccaaaaagcggaaggtctctctgctcttcgatcacctggaacccgaggagctgagtgaacatctgacctacttggaattcaaaagctttagaagaatttccttcagcgattatcagaactacctggtcaattcttgcgtgaaggagaacccaacaatggaaaggtccatcgctctgtgtaacggcatctcccagtgggtgcaacttatggtgttgagccggccaacaccccagttacgcgctgaggtgtttatcaaattcatacaggtggcccagaagctacatcagttacagaatttcaataccctgatggctgtgattggcggtttgtgtcactcctctatatccaggcttaaagagaccagttctcatgtcccccatgagattaacaaggtgctgggtgagatgacagagttactgtcctcctctcggaactacgacaactatcgaagggcctacggagagtgcaccgacttcaagattcctattttaggggtccaccttaaagatctcattagtctctacgaggctatgccagactacctggaagatggtaaggtgaacgtgcacaagttgctcgccctgtacaaccacatctccgagctggttcagctgcaggaggtggccccacccctggaggctaacaaagatctcgtgcaccttcttaccttgtcgctcgacctttactataccgaggatgagatctacgaactgagctatgcaagggagccccgaaaccacagagccccaagcgtgtttaaaaactacgatcatgaccaagatgggtacatctcccaggaggagtttgaaaagatcgccgctagcttcccattcagcttttgtgtaatggacaaagatcgggaaggactcattagcagggatgagattaccgcatatttcatgcgtgcgagcagcatctactctaaactgggcttggggtttccccacaatttccaggaaactacttatctcaaaccgaccttctgtgataattgtgcaggctttctctggggagttatcaagcaggggtaccggtgtaagggcaataagtattcggaatccaggtag

SEQ ID NO: 237994 - DNA, 1794 bp, Artificial Sequence
  Description of Artificial Sequence: Synthetic coding sequence
atgggcacacttggcaaggcacgcgaggcacctcggaagccgtcccatggctgtagggcagcatctaaggccaggttggaagcaaagcccgcaaacagcccttttccaagccatccatccttggcacatatcacccagtttagaatgatggtttccctgggtcacctggcaaagggcgctagtttggatgacctcatcgacagttgtatccaatcctttgacgcagatgggaacctgtgccggagcaaccagctgctacaggttatgcttactatgcacagaatcgtgatttcttccgccgaactgctccagaaggttatcacactctacaaggatgcccttgctaagaactctcctgggttgtgcctcaaaatatgttacttcgtgcgctactggattacagagttctgggtgatgtttaaaatggacgcttccctaaccgataccatggaagaattccaagagctcgtcaaagccaagggcgaagaactgcactgcaggttaattgacacaacccaaattaatgcacgggattggtcccggaagctcacgcagaggatcaagtccaacacctccaagaagcggaaggtgtcccttctcttcgatcatctggaaccggaagaattgagcgaacacctaacctacttggagttcaagagcttccgaaggatatctttttcagactaccagaactacctggtgaactcctgcgtgaaagaaaatccaactatggagcgtagtatagcattgtgcaacgggattagccaatgggtgcagttaatggtactcagcagaccaactccgcaacttcgcgcagaggtcttcatcaaatttatccaagtcgcacaaaaattgcaccagctccagaactttaataccctcatggccgtgatcggtggcctctgtcactccagcatatctcgactgaaggagacgagctcccatgtgccccatgaaattaataaggtcttgggcgagatgactgagctgttgtcctccagcaggaattatgacaactacaggcgcgcttacggcgaatgtactgatttcaaaattccaatccttggcgtacatcttaaagatctcatatcattgtatgaagcaatgcctgattatttagaggacggtaaagttaatgtgcataaactattggctctctataatcacatttccgagctcgtccagctgcaagaagtcgcacctccccttgaagctaacaaagatctggtccatctcctgacgctctcactggacctatactacacggaggacgagatctacgaactgtcctacgccagagagccacggaaccacagggccccttccgtgttcaagaactacgaccacgatcaggacgggtacattagccaagaagagttcgagaaaatcgctgcctctttcccattttctttctgcgtaatggacaaagatagggagggcctgatctcacgggatgagatcaccgcttacttcatgagagctagctctatttactctaaattggggttaggtttcccccacaatttccaggaaactacctacctaaagcccactttttgcgataattgcgccggattcttgtggggggtaattaaacagggatataggtgtaaggattgcggtatgaactgtcacaagcagtgcaaggatctagttgtgtttgaatgcaagaaacgagcaaagaaccctgtggcgccaacagaaaataacactagcgttggtcctgtatctaatctgtgttcgctcggagccaaggacctcctgcacggcaataagtactctgagagtagatag

SEQ ID NO: 237995 - DNA, 1830 bp, Artificial Sequence
  Description of Artificial Sequence: Synthetic coding sequence
atggctggtacattagatttggataaaggatgcacagttgaagagctacttagagggtgcatcgaagccttcgacgattcaggtaaagttcgagacccccagctagtgagaatgtttctgatgatgcacccctggtacatacccagctctcagcttgcagctaagcttctgcacatttatcaacaatcaagaaaagacaatagtaattccttgcaggtcaagacctgccacctcgtgaggtattggatctccgccttccccgctgagtttgatcttaatcctgagctcgcggagcagatcaaggaactgaaggcgttactcgatcaggaagggaacagaagacacagcagcctcattgacatcgatagcgtgccgacttacaaatggaaacgtcaggtcacccagagaaaccctgtgggccagaagaagcgaaaaatgtcgctgctgtttgatcacctcgaaccgatggaactggcagagcacctgacctacctagagtaccgttccttctgcaagatcctctttcaggactaccattcattcgtgacccatgggtgcactgtggacaatccagtgttggagagatttatttccctcttcaattccgtctcccagtgggtgcagttgatgatcctgtcaaagcccactgctccccaaagggccctggtgatcacacactttgtccacgttgcggagaaattactccaattgcagaacttcaacaccttaatggccgtggtcggtgggctgtctcacagtagcataagtcgactgaaggagacgcattctcatgtgtctcctgaaacaataaagttgtgggaaggcttgacagaacttgtgactgctactgggaattacggcaactacagacgcaggctcgcagcatgtgtcgggttccggttccccatcctgggcgtgcacctcaaggatcttgtggctctgcaactggcccttcccgactggcttgatcccgctcgcaccagacttaacggcgcaaagatgaagcagctttttagcattcttgaagagctggccatggttacctcattgaggcccccagtccaggcgaatcccgacttgctgtccctactgactgtgagtctggaccaatatcagacggaggatgagctgtatcagctgagcctccagcgcgagcctcgctcaaaatccagtcccacctctcctacatcctgtacccctccaccgcgtcccccagtattagaggaatggaccagtgcagcaaaaccaaaactcgaccaggcactggtggttgaacacatcgagaagatggtggaatccgtgtttcgcaacttcgatgtagatggcgatggacacatctcacaggaagaattccagatcatacgagggaacttcccttatttgtctgctttcggagaccttgaccaaaaccaggacgggtgtataagtagggaagagatggtgtcttatttcttacgtagcagttcagtgctcggaggacggatgggatttgtccacaacttccaagaatccaattcactgcggccagtagcatgccgacattgtaaagcgttgatactgggtatctataagcaggggctgaagtgtcgcgcatgtggcgtgaactgccacaagcagtgtaaggacaggctctccgtggaatgccgacggagagcacagtccgtcagcttggaagggtccgcaccctcacctagccctatgcactcccaccatcacagagctttttccttctccctgccgagacctggcaggaggggatcccgtccacctgaaatccgggaggaggaagtgcagacagtggaggacggtgttttcgatattcacctgtag

SEQ ID NO: 237996 - DNA, 1833 bp, Artificial Sequence
  Description of Artificial Sequence: Synthetic coding sequence
atggctggaaccctggacctggacaaaggctgcaccgtagaagaacttctaaggggctgcatcgaagcctttgacgacagtggcaaggtccgagatcctcagttggtacggatgttcctcatgatgcatccttggtatattccatcatcgcaattggccgctaaactgctgcacatttatcaacagtcgaggaaggacaactcgaatagcctccaggtgaagacttgtcatctggtccgatattggatatcagcattcccagcggagtttgatctcaatccagagttggccgagcagattaaagagctaaaagccctccttgatcaggagggtaatcgtagacactccagtttaatagacattgacagtgttcccacctacaagtggaaaagacaggtgacccagcggaatccggtgggacagaaaaagcgtaaaatgagtcttctgttcgaccacctagaacccatggagctcgcggagcatctcacttatctggagtaccggtctttctgtaagattctctttcaagattaccatagtttcgtcacacatggctgcacagtcgataatcctgtgcttgaacgcttcatcagcctgtttaactcagtgtcgcagtgggtccaactgatgatcctgtccaagcctacggcccctcaacgagccctggttatcacccactttgtgcatgttgccgagaagcttctccagctgcagaattttaacaccttgatggccgtggtcggaggtctcagccattcatcgataagtagactgaaggagacacactcccacgtttccccggaaaccattaaactgtgggaaggactcactgagctggttaccgccactgggaattacggaaattatcggaggagactggcagcttgtgtgggtttccgttttccaattctcggggtgcatctgaaagatcttgtagcattgcagctcgcgttgcctgattggctggaccctgctcggacccgcctgaatggtgcaaagatgaagcaattattcagcatccttgaggagctagccatggtaacctcgctccgcccacccgtccaagcaaatcccgacctcctgtcccttctgaccgtgagccttgatcaataccagacggaggacgaactataccaactctcccttcagagggagcccaggtcaaaatcctcacctacatcaccaacaagctgtaccccccctccccgtccacccgtgctggaggaatggacaagcgcagcgaaacccaaattggaccaagctctcgtggtggaacacattgagaagatggtagagagtgtgttccgtaatttcgatgtggatggggacggccacatctcacaggaagaatttcagattatccgcggtaactttccgtacctctcagcgtttggcgatctagaccaaaatcaggacggctgtatttctcgagaagaaatggtgtcctactttctccgatcctccagtgttctcggtggtagaatgggtttcgtgcataatttccaagaatccaattctcttaggcctgtcgcctgtcggcactgtaaagctttgattctgggtatctacaagcagggacttaaatgtagagcctgcggtgtgaactgtcacaaacagtgtaaggaccgactctcagtcgagtgccggagacgtgcacagagcgtttcccttgaaggttcagctcctagcccgtcgccaatgcactcccaccaccaccgggctttttcgttctctctgccaagacctggtcggaggggcagccggccacccgctgagattagagaagaggaagtccaaaccgttgaggacggcgtattcgatatccacttgtag

SEQ ID NO: 237997 - DNA, 1830 bp, Artificial Sequence
  Description of Artificial Sequence: Synthetic coding sequence
atggcaggtaccctggacctcgacaaaggttgcacagtggaagaactgctgcggggatgtatcgaggcattcgacgatagcgggaaggtccgggatccgcagcttgtgcgcatgtttctcatgatgcacccgtggtatatcccaagctctcagttggctgctaagctgttgcatatctatcagcagagccgcaaagataattcaaacagcctgcaggtgaagacatgccatctggttcggtattggatctctgctttccctgccgaattcgatctgaacccagaactggccgaacaaattaaggagctcaaggcactactggatcaagagggcaatagaagacactcttctctgatagacattgacagcgtccccacatacaaatggaaaaggcaggtcacccaaaggaaccctgtgggccagaagaagagaaagatgtctctactgttcgatcatttggagcccatggaactggcagaacacttgacttatctcgaataccggagcttctgtaaaatcctgttccaagattatcactctttcgtgactcacggatgtaccgttgataacccagtcctggagaggtttatcagtctctttaattctgtaagccagtgggtgcaactgatgattctgagcaagcctaccgctccccagcgggctcttgtcatcacccacttcgtccacgtggcagaaaaattactgcaactgcagaactttaatacgctcatggcagtggtgggcggactatcgcactcatcaatttcacgtctcaaggagacccatagtcacgtatcccccgaaaccattaaattgtgggagggtctcactgaattggtcactgctactggtaactacgggaactatcgtagacgacttgcggcatgcgttggcttccgctttccaatcctcggcgtgcatcttaaagatttagtcgcccttcaacttgctctgccagactggctcgacccagctcgtaccaggctcaacggcgctaagatgaagcagctgtttagtattcttgaagaactagcaatggtgacctccctccgcccaccggtgcaggccaaccccgatctgctttcattgttgaccgttagcttagatcagtaccaaaccgaggatgagctgtaccaactgagcttgcaaagggagccaagatctaagagctccccaacaagccctacaagttgcaccccacctccccgaccccctgtattggaagaatggacttccgccgcaaagcccaaactggaccaggctctcgtcgtcgagcacatcgaaaaaatggttgagagtgtgttcagaaattttgacgtagacggtgacgggcacataagtcaggaggagttccagattattcgtggcaactttccttacctctcggcattcggcgaccttgatcagaatcaggacggttgcatttcaagagaagaaatggtgtcttacttccttcggagtagctctgtgcttggcggtagaatgggcttcgttcataactttcaggagtcaaactcactgcggccagtggcatgcaggcactgtaaggctctgatcctgggaatttacaagcaagggctcaagtgccgggcttgtggcgtaaactgccacaaacagtgcaaagatcggctaagcgtggagtgcagacggagagcacagtctgtctctttggagggctctgctccttcaccaagccccatgcactcccatcatcaccgagccttctcgttctctctccctagacctggtaggagggggtctagaccaccggaaatacgagaggaggaagtacagacagttgaggatggtgtgtttgacattcacttgtag

SEQ ID NO: 237998 - DNA, 1830 bp, Artificial Sequence
  Description of Artificial Sequence: Synthetic coding sequence
atggccggtactcttgacctggacaaaggctgcactgtcgaggagctactaagaggatgtattgaggcttttgacgattctggcaaagtgagagatcctcagctagtgagaatgttcctgatgatgcacccatggtatataccctcctctcagctggccgctaagttgcttcatatttaccagcaatccaggaaggacaactctaacagcctgcaggtgaagacttgtcacctcgtcaggtactggatctccgcctttcctgccgagttcgatctgaaccctgagctcgccgagcagataaaggaactaaaggccctgctggaccaggaagggaaccgccgacactccagcctgattgatatcgattccgtcccaacctataaatggaaaaggcaggtgacccaacggaatccggtcggccagaagaagaggaaaatgtcccttttatttgatcatctggaacctatggaactggcggaacatctgacatatctggagtatagaagcttctgtaagattctgttccaagattatcactctttcgtaacccatggctgtacagtggacaaccccgtgcttgaaagatttatcagcctctttaattcagtttcccaatgggttcagctcatgatcctatccaaacctaccgccccacagcgcgcattggtcataacccacttcgttcatgtggctgagaaattgttgcagctacagaactttaatactctgatggctgttgtgggcggacttagtcacagctcaatctcaaggctcaaagaaacccactctcatgtctccccagagaccattaaactgtgggagggtctgacagagctggtgaccgctacaggtaactacggtaattatcgcagacgcttggcagcttgcgtcgggttccggtttcccatcctgggggtgcatctgaaagacttggttgcgttacagttggccctgccagactggctcgacccagctagaacacggttaaatggagccaagatgaagcagctttttagcatcctggaggaattggctatggtgaccagtctccgccctcctgtgcaagccaacccagatttactgtctcttctgaccgtcagtctggaccagtatcagacagaagatgagctgtatcagctgtccctgcaacgtgagcccaggtccaagtcctctcctaccagccccacctcatgcacaccacctccacgccctcctgtcctggaggaatggaccagcgccgctaagcccaaactagaccaagctctcgtagtggaacacatcgagaagatggttgagagtgtgtttcgcaatttcgacgtggatggagacggacatattagtcaagaagaattccagatcatacggggaaacttcccttacctttccgctttcggagacctcgatcagaaccaggatggctgtatctccagggaagagatggtgtcgtatttcttgcgcagctcttccgtactcggtggcaggatgggttttgtgcataattttcaggaatcaaactcactgcgaccagttgcctgtcggcattgcaaggcactgattctagggatctacaagcagggccttaagtgtcgcgcttgcggggttaactgtcataagcagtgtaaggacaggctctcagtcgaatgcagacgaagggcgcagtcagtgtctctggagggtagtgccccatccccctcccctatgcacagccatcaccatagggccttctcattctctcttccccgtcccggacgcagaggcagtcgccctcccgagatccgagaggaggaagtccaaacagtcgaggatggggtgttcgacatccacctgtag

SEQ ID NO: 237999 - DNA, 432 bp, Artificial Sequence
  Description of Artificial Sequence: Synthetic coding sequence
atggcaggcacgttagatttggataaaggctgtaccgtggaggagctgctgcgagggtgcatagaggcttttgatgattccggaaaagtgcgtgacccccagcttgtgcgcatgtttttaatgatgcacccatggtatattcctagcagccagctcgctgccaagctgctgcacatctatcagcaaagccgaaaggacaactccaattccctacaggttaagacctgccatctcgtacgctattggatcagcgcctttcctgccgagttcgacttgaaccctgaactcgcggagcagatcaaagaactgaaggcgctattagaccaagaggggaaccgacgccactcatctctcattgatattgattccgtgtgtgtgggggaacatagaggcctggggggacactcggttagttacacgatctgtgcgtag

SEQ ID NO: 238000 - DNA, 1731 bp, Artificial Sequence
  Description of Artificial Sequence: Synthetic coding sequence
atgaaccgcaaggacagtaagaggaagtcacaccaggaatgtactggcaagattggcggacgtggacgcccacgccaggttcgacgacacaaaacgtgtccctcccccagagaaatatcaaaagtcatggcctctatgaatttgggcttactgagcgaggggggttgcagtgaggacgaactgctggaaaagtgcatccagtcctttgacagtgcgggttctctatgtcacgaagatcacatgctaaacatggtgctcgctatgcactcctgggtactccccagcgcggacctggcggcaaggcttttgaccagctaccagaaggccacaggcgacacccaggaactcaggcgactgcagatttgccatctcgttagatactggttaatgcgacatccagaagtgatgcaccaggatccacagctcgaggaggtgatcgggaggttctgggcgacagtggcgcgagagggcaattcggcgcaacggcgtctcggcgactccagcgacctcctttcaccgggtggtcctggtccaccactgcctatgtccagtcccggactggggaaaaaacggaaggtatctctcttgtttgatcatctcgagaccggagaactagcacagcacctcacgtacctcgagtttaggtcattccaggccatcacagccctgctggaactgacagagctactggcatctcacaacaactacgctaggtacaggcggacctgggcaggctgcgccggattcaggttaccagttcttggggttcatttgaaagacttagtgagtctccacgaagcccaacctgatcggctccccgatgggaggctgcacctgccgaaactcaataatctgtacctgcgtctgcaggagcttgtcgccctgcaaggacagcaccctccatgctcagcaaatgaggatcttctgcacctgctcactttgagcctggatctgttttacactgaggatgagatttacgaactcagctacgctcgcgagccccgatgccccaaatcattgcccccttctccatttaatgcacccctcgttgtggagtgggcgccaggagtgacaccaaagcccgatcgcgtaactttgggcaggcatgtggagcagctggttgaatcagtattcaagaactacgacccagaggggcgaggtaccatttctcaggaggacttcgagcggttgtctggtaatttcccctttgcctgtcatgggctacatcctccaccgcgtcaaggacgagggagtttcagtagagaggagcttactggctatttgctacgcgcttccgccatatgttcaaaattgggcctggcatttttgcacaccttccacgaggttacattccggaaacccacattctgcgactcttgctcggggttcttatggggggtgaccaaacagggttacagatgccgggagtgtggactttgttgccacaaacactgtcgcgaccaggtgaaggtggagtgcaaaaaaagacctggagccaagggtgatgctgggcctccaggcgctcctgtgccatccacccctgcccctcatgccagctgcggatccgaagagaaccattcatacacactgagcctcgaacccgagaccggatgccaattgcgtcacgcctggacccagaccgagtccccccatccctcctgggagactgatacggttccatgtcctgtcatggaccctccatcaacggcctcctctaagctcgatagctag

SEQ ID NO: 238001 - DNA, 1854 bp, Artificial Sequence
  Description of Artificial Sequence: Synthetic coding sequence
atgaacaggaaggatagtaagcggaaaagccaccaggagtgtaccgggaaaatcggcggtagaggacgaccacggcaggtaaggaggcacaagacatgcccttccccgagagaaatttctaaggttatggctagtatgaatctgggtctgctctctgagggcggatgtagcgaggacgagctgctggagaaatgtatacagtcttttgattctgccggaagcctgtgtcacgaagaccatatgctgaatatggttctagcaatgcacagctgggtgttaccaagcgctgaccttgcagctaggctcctgactagctaccagaaggcaaccggagacacccaggaattgcggcgacttcaaatctgccatcttgtgcgttactggctcatgaggcacccagaagttatgcatcaggatcctcagctggaggaggtcataggccgtttctgggcgacagtcgctagggaagggaattcagctcagaggaggctaggagatagctctgatttgctcagcccgggagggcctggacctcctcttcctatgtcctctccaggtttaggcaaaaaacgtaaagtctccctgctgttcgaccatctcgagacaggagaattggcccaacaccttacctacctcgaatttcgaagcttccaggcgattacaccccaggatctgaggagttacgtactacaaggatctgttagggggtgtcctgctttggagggaagtgtcgggctatcaaacagcgtgtcacgctgggtgcaagtgatggttctctcccgcccaggccctttacagcgcgctcaggttttagataaattcatacacgtggcacaacgtttgcaccagctacagaactttaacacactaatggctgttactggaggcctctgtcacagtgccatcagccgtctgaaggatagccacgcccacctgagcccagattctactaaagcccttctggaacttaccgaactcctcgcatcacacaataactacgctcgataccgcaggacatgggcgggttgtgcgggtttccgcctccctgtactgggcgtacatttgaaagatctggttagcctgcatgaggcgcagcccgacagactcccagatgggaggctacacctgccaaagctgaataatctgtatctgagactccaagagctcgtggcccttcagggccagcaccccccatgttctgccaatgaggatctcttacatctcctaaccctctcactggacctgttttatacagaagacgaaatctacgagctctcctacgcgagagagccgagatgcccaaaaagcctaccacccagcccttttaatgctccactggtagtcgagtgggccccaggcgtcactcccaaaccggaccgcgtgacacttggcaggcacgtggagcagctggtggagtctgtgttcaagaattacgaccccgagggacggggaaccatttctcaggaagacttcgaacgcctttctgggaactttccgtttgcttgccacggactgcacccccctccgcgacagggcaggggctccttttccagggaggagctgaccgggtacctgctgcgggcaagcgccatttgtagtaagctgggcttggccttcctccacacgtttcatgaggtcaccttccggaagcccacattctgcgactcatgtagcggctttctgtggggggtcacgaagcaaggataccggtgtagaggtgagtggggcgtctccgaatgggagggaagtctgggtccccaggccggaaggatggatgacactgaccgcacaccagccgctgccttcccccaatccgccggatgcgtggctactaatacagccgaaacgcgttag

SEQ ID NO: 238002 - DNA, 1455 bp, Artificial Sequence
  Description of Artificial Sequence: Synthetic coding sequence
atgaatcgcaaggatagcaagcggaagagtcatcaggaatgtaccggcaaaattgggggacggggacgaccgagacaggtgaggagacataaaacctgcccaagcccccgagagatatctaaggtgatggcttcaatgaatctgggccttttgagcgaggggggatgctcggaagatgaactgttggaaaaatgtatacaatcctttgattccgctggatctctgtgccacgaggaccacatgttgaacatggtgctggccatgcacagctgggttctacccagtgctgacctggcagcgcgtctgctgaccagttaccagaaggcaaccggcgatacgcaggaactccggagactccagatatgccacttagtccgctattggctcatgcgccatccggaggtgatgcaccaggatccccagttagaagaggtgataggaaggttttgggcgaccgtggctcgcgaggggaacagcgctcaacgcaggctaggagactcatccgatctcctgtcacccggaggccctggtcctccgctgccgatgagctccccaggcctcggtaagaaacgaaaggtgagccttctgttcgaccatcttgaaactggggagctcgcacagcacctgacttatctggagtttagaagcttccaggcaattactctgagccttgacttgttctacacagaggatgaaatttacgaattgtcctacgcgcgagaacctagatgtcctaagtccttgccccctagtcctttcaacgccccactcgtggtggaatgggctcctggagttacccccaaacctgatcgcgtgacgcttggacgtcatgttgagcaactggtggagagcgtcttcaagaactacgatcctgagggcaggggcaccatatcccaagaagacttcgagagactgtcaggaaattttccctttgcgtgccatgggcttcatcccccaccacggcagggcagaggctcttttagccgggaagaactgaccgggtatctgctgcgcgcttcagctatatgtagcaaactcgggctggctttcttgcatacattccatgaagtaacgtttcggaaacctacgttttgtgattcttgttctggctttttgtggggggtgaccaaacaggggtataggtgtagagagtgcgggctatgctgccacaagcactgcagagatcaagtgaaggttgaatgcaagaaaaggccaggggctaagggcgatgccggtcccccaggcgcaccggtgccttctactccagcgccacacgccagctgtggttcagaggaaaatcactcttacaccctctccctggagccagagactggttgtcagctgaggcatgcatggacacagacagaaagtccccatccctcttgggagaccgataccgtcccttgcccagtgatggatcctcctagcaccgcttcgtctaaactcgactcatag

SEQ ID NO: 238003 - DNA, 1746 bp, Artificial Sequence
  Description of Artificial Sequence: Synthetic coding sequence
atgaatcgtaaagattcaaaaagaaagtcgcatcaggagtgcactggcaagatcggaggacgcggtcgccctcgtcaagtgaggcggcataaaacatgcccatcacccagggagatctctaaggtcatggcttccatgaacctgggcctactctctgaggggggatgctccgaggacgagctgttggagaagtgcatccaatcctttgactcagcgggaagtctttgccacgaagaccatatgctcaatatggtgcttgccatgcactcgtgggtgttaccttctgctgacctggccgctagattactgacgagttaccagaaggcaaccggagatacccaagaactacggaggctgcaaatctgtcacctagtccgatactggctgatgagacaccctgaggtaatgcaccaagacccccagttggaggaggtgatcgggcgtttctgggccacggtggctcgggagggaaatagcgctcagaggaggctgggggactctagtgacctgctgagccccggaggacccggtccacccctacccatgtcctctcccggtttagggaagaagcgcaaagtatctctgctctttgatcacttggagacgggcgaactggcccagcatctgacatatctcgagttcaggtcattccaggctataacaccccaggatctaagatcatacgtgctccagggaagcgtgcgcggatgtcctgctttagaaggctcagtaggactctcaaactccgtatccaggtgggtgcaagttatggttctttcccgtcctggtccactccagagagcacaggtgctggacaagttcattcacgtggcacagcggctacaccagctccagaacttcaatacactgatggcagtgaccggcggactgtgtcactctgccattagcaggctgaaagatagccatgcacatttgtcccccgacagcactaagctgtctctggacctgttctacaccgaggatgagatctatgagctgtcttacgcaagagaacccagatgccctaaatcactgccacccagccctttcaacgccccactggtggttgagtgggcccctggggtgacccccaagcccgatagggtcacccttggtcgccacgttgaacagctcgtggagtcagttttcaaaaattacgacccagagggtagaggcacaatcagtcaggaagactttgaacgtctgtccggaaacttcccctttgcctgccatggactgcatcccccaccacgccaggggagaggatctttctctcgagaggagctgacaggatacctgctacgcgcttccgcaatttgttctaagttagggttggcttttctgcatacctttcatgaggtaacatttcggaaaccaactttttgtgactcctgttctggcttcctgtggggagttactaagcagggctatcggtgcagagagtgtggtctttgctgccacaaacactgtcgagaccaggtcaaggtcgaatgtaaaaagcgaccaggggctaagggggacgcaggcccacccggagcccctgtcccttctacacccgctcctcatgcctcatgcgggagtgaggaaaatcactcctacacactttccttagagcctgagacgggctgccagcttcggcatgcatggactcagactgaaagccctcacccgagttgggaaaccgacactgtcccctgtcccgttatggacccccctagcactgcttcaagcaagcttgactcgtag

SEQ ID NO: 238004 - DNA, 2022 bp, Artificial Sequence
  Description of Artificial Sequence: Synthetic coding sequence
atgaaccggaaggactcaaagcgcaaatcccaccaggaatgtactggcaaaatcggcggaagaggcagacctcgccaggtccgacggcacaagacatgcccatcccccagagaaatctcaaaagtgatggcaagtatgaacctcggtctgttatccgaggggggatgcagtgaggacgagttgctggaaaagtgtatccagtcatttgactctgccggttccctttgtcatgaggaccacatgctcaacatggtcttagctatgcacagttgggtcctaccctccgcagacctggccgctagactcctaacgtcctatcagaaggcaactggggacacacaggaactgaggcgcctgcagatctgccacttggttcggtactggcttatgcgccatcccgaggtcatgcaccaggatccacagctcgaagaggttatcggacggttttgggcaaccgtagcccgagagggcaattcagcccagaggagactgggggattctagcgatttgctgagtcccggaggcccaggcccacctttgcccatgtctagcccgggtctcggcaagaagagaaaagtcagcctcctttttgatcatttggagactggcgagctggcccagcacctgacctacctggagtttcggagcttccaagccatcacccctcaagatctgaggagttacgtgctccagggtagtgtgcgaggctgccccgctctggaaggttcagtgggattgtccaacagcgtcagccgatgggttcaggtgatggttctctccagacccggacccctccagagggcacaggtactcgacaaattcatccacgtggcccagcgcttgcaccagctgcagaatttcaacaccctcatggccgttaccggaggactgtgtcattcagccataagtcgtctaaaggatagtcatgcccatctgtctccagatagtacaaaagctctgctggaactgacagagctccttgcttctcataacaattatgcacgctaccgtcgaacttgggccggatgtgccggtttccgcctacctgttctgggcgtacacttgaaggatctggtctcgctccacgaggcacagcctgaccggctccctgacgggcgattgcatctgcccaaactgaacaatttgtacctacggctgcaagagctggttgccctgcagggtcagcaccccccatgtagcgccaacgaagacttacttcacctgctcactctgagccttgatctgttctacaccgaggacgaaatatacgagctctcgtatgcgagagaacccagatgccctaagtctctgccaccaagtccattcaatgctccattggtcgttgagtgggcaccgggtgtgaccccaaaacccgatagagtgactctcggcaggcacgtggaacagctggtggagagtgtgtttaagaattacgatcctgaggggaggggaaccatatcccaagaagattttgaacggctgagcgggaactttccatttgcctgccacggattgcacccccctccccgacagggacgaggaagtttcagcagggaggagcttactggctacctcctccgcgctagcgccatttgcagcaagctgggccttgcgtttttgcacacgtttcacgaggtgactttcaggaagccgacattctgcgactcgtgctcgggtttcctatggggagtgactaagcagggatacagatgcagagagtgtggtctgtgctgtcacaaacattgcagagaccaagtgaaggtggagtgtaagaaacgtcccggagctaaaggcgacgccggaccgccaggcgctccagtgcccagcactcctgctcctcatgctagctgtggaagtgaagaaaaccactcatacactttgagcctcgagcccgaaactggatgtcaactgcgccacgcctggacacagacagaatcaccccatcccagctgggagactgacactgtgccctgtcccgtaatggacccgccatccaccgcgagcagcaaactcgattcgtag

SEQ ID NO: 238005 - DNA, 1980 bp, Artificial Sequence
  Description of Artificial Sequence: Synthetic coding sequence
atgaatcggaaggattccaagagaaaaagtcatcaggaatgcacaggaaaaattggcggacgcggtcggcctcgccaggtgcgtcgccacaagacttgtccgtctcccagggaaatatctaaggtcatggcctctatgaacctgggcctgctctcagaaggaggctgctccgaggacgagcttctggagaaatgtattcaaagttttgacagtgccggtagcctatgccacgaagatcatatgctgaatatggttctggccatgcacagctgggtcctgccatccgcagatctagccgctaggctcttaacatcctatcaaaaggctaccggtgatactcaagagttgaggaggctccagatctgccatctggtgaggtattggttgatgcgacaccctgaggtgatgcaccaggacccccagctggaagaagtgattgggagattttgggctactgtggcccgtgaagggaacagcgcccaacggcgactgggagactcatctgatctgccaggtttgggaaaaaagagaaaagtgagtctgctctttgatcatctggagacaggcgaattggcccagcatctgacatatttagagttccgctcctttcaagccatcaccccccaggatctccgcagctatgtactccagggtagcgtgcgaggctgtccagccctggagggcagtgtggggctctcaaacagcgtctctaggtgggtccaggtgatggttctgtcgagaccaggtcccttacagcgcgctcaggtcctggacaaattcatccacgtggcgcagcgtttgcaccagcttcagaacttcaacaccctgatggctgttacaggaggcctctgtcactcggctatctctcggcttaaggactctcatgctcacctgtcccccgattctaccaaagccctgctggagttaaccgaactgcttgcatcacacaacaactatgcacggtatcgtcgcacctgggccggatgtgccggatttcgacttcctgttttgggggtccaccttaaagacctcgtcagcttgcacgaggcccagccagacagactgccggacgggaggctgcatctgcccaaactgaataatctgtaccttaggcttcaggagctcgtggccctacagggacagcaccccccttgttcggcaaacgaagacctgctgcaccttttgacccttagcctggatctgttctatacagaggatgaaatttatgaactctcctacgccagagagcctcgctgccccaagagtctgccacccagtccatttaacgcgccactggtcgtggaatgggctcccggtgtgactcctaagccagacagggttactctggggcgtcatgtagagcaactggttgagagcgtgtttaagaattatgatcctgaaggtcggggaactatctcccaggaggactttgagagactgtccggcaatttccccttcgcttgccatggattgcacccccctccccgtcaaggaagaggatctttctctcgagaggagctgactgggtatcttctgagagcgagtgcgatatgttccaaattgggactagcatttctgcatacatttcatgaagtcactttcagaaaacccactttctgcgattcctgttcaggtttcctgtggggagttaccaaacagggatacagatgtcgagagtgcggactgtgctgccataaacactgccgcgaccaagtgaaagtggaatgtaagaaaagacccggagccaagggcgatgctggccctcccggtgctccagtcccctctactcccgcaccacatgctagttgcggatctgaagagaatcatagctacacactttctctggaacccgagacggggtgccagctgaggcatgcatggactcagactgaatcccctcaccccagttgggagactgataccgtgccttgcccggtgatggatcccccatctacagcttctagtaagctcgatagctag

SEQ ID NO: 238006 - DNA, 1815 bp, Artificial Sequence
  Description of Artificial Sequence: Synthetic coding sequence
atgaatcgaaaggactccaagcgaaagagccaccaggaatgtactggcaaaatcggtgggaggggtcggcctagacaggttcgtagacacaagacttgtccctcaccgagggaaattagtaaggtcatggccagtatgaaccttgggctcctatccgagggaggctgcagtgaagatgagctgctggagaaatgtatccaatcctttgacagtgccggaagcctatgtcatgaagaccacatgctgaatatggtgctggccatgcactcttgggttctgccttctgccgatctggcagcacgtctgttaacgtcttaccagaaagctacaggcgatacccaagagctgcgccgtcttcagatctgtcacctggtgcggtattggcttatgcgacatcctgaggtaatgcaccaggacccccaacttgaggaggtcattggcagattttgggcgaccgtcgccagggagggcaacagtgcccaacggcgattaggcgacagcagcgacctattgtcaccgggagggcctggtcccccactgcccatgtcctcacccggattggggaagaaaagaaaagtcagcctacttttcgaccacctagagaccggcgagctggcccagcatctcacgtacttagaatttcggagcttccaggccatcacccctcaagacctccgatcctacgtcctgcagggctccgtgcgagggtgcccagccttggaaggttcagtggggctgtctaatagtgttagcaggtgggtccaggtgatggttttgtccaggccaggaccgctgcagcgcgcacaggtgctggataaattcatccacgtcgcccagcgcttacaccagttgcagaacttcaatacattgatggccgtgactggcggtctctgtcactccgctatatcacggctgaaggactcccacgcacatttgtcgcctgactcaacgaaggaactggtggctttgcaaggccaacaccccccatgcagcgctaatgaagatctgctccatctgttaacactctcgctagatctgttttacactgaggatgaaatctacgaattgtcctatgctcgggaaccgaggtgtcctaagagcctccctccaagtcctttcaatgcacctttggtggtggagtgggcccctggcgttacacccaagcccgaccgcgtgacactcggcaggcatgtagagcagttggtcgaaagtgtgtttaagaactacgatcccgagggaagaggcactatatcccaggaagacttcgagcgactttccgggaattttcccttcgcctgtcatgggttacaccccccaccccgacagggcagagggagctttagccgtgaggagctcactgggtatcttttgcgggctagcgctatctgttccaaactcggcctggctttcttacatactttccatgaagttacgtttcgaaagcccaccttctgtgattcctgcagcggtttcctgtggggagtgaccaagcaggggtatagatgtcgcgagtgtggactttgttgtcacaaacactgtcgcgaccaagttaaggtggaatgcaagaaacgccctggggctaagggcgacgctgggcctccgggtgctccagtgccaagcacgcctgcccctcacgcctcttgcggatccgaagaaaaccactcgtataccctcagtctggagcctgaaaccggatgccagttacggcatgcatggactcagacagagtccccccatcctagctgggaaacggataccgtgccttgccctgtcatggacccacctagcactgcatcttctaaactggattcttag

SEQ ID NO: 238007 - DNA, 1857 bp, Artificial Sequence
  Description of Artificial Sequence: Synthetic coding sequence
atgaagaaggacgttcgtattctgcttgtcggcgagccccgtgttgggaagaccagcctcatcatgagcttagtgtccgaggagttccccgaagaggtgccacccagagcagaggaaatcacgatcccagccgatgtgacacccgaacgggtccctacccacatagttgactattccgaagcagagcagagtgacgagcagctgcaccaagaaatctctcaggcaaatgttatctgtattgtctacgctgtgaataataaacacagcattgataaggtcactagcagatggattccgctgatcaatgaacgtaccgataaggacagtagactccccctgattctcgtcgggaataagagcgatctcgtggagtatagctctatggagacaatcctaccaataatgaaccagtacacagagatcgaaacatgcgtggagtgcagcgccaaaaatcttaagaatatttctgagcttttctactacgctcagaaagccgtgctgcatccaacgggacccctatactgccccgaagagaaggagatgaagcctgcttgtatcaaagcacttacgagaatctttaagatcagcgatcaggacaacgatgggaccctgaatgatgccgaactcaacttttttcagcgcatctgctttaacacacctcttgctcctcaggctttagaagatgtgaagaatgtcgtcaggaagcatatctctgacggggtggctgattctgggctgacgctgaagggctttctgtttttgcatacattattcatccagcgaggcagacacgagacgacctggacagtacttcggaggttcggttacgatgatgaccttgatctcacacccgaatacctttttccgctgcttaaaatcccacccgattgcactacagagctcaatcatcacgcttatctatttctccaatcaacctttgataagcacgacttagatagagattgtgcactgtccccggacgaactgaaagacttgttcaaggtgtttccttatataccatggggcccagatgttaataacactgtgtgtacaaacgaacgtggttggattacctaccaggggttccttagccagtggacattaactacctacctggacgttcaacgctgcctggagtatctcgggtatttgggctactctatcctgaccgagcaggagtcccaggcctctgccgtgacggtaacccgggacaaaaaaatagatttgcaaaagaagcagacacagaggaatgtgttcaggtgtaacgtcattggagtgaagaactgcgggaagtcaggcgtgctgcaggcgctgctcggcagaaatctgatgcgccagaagaaaattcgagaagatcataagtcatattatgccattaacaccgtgtacgtctacggacaggagaagtacctccttcttcacgacatctccgaatccgaattcctgacagaagccgaaattatatgtgacgtagtatgtttggtgtacgacgttagtaaccctaaaagcttcgaatattgcgccagaatctttaagcaacacttcatggattcacggattccttgcctgattgtggcagcaaaaagcgatctgcacgaggtgaagcaggagtatagtatttcacccactgacttttgcaggaagcataagatgccaccaccacaggcctttacctgtaacacagccgacgcgccaagtaaagatatctttgtgaagcttaccacaatggcaatgtatcctcacgtcacgcaggccgaccttaaaagcagtaccttctggctccgggcttcttttggtgccactgtttttgctgtactgggcttcgctatgtataaggccctgctgaaacagcgatag

SEQ ID NO: 238008 - DNA, 1980 bp, Artificial Sequence
  Description of Artificial Sequence: Synthetic coding sequence
atgaaaaaagatgtacgaattttgctggtgggagagccaagagtggggaaaacctccctaattatgtcgcttgtatccgaggaattccctgaggaagtccctccgcgtgccgaagagattacaattccagctgatgttacccccgagcgcgtgccaacccatattgtcgattattcagaagcggaacaaagcgatgagcagcttcaccaggaaatctctcaggctaatgttatatgtattgtgtacgctgtgaacaataagcactctattgacaaggtaacgtcccgctggattcctctcataaacgaacgcactgataaggatagcaggctgcctttaatcctggtgggaaacaagagcgacctcgtcgagtatagttcaatggagacaattctgcccattatgaatcaatacacggagattgagacctgcgtggagtgctccgcaaaaaatttgaaaaacatttctgaattgttttattacgcccagaaggctgtgctgcaccctactggacccctctactgccctgaggagaaggagatgaagcctgcatgtattaaagctctgacaaggatttttaaaatttcagatcaggataacgatggtactcttaatgacgcagagctaaacttttttcagaggatttgcttcaacacaccactggcccctcaggccctcgaggacgttaagaatgttgtgaggaagcatatatccgacggcgtggccgattccggtctgacattaaaaggatttttatttctccatacgctgtttatccagcggggacggcatgaaacaacatggacagttctgcgccgtttcgggtacgatgacgacctcgatctgacccctgaatacctcttcccactgctgaaaatcccacctgactgtactactgagctcaatcatcacgcctatttattcctccagtctacatttgacaagcacgacctggatcgcgattgcgcattgtcgcccgatgagctgaaggatctctttaaggtttttccttatattccctggggccctgatgtgaacaacactgtgtgtacaaatgaaagggggtggattacatatcagggttttctgtcccaatggacacttacaacatacttggatgtccagaggtgcctagagtatctgggctacctcggatattctatcctgactgagcaggagtcccaagcctccgccgtaacagtcacaagagacaaaaagatcgatctgcagaaaaagcagacgcagagaaatgtctttagatgcaacgtgattggtgtcaagaattgtggcaagagtggggtgctgcaggcgcttttaggccgaaatctgatgcggcaaaagaaaataagagaagaccacaagagttactatgctatcaacactgtttacgtatacgggcaagagaaatacctgctactgcatgatatttcagagagcgagtttctgaccgaggcggagattatttgcgacgttgtctgtctcgtatacgatgtgtctaatcccaaaagctttgagtactgcgccaggatcttcaagcaacatttcatggattccagaatcccttgtctgattgtcgccgctaagagcgatctgcatgaggtgaaacaggaatattcaatatctcctacagatttctgtaggaagcataagatgcctccccctcaggccttcacttgcaatacagccgatgcaccatccaaagatattttcgtgaagctaaccactatggctatgtatccccatgcacgcctgagatgcatgtgcacctgcaaccgatgcacgttttgtatttgccagaattttcttaatagcgacctgctgcaatctgtaaagaacaagattttcactgcagtcctcaacaggcacgtgacccaggccgacctgaagtcgagtaccttttggcttagagccagcttcggtgccacagtctttgcagtactggggtttgcgatgtacaaggctctgctgaagcaacgctag

SEQ ID NO: 238009 - DNA, 2076 bp, Artificial Sequence
  Description of Artificial Sequence: Synthetic coding sequence
atgaagaaagacgtgaggatcctcctggttggagaacctcgggtgggcaaaacctcactcattatgtcactggtttcggaggaattcccggaagaagtcccgcctagagccgaagagataaccatccctgccgacgtgacacccgagcgcgttccaacccacatcgtggattactccgaagcagaacagagcgacgaacaattacaccaggagatttcccaggctaacgtcatctgtattgtatacgccgtcaacaataagcactctatcgataaagtcacttccaggtggatacccttgattaatgagaggaccgataaggattccaggctccccctgatcctggtgggaaataaatccgatcttgtggaatactcatcaatggagaccatcctgccaattatgaaccaatacacagagatcgaaacatgtgtcgaatgttctgctaaaaacctgaagaacatctcagaactgttctactatgcccaaaaggcggtgcttcatcccaccggtcctctgtattgtcccgaagagaaagaaatgaagccagcctgcataaaagctttgacccggatcttcaagatctctgaccaggataatgacggcacgctgaacgacgcagaacttaacttcttccaacgcatttgttttaacacgcccctcgcccctcaggccctcgaagacgtgaaaaatgtcgttcgaaaacatatttctgacggagttgccgactcaggtttgactctcaaggggttcttgtttctgcataccttattcatccagcggggacgacatgaaacaacatggaccgtgctgaggagatttggctacgacgatgacctggatttgacacccgagtacctgtttccgctgctgaagatccctccagactgtacaactgagttgaaccatcacgcctacttatttctgcaatccacattcgataagcatgacctggatagagactgcgctctgtcaccagacgaactcaaggatctattcaaggtgttcccctacatcccctggggtccagatgtcaacaacacagtctgcaccaatgagcgcggttggatcacgtatcaggggttcttaagccaatggactctcaccacttacctagatgttcaacgctgcctggagtatctggggtacttaggttactccatcttgactgagcaggagtctcaggcttctgcagtgacagtcacgcgggacaagaagatcgacctgcagaagaaacagactcagcggaatgtgttccggtgcaatgttattggtgtgaagaactgcggcaagagtggcgtgctccaggcattgctgggcaggaacttgatgcgtcagaagaagatccgtgaagaccataagagctattatgcaattaacacagtttacgtctatgggcaggagaaataccttctgctccatgatatatcagagagtgagttcctaacagaggccgagattatctgtgatgtcgtatgcctcgtgtatgacgtctctaatccaaaaagttttgagtactgcgcccgaatttttaagcagcacttcatggactccagaattccttgtctgatcgtggcagcaaaaagcgacctccacgaagtaaagcaggaatattccatcagccctaccgacttttgccgcaaacacaagatgccgccaccccaagccttcacgtgtaacaccgctgatgcaccatcaaaggatatctttgtgaagttgacaactatggctatgtatccagaagaccactaccgcgatagattgagtcgagacatgggccataccgataggatagagaatcttcgtaagatctgggtgttcctgaagaccgccttccatgccaggttacggtgcatgtgtacatgtaatcggtgtaccttttgtatttgccagaattttttaaactccgatttgctgcaatctgtgaagaacaaaatcttcactgccgtcctgaatcggcatgtgacccaggccgaccttaaatccagtaccttctggcttcgagcatcattcggggctactgtgttcgctgtgctagggtttgcaatgtataaggccctgctcaaacagagatag

SEQ ID NO: 238010 - DNA, 1953 bp, Artificial Sequence
  Description of Artificial Sequence: Synthetic coding sequence
atgaaaaaagatgtccgcatcctgctcgttggcgagcccagggtgggcaagacctctctcataatgtccttagtgtctgaggaattccccgaggaggtgccacccagagcagaggagatcactattcctgctgacgtcactcctgaacgcgtccctacccatattgtcgattacagcgaggcagagcagagcgacgaacagctgcaccaggagatttcccaggctaacgtcatctgtatcgtctacgctgtcaacaacaagcactccatcgataaagtgacctcacgctggatcccgcttatcaacgagagaactgataaggattctagattgcccctgattctggtgggaaacaaaagcgaccttgtcgagtattcaagtatggagacaatcctgccaatcatgaaccagtatactgaaattgagacatgtgtcgagtgctcggccaagaacctcaaaaatatctccgagcttttctactacgcccagaaagccgtgttgcatccgactgggcctctttactgtccagaggaaaaggaaatgaagccagcatgtattaaagcactcactcgcattttcaagatttcggatcaggataatgacggtacattaaatgatgccgaactcaacttttttcagaggatatgtttcaacactccattagccccacaggccctggaggacgtgaagaacgtggtgaggaagcacatctctgatggtgtcgcagatagtggtctgacactgaaaggatttctgttccttcacaccttatttatacagcgcggtcgacacgaaacaacctggaccgtattacggcgtttcgggtacgatgacgatcttgatctgactccggaatatctgtttcctctcctgaagatccccccagattgcacaacagagcttaatcaccacgcctatctctttctacaaagcaccttcgacaaacatgacctagacagagactgcgccttgtcacccgacgagttgaaggacctgttcaaggttttcccctacataccatgggggccagacgtaaataataccgtatgtaccaatgagcggggatggattacatatcagggattcctgagccagtggaccctcaccacctacctggacgtgcagaggtgccttgagtaccttgggtatctgggatatagcattctcactgagcaggagtcccaggcctcagctgtgactgtgacaagggataagaaaattgacctacagaagaagcaaacacagcgaaatgtgtttcggtgtaatgtgattggggtaaaaaattgcggtaagagcggagtgcttcaagccctgctggggagaaatcttatgcgccaaaaaaagatcagagaagatcacaaatcctattatgcaataaacaccgtgtacgtttacggccaggaaaaatatctgcttctccatgacatctccgaatcagagtttctcaccgaggcagaaattatttgcgacgttgtttgcttagtgtatgacgtgtcgaaccccaaatcttttgagtattgtgccaggatttttaagcaacattttatggattcacgcatcccgtgcctgatcgtcgctgctaaatccgatttacacgaggtgaagcaggaatacagcatttcacctacagacttctgccgcaaacataagatgcctccaccccaagcttttacttgtaacacagccgatgccccttctaaagatatctttgtcaagctgactaccatggccatgtaccctgaggatcactaccgggaccgcctctctcgagatatgggccacaccgaccgtattgagaacttacggaaaatctgggtctttctgaaaactgctctccatgtcacgcaggccgatctgaaaagcagcactttctggttgagggcctcttttggagccacagtgtttgccgtgctgggctttgcaatgtacaaggcgcttctgaagcaacggtag

SEQ ID NO: 238011 - DNA, 744 bp, Artificial Sequence
  Description of Artificial Sequence: Synthetic coding sequence
atgaaaaaggacgtcaggatcctattagtgggtgagccgagagtgggaaagacaagtctgataatgtcacttgtctctgaggaatttccagaggaggtgccaccccgagccgaggaaataaccattcccgcagacgtgaccccagaacgggtgcccacacatatcgttgactatagcgaggccgagcagagcgatgagcagctgcaccaagaaattagccaggccaatgttatatgcattgtgtacgcagtgaacaataaacactccatcgataaggtgacatcgcggtggatacccctgataaacgaaaggacggataaggactcacgcctccctctcatcttagtggggaacaagagcgatctcgtcgagtactctagcatggaaaccatcttaccgattatgaaccaatacaccgagatcgagacctgcgtcgagtgttccgccaagaatctgaagaacatttcagagcttttttattatgcccagaaagccgttcttcaccccacaggacccttgtactgccctgaggaaaaagagatgaaacccgcatgcatcaaagcccttaccagaatctttaagatctcagatcaagacaatgacggtacgctgaacgacgcagagctgaactttttccaaaggatctgttttaacacaccactggcccctcgtttcggctttgaacaggtgttagtgctgctctttttgcagttctgggctctgctgtgcaccaagcattattag

SEQ ID NO: 238012 - DNA, 1857 bp, Artificial Sequence
  Description of Artificial Sequence: Synthetic coding sequence
atgcggcgtgacgtgcgtatcctgctgttaggtgaggcacaggtgggcaagactagcctgatcttatctttagtgggtgaggagttccctgaagaggtcccccctagggctgaagagattacaatacccgctgatgtgactccagaaaaagtacccacacacatcgtagattactccgaggcagagcagacggacgaggagttgagagaagagattcacaaggcaaatgtcgtctgtgttgtatatgatgtatcagaagaggccacaattgagaagatccgcacaaagtggattccacttgtgaatggcggaactactcagggccctagggtccctattatacttgtgggcaataagagtgatttgagaagcggctcctccatggaggccgtgctcccgattatgagccagtttcccgagatagagacctgtgtcgaatgttccgccaaaaatctcaggaatatctctgaattgttttattacgctcagaaggcagtgctccaccccaccgcacctctgtacgatcccgaagccaaacagctgcggcctgcgtgtgctcaggcccttaccagaattttcaggctgagtgatcaggacttagatcaggcattgtcagacgaggaattaaatgcatttcaaaaatcttgcttcggccaccctctggctccgcaggctctggaggatgtgaagactgtagtttgccgaaacgtcgcaggtggggtcagggaggatagactgacactggacggatttctgttccttaacactctttttatccagaggggccgacacgagaccacttggaccatcttgcgcagattcggctattcggatgcactcgaactgaccgcagactacctctcccctctgatccatgtaccccctggatgcagtacagagctcaatcacctcggatatcagttcgttcagcgggtgtttgagaagcatgatcaggacagggatggagcgttatcacccgtagagctccagtcactgtttagcgtttttccagctgctccttggggtcctgagctgccaagaaccgtcagaacggaggccggtcggctgccgttacacgggtatctttgtcagtggactcttgtaacatatttggacgtccggtcatgccttggccacctgggctatctggggtacccaactctttgtgaacaagaccaagcacacgccatcacagtaacccgagaaaaaaggctcgatcaggagaaggggcagactcaacgctctgtgcttttatgtaaggtggttggcgcacggggagtggggaagtcagcttttttgcaggctttcttgggccgaggacttggacaccaagatacaagggagcagcccccaggctacgccatcgacacggtccaggtgaatggtcaagaaaaatacctgatactttgcgaagtcgggacagatggactccttgcgaccagcctagacgctacatgcgatgttgcctgtttgatgttcgatggcagcgatccaaagagcttcgcccattgtgctagcgtttataagcaccattacatggacggccagacaccgtgtctatttgttagcagtaaagccgatcttccagagggggtagccgtgtccggccctagccctgccgagttttgccggaagcacaggctgcctgccccagtccccttctcgtgtgccggtccagccgaacccagcactacaattttcactcagctcgccacaatggctgctttcccccacctcgtgcacgccgagttgcacccgagtagcttctggctgcgaggcctgctgggggtggttggtgcagccgttgcagccgtactctccttctctctctaccgcgtgctggtgaagagccagtag

SEQ ID NO: 238013 - DNA, 777 bp, Artificial Sequence
  Description of Artificial Sequence: Synthetic coding sequence
atgccacctcaacagggggatcctgcgtttcctgatagatgcgaagcccctccagtaccgccacgacgggaaaggggaggacggggtgggaggggaccaggcgagccaggaggccgagggcgagccggaggagccgaagggcgaggcgtcaagtgtgtcctcgtcggcgacggcgctgtgggtaagacaagcctggtagttagctataccaccaatggctatccaacagaatacatccccacggccttcgacaatttcagtgcagtggtgtccgtggatggcagaccggtgaggttacagctttgcgatactgcgggtcaggatgaattcgacaaactcagaccattgtgttacactaatactgacatcttcctcttgtgcttcagtgtggtgtccccttcgtctttccagaatgtctccgagaaatgggtgccggaaatacggtgtcactgtccaaaggcaccaataatcctggtgggtacacagtcagatctcagggaagatgttaaggtcctcatagaactggacaaatgcaaagaaaaacctgtgccagaggaggccgctaagctgtgcgccgaagaaatcaaggccgctagttatatcgagtgttccgctctaacccagaaaaaccttaaggaagtgttcgatgcggctattgtggcgggaatccaatactcagatacacagcagcagcccaaaaaaagcaagagcagaacaccggataagatgaaaaatttgagtaaatcttggtggaaaaagtattgttgctttgtgtag

SEQ ID NO: 238014 - DNA, 1527 bp, Artificial Sequence
  Description of Artificial Sequence: Synthetic coding sequence
atggatcatctgggagcgtctctgtggcctcaagtaggctccctgtgtctgctgctcgccggtgcggcttgggccccaccccctaacctgccagaccccaagtttgaaagtaaagctgcccttcttgctgcaagaggtcctgaggaactcttatgcttcactgagaggctggaagatttagtctgcttttgggaagaagcagcctcggcgggagtcgggcctggaaactactccttcagctaccagctggaggatgagccatggaagctatgtaggctgcatcaggccccaaccgccaggggcgcagtcagattttggtgttcattgccaaccgccgatacctcgtcatttgtaccactggaactgcgagtgactgctgcctccggcgcaccaaggtatcatcgcgtgatccacattaacgaagtagttctgctggatgctcctgtgggcctggtcgccaggctggctgatgagtctggccacgtggtgttgcgttggctgcctccgccagaaactcccatgacatcccatatccgatacgaggtggacgtttccgcgggtaacggtgcaggatctgtacagcgggtggaaattctcgagggtagaaccgagtgtgttctgtctaatttacggggtagaacccgctatacattcgctgtgcgggctcgtatggccgaaccaagctttggagggttctggtcagcctggtcggaaccagtatctctgctgacaccatcagacctggatcctcttatcttgacactcagcctgatacttgtcgttatactcgtgctcctgactgttttagcgctacttagtcatagaagggccctcaagcagaagatatggcccggtatccctagtcccgagtcagagttcgaagggctcttcaccacacataagggtaactttcaactatggttataccagaacgacggttgcttgtggtggtctccgtgcacacctttcacggaggatccgcctgctagccttgaagtgctctccgaacggtgttgggggacgatgcaggctgtcgagccaggcaccgacgatgagggtcccttgctggagcctgttgggagcgaacacgcccaagatacctacctagtgttagataaatggctccttcctcgaaatcccccaagtgaggacttgccgggtcctggcggaagcgtggatattgtggctatggatgagggatcagaggcttcctcatgttcatcagcactcgcctcaaaaccctcccccgagggcgcttcagccgctagtttcgagtacacaatcctggacccttctagccagctattacgcccttggactctttgtccagaactgcctcccacccctccccacttgaagtacctgtacctggtggtctcggatagcgggatatcaacggactattctagtggcgactcccagggcgctcaaggaggtctctcagacggaccatactcaaatccctacgagaattccctcattcctgcggcagagccattgccgccatcttacgttgcgtgttcatag

SEQ ID NO: 238015 - DNA, 2550 bp, Artificial Sequence
  Description of Artificial Sequence: Synthetic coding sequence
atggccgcagctgccccagccgcagcagccgctagctcggaagcccctgcggctagcgcaactgctgagcccgaggccggtgaccaagattcacgcgaagtccgggtgctccagtccctgcggggtaagatctgcgaagccaagaacctgctcccttatctcggcccacataagatgagagactgtttctgcactattaacctcgatcaagaagaggtgtacagaacacaggtggttgaaaagagtctgtcaccttttttctctgaggagttttacttcgagatccccaggacgtttcagtacctgagcttttatgtgtacgataagaatgtgcttcagcgcgatctccggattggcaaggtcgcaatcaagaaagaggacctttgtaatcactcgggaaaggaaacctggttctctctgcagccagttgattcaaactccgaggtgcagggcaaggttcacctcgaactgaagctcaatgagctcatcacggagaatggcacggtgtgccaacagctggtagtacacatcaaagcctgtcatggcctcccacttataaatgggcagagctgtgacccgtatgccaccgtgagcttagtgggcccttctcgaaatgaccagaagaaaaccaaagtgaagaaaaaaactagcaacccacagttcaacgagattttttattttgaggtgacacggtcatctagctacaccagaaagagccagttccaagtggaggaggaagacatcgaaaaactggagattcgcattgacctgtggaacaacggaaacctcgtgcaggacgtgttcctgggtgaaatcaaggttcccgtgaatgtgttacgaacagattcctcacatcaggcgtggtacctgctgcaaccgagggacaacggaaacaaatcctcaaagaccgacgacctgggctccctgcgactgaacatatgttatactgaagattacgtcttgccaagcgagtattatggccctctaaagacccttctacttaagtctcctgatgtgcaaccaatttccgcatcggcagcttacatcctgtcggaaatttgtagggacaagaacgacgccgtgctgccacttgtgcgtctgctgctccatcacgataaactagtaccatttgctacagccgtcgcggagctggacttgaaagacactcaggacgccaatacaatcttccggggaaattcactggcgacacgttgtctggacgaaatgatgaagattgtgggtgggcactacctgaaggttaccctaaagcccatcctggatgaaatctgtgattcctcaaagagttgtgaaatcgaccccattaaacttaaagagggggacaacgtggaaaataataaggaaaacttgcgttactacgtggataagctgtttaacactattgttaaaagtagcatgagttgccccaccgtcatgtgcgacattttttatagtttgcggcagatggccacccagcgcttccccaatgatcctcacgtccagtacagcgctgtcagttcctttgtgttccttaggttttttgccgttgcagtggtcagtccccacacattccacctcaggccacatcatcccgatgctcagacgattcggacccttaccctgatatccaaaactattcagaccttgggtagctggggctctctgtccaaaagcaagtcttcatttaaggaaactttcatgtgtgaattcttcaaaatgttccaggaggagggctatatcatcgcagtgaaaaaattcttagacgagatctcttcaaccgagaccaaggaaagctccggaacctccgagccggttcatttaaaggagggcgaaatgtataaacgggctcagggaaggacgcgaattggaaagaagaatttcaagaaaaggtggttctgtttaaccagtagggaactgacgtaccacaagcagccaggcaaggatgcaatttatactattcccgtcaagaatattttagccgtcgagaaattggaggaatcctcttttaacaaaaaaaacatgttccaagttatccatacagagaagcctctgtacgtccaagcgaacaattgcgtagaggccaacgagtggattgacgtgttatgtcgtgtgtccaggtgtaaccagaaccggctttctttttaccacccatcagtataccttaatggtaactggttgtgttgccaggaaacaggagaaaatacattgggttgcaaaccctgtacagcaggcgtccctgccgatatccagattgacatagatgaagacagggagaccgagagaatttacagtctgttcactctgtcactgctgaagttgcaaaagatggaggaggcctgcggaacaattgccgtctaccaggggccacaaaaagagcccgatgattacagcaacttcgtgattgaagatagcgtaaccacatttaaaactatacagcagattaaaagcatcattgagaagctggatgaacctcatgaaaaatatagaaaaaagcggagcagcagtgcgaagtatgggtccaaagaaaaccctatcgtaggtaaagcctcctag

SEQ ID NO: 238016 - DNA, 834 bp, Artificial Sequence
  Description of Artificial Sequence: Synthetic coding sequence
atgatgaaaatcgtcggagggcactacctgaaggtcacattgaaaccaatcttggatgagatatgcgactcttccaagtcttgtgagatcgatcccattaaactgaaagagggtgataacgtcgaaaataacaaagaaaacttgcgttactacgtggataagcttttcaacacgatcgtgaagagcagcatgagctgcccgaccgtcatgtgtgacattttctattctttaagacagatggccacacagcgcttcccaaacgatcctcacgtccaatacagtgctgtgtcttcattcgtctttctgcgcttcttcgccgtcgccgtcgtgtcgccacacacgtttcatctgagaccacatcatccagacgcacagactatccgaactctcactctgatttctaaaaccattcagaccctaggcagctggggtagcctgtcaaaatcaaagtcgtcgtttaaagaaaccttcatgtgcgaattttttaagatgtttcaggaagagggctacatcatcgccgtcaagaaatttctcgatgagatttccagcactgaaaccaaagaaagctctgggacatctgagccagtccacctaaaagaaggggagatgtacaagagggcacaagggagaaccaggatcggaaagaaaaacttcaaaaagcgctggttttgcctgacgtcgcgggagctcacctaccacaaacaaccagggagctgtgtatacgcattgctgtggggcttttcgtggttttccgtgaaggtttccttacctctgatcgtcaccttggtgaacccatttagcaacattaccgtcgtgtacggcttcagccactag

SEQ ID NO: 238017 - DNA, 2553 bp, Artificial Sequence
  Description of Artificial Sequence: Synthetic coding sequence
atggcagccgctgccccagctgccgcagcagcaagcagtgaggcaccagctgcctccgcgacggccgagcccgaggccggagaccaggacagcagggaagtccgcgtcctgcagtccctgcggggaaagatctgtgaggctaaaaacttgttgccatacttggggcctcacaaaatgcgcgactgcttctgtacaataaacctggaccaagaagaagtgtatcgtacccaggtcgtggagaagagcctgtcaccctttttttctgaggagttctactttgaaatacctcggacgtttcagtatctgtctttctacgtgtatgacaaaaacgttctccagagagatctcagaatcggaaaggtggccattaaaaaggaggacctctgcaatcattccggaaaagagacttggtttagcctgcagcccgttgattctaattccgaagtgcaaggtaaggtacatttggagttgaagctgaatgagctaattactgagaatggaacagtgtgtcagcaacttgtggtgcatataaaagcctgccacggactacccctcattaacggccagagctgtgatccttatgcaactgtgagcctcgttggcccttccagaaacgaccagaaaaaaaccaaggttaagaaaaagacctctaatccccagtttaatgagattttttatttcgaagtcaccagatcttcgtcgtatacacgaaagtcacaattccaggtcgaagaagaggatattgaaaagctcgagatcaggattgatttgtggaataatggcaatctggtgcaggatgtcttcctgggtgagattaaggtgcccgtcaatgttctgagaaccgattcttctcatcaggcctggtacctgctacagccacgagacaatggtaacaagtctagcaaaacagatgacctgggaagtcttcgcctaaatatttgttataccgaagattacgtacttccgtctgagtactatggtccacttaagacacttcttttaaagagcccagacgtgcagcctatcagcgcctcagccgcttacatcctgtcagagatttgcagagacaaaaacgacgcggtgttacctctcgttaggctcttgttgcaccacgacaagctggttcctttcgccactgccgtcgcagagctggatctgaaggacacccaggacgctaatactattttccgaggcaactctctggccaccaggtgtctcgacgaaatgatgaagatcgttggcggtcattaccttaaagtgacgcttaagccgatccttgatgaaatatgcgattcttcgaagagttgtgagatcgaccccatcaaattgaaagagggtgataatgtagaaaataacaaggaaaacctacgctattacgttgataagctattcaacacaatagttaaaagcagtatgtcctgtcctaccgtcatgtgtgacattttctacagtcttagacagatggccacccagcgattccccaacgatccacacgtacagtactctgcggtatcctcttttgtctttcttaggttcttcgcagtggcagtggtcagtccccacacctttcatctccggccacatcacccagatgcgcagaccattaggactctgactttaatctccaagaccatccagacactaggctcctggggctcactgtctaagagtaagtccagttttaaagaaaccttcatgtgtgaattttttaagatgttccaggaggaagggtatatcatcgccgtcaagaagtttttagatgaaattagtagtactgaaactaaggagtctagcggcacctccgaaccggtccatctgaaggagggcgaaatgtacaagcgtgcccagggtagaactagaatcggcaagaagaacttcaaaaagagatggttctgcctgacgtctcgcgagttgacttatcacaagcaaccgggttctaaagacgccatctacaccatacccgtaaagaacatcctggccgtggagaaactcgaggaatcatcctttaacaagaagaacatgttccaggtgattcacaccgaaaaaccgttgtacgtgcaggcaaacaattgcgtcgaggccaacgaatggattgatgtgttgtgtagggtctctagatgcaatcaaaaccggttatcgttttatcacccctccgtgtatctgaatggcaactggctgtgctgccaagagaccggtgagaatacactcgggtgcaaaccctgcaccgccggagtgcccgctgacattcagatcgatatagatgaggaccgagaaaccgagcgcatctacagtctgtttactctgtccctcttgaagctccagaagatggaggaggcatgcggaacaattgccgtttaccaggggccacagaaagagcctgatgactattcaaacttcgtcattgaggattcagtgaccacatttaagaccatacaacagatcaagtccatcatcgaaaagctggatgaacctcacgaaaagtatcgaaaaaaaaggtcttcgtcagctaagtatggatccaaggaaaaccccatcgtgggcaaagctagctag

SEQ ID NO: 238018 - DNA, 2505 bp, Artificial Sequence
  Description of Artificial Sequence: Synthetic coding sequence
atggccgtggaagacgaaggactgcgagtgtttcagagcgtcaagattaagataggggaagccaagaatctgccttcttatcccggaccaagtaaaatgcgggactgctattgtactgttaatctggaccaggaagaagtctttcggacaaaaatcgtggaaaagtccttatgtcccttctacggggaagacttttattgcgagatccctaggagcttccggcatctcagtttctatatcttcgatagagatgtgtttcgacgtgattcaattatcggaaaagtggccatccaaaaagaggacttacagaaatatcacaatcgagacacttggttccagttacaacacgtggatgccgacagcgaagtacaaggtaaggtgcacctcgaactgaggctgtcggaggttattactgacaccggcgtcgtttgccacaaacttgccactcgcatagttgagtgtcaaggtttacccattgtgaacggtcagtgcgatccgtatgcaaccgtgacgctggctggcccattccgtagcgaggccaagaagacgaaggtgaaacggaagactaacaatccacagttcgatgaagtgttctactttgaggtgacgaggccatgttcctactcaaagaagtcacactttgactttgaggaggaagacgtcgacaaactggagattagggtagacctctggaatgccagcaatctgaaattcggagatgaatttctaggggagctcagaattcccctgaaagtgctgagacagagcagctcctatgaagcctggtacttcttacaacctagggataacggctctaagtcgctcaagcccgacgaccttggctccctgcgacttaacgtcgtttacacagaggatcacgtgttttccagcgactactactctcctttgcgggacttgctgttaaagagtgcagacgttgaaccggtaagtgcttccgccgcacacatattgggagaagtttgtagggagaaacaagaggccgctgtgcccctggtgcgtctcttcttgcattatgggagggttgtgccttttatatccgcgattgcatccgcagaagtcaagcgtacacaggatcctaatactatcttcaggggaaattccctggccagcaaatgcattgatgagactatgaagttggcaggtatgcactatctccacgtgacactaaagcctgctattgaagagatctgccagtcacataagccttgtgagatcgaccctgtgaaactgaaggacggagagaaccttgagaataacatggagaacctgcgacagtatgtggatcgtgtgttccacgccattactgagagcggagtgtcgtgtccaaccgttatgtgcgatattttctttagtttgcgtgaggcagcagctaagcgctttcaagacgatcccgatgtgagatacaccgcagtaagctcttttatattcttacgtttcttcgcccctgctattttatcacctaatctgtttcagctgaccccccatcacaccgatccccaaactagccggaccctgacgctgatatcaaaaacagtgcagactctgggatctttgtctaaatcaaaatcggcaagtttcaaggagtcctatatggcaaccttttatgagttctttaatgaacagaagtatgccgatgccgtcaaaaacttcttagacctcatcagcagctcagggaggagggaccccaagtctgtggagcagccaatcgtgttgaaagagggctttatgataaagagagctcaaggacgtaaaaggttcgggatgaagaactttaagaaacgatggttccggctaacaaaccatgaattcacgtatcacaaatctaaaggcgaccagcccctgtatagtataccaatcgaaaatatactagccgtcgaaaagttagaggaggagtcattcaaaatgaagaatatgttccaggtgatccaaccagaaagggcactgtacatccaggccaacaattgtgtagaggcgaaagactggatcgatatcctcactaaagtgtcccagtgcaaccaaaaacgcctgaccgtgtaccacccttccgcatatctctccggccactggctttgctgcagggcccctagcgacagcgcacctggctgtagcccgtgcacagggggtctccctgccaatatccagttggacattgatggagatcgcgagacagaaaggatctatagcctgttcaatttgtacatgagtaagctggagaagatgcaggaggcctgtggtagtaaatcagtgtacgatggacccgagcaggaagaatactctactttcgtgattgacgacccccaggagacctacaaaacacttaagcaagtgattgcaggtgtcggcgctcttgaacaggaacacgcccagtacaaacgcgacaaattcaaaaaaaccaaatacggctcccaggagcaccctatcggggacaaatcattccagaactatatcagacagcaatcagagaccagcacacattccatttag

SEQ ID NO: 238019 - DNA, 2409 bp, Artificial Sequence
  Description of Artificial Sequence: Synthetic coding sequence
atgagggattgttattgcacagttaatctagatcaggaggaggtgttccgaactaagattgtggagaaatctttatgccccttctatggcgaggacttttattgcgagattcctcgatctttcagacacttaagtttttatatcttcgatagggatgtcttcaggagagacagcatcatcggtaaggtggccattcagaaggaggacctccaaaagtatcacaacagagacacatggttccaacttcagcatgtcgatgccgatagtgaggtccaaggtaaggttcacctagaattgcgcctgtccgaggtcatcacagacactggcgtggtgtgccataagctcgctacgaggattgtagagtgtcagggcctgcctatcgtgaacgggcagtgtgacccatacgcaacagtcaccttggcaggtcctttccgtagcgaggccaagaagaccaaggttaagcgtaaaacaaataatcctcaatttgatgaagtgttctattttgaagtgacgcgtccctgtagttatagcaagaaaagtcattttgactttgaggaggaggacgtggataagctcgagatcagggtggatctgtggaacgcctccaacctcaagttcggggatgaatttctgggcgagctgcgaatcccactgaaggtcctgagacagagcagttcttacgaggcctggtatttcctccagcctagggataatgggagtaaatccttaaaacccgatgatctcggcagtctgaggctgaacgtggtctacacagaagatcatgtgttttctagcgattattactcccctctgcgcgatctactgctgaaatcagccgacgtcgagccagtctcagcaagcgcagctcacatcctgggagaggtctgtagggaaaagcaggaggccgcagtgccccttgttcgcttgtttcttcactacggcagagttgtgccattcatttccgccattgcatccgcagaagttaagcggactcaagaccctaacacaatattcagaggtaatagcttagcatccaagtgtatcgacgagactatgaagctggccggtatgcattacctgcacgtcactctcaagcccgcaatcgaggagatctgccaaagtcacaagccctgtgaaatcgatcctgtcaaactcaaggatggcgagaacctggaaaacaatatggaaaacctgaggcagtacgtagatcgggtcttccatgctataacggaatccggcgtatcttgcccaacagttatgtgcgacatcttcttttcactgcgagaggcagctgccaaacgctttcaggacgatccagacgtgaggtacacagctgttagctcttttatatttctgaggttttttgcccctgccatccttagcccaaacttgttccagctgacccctcatcatacagaccctcagacaagccgcacactgaccttgatctcaaaaactgtccagacactggggagcctgtctaaaagtaaatcagcctcctttaaagagagctatatggccaccttttacgaattcttcaacgagcaaaagtatgcggatgccgtgaagaattttctcgatctgatctcatcttctggacggagggatcccaaaagcgtggagcaaccaatcgttcttaaggaaggatttatgattaagcgggctcaaggacggaagcgtttcgggatgaaaaacttcaagaaacgttggttcaggctcactaaccacgagttcacctaccacaaaagcaagggggaccagcccctatattcgataccgatcgagaacatcttggccgttgagaagctggaagaggaaagcttcaagatgaaaaatatgtttcaagtgatacagcctgagcgggcactgtatatccaggccaataactgcgtggaggcaaaagactggatcgatattctcaccaaagtatcccagtgcaatcagaagagactaacggtttaccatccttctgcatatttgtccggtcattggctctgctgtcgggcaccttctgactccgcaccaggctgtagcccttgtacaggcggactccccgctaatatccagctagatatcgacggggaccgagaaactgaaagaatatatagcttatttaacctttatatgagcaagctggaaaaaatgcaggaggcctgcgggagcaagtcagtgtatgatggtccggaacaggaggagtactccacattcgttatcgacgatccccaagagacatataagacattgaaacaagtgattgcgggagtcggagcgctcgagcaagaacatgcccaatataaacgggataaattcaaaaagactaaatacgggtcgcaggagcacccaattggtgacaaatcttttcagaattacattaggcaacagagcgaaacaagtacacacagcatctag

SEQ ID NO: 238020 - DNA, 399 bp, Artificial Sequence
  Description of Artificial Sequence: Synthetic coding sequence
atggccgtggaggacgagggcttgcgtgtgtttcaatccgtcaagatcaaaatcggagaggctaagaacctgccgtcatacccgggtccatctaagatgcgggactgctactgcacagtcaacctagaccaggaggaagttttccgcacaaagattgtggagaagtccctgtgccctttttacggcgaggacttttactgtgagattcctagatcttttagacatctgagcttttatatcttcgatagggacgtgttcagacgtgatagtatcatcggccagtccgctcccggtgccgcagctgagcgcggtcatcatcgtcactggggccgtctaccccaagctcggcacacgcaccgacgggtgcccggacccccacacagggaatgggctatgtag

SEQ ID NO: 238021 - DNA, 2412 bp, Artificial Sequence
  Description of Artificial Sequence: Synthetic coding sequence
atggctaaaaggagttccctgtacattagaatcgtggaaggaaaaaacctgcccgcaaaggacattacaggcagctccgacccctactgcattgtgaaggtcgataacgaacccattatcaggaccgccacggtgtggaagacgttatgccctttctggggagaagagtaccaggtgcatcttcctcctactttccatgctgtcgccttctacgtgatggacgaagacgctctgtcccgtgatgatgtgatcggtaaggtttgtttaactcgcgatacaatcgcctctcacccaaagggattttccggctgggcacacctaacggaggtcgatcctgatgaagaagtacaaggagagatacacctgcggctggaggtttggcctggtgcccgtgcttgcagattacgttgctcagtgctcgaggccagggatctcgccccaaaggaccgcaacggaacctccgatccattcgtaagagtcaggtacaaagggaggacccgcgaaacctctatcgttaagaagtcctgctatcctaggtggaacgagaccttcgagtttgagctgcaggagggagccatggaggccctgtgtgtcgaggcctgggattgggatttagtgtcacgtaacgattttctcggcaaagtggttattgatgtgcagaggctgcgggtggtacagcaggaggagggctggtttaggttacagcccgaccaaagcaagtcccgaaggcatgacgaaggcaacctgggaagcctccagctggaggttagactgcgcgatgagaccgtgttgcccagtagctactatcagccactggtgcatctgctgtgccacgaggtgaagttgggtatgcaagggcctggtcagttaatccctctcatcgaggaaacaacgtcaaccgaatgccgacaggacgtggccaccaacctgcttaagctcttcctcggacaagggttagccaaagattttctggatctgctttttcagctggagttgtcgagaacgagcgaaacgaataccctgtttaggtccaacagtttggcttccaaaagcatggagagctttctcaaagtggccggaatgcaatatctccacggcgtccttggcccaatcataaataaagtgtttgaggaaaagaagtatgtggagctggatccatctaaggtcgaagtgaaagatgtcggctgctcggggttgcacagacctcaaacagaagcagaggttcttgaacaaagtgcccagactcttcgggcacatctaggagccctcctctctgccctgagccgcagcgtcagagcttgcccagccgtggtaagagcgacattccggcagctgtttagacgggttagggaaaggtttcctggggcacaacacgaaaacgtgccatttatcgcagttacctcctttctgtgtctccggttcttttcacccgcaatcatgtcgcctaagctgttccacctacgtgaaaggcatgctgatgctcgcacctcacggaccctgctccttctggccaaggctgtgcagaacgtgggtaacatggataccccggctagtcgagccaaggaggcttggatggaaccactgcagccgacagtccgacaaggtgtcgctcagctcaaggattttattaccaagctcgtcgacatagaagagaaggacgagctggatctccagagaaccttatctttgcaggcccctcccgtgaaagagggtccacttttcattcacagaacaaagggtaaaggcccactaatgtcctcttcgtttaagaagctctatttctcattaaccaccgaggccttgtctttcgccaagactccaagctctaaaaagagtgccttgatcaaattggctaacatcagggccgctgaaaaagtggaagagaagtcattcggcggttcccatgtgatgcaggtgatctacacagatgacgctgggagacctcaaaccgcctatctgcagtgcaagtgtgttaatgaactgaatcagtggttatcagcactgagaaaagtatccattaacaacacaggtctgcttggatcataccaccccggagtcttcagaggcgacaagtggtcctgctgtcatcagaaggaaaagacaggacaagggtgcgataagacacggagcagggtcaccctgcaggagtggaacgacccactagatcacgacctagaggctcagctcatttatcggcatctgctgggagttgaagcaatgctgtgggagaggcatcgcgagctgtctggaggcgctgaagcaggcacagtgccaacctctccaggcaaggtgccagaggacagcttagctcgattactgcgggtgctgcaggatctccgcgaggcccactccagctcgcctgccggttcaccgccatctgagcctaattgcctgttggaattacagacctag

SEQ ID NO: 238022 - DNA, 2274 bp, Artificial Sequence
  Description of Artificial Sequence: Synthetic coding sequence
atggctaagcggagtagtttatatatccggatagtcgaaggcaaaaaccttcctgcaaaggatattactgggtcctcagacccatactgcatcgtcaaagtggataacgagccaatcattcgtactgccacggtgtggaaaaccctgtgccctttttggggagaggaataccaggtgcacctgcctcccactttccatgctgtggcattttatgtcatggacgaggatgccttaagcagagacgatgtaattggaaaagtttgcctgactcgcgatacaatagcctctcaccccaaagggttctctgggtgggcccatctgaccgaggtagatccagatgaggaagtgcagggtgaaatccacctcaggctggaagtgtggcccggagctcgggcatgccggctgcgctgctcagtgttagaggcacgcgacctcgcccctaaagaccgtaacggcaccagcgatccgttcgtgcgggtgcggtacaaagggcgtacgcgcgagacgtcaattgttaagaaatcctgttatcctcgctggaacgaaacctttgaatttgagttacaggaaggcgctatggaagccctctgtgtcgaggcttgggactgggacttagtctcaagaaatgattttctcggcaaggtcgtcatagatgtccaaagactgagggtggtgcagcaagaggaaggttggttccgattacagccagatcagtcgaagtcacgcaggcatgacgaaggcaacctgggcagcctgcagctggaggttcgattaagagacgagacagtcctcccgtcatcttactaccaacccctggtccacctgctctgccatgaggtgaagttgggtatgcaggggcctgggcagctcattcctctgatagaagagactacgtctaccgaatgcaggcaggacgttgccaccaatcttttgaagctgtttctcgggcagggtttagccaaagacttcctggaccttttgtttcaactagaactctccaggacgagtgagaccaatacattgtttcggagcaactctctcgcctcaaagagcatggagtctttcctcaaggtcgccggaatgcaatacttacatggagtgttgggtccaatcatcaataaggtattcgaggagaagaagtatgtcgagctcgacccaagtaaggtcgaagtcaaagacgtggggtgctccggcctgcatagacctcagacggaggcggaagtgctggagcagagcgcccagaccctgcgggctcatcttggggcactgctttctgcactctctcgatctgtacgagcgtgccctgctgtagtgagagctactttccggcagctattccgcagggttcgagagcgcttcccaggggcacagcacgaaaatgtgccctttatcgcagttacctcattcctctgtctgcggttcttctcgcctgccattatgtcgcccaagctttttcatctacgcgaacggcatgcagacgcaagaacttcccgcacactcttactgctcgccaaggccgtgcagaatgtgggcaatatggacaccccggcttctcgtgctaaagaggcttggatggagccactgcaacctactgtcaggcagggagtcgcacaattaaaggattttattacaaaattagtagatattgaagaaaaggatgagctcgatctccagcgcaccctgagcctccaggccccacccgttaaagaggggcctctgttcatacacaggactaaaggcaaagggccactgatgtcatcttctttcaaaaaactttacttctcccttacgaccgaggcgctctcattcgccaagacaccgagctctaagtgtgtgaacgagctgaaccaatggctaagcgccttgcgtaaagtaagtatcaacaataccggacttcttggcagctaccaccctggtgtatttaggggggataaatggagttgttgccaccagaaggagaagaccggccaggggtgcgataagaccagatccagggtaacacttcaagagtggaatgaccctttagatcatgatctcgaagctcagctcatctacagacatctcctgggcgtcgaggccatgctctgggagaggcaccgtgagctgtctgggggtgcggaggctggcactgttccaacatccccgggtaaagtaccagaagatagtctcgccagacttctgcgcgtgctgcaagaccttagggaggcccactcctctagcccagcagggtcgccacccagcgaacccaactgcctcctcgagctgcaaacctag

SEQ ID NO: 238023 - DNA, 2196 bp, Artificial Sequence
  Description of Artificial Sequence: Synthetic coding sequence
atggacgaagatgctctgagcagagacgacgtcatcggcaaggtatgcctaacacgggataccatcgcctcccatcccaagggttttagtgggtgggctcatttaaccgaggttgaccctgacgaggaggttcagggcgagattcacctgagactggaagtgtggcccggagctagagcttgccggctgcggtgctccgtcctggaggccagagacctggccccaaaagaccgcaatggaacctctgatcccttcgtaagagtaagatacaagggccgtacacgagagacatccatcgtgaagaagtcctgttatcccagatggaatgagacgttcgaattcgagttgcaagagggagctatggaagctctgtgcgtggaggcttgggactgggatttagtctcaaggaacgacttcctcggcaaggtggtgattgacgttcagcgcttgagggttgtccaacaggaagaggggtggttccgcctccaaccagatcagagtaagagccggagacacgacgaaggcaatctgggcagcctgcaactagaagttcggcttagggacgagaccgtgctgccctcttcttactatcagccccttgtacatctcttatgtcacgaagtaaagctgggaatgcaaggaccaggccaactcatcccgttaatagaggagacgacatcaacagaatgtcgccaggatgtggccacaaatcttctcaagttgttcctggggcaagggttagccaaggatttccttgacctgctgtttcaactggaactgtctaggacatccgagacgaacacgttgttccgttccaacagcttggctagcaaaagcatggagtccttcctcaaggttgcaggaatgcagtacctgcatggtgtgctaggaccaatcatcaacaaggtgttcgaggaaaagaaatatgtcgagctcgaccctagtaaagtcgaggtgaaggatgttggctgttcagggcttcataggccacagaccgaggcagaagtcctagagcagagcgcacaaacactccgggcacatcttggagcactgttgtccgcactttcaagatctgtaagagcctgccctgctgttgttcgggcaacctttagacagttgttcagacgagtgagggagcgttttcctggtgctcagcatgagaatgtaccctttattgctgtgacctccttcctctgcctccgcttctttagtcctgcaattatgtcccccaaactcttccacctcagagaaagacacgccgacgctcgtacatctagaactctgcttcttctggcaaaggccgtccagaatgttggaaacatggacacgcccgcttctagagccaaggaggcctggatggagcccctccagcctaccgtcaggcagggcgtggcgcagctgaaggacttcataaccaaactggtcgacattgaggagaaggatgaacttgacctgcaacggaccctcagcttgcaagcccctccagtcaaggagggcccattgttcattcaccggaccaaggggaagggcccactgatgtccagctcattcaagaagctatacttctcactgaccaccgaagcactttcattcgcaaagacaccgtcatctaagaaatctgccctgatcaaactggccaatatccgagcggcagagaaggtggaagagaaatccttcggtggtagccacgtcatgcaagtcatttacacagacgacgcaggcaggccccagaccgcctaccttcagtgcaaatgcgttaatgaacttaaccagtggctcagtgccttgcgcaaggtgtcaattaacaacactggcttgttggggagctaccaccctggcgtgtttcgcggagacaagtggtcttgctgccaccagaaggagaagaccggacaagggtgcgacaagactcggagccgggtgactttgcaggagtggaatgatccgttggatcacgacctggaggcgcagctgatctaccggcatctgctgggtgtcgaagcaatgctgtgggagagacatcgcgagctatccggtggcgctgaggctgggaccgtgccaaccagccccggaaaggtaccagaagactctctggctcgcttgctgcgagtgttgcaagacctgagagaagcacatagcagcagcccagcaggctccccccctagtgagccgaactgtcttcttgagctgcagacctag

SEQ ID NO: 238024 - DNA, 2415 bp, Artificial Sequence
  Description of Artificial Sequence: Synthetic coding sequence
atggccaagtcctcctcgcttaatgtgagggtggttgaaggcagagctctgccggctaaagacgttagcggctcaagcgatccatactgcttggttaaagtggatgatgaggttgtcgcacgcaccgccaccgtctggagatcactcggccctttttggggggaagagtataccgtccacctgcctcttgacttccaccagctggccttctacgttttagacgaggacactgtaggacacgacgacatcattgggaagatttccctgagtcgggaagcgatcactgcagatcctagaggcatcgactcttggataaacctgtctcgagtggaccccgatgcggaggtgcagggagagatatgcctctctgtgcaaatgctggaggatggccagggtcgttgcctgcggtgccatgtcctccaggcccgtgacctcgcacccagagatatttccggaaccagcgacccctttgcgcgagttttttgggggtcccagtctttggaaacatcgactatcaaaaaaactagatttccccactgggacgaagtgctcgaactccgggaaatgcctggcgctccaagccccctccgggtggaattatgggactgggacatggtgggcaagaacgacttcctgggcatggttgagttttccccaaaaaccctgcagcaaaagccgcctaagggctggttcaggctactgcccttcccacgagctgaggaggactctggtgggaatctcggagccctgagggtgaaagtgagactcatcgaagatcgcgtcctcccctcgcagtgttatcagccattgatggaactgctaatggagtccgtgcagggacccgctgaagaagataccgcctcccctttggctctcctcgaggagttgacactaggtgactgcagacaagacctagcaaccaaactggtgaaactgtttcttggacggggactggctggcaggttcttggactacctgacccggagagaggtggccagaaccatggatccaaacaccctgttccgaagtaacagtctggcctccaaatcgatggagcaattcatgaagcttgtgggtatgccatacctccatgaggtgttgaagccagttataagtcgcgtttttgaggagaaaaagtatatggagttagacccctgcaagatggaccttggcaggactagacgcatttcatttaaaggggcactgtcagaggagcagatgcgggaaacttcactcggactgctgacgggctatctcggaccgattgttgacgcaatcgtgggatccgtcggcagatgcccgcctgccatgcgactggcatttaaacaacttcataggcgggtggaagaacggttcccccaagccgagcatcaggacgtcaaatatctggctataagtggatttttgtttctgcggtttttcgcaccagcaatcctgacacctaaactgttcgatctacgggaccaacacgctgaccctcaaacaagcaggagcctcctcctgctggctaaggctgtgcaaagcatcgggaacctcgggcaacagttgggacagggaaaggagctgtggatggcacccttacaccctttcctcctacagtgtgtatcgcgtgtaagagatttcctggacaggcttgtggacgtggacggagacgaagccggagtgccagctcgcgctctctttccaccttcagcgatcgtccgcgagggctacctgctgaaacgcaaggaggaacccgctggcctcgccacccggtttgcttttaagaagcgttacgtgtggctcagcggcgagactctaagtttttctaagagtcctgaatggcagatgtgccacagcattcccgtgtcccacatcagggctgtggagagggtggacgagggcgcttttcaactcccgcacgtgatgcaggtggtcacccaggacggcacaggagcgcttcacactacatacttacagtgcaagaatgtgaatgagttaaatcagtggctttccgccttgaggaaagcgagcgcccctaatcccaacaagcttgcagcatgtcatcctggcgcttttcggtctgccaggtggacatgctgtctgcaagcagaaagatccgctgctggttgttctcggacacactcagccgtgaccttgggagactggtcagatcccctcgacccggacgcagaggcccagacggtttacaggcagctcttgctcgggcgagatcagctgcgccttaagcttctcgaagattccaacatggacactactttggaggccgacactggagcctgtcctgaggttctggctagacagcgggcagcaacggctagacttctggaggtcctggcggaccttgatcgggctcacgaagagtttcagcaacaggagagggggaaagccgctctaggacccctcggtccgtag

SEQ ID NO: 238025 - DNA, 2331 bp, Artificial Sequence
  Description of Artificial Sequence: Synthetic coding sequence
atggccaagagctcgtcgctcaacgtccgggttgtggaagggcgagcactcccagcaaaggacgtatcaggttcctcggacccttactgtctggtcaaagtggacgatgaggtggtggccagaaccgccactgtttggcgaagcctgggccctttctggggggaagagtacacagttcatctccctctagacttccatcagctcgctttttacgtcctcgacgaagacactgtgggacacgacgatatcatagggaagatttccctgtcccgagaggcaatcactgccgacccacggggaatcgattcttggattaacctgtcaagagtcgaccctgatgccgaagtccagggggaaatttgtctgtcagttcagatgctggaggacggccaggggcgatgtctgcggtgtcatgtgctgcaggccagagacctcgccccacgcgatatctccggcacgtcggacccattcgccagggtgttttggggttcacagtcactggagacctcaaccattaaaaaaacgcgatttccccactgggacgaggtgcttgaactcagggagatgccgggagccccaagccccctacgagtggagctctgggactgggatatggtgggaaaaaacgacttcctcgggatggtggaattcagccctaaaacgctgcagcaaaaacctcccaaagggtggttccgcctcttgccctttccccgtgctgaggaggactccggtggaaatctgggcgcactaagggttaaggttaggctgatcgaggatcgggtgctaccttctcagtgctaccagccattgatggaactattgatggaaagtgttcagggccctgcagaagaggataccgcatcacctttagcgctgcttgaggagttgacgcttggtgactgtcgacaagatctcgctaccaaactagtgaaattattcctgggcagggggctggccggacgtttcctggattatttaacaagacgcgaagttgctagaaccatggatccaaacacactgttcaggtccaattccctggcatcaaagagcatggaacaattcatgaaactagtgggaatgccgtatctgcatgaggtgctgaagcctgtcatcagccgagtgtttgaagaaaagaagtatatggagttggatccttgtaaaatggacctggggagaaccaggcggatctcattcaaaggtgctttgagcgaagaacagatgcgagagacctccctggggctcttgaccggatacctgggccctattgtggacgcaatcgtaggctctgtgggcaggtgcccgccagcaatgcggttagctttcaagcagctgcatcggagagtcgaagagaggtttccccaggctgagcaccaagatgtcaaataccttgccatctccggtttcctttttctcagatttttcgctccggcaatcctgactccaaagctcttcgatctcagagatcagcatgccgaccctcagacgtcacggtcccttctgcttctggcaaaggcggttcagtcaatcggaaatctcggccagcagctgggccagggcaaagaactatggatggcccctcttcacccatttctgctgcagtgcgtgtctcgtgtgagagacttcttagataggctggtggacgttgatggcgatgaggctggggttccagcacgggctctcttcccaccctcggccatcgtgcgcgagggctatctgctgaagcgcaaagaggaaccggctggcttagccacccgctttgcttttaaaaagcgatacgtttggctgtctggagaaacgttgagctttagcaagagtccagagtggcaggtcgtcacccaggatggaaccggcgctctacacacaacttacctacagtgtaagaatgtcaacgagcttaatcagtggctgtccgcactgcggaaggccagcgcccctaaccccaataagctagccgcttgtcaccccggtgcttttaggtcggctcgctggacttgttgtctgcaggcagagcggtccgctgcgggttgctcccgcacccatagcgccgtaactctgggtgactggagcgatccgctcgatccagatgcagaggcacagacagtctaccggcagctcttactcggtagagaccagctgcgtctcaaacttttggaagactcaaatatggacaccacgctggaggcagataccggggcttgtcccgaggtgctcgctagacaacgagcagctaccgccagattgctcgaggtcttagcggatctcgaccgcgcacacgaagagttccagcagcaagagagaggcaaagcagccttgggtccgcttgggccatag

SEQ ID NO: 238026 - DNA, 2421 bp, Artificial Sequence
  Description of Artificial Sequence: Synthetic coding sequence
atggcaaagagtagcagcctgaatgtaagggtagtggaggggagagccttacctgccaaagacgtgagtggttctagcgacccatactgcctcgtgaaggtagatgatgaagtggtggccagaacggccaccgtgtggagatccctgggccctttctggggcgaggaatataccgtgcaccttccactcgatttccaccagttggccttttacgtgttagacgaggacacagtcgggcacgatgatatcatcggcaagatttctttgagcagagaggcaattacagctgaccccaggggcatagactcatggatcaacttaagccgcgtagatccggacgccgaggtccagggggagatctgtctgtctgttcagatgttagaggacgggcaaggacgttgtctccgctgtcatgtcctgcaggcccgagacctagccccaagggatatcagcggaaccagtgacccatttgctcgagtcttctgggggtctcaatcactcgagactagtactatcaaaaagactcgtttccctcattgggatgaggttctagaactacgggaaatgccgggagctcctagtccactcagagtggaactctgggactgggacatggtgggtaagaatgatttcctgggaatggtggagttttcacccaaaactcttcagcagaaaccgcctaagggatggttcagattgctgccattcccacgcgcagaggaggattcagggggaaatttaggagccctgcgggtgaaggttcggctgatcgaggacagggtgctgccaagccaatgctaccagccactgatggagctcttaatggagtccgtgcagggacccgctgaagaagatacagctagcccactggcgttacttgaggagctgactctgggggactgtagacaagatctggccacaaagttggtgaaattgttcttgggaagaggcctagcgggtcgtttcctggattacctgacccggagagaggttgccagaaccatggacccgaataccctgttcagatccaatagtctggcatctaagtctatggaacaatttatgaagctggtgggcatgccctacctgcatgaggtactgaagcctgtaatttctagagtatttgaggaaaagaagtacatggagctggatccctgtaagatggatctcggacgcacccggagaatttccttcaaaggggcattaagcgaagaacagatgcgcgagacaagcctcggattactcaccggctatttgggacccatcgtcgacgccatagtagggtctgttggtcgatgcccccctgccatgcgcctggcatttaagcagcttcaccggagagtggaggagcgcttcccacaggcagagcatcagcaggacgtgaagtacctggctatctcagggttcctgtttcttcgcttttttgcccctgcaattctgacacctaaactttttgacctacgggatcagcacgccgacccccagacctcccggtcgctactgctcttggctaaggcagtccagagcatcggtaatctggggcaacagctggggcagggcaaagaactctggatggcacctctgcaccctttcctgctgcagtgtgtttcacgagttcgcgacttcctggacaggctagttgacgtggacggggacgaagaggccggagttccggctcgtgctctgttcccacctagcgctatcgtgagggagggttacctgctgaagaggaaagaggaaccagccggactggctacaagattcgcctttaaaaagagatacgtgtggctgtctggagagacactctcatttagcaaatccccagagtggcagatgtgccattctatcccagtgagccacatccgcgcagtggaaagggtggatgagggggctttccagctgccccacgtcatgcaggtggttacccaagacggcacaggcgcactgcacaccacctatctgcagtgcaagaacgtcaatgagttaaaccagtggctgtcagccttaagaaaggcatcggcacccaatccaaacaagttggcggcatgccaccccggagcattccggagtgccaggtggacctgctgcctgcaggctgaacgcagtgcggctggctgctctaggactcacagtgctgtcacactcggcgactggagtgatcctctcgacccagatgccgaagctcagacggtctatagacagctgctgcttggtcgtgatcagttgcgcctgaagctgttagaggattccaatatggataccacactggaggcagatacaggggcatgccctgaggtactggccagacagagggccgctacagccaggctgttagaggttctggcagacttggacagagcccacgaagagtttcagcagcaagagcgaggcaaggctgcactgggccctcttggtccctag

SEQ ID NO: 238027 - DNA, 3714 bp, Artificial Sequence
  Description of Artificial Sequence: Synthetic coding sequence
atgcagaagtcggtgcgttataatgagggccacgccctgtacttagcattccttgccagaaaagagggaactaagagagggttcctcagcaagaagaccgccgaggcctctaggtggcatgagaaatggttcgccctgtatcagaatgtgttgttctattttgagggtgagcagtcctgccgccctgctggaatgtacctgttggaaggatgtagttgcgaacgcacccctgctccaccacgggcaggcgctggccagggtggcgtcagagacgccctagacaagcaatattatttcactgtgctcttcggccatgaaggccagaaacctttggagctcagatgcgaggaggagcaagacggaaaggaatggatggaagcgatccatcaggccagctatgccgatatcctgatcgaaagagaagtcctgatgcagaaatacattcacttggtgcagatcgtagagactgagaaaatagccgctaaccaacttcgacatcagttggaagaccaagacaccgaaatcgagcgtttgaagtctgaaattatagccctcaataagactaaagagcggatgaggccctaccagagtaaccaagaggatgaagacccagacataaaaaaaattaagaaagtccagagcttcatgagaggatggctctgccggcgtaaatggaagacaatagtgcaggattatatttgcagcccccacgctgagagcatgaggaaaagaaaccagatagtgtttacaatggtggaagcagaatctgagtatgtgcaccagctctatatcctggtaaacgggtttcttcgtcctcttagaatggctgctagtagtaagaaacctccaatttcccacgatgatgtgtcttccatctttttaaacagcgagaccatcatgtttctgcatgagatcttccaccagggtctgaaagcacgaatcgcgaattggccaaccctaatcctggctgatctatttgacatcctgctccctatgttgaatatctaccaggaatttgtgagaaatcatcagtactctctccaggtgctcgcgaactgcaaacagaatagggatttcgacaaactgctgaaacagtatgaagccaatcccgcatgtgagggacgcatgctagaaacctttctgacatatcccatgttccagataccacggtacataatcaccctgcacgagcttctggcacataccccacacgagcacgtcgaaaggaagtcactcgagttcgccaagtcgaaactcgaagagctttcacgggttatgcacgacgaggtatccgacactgagaatattcgaaagaatctcgctatcgaaagaatgatcgtcgaagggtgtgatatcctcctggatacctcccagacatttatcagacaggggagtctgatccaggtccccagcgtggaaaggggcaagttgagcaaggttcgtcttgggagcctgtctttgaagaaagagggagagcgacagtgcttcctgttcaccaagcacttcttgatttgtactcggagttccggagggaaactgcacttgcttaagacaggtggcgtcttgtctctaattgactgtacacttatcgaagagcctgacgcttctgatgatgacagcaagggcagcgggcaggtgttcgggcatctggacttcaagatcgttgtcgagccacccgatgcggcagctttcactgttgtgttactggccccaagccggcaagagaaagctgcctggatgtctgatatttcccagtgcgtggacaacatcaggtgcaacgggctaatgacaattgttttcgaggagaattccaaagtgaccgttcctcacatgattaaatcagacgctcgcctgcacaaggatgatactgatatctgcttttccaaaacactgaattcgtgcaaggtgccccagattcgctatgcttcagtggagcgcctgcttgagagactaacggatttacgttttctgtctatcgattttcttaacacatttttgcatacatacaggatattcacaaccgctgccgtggtgctgggcaagctgtccgatatttacaaacggccatttacatccatccctgtgagatccctggagttgttctttgctacgagccaaaataatcgtggcgaacaccttgttgatgggaagtctccgcgactttgcaggaagtttagctctccgcctccattggctgtatctcgcacttcttcccccgtgagggccaggaaattgtcattgacctcacctcttaattctaaaatcggggcactcgatctgaccacctcatcttcacctaccaccacaacgcagagtccagctgcgtcaccccctcctcataccgggcagatccccctggacctgtctcgagggctgtcttccccagagcagtcaccaggcactgtggaggagaatgttgacaatcccagagtcgacttatgtaacaaactgaaacggagcattcaaaaggccgtgcttgaaagtgctccagctgaccgggcaggagtagaatcttcacctgctgccgatacaactgagctatcaccctgtcgcagcccctcgacgcctcgtcacctacggtacagacagcctgggggacagactgctgacaacgcacactgctctgtgagccctgcatccgcctttgcgatagctacagctgcagctggtcatggttctccccctgggtttaataacacagagcgcacatgtgataaggaattcattatcagacgtacagctactaatcgcgtcttgaatgtgctgagacactgggtctctaagcatgctcaggacttcgaactgaacaatgagctgaaaatgaacgtcctaaatctcctggaggaggtcctccgcgaccccgaccttctgccccaggagagaaaggccgctgccaatatcctccgcgctctcagtcaggatgaccaggatgacatccacctcaagctcgaggacatcatccagatgacagattgtatgaaggctgagtgcttcgagagtctgtccgctatggaactggctgagcagatcaccttgctcgatcacgtgatcttccgctcaatcccatatgaggagttcctgggacaagggtggatgaagctggacaagaacgagcgcactccttatattatgaagacgtcacagcacttcaatgacatgtccaatctcgtggcatcccagattatgaactatgcggatgtcagcagtcgcgcaaacgctatagaaaaatgggtcgcggtggctgatatctgccgttgcctgcacaactataatggggtgctggaaattacctccgccctgaatagatcagcaatttaccggctgaagaaaacctgggccaaagtcagcaaacagacgaaagcattgatggacaaacttcagaaaactgtgtcttctgagggcaggttcaagaacctgcgggaaactctgaaaaactgtaacccgccagccgtcccatacttgggtatgtacctcaccgaccttgcgtttattgaggagggaactcccaacttcacagaagaaggactggtcaacttttcgaagatgcggatgatctcacatatcattcgtgaaatccggcaatttcagcaaacaagttaccgaatagatcaccagccaaaagttgcccagtatttgttagataaggacctgataattgacgaggacactctatacgagctgtccctgaaaattgaaccgagactaccggcttag

SEQ ID NO: 238028 - DNA, 4431 bp, Artificial Sequence
  Description of Artificial Sequence: Synthetic coding sequence
atgacaagcagtagccctgccggtctcgaagggagcgatttgtctagcatcaatactatgatgtccgccgtgatgtcagtaggtaaagtcaccgaaaacggtggatccccacagggcatcaagtcccccagtaaaccccctggccctaatcgcatcggcaggcgcaatcaagagactaaagaagagaagagtagctataattgcccactatgtgagaaaatttgcacgacgcagcaccagcttactatgcacattagacagcataacactgacacaggtggagccgatcactcgtgtagcatctgcgggaaatcactgtcctccgcctctagccttgaccggcatatgcttgttcattccggcgagagaccctacaaatgcaccgtgtgtggtcagtctttcactaccaatggtaacatgcacagacacatgaaaatccacgaaaaagacccgaactctgccacagcaacggccccaccttctcctctcaaaagacgaaggctttcttctaagagaaaactgagccatgatgctgaaagtgagagagaggatccagcaccagcaaaaaagatggtagaggacggtcagtctggtgatctcgagaagaaggcagacgaggtcttccactgccctgtgtgcttcaaggagttcgtgtgtaagtacggactggagactcacatggagacacactcggacaatcccttgcgctgtgacatatgctgcgttaccttccggacacaccgcggactgctgcggcacaatgctctggtgcataagcagctgccacgagacgctatgggacgtcccttcatccagaataatccatcaataccagctgggtttcatgatctgggatttaccgacttttcatgcaggaagtttcctaggatcagtcaggcatggtgtgaaaccaaccttagaaggtgtatcagcgagcaacacaggttcgtgtgcgatacatgcgacaaggcctttcctatgctgtgcagcctggccctgcacaagcaaacccacgttgctgctgaccaggggcaagaaaagccccaggctacccccttacctggcgatgccctggatcaaaaaggcttcctggccctcctgggcctgcagcacacaaaagacgtgcgcccagctccagctgaagagcctctgcctgatgataaccaggcgattcagctgcaaactctgaaatgtcagttaccacaggacccagggtgtacaaacttgctgtccttatctcccttcgaggccgcttccttaggcggatctctgaccgtcctccccgctacaaaggactccattaaacacctcagcctccagccgtttcagaagggcttcatcatccagcccgattcatccatcgtagtgaagcccatctcaggcgaatccgctatcgagctggctgacatccagcaaatcctaaaaatggcagccagtgcgcctcctcagatctccctgccacctttttctaaggcacctgctgccccactacaagcgatcttcaagcacatgcctcctctgaagcctaaacccctggtcactccacgtactgtcgtcgctacctccacccctccacctttgattaacgctcaacaggcttcccccggttgtatatcccctagtttgccacctccccctctgaagctgctcaagggtagtgtggaggccgcaagcaatgcccacctcctgcagtcaaagtccggaacccaacctcacgcggctaccagactgagtctacaacagccccgtgcagagcttccgggtcagccggaaatgaaaactcagctggaacaggactctattatcgaggcgctactgcccctcagcatggaggcaaagattaagcaagaaattacagaaggggaactgaaggcattcatgactgcccctgggggtaagaaaacgccagccatgagaaaggtcctctatccctgtcgcttttgcaaccaagtgtttgccttctctggagtgctcagggctcatgtgagatcacacctcggaatctcaccgtatcagtgcaatatttgtgattatatcgccgctgacaaggccgctttgattaggcaccttcgaacacattcaggagagcggccatatatctgcaaaatttgccattaccccttcaccgtgaaagcaaattgcgagcgacacctgcgcaagaagcacctgaaggcgactagaaaagacattgaaaagaatatcgagtatgtttcttctagtgccgctgagctggttgacgcattttgtgctccggataccgtgtgtcggctgtgcggcgaggatctgaaacattacagggcactccgcattcacatgagaacccactgtggccgtggtctgggcggtggccacaagggcaggaagcctttcgagtgtaaggagtgttcagctgcattcgctgctaaaagaaattgcattcatcatatcttgaagcaacatctgcacgtgcccgagcaggatatagagtcctacgttttggcggcagacggcctaggaccggctgaagccccagccgcagaggcctccgggcgaggggaggacagtggatgtgccgctcttggagactgcaagcccctgacagctttcctggaaccacagaacggttttttgcatagagggccaacacagcccccaccccctcatgtgagcattaagctagagcctgctagcagtttcgccgtggacttcaacgagccactagatttctcccagaagggtttagccctggtccaagtcaagcaggagaacatcagtttcctatctcctagcagcctcgtgccctatgactgttcaatggagcctatagacttgagcataccaaagaattttcggaagggggataaagacctggccacaccttcggaggctaagaagccagaggaggaagctggtagcagcgaacaacctagtccttgcccagcgcctgggccttctcttccagtgacattaggtccttccggtatcctagagtccccgatggctcccgcacctgctgccacaccggaacctccagcgcaaccacttcagggacctgtgcagctcgctgtgcctatttacagctccgctctcgtgtcttcaccgccactggttggatcctccgcgctgctctcaggaaccgccctgctgcgcccactccggcctaagcctcctctactgctgcctaaaccgcctgtcacagaggagcttccaccattagccagcattgcgcagataatcagcagtgtatcctccgcacctaccctgcttaaaacaaaagtggccgatcccggacccgcatcaactggttctaatactacagcctcagatagcttggggggtagcgtcccgaaagcagctaccactgcaactcctgccgcaacaacctcccctaaggaaagttctgaacctccagcgcctgcctccagtccagaggctgcctcccccaccgaacaggggcctgcaggaacatcaaagaaaagaggcaggaagcgcggtatgcggtctcgcccaagggcaaactctggcggagtggatctcgatagcagcggcgagttcgcgtccatagaaaagatgctggctactacagacacaaacaagtttagtccttttttgcagacagcggaggacaacacgcaggatgaggtggccggtgcacctgccgaccatcatgggccaagcgacgaggagcagggttcccccccagaagacaagttgttgagggctaagaggaattcctataccaactgccttcagaaaatcacatgtcctcattgccccagagtgttcccatgggcctctagcctgcagcgtcatatgttaacacacactggccagaagcccttcccttgtcagaagtgtgatgctttcttcagcacaaagtcgaattgcgaaagacatcagcttcgaaagcatggggtcaccacatgctctttgaggaggaacggactaattccccagtccaaggaatctgatgtaggctcccacgattctaccggcgagcgcccttataagtgccaaacctgtgaacggacgttcacactcaagcattcgctggttagacaccaaaggatacaccagaaggccagacacgccaagcatcacggaaaggactcagataaggaggagcgcggtgaagaggactcagaaaatgagtccacacactcaggaaacaatgccgtcagtgaaaacgaggctgagctggcacctaacgctagcaatcatatggcagttacgaggtcacgaaaagaaggccttgcctcagcaaccaaggattgctctcacagggaggagaaggtgacggcgggttggccatctgagccgggacagggggacctgaacccggagtcaccggcagctctgggccaagatctacttgagccaaggtccaaacggccagctcacccgattctggctaccgctgatggagcctcccagcttgtggggatggagtag

SEQ ID NO: 238029 - DNA, 5063 bp, Artificial Sequence
  Description of Artificial Sequence: Synthetic coding sequence
atgacatcttcatcccccgcagggttggagggcagtgatctctcatcaataaacacgatgatgtctgccgtgatgtcggtcggcaaggtgaccgagaatggagggtcaccccaaggcattaagagtcccagtaaacctccagggccaaacaggatcggacgccgaaaccaagagacaaaagaggagaagagctcctacaattgtcctttgtgtgaaaagatttgcacaactcagcatcagctgaccatgcacatccggcagcataacacagataccggcggagcagatcactcttgttctatctgcgggaagagcctgtcctccgcctctagtctagataggcatatgttggtccacagtggtgaacgcccatataaatgcaccgtgtgcgggcagtcatttacaaccaacggcaacatgcacagacacatgaaaatccacgagaaggatcccaactccgccaccgccacggccccacctagccctttgaaacgtcgcagattatcctccaagcgcaagctgtctcatgacgctgaaagtgagcgagaggacccagcgccagccaaaaagatggtggaggatggtcaaagcggtgatctggagaagaaggccgacgaggtgtttcactgtcctgtctgctttaaggagtttgtgtgcaagtatggcctggaaacgcatatggagactcactccgacaaccccctgcgctgtgatatatgctgcgtgacatttcgcacccacagaggccttttgaggcacaatgctctggtgcataagcagcttcccagggacgctatgggaaggccttttattcagaataacccgagtatcccagctggcttccatgatctggggttcacggactttagttgtcgaaaatttccacgcatcagccaagcttggtgcgagacaaacctgaggcgatgtatctcagagcagcataggttcgtgtgcgacacctgtgataaagcctttcccatgttgtgcagcctggcgctacataaacaaacccatgtggctgcagaccaaggtcaggagaaaccacaagccacacctctccccggagacgctctggatcagaaaggattcctggcccttctggggctacagcatacaaaggatgtgagacccgcaccagcagaggagccactccctgacgataatcaagctatccagctacagaccttgaagtgtcaactgcctcaggaccctggatgtaccaatcttctgagtttgtctccatttgaggctgcctccctgggaggcagcctgaccgtgctgcctgccaccaaggattcaattaaacatctgagcctgcagcccttccagaaggggttcattatccagccagactcttctatcgtcgtcaagccaatctccggtgagagcgctatcgagctggccgatattcagcaaattctaaagatggccgcttcagccccaccccagatctctttgccaccgttctccaaagccccagcggctccgctgcaagccatttttaagcacatgcccccacttaagccaaaacctctggttacaccgcgtaccgtagttgccacctctactccccctcctttgatcaacgcccagcaggcaagccctggctgcattagcccgagtctccctccgcctcccctgaaacttcttaagggatcagtcgaagcggcatccaatgcccatctcttgcagagcaagagcggtacacagcctcacgcagcaacacgactcagccttcagcagccaagagccgaactgcctggacagccagaaatgaaaacccaactcgagcaggattcaatcattgaggccttgctgcccctgtccatggaagcaaaaattaagcaggagatcacagaaggtgagctcaaagcttttatgacagcaccgggagggaagaagactcctgccatgagaaaagtgctgtatccctgccgtttttgcaatcaggtctttgcattctctggggtactacgagcccatgtccgatcccacttaggaatcagtccatatcagtgcaatatctgcgattacatcgctgcagataaagccgcactgatccggcacttaaggacgcactctggcgaaagaccttatatctgcaaaatctgtcactatccctttaccgtaaaggctaactgtgagaggcatctacgcaaaaagcatcttaaggcaactcgcaaagacatcgaaaagaacattgagtatgtcagttcatctgccgcagaactcgtcgatgccttttgcgcccctgacaccgtgtgccgactgtgtggggaggatttaaaacactatcgggcactgaggatacacatgaggacacactgtggcaggggattgggtggagggcacaagggaagaaaaccgtttgaatgcaaggaatgctctgccgcattcgccgctaaaagaaactgtatccaccacatactgaagcagcacttgcacgtgcctgaacaagacatcgagagttatgtgttggctgctgacggcctaggccctgctgaggcaccagcagcagaagcctctggcaggggggaggattcagggtgtgctgcacttggagactgcaaacccttaacagcgttcctggagccacaaaacggctttctccatcgaggtccaactcagccaccaccgccacatgtgtctataaaactggaacctgccagcagtttcgccgttgacttcaacgagcccctggactttagccaaaaaggactggctttagtccaggtcaagcaagagaacatctcattcctgtcgccatcttctctggtgccctatgattgctccatggaaccaattgatcttagtattcctaagaactttaggaagggggataaggatttggctacacccagcgaagcaaaaaagcctgaagaggaggcgggaagttccgaacaaccttcaccatgccctgcaccgggacctagcctccccgtaacactggggccatcaggcatcttagagtcacccatggctcccgctcctgctgcaaccccagaaccccctgctcagcctcttcaggggccagtccagctggccgttcctatttacagctcagccctggtgagctccccccctcttgtaggatcatccgccctgctgagcggaactgcattgctccgcccacttagacctaagcctccactgctgctgccaaagccccctgtcacggaagaactgcccccactggcctctatcgctcagataatctcgagcgtgagctccgcccctaccctccttaaaactaaagtggcagaccccggtccggcatccaccggaagtaatacgaccgcatccgatagcttaggaggatctgtccctaaggccgcaacaaccgcaactcccgctgctaccactagccccaaggaatcttccgaacccccagccccagcatcatcccccgaagctgcttccccaacagagcagggcccagccggaactagcaagaaaagaggacggaagcggggaatgcgctccaggcccagagctaacagtgggggagtcgatttagattcatccggagaattcgcttcaatcgagaagatgttagccaccacagacaccaataagttctccccctttcttcagacagctgaggacaacacccaggatgaggtggcaggggcacccgcagatcaccatggcccatccgatgaggagcagggaagtccacccgaggacaagttgttaagggctaagcggaattcttatacaaattgtcttcaaaagatcacttgtccacattgcccacgcgtattcccatgggctagcagtctgcagaggcacatgctgactcacacagactctcagtctgacgccgaaacagcggctgctgccggagaagttcttgatctgacctcccgagatcgcgaacagccctccgaaggggctacagaactgcgccaagtagccggagatgcccctgtcgagcaggcaaccgctgagacagccagccccgtgcatagggaggaacacggcagaggcgagtctcatgaacccgaagaggagcacggaactgaggagtctaccggtgacgccgacggcgctgaagaagatgcttcttctaaccagagcctcgatctggatttcgctacaaagctcatggactttaagctggccgagggagacggagaagccggtgccggtggggcagccagtcaggagcaaaaattagcatgtgacacttgcggtaaaagtttcaagtttctgggtactctctctcggcatagaaaggcccatggacggcaggaacccaaagacgagaagggtgatggcgcttctaccgccgaagaaggcccacaaccagcgccagaacaggaggaaaagcctccagagactcctgccgaggtcgtggagagtgctcctggcgcaggcgaagcgccagctgaaaagctggcagaggagacagagggacctagcgatggagaaagtgcagccgaaaaacgtagctcagagaaatcagacgacgataagaagcccaagaccgacagtcctaaatctgttgcttccaaagctgataagaggaaaaaagtttgttcagtttgtaataagcgattctggtccctgcaggaccttacaagacacatgcgctcgcataccggagaaagaccgtacaagtgccagacctgtgaacgcacgtttacgttaaaacatagtcttgtgcggcatcagcgaattcatcagaaagctcggcacgccaaacaccacggcaaagatagcgacaaagaggagcgaggggaggaggacagcgaaaacgaaagtacacatagcggaaataacgcggtgtccgagaacgaggccgagctcgccccaaatgccagcaaccatatggccgtaaccagatcccgtaaggaaggactggcctctgctactaaggactgcagccatcgggaggaaaaagtaacggctggttggccatccgagcctggccagggagatctgaatcctgagtccccagcagcattggggcaggacctgctggagcctcgtagcaaacgccctgctcatccaatcctagctacagcggatggagccagtcagcttgtgggcatggagta

SEQ ID NO: 238030 - DNA, 5063 bp, Artificial Sequence
  Description of Artificial Sequence: Synthetic coding sequence
atgaccagcagctcccctgcgggtctggagggaagtgatctgtcttctattaataccatgatgtcggctgtgatgtctgtcggcaaagtgacagaaaacgggggatcacctcaggggattaagtctccctccaagccacctgggcctaaccgtattggacggcgaaaccaggagaccaaggaggaaaaaagcagctataattgccccctctgcgagaagatttgtactactcaacaccaacttaccatgcacattcgacaacataatactgacactgggggagcggatcactcttgttctatctgtgggaagtccttgtcgagcgcttcaagcttagaccggcatatgcttgtacacagcggggaaagaccatacaagtgcaccgtgtgcggacaatcatttacaacgaatgggaacatgcaccggcatatgaaaatccacgaaaaggaccccaattccgcaacagccacagcgcctccgtctccactgaagcgcagaagactgtctagtaagcgcaagctgtctcatgatgccgagagcgaaagggaggatccggcaccggctaagaagatggtcgaggacggccaatcaggggacctggagaaaaaggccgacgaggtttttcattgtccggtgtgctttaaggaattcgtttgcaaatatggcctggagactcacatggagacacacagcgacaacccattgcgctgcgatatctgctgcgttacatttaggacccacagagggttgctccgccataacgcacttgtccacaagcagcttcccagggacgcgatgggcaggccatttattcaaaacaatccctcaatcccggctggattccatgatcttggattcactgatttcagctgtaggaagtttcccaggatctcacaagcttggtgtgagacaaacctaaggcgctgcatctcagagcagcatcggttcgtgtgcgatacttgcgataaggcattccccatgttgtgttctctcgccttgcataagcaaacccatgtggccgctgaccaaggccaggagaagccgcaagcaaccccgctcccaggtgatgcccttgatcagaagggattcctcgcgcttctaggcctccaacacactaaagacgtgagacccgctcccgctgaggagcctcttcccgacgacaatcaggctattcaattgcaaacattgaagtgccagctgccccaggacccaggctgcacaaatctcctgtccctgtccccatttgaagccgcaagtctgggcggatccctgactgtgctccctgctactaaagattcaattaagcacctgtcccttcagccctttcaaaaggggttcatcatacaaccagattcatctattgtggttaagcccatctctggcgaaagcgccatcgaactagctgatattcagcagatactgaaaatggccgcatcagccccaccgcagatatcgcttcccccattctcgaaggccccagccgcacctctacaggccatcttcaagcacatgcctccgttgaaaccaaagcccctggtcacccccaggaccgttgtcgccacctcgacaccccctcccctgattaatgcccagcaggcatcccccggatgtatctctcctagtctcccgcctcctccccttaagttgctcaagggttctgtagaagccgctagtaatgcccacctcctgcagtccaagtcaggcactcagccgcatgccgcaacccggctgagcctgcaacagcccagagctgagctgccaggacagcccgaaatgaagactcagttggaacaggacagtatcattgaagctctcctgcccctcagcatggaagctaagataaagcaggaaatcaccgagggtgaactgaaggcattcatgacagctcccggtggcaaaaagacccccgctatgcgaaaagtcttgtacccctgtagattctgcaaccaggtatttgcttttagtggcgtgttacgggctcatgtcagatcgcacctcggtatctcgccctaccaatgcaatatttgcgactatatcgcagctgataaggctgctctgatccggcacctgcgcactcactcgggtgaacggccatatatatgcaaaatatgtcactatcctttcaccgttaaggctaactgcgagaggcaccttagaaagaaacacctcaaagccacacgcaaagacatcgaaaagaacatcgaatacgtgagttcttcagctgccgagcttgttgacgcattctgcgcccctgataccgtctgtcgactgtgtggagaggatctgaaacactatcgagcattgagaattcacatgagaacacattgtggacgcggtcttggaggcggacataaaggtcgaaaaccatttgagtgtaaggagtgctcagccgcttttgccgctaagagaaattgtatacatcacattttaaaacaacaccttcacgtcccagagcaggatatcgagtcctacgtcctagcagctgatggcttggggcctgcagaggccccagccgcagaagcaagcggaaggggcgaggacagcggctgcgctgctttgggcgactgcaaacccttgaccgccttcctggaacctcagaacggatttctccatcgcggacccacccagccccctccaccacacgtgagcatcaaattagaaccagcatcttccttcgcagtcgacttcaacgaaccgctggacttctctcagaaaggactcgccctcgttcaggtcaaacaagaaaatatcagctttttgtctccctcttccctagtgccttatgactgtagcatggagcctattgatctgtcaattcccaaaaactttaggaaaggcgataaagacctggccactccttcggaggccaagaagcccgaagaggaagctggcagctccgaacagcctagcccgtgcccagccccaggtcctagcctgccagtgactctcggaccctctggcattctcgagtctccgatggcacctgctcccgcagctacacccgaaccccctgcccagcctctgcaaggcccagttcagctggccgtgcctatttatagctcggcactcgtgtccagccctccgttagtcggctcctcggctttactgtccgggaccgcattgctacggcctctgcgccctaagcccccattactgttgcccaagccccctgtgactgaggaattgcctccactggcctcaattgctcagattatttcaagcgtgtcctccgctccaaccctgcttaagaccaaggtggcagatccaggcccagcctccaccggatcgaacaccactgcttcagattcgttgggcggatctgtgcccaaggccgctactaccgccaccccagctgctaccacgagccccaaggagtcaagcgaaccgccagcaccagcttccagccccgaggccgcttctcccaccgaacaggggccagccggtaccagcaagaaaaggggacgcaaacggggaatgcgttcaagacctagagccaacagtggcggtgtggatctcgattcgtccggtgagttcgcctctattgagaaaatgctggccaccaccgataccaataaattcagcccattcctgcagaccgcggaagataacacacaggatgaggtggctggcgctcccgctgatcaccacggacccagtgacgaagagcagggctctccacctgaggataaactgctgagagctaaacgcaactcttataccaactgcctgcagaagatcacatgtccacattgccctcgagtgttcccctgggctagctcgcttcagagacacatgctgacccacacagactcacagtcagatgctgaaacagcagctgcggcaggggaggtgttggatttgacttcacgtgacagggagcagccttccgaaggcgctacagaactgcgacaggtggccggagatgcaccagttgagcaggccactgcggaaaccgcctccccagtccacagagaggaacatggacgcggagaatcgcatgaaccagaggaggaacatggtaccgaggaatctaccggtgacgccgatggcgctgaggaagacgctagtagcaatcaaagcctcgatctggactttgccactaagcttatggattttaagctggcggagggcgacggagaagctggcgctgggggagcggctagtcaagaacaaaagctcgcatgcgacacctgtggaaagagcttcaagtttctggggactcttagcaggcaccggaaagcccatgggaggcaggaaccaaaggacgagaagggagatggagcaagtaccgcggaagaaggaccacagccagcacccgagcaagaagagaaacctccagagacccctgctgaggtcgttgaaagcgctccaggagccggagaggccccagccgagaagctggctgaggagaccgagggcccatccgacggagaaagtgcggcagagaagcgctctagtgagaaatctgatgacgacaagaaacctaagactgacagcccgaagtctgtcgccagtaaggccgacaagaggaagaaggtttgcagtgtctgcaacaagcgcttctggtccctgcaagacttaactaggcacatgaggtcccacacaggcgagagaccatacaagtgccaaacctgtgagcggacctttactcttaaacacagtctggtgcgacaccagcggattcaccagaaagctcggcacgccaagcaccacggcaaagactcggacaaggaggagcggggagaagaggattcagaaaacgagagcacacactctggaaacaatgccgtctccgagaacgaagcggagctggctcccaatgcttcaaaccacatggcagtgacaagatcaaggaaagagggtttggcgtcagctacaaaggactgcagtcaccgggaggagaaagtcaccgctggctggcccagtgaacctgggcagggcgatctgaaccctgagtcaccagccgcattgggccaggacctgctggagcccagatctaagaggcccgctcacccaatcctggcaacagccgacggagcctcacaactggttggaatggagta

SEQ ID NO: 238031 - DNA, 5228 bp, Artificial Sequence
  Description of Artificial Sequence: Synthetic coding sequence
atgaccagctcaagcccggctggactggagggttccgatctgagttcaatcaacaccatgatgtcagccgtgatgtcagtcggcaaagtgacagaaaacggagggtcaccccagggcatcaaaagtccatccaagccccctggccctaaccgtatagggcgacgcaatcaggaaaccaaggaggagaaatcctcttataactgcccactctgcgagaagatttgcaccactcagcatcagctcacaatgcatatccgccagcacaatacagacactggtggagcagatcacagttgcagcatatgtggtaaatcattaagcagcgcctctagtctggatcgccatatgcttgtccactctggcgaaagaccttacaagtgtacggtctgcgggcaatcttttaccacaaatggtaacatgcaccgacatatgaaaatacatgaaaaggacccaaattccgccacagccacagctcccccttcacctctcaaaaggagacgcctgagcagtaagcggaagctctctcatgacgctgaatcagaacgagaggatccagctccggctaagaagatggttgaagatggacagtcaggagatctagagaaaaaggctgatgaagtattccattgccctgtttgctttaaggagtttgtatgtaaatacggactggaaacacatatggagacacatagcgataatccactgcgctgcgatatatgttgtgtcacatttcgaacacacaggggcttgttgagacataatgccttggtgcataaacagcttcctcgggatgcgatgggtagaccgttcatccaaaataacccttccatcccagcaggttttcacgatctcggattcaccgacttttcatgtcgtaagttcccacgcatcagtcaggcttggtgcgagacaaatctgcgtagatgcatcagcgagcagcatagatttgtgtgtgacacttgcgataaggcgttccctatgctgtgctcactcgccctgcacaagcaaacccacgtcgcagcggaccagggccaagagaaaccacaggcaacaccgttgcccggtgatgccctcgaccagaaaggcttccttgccctgctgggtttgcaacatacaaaggatgtgcgccctgctcccgcagaagaacccctgcccgacgacaaccaggcaatacaactgcaaacactcaaatgtcagttgccgcaggatcctggatgcacaaatctcctctctctgagcccctttgaggccgcttccctagggggaagtctcacagtcctgccagcaaccaaggattctattaaacatttgtccttgcagccgtttcagaagggattcatcattcagcctgattcatcaatcgtggttaagccaatcagcggtgaatctgcaattgagctagcagacatacaacagatactgaagatggctgcgtccgcccctccccagatctcactgccgcctttctctaaggcgcctgcagcacctctgcaagccattttcaaacatatgcccccactcaaacctaagcctttggtgacgcctagaactgtggttgctaccagtacccctccgcctctaatcaatgcccagcaagcgagcccaggatgcataagtccttccctaccccctcccccacttaagctgctgaaggggagtgtggaggccgctagtaacgcacatctgctgcagagcaagagcggaacacagccacacgcagccacaaggcttagtctccaacagccacgtgcagagctgcccggtcagcccgagatgaagacccagcttgagcaagatagcataatcgaagccctgcttcccctgtcaatggaagccaaaataaaacaggagatcacagaaggtgaattgaaggcctttatgacagcacccggtggaaagaagaccccagccatgagaaaggtattatatccgtgtaggttctgtaatcaggtgttcgcattctcaggggtgcttagagctcacgtgaggtctcacctagggatctcaccttatcagtgtaatatttgtgattacattgccgcagataaggctgcgctgatacgccacctgagaacccactctggtgagcgtccctatatctgtaagatctgtcattaccccttcacagtgaaagcaaactgtgaaagacacctcaggaaaaagcatctgaaggcaacgagaaaggatatcgaaaagaacattgaatatgtgtcaagttctgcggctgaacttgtcgacgcattctgtgccccagacaccgtttgtcgcctatgcggagaggacctaaagcactatagggcacttcggattcacatgagaacccattgcgggagaggcctgggagggggacacaagggcaggaagccgttcgaatgtaaagagtgtagcgccgcttttgctgccaagcggaactgcattcatcacatattgaaacaacacctgcacgtgccagagcaggatattgagagctatgtgctcgccgctgacggcctcggcccagctgaagctcctgccgcagaggcttctggaagaggtgaggattccggttgtgccgcactgggggattgcaaacccctcaccgctttcctggagccacagaatgggttcctgcacagaggcccaactcagccccctcccccacacgtatctatcaagttagagcctgcctcctcattcgccgtggacttcaatgagcccttggactttagccagaaaggactggcattagtccaggtgaaacaggaaaacatcagttttttaagtcctagctccctagtgccctacgactgcagcatggagcctatcgatcttagtattccaaagaacttccggaagggtgacaaggacttggcgactccatccgaagcgaagaagcccgaggaggaggccggaagctccgaacaacccagcccttgtccagcccctgggcctagcctcccggtgacccttgggccaagcggtattctcgaaagtcccatggctcctgctcccgcagcaacaccggaacccccagcccagcccctgcaggggcctgtgcagctcgcagtgcccatctattcctcagcgctcgtgagctcgccgccactggtcggctccagcgcgttgttaagcgggaccgcattgctgcgtccactgaggccaaagcctccattactactgcctaaacccccagtgaccgaggagctgccccctttggcaagcattgctcagattatatcctcggtgagtagtgcccctactctgttgaagaccaaggttgcagaccccggacccgctagcactgggtctaatacgactgcgagcgattcactgggaggctctgttccgaaagcggctactacagctacccccgcagcaactacctctcccaaggagagcagtgagccaccagcccctgcatccagcccagaggcagcaagccccaccgaacaaggacctgcaggcacctccaaaaagcggggacgcaagcgaggtatgagatcccgccctcgggcaaactcaggtggggttgacctggattccagtggcgagtttgcctcaattgaaaagatgctggcaacaactgatactaataagttttctccatttttgcagacagcagaagataacacgcaagatgaggtcgcaggcgcacccgctgatcaccacgggccatccgacgaggagcagggtagtcccccagaggataagctgctcagggcgaaaaggaatagttataccaactgcctccagaagatcacctgcccccactgccctcgagtcttcccttgggccagttcacttcagcgacacatgttaactcacactggccaaaaacccttcccatgccagaaatgcgacgcgttcttcagtacgaagtctaactgtgagcgccaccagctccgcaagcacggagttacaacctgttcactgcgacgaaacggcctgatcccacagtccaaagaaagtgacgtgggctcccacgactcgactgactcacagtctgacgcagaaaccgccgctgcagctggcgaagtcctggatttgacatcccgggatagggagcagccttccgaaggggcaactgagctgcgacaggttgccggtgacgcgccagtcgagcaggctactgcggagaccgcttccccggtgcacagggaagaacatggccgtggagaatcacatgagcctgaagaagagcatggtactgaggagagcaccggagatgccgacggcgcagaggaggacgcgagctccaatcagagccttgatctggacttcgcaacgaagctgatggattttaaactcgctgagggagacggcgaagcaggagccggaggcgctgccagccaagagcaaaagttagcttgcgacacctgcggtaagtcttttaagttcctgggcacgctgagcagacaccggaaggcacatggcaggcaggagcctaaggacgaaaagggcgacggcgcatcaacagctgaagaaggtccccaacctgctcctgagcaggaagaaaagccgccagaaacaccggctgaggtggtggaaagtgcaccaggtgcaggggaggctcctgccgaaaaacttgctgaggagaccgagggcccaagcgacggagaatctgccgctgaaaaaagatcgagtgaaaagtctgacgacgataaaaagcctaaaacagacagtccaaaatcagttgccagtaaagctgacaagcgcaagaaagtgtgttctgtgtgcaataagcggttttggtctttgcaagatttaacgaggcacatgcggtctcacactggggaacgtccttataagtgccagacgtgcgagcggacgttcaccttgaaacatagtctggttaggcaccagcgcatacaccaaaaggcccgacacgcaaagcatcacgggaaagactccgacaaggaggagagaggtgaggaagactccgaaaacgagtctacacactctggtaacaatgccgtaagcgagaacgaagccgaactcgctcctaacgcctcaaatcatatggcagtgactaggagcaggaaggaagggctggcctcagccacaaaggattgttcccaccgggaggagaaggtgacagccggatggccaagcgagcccggacagggagatctgaatcccgaatcacctgcggcacttggccaggacctgctggagcctcgatcaaaacgacctgcacatccgattctagccaccgcagacggtgcatcacagctggtcggaatggagta

SEQ ID NO: 238032 - DNA, 15 bp, Artificial Sequence
  Description of Artificial Sequence: Synthetic coding sequence
atgactagctcctag

SEQ ID NO: 238033 - DNA, 495 bp, Artificial Sequence
  Description of Artificial Sequence: Synthetic coding sequence
atgacatccagcagtccggctggtcttgagggctcggatctgtcatctatcaacactatgatgagcgccgttatgtctgtcggcaaggtcaccgaaaacggtggcagcccacagggaatcaaatctcctagcaagcccccagggccaaaccgtatcggcagaaggaaccaggagactaaggaggaaaagtccagctataattgcccactgtgtgaaaaaatatgcacaacacagcaccaactaacaatgcacattcggcagcacaacaccgataccggcggagcagatcactcgtgctcgatctgcggtaagagcctgtcatcagccagttccctggaccggcacatgctggtgcactcgggagagcgcccatataagtgtacggtttgtgggcagagcttcactactaatggcaacatgcatagacatatgaaaatccacgagaaagaccccaacagtgcaacggctactgctcctcctagcccactgaaatag

SEQ ID NO: 238034 - DNA, 2337 bp, Artificial Sequence
  Description of Artificial Sequence: Synthetic coding sequence
atgacgtcttctagtcctgccggtctggagggcagcgatttatcgtccattaacaccatgatgtctgcggttatgagcgtgggtaaggtcactgagaacggtggctccccccaggggattaaatcaccctccaagcctcccggtccaaatagaatcggcagacgaaaccaggagacaaaagaagagaaatcctcttacaattgcccactatgcgaaaaaatatgtaccactcagcaccaactgaccatgcacattaggcagcacaacaccgacactggtggcgctgatcactcctgcagcatatgtgggaagtctctttcgagcgcttcctccctggaccggcacatgttggtacattcaggggaacgtccgtataagtgtactgtatgcgggcaaagcttcaccactaacggcaacatgcaccgccacatgaaaattcacgagaaagatccgaatagcgcgacagctactgctccacccagccccctgaagcggagacggctttctagtaaacgaaagttgtctcacgatgctgagtctgaaagagaagatcccgctcctgccaagaaaatggtcgaggatgggcaaagcggcgacttggagaagaaagcagatgaggtctttcattgtcccgtttgctttaaagaatttgtgtgtaagtacggtctggagacgcatatggagactcacagtgacaatcccctgcgatgtgacatttgttgcgtgacgtttaggacccatcgcggtcttctcagacacaatgccttggtgcacaaacagctaccccgagatgccatggggaggccctttatacagaacaacccatcgatcccagccggatttcacgatctgggctttacagattttagctgcagaaagttccccagaatatcgcaggcctggtgcgaaaccaatctacgcagatgtatttctgaacagcaccgattcgtgtgtgatacatgcgacaaagcttttcctatgctatgcagcctggcactgcacaagcaaactcacgttgctgcagaccaggggcaggagaagccgcaggctacacccttgccaggagatgccctagaccagaaaggatttctggctctgttgggtctgcagcataccaaagacgtccgccctgctccggcagaggaacccttaccagatgataatcaagccattcagttgcaaaccctgaagtgccagcttcctcaggatcccggatgcacgaatttgctctctctgtctcccttcgaagctgcatctttagggggatccttaactgtccttccagctactaaagactccatcaagcacctctccctgcagcccttccagaagggtttcatcatccagccagatagctcaattgtggttaaaccaattagcggcgagtcagccattgagctcgcagatatccagcagatattaaaaatggctgcctccgcacctcctcagatcagccttcctccgttctccaaagcccctgccgctccactccaggccatattcaagcatatgccacctctgaagccaaagcctctggtaacgcctagaaccgtagttgccacctctacccctcctccgctaataaatgctcagcaggcttctcccggatgtatttcaccctcattaccccctcctcccctgaagcttttgaagggttcggttgaagcagcctccaatgcccacctgttacagtctaagagtggcacacagcctcacgcggcaacccgtttaagcttgcagcagcctagggcagagttgccgggacaaccagagatgaagacacagttagagcaggattccatcatcgaggctctacttccactgtctatggaggccaagatcaagcaggaaatcactgaaggcgaactgaaggcctttatgaccgcccctggcggaaagaaaacaccagcaatgcggaaggtcctctacccatgccggttctgcaaccaggtgtttgctttctcaggcgtattaagagcacatgtcaggtcacatctggggatcagcccttaccagtgcaatatttgtgattacatagcggctgacaaggcggctcttattaggcacttgcgcacccatagcggtgagcgcccttacatttgcaagatctgtcactacccatttacagtaaaagccaactgcgaacgacacttacggaaaaagcacctgaaggcaaccagaaaagacattgagaagaacattgagtatgtgagctcttcagctgctgaacttgttgatgcgttttgcgctccggataccgtttgccgactgtgcggagaggatttgaaacactaccgagctcttcgaatccacatgcgaacccactgtggaagatag

SEQ ID NO: 238035 - DNA, 411 bp, Artificial Sequence
  Description of Artificial Sequence: Synthetic coding sequence
atgacaagttccagccccgctggactggagggctctgacctctcatccatcaacactatgatgtccgccgtcatgagcgtgggaaaggtaacggaaaacggtggcagcccgcagggcattaaatctcctagcaaacccccagggcctaaccgcatcggtaggaggaatcaagagacgaaagaggaaaagagcagctataattgtcccctatgcgagaagatctgcacgactcagcatcagctgactatgcacatccgtcaacacaacacagacacaggaggtgctgatcacagctgcagtatctgtggtaagtctttaagttccgcctcgtccctggaccggcatatgctagtgcacagcggcgaacgaccctacaagtgtaccgtttgtggccagagctttacaacctag

SEQ ID NO: 238036 - DNA, 189 bp, Artificial Sequence
  Description of Artificial Sequence: Synthetic coding sequence
atgacgtccagcagtccagctggtctggaaggctccgacctctccagtattaacaccatgatgtctgccgtcatgtcagtgggcaaggtgactgaaaatggagggagcccccaaggcatcaagtcacctagtaagcctcctggacctaaccggatcgggaggagaaatcaggttagcgtccacacttag

SEQ ID NO: 238037 - DNA, 834 bp, Artificial Sequence
  Description of Artificial Sequence: Synthetic coding sequence
atgtccaagagcttgaagaaactggttgaagagagcagagaaaagaaccagcctgaggtggatatgagcgataggggcatttctaacatgctagacgttaatggactgttcactctgtctcatataacacagctcgtgctgtctcacaataagctgaccatggtgccacccaatatcgcggaacttaagaatctcgaagtattgaacttcttcaacaatcaaattgaagagctgccaacccaaatttcaagcctccagaagctgaagcacctcaatctggggatgaacagactgaatactcttccccgtgggtttgggtcattgccagccctcgaggttctggatctcacttataataaccttagcgagaacagcctgcccggaaattttttttacctgactacactacgggctctctatctgagtgacaatgatttcgagattctgcccccagacattggaaaattgacaaagttgcagattctgagcctcagggacaatgatttaatatccctgcccaaagaaattggtgagctaacgcagctcaaggaactgcatatccaggggaatagattgacagtactcccccctgaattaggaaacctggaccttaccggtcagaagcaggtatttaaagccgagaacaacccctgggtgaccccgattgcggaccagtttcaactaggtgtttcccacgtgttcgaatacatccggtcagagacctataagtatctttacgggagacatatgcaagccaacccggaaccacccaaaaagaacaacgacaagtctaagaagatatcaaggaaaccactggcagctaagaaccgctag

SEQ ID NO: 238038 - DNA, 675 bp, Artificial Sequence
  Description of Artificial Sequence: Synthetic coding sequence
atggtccccccaaatatcgcagagctcaaaaacctagaagtgcttaacttttttaacaatcagatcgaggagcttccaactcagatctcgtctctacagaaactgaaacacctgaatcttggaatgaaccggttgaatactctgcctcgcggattcggaagtcttcccgcactggaggtcctagacctgacctacaataacctttccgagaacagcctcccgggaaactttttctatcttaccactctgcgagctctctacttgtcagataatgacttcgaaattctgcctccagatatcggaaagctgacgaagctccagatcctgtctctgcgcgataatgacctgattagcctgccaaaggaaattggagaactgacacagctgaaggagctgcacatccagggcaacaggctcaccgtgctgcctcctgagcttggaaatctcgacctcaccggccagaagcaggtattcaaggcagagaacaacccttgggtgacgccgatagctgaccagttccaattgggggtgtcacacgtcttcgagtacattagatctgaaacatataagtacttgtacggacggcatatgcaagcgaatcccgagccacccaagaaaaataacgataagtccaaaaaaatttcccgaaagccattagctgcaaaaaaccggtag

SEQ ID NO: 238039 - DNA, 834 bp, Artificial Sequence
  Description of Artificial Sequence: Synthetic coding sequence
atgagtaaaagcctcaaaaagctcgttgaggaatcccgtgagaagaaccaaccagaggttgacatgtctgatagaggaatcagcaatatgctggatgtgaatgggctgttcacactcagccatatcacgcagctagtgctctctcataataaactgacaatggtcccgcctaacatcgcagagcttaagaatcttgaggtgctcaatttttttaacaaccagatagaggagctgcccacacaaatttcatcgcttcagaagctgaagcacctgaacctgggcatgaacaggctgaacaccctgcccaggggcttcggaagcctgcccgcacttgaagtactcgatctgacttataacaacctgagtgagaattctctgcctgggaacttcttttatctaaccacactgagagctctctatctctctgacaacgactttgaaatcttgccaccagacatcgggaaactcacaaaattgcaaatcttgtctctgcgggacaatgatctgatttccctccctaaggaaatcggcgagctgactcagcttaaagaactgcacatacaagggaatcggctgactgtcctccctcctgagctaggcaacctcgatctgactggtcagaagcaggtgttcaaggcagaaaataatccttgggttaccccaatcgcggatcagtttcaattaggcgtgtcacatgttttcgaatacatcagatccgaaacctataagtacctatacggtcgtcacatgcaagcaaatcccgaacccccaaagaagaataatgacaagtctaagaagatcagcaggaagcctctggccgctaaaaatcggtag

SEQ ID NO: 238040 - DNA, 945 bp, Artificial Sequence
  Description of Artificial Sequence: Synthetic coding sequence
atggctgctaccgcatcagccggtgcgggtgggatcgacggaaaaccgaggacatctccaaagagtgtgaaatttttattcgggggtttagctggcatgggggctaccgtgtttgtgcagcccctggaccttgtgaagaataggatgcagctgtccggtgaaggagccaaaactagagaatataaaacgagctttcatgccttaacaagcatacttaaggccgaggggctccgaggtatctataccggcctgtctgccggacttctgcggcaagccacatatactactacacgtctggggatctacactgtgctattcgaacgccttaccggtgcagatggcactccccctggatttctgttaaaggcagtgatcggcatgacagcaggtgccactggagcctttgtggggacccctgctgaagtcgctctaatccgcatgaccgccgacggccgactgcccgcagatcagagaagggggtataaaaatgtttttaatgccctaattaggatcaccagggaagagggcgttcttactctgtggcggggatgtatccccaccatggcgagagcggtggtcgtgaacgcggctcagctcgccagttactcccagtccaaacaatttctgctggactctggctacttttctgacaacatcctttgtcacttctgtgcttccatgattagcggtctggtcactacagccgcatctatgcccgtcgacattgctaaaactagaatccagaacatgcgcatgattgacggcaagcccgagtataagaatggtttggacgtgcttttcaaggtcgtgcgatacgaggggtttttctcactctggaagggcttcaccccctattatgcccgactcggccctcataccgtcctaacattcatcttcctggaacagatgaacaaggcctacaaacgcctctttctctctgggtag

SEQ ID NO: 238041 - DNA, 1530 bp, Artificial Sequence
  Description of Artificial Sequence: Synthetic coding sequence
atgtctatgggggcaccgagatcactgctactggccctagccgctggactggccgtagccaggcctcctaatattgttctgatcttcgccgacgacctgggttatggagacctgggttgttacgggcacccgagctccacaacccccaatttggatcagctggcagccggagggctccggtttaccgatttctatgtgcccgtgtctctctgcacaccgtcgagagccgctttactgaccggcagattgcccgtgcggatgggtatgtatccaggtgttttggtcccttcctctcggggaggactccctcttgaggaggtcaccgtagcagaagtgctcgccgctaggggttatcttacaggaatggccggaaaatggcacctgggagtcggcccagagggggctttcttgccaccacatcaaggtttccatcggttcctggggattccatactcccatgatcaaggtccctgccagaacctcacttgttttccacccgcaactccatgcgacggtggttgtgatcagggattggtgcctatccctctgctcgctaatttaagtgtcgaagctcagccaccttggttgcccggtctagaagcgagatacatggccttcgcccacgacctcatggccgatgctcaacggcaggatagaccgtttttcctttattatgcatctcatcacacgcactatcctcagtttagcggccagtcattcgctgagcggagcggaagaggcccttttggagacagtctaatggagctggatgctgcagtggggaccctgatgactgctatcggggacctaggactcttggaagagactctcgttatattcacagcggataacggacccgagacaatgcgcatgtcccgtgggggatgctccggtctcctaagatgcggaaagggtactacttatgagggtggcgtgagagaaccggcattggctttctggccaggacatatcgcccctggtgtaacgcatgaactggccagctccctggatctactgccaacattggccgctctcgcaggcgctcctctgcccaacgtcactttggatggatttgatttaagtcctctccttctgggcaccggaaaatcccctcgccagtcgctgtttttctacccttcttaccccgacgaagtccgtggcgtgtttgcagtgaggactggaaagtataaggcgcacttctttacgcagggcagcgcccactctgacaccactgccgatcctgcatgccacgccagcagtagtctgaccgcccatgagccccctctactctacgatttatctaaggaccctggagagaattataacctgctcggaggtgtggctggtgccactcctgaagtcctgcaagcgttgaagcagctccagcttctcaaggcccaactagacgcagccgtgactttcggcccttctcaggttgccagaggggaggaccctgctctacaaatctgctgtcaccctggatgtacaccacgcccagcctgctgccactgcccagacccccacgcctag

SEQ ID NO: 238042 - DNA, 600 bp, Artificial Sequence
  Description of Artificial Sequence: Synthetic coding sequence
atggcaaagtctgcggaggtcaagctggcaatcttcgggcgagctggggttggcaagagtgcgctggttgtccgcttcttaacaaagagatttatttgggaatacgaccccaccctcgaatccacatacaggcaccaggccacaattgatgacgaagtagtgtcaatggaaattctagacaccgctgggcaggaggacacgattcagagagagggccacatgcgctggggcgagggtttcgttttggtctatgatatcactgaccggggatcattcgaggaggtcctgccactcaagaacatcctggacgagatcaaaaagccaaaaaacgtcaccctgattctcgtgggcaataaggcagacttagatcacagtaggcaagtcagcacagaagaaggtgagaaactagcgactgaattggcctgtgctttctatgagtgttctgcctgtaccggtgaaggcaatatcacagagatcttttacgaactgtgccgcgaagtccggagacgcagaatggtgcagggcaaaaccaggagaaggtcctctaccacgcacgttaaacaggcgattaataagatgcttacaaaaatttctagttag

SEQ ID NO: 238043 - DNA, 120 bp, Artificial Sequence
  Description of Artificial Sequence: Synthetic coding sequence
atggccaaaagcgcagaagtgaaactcgccatcttcgggagagccggtgtgggcaaatccgcactagtcgtgaggtttctgactaaacggttcatctgggagtacgacccgactctgtag

SEQ ID NO: 238044 - DNA, 600 bp, Artificial Sequence
  Description of Artificial Sequence: Synthetic coding sequence
atggctaagagtgccgaggtgaagttggccatattcgggagagctggggtgggaaaatctgccctcgtagtccgatttttaacaaaacgctttatttgggaatacgaccccaccctggaaagcacgtataggcatcaggccacaattgacgatgaggtcgtgagcatggaaatactggataccgctggccaggaggataccattcagcgggaggggcacatgagatggggagaaggatttgtgttggtatacgatattaccgatcggggatcattcgaggaggtcctgccacttaaaaatattttggatgagattaagaagccaaaaaacgtcaccttgatcctagtagggaacaaagctgacttggatcatagtcgacaggtgtcaacggaggaaggggagaagctagcaaccgaactagcctgcgcattttacgagtgttcagcctgtactggcgaaggtaacatcacagagatattctacgagctgtgccgtgaagtgcggcgaagacgaatggtgcaaggaaagaccagacggcgtagctcaactacacatgtaaagcaggccatcaataaaatgctgaccaagattagctcctag

SEQ ID NO: 238045 - DNA, 600 bp, Artificial Sequence
  Description of Artificial Sequence: Synthetic coding sequence
atggccaagtccgccgaggttaagctggctattttcggtcgcgcaggcgtgggtaagtctgccctcgtcgtacgcttcctgaccaaaagattcatttgggagtacgatcctacccttgagtctacttaccgtcaccaggccacaatcgacgacgaggtagtgagcatggagatactggatactgcaggccaagaggacacaatccagcgggaggggcacatgcgctggggtgaagggttcgttctggtctacgacataaccgatagggggagtttcgaagaagtactgcctctcaaaaacatcctcgatgaaattaagaaacccaaaaatgtgaccctgatcttggtggggaataaagccgacctggaccactccagacaggtttccacggaggagggagagaagttagccacggagctggcctgcgcattctatgagtgtagcgcgtgtacgggcgagggaaatattactgaaatcttctatgagctatgccgggaggttaggcgacgcaggatggtccaaggcaagactcgcaggcgcagctcgacgacacacgtgaagcaagctatcaacaaaatgctgaccaagattagttcttag

SEQ ID NO: 238046 - DNA, 543 bp, Artificial Sequence
  Description of Artificial Sequence: Synthetic coding sequence
atggctaaatctgctgaagtgaagttggctatttttggtagggctggagtcggcaagtccgagtctacttatagacatcaagctaccatcgatgatgaagtagtctctatggagattctggacaccgccggacaagaggacaccatccaacgcgaaggtcatatgcgttggggggaaggcttcgtgctggtatatgacattaccgatcgcggtagcttcgaagaggtattgcctctgaaaaacattctcgacgagataaagaagccaaagaacgtgaccctcatcttagtgggcaacaaagcagacctagatcattcacggcaagtgagcacagaagagggtgagaagttggcaacagagctcgcttgtgctttctacgagtgttcagcttgcacaggagagggcaacatcactgaaattttctacgagctttgtcgagaagtgcggaggcgcagaatggtccagggcaagacgcggcgaaggtcctccacaacccacgttaagcaggcaatcaacaagatgttaaccaagatatctagctag

SEQ ID NO: 238047 - DNA, 612 bp, Artificial Sequence
  Description of Artificial Sequence: Synthetic coding sequence
atggtgagcacatacagggtggccgttctcggagcacggggtgtgggtaaatccgctatcgtgcggcaattcctgtataacgagttctcagaggtttgtgtccccacaactgctcgaaggctgtatcttcccgcagtggtgatgaatggtcatgtccacgacctccagatcctggacttccctcctatttcagctttccctgtgaacaccctgcaggagtgggcagacacctgctgcagggggcttcgctctgtgcacgcctacatcctggtctatgacatctgttgctttgattcctttgagtacgtgaaaacaatcagacagcagatcttggagacccgggttattggaacctcagaaacacctattatcattgtcggtaataagcgggatctgcagaggggtagagttataccaaggtggaacgtgagccaccttgtgcgcaagacctggaaatgtggatatgtcgagtgttccgcaaaatataactggcacatcctgctgctcttcagtgagctccttaaatctgtgggctgcgctcggtgcaagcacgtgcatgcagcactgaggtttcagggcgcacttcgtaggaaccgctgcgctatcatgtag

SEQ ID NO: 238048 - DNA, 729 bp, Artificial Sequence
  Description of Artificial Sequence: Synthetic coding sequence
atgaggccgctgagtatgtcggggcacttccttctagcacctattcccgaaagctctagtgactacttactgcccaaagatattaaactggctgtccttggcgctgggagggtggggaaaagtgcaatgattgtgagattcctgactaaaagattcattggagattacgagcccaatactggaaaattgtactcacggttagtgtacgtcgagggcgaccagctcagcctgcaaatacaagacacgcctggcggtgtgcagatacaggactctcttccacaggtggttgactccctgagcaagtgcgttcagtgggcagaaggctttcttttagtgtacagcataactgattatgactcatatctctcaataagaccactctatcagcacatccgcaaagtgcaccccgattcgaaggccccagttatcattgtggggaataagggggacctcctccacgccaggcaggtccagacacaagacggaatccagctcgcgaatgagctcgggtctctcttcctggagattagtacatccgaaaactacgaggacgtctgcgatgtgtttcaacacctctgcaaggaggtcagcaaaatgcacgggctgagtggggaacgccgaagagcatccatcattccacgaccgagatcccccaacatgcaggatctgaagcggagattcaagcaagccctgtctccaaaggtgaaggccccaagcgccctcggatag

SEQ ID NO: 238049 - DNA, 747 bp, Artificial Sequence
  Description of Artificial Sequence: Synthetic coding sequence
atgaggctcattcaaaacatgtgtacaatcgcggagtaccctgcgccaggaaacgccgctgcctcagactgctgcgtgggagcagccggacggagacttgtaaagatagccgttgtcggagccagcggggtgggcaagactgcgctggttgtgcggttcctgactaaaaggtttataggtgactacgagagaaatgcagggaacctatacactagacaagtacagatcgagggcgagacgctggcactgcaggtgcaggacacaccgggtattcaggtgcacgagaattctcttagctgcagcgagcagctcaacagatgcattcgttgggccgatgccgtcgtgatcgtttttagcatcaccgactacaagagttatgagctgataagtcagctgcaccaacatgttcagcagctgcaccttggaacacgccttcccgttgtggttgtggctaataaagctgatttgctgcacatcaaacaggtggaccctcagcttggcctccagctggcgagcatgttgggatgcagcttctatgaggtttcggtctcggaaaactacaatgacgtgtactctgctttccacgtgttgtgcaaggaagtgtcacataaacagcagccatcctccactcctgagaagaggcgcaccagcttgattcccaggcctaaaagcccaaatatgcaggacctaaaaagaaggttcaagcaggccttgagcgccaaggtgcgaaccgtaaccagcgtgtag

SEQ ID NO: 238050 - DNA, 927 bp, Artificial Sequence
  Description of Artificial Sequence: Synthetic coding sequence
atgacactgaacggcggtgggtctggtgctgggggtagccgcggtggcggacaggaacgggagcgcagaagagggtcgactccatggggccctgcgcctcctctgcatagacggagcatgcctgtcgacgagcgcgacctgcaggctgcattgacccccggagctctgaccgcggctgccgcagggactggtacccagggtccgagacttgattggccagaggactctgaggatagtttaagctccggcggaagcgacagcgatgagtccgtctataaagtcttgctgcttggcgcacccggtgtgggtaagtccgccttagctaggatctttggtggagttgaggacggccctgaggccgaagccgcagggcacacgtatgatcgctccatcgtagtcgatggtgaagaggccagtctaatggtgtatgacatatgggaacaggacggtggccgatggctaccaggtcactgtatggccatgggcgatgcgtacgtcattgtctattccgtcaccgataaaggtagttttgagaaggccagcgaactgagggtgcagctcaggagagcacgccaaacagatgacgtccctattatactggtgggtaacaagagcgatctcgtgcgttcaagagaagtgagcgttgatgaggggcgagcttgcgccgtcgtgtttgattgtaagttcatcgagacgagcgctgcccttcaccataacgtgcaagcattgttcgagggagtggtcaggcaaattcgtcttaggagggacagcaaggaggctaatgcgaggcgtcaagctggaacacgccgacgtgaatcactcggaaaaaaggccaagcggtttctgggcaggattgtagcacggaactcgcggaagatggcgtttcgtgctaagtccaagtcgtgtcatgatctcagtgtgctgtag

SEQ ID NO: 238051 - DNA, 927 bp, Artificial Sequence
  Description of Artificial Sequence: Synthetic coding sequence
atgaccctcaatggtggcggatccggcgcaggaggcagcaggggagggggtcaggaaagggagcgcagaagagggtccaccccgtggggcccagctccccctctgcacagacggagtatgcccgttgacgaacgcgatctgcaggcagccctgacacccggagcgctgacggctgctgccgctggaacaggtacacagggcccaagattggactggcctgaggactccgaagattccttgtcgtctgggggaagcgacagcgatgagtccgtgtataaagtcttacttcttggggctcctggcgtggggaagtctgctttagccaggatatttggtggggttgaggatggcccagaagccgaagctgccggtcacacctacgaccgctccatagttgtggacggcgaagaagcctccttaatggtttacgatatctgggagcaggacggcggtaggtggctgcctggacactgtatggcaatgggggatgcctacgttatcgtctacagcgttactgataagggtagttttgaaaaagcttccgagttacgcgtccagctgaggcgtgcacgccagaccgatgacgtccccataatcctggtagggaataagagtgacctggtgcggtcccgtgaagtgtcagtggacgagggaagagcctgcgcagtcgtttttgactgcaagtttatagagacctctgcagcactccaccataatgtccaggctctgttcgagggcgtcgtcagacagattcgtctaagacgcgattcaaaagaggctaatgccagacgtcaggctgggactagaagaagggaatctctcggcaaaaaggcgaaaagattcctcggcaggatagtcgcccgtaattcccgcaagatggccttcagagctaaatctaagtcttgtcatgacctttctgtgctatag

SEQ ID NO: 238052 - DNA, 579 bp, Artificial Sequence
  Description of Artificial Sequence: Synthetic coding sequence
atgcaagccattaagtgtgtcgttgtgggcgacggcgcagtcgggaaaacgtgtctgcttatttcttacaccactaacgcattcccaggggagtatattccgactgtatttgacaactatagcgctaatgtgatggtcgacggcaagcccgtgaatctggggctttgggacaccgctggacaagaggactacgatagactacggccactatcctatccacagacggatgtctttctgatctgcttcagtctcgtgagtccggcttcattcgagaatgttagggccaagtggtacccagaagttcgccaccactgtccacatacacctattttgctggttggcacaaaactggatctccgggacgacaaagacaccattgagcgcctgcgggataaaaaactggccccaataacataccctcaaggactagccatggccagggaaattggatccgttaagtacttggaatgtagtgccttgacgcagcgaggcctgaagaccgtgtttgatgaggccatcagggccgttctttgcccaccacccgtgaaaaagcctggaaaaaagtgcactgtcttctag

SEQ ID NO: 238053 - DNA, 942 bp, Artificial Sequence
  Description of Artificial Sequence: Synthetic coding sequence
atgcctaacactgctatgaaaaagaaggtgcttctcatggggaagagcggctctggaaagacttccatgagatctatcattttcgccaactacatcgcaagggacacccgacggttaggcgctacaattgacgtcgaacatagtcatgtcaggttcctaggaaacctggtcttaaatctatgggactgtggcggtcaggacacctttatggagaactacttcaccagccagagggataatatctttcggaatgtggaggtgctaatttacgtctttgacgtcgaatcacgcgagctcgagaaggacatgcactactaccaatcctgtctagaagcgatattacagaactctccggatgctaagatattctgtctcgtgcacaagatggatttggtgcaggaggatcagcgcgaccttatcttcaaggagcgggaggaggatctgagaagacttagtcgcccactggagtgcgcctgctttcggacctcgatctgggatgaaacgctttacaaggcctggagcagcatcgtgtaccagttgattcccaatgttcagcagctcgagatgaacctgcgcaacttcgctcagatcatagaggccgacgaagtgttactttttgagcgcgctacattccttgttatcagccactatcaatgcaaggagcagcgtgacgtccaccggttcgagaagatctcgaatataattaagcaatttaagctctcttgtagtaaactggccgcatcatttcagtccatggaggtgcggaacagcaattttgccgcatttatcgatatttttacttcaaatacttatgtaatggttgttatgagcgacccctctatacccagcgctgctacactaattaacattcgtaatgcaaggaaacactttgagaagttggaacgagtggacggccctaagcatagccttttgatgcggtag

SEQ ID NO: 238054 - DNA, 1125 bp, Artificial Sequence
  Description of Artificial Sequence: Synthetic coding sequence
atggaggaatcagacagcgagaagacgaccgagaaggagaatctgggccctcggatggaccctcctttaggggaaccagagggctcccttggctgggttttaccgaacaccgccatgaaaaaaaaggttttgctgatgggcaaatccggcagcgggaagactagcatgcgcagcataatcttcgctaactacatcgctcgggatacgcgacgtctgggagctacaatcctggaccgtatacactccttgcaaattaattcctcactgagcacttactcactggtggattccgtgggaaatactaagacattcgatgtcgagcattcccatgtgcggttcctcgggaatctcgtgctgaatctgtgggactgtggtggacaggacaccttcatggaaaactactttacctcccagagagataatatctttcggaacgtcgaggtgctgatctacgttttcgacgtcgaatcacgtgaactggaaaaagacatgcattattatcagtcgtgcctggaggcgatccttcagaacagtccagatgctaagatcttctgtctggtgcacaaaatggatctagtccaggaggatcagcgtgatctgatctttaaagagcgggaagaggacctgcgcagattatccagacccctggaatgttcttgtttccgcacttcaatttgggacgaaaccctctacaaagcctggagttctatagtgtatcagctgatacctaatgtacagcagctggagatgaaccttcggaatttcgccgaaattatcgaggctgatgaggtgctcctattcgaacgggcaacctttctggtcatttcacattaccaatgcaaagagcagagggacgctcacagatttgagaagatcagcaatattattaagcagttcaagctttcatgcagtaagctggccgctagtttccagagcatggaggtcaggaacagcaacttcgccgcattcattgacatatttacttccaacacatacgtgatggtggtgatgagtgacccctctattccctcggcagccacgctgataaacattcggaacgcacgcaaacactttgagaagctcgaaagagtcgacggcccaaagcagtgcttgctaatgcgttag

SEQ ID NO: 238055 - DNA, 1041 bp, Artificial Sequence
  Description of Artificial Sequence: Synthetic coding sequence
atggaagaatccgattctgagaagactactgagaaggagaacttgggccctcggatggatcccccactcggagaacctgaagggtctctggggtgggtactccccaatactgctatgaagaagaaggtcttactgatggggaaaagcgggagcgggaagactagtatgagaagtattatattcgctaactatatcgcccgagacaccagaagactgggagctacaatcgatgtcgagcactcccacgtccgatttcttggcaatttggtgctgaacctctgggactgcggagggcaggacacattcatggaaaattatttcacctcacagcgcgataacatcttcagaaacgtggaggttctgatctatgtgtttgacgtggaatcacgggagctcgagaaggacatgcattactatcaatcttgcttggaagccattttacagaattctcctgatgccaagattttttgtcttgtccacaaaatggacctggttcaggaagaccagcgggacctgatcttcaaagagcgcgaggaagacctgcgcagactgtcccggccactggagtgttcttgttttcgtacttccatttgggacgaaacactctacaaggcctggagttcgattgtttaccagctgatccctaacgtccagcagctcgaaatgaatttgcgcaactttgcagagatcattgaggccgacgaggtgcttctgtttgagagggccactttcttggtcatttcccattatcagtgcaaggagcaaagagacgctcatcgatttgagaagatcagtaatatcatcaagcagttcaagctctcttgctcaaagctagcggcaagcttccagtcaatggaggtccggaattcaaactttgcagcgtttatagatatctttacgagcaacacatatgttatggttgttatgtcagacccttcaatccccagcgctgcaaccctaatcaatatcagaaacgccagaaagcatttcgagaaacttgaacgggttgatggacctaagcagtgcctcctaatgagatag

SEQ ID NO: 238056 - DNA, 585 bp, Artificial Sequence
  Description of Artificial Sequence: Synthetic coding sequence
atgaagaaaaaggttctgctgatggggaagtctggttctggcaagaccagcatgagaagcattatcttcgctaactacatagccagagatacaaggcgtctgggtgctaccattgacgtggaacacagccatgtccggttcctcggaaacctggtcctcaacctgtgggattgcgggggacaggatacttttatggaaaactatttcacgagtcagcgagataacatctttaggaacgttgaggtcttgatctacgtgtttgatgtggaaagcagggaactggaaaaggacatgcactactatcagtcttgcttggaagctattcttcagaatagccccgacgccaaaattttctgcctggtgcacaagatggacttagtgcaggaggaccaacgagacttgatcttcaaagagcgagaggaagacctgagaaggctctccagaccgttggaatgctcatgcttcagaacatctatctgggacgaaacgctgtacaaggcgtggagcagcattgtctaccaattaattccaaacgttcaacagctggagatgaacttgcgaaacttcgcagagatcattgagtag

SEQ ID NO: 238057 - DNA, 1200 bp, Artificial Sequence
  Description of Artificial Sequence: Synthetic coding sequence
atgtccctccagtatggggcagaggagacacccctcgccggatcctacggagctgcagacagtttccctaaagactttggctacggcgtcgaagaagaagaggaagaggccgctgccgctggaggcggagttggcgcaggtgccggaggcggttgcggcccaggcggagccgactcctccaaacccaggatcctccttatggggctgcgcaggagcggaaagtcctcaatacaaaaagttgtgttccataagatgtcccctaacgaaaccctctttctggagtccacaaacaaaatttacaaggatgacatttccaactcctcctttgtcaacttccagatctgggactttccagggcagatggacttctttgacccaacttttgattacgagatgatctttcgcggaacaggcgcactaatctacgttattgatgcgcaggatgattacatggaagctttgactagactgcatatcacggtgtccaaagcctataaggtcaatccggatatgaactttgaggtgttcattcataaagtggacggtctgtccgatgaccataaaatcgagacgcagagagatatccatcaacgcgctaacgacgacctggcagatgccggtctggagaagttgcacctgagtttttatcttacaagcatctatgaccacagcattttcgaggcattctccaaggtagtgcagaagctgattccacagctcccaactttagagaacctgctgaacatttttattagcaattccggaatcgagaaagccttcctctttgatgtggttagcaagatctacatcgccaccgactctagccccgtggacatgcagtcttacgaactgtgctgcgatatgatcgatgtcgtgatcgacgtctcctgcatctacggccttaaagaggacgggagcgggtctgcctacgataaagaaagtatggcaattatcaagctcaataatacgacagttctttaccttaaggaagtcaccaagttccttgcattagtgtgtatcctgagagaagaaagcttcgaacggaagggtttgattgattataactttcattgtttccggaaggccattcacgaggtgttcgaggtgggcgttaccagtcaccgctcttgtggtcaccagacttcagcctccagcttgaaagctctcacgcataacggtactcccaggaacgcgatttag

SEQ ID NO: 238058 - DNA, 750 bp, Artificial Sequence
  Description of Artificial Sequence: Synthetic coding sequence
atggaagccttggcccgactgcacctgaccgtaacaagggcttataaggtcaatacagacattaacttcgaggtgtttattcataaagtggacggactatccgacgaccataagattgagacacagcgagatatacatcaacgcgcaaacgacgacctcgcagatgccggactggaaaagatccacttgtcattttacttgacctccatctacgaccatagcatattcgaagctttctctaaggtggtgcagaagttgatccctcagctgcctaccttagagaacctacttaatatttttatcagtaatagtggcatcgagaaagcttttttgttcgatgtagtcagcaagatatatatcgcgacagactcaacacctgtggacatgcagacatacgagctgtgttgcgacatgattgatgtggtgattgatatatcttgcatctacgggctaaaggaggacggcgctgggacaccatatgacaaagagtccaccgcaatcattaaactgaacaatacgaccgtcttgtacctgaaagaagtgaccaaatttctcgcactggtctgtttcgtgagggaagagtccttcgagcgcaagggactgatcgactacaattttcactgctttcgtaaggctattcacgaggtctttgaggtgcggatgaaagtggtgaaaagtcggaaagtgcagaaccgactccaaaaaaaaaagagagctacgccaaatggaacgccccgtgtgctcctttag

SEQ ID NO: 238059 - DNA, 1203 bp, Artificial Sequence
  Description of Artificial Sequence: Synthetic coding sequence
atgtcccaggtactgggcaaaccgcagccccaggatgaggacgatgccgaagaggaggaagaggaggatgagctggtggggctcgccgactacggcgatggccctgactcttccgacgctgaccctgactcagggaccgaggagggggtactggatttttccgaccccttttccaccgaagttaaaccgaggatcttgctgatgggcctcagacggtcagggaagtcctccatacagaaagtggtgttccacaagatgtccccgaatgagaccctgtttctagaatccactaataagatttgtcgggaagacgtgagtaattcctcatttgtaaattttcagatttgggactttccgggacaaattgacttcttcgatcctactttcgactacgaaatgatttttagggggactggggctcttatttttgtgatcgacagtcaggatgactacatggaagccctggcccgtctacatttgaccgttacccgggcatataaggtgaataccgacatcaacttcgaagtattcatccacaaagtggacggcctttctgatgatcataaaatcgaaactcagcgtgacatccaccagagagctaatgatgacttagccgatgctggcctggaaaaaatccacctgagcttttatctgactagcatttacgatcacagcatttttgaggccttttctaaggtggtccagaagctcatacctcagttacccaccctagagaacctcctcaatatctttatctccaactctggcatcgaaaaggcatttctgtttgacgtggtgtcaaaaatatatatcgccaccgattcgacccctgtggatatgcaaacttatgagttgtgttgtgatatgatagatgtggtcattgacatcagctgtatatacggactgaaggaggatggagccggtactccttacgacaaggaaagcactgccatcataaagctcaataacactacagttctttacctcaaggaggtgaccaagtttctggccctggtgtgcttcgtgagagaagagtccttcgaacggaagggtttgatcgactacaacttccactgtttccgaaaagccattcacgaagtcttcgaagtgcgcatgaaggtcgttaagtcacgaaaggtgcagaatagactgcagaaaaagaagagagctaccccaaatggaacacctcgtgtgctcctgtag

SEQ ID NO: 238060 - DNA, 348 bp, Artificial Sequence
  Description of Artificial Sequence: Synthetic coding sequence
atgttgagggacaccatgaagagttggaacgacagccagtccgacctatgtagtactgaccaagaagaggaggaagagatgattttcggcgagaatgaggatgatctggatgagatgatggatctgagtgatctgccaacaagtctgtttgcctgcagcgtccacgaggcagtgtttgaggcaagagagcagaaggaacggaacatgaactttaccagagagcagtcgaggcaccctgcctggtggtttatgtcagtgaaagtgaagctgaagcggaagaagcgccaaaaaaccccaaataggaagctgcctcgtaggggcgctcccaccctgcgccctcagaggtag

SEQ ID NO: 238061 - DNA, 726 bp, Artificial Sequence
  Description of Artificial Sequence: Synthetic coding sequence
atgctgcgggacaccatgaagtcctggaatgattcgcagtccgatctctgcagcacagaccaggaggaagaggaggagatgatttttggggaaaacgaagacgacctagacgagatgatggacctgtccgatctgccaaccagcctttttgcttgcagtgtgcacgaggcggtgttcgaggcaagggaacagaaggaaagatttgaggccctcttcaccatttatgatgatcaggtgacctttcaattgttcaagagcttccgacgggtccggataaatttctcaaaacctgaagccgcagcacgggcaagaatagaattgcacgagacagatttcaacggccagaaactcaaactgtattttgcccaggttcagatgtctggggaggtgagggacaaaagctatcttctacccccacagccagtgaagcaattcctaattagccccccagctagcccgcctgtggggtggaagcagtccgaagacgccatgccggtgattaactacgatctcctatgtgccgtgtcaaagctcggtccaggtgagaaatacgagttgcatgcgggaaccgagtcaacaccctccgttgtggtgcacgtatgcgaaagcgagacagaggaagaggaggaaactaaaaaccccaaacaaaagatcgctcagaccaggcggccagatcccccaactgcagccttgaacgaaccacagacctttgattgcgccctttag

SEQ ID NO: 238062 - DNA, 522 bp, Artificial Sequence
  Description of Artificial Sequence: Synthetic coding sequence
atgctgagggacaccatgaagagctggaatgacagccagagtgatctttgtagcactgaccaggaggaagaggaggagatgatctttggcgagaacgaggacgatctggacgagatgatggacttgagtgacctgcccaccagcctttttgcatgctcggtgcatgaggccgtctttgaagcccgagagcaaaaggagcgttttgaggccctgtttaccatttatgacgaccaggtgacattccaattgtttaagtcgttcaggcgagtgcggattaatttctccaaacccgaggcagctgccagagccaggattgaactgcacgaaacagacttcaatgggcagaagcttaagctctactttgcgcaagaacgaaacatgaattttaccagagaacaaagcaggcacccagcatggtggttcatgtctgtgaaagtgaagctgaaaaggaaaaaacggcaaaaaactcccaaccgcaagctgccacggcgaggggcaccgaccctaaggccccaaagatag

SEQ ID NO: 238063 - DNA, 198 bp, Artificial Sequence
  Description of Artificial Sequence: Synthetic coding sequence
atgctgcgcgatactatgaaaagctggaacgatagccagagtgacctgtgctccaccgaccaagaagaggaagaggagatgatttttggtgaaaatgaggacgatcttgatgaaatgatggacctgtctgatttaccaaccagcctcttcgcatgcagtgtgcatgaggctgtattcgaggcgcgagagcagaagtag

SEQ ID NO: 238064 - DNA, 696 bp, Artificial Sequence
  Description of Artificial Sequence: Synthetic coding sequence
atgctgagggataccatgaaaagctggaacgattcccaaagcgatctctgcagcaccgaccaggaggaggaagaggagatgatctttggtgaaaacgaggacgatctggacgaaatgatggatctttcagacctgccaacctccctcttcgcctgttctgttcacgaagccgtctttgaggctcgggagcagaaagaacgcttcgaggcattatttactatatatgacgaccaggtaacattccagctattcaagtcctttagaagagtgcggatcaacttctcaaaaccagaggccgctgcgcgtgcaaggatcgaattgcacgagaccgattttaacggccaaaagctcaagttgtactttgcccagtcatacctgttaccgcctcaaccagtcaaacagttcctgatcagtccacctgctagcccgcctgtgggttggaagcagtctgaagatgctatgcctgtgatcaattacgacctactctgcgccgtctcaaagctgggacccggtgagaagtatgagctgcacgctggcacagagtccacccccagcgtcgtcgtgcacgtttgcgagagtgaaacagaggaagaagaggagacgaagaaccctaaacagaagatagcccagactagacgccctgatcctcccactgccgcactcaatgaaccccagaccttcgactgcgctctgtag

SEQ ID NO: 238065 - DNA, 552 bp, Artificial Sequence
  Description of Artificial Sequence: Synthetic coding sequence
atgctgcgagataccatgaagtcctggaacgattcccaaagtgacctatgtagcacagaccaggaggaggaggaagaaatgatcttcggcgagaatgaggatgacctggatgaaatgatggacttgtctgatctgcctacatccttgtttgcatgctccgtacatgaggccgttttcgaggcacgtgagcagaaggtgcagatgagcggcgaggtgcgggataagagctacttgctgccgcctcaacctgttaaacagtttttgatatcgcctcctgcttctccaccagtggggtggaagcagtctgaggacgcaatgccagtaattaattacgaccttctctgcgcagtgtccaaactcggtccaggagaaaaatacgagctgcacgcaggtaccgaaagtactccatccgtggtcgtgcatgtgtgcgaaagtgaaacagaggaagaagaggagaccaagaacccgaaacaaaagatcgcccaaacaaggagaccagatcctcctaccgccgcactcaatgaaccccagaccttcgattgcgcgctatag

SEQ ID NO: 238066 - DNA, 900 bp, Artificial Sequence
  Description of Artificial Sequence: Synthetic coding sequence
atgcactcgcttgccacagccgctccggtgcctactactctggcccaggtggaccgggaaaagatctaccagtggatcaacgagctctcctcccctgaaacacgcgaaaacgccctgctcgaattatccaagaagcgagaatctgtgcctgacttggcacccatgctgtggcacagcttcgggacgatcgccgcactactgcaggagattgtgaatatttacccttcaatcaatccacctaccctgaccgcacaccagagcaatagagtgtgtaatgctcttgcactgctgcagtgtgtggctagtcacccggagacccgtagcgctttcctggccgctcatatccctttgttcctgtaccctttcttgcacaccgtgtcaaagacccgaccattcgagtacctgcggcttacctctctcggcgtgattggagccctggttaagacagatgaacaggaggtcattaattttttactcacgaccgagatcatccctctttgcctaaggattatggagtcggggagtgagctgtcaaaaacggtggctacctttattttacagaaaatcctgctggatgatacgggactggcctacatatgtcagacatatgaacggttcagccatgtcgccatgatactcggcaaaatggtccttcaactgtctaaggaaccatctgcaagattactgaaacatgtggttaggtgttacttgagactgagcgacaacccacgagccagagaagcgctgcgccagtgtctccccgaccagctcaaggataccaccttcgcacaggtgctcaaagacgacactaccaccaagcgctggttggcgcagctggtgaaaaacttgcaagaagggcaagtaacggatcctcggggtattcctctccctcctcagtag

SEQ ID NO: 238067 - DNA, 996 bp, Artificial Sequence
  Description of Artificial Sequence: Synthetic coding sequence
atgcattccctcgctacagccgctcccgtgccaacgactctggctcaggtggatcgcgagaaaatctatcagtggatcaatgagctttcgtccccagagacaagagagaatgcgctcctcgagctgtccaagaagagggagagtgtgccagacttagctccaatgttgtggcacagttttggcacaattgctgctctgcttcaggaaatcgttaacatctacccttcaattaacccaccaacgttgacagcccaccaatctaatcgggtgtgcaacgccctcgcgcttttgcaatgtgtggcatctcacccagaaacccgcagcgcctttctcgccgctcacatacccctctttctttacccattcctgcacaccgtgtctaaaactcgaccctttgagtatcttaggctcacatcgctgggggtgatcgtagagactggattccatcatgtgggacaggctgatctggagcttcccacctcttccgacctgccagcttctgcctcacagtcggcgggaatcaccggtgccttggtaaagactgacgagcaggaggtgattaatttcttgttaaccaccgagattattccgctgtgccttaggatcatggaaagcggcagcgagcttagcaaaactgtggccacttttattctgcagaagattctgttggacgatacgggcctggcatatatctgtcagacatatgaaagattctcacacgtagccatgatattaggcaagatggttctgcagctgtctaaggagccctccgccaggcttctaaagcacgtggttcggtgctatttacggctatctgataatcccagggcacgagaagcactcagacaatgtctccctgatcagctaaaggataccacgttcgcacaggttttaaaggacgatacaacaaccaagcggtggttggcgcagcttgtgaagaatctgcaggagggtcaggtcaccgaccctcgtgggattcccctaccgccacaatag

SEQ ID NO: 238068 - DNA, 900 bp, Artificial Sequence
  Description of Artificial Sequence: Synthetic coding sequence
atgcactccctggccaccgcagctccagtacctacaacactggcccaagtggatcgagaaaaaatctatcagtggattaacgagctgagttcccccgagaccagagaaaacgctttgctcgagctctcgaaaaaacgcgagtccgtccccgatctcgctccaatgttgtggcactcatttggcaccattgcggcactgctccaagagattgtcaacatctacccctctattaacccgcctacactgactgctcatcagtctaaccgggtgtgcaacgcccttgccctgctccagtgcgtcgctagtcacccagaaacgcggtctgcgttccttgccgctcacatcccccttttcctgtacccttttttgcacaccgtgagcaaaacccggccttttgaatacctgaggctcaccagcttgggggtgatcggggctttggtgaaaactgatgagcaggaggtcatcaacttcctgctcaccaccgagataatccctctctgtctgcggattatggaatccgggtcggaactctctaaaactgtcgcgacctttatcttacagaaaattcttctggatgataccggccttgcttacatatgtcagacatacgaacgtttctctcatgtggccatgattctcggcaagatggtgctacagctgagcaaagagccgtctgccaggctactgaagcatgtcgttcgatgttatttgcggcttagcgataaccctagagcaagggaggccttgcgccagtgtcttcctgatcagttgaaagataccactttcgcccaggtgctcaaggacgatacaaccactaaacgatggcttgctcaactcgtgaaaaacctccaggaaggccaggtcacagatcctagggggataccattacccccacagtag

SEQ ID NO: 238069 - DNA, 777 bp, Artificial Sequence
  Description of Artificial Sequence: Synthetic coding sequence
atgcactccttagctaccgcagccccagtgccgaccacgctggctcaggtcgacagagaaaagatataccagtggatcaatgaactttcctcacccgagaccagggaaaacgcactgcttgagctctcgaaaaagcgggagtccgtccccgatctcgccccaatgctgtggcatagttttggaacaatagcagcactccttcaggaaatagtgaacatctacccaagtatcaaccccccaacactaacagcacatcaatctaatcgagtgtgtaatgccttggcgttgctgcagtgtgtggcaagccatccagaaacacgctctgccttcctggctgcccacatcccactctttctttacccatttctgcacaccgtctccaagacaaggcccttcgagtatttacggctgacaagcctaggagtgataggtgccctggtgaaaacagacgaacaggaggttataaactttcttctgactacagagatcattcctttgtgtttgcgcataatggagtcaggaagtgaactctctaagacggtggctaccttcatcctgcagaaaatcctgctcgatgacactggactggcttatatttgccagacttacgagcgtttttcccatgtggccatgatccttgggaaaatggtactgcagttgagcaaggagcctagcgctagactgctgaaacatgtggtgagatgctatcttcgactgtccgataatcccagattcagcgatcttacgttctgttggtctagtttccagcggaaatag

SEQ ID NO: 238070 - DNA, 990 bp, Artificial Sequence
  Description of Artificial Sequence: Synthetic coding sequence
atggctgctcttggtggggacggtctgaggttgctgtcagtgtcccgacccgaacgaccgccagaatcggccgctcttggagggctggggccaggcctctgttgctgggtctctgtcttctcatgcctctcactggcctgttcgtacgtcggcagtctttacgtttggaaatctgagctgccacgagaccacccagccgtaattaaacggaggtttacttcggtcctagtggtgtccagccttagtcccctttgcgtcttgttgtggcgcgagctcacgggcatccagcctggcacgagtctgcttactttgatgggattccgactggaaggcatcttcccagcagcgttgctacccttgctgctgaccatgattctgttcctggggcctttgatgcagctgagcatggactgtccgtgcgatctggcggacggcctgaaagtggtccttgctccccgaagctgggctcgttgcctgacggatatgcgatggcttaggaatcaagtcatcgcgcctctcactgaagagttggtcttcagagcctgcatgctcccaatgctcgccccatgtatgggtttgggaccggctgtcttcacatgtccactgtttttcggagtggcacacttccaccacataatcgagcagctcagattccgtcaatcttccgtgggcaacatttttctgagcgctgccttccaattttcgtacacggccgtatttggggcatacacagcgtttctctttatccgcacaggccaccttatcgggccagttctgtgccacagtttttgtaattacatgggcttccctgcagtttgtgcagctctggaacatccccagcggaggcccttgctggcagggtatgcactgggcgtgggactgtttctgctgctgctgcagccacttactgatccgaaactttacgggtccctgcctctgtgcgtgctcctggaacgagctggcgattccgaagccccactgtgtagctag

SEQ ID NO: 238071 - DNA, 927 bp, Artificial Sequence
  Description of Artificial Sequence: Synthetic coding sequence
atggccgcacttggcggagacgggttgagactgctgtccgtgagtcgccctgaacgccctcctgagagcgccgcactcggcggtcttgggcctggcttgtgctgttgggtttctgtgtttagctgtctctcccttgcctgcagctacgtcggatccctttacgtctggaagtccgaactgccccgtgatcatcctgccgttattaaacgccgatttacaagcgtactcgtagtgagctctttgtcgccgctatgtgtcctcctttggagagagctgacagggatccagcccggtacttccctgctgacccttatggggtttcgccttgaagggatctttccagccgcattgctcccgctgttacttaccatgattctctttctgggacctcttatgcaactgtccatggattgtccgtgcgacctggcagacggattaaaagtggtgctggcgcctcgctcctgggccagatgcctaactgacatgagatggctcaggaaccaagtcattgccccattgacagaggagttggtgttcagagcgtgcatgttacccatgttggctccgtgtatgggactcggcccagcagtgtttacctgccccctgtttttcggagtcgctcactttcatcacatcattgagcagctccggtttcgtcagagttctgtcggcaatatctttctatcagcaggacacctgatcggtcccgtcctgtgccatagcttctgcaactacatgggctttccagccgtttgcgctgccctcgagcacccccagcggagacccttactggctggatacgccctcggcgttggcttatttctgcttctgcttcagcctcttaccgatccaaagctgtacgggtcactacccctgtgtgttctactggaacgggcaggagactccgaggcccctctctgtagttag

SEQ ID NO: 238072 - DNA, 1164 bp, Artificial Sequence
  Description of Artificial Sequence: Synthetic coding sequence
atggtacctaagggggcaactatgctggtgatcccccctggactctctgaggaggaagaggctctccagaaaaagttcaataagctgaaaaaaaagaagaaggctctgcttgctctcaaaaagcagtctagttccagcacgacatctcaaggtggtgtgaagaggtctctgtcggaacagcccgtgatggatactgccaccgctactgaacaggcaaagcagctggtcaagagcggagctatttccgcgatcaaagccgagacaaagaacagcggctttaaacgctctagaactttggagggaaaactgaaagaccccgagaagggaccagtgcccaccttccagcccttccagcgctccatttccgcagacgatgatcttcaggagagttctcgcagaccgcagagaaaaagcctatacgagtccttcgtatccagctctgatcgtctaagggagctggggccagatggtgaagaagcagaaggccctggggctggcgatggccctcctcgcagcttcgactggggctatgaggagcggtctggcgctcattcatctgcttcacctccacgcagtagatcccgcgatagatcccatgagcgaaatagagacagggatagggaccgggagcgggaccgggatcgcgacagggaccgcgatcgagagcgcgaccgcgatagggacagggatcgggaccgggaccgggagcgtgacagagaccgagaaagggacagagatcgggacagggaaggcccatttcgaagaagtgattctttcccagaaagacgggcaccaagaaaggggaacactctctacgtctacggggaggacatgactccaacgctgctccgaggggctttctcaccatttgggaacattattgatctaagtatggatccgccacgtaactgcgccttcgtcacgtacgaaaagatggagagtgctgatcaggctgtggctgagctgaatggcacgcaggttgagtccgtacagctgaaggtaaacatcgcccgtaaacagcccatgcttgatgctgccaccggaaagtctgtgtggggctctctagcagtgcagaacagtcccaagggttgtcaccgcgataaacggacccaaatcgtctattccgatgatgtatataaggagaatctggttgatggcttttag

SEQ ID NO: 238073 - DNA, 1143 bp, Artificial Sequence
  Description of Artificial Sequence: Synthetic coding sequence
atgttggtaatccccccaggtctctccgaagaagaagaagcgctacaaaagaagttcaataaacttaaaaagaagaagaaggctctcctcgcgctgaagaaacaaagcagcagctccactacgagccagggcggagtgaaaaggagcctttctgaacagcctgtgatggataccgcaacagccaccgagcaggctaagcagctcgtcaaatctggtgcaatttccgctatcaaagcggagacgaaaaattctgggtttaagaggtcgagaactctggagggaaagctaaaagacccggaaaagggcccagtgcctacctttcagccgttccagcggtctatcagcgctgatgatgacttacaggaatcgtcacggcgaccccagagaaagtcactttatgagtcctttgtgagcagctcagataggctccgggagctgggacccgatggtgaggaagccgaggggcctggagccggagacggccctcccagaagtttcgactgggggtacgaggaaagatccggggcacatagctccgcatctccccctagatctcgcagtcgagaccggtctcacgaacgcaacagggaccgcgatcgggacagggagagggacagagacagggatagggaccgagaccgagagcgcgatagggatcgagatcgggacagggatagagatcgcgaacgggatcgcgaccgagagagggatagggacagggatagggaagggccttttcgcaggtccgatagttttcccgaaagaagagcccctaggaagggcaacactctttacgtgtacggcgaggatatgacccctactcttctgcggggagctttcagcccatttgggaatattatcgatctgtcaatggatccaccccgtaactgtgctttcgttacgtatgagaagatggagtccgcggatcaggcagtggctgagctcaacgggacccaggtggaatccgttcagctgaaagtaaatattgctcgcaagcagccaatgctcgatgccgctaccggcaaatcagtgtggggttcccttgcggtgcagaattctcccaaaggatgccacagagacaagcgcactcagatcgtgtactctgacgatgtgtataaagaaaacctcgtggatgggttttag

SEQ ID NO: 238074 - DNA, 1143 bp, Artificial Sequence
  Description of Artificial Sequence: Synthetic coding sequence
atgctggtcatccccccaggcttaagtgaagaggaggaggccctgcagaagaaattcaataaactaaagaagaaaaaaaaagccctattggcactgaagaagcagagcagttcctccactacgtcacagggtggcgtcaagcgatccctcagcgagcagcccgtcatggacaccgcaaccgccacagagcaagccaaacagctggtgaagagtggtgctatatcagctataaaggcggaaacaaaaaattcaggctttaaaaggtcgagaacactcgagggcaaactgaaggaccccgagaaagggcctgtccctacctttcagcctttccagaggagtatctctgccgatgatgatttacaggagagctcccgtcggccacagcgaaagagcctgtatgaaagctttgtgagcagcagcgaccggctgagagagctgggccctgatggcgaggaagccgaaggccctggtgcgggagatggaccccctagatcattcgactggggttatgaggaacggagcggcgctcactcaagtgcctctccgccacggagcagatctcgcgaccgcagccacgagaggaacagagaccgggatagagacagagagagggatcgcgacagggaccgggaccgcgatcgggaaagggaccgggatcgcgatagggaccgcgatcgggatagggaacgcgatagagaccgcgaacgcgatagagacagagaccgtgaaggccctttcaggcggtcggactcttttcccgagagaagagcccctagaaaagggaacactctttacgtgtatggtgaggacatgacaccaactctgttacggggagcattctcccctttcggtaacatcatcgacttgtctatggaccccccaaggaactgtgcgtttgtcacctatgagaaaatggagtccgcagaccaagcagtcgctgagctcaatggcacgcaagtagagtccgtgcagttgaaggtgaacattgcacgcaagcagcctatgctggatgcagccacagggaagtcagtgtggggaagtttagctgtgcagaattcccctaagggctgccaccgggacaaaaggacccagattgtgtatagcgacgacgtgtacaaagagaacctggttgacgggttttag

SEQ ID NO: 238075 - DNA, 1143 bp, Artificial Sequence
  Description of Artificial Sequence: Synthetic coding sequence
atgttggtgatcccaccagggctctctgaggaggaagaagccttacagaaaaagtttaataaactgaaaaagaagaagaaagccctcctggcgctgaagaaacagagttcttcttctacaactagccagggcggagtaaaaagaagcctaagcgagcagcctgtgatggacacagcaaccgcaaccgagcaagctaaacagctcgttaaaagtggagctatttcagcaattaaggctgagaccaaaaattcaggctttaaacgcagtaggacactcgaaggaaagctcaaggaccccgaaaaggggccagttccgactttccagccctttcaaaggagtattagtgctgatgatgatcttcaggagtcctccaggcgccctcagcgcaagtccctatatgaatcgtttgttagctcttccgacaggctccgagagttgggcccagacggtgaagaagccgagggtcccggagccggagacggtccacctaggtcttttgactgggggtacgaggaaaggtctggtgcccacagctcagcaagtcctccgaggagtaggagccgcgatagatcgcacgagagaaacagagacagggacagagaccgggagcgggatagggacagggatcgggatagagacagagaaagggatagagacagagatagggaccgagaccgcgacagagaacgggatcgtgacagggagcgggaccgagatcgggacagggaaggaccatttcggagatctgattcgtttccagaacgcagagcacctcgcaaggggaacacactttatgtttatggtgaagatatgacaccaacactgttgagaggtgccttctcaccgttcggcaatatcatcgatttaagcatggacccaccacggaactgcgcgttcgtgacgtacgaaaaaatggaaagtgccgatcaggctgttgccgagctgaacggaacacaggtggagtcagtgcaacttaaagtaaacatcgctagaaaacagcccatgctagatgctgccaccgggaagtccgtgtgggggtcactggccgtgcagaatagcccgaaggggtgtcatcgtgacaaaagaacgcagattgtatactctgacgacgtctacaaggagaacctggtggacggcttctag

SEQ ID NO: 238076 - DNA, 885 bp, Artificial Sequence
  Description of Artificial Sequence: Synthetic coding sequence
atgttagttataccacccggacttagtgaggaagaggaggccctccagaagaagtttaacaagttgaagaaaaagaagaaggcacttctcgccctcaagaagcaatcaagctctagcactacgtcccagggtggagtgaagcggtccttaagtgagcagcccgtgatggacactgcaactgccactgagcaggccaagcagttggtcaaatcaggcgcaatctcggcaattaaggcagaaacaaagaattcggggtttaagcgatctagaacactcgagggaaaactgaaggaccctgaaaagggaccagttccaacttttcagccctttcagaggagcatttctgccgacgacgatctgcaggagtcatctcggcgtccacagcgcaaatctctttacgaatcgttcgtatcaagctcagatcgcctacgagagctgggacctgacggagaggaggctgaaggacctggcgcaggtgatggcccacctcggtccttcgactggggatacgaagagaggtccggcgctcatagttccgcttctccgccacggtctaggtcacgagacagaagccacgagcgaaacagagaccgggaccgagatagagagagggatcgagatcgtgacagggatagggaccgggaaagagatagggacagggaccgagatcgcgaccgtgaccgcgaacgggatcgagaccgcgagcgggacagggatcgagatagggagggtcctttccgcagatccgattcattccctgaaaggagagccccacggaaaggtaacactctgtatgtgtacggcgaagatatgacgcctacactgcttagaggtgctttttccccattcggaaacattatagacctgagtatggatccaccatag

SEQ ID NO: 238077 - DNA, 480 bp, Artificial Sequence
  Description of Artificial Sequence: Synthetic coding sequence
atgctcgtgatcccccctgggctgagtgaggaggaagaagcactccaaaagaaattcaataagttgaagaaaaaaaagaaagctctgttggccctgaaaaaacagtcttcttcatctaccacgagccaggggggtgttaaacgctccctcagtgaacaacctgtgatggacactgctactgccactgagcaagcaaagcagcttgtcaagagcggcgctatctctgccatcaaggccgagactaaaaatagcggattcaagcggtcaaggacattagagggcaaactgaaggaccccgaaaaaggccctgtccctacatttcaacctttccagcgcagcatctcggctgacgatgatctccaagaaagtagccgaagaccccaaaggaaatctctctatgaatcgtttgtatcgtcaagtgacagactgagggaactgggtcctgatggcgaggaggcagaaggcccaggggctggatag

SEQ ID NO: 238078 - DNA, 723 bp, Artificial Sequence
  Description of Artificial Sequence: Synthetic coding sequence
atgttggtcatacccccaggattaagtgaggaggaagaagccctgcagaagaaattcaataagctcaaaaagaaaaagaaagctctccttgcactcaagaaacagtcaagcagttcaacgacatcacaaggaggggtaaaacgttccctgtccgagcagccagtgatggataccgcaacagctacagagcaggcaaagcaattagtgaaaagcggtgcgatttctgctatcaaagcggagaccaaaaactcaggattcaagaggtcccggaccctcgaaggcaaactcaaagatcccgagaaaggacctgttcctacgtttcagccattccagaggagcattagcgcagacgacgacctccaggaaagctctaggcggccacagaggaaatcactctacgagagcgatcgcctccgtgaactggggcctgatggcgaagaggccgaagggcctggggctggagacggtcccccacgtagcttcgactggggatacgaagagaggagtggagcgcactccagcgcatcccccccacggagcagatcccgggataggagccacgaaagaaacagagacagagatagagacagagagcgagaccgggacagggatcgtgaccgtgatcgtgagcgtgacagagaccgcgatagagaccgcgaccgggatagagaacgagacagggatcgggaaagggatcgggatagggatcgtgagggtccttag

SEQ ID NO: 238079 - DNA, 480 bp, Artificial Sequence
  Description of Artificial Sequence: Synthetic coding sequence
atgttagtgatccctccagggctatctgaggaggaagaggcgcttcagaagaaatttaacaagctgaagaaaaagaaaaaagcactgcttgctctcaagaagcagtctagcagttctactacgtcccaggggggagtcaagcgtagcctgagcgaacagcccgttatggacactgctaccgcaactgaacaggccaagcagctcgtgaaatcaggcgctatctccgctatcaaggcggagacgaagaacagcggtttcaaacgatctaggacactggagggtaagcttaaggaccccgagaagggccctgtccctacattccagccatttcagagatcgatctcagctgacgatgatctgcaggaaagctctagacggcctcagaggaagtccctgtatgaatctttcgtgtcatcgtccgacaggctgcgagagctagggccagacggcgaggaggcagagggacctggagccggatag

SEQ ID NO: 238080 - DNA, 480 bp, Artificial Sequence
  Description of Artificial Sequence: Synthetic coding sequence
atgttagttattcccccaggactcagtgaagaggaagaggccttacaaaagaaatttaacaagctcaaaaaaaagaagaaggctctccttgccttgaagaaacagtcaagtagttcaaccacatctcaggggggtgttaaaaggtccctgtcagagcagcctgtgatggacacagccactgccactgagcaggccaaacagcttgtgaagtctggtgctatatcagcgatcaaagctgagacaaagaacagcggatttaaaaggagtcgcacccttgaaggcaagcttaaagatcctgagaaaggcccagtgcccaccttccagccctttcaacgaagtatcagcgcggacgatgatctgcaggaatctagtcgcaggccacagcggaaatccttgtacgagtcatttgtgagttctagtgacagactgcgggagcttggccctgacggcgaagaggccgagggaccaggagccggatag

SEQ ID NO: 238081 - DNA, 1005 bp, Artificial Sequence
  Description of Artificial Sequence: Synthetic coding sequence
atgctggtaatccctcctggcttgtccgaggaagaggaggccctccagaaaaagttcaataagctcaaaaagaagaagaaagctctgcttgcactcaagaaacagagcagttccagcactaccagccaaggcggagtcaagagatccctcagtgagcagcccgttatggatacggccacagcaactgagcaggccaaacagctggtaaaatctggtgctattagtgccatcaaggccgagactaagaacagcgggttcaagagaagccgcacactggaaggcaagcttaaggaccccgagaagggacccgtccctacttttcagcccttccagagatctatctccgcagatgatgacctgcaggaatccagtaggaggccccagcggaagtcgctgtatgaatctgaccgcttgagggagctcggacccgatggagaggaagccgagggacctggagcaggggatggacctccgagatccttcgattgggggtacgaggaacggtctggcgctcactcctccgcatcccctccaagatctagaagcagggacaggtcccacgagcgaaatcgagaccgtgaccgggatcgggaaagggatagagatagagatcgcgacagggaccgcgagcgcgatagggatcgcgatagagacagggatagggatagagaaagagaccgcgatagggaaagggacagggacagagaccgggagggaccattccggagatcggattccttcccagagagacgcgctcccagaaagggcaatacactgtacgtatacggggaagatatgacgccaacactgctcagaggagccttctcaccgttcggcaatatcatcgatctctccatggatcctcccagaaactgcgccttcgttacctatgagaagatggaatcagcagaccaggccgtggccgagctcaatggcactcaggtcgagtccgtccagttgaaggtaaacatcgcaagaaagcagccgatgctagatgcagcttag

SEQ ID NO: 238082 - DNA, 723 bp, Artificial Sequence
  Description of Artificial Sequence: Synthetic coding sequence
atgcttgttatcccccctggactgagcgaggaggaagaagctctccaaaagaagtttaacaagctcaagaaaaagaagaaagctctgttggccctcaagaaacagtcatcaagttcaacaactagccagggaggcgtcaaacggtccctaagcgagcagcctgtcatggataccgccaccgccacagagcaagccaagcaactggtgaagtcgggggcaatctcggccattaaggccgaaaccaaaaatagcggctttaagcgcagtaggaccctcgaggggaaactgaaggatcctgaaaaggggcctgtaccaacgtttcagccattccagagaagtatctccgccgatgacgaccttcaggagtctagtagacgtccccagcgtaagtcattgtacgagagcgaccgtctgcgtgaattagggccagatggcgaagaggccgagggcccaggcgcaggcgatgggcctccaaggtcctttgattggggatatgaagaacggtctggggctcactcatccgcgagcccaccacgcagtagaagtcgagaccggagtcatgagaggaatcgagaccgcgatcgggacagagagcgtgatcgtgacagagacagggatcgggatcgtgagagagatcgtgaccgcgaccgtgatagggatagggatagggagcgggaccgcgatagagagcgagatcgagatagagaccgggagggcccttag

SEQ ID NO: 238083 - DNA, 480 bp, Artificial Sequence
  Description of Artificial Sequence: Synthetic coding sequence
atgttggtaatacccccaggactgagtgaagaagaggaagcactgcagaagaagttcaataagctgaaaaaaaaaaaaaaggccctccttgccttaaaaaagcagtcatcaagtagtacgacctcccagggaggcgtaaagcggagtttatcagagcagcctgttatggataccgccactgcaactgagcaagccaagcagttggtcaagagcggtgcaattagcgcgatcaaggcagagactaaaaacagcggattcaagagaagcagaacgctggaaggaaaactgaaggatccagaaaagggcccagtcccaacatttcaacctttccaaagaagcatttccgccgacgacgacctacaggagagttcacggaggccacaacggaaatccctgtatgaatcctttgtgtcttcaagcgatcgcctacgggagctgggcccagatggcgaagaagccgagggacccggtgctggatag

SEQ ID NO: 238084 - DNA, 1005 bp, Artificial Sequence
  Description of Artificial Sequence: Synthetic coding sequence
atgctcgtgatccctcctggtctctcggaggaggaagaagcactgcaaaagaaatttaacaagctgaagaaaaagaagaaagcacttctggccctcaagaagcagtctagcagctcaaccacgtctcaggggggtgtgaagagaagccttagtgagcagcccgttatggatacagctacagctactgagcaggccaagcagctcgtaaagtcaggagccatatctgcaatcaaggccgagactaagaatagtggatttaagcgttcccggaccttagaggggaagctgaaggatcctgaaaagggccctgttccgaccttccaaccatttcaaagatccatcagcgccgacgacgatctccaggagtcttccagacggccacagagaaaatcactgtacgagtcagataggttacgagagctgggccctgacggggaagaggcagaggggcctggtgcgggtgacggaccccctaggagcttcgattggggttacgaagagaggagcggagcacacagctctgcgtcgcccccaagaagtagatcacgcgaccgatcccacgagaggaaccgcgaccgagacagagatcgggaacgcgacagggaccgcgaccgggatcgggacagagagagagaccgcgaccgagatcgagaccgcgatcgggacagagagagggatcgcgacagagaacgcgaccgtgatagagatagagaagggcctttccggagatccgactccttccctgagcggagagcccctagaaagggtaacactttatatgtttacggcgaagacatgacccctactcttctcagaggcgcatttagcccatttgggaacattattgatttgtcgatggatcctccgagaaactgcgcctttgtaacttacgagaagatggagagcgctgatcaggctgtggctgagctaaatgggacccaggtcgaatccgtccaactgaaggtaaacatagctagaaagcagccgatgcttgacgctgcatag

SEQ ID NO: 238085 - DNA, 480 bp, Artificial Sequence
  Description of Artificial Sequence: Synthetic coding sequence
atgctggtgatcccacctggtctgtccgaagaagaagaagccctgcagaagaaattcaacaagctcaaaaaaaaaaagaaggctctgctggcccttaaaaaacagtcaagctcatcaacaacctcacagggtggagtgaaacgaagcctttctgagcagcccgtcatggacaccgccacggccacggaacaagccaagcaacttgtaaagtccggggcaataagcgcaatcaaggcggagaccaagaatagtgggttcaagcggtctcgcacactcgaggggaaacttaaggacccggaaaagggcccagtgcccaccttccagccctttcagcgctctatttccgcagacgacgatcttcaggagagttctcggcgaccgcagcgcaaatcgctatatgagtcatttgtgagcagttctgaccggttgcgggagctgggtcctgacggagaggaagcagagggaccgggtgcagggtag

SEQ ID NO: 238086 - DNA, 1143 bp, Artificial Sequence
  Description of Artificial Sequence: Synthetic coding sequence
atgctcgtaatcccgccaggcctatcagaggaggaagaggccctgcaaaagaaatttaacaagctcaagaagaaaaagaaagcactactagccctgaagaaacagtcgtcatcctcaacaacctcccagggaggggtaaagcgaagcttgagtgagcagccagtcatggataccgctacagcgactgagcaggcaaagcaactggtgaaatctggtgctatctctgcgatcaaggccgagacaaagaacagcggcttcaagcgatctagaacactcgagggaaaattgaaggatccagagaaagggcctgtcccgactttccagccattccaaaggagcatctcggccgatgacgacttgcaggaatcgagtagacggcctcaacgcaaaagcctgtatgagtcttttgtatcaagctccgatcgcctgcgcgagttaggaccagacggcgaagaagcagagggtccaggcgcaggcgatggccctcccagatcttttgattggggttacgaggaaaggtctggcgctcattcctctgccagccctccaagatctcgaagcagagaccgatcccatgaacggaaccgcgacagggacagggaccgagaacgcgacagggacagggatcgtgatagggacagggaacgcgatcgcgatagagatagggatcgggaccgtgatcgcgagcgcgatagagatcgggagcgcgatcgcgatagagaccgtgagggcccatttcgccgttcagactcatttcccgaacgcagagcccctcggaaggggaacaccctctacgtttacggggaggatatgacacctaccttgctccggggagccttctcgccatttgggaacatcatcgatctaagcatggaccctccgaggaattgtgcctttgtcacatatgaaaaaatggaatccgctgatcaggccgttgctgaactgaatggcacccaagttgaaagtgtgcaactgaaggtcaatattgcacgcaagcagcccatgttggacgctgctaccgggaaaagtgtctgggggtcactggccgtacagaattcacccaagggctgccatcgggacaagagaacccagattgtttatagcgatgatgtctacaaggaaaaccttgtggatggcttctag

SEQ ID NO: 238087 - DNA, 885 bp, Artificial Sequence
  Description of Artificial Sequence: Synthetic coding sequence
atgcttgttatcccgccaggtctaagcgaagaggaggaagcccttcagaaaaagtttaacaaacttaaaaagaaaaaaaaggctctgctggcactcaaaaagcagtcttcctcctcaacaacatctcaaggcggagtgaaaaggtcgctgtctgaacagccagtgatggataccgccacagccactgagcaggcaaaacagttggttaaatctggggcaatctcggctattaaggcagaaactaagaactcaggatttaaacgttccagaaccctggaaggcaaactcaaggacccggagaaagggcctgtccctacattccagccattccaacgctctattagcgcagacgacgatctgcaagaaagctcaaggcgccctcaaagaaagtccctgtacgaatctttcgtctcatctagtgatcgactgcgtgaactgggacctgacggcgaagaggctgagggtcccggtgctggggacggcccacctaggagcttcgactggggatatgaggaaagaagtggagctcatagtagcgcttcaccccctagatctagaagtagagatcggagtcacgagcggaacagagatcgggatcgcgaccgagaaagagatcgcgatcgggaccgggatagggatcgggaacgggacagggatcgtgacagagaccgggaccgagaccgggaaagggacagagatcgcgagagggatcgggacagggatcgcgagggccctttccggagaagcgacagttttcctgagcggcgtgcccctagaaaaggtaataccctctacgtgtatggagaggacatgactcccactctgctccggggagctttcagtcctttcggaaatataatcgatttatctatggatcctccctag

SEQ ID NO: 238088 - DNA, 723 bp, Artificial Sequence
  Description of Artificial Sequence: Synthetic coding sequence
atgttagtcattccacctgggctctccgaggaagaggaggctctccagaagaagttcaataagttaaagaagaaaaagaaggccctgttagcattaaagaaacagagtagctcttcaacaacctcccaagggggtgttaaaaggagcctcagtgagcaacccgttatggacaccgcaaccgccacagaacaagctaagcagctggtcaaatccggggctatctcggctattaaggcagagacaaagaactctgggttcaagaggtcacggaccctcgaaggaaagctcaaagatcctgagaagggtcctgtccctactttccagccgttccagcggagcatttccgccgatgatgatttgcaggaaagctctagaaggccgcagcggaagagtttatatgaaagtgatcgtctgcgggaactggggcctgacggcgaagaagccgaggggccaggcgctggagatggaccgcctcggtcattcgattggggttacgaggaacgatccggcgctcattcatccgctagccccccaaggtctcgatctcgcgatagaagccacgaacggaatcgtgacagagaccgcgacagggagcgcgatcgggacagagatagggatcgggacagagagcgcgaccgggatagggatagagaccgtgacagggatcgggagcgagatcgtgacagggagagagatagggaccgagacagggagggcccttag

SEQ ID NO: 238089 - DNA, 885 bp, Artificial Sequence
  Description of Artificial Sequence: Synthetic coding sequence
atgctggtcatcccgcctgggttgtctgaagaagaggaggcccttcagaagaaatttaacaaactgaaaaagaaaaaaaaggctttgctcgccttaaagaagcagtcgagttcaagcacaacatctcagggtggagtcaaaaggagcctctccgagcagcctgtgatggacactgcgactgccactgagcaggcaaagcaactggtgaagtcaggggctatcagcgccatcaaggctgagaccaaaaatagcggattcaaacgctcccgaacccttgaaggcaagctgaaggatcctgagaagggtcccgttccaacattccagccgttccagcggtcaatcagtgcagatgacgatttacaggagtctagccgaagaccacagaggaagtccctatatgaatccttcgtaagcagctctgatagactgcgcgaactgggccctgatggtgaggaggcggagggacccggtgcaggagacggacctcctcgcagcttcgattggggctatgaagagaggagcggggctcacagttcagcctcgcctccgcgatccaggtcacgtgatcggagccacgagaggaatcgggatcgcgacagggatagggaacgcgatcgcgatcgggatcgggatagagacagagagcgggaccgcgatcgagaccgcgaccgagatcgcgatcgagaacgcgaccgcgacagggaaagagaccgtgatcgagatcgcgaaggaccattcagacgcagcgatagtttcccagagcggagggctccaagaaaaggtaacactctgtacgtctatggagaagatatgacaccgaccctgctgagaggggcatttagtccttttggcaatatcattgatctaagcatggacccgccatag

SEQ ID NO: 238090 - DNA, 1005 bp, Artificial Sequence
  Description of Artificial Sequence: Synthetic coding sequence
atgctcgttatcccacctggcctgtcagaggaggaggaagcactccaaaaaaagtttaacaagctgaaaaagaaaaagaaggcgctactggctctgaaaaaacagagtagctcatctacaacaagtcagggcggagttaaacgatcattgagtgaacagccagttatggacactgcgaccgcaacggagcaggctaaacaactcgtaaaaagcggagctatttcagctatcaaagcagagacaaagaactctgggtttaagcggtcacggactctcgaaggcaaactgaaagatcctgaaaaagggccagtgcctactttccaaccttttcaacggagcatctcagccgacgatgacctccaggaaagctccaggagaccccagagaaagagcctctacgagtctgatagactgcgcgagctcggtcctgacggggaagaagccgaaggcccaggagccggagacgggccacccagatccttcgactggggctatgaagagagaagcggagctcattcatctgcttccccccctcgctcacgatctcgtgacagaagccatgaaaggaaccgcgatcgagatcgcgaccgcgagcgagacagagaccgagatcgagatagggatcgcgagcgggatcgcgaccgcgacagagatagagaccgcgacagggagcgcgatagagatagggagcgggaccgagacagggaccgtgaggggcctttccgcaggtccgactcttttccagagcgacgcgctccacgcaaagggaataccttatatgtgtatggagaggacatgacccctaccttgcttagaggagcctttagcccttttggaaatattatcgatctttcaatggatcccccacggaactgtgcctttgtgacttatgaaaagatggagtcggctgaccaggccgtagctgaactgaatggtacccaggtagagtctgttcaactgaaagtcaacatagccaggaagcaacctatgctcgacgccgcttag

SEQ ID NO: 238091 - DNA, 1005 bp, Artificial Sequence
  Description of Artificial Sequence: Synthetic coding sequence
atgctcgtgattccacctggactgagcgaggaagaggaggccctgcaaaaaaagttcaacaagcttaagaagaaaaagaaagcccttctggcacttaaaaagcagtcaagtagtagtacaacgtctcagggtggcgtcaagcgttctctgagcgaacagcccgttatggacaccgcaactgccaccgagcaggctaagcagctggtgaaaagtggggctatctccgcaattaaagcggagactaagaatagtggtttcaagcgttccagaaccttggagggaaagctgaaggaccccgagaagggtccagtccccactttccagccctttcagagaagcatttcagcagatgatgacctccaggaatcgagtcgcagacctcagcgcaagtcgctgtatgagagcgataggctgcgggaattggggccagacggggaagaagcagaaggcccaggcgctggggatgggcctcctcgatctttcgattggggatatgaggagcgctcaggggcacatagtagcgctagcccaccgcgaagtagaagtcgcgacaggagccacgagcggaatagagatagagaccgggaccgggaacgagatagggatcgcgaccgggacagggacagagagcgcgatcgagaccgtgacagggatcgagatagggacagggaacgcgatcgagatcgggagagggatagagaccgtgacagagaggggcctttcagaaggtccgacagtttcccggagcgaagggcaccacggaaggggaatactctttatgtgtatggtgaagacatgacccccacgttgctgcgcggtgccttttcccctttcggcaatataattgatctctcaatggacccacctcggaattgcgcttttgttacgtacgaaaagatggaatctgctgatcaggcagtggctgagctgaatggcactcaggttgagtcagttcagctgaaggttaatatcgcccgaaagcagcccatgcttgacgcagcatag

SEQ ID NO: 238092 - DNA, 1005 bp, Artificial Sequence
  Description of Artificial Sequence: Synthetic coding sequence
atgctggtcatccctcctggtctctccgaggaagaggaagcattgcagaaaaagtttaataaacttaaaaagaagaaaaaggctctgctggctctgaaaaagcagagcagcagcagcaccacgagtcagggaggcgtgaaacgcagtctgtccgagcagcccgttatggatacggcgacggctacagaacaggctaagcagttggtcaaatccggcgctatcagcgccataaaggctgaaactaagaacagcggctttaaacggtcacgtacactcgagggcaaactgaaggaccctgagaaagggccagttcccacattccaaccattccagcgtagcatttcggctgacgatgacctccaggagagttcacgaaggccccagcgaaagtcgctctatgaatccgatagactcagagagctgggacccgatggcgaggaagccgaggggccaggcgctggagatggcccacctaggagcttcgactggggatatgaagagagatctggtgcccactcctccgcaagccctccacgttcccgatcccgagacaggtcacacgagcggaaccgagacagggaccgggatagggaaagagatagagaccgagacagagacagagatagagagagagaccgcgacagagaccgggacagggaccgcgacagagagcgcgacagggatcgtgaaagggaccgcgaccgggacagggagggaccattcaggcgttctgactcctttcccgagaggagggcaccaagaaagggcaacaccctctacgtgtatggcgaggatatgacaccaactttgcttcggggtgcctttagtccttttggtaatatcattgatttatcgatggacccacctcgaaattgcgcctttgtcacttacgaaaaaatggagagcgccgaccaggcagtcgcagagctgaatggcactcaggtagaatctgttcagcttaaagtcaacatcgctcggaaacaacctatgttagatgccgcttag

SEQ ID NO: 238093 - DNA, 1053 bp, Artificial Sequence
  Description of Artificial Sequence: Synthetic coding sequence
atgttagtgatccctccaggattgagcgaggaggaggaggcattacagaagaaatttaataagctgaagaaaaagaaaaaagctctgctcgctttgaaaaaacagagcagttcaagtaccacctcccagggaggtgtgaaacgctcactctctgagcagcctgtgatggatactgccaccgccaccgagcaggcaaagcagctcgtgaagtcaggagcaatcagcgctattaaggctgagaccaagaacagcggtttcaaaagatccaggaccctggagggaaaattaaaagacccggaaaaaggcccagttccaacattccagccctttcaaagatccatcagcgccgacgatgatttacaggaaagcagcaggcgtccccagcgcaagagcctttacgagtccttcgactggggctacgaggagagatctggggcacactcctctgcttctcctccacgcagtaggtctagggacaggtcacatgaacgaaaccgagatcgggaccgcgatagggagcgcgacagagatagagatagggatcgggatcgcgagcgcgacagagatcgagatcgcgacagagatagggatcgcgagcgggacagggatagagaaagagatagagacagggatagagaaggcccatttcgcaggagtgattcatttcccgagaggcgggctccgagaaaaggcaacacactgtatgtgtatggagaagatatgacacccactctccttcggggagccttttcaccctttgggaacatcattgacctgagtatggatccacccaggaactgtgcctttgtcacctatgaaaaaatggagtccgccgatcaggccgtagccgagctgaatggtacgcaggtggagtctgtccagctcaaagtcaatattgcgaggaaacagcctatgctagacgcagccacaggaaagagcgtgtggggtagcctggccgtgcagaacagccctaaagggtgtcatagagacaaacggacccagatagtgtacagcgatgacgtctataaagaaaatctcgttgacgggttctag

SEQ ID NO: 238094 - DNA, 1143 bp, Artificial Sequence
  Description of Artificial Sequence: Synthetic coding sequence
atgctagttatcccacccggtttgagtgaggaggaagaggcccttcagaagaaattcaataagctgaagaaaaaaaaaaaggctctccttgccctgaagaaacaatccagcagcagcacgacatcccaggggggagtgaagcgctccctctctgaacagccggtgatggatactgccacagccactgagcaggctaagcaactagttaagtcgggggctatttctgccataaaagctgagacgaagaactcgggtttcaagcgcagtagaacattagagggaaaactgaaagaccctgagaagggtcccgttccaacctttcaacccttccagcgctccatcagcgctgatgatgatctgcaagagtcttcacggagacctcagcggaagtccctctatgaaagctttgtgtcatcctctgacaggctgcgtgaactggggccagacggcgaggaggcggaaggacctggggctggagacgggcctcctcgttcattcgactggggctatgaagaaaggagcggagctcacagctctgctagcccgcctcgatctaggagtcgggaccggtcgcatgaaagaaacagagatcgtgaccgggaccgtgagcgcgacagagacagggaccgagatagagatcgcgagcgggatcgggatcgcgaccgggaccgggacagagatcgagaaagagatcgagatagggaacgggatcgggaccgtgaccgggaggggccttttcggagaagtgactccttcccggagaggcgggctccaagaaaaggcaatacactgtacgtctatggggaggatatgacgcctactcttttgcgaggcgcttttagcccttttggaaacattatagacctgagcatggaccccccacgcaactgtgcatttgtgacgtatgagaagatggagagtgcagatcaggctgtcgcagaacttaatggcacccaagttgaatcggtgcagctgaaggtcaacatcgctcgtaagcagcccatgttagacgcagcaacaggtaaaagtgtctggggttcacttgcagtgcagaacagtcccaagggctgccatcgcgacaagaggactcagatcgtctactctgatgacgtttacaaggagaatctggttgatggcttttag

SEQ ID NO: 238095 - DNA, 723 bp, Artificial Sequence
  Description of Artificial Sequence: Synthetic coding sequence
atgttggtgattcctcccggtctttctgaagaggaagaggcattacagaagaagttcaacaaacttaagaaaaagaagaaagccctgctcgcactcaaaaaacaatcgagcagcagcacaacgtcccaaggaggtgtcaaacggtctctctccgaacaaccagtaatggacactgcaacagcaactgagcaggctaagcagctggtaaaatctggcgcaattagtgctattaaggctgaaaccaaaaattcaggtttcaagagatccagaacactcgaaggcaagctcaaagatcctgagaagggtcctgttccaacgtttcagcctttccagcggagtatttccgccgatgacgacttacaggagtcaagtaggagaccacagcggaaatctctatatgagagcgatcgactcagagagctgggaccggacggggaggaggcggaaggcccaggggctggcgatgggcctcctagaagtttcgactgggggtacgaggagagatccggcgcacacagttctgcttctccgccacgatcacgaagcagggatcgctctcatgaacgcaatagggaccgggatcgggatagggagcgcgatcgagatagagacagggatagggatagagagagagaccgtgatcgggatagagacagagatcgagacagggagagggaccgagaccgtgaaagggaccgggaccgggaccgggagggtccctag

SEQ ID NO: 238096 - DNA, 1005 bp, Artificial Sequence
  Description of Artificial Sequence: Synthetic coding sequence
atgctggtgattccacctgggctctcggaggaggaggaggccctgcaaaagaagtttaataagttaaaaaaaaaaaaaaaggcactgttagcccttaaaaaacagtcatcaagtagcactaccagccagggaggggtaaagaggtccttgtcggaacagcctgtaatggacaccgcgactgcaactgaacaggccaaacagttggttaaaagtggggctatctccgcaatcaaggctgagaccaaaaactctgggttcaagagaagccgtaccctggaaggtaagctgaaagaccctgagaaaggtccggttcctaccttccaaccttttcagcggagcatcagtgccgacgacgacttacaggagtcaagtcgccgaccacagagaaaatcactgtacgagagcgatcgcctgcgggagttaggcccagacggggaagaggcagagggacccggagccggtgacgggccacccagatcttttgactggggctacgaggagaggagcggggcacactcttccgcctctccaccaaggtcaaggagtagagaccggtcacacgaaaggaatagagatagggatcgagaccgggaacgggaccgcgatagggaccgagaccgagacagggagcgagacagggaccgggatcgggatagagaccgggacagggagcgtgatcgggatcgcgaacgcgaccgagacagagacagagagggccctttcagacgcagtgactccttcccagaaaggagggcgcctaggaaagggaatacgctgtacgtgtacggggaagacatgacgcccaccctgttacggggagctttctctccttttggaaatattattgatttgtcaatggacccacctcgtaattgtgccttcgtgacatacgaaaagatggagtcagcagaccaggctgtcgcggagctaaacggcacacaagtggagtccgtgcagctgaaggttaacatagccagaaagcagccgatgttggacgcagcctag

SEQ ID NO: 238097 - DNA, 885 bp, Artificial Sequence
  Description of Artificial Sequence: Synthetic coding sequence
atgttggtcattccccctggtctctcggaggaggaagaagcattacagaaaaaatttaacaaactaaagaaaaagaagaaagctctcctcgcactaaaaaaacagagttcctcttctaccaccagccagggaggcgtgaagcgatctctgtctgagcaacccgtgatggacactgccacggcaactgagcaggcaaaacagttagttaagtcaggtgccatctcagcgatcaaggcagagaccaaaaattccggctttaaaaggtcacggaccttagaaggcaaattaaaggatcctgagaagggccctgtgcctaccttccagccattccaaagaagtatcagcgcggatgatgacctgcaagaaagctcccggcgtcctcagagaaaatccctgtatgagtccttcgtgtcttctagtgacaggttgagggagctcggtccagacggtgaggaggcggagggcccaggcgctggcgacggcccacctcggtccttcgattggggatacgaggaacgtagcggggcacactcatcagcgtccccaccacgtagccgaagcagagaccggagtcatgagagaaatcgcgaccgggaccgcgaccgcgagcgggaccgggaccgggaccgggatcgcgaccgtgaaagagatagagaccgagacagagatcgagatagagacagggagagagatcgggaccgggagagagaccgagaccgcgaccgtgaaggcccattccggcgatcagattcattcccggagcggagagcaccgaggaagggaaatacgctttatgtctatggcgaagatatgacccccaccctgctgaggggtgctttcagcccgttcggtaatattatcgatctttctatggatccgccttag

SEQ ID NO: 238098 - DNA, 885 bp, Artificial Sequence
  Description of Artificial Sequence: Synthetic coding sequence
atgctggtcattccaccaggattatctgaggaggaggaagcgcttcaaaagaagtttaacaaactgaagaaaaagaagaaagccctactggctctgaagaagcagtctagttcttccaccacttctcaaggcggtgtgaagcggagcctctcagagcagcctgtgatggacacagctacagctactgagcaagccaaacagctagttaagtctggagctattagtgcaattaaagcagaaacaaagaacagtggatttaagagatcccggacgctagagggcaagctgaaggatcctgagaagggcccagtgcctactttccagcctttccagaggagcatcagcgccgatgacgatctccaggaatctagtagacgaccccagagaaagtcgctatacgaatccttcgttagctcaagcgatagattacgtgaacttggacctgatggagaagaagcagagggacctggtgccggtgatggcccacctcgctctttcgactgggggtacgaggaacgtagtggggcacacagtagtgcttcgcctcctcggtcacgctctcgggatcggtcccatgagcggaatagggaccgagacagagatcgagaacgagaccgcgatcgagacagagatcgcgaccgtgaaagagaccgagatagagaccgagatcgtgatagagacagggaacgcgacagggatcgtgagcgagatcgcgatagagatcgcgaaggccctttccgtcgaagcgacagcttcccggagcgaagggccccacggaagggaaacactctctacgtttacggcgaggatatgacccccactctgcttaggggggctttcagtccattcggcaatatcatcgatcttagtatggaccctccatag

SEQ ID NO: 238099 - DNA, 885 bp, Artificial Sequence
  Description of Artificial Sequence: Synthetic coding sequence
atgttggtaattcctccagggctctccgaggaagaggaggccctacagaagaaattcaataagttgaaaaaaaagaaaaaggcgcttctcgccttgaaaaaacagagttcaagtagcactacatcgcaaggcggagtgaaacgttccctgtcagagcagccggtgatggacaccgcaaccgcaacagagcaggccaagcagttggtcaagtcaggtgctatctcagccattaaggccgagactaaaaactcaggttttaaacgatctcgcaccttggagggtaaactaaaagaccctgaaaagggtccggtccctacctttcagcctttccagagatcaatttctgcagatgacgacctccaagaaagctcaagaaggccccaacgaaagtccttgtatgagtccttcgtttcttcttccgaccgactcagggagctcgggccagacggggaagaggctgaaggccctggcgctggagacgggcctccgaggtcctttgactgggggtacgaggagagatcgggagctcacagctcagcgagtcccccacggagccggagccgggacagatcacacgagcgcaatcgagacagggaccgggatcgggagcgcgacagagaccgagatcgggatagggatagagagcgcgacagagacagagatcgggatcgcgatagggacagggagcgcgaccgggacagagagcgcgaccgggatcgcgatcgtgaaggcccatttaggcggtctgatagctttccagagcgcagagccccacgaaaaggtaatacactttatgtttacggggaggacatgacaccaacccttctgcgtggggctttctctcccttcgggaacatcatcgatctgtccatggatccaccttag

SEQ ID NO: 238100 - DNA, 723 bp, Artificial Sequence
  Description of Artificial Sequence: Synthetic coding sequence
atgctggtgatccctccgggactcagtgaggaggaagaggccctgcagaagaaatttaacaagctgaagaaaaaaaagaaggcattactcgccctcaaaaagcagagcagcagcagtactacctcccagggaggggtcaagaggtcgctgtctgagcagccggtgatggacactgcaaccgcgacggagcaggctaaacagttggtcaaatctggggcaatcagcgctattaaggcggaaaccaagaatagtggattcaagcgatcccgtaccctagaaggcaaattgaaagacccagagaagggcccagtgccaacattccagcccttccaaagatctattagtgctgacgacgatttacaggagtcctcccgcaggccccagcggaaaagtctgtatgagtctgacaggctgcgcgagctgggtcccgatggtgaggaagcggaggggcctggagccggagacggtccaccaagaagtttcgactgggggtacgaagagaggtccggcgcacatagttctgcatcccctccacgttcaaggtccagggacagaagccacgaacgaaatcgagaccgtgaccgggatcgtgaacgggacagggaccgcgatcgggatagggaccgggaacgtgacagagaccgcgatcgggatcgcgatagagatcgggaaagagatcgggaccgcgagagggacagagatcgggatcgggaggggccatag

SEQ ID NO: 238101 - DNA, 1143 bp, Artificial Sequence
  Description of Artificial Sequence: Synthetic coding sequence
atgctggtcatccccccaggcctgagtgaagaagaggaggcgcttcagaagaagttcaacaagctcaaaaaaaaaaaaaaggctctcctggcactgaagaaacagagcagctcgtcaacaacaagccaaggaggagtcaagcgctcactgagtgagcagccagtcatggacaccgccaccgctaccgaacaggctaagcagttggtgaagagcggggcaattagcgcaattaaagcggagactaaaaactccggctttaagcgtagcaggacactggagggtaaactcaaggaccccgagaagggtcctgtccccacattccagccattccagcggtctatcagcgccgatgatgacctgcaggaatcatcacgtaggccccagaggaagtctctctatgaaagctttgtaagttccagcgacaggttgcgcgaactgggtcctgacggcgaagaagctgaaggtcccggagccggagacggccctcccaggtctttcgactggggctacgaggagaggagcggcgctcattcgtccgcttcaccaccgaggtcccggagtcgggataggtcgcatgaaagaaaccgggacagggacagggacagggaacgggaccgggatcgggatagggaccgggatagagagagagatcgcgaccgcgatagagatcgagacagggaccgcgaacgggatcgggatcgcgaaagagatagagacagagaccgagaagggccattccgacgctccgatagtttccccgaacgaagagcccctcgcaaaggaaatacgctgtatgtgtacggggaggatatgacaccgactcttttgcgtggtgctttttctcccttcggaaacatcattgacctgtcaatggacccccctagaaactgcgcctttgttacgtatgagaaaatggagtccgccgaccaggccgtggccgaactgaacggcacacaggtggaatctgttcaattaaaagtcaatatcgcgcgaaaacagcccatgctggatgctgctacaggaaagtccgtatggggaagcttagcagtccaaaattcccctaaaggatgccatcgtgataaaagaacccagattgtctattccgatgatgtgtataaagaaaacctggtagatgggttctag

SEQ ID NO: 238102 - DNA, 480 bp, Artificial Sequence
  Description of Artificial Sequence: Synthetic coding sequence
atgttagtcattccccctggactctctgaagaagaagaggcattacaaaaaaagtttaacaagcttaaaaaaaagaagaaggccctgctggccctgaagaaacagagtagttcttccaccaccagccagggcggtgtgaaaagaagtctgtcagagcagcctgtgatggatacagccacagctactgagcaggctaaacagctggtcaagtccggtgccatttcagccattaaggccgaaactaaaaatagtggatttaagcggagccggaccctggaaggaaaactcaaggatccagagaaaggaccggtgcccacctttcagccctttcaaagaagcatttccgccgacgatgacctgcaagaatctagtaggcgccctcagcggaaatcactttacgaaagctttgtgagcagttcagaccggctgagagagctgggcccagacggtgaagaagctgagggtcccggagccggatag

SEQ ID NO: 238103 - DNA, 1164 bp, Artificial Sequence
  Description of Artificial Sequence: Synthetic coding sequence
atggtaccaaaaggcgctacaatgctggtgatcccacccggactgtccgaggaagaagaggccctgcagaagaaatttaataaattaaaaaaaaagaagaaggcgctcctggcgttgaagaaacagagttcaagttcgaccacctctcagggcggagtgaagagatcactgtcagagcagcccgtgatggatacggctactgccactgagcaggcgaagcagctggtcaagagtggggcaatctccgcgatcaaggccgaaaccaagaatagtgggttcaagagatctaggacgctggaggggaagctgaaggatcctgaaaagggcccagtgcccacatttcagcctttccagcgttcaatctccgcagacgacgatttgcaggaatccagccgcaggccgcagaggaagtcactgtatgagagctttgtgtccagttcagataggctgagagagttggggccagacggagaagaggccgagggacccggtgcaggtgacggacccccaaggagtttcgattggggctacgaagagcgatctggcgcacacagctccgcgtcgccccctcgaagtcggtctcgcgatcgctcccacgaaagaaaccgtgatagagacagagatagagagcgcgatagagatagagatagagacagggaccgtgaaagggacagggaccgggatagagatcgcgacagggatcgggaaagggatagggacagagaacgtgaccgtgatagggatagagagggcccttttcgaaggagcgactcttttcctgaaaggcgggctcctagaaaaggaaataccctctatgtttatggcgaggatatgacccccactcttctgcggggagcgttctcgcccttcgggaacatcattgatctgagtatggatccaccccgaaattgcgctttcgtcacttacgagaagatggaaagcgccgaccaggctgttgcagagctcaatgggacacaggtcgagagtgtccagttgaaagtgaatatcgccaggaaacagccaatgctggatgccgcaactggcaagtctgtctggggatctctcgcagtacaaaacagccctaaagggtgccacagggacaaacggacccaaattgtgtattccgacgacgtgtataaagaaaatttggtggacggcttttag

SEQ ID NO: 238104 - DNA, 1164 bp, Artificial Sequence
  Description of Artificial Sequence: Synthetic coding sequence
atggtcccaaagggggctaccatgctagtgatccctccaggcctgtcggaggaagaagaggcactccagaaaaagttcaataaactaaagaaaaagaaaaaagctctgctggcactcaagaagcagtcatccagcagtactactagccagggcggtgtcaaacgaagcctctcagagcaacctgtcatggacaccgctaccgccaccgagcaggctaagcagttggtaaagtctggtgccatttccgcgattaaagcagagacaaaaaattctggattcaaacgctctcgtacgctcgagggaaaactgaaggaccccgagaaaggacctgtacctacattccaaccattccaacgcagcatttctgcggatgatgacctccaagagtcatcacgccgacctcaaagaaagtctctttacgagtcgttcgtgtccagctcagatcgtctacgggagcttggccctgatggagaggaagctgaaggcccaggggctggcgacggtccacccagaagcttcgactggggctatgaggagagatccggagcccactcaagcgcatcgcctccacgttcccgttcccgggataggtcccacgagaggaatagagacagggacagagaccgggagagggatagagacagagaccgggacagggacagggaaagggacagggatcgggatcgcgatcgagacagggatcgggagcgggatcgtgaccgcgagagggacagagaccgggatcgcgaggggccattccgcagaagtgactcctttccggagcgcagagcccctcggaaggggaacactttatatgtgtacggcgaggacatgacaccgaccctgcttcggggtgcgtttagcccattcggtaacattattgatctgagcatggaccccccaaggaactgcgctttcgttacatacgagaagatggaaagcgcagatcaggccgtggccgaactcaacggtacccaggtggaatcagtacaactgaaggtcaacatagcccgaaagcagcctatgctggacgcagccacagggaagtcagtctggggctctctcgccgtgcagaactcccccaagggatgccaccgggacaagcgaactcagatcgtctatagtgacgatgtgtacaaggaaaacttggtggatgggttctag

SEQ ID NO: 238105 - DNA, 1164 bp, Artificial Sequence
  Description of Artificial Sequence: Synthetic coding sequence
atggtgcccaagggggctacaatgttagtgattcctccaggactgagcgaggaggaggaggccctgcaaaaaaagtttaataagctgaaaaagaaaaagaaggcactgctggccctgaaaaaacaaagctctagctccaccacctctcaagggggagtcaaacgtagtctctctgagcagcccgtgatggacacagccactgccacggagcaggccaagcagctggtcaaatctggcgctattagtgcaatcaaggcagagactaagaactcggggtttaaaaggtcccgcactctggaaggaaagttgaaggatccagagaaaggccctgtgcctactttccagccttttcaaaggtcgatttctgcggatgacgatctccaggaatcgtcccgaagacctcagcggaaatctctgtatgagtcctttgtatctagctctgatagactcagagagctgggaccagacggcgaagaagctgaaggccctggggctggcgatgggccacctcggtcgttcgactgggggtacgaagaacgcagtggagcgcactcgagtgccagcccgccacgctcccgaagtagggatcgcagccatgagaggaatcgtgaccgggacagagaccgagagcgtgatagggatcgtgatcgcgaccgcgatcgcgagagagatcgggaccgggatcgggatcgtgatcgcgacagagaacgcgatagggatcgcgagagagaccgcgatagggatcgggagggccctttcaggcgcagcgactcattccccgagagaagagcaccccgaaagggtaacactctgtatgtgtacggtgaggatatgacccctacgctgttgaggggggctttctctccctttgggaacattatcgacttgagcatggatcctcctcgcaattgcgcttttgtcacttacgaaaagatggagtccgcagaccaggccgttgccgagctcaacggcactcaagtagagtccgtgcaattgaaggtcaatatcgcccgaaagcaaccaatgttagatgctgccaccggtaaatcggtttggggctccttggcagttcaaaacagtcccaaaggctgtcatcgcgataagagaactcagatcgtgtactctgatgacgtttataaagagaacttggtcgatggcttctag

SEQ ID NO: 238106 - DNA, 1164 bp, Artificial Sequence
  Description of Artificial Sequence: Synthetic coding sequence
atggtcccgaagggtgccaccatgctagtgatcccacccggactgtccgaggaagaagaagctctgcagaagaaattcaataagctgaaaaagaaaaaaaaggcactgctggcactgaagaagcagtcctcgtcaagcacaacttctcaaggcggtgtaaagagatctctttccgagcagccagttatggacacagccacagctaccgagcaagcgaaacaactggtgaagtctggagcgatttccgccattaaggctgagacaaaaaattctggcttcaaacgcagccgaactctagagggcaagttgaaagaccctgagaagggtcccgtccccaccttccagccttttcagagaagtattagtgctgatgatgacctacaagagtcgagtaggaggcctcagcgtaagtctttatatgagagttttgtctccagcagcgatagactgagggaactgggacctgatggcgaagaggctgagggacccggagcaggcgacggccctcctaggtcattcgactggggatatgaggaaagatcaggtgcgcattcctcagccagcccaccccgttcccgcagccgagacaggtcccacgagcgcaaccgtgacagagacagggacagggagagagatcgcgatagggatcgagatagagatcgagagagggatagagaccgggaccgcgatcgagatcgcgatagagagagagaccgggaccgcgagagggacagagaccgcgatcgcgaaggcccttttcgacggtcagatagctttccagaaagaagggctccacgcaaggggaacaccctctatgtttacggagaggatatgaccccaactttgctgagaggtgctttctccccctttgggaatatcatagatctcagtatggacccgccacggaactgcgcgttcgtgacgtacgaaaagatggagagcgccgaccaggccgtcgccgagcttaacggcacacaggtggagtcagtccaactgaaagtgaacattgccagaaagcaaccgatgctggacgcagcgaccggaaagtcagtatgggggtccctcgctgtgcagaattccccgaagggctgccaccgcgataaaaggactcaaattgtgtacagtgacgatgtgtacaaagagaacctggtggacggcttttag

SEQ ID NO: 238107 - DNA, 1164 bp, Artificial Sequence
  Description of Artificial Sequence: Synthetic coding sequence
atggtgccgaagggcgctactatgcttgtgatcccacctgggctgtctgaggaagaagaggccttgcagaagaagtttaacaagttaaaaaaaaagaagaaggcgctgctggcccttaagaagcagagctcatccagcactacaagccagggtggggtgaaaagaagccttagtgagcaaccagtgatggacactgccaccgcgactgagcaggcgaagcagctggtgaagtctggcgcaatctctgccattaaagctgagacgaagaattcgggatttaagcgctcacgcaccctggaaggaaagctgaaggatcccgagaagggcccagtacccaccttccaaccttttcaaaggtccatttccgcagatgacgacctgcaggaatcatctagacgtcctcagaggaagagcctgtacgagtccttcgtctcgtcaagcgacaggctgcgggagcttggccctgacggggaagaagccgaagggcctggtgctggagacgggccacctcggtcgttcgactggggttacgaagagaggtctggggcacattcctccgcctcccccccaaggtccagatctcgggaccggagtcatgaacgcaaccgcgacagggatcgggatcgggaaagggatagggatcgcgaccgtgatcgggatagggagagggatagagatcgggatcgtgaccgggatcgggaccgcgaaagagatagggatagagaacgtgatagggatagagaccgggagggtccattccggagatcagattccttcccggaaaggcgggctccaagaaagggaaatacgctgtatgtgtatggggaggacatgacaccaactcttttgcgcggagccttttctccatttggcaacatcattgatctgagcatggatccacccaggaattgcgcctttgtcacctatgagaaaatggaatcggcagatcaagccgttgccgagctcaacggtactcaagtagaaagcgtgcagctcaaggttaatatcgccaggaagcagccaatgctcgatgccgcaacaggtaagagcgtgtgggggtctctagctgtccagaactctcccaagggatgccatcgggacaagcgaacgcagattgtctatagcgatgacgtctacaaggagaacctggtcgacggcttctag

SEQ ID NO: 238108 - DNA, 3294 bp, Artificial Sequence
  Description of Artificial Sequence: Synthetic coding sequence
atggccacgcaggtgatgggccaatcgtctggaggaggcggactgttcaccagctccggcaacatcggaatggccctccctaacgacatgtacgatttacacgaccttagtaaggctgagctcgctgccccacagttgattatgctcgctaacgttgctctgactggcgaggtcaatgggtcctgttgcgactatctcgtgggggaagaacgccagatggctgagctcatgccagttggcgataacaacttcagcgactccgaggaaggcgagggtctcgaagagagcgccgacattaagggcgagccccacgggcttgagaacatggagttgcgatcccttgagctatccgtggtcgagccacagcccgtgttcgaggcttctggcgctcccgatatttactcctcaaataaagatctgccccctgagacccccggagccgaagacaaaggcaagtcatccaagacgaagccctttcgatgtaagccctgtcagtacgaagcagagagcgaagagcagttcgttcatcatatccgggtgcattcagcaaagaagtttttcgtggaagaaagcgctgaaaagcaggccaaggcgagagagtcggggagttctactgccgaagagggcgatttttctaaaggccctatacgttgtgaccgctgcggatataacacaaaccggtacgaccactacacagcacacctgaagcatcacacaagggcaggcgacaacgagcgcgtttacaagtgtattatatgtacatatactaccgtgtctgaataccactggcgcaaacatctgcgcaaccactttcccagaaaagtgtacacctgcggtaagtgcaactatttctcggacagaaaaaacaattacgtgcagcacgtgaggacccacacaggcgagagaccgtacaaatgcgagctgtgtccttactcctcctcccagaaaacacacttaacgagacatatgcgcactcattctggagagaaaccctttaaatgcgatcagtgcagctatgttgcctcaaatcaacacgaagtgaccaggcacgctcgccaggttcacaacggacccaagccccttaactgcccacactgcgactacaagaccgcggacagatctaatttcaagaaacacgtggaactgcacgtgaacccgagacaatttaactgtcccgtctgtgactatgcagccagcaagaagtgcaacctacagtatcactttaagtcaaaacaccccacatgtccaaataagactatggacgtgtccaaggtgaaacttaaaaaaactaagaagcgggaggcagatctgccagacaacatcacgaatgagaaaacggagatagagcaaaccaagattaagggagatgtggcaggcaaaaaaaacgaaaaaagtgtgaaagcagaaaaacgagatgttagcaaagagaaaaaaccctccaacaatgtgagcgtcatacaagtaaccactcgcacccgcaagtccgtgacagaagtcaaagaaatggacgtccacaccggttcgaacagcgagaaattctcgaagaccaagaagagcaaacggaagttggaagttgattcacactcgctacatggaccagtgaacgatgaagagagctcaacaaaaaaaaagaagaaagtggagtcaaagtctaagaacaactctcaggaggtgcctaagggagattctaaggttgaggaaaacaaaaagcaaaacacgtgtatgaagaaatcaaccaagaagaaaacattaaaaaacaaatccagtaagaaatctagtaagccacctcagaaagaaccagtggagaaaggctccgctcaaatggaccctccacagatgggtcctgctcccacagaggcggtccaaaaaggaccggtgcaagtagagccccctccgccaatggagcatgcgcagatggaaggagcccagattcggcctgccccagatgagcccgtccagatggaggttgtccaggaagggccagcccagaaagagctcttgccccctgtcgaacctgctcagatggtaggcgcacagattgtcctggcacacatggagctgccgccaccaatggagaccgcgcaaacggaggtcgcacaaatgggcccagcccctatggagcctgctcagatggaagtggcccaggtggaatccgctcctatgcaggtagtgcagaaagagccagtccagatggaactaagtccaccaatggaagttgtgcaaaaagagccggttcagatcgaactcagtcccccaatggaagtcgtccaaaaagaacctgtgaaaatagagttgtcacctcctattgaggtggttcagaaggagccagttcagatggagctatccccacctatgggagtcgtgcagaaagagccagcccagcgcgaaccccctccacctcgggagccgccattgcacatggaacccattagcaaaaaacctccactcagaaaagacaagaaagaaaagagtaacatgcaaagcgagcgcgctcggaaagagcaggtgctgatcgaggtaggtcttgtgcccgttaaagactcctggcttctcaaagaatccgtgagtactgaagacctctccccccctagtccaccactgcccaaagaaaacctccgcgaagaagcgagtggagaccagaaactgctgaatacgggcgagggaaacaaagaggcgcctttgcagaaggtgggcgcagaagaagccgatgagtccttacccggactggcggctaatatcaacgaatctacccatatatcttctagtggccagaatctgaacacccctgaaggggagaccttgaatgggaagcatcaaaccgattccatagtctgtgaaatgaagatggatacagaccaaaacacccgggagaacttgactggaataaattccaccgttgaggagcccgtatcacctatgctgccacccagcgcagtggaagagagggaggcggtctctaaaacggctttggcttctcccccagcaaccatggctgctaatgagagtcaggaaattgatgaagatgagggcattcattcacatgagggtagcgacctctctgataatatgagcgagggcagtgacgatagcggcttacacggcgcacggcctgtgccacaagagtcgagtagaaaaaacgccaaggaagctctagccgtgaaagcagctaagggggacttcgtatgtatattctgtgatcgatcattccggaagggaaaagactattcaaagcatctgaaccgtcatcttgttaacgtctactaccttgaagaggctgcgcaaggccaggagtag

SEQ ID NO: 238109 - DNA, 3225 bp, Artificial Sequence
  Description of Artificial Sequence: Synthetic coding sequence
atggctacacaggttatggggcagtcatccggtggcggaggcctttttaccagctccggcaatatcggtatggcactgcctaatgatatgtatgacctccacgacctttcaaaagccgagctcgctgcccctcagctcatcatgctcgcgaacgtcgcactcaccggcgaagtcaatggttcctgttgcgattatttggtgggggaggaacgccagatggccgaattgatgcctgtgggagacaataacttctctgactctgaagaaggagagggtttggaagagagcgccgatatcaaaggcgagccacatggcttggaaaacatggaactgagaagcctggaattaagcgtggtggagccccagcctgtattcgaggcaagtggagcacccgacatctatagctctaataaagatctgcctcccgaaacaccaggggctgaagacaaggggaagtcctcgaagactaagccttttcgctgtaagccttgccagtatgaagcggaatccgaagagcagtttgtgcatcacatccgcgtgcactctgctaaaaagttctttgttgaggaaagcgccgagaagcaagcaaaggcccgtgagtctggctcctcgactgcggaggaaggagacttctctaagggacccattcgttgcgaccgctgtggctacaatacaaaccgctacgaccactacacagcacatctcaagcaccacactcgggcaggggacaatgagcgcgtgtacaagtgtattatctgcacgtacactacagtctcagagtaccactggcggaaacacctgcgcaaccactttccaaggaaggtgtacacatgcggcaagtgtaattacttttctgaccggaaaaataactacgtacagcacgtgcggacccatacgggaaagcggccttccggcgagaagccctttaaatgcgaccagtgttcatatgtagcttctaaccagcatgaggttactcgtcatgccaggcaggttcataatggcccaaaaccactgaattgtccacactgtgactacaaaaccgccgatcgctccaacttcaaaaaacatgtggaactgcatgttaaccctcgacaattcaactgtccagtgtgcgattacgctgcttcaaagaaatgcaatctccaatatcacttcaagtcaaagcaccctacctgccctaacaaaactatggatgtatcaaaagtaaaactgaaaaagaccaagaagagggaggccgacctcccagataacattactaacgaaaaaaccgagattgagcaaacaaagattaagggggacgtggcagggaagaagaatgaaaagtccgttaaggccgaaaaaagagacgtgtccaaagaaaagaaaccgtccaataatgtctctgttattcaggtaacgacccggacccgcaaatccgtcacagaggttaaggagatggatgtgcacactggttcaaactccgagaagtttagtaagaccaagaaatctaagagaaaactggaggtggacagccattcactgcacggcccagtgaatgacgaagagagcagcacgaagaaaaaaaagaaagtagagagcaaatctaagaataacagtcaggaagtgcccaagggtgactccaaggtagaagagaacaagaaacaaaatacttgcatgaagaagtcaaccaagaaaaaaactctgaagaataaaagctccaagaaatccagcaaaccgcctcagaaggaacccgtggaaaaggggtcagcccagatggatccaccacagatgggacctgctcccaccgaggccgttcaaaaagggcctgtgcaagtcgagcctccccctcctatggaacatgcccagatggaaggggcacagatcagacccgcacctgacgagcccgtgcagatggaggtggttcaagagggcccagctcagaaggaattattgcctcctgtggagcccgctcaaatggtgggcgcacagatcgtgctcgctcacatggaactcccccctccgatggaaactgcccagacagaggtagcccagatgggacctgcacccatggaaccagcgcaaatggaggtcgcccaggtggagtctgcccctatgcaggtggtgcaaaaagaacctgtgcagatggagcttagccccccaatggaagtggtgcagaaggagcctgtgcaaattgaattgtcccctccaatggaggtggttcagaaagagccagtcaaaattgagctgagccctcccatagaggttgtgcagaaagagcccgtacagatggaactgagtccaccaatgggcgtggtacaaaaggagcccgcacagcgggagccaccacccccacgcgagcctcctctccatatggaacccattagtaaaaagcctcctctgcggaaggataagaaagagaaatctaatatgcaatccgaacgcgctagaaaggaacaggtattaatagaagtcgggctggtgcctgtgaaggactcttggctgctcaaagaatcggtaagcactgaggacctcagcccacctagccctcctctccccaaggagaacctgcgtgaagaagcctcaggggatcagaagctgcttaacacaggtgaggggaataaagaggctccactacaaaaagttggggctgaggaagccgatgagtctctgcccggtctagcagccaatatcaacgagtccacgcacatcagctcctcggggcagaaccttaacactcctgaaggggaaacactcaacggaaaacaccagacagatagcattgtctgtgagatgaagatggacaccgaccagaacacacgtgagaacctgaccggaatcaactcaaccgtagaggaacctgtgagccccatgctgcccccatctgctgtcgaggagcgagaggccgtttccaagaccgctctcgcctcacccccagctactatggccgctaatgagtcccaggaaatagacgaggatgaggggatccatagccacgaaggctccgatctgagcgataatatgtccgaagggagcgatgattctggtctgcacggggcacgccctgtaccccaagagtcatcgcgaaaaaacgccaaagaggccctcgccgtaaaggccgctaaaggggatttcgtttgtatcttttgcgacagaagctttagaaagggtaaggattactccaagcatctgaacaggcacctggtgaacgtgtactacctggaggaggccgcacagggccaggaatag

SEQ ID NO: 238110 - DNA, 1383 bp, Artificial Sequence
  Description of Artificial Sequence: Synthetic coding sequence
atggccactcaggtcatgggccagtcgtcaggcggaggtgggttgtttacttctagcggcaacattggcatggcgcttcctaacgatatgtatgaccttcacgacctgtctaaggccgagctggcagctccccagcttatcatgttagcaaacgtggctctcaccggggaggtgaatggaagttgctgtgattatctcgtcggtgaagagcgccagatggccgagttgatgcctgttggcgataataacttcagtgattcggaggagggagaaggtctcgaggagtcagccgacataaaaggcgaaccacatggcttggaaaacatggaactccgctctcttgagctgagcgttgtcgagccccagccggtcttcgaagcttccggcgctccggatatctactcatctaataaagatcttcctcccgaaactcctggagcagaggacaaagggaagagctccaagactaaacctttcagatgtaaaccatgccagtacgaagccgaatcagaagagcagttcgtgcatcacatcagagtgcactccgccaaaaagtttttcgtggaggagagcgcagagaagcaggcaaaggcccgtgaatccggctccagcaccgcagaggaaggagacttctctaagggtcccattaggtgcgatcgctgtggatataataccaatcgctatgaccactacactgcgcacctgaaacatcatacccgagctggagacaatgagagggtgtataagtgtatcatctgcacatacacaactgtatctgagtatcactggcggaagcacttaaggaaccactttcccagaaaagtctacacctgtggcaagtgcaactatttcagtgataggaaaaataactatgtccaacacgtaagaactcacactggcgaaaggccctacaagtgtgaactctgcccctatagcagctcccagaaaactcaccttacaagacacatgcgcactcattctggcgagaagccctttaagtgtgatcagtgttcttacgtagcttctaatcagcacgaagtgactagacacgcgaggcaggtccacaatgggccaaaaccactcaattgcccacactgtgattacaagacggcagatcggtccaatttcaagaaacacgtcgagctgcatgtcaatccgagacagttcaattgtcccgtctgtgactacgccgcaagcaaaaaatgtaacctgcagtatcatttcaagtctaagcatcctacatgccccaacaagacaatggatgtcagcaaggtgaaactgaagaagacgaaaaaacgcgaagccgacttaccagataacataaccaatgaaaagactgaaatcgaacagactaagaaaaagaaaaaaaagaaaaaaaaatag

SEQ ID NO: 238111 - DNA, 5744 bp, Artificial Sequence
  Description of Artificial Sequence: Synthetic coding sequence
atggctgatggcaagggggatgctgcagccgtggccggagcaggggcagaagcacctgccgtcgctggggcaggcgatggtgtcgaaacggaatcgatggtgagggggcatcgcccagtgagccccgcaccaggagcaagtgggctccggccatgcctgtggcaattagaaaccgaactcagagaacaagaggtgagcgaggtatcatccctgaattattgccgttctttttgtcagaccctcctgcagtacgcaagtaacaagaacgcatccgagcacatagtgtatctgctagaggtgtaccgactggcgattcagagcttcgctagtgcaaggccctacttgaccaccgaatgtgaagatgtgctcctggtgctggggaggctggtgctgagctgcttcgagctcctcttaagcgttagcgagtccgaactgccttgtgaagtttggctccccttcttgcaatcccttcaggagtcccacgacgctcttctggagttcggaaacaataatctacagatccttgtgcatgtcaccaaggaaggcgtctggaagaatccagtgctcctgaaaattttaagccagcagccagtggaaactgaggaagtaaacaaactgatcgcccaggagggaccctctttccttcaaatgagaatcaaacaccttctgaaatccaactgtattccccaggcgaccgccctgagcaagctctgcgctgaatcaaaggaaataagtaacgtctcttcgtttcagcaggcatacattacctgtctgtgtagcatgctacccaatgaagatgcaatcaaggaaatcgccaaggtggactgcaaagaggtgctggatattatttgtaacttagaatctgaggggcaagataacaccgccttcgtgctgtgtacaacctacttaacccagcagctgcagactgcctccgtgtattgttcttgggaattaacccttttttggagcaaactgcaacgtcggatagatcctagcttggatacttttctagagcggtgcagacagttcggagtcatagcaaaaactcagcagcacctgttctgtctgattagagtgatccaaacagaggctcaggatgccggattaggagtgagcattcttctgtgcgtgcgggctctgcagcttaggagttccgaagacgaggagatgaaagctagtgtatgtaagaccattgcttgcctcctgcctgaggacctggaagtgaggagagcatgccagctgactgaatttctgatcgaaccatccctggacggcttcaatatgctcgaggagctgtatctgcagcctgaccaaaaattcgacgaagagaacgccccagtcccgaacagcctgagatgcgagctgcttctcgcacttaaggcgcactggcccttcgaccccgagttctgggattggaagacactgaaacgccactgccaccagttgcttggacaggaggccagtgattcagatgacgatctctctggatatgagatgtcaatcaacgacactgacgtgctcgaaagttttctaagtgattacgatgagggaaaagaagataaacaatacaggagacgagatctcacggatcaacacaaagaaaagcgagataagaaacccatcggctcatccgagcgctatcagaggtggctgcaatataaatttttctgtctgctgtgcaaacgcgagtgtatagaagcacgaattttacatcacagtaagatgcatatggaggatggaatctatacgtgtccggtctgtatcaagaagtttaagcgaaaggagatgttcgtgccccatgtgatggagcacgtgaagatgcccccatcacggcgtgacagatctaagaagaagctgctgctgaaaggttcccagaaaggaatttgccctaaatctccgagtgccattccagaacagaaccatagtctgaatgaccaggcaaaaggggaatcccacgaatatgttaccttttctaagctggaagattgccacctgcaggacagggacctgtacccctgccccggaaccgactgcagccgggtgtttaaacagtttaaatacttaagcgtgcacctcaaagccgaacaccagaacaatgatgagaacgctaagcattatctggatatgaaaaacaggagagagaagtgtacatactgtaggcggcacttcatgagtgcgttccatcttcgcgaacacgaacaagtacactgcggtccgcagccctacatgtgcgtctctatcgattgctatgctagatttggctctgtgaatgagctgttgaaccacaagcagaagcatgacgacctgcgttacaagtgcgagctgaacgggtgcaacatcgtcttttctgatctgggccagttgtaccatcacgaggcccagcatttcagggatgccagttacacatgtaacttcttgggatgcaagaaattttattactcaaagatagagtaccagaatcacttgagtatgcataatgttgaaaatagcaacggagacattaagaagagtgtgaaacttgaagagtctgccaccggagaaaaacaagactgcatcaatcaacctcacctgttaaaccagaccgacaaaagccatctgcccgaggacctcttctgtgccgagagcgccaactctcaaatcgatacggagacagccgagaacttaaaggaaaacagcgacagtaactcttctgatcagctgtcccactcaagtagcgctagcatgaacgaagaacttattgacactcttgatcacagcgagaccatgcaagacgtgttactgagcaacgaaaaggttttcggtcctagcagcctgaaggagaaatgtagctccatggctgtgtgtttcgatggaaccaagttcacttgtggcttcgatggatgtggttccacctataagaatgctcgcggaatgcagaaacacctgcgcaaggtgcatccctatcatttcaaaccaaaaaaaatcaaaaccaaagatctgtttccatccctcggaaacgaacataatcagactaccgagaagctagatgctgaaccaaaaccttgtagcgataccaacagcgattcccccgatgagggactggaccacaatatccacattaaatgcaaaagggagcaccaaggatactcctctgaatccagcatttgtgcttcgaagcggccatgtacagaggacactatgctggagctgctgttgcggttgaagcacctgtcgcttaaaaacagcatcacccacgggtccttctcagggtcactgcaaggctatccttcatcaggcgctaaatccctgcagagcgtgtcgtcaatttccgatctgaactttcaaaatcaggacgagaacatgcctagccagtatttggcccaactggcggcaaagcccttcttttgtgagttgcagggttgtaagtacgagtttgtgactagagaggccctacttatgcactacctcaaaaagcataactactccaaagaaaaggtgctacagcttacaatgtttcagcacagatactccccatttcagtgtcacatttgtcagagaagttttacaaggaagacacatctaagaatccactataagaacaaacatcaaatcgggtctgatagggcaacccacaagttgctggataatgagaaatgtgatcatgaagggccatgtagcgtcgaccgcttgaagggcgactgcagcgccgagttagggggagaccccagctccaactccgaaaaaccacactgccaccccaaaaaggacgaatgctcatctgagacggatctggagtccagttgcgaagagactgagagcaaaacgagcgatatttcttccccaataggtagtcaccgagaggaacaagaagggagggaggggagaggatccaggcgaaccgtagctaaaggcaatctctgttacatcttaaacaagtaccacaagccatttcactgcattcataagacctgtaattccagttttacaaatctcaaaggccttatccgacactatagaaccgtgcaccagtacaacaaggagcaactgtgtctggaaaaggacaaagctcgtaccaaaagggagttagtaaaatgcaaaaagatattcgcctgcaaatacaaggagtgcaacaagcggttcctctgctccaaagcacttgcaaaacactgctctgattctcataacttggaccacatcgaagagcctaaagtcttgtcagaagccggtagtgctgccagattttcatgcaaccagccccaatgcccagcggtcttttacaccttcaataagcttaagcaccatctaatggagcagcacaacattgaaggcgagatacattccgattatgagatacactgcgacctgaatgggtgcggccaaattttcacacaccgttctaattattcacagcacgtgtattatcgacacaaagattattatgacgacctgtttagatcccagaaagtggctaacgagcggctactgaggagcgaaaaggtgtgccagacagctgacacccagggacacgaacatcagactacaagaagatcattcaatgccaaatcaaagaagtgtggtctgattaaagaaaagaaagcacccatctctttcaagacaagggcagaagcgcttcatatgtgtgttgagcactctgagcatacgcagtatccttgcatggtgcaaggctgcctttctgttgtaaagttggagagtagtatcgtgaggcattataagaggacccatcagatgagcagcgcctatctggagcagcaaatggagaaccttgtggtgtgtgtgaaatacgggactaaaatcaaggaagagcccccaagcgaagccgatccctgtattaaaaaagaagagaatcgctcctgcgaatccgaacgtacagagcattcacatagtcccggtgactcaagcgcccctattcaaaacaccgactgttgccactcaagcgagagggacgggggacagaagggctgcatcgagtctagttccgtgttcgacgcggacactctcctttaccggggaactctgaaatgcaaccactcttccaaaacgacaagtctcgagcagtgtaatatcgtccaaccacccccaccctgcaaaatcgaaaacagcattcccaacccaaatggcacagaaagcgggacttattttacctctttccagttgccattgcctcggatcaaagaatccgagaccagacagcactcctccgggcaggaaaatacagtgaaaaaccccactcatgtaccaaaagaaaatttccggaaacattctcagcccagaagctttgacctgaaaacttacaagcccatgggcttcgagtcgtcattcctgaagtttattcaggaaagcgaggagaaggaggatgacttcgacgactgggagcccagcgagcatctgaccctctccaacagcagccagtcctctaatgatcttactggcaatgtggtggcaaacaatatggttaatgattcagaacctgaggttgatataccacacagctctagtgactctactatacatgagaacctgacagctatcccaccattgattgtggcagagaccaccaccgtccctagcttggagaatttacgcgtggtgttagacaaggcactgacagattgtggggagctggccctgaaacagctgcattatctaagacccgttgtggtgctggagaggagtaaattttccacccctatcctagatttattcccaactaaaaaaacggacgagctgtgtgtggggagcagcta

SEQ ID NO: 238112 - DNA, 4824 bp, Artificial Sequence
  Description of Artificial Sequence: Synthetic coding sequence
atgttctaccatgatctgttttaccgagagttgacgcttttttggtctaagttgcagcgaaggattgatcctagcttagacaccttccttgaaagatgtcggcagtttggcgtgattgctaagacacagcagcatctcttttgtctgattagggtcatccagaccgaagcacaagacgctggcctaggcgtttcgatattactctgtgtacgggctctgcagctgagaagtagcgaggacgaagagatgaaggcttcagtgtgcaaaacaatcgcttgcttactgcctgaggacctggaggtccgaagagcctgccagctgacagagtttctgatcgaaccttcacttgacggcttcaatatgctggaggagctatacctgcagccagatcaaaaattcgacgaggaaaacgcaccagtgcccaattccttgagatgcgaactactcctggcactcaaagcacattggccgtttgatcccgagttttgggactggaaaacactgaagcgccactgtcatcagctgcttggacaggaggcatctgatagcgatgacgacttgtcaggatatgagatgtcgattaatgacacggacgtgttggaatcttttcttagcgattacgacgaaggcaaagaggataagcagtaccgccgtcgggacctgacagatcagcacaaggagaaacgcgataaaaaacctatcggatcctccgagcgctaccagcgatggctgcagtataagtttttctgcctgttgtgtaaaagggaatgcatagaagctaggatattgcatcattcaaaaatgcatatggaggacggaatttacacctgtccggtctgcatcaaaaagttcaagcgaaaggagatgttcgtaccacacgtgatggagcacgtgaaaatgccgccatctagaagagaccgctcaaagaagaaactgctgctgaagggcagccagaaaggcatttgtcccaaatctcctagcgcaatacctgaacagaatcactccctgaatgatcaggccaagggcgaatctcatgagtacgtcacgttctccaaactcgaggactgccatttgcaagatagagacttatacccctgcccgggaactgattgtagtagggtgtttaaacagtttaagtacctgagcgtgcatctgaaggccgaacaccagaacaatgatgaaaacgccaaacactatctcgatatgaagaaccgcagggagaaatgcacctactgccggaggcattttatgtctgccttccacctcagagaacatgagcaggttcattgcggcccacagccttatatgtgtgttagtattgactgttatgccaggtttggaagcgtgaatgaactcctcaatcataagcagaagcacgacgatctacggtacaaatgtgagctgaatggctgcaacatcgttttctccgacctaggccagttatatcaccacgaagcccagcacttcagggatgcctcatacacctgtaacttcctcggttgcaaaaagttttattattctaagattgagtaccagaaccatctgagcatgcacaacgtcgagaattcgaatggtgatattaaaaagagcgtaaagctggaagaatccgcgactggggagaagcaggattgtattaatcagccccacctgctcaaccaaactgacaagtcacatctgccagaggacctcttctgtgcagaatccgccaattctcagattgatacggagaccgctgagaatctgaaagagaactcagattctaattcctcagaccagctttcgcactcctcctctgccagcatgaacgaggaacttatcgacacgctggaccactccgaaacaatgcaagatgtcctcttgtcaaatgaaaaagttttcgggccatcatcgctgaaggaaaagtgttcctccatggccgtctgctttgacggaactaaattcacctgcgggtttgatgggtgcggctcgacttacaaaaacgcacgtggcatgcagaaacacctcaggaaggtgcacccctatcactttaagcccaagaaaatcaaaacaaaggaccttttcccgagcctgggcaatgagcacaatcagacaacagagaaactcgacgccgagccaaagccatgtagcgacaccaatagcgactcacctgacgagggtttggatcacaacatccacatcaaatgtaagcgagagcatcagggttatagcagtgagagctccatttgtgcctctaaaaggccttgcaccgaggacacaatgctcgagctgctgttgcgtctgaaacacctcagtctgaagaactcaattacccacggctcattctctgggagcctgcaggggtaccctagctcaggcgctaaatcccttcaatctgttagtagtatttcggatctgaatttccaaaaccaagatgagaatatgccctcccagtacctcgcacagttggcagcgaagccattcttttgcgagctacagggctgtaagtacgaattcgtcacccgcgaagcgctcctcatgcactaccttaagaagcataactattccaaagagaaggtcctgcagctgaccatgttccagcaccgctacagcccctttcaatgccatatttgccagcggtcattcacaagaaaaactcacctgcgtatccattacaagaacaaacatcagatcggcagcgaccgcgctacgcacaaactgctcgacaacgaaaagtgtgatcacgaggggccttgctctgtggaccggctgaagggcgactgtagcgcagagctggggggagatccttctagtaacagtgagaagcctcactgtcatccaaagaaggatgaatgtagttcggaaacagatttggagagcagctgcgaggaaactgagagtaagaccagtgatatcagttcccctatcgggtcacacagggaagaacaggaaggacgagagggacgtgggtcccgcagaactgtggctaaaggcaacctctgctatatcctgaataagtaccataagccattccactgtattcataagacttgcaattcgtccttcacaaatctgaagggattgatccgtcattatcgtactgtccatcagtataacaaggaacaactctgcctggagaaagacaaggcccgaacaaagcgcgaattggtaaagtgtaaaaaaatcttcgcttgcaagtataaggaatgtaataagagattcctgtgcagtaaagcactcgccaaacattgcagcgactcacacaacctggatcacatcgaggagccaaaggtgctgagtgaggccggatcagcagcgcgtttcagctgcaatcaaccgcagtgtccagccgtgttttatacttttaacaagttgaagcaccatttaatggaacagcacaatatagagggcgagattcatagcgattatgaaattcactgcgatctcaatgggtgtggccagatctttactcatcgatccaattattcccagcacgtgtactaccgacataaggactattacgacgaccttttccgtagccagaaggtggctaatgagcgcctcctcagatctgaaaaagtgtgtcagactgctgatacacagggacatgaacaccagactacaagacggagctttaatgccaaatcaaagaaatgcggattgattaaagagaagaaagccccaatttcatttaagactagagccgaggctctacatatgtgcgtggagcacagcgagcatacgcagtacccatgcatggttcaaggctgcctgagcgttgtcaagctggagtcatctattgtgcgacactacaagcggacccatcagatgagttcagcgtaccttgaacagcagatggaaaacctggttgtgtgcgtgaagtacggaaccaaaataaaggaagaacctccttcggaagctgatccctgcatcaagaaagaggaaaatagatcttgcgagtccgaaagaactgagcacagtcattcacctggggacagtagcgcccctattcagaacaccgactgctgccactcttcagaaagggacggcggacagaagggatgtatcgaaagctcttctgtttttgatgcagacacgctgttatacagaggtactctcaagtgcaaccacagtagcaaaacaacaagtctggagcagtgtaacatcgtgcagccacctccgccttgtaaaattgagaacagtattcctaaccctaatgggaccgaatccgggacgtatttcacctcatttcagctgccactccctcgaatcaaagaatcagagaccagacagcatagttcaggtcaggagaatactgttaagaaccctacgcatgtgcctaaagaaaactttcgaaagcacagccagcccagatcctttgacctgaagacctataaacctatggggtttgaatccagtttcctgaaattcattcaggaatctgaggaaaaagaggatgactttgacgattgggagccgagcgagcacctaactttgtccaactcctcacaatcctccaatgacctgaccggaaacgtggtggcgaacaatatggttaatgattccgagcctgaggtcgacataccacattcgtcctcggactccacaatccacgaaaacctcactgcgatcccgccactcatagtagccgaaaccacaacggtgcccagtttggaaaacttgcgggtggtgttggacaaggcgctaacagattgcggcgagctggcactgaaacaactccattacctgcggccagtggtagtgttggagagatccaaatttagcactccaatcctagatctattccccaccaaaaagactgacgaactttgcgtgggctcttcgtag

SEQ ID NO: 238113 - DNA, 1641 bp, Artificial Sequence
  Description of Artificial Sequence: Synthetic coding sequence
atgttctattatcctaacgtgctgcagcgacacactggctgctttgctaccatctggctcgcggcaactcggggatcaagactagtgaaaagggagtatttgcgggtgaacgttgtgaagacatgtgaagaaattctgaattacgtgctggtgagagtacaacctccccagccgggtctgccgaggcccaggttctctctgtacctgtctgctcagctccagatcggggtgatccgagtgtacagtcagcagtgccagtatctggtcgaagacatacagcatatcctggaacgtctccacagagctcagctgcagatccgaatagatatggaaacagagctaccttctctgctcttgccaaaccacctggccatgatggagaccctcgaagacgccccagaccctttttttggaatgatgtctgttgatcctagattgccgtccccatttgacattccccagataagacacctgctggaggctgccattccagaacgagttgaggaaattccaccagaggtgcctaccgagcccagggaacccgaacgcatacccgtcactgtgttaccaccagaagctataacgatcctggaggctgaacctattcgaatgcttgaaatagagggcgagagggagcttcccgaagtaagtaggcgtgagctggacctattaatagccgaagaagaagctattctgctggagataccgaggttgcccccacctgctccagcagaggtggaaggaatcggagaggccttaggcccagaggagttgagactcaccggctgggagccgggagcactcctcatggaggtgaccccaccagaggaactgaggcttcctgctcctcctagccctgagcgaaggccacccgtgcccccaccgcctcgcagacgacggagaaggagacttctcttctgggataaggagacgcagatttcacccgaaaaattccaggagcagctccagaccagagcacattgctgggaatgccctatggtgcagccaccagaacggacaattcggggacctgctgagttgttccggactcctactctgagcggatggctccccccagaattactgggattatggacccattgcgctcagcctccgccaaaggctctgcgaagggaactccccgaagaggccgctgctgaggaggaacgacgcaagatcgaagtgccctctgaaatcgaagtgccgagggaagctctcgagccatccgtcccactgatggtgtcattagaaatcagtctggaggccgcagaggaggagaaaagtcgtattagtttgattcctccagaagagcggtgggcctggcctgaggtggaggctccagaagcacctgccctgccggtggtgccagagctgccggaagtccctatggaaatgcctctcgtgctaccccctgagctggaacttttgtcactcgaggctgtgcaccgcgctgtggccctggagctccaggctaacagagaacctgactttagctccctggtctctccattatcacccaggcgtatggccgctcgcgtgttttaccttcttcttgtgctgtcagcacaacaaatactccacgtgaagcaggagaaaccctatggccgtcttttgattcagcccggaccgaggttccattag

SEQ ID NO: 238114 - DNA, 1590 bp, Artificial Sequence
  Description of Artificial Sequence: Synthetic coding sequence
atgttctattatccaaatgttttacaacggcatacgggatgctttgcaaccatttggctggcagcaacacgcggttctaggttagtcaagcgggagtacctccgcgttaatgtcgttaagacctgcgaggagatacttaattacgtcctagtccgagtgcaacctccccaaccaggcctgccacggcctaggttctcactttatctgtctgcacagctgcagatcggcgtgatcagagtgtacagtcagcagtgtcaatacttggtggaggatattcagcacattctggagaggctccacagggcacagctgcaaattcggatcgatatggaaaccgaattaccgtctctacttttacctaaccacctcgcaatgatggaaacactggaagatgctcctgacccgtttttcggaatgatgagtgtcgatcctcggctgccctcacccttcgatatccctcagattcgccatctgctcgaagccgctatccccgagcgcgtcgaggagattcctcctgaggtccccaccgagcccagggaaccagaacgaatccccgtcacagtgctgcctcccgaggcgatcaccatccttgaggcagagcctatccgtatgcttgagatcgaaggggaacgggagctgcccgaggtatctcggagagaattggatctactgattgctgaggaggaagctattctcctcgaaatacctaggctgcccccacctgctcccgcagaggtagaaggaattggagaggccctggggcctgaagaactgagactcacaggctgggagcccggtgcgttgttaatgcgacggcctcctgtaccaccacctccaaggcggcgacgacgcagaaggctgctgttttgggataaagagacacaaatctctcctgaaaagtttcaggagcagctacagaccagagctcactgctgggagtgtcccatggtgcagccacccgagcggaccattagggggccagctgaactattcaggacccccactctgagcggctggctgcctcctgaactgctcgggctctggactcactgcgcccagccccctccaaaggctctgcggagggagttgccggaggaggccgcagctgaagaggaaaggcgcaaaattgaagtacctagcgaaattgaagtgcccagggaggccttagaaccttctgtgccgcttatggtgtcactcgagattagcctcgaggcagctgaagaggaaaagagcagaattagcctcattcctccagaagaacggtgggcctggcctgaggtcgaagctcctgaagcgccagccctgcctgtggtgccggaactgccggaggttcccatggagatgccacttgtcctgcccccagagttggaactgctatccctagaggccgtccacagagcagtggctctggagcttcaggccaaccgtgaaccagacttcagcagcctggtgtcacccctcagcccgcgaagaatggccgcaagggttttctatctcctacttgtgttgagcgcccagcaaatactgcacgtaaagcaggagaaaccctacgggcgactcctaatacaaccagggccaagattccattag

SEQ ID NO: 238115 - DNA, 225 bp, Artificial Sequence
  Description of Artificial Sequence: Synthetic coding sequence
atgttttactaccctaatgtgcttcaacgtcacacgggctgcttcgcgacaatctggttggccgctacccgcggttccagacttgtgaaaagggaatacctacgggtgaatgtcgtcaagacctgtgaggagatcctgaattacgtactcgtacgcgtgcaacctccgcagccaggactgcctcgcccacgattctccctgtatctctctgcacagctgcagtag

SEQ ID NO: 238116 - DNA, 1641 bp, Artificial Sequence
  Description of Artificial Sequence: Synthetic coding sequence
atgttttactatcccaatgtcctgcagaggcacacaggatgtttcgctacgatttggctggcagcaacacgaggttcaaggcttgtcaaacgagaatacttgagggtgaacgtagtgaagacttgtgaggagatcctgaactatgtactcgttcgggtgcagccgcctcagcccggtctacctcgcccacgatttagtttatatctcagcgcccaactgcagattggagttatccgcgtgtatagccagcagtgtcagtatctcgttgaagacattcagcacatcctggagcggttgcatcgcgcacagctgcaaataagaatagacatggagactgaactcccttccctccttcttcccaaccatctcgccatgatggaaacactggaagacgctcctgacccattcttcgggatgatgtccgtggatcccagactgcccagccctttcgatattccccagattcggcacttactggaggcagctataccggagcgggtggaagagattcccccagaagtgccaacagagccaagagaaccagaacgtatccccgtaacagtgctaccacctgaagccatcacaattctggaagccgaaccaattaggatgctggaaatagaaggagaacgagaactgcccgaagtatctcggagggagctagatcttctaatcgccgaagaagaagctatactcctggagatcccaaggctgcctccaccagcgcctgcggaggtggaaggtattggagaggctctcggaccagaagaacttagactgaccggatgggagcccggagccctcctgatggaggtgaccccacccgaggagctcagactgcccgcacctccatctcccgaacggcgtcctccagtgccacctcctccacggaggagaaggaggaggagactattattttgggacaaagaaacgcaaatttcccccgagaaatttcaagagcaactgcagactcgagcacattgctgggagtgtcccatggtgcagccacctgagaggactataagggggcctgccgagttattccggacaccgacactctccggctggctacctcctgagcttctgggtctgtggacacactgtgctcagccccctcccaaagctctgcgtcgcgaacttccagaggaggccgcagcggaggaggagcggaggaaaatcgaagtgccgagcgagattgaggtccccagagaagccctggaaccatcggttccactgatggtgagcctggagatctcgttagaagcagcagaggaagagaaatcccgtatttccttgattccacctgaagaaaggtgggcttggcctgaggtggaggcccctgaagctcccgctctgcccgtggttcctgaacttcctgaggtgcccatggagatgccgttagtcctgcctccagaattggagctgctgtcgcttgaagcggttcacagagcggtggctttggagctacaggccaacagagagccagatttcagctccttagtcagccccctgtctccacgcagaatggcagcccgagttttttatctgctgcttgttctatccgctcagcagattctgcacgtgaagcaggagaaaccatatgggaggctgttaatccagcccggacccaggtttcactag

SEQ ID NO: 238117 - DNA, 699 bp, Artificial Sequence
  Description of Artificial Sequence: Synthetic coding sequence
atggccggagatacagaagtgtggaagcagatgttccaggaactgatgcgcgaggtgaaaccatggcatcgatggacacttagaccagataaggggctgctgcctaatgtcttgaaacccggatggatgcaataccagcagtggaccttcgccagattccagtgttcatcctgctcacgaaattgggcttccgcacaggtgctcgtccttttccacatgaactggtcagaagaaaagtctcgtgggcaagttaagatgcgcgtgttcacccagcgatgcaaaaaatgtcctcaaccactcttcgaggatccagagttcacccaggagaacatctccaggatcctaaaaaatttggtgttcagaatccttaagaaatgctaccgagggagatttcaactaattgaagaggttccgatgattaaagacatctcattggagggtccacacaactccgacaattgtgaagcatgcctgcagggattttgtgcgggaccaatccaggtgacctcacttccacctagccagacacccagggtacattctatttacaaggtggaagaagtggtcaagccctgggcctccggagagaacgtgtacagctacgcttgtcaaaaccatatctgcaggaatttaagtatattctgctgctgtgtgatcctgattgttatcgttgtgattgttgtgaagaccgcgatttag

SEQ ID NO: 238118 - DNA, 741 bp, Artificial Sequence
  Description of Artificial Sequence: Synthetic coding sequence
atggttgtcgatttttggacatgggagcaaacgtttcaggagctgatccaggaggcaaagccacgggcaacctggaccttgaagcttgatggcaacctccaactggattgcctggcacagggttggaagcagtaccagcagagggccttcggctggtttaggtgtagcagctgtcaacgctcctgggcgtccgcccaggtccagattctgtgtcatacgtattgggaacattggacctcccagggccaggttcgcatgcgacttttcggacagcgttgtcaaaagtgcagctggagccagtatgaaatgcctgagttctccagcgatagcacaatgcggattctgagtaacttagttcagcatatcttgaagaaatactacggaaacggcaccagaaagtcccctgaaatgccagtcatcctcgaggtaagtctggagggatcccatgacaccgccaattgtgaagcctgtactctgggcatttgtggtcagggactaaagtcctgcatgactaagccgtccaaaagcctactcccccatctgaagacgggaaattcttccccgggaataggcgcagtgtatctcgcaaaccaggctaaaaaccagtccgccgaggcaaaggaagccaaaggttccgggtacgagaagttgggtccaagcagagatccagatccgctgaatatctgcgtttttatcctgctgttagtttttatcgtagtgaaatgtttcaccagtgagtag

SEQ ID NO: 238119 - DNA, 447 bp, Artificial Sequence
  Description of Artificial Sequence: Synthetic coding sequence
atggccagggctctctgccgcctgccacgaaggggcctctggctcctcctagctcatcacttgtttatgactactgcatgtcaagaggccaactacggtgccctgttaagagagctgtgtcttacccagtttcaggtggacatggaggctgtcggtgagactttgtggtgtgactgggggaggacaatcagaagttatcgtgagctagctgactgtacatggcacatggccgagaaattaggctgcttctggccaaacgccgaggtcgaccgcttttttcttgcggtgcacggaagatactttaggtcttgcccaatttctggcagagcggtacgggaccccccaggcagtattctgtatccgttcattgtggtgcctattacagtgacgttgctggtgacggctcttgtggtgtggcagagtaagagaactgaggggatcgtgtag

SEQ ID NO: 238120 - DNA, 381 bp, Artificial Sequence
  Description of Artificial Sequence: Synthetic coding sequence
atgacaaccgcatgccaggaagccaattatggtgccctgcttcgcgagctttgcctaactcaattccaggtggatatggaagccgtcggtgagactctttggtgtgattgggggcgaaccattcgctcttacagagaacttgccgattgcacatggcatatggcggagaaactcggctgcttctggccaaatgccgaggtagaccgattcttccttgccgtgcatgggagatacttccgctcctgccctatctctggacgggctgtgagagaccctccaggctccattctgtaccccttcatcgtcgtgcccatcaccgtgaccctgttggttactgcactggtagtgtggcagtctaagcgtaccgaggggatcgtgtag

SEQ ID NO: 238121 - DNA, 381 bp, Artificial Sequence
  Description of Artificial Sequence: Synthetic coding sequence
atgacaacagcttgtcaggaagcgaattacggggctttgttgcgagaactttgtctgacacagtttcaggtggatatggaggccgtgggcgaaactctgtggtgtgattgggggaggaccatccgcagctaccgggagcttgcggattgtacttggcacatggccgagaaacttggatgtttctggcctaatgctgaagtagatcgattcttcctggctgtccacgggaggtacttcagatcctgcccaatttcgggcagagctgtgcgggatccgcctggctccattctttatccatttatcgtcgttcccatcaccgtgaccctcctggtgaccgctctggtcgtctggcagtctaaaagaacagaagggatcgtttag

SEQ ID NO: 238122 - DNA, 381 bp, Artificial Sequence
  Description of Artificial Sequence: Synthetic coding sequence
atgaccacagcctgtcaagaagcaaactacggagccctgcttagagagctgtgccttacacaatttcaggtcgacatggaagccgtgggagaaacactctggtgcgactggggcaggacaatccgttcctatcgcgagctcgccgactgcacctggcacatggctgagaaactcggatgcttctggcctaacgctgaggttgatcgcttctttctggccgtgcatggcagatacttcaggtcctgccctatttctgggcgtgccgtgcgcgatcccccaggctccatcctgtatcccttcattgtggtccctatcacggttaccctgcttgtgactgctctagtagtctggcagtccaagcgcaccgaaggcatcgtgtag

SEQ ID NO: 238123 - DNA, 528 bp, Artificial Sequence
  Description of Artificial Sequence: Synthetic coding sequence
atggcttccctgcgagttgaacgtgctggaggaccacgcctccccagaacacgggtcggtcggccagccgcactccgccttctgctcttgcttggcgcagtacttaacccgcacgaagcgctggcacaacctttacccactactggcacccctggcagcgaagggggtacagtgaaaaactacgaaactgccgttcagttttgctggaatcattataaagatcagatggatccaatcgagaaggactggtgtgattgggcaatgatcagcagaccatattcaaccctcagagattgcctggagcattttgcggaactatttgacctcgggttccctaatcccttggccgaaaggattattttcgagacccatcagatacacttcgctaactgttctttggtccagccaacctttagcgatccacctgaggacgtgctgctcgccatgatcatcgcccctatatgtcttattccattcctgatcactctggtcgtttggcgctcgaaggacagtgaagcccaagcatag

SEQ ID NO: 238124 - DNA, 447 bp, Artificial Sequence
  Description of Artificial Sequence: Synthetic coding sequence
atggaaaccggcgctctgagaagaccacagctgctgccactgttactgctcctctgcggaggatgtccacgcgctggcggttgtaacgagactgggatgttggaacggcttccactgtgtgggaaagcttttgcagacatgatgggcaaggtcgatgtgtggaaatggtgcaacttgtccgaattcattgtgtactacgagagctttaccaattgtacagaaatggaagcgaacgtagtcggctgctattggccgaatcccctcgcacaggggtttattactgggatccaccgacagtttttctctaattgtacagtggaccgagtacacctcgaggacccgcctgacgaggtgctgatacccctgatcgtcatccctgtggtgctcactgtggcaatggctggcctcgtggtgtggcgctcaaaacgtacagatacactgctctag

SEQ ID NO: 238125 - DNA, 447 bp, Artificial Sequence
  Description of Artificial Sequence: Synthetic coding sequence
atggaaactggagccttgagaagaccacaactgctcccattattactactgctctgtgggggttgtccccgagctggtgggtgcaatgagactggaatgctcgaacggttacccctgtgcggaaaagccttcgccgatatgatggggaaagtggacgtctggaagtggtgcaacctgagcgagtttattgtgtactacgaaagtttcaccaactgtacggagatggaggccaacgtggtgggctgttactggcctaatccacttgcccaggggttcataacgggaattcataggcagttcttcagtaactgcacagtagatcgtgtgcacctggaggatcctcctgacgaagtgcttattcctcttattgtcattccggttgtgctaacagtcgcaatggcaggtcttgtggtttggagatctaaacgcacggatacactgctctag

SEQ ID NO: 238126 - DNA, 456 bp, Artificial Sequence
  Description of Artificial Sequence: Synthetic coding sequence
atggagacaggggcactgcggcgtccacagcttcttcctctgttgttactgctatgtggcggttgtccccgtgctgggggatgcaacgagaccggtatgttggagcgccttccactttgcggaaaggccttcgctgatatgatgggcaaagtggatgtgtggaagtggtgtaacctcagcgagttcattgtatactacgaaagcttcacaaattgcactgaaatggaagctaatgtcgtcggttgctactggccgaatccgctcgcacaaggtttcatcacagggatccatagacagttcttctccaattgtactgtggacagggtacatctcgaagaccctcccgacgaggtgctgataccactaattgtgatacctgtggtcctgactgtcgcgatggccggattggtggtctggcggtcgaaacgaactgacacactcctttgcggcaactag

SEQ ID NO: 238127 - DNA, 606 bp, Artificial Sequence
  Description of Artificial Sequence: Synthetic coding sequence
atggtgtcctggataataagtcgtctggttgtgctcattttcggcaccctgtatcccgcatattacagctataaagcagtcaagtctaaggatatcaaagaatatgtgaagtggatgatgtactggatcatttttgccttgttcaccaccgcagagacgttcactgacatctttctttgttggtttcctttctattatgaactgaaaattgcctttgtggcgtggttactgtcaccctacactaaaggttcgtctctactctaccgcaagttcgtccaccccactctgagcagtaaagagaaggaaatagacgactgtttagtccaagccaaagacaggtcttatgatgctcttgtgcattttggcaagcgcggactgaatgttgcagctaccgctgctgtgatggcagcctctaagggccagggggcactttcagaaagactaagaagtttcagcatgcaagatctgaccacaatccgcggagacggagctccagcacccagcggcccacccccacccggtagcggtcgagcgtccggcaaacacggccagccaaagatgtctcgttctgcgagcgaatcagcttcatcgagtggtacagcatag

SEQ ID NO: 238128 - DNA, 525 bp, Artificial Sequence
  Description of Artificial Sequence: Synthetic coding sequence
atggatcacctgcaggctggcggagttaagtggatgatgtactggattattttcgcactgtttaccaccgccgaaacattcaccgacatcttcttgtgctggttcccgttttattacgagctgaaaattgcattcgtggcttggctgctgtcaccttacacgaagggatccagtttgctctacaggaagtttgtacaccctactttgagtagtaaggaaaaggagatcgacgactgcctggtccaggctaaagatcgtagttacgatgctttggtccatttcgggaagcgcggtctgaatgttgcggctaccgccgctgtcatggccgcaagcaaggggcagggcgctctgtccgaacgactccggtcattcagcatgcaagatctcaccaccatcaggggcgatggcgctcctgcccctagcggcccaccaccgcctggcagtggaagagcaagtggaaagcatggtcagccgaagatgagtcggagcgcctctgaatcggcttcatccagcggaacggcttag

SEQ ID NO: 238129 - DNA, 627 bp, Artificial Sequence
  Description of Artificial Sequence: Synthetic coding sequence
atgcagaaggtactgtctaatggccagactgaagaggtgagaagcgggtcccgcctcatctttggcacactgtaccctgcgtattattcatataaagctgtcaaatcaaaggacatcaaagagtatgtgaaatggatgatgtactggatcatattcgccctgttcaccaccgctgaaacattcactgatatcttcctttgttggtttccgttctactatgaactgaagatcgcattcgtcgcgtggttgctgtccccctacaccaaaggatcttcccttctttatcggaaattcgtccacccaacgctgagtagcaaggagaaggagatcgatgattgtctggtccaggcaaaggaccgctcttacgatgctctggttcactttggcaagcgaggattgaacgtggctgccactgccgcagttatggctgcttcaaaggggcagggcgcactgagtgagcggcttcggtcctttagcatgcaggatttgaccactattcgcggagacggagctcctgcaccttccgggcctccaccacccggatccgggagggcctctgggaagcacgggcagccaaagatgtcgcggagcgcttcagagtctgcttcaagctccggcacggcctag

SEQ ID NO: 238130 - DNA, 543 bp, Artificial Sequence
  Description of Artificial Sequence: Synthetic coding sequence
atgtcactgcatccttgtcgactcaataatctaccaaatcaagtaaaatggatgatgtactggattatcttcgcactgttcactaccgcagagactttcacggacatcttcttgtgctggtttcccttctactacgagctgaagattgcattcgtggcttggctgctgtctccttacacaaagggaagttccctgctgtaccggaagttcgtccatccaaccctgtcatccaaggaaaaagaaattgatgattgcctggttcaggccaaagataggagctacgatgctctggtacacttcggtaagagagggctcaatgttgctgctactgcggcagtgatggccgcttctaaggggcagggagctttatcagagcgtttacgctccttttctatgcaggatttaacaacgattagaggcgatggtgcccctgccccaagtggcccaccccctcctggcagcggaagggcatcggggaagcacggccaacccaaaatgtctcgcagtgcttccgagtcagcatcctctagcggaactgcgtag

SEQ ID NO: 238131 - DNA, 432 bp, Artificial Sequence
  Description of Artificial Sequence: Synthetic coding sequence
atggtgtcttggattatttcccggttggtcgtgctgatcttcgggaccctgtaccccgcttattattcctataaggctgtcaagagcaaggatatcaaggagtatgtgaaatggatgatgtattggatcatcttcgcactctttaccacagcagagacgtttactgacatttttctgtgctgggatcgggtgccctaccggcgagactgcggagcctcggcatgtagaacaagccctcctagcggcgaaaccgcccctctgctaccccgagcaccgcatcatcgagggctcggaggacccgcagcaaacactgcaagcctacgatgtcccggtgttttgctgagggctctggccgctcaagcgccaccgagaattctccgctctcgttttcgcaagaagtcaacttcatccagcgctactgaaaccacgtag

SEQ ID NO: 238132 - DNA, 759 bp, Artificial Sequence
  Description of Artificial Sequence: Synthetic coding sequence
atggttagttggattatttctcgcctagtcgttctaatcttcggaacactgtaccccgcatacagctcgtacaaagctgtcaagacaaaaaacgtcaaagaatacgtgaaatggatgatgtactggattgtcttcgccttctttaccacagccgaaacgcttactgacattgtgctgtcttggttccccttttatttcgaacttaaaatcgccttcgtaatatggttgttatcaccttacactaagggtagtagtgtgctatataggaaattcgtgcacccgaccctttccaacaaggagaaagagatagacgagtatataactcaggctagagacaagagctatgagaccatgatgagggttggaaaacgcggtttgaatctggcggctaacgccgctgttacggctgctgccaagggcgttctctctgagaagctcagaagttttagcatgcaggatctcactctcatccgagacgaggacgcgcttcccctgcagcgccctgatggaaggctaaggccctcacccggttcattattggacaccattgaagatcttggtgacgaccccgctctatcactgcgatcaagcaccaaccccgcagattccaggacagaggcctctgaagatgatatgggcgacaaagcacccaagagagccaaacccatcaaaaaggcacccaaagcggagcccttggcttctaagactctgaaaactaggccgaagaaaaagacaagcggtggtggcgattcagcttag

SEQ ID NO: 238133 - DNA, 765 bp, Artificial Sequence
  Description of Artificial Sequence: Synthetic coding sequence
atggtctcatggatcattagccggctggtcgttcttatctttgggacactgtatcccgcatattcttcgtacaaggcagtgaaaactaagaacgtgaaggaatacgtcaaatggatgatgtactggatagtgtttgcgttcttcaccacagccgaaacactgacagatatagtcttatcctggtttccgttctacttcgaattaaagatcgcctttgtgatctggctcctcagcccgtatacaaaggggtcctccgttctgtaccgtaagttcgttcatcccacactgagcaataaagaaaaagaaatagatgagtatatcacccaggcgagagacaagagctacgagacaatgatgcgcgttggaaagagaggcctgaacctggccgctaacgcagccgttacagccgcagcaaagggtcagggagtcctgtcagagaagctgcggtcatttagtatgcaggatctaacactgataagggatgaggacgctttgcctctccagcggcctgacgggcgtctgcggcctagccccggaagcctgctcgatacaattgaggacctgggggatgatcccgcattatccctgcggtcctctacgaatccggcagacagcaggacggaggccagtgaagatgacatgggcgacaaagcccctaaacgagctaaacccatcaagaaggcccctaaggccgagccgctggcgagtaaaacactgaaaaccagaccaaagaagaagactagcggaggaggagactctgcatag

SEQ ID NO: 238134 - DNA, 723 bp, Artificial Sequence
  Description of Artificial Sequence: Synthetic coding sequence
atgctgtatccagcgtactactcatacaaagccgtcaagaccaagaacgtgaaagagtatgtgcggtggatgatgtactggattgtttttgcactgtacaccgtcatcgagaccgtcgccgaccagactgtcgcctggttccccctttactatgagcttaagattgcctttgttatttggttgttgtcgccatatacaaagggcgcttccctaatttatcgcaagttcctgcatcccctgctgtcctctaaagaaagggagatcgacgattacattgtacaggcgaaagaacgcggttacgagactatggtcaatttcgggaggcagggtctcaacctggctgctaccgcagccgtaaccgccgctgtgaaaagccagggtgctataaccgagaggctccgtagcttctctatgcacgacctgaccactatccagggagacgagcctgtaggccagcggccatatcagccactgccagaagcaaaaaagaagagcaaacccgcaccatccgaatctgccggatatggcatacccctgaaggacggtgacgaaaaaactgatgaagaggccgaaggcccttactccgacaacgagatgctgactcataagggcctgcgacgatcccagagcatgaagtcggtcaaaaccactaaggggaggaaagaagtgcggtacggttccctgaaatacaaggtgaaaaagaggccacaggtctacttctag

SEQ ID NO: 238135 - DNA, 768 bp, Artificial Sequence
  Description of Artificial Sequence: Synthetic coding sequence
atggtttcctggatgatttctcgagccgtcgtgctcgtcttcggcatgttataccccgcatactacagctataaggccgttaaaactaagaatgttaaagaatatgtaaggtggatgatgtactggattgttttcgctctgtataccgtcatcgaaaccgttgctgatcagaccgtggcctggttccctttgtactatgaactgaagatcgccttcgtcatttggctcctaagcccatacaccaagggggcatccctgatctatcggaagtttcttcatccactcttgtcaagcaaagaacgggagattgatgactacatcgtccaggctaaagagcgcggatatgagaccatggtgaattttggtcggcaaggactgaacttggcagctactgctgccgtgaccgcagccgtcaagtctcagggggctattactgaaaggctacgatctttttccatgcacgacctgacaacgattcaaggagatgaaccggtgggccagcgtccgtatcagccactgccagaggctaaaaagaaaagcaaacccgcacccagtgaaagcgccggatacgggattccgctgaaggatggagatgagaaaactgacgaggaagccgaaggcccatactctgacaatgagatgctcactcacaaaggactgagacgcagccagagcatgaaatcggtcaagactaccaaagggaggaaagaagtccggtatggctccctgaagtacaaagtgaaaaagcggcctcaagtgtacttctag

SEQ ID NO: 238136 - DNA, 774 bp, Artificial Sequence
  Description of Artificial Sequence: Synthetic coding sequence
ctcatgatgtggctcctcgtagaacgagctctgatccagctggtattcggtatgctttatcccgcatactatagctataaggcagtcaaaactaagaacgtcaaggagtacgttcgctggatgatgtattggatagtatttgccctttacacggtgatcgagacagtcgcggatcagactgtggcgtggttcccgctgtattacgaactaaagattgccttcgttatatggctcctctccccttacaccaaaggggcttccctaatttaccggaagttcttacacccattgttaagttctaaggaaagggagattgatgactatattgtgcaagccaaagagagaggatatgagaccatggtgaatttcggccgacagggtctcaacctggcagcgacagcagcagtgaccgccgctgttaagtcgcagggcgcaattactgagagactgagaagcttctccatgcacgacctcaccacaatccaaggagacgaacctgttgggcagcgcccttatcagccattacctgaagcaaaaaaaaaaagtaaacctgccccaagtgagagcgccggatatgggattccactgaaggacggcgatgaaaagacggacgaggaggcagaagggccatacagtgacaatgaaatgctgacccacaaggggctgaggcgttcacagtccatgaaatccgttaagaccaccaagggcagaaaagaggtcaggtacgggagccttaagtataaggtgaagaagcgaccccaagtatatttttag

SEQ ID NO: 238137 - DNA, 774 bp, Artificial Sequence
  Description of Artificial Sequence: Synthetic coding sequence
atggtgtcatggatgatttgcaggcttgtggtacttgttttcggcatgctgtgtcctgcatacgcaagttacaaggctgtgaagacaaaaaatatacgggagtatgtccggtggatgatgtactggattgtattcgcgctgttcatggcagctgagattgttactgacatcttcattagttggttccctttttattacgagataaaaatggcatttgtcctgtggctgctcagcccttatactaagggcgcttctctgctctacaggaagtttgttcatccttcactgagccgccatgagaaggagattgacgcttacattgtgcaggcaaaggaaaggagctacgaaaccgtgctctcattcggcaagagaggcctcaacatagctgcgtcagccgctgtccaggcagcaactaagtcccagggggctctggccggacgactgcggtccttttctatgcaagacctgcgaagcatctccgacgcgcctgcccctgcataccacgaccccctctacttggaggatcaggttagtcaccgccgtccaccaattggctatagagcaggcggtctccaggacagcgatactgaggatgaatgctggtccgacacggaagctgtccccagagctccagcaaggccacgcgaaaagcccctcattcgctcccagagtctacgggtggtgaagaggaaacccccagtccgagagggaacatcccgttccctgaaggttcggactagaaagaaaaccgtaccaagcgatgtagactcatag

SEQ ID NO: 238138 - DNA, 522 bp, Artificial Sequence
  Description of Artificial Sequence: Synthetic coding sequence
atggtttcttggatgatttgcaggctggtcgtgttagtgttcggcatgctatgtcctgcctacgcatcctacaaggctgtgaaaaccaagaacatccgagaatacgtacggtggatgatgtactggattgtgtttgccctctttatggcagcagagattgtgaccgacatcttcatctcctggttccctttctactatgagattaagatggctttcgttctgtggctgctcagtccttataccaaaggcgcaagtctgctgtacagaaaatttgttcatcccagcctgagcagacatgaaaaagagattgatgcctatatcgtacaggctaaggagcgaagctatgagactgtgctgagctttggcaagcggggtctgaacatcgcggctagcgccgcagtgcaggccgctactaaaggcacagggcctggagcatgtcggaccgctacaccgagaatgagcgttggacagatcctgagacagtctcccggtagacagccaggtccagagagatctccatag

SEQ ID NO: 238139 - DNA, 570 bp, Artificial Sequence
  Description of Artificial Sequence: Synthetic coding sequence
atgagtgccgcaatgcgtgaacggttcgaccgtttcctccatgagaaaaattgcatgacggatctcctggccaaactagaggccaagaccggcgtaaaccgatccttcattgctctgggggtcattggactcgtcgccctctacttagtcttcgggtatggggcatcacttctgtgcaatctcatcggattcggctaccccgcttatatctcaattaaggcaatcgagtcaccaaacaaagaggacgacacccagtggttgacctactgggtggtctacggcgtcttctccattgccgagttcttttcagatatctttctgagttggtttccgttttactacatgcttaaatgtggattcttgctttggtgcatggccccatcaccaagtaacggcgcagaacttttgtacaaacggattatcaggccctttttcttgaaacacgaaagccagatggacagtgtagtaaaggacttaaaagataaagccaaggagaccgccgatgcgattactaaagaggccaaaaaggccacggtaaatctactcggtgaagagaaaaagtccacatag

SEQ ID NO: 238140 - DNA, 396 bp, Artificial Sequence
  Description of Artificial Sequence: Synthetic coding sequence
atgtccgccgctatgagggagaggtttgatcgtttcttgcacgaaaaaaactgtatgacggacttgctcgccaagctggaggctaaaacaggagtcaatcgctcctttatcgctctgggcgtgatcgggctggtcgcactttatctggtttttggatatggcgcttcgctcctttgcaacttgattggtttcggttaccctgcctacatttctatcaaagctatcgaaagccctaataaggaggacgatactcagtggttgacctattgggtggtctatggcgtgttctctatcgcagaattcttctcagatattttcctcagttggtttccattctattatatgctgaaggtgtggtcaggattgggttttctcctgcccaggtgtcttctgtag

SEQ ID NO: 238141 - DNA, 1413 bp, Artificial Sequence
  Description of Artificial Sequence: Synthetic coding sequence
atgcacttttcaatcccagagacagaatctcggtccggggattctgggggatctgcttacgtggcctataatattcatgtcaacggagttctgcattgtagggtcagatacagtcagttactcggcttgcacgagcaactgcgaaaagagtatggcgctaatgtgctgccagcatttcctcctaagaaactgtttagtctcacgcctgctgaggttgagcagaggcgggagcagctcgagaaatatatgcaggccgtaaggcaagaccctctgctggggtcatctgagacttttaattcctttcttagacgcgcacaacaagaaactcagcaggtgccaactgaggaggtttcactggaagtgctcttatccaacggccaaaaggtgctggttaatgtcctcacttcggatcagactgaagacgtgctcgaagccgtggctgccaaactagatttgcctgatgacttgatcggatacttttctctgttcctcgtgcgcgagaaggaggatggcgctttcagcttcgtaagaaagcttcaggagttcgagctgccctacgtttccgtgacctctctccggtctcaggagtacaaaatcgtcttgcggaaatcctactgggattccgcctatgatgacgacgtaatggaaaatcgggttggcttgaacctcctgtacgctcaaactgtttctgatatagagagaggatggattcttgtgacaaaagagcagcatcggcagcttaaatctttgcaagaaaaggtgagcaagaaagagttcctccgccttgctcagactctgcgacattacggctatttacggtttgatgcttgtgtcgccgacttcccagagaaggattgccctgttgtggtgagcgctgggaatagtgagctcagcctccagttacggcttcctggccaacagctgagggaaggcagcttcagagtgactagaatgcgctgctggcgcgtgacgagttccgtccccctgccatcaggatcaaccagcagccccggacgaggcagaggagaagtgagactggagctggcgtttgagtatctgatgtctaaagaccggctgcagtgggttaccattacctcacctcaagcaatcatgatgtccatttgcctgcaaagcatggtggacgagctgatggttaaaaaatccggaggatccatccggaaaatgctgcggcgaagggtggggggaaccctgcgtaggtctgattcccaacaggctgtgaaaagcccaccattactcgaatctccagatgctaccagggagagtatggtgaagctcagtagcaaattatctgcagtaagccttcgcggaatcggatccccatccaccgatgcaagtgccagtgatgtgcacggcaatttcgcgttcgaagggataggcgatgaagacctctag

SEQ ID NO: 238142 - DNA, 2814 bp, Artificial Sequence
  Description of Artificial Sequence: Synthetic coding sequence
atgcaccgccctcggcgtcggggtacccgacctcctctgctcgccctactggctgccctgctgctggctgccaggggtgccgcagcccaggaaactgaactatccgtgtccgcggagttagtacccacgtcatcttggaacatttcgagtgagcttaataaggactcatatctgacactggacgagcccatgaataatataactacctcattgggccagaccgccgagctgcactgcaaggtgtcaggaaaccctcctccgacaatcaggtggttcaaaaatgatgctccagtggtgcaggagcctagacgcctttccttccgctcaacaatctatggatcccgcttgaggattcggaacttggatacgactgacacaggatacttccagtgtgttgcgacgaatggcaaagaagtcgtctcgtcaaccggggtactctttgttaaatttggcccacctcccaccgcttctccaggctactccgatgagtacgaggaagacgggttttgccagccatatcgcggaattgcctgcgccagattcataggtaatcgtacggtgtacatggagtcccttcacatgcagggtgaaatcgagaatcagatcactgcagcctttacgatgattgggaccagctctcatctgtccgacaagtgctctcaattcgccataccttctctatgccactatgcattcccttactgtgacgaaacctcttccgtccccaagccacgcgacctctgtagggacgaatgcgagatcttagaaaatgtcctgtgccagacagagtacatctttgcacgcagtaatcccatgatcctcatgcgcctcaaacttccgaattgcgaggacctgccgcaaccagagtccccagaagctgcaaactgtatcaggatcgggatccccatggcagatcctatcaataaaaatcataaatgttacaattctaccggggttgattaccgagggaccgtttctgtgaccaagagtgggaggcagtgccagccctggaatagtcagtaccctcacacacacacatttacagcactcagattcccggagcttaacggcggacacagctattgtaggaacccaggaaaccagaaggaggcgccatggtgctttactcttgacgagaattttaaatcagacctgtgcgatatacccgcttgtgattctaaagattcgaaagagaaaaacaaaatggagattctctacatcctggtgccaagtgtggcaatccccctcgctatcgccctgctcttctttttcatatgtgtttgtcggaacaaccagaaatcctcatctgcccctgtgcagagacagccgaaacacgtccgtggccagaacgtagaaatgagcatgctgaacgcatataagccgaaaagcaaagcgaaagaactgcctctatctgccgtgcgcttcatggaagagctcggggagtgcgccttcgggaaaatatacaagggccacttgtaccttcctggtatggaccatgcacagctggtggcaatcaaaactctgaaggattataacaatcctcagcagtggaccgagttccagcaggaggcgtcactgatggccgagctgcatcaccccaatatagtctgtctgttgggagccgtgacccaagagcagcctgtgtgtatgctttttgaatacatcaatcaaggagatctacacgagttccttataatgcgaagcccacacagtgacgtgggatgttctagcgatgaggacgggaccgtgaaatcaagtttagaccatggggacttcctgcacatcgcaatccagatagcggctggtatggagtacctgtcctcccacttttttgtgcacaaggatctggccgctcggaacatcctaataggagaacaactgcatgtcaagatctcggacctcggcctgagccgggagatatatagcgccgattactaccgagtgcagtccaagtcacttctacccatcaggtggatgccccctgaggcgattatgtacggaaagtttagctccgactccgatatctggtctttcggcgtggtgctctgggaaatcttcagctttggccttcaaccttattatgggttttctaaccaggaggttatcgaaatggtgagaaaacggcagttattgccctgttcagaggactgtcccccacgtatgtatagcctgatgactgagtgctggaatgagataccgagccggaggcctcgcttcaaggacattcatgtgcgtttgcgatcttgggaaggactgagctcccatacctcatcaacaacaccctccgggggaaacgccacgacccaaacaacaagcctctccgcctctccggtgtccaacctgtccaatcccaggtacccaaactacatgtttccctctcagggtattacaccgcaaggacaaatcgctggttttataggcccaccgataccccagaaccaaagattcatcccgataaatggttaccctattccccctggttacgcggcattccctgccgctcattaccagccaaccggtcctccgagagtaatccaacactgcccccctccaaagtctcgaagcccatcttctgcttctgggtctaccagtaccggacacgtgactagcctcccttctagcggttccaaccaagaggcgaatatacccctccttcctcacatgtcgatccccaaccaccctggcggaatggggatcaccgtttttgggaacaagtcccagaaaccctataaaatcgactctaaacaagcatctttactcggtgacgccaacatccacggacacaccgagtcaatgatttcagctgaactatag

SEQ ID NO: 238143 - DNA, 1182 bp, Artificial Sequence
  Description of Artificial Sequence: Synthetic coding sequence
atgcaccgacctcggcgtcgaggcactcggccacccttgctggcactcttagctgcccttctcctggccgctcgcggtgcggctgctcaggagacagagctgtctgtgtcagccgagcttgtgccaacttcctcatggaacatctccagtgagctcaacaaagattcgtacctcacattggacgaacctatgaataatatcacaactagtttgggacagacggctgagcttcactgcaaggtttccgggaatccacctcctaccatacgttggtttaagaacgacgccccagtggtccaggagcctaggcggttatcatttcggagcactatctatgggtctcgattaagaatacgtaacctggatacgacagataccgggtattttcaatgtgttgccaccaacgggaaggaggtggtctcttccacgggcgttctgttcgtaaagttcggcccacctcctacggcttcacccggttacagcgacgagtatgaggaggatggtttctgtcagccctaccggggaatcgcctgcgcacggtttattggcaaccgaaccgtgtacatggaatccctgcatatgcagggggaaatcgagaatcaaataaccgccgcatttactatgatcggcacctcctcacacctcagcgataagtgcagccaatttgccatcccaagcctctgccattatgcttttccttactgtgacgagactagcagcgttcccaagcccagggatctgtgtcgagacgaatgtgagattctagaaaacgtgctttgccagacggaatatatttttgccaggagcaatccgatgatcttgatgagactgaagctaccaaactgtgaggatctgccacaacccgaatcacccgaagcagctaattgtataaggatcggcatccctatggcggatcccataaacaaaaaccacaagtgctataactctaccggagtggactacagaggaacggtgtctgtgacaaagagtggtcggcagtgccagccttggaatagtcagtatccccatactcacacttttaccgctctcaggtttcccgagctcaatggcggtcatagttattgtagaaatccgggtaaccagaaagaagccccttggtgtttcaccctggatgaaaacttcaaatccgacctctgtgacattccagcctgtggtaaatag

SEQ ID NO: 238144 - DNA, 2823 bp, Artificial Sequence
  Description of Artificial Sequence: Synthetic coding sequence
agagcccgtgggtgctccgctcggagaaggggcacacgtccgccactcctggctttgctcgcagctctgttactggctgcccgaggcgctgccgcacaggaaactgaactcagcgtctctgccgagttagtgccgacatcctcttggaacatttcctctgagctgaataaagatagctacttgactttggatgaacccatgaacaacattacaaccagtctgggccagaccgctgaactgcattgcaaggtttccggtaatcctcccccaactatccgctggttcaagaacgacgctcccgtcgtgcaggagccaagaagattgagcttccggagcaccatctacggaagcagactacgaatccgtaacctcgacaccacagacactggatacttccaatgcgtggctactaatgggaaggaagtggtgtctagtacaggcgtgctgtttgttaagttcggcccaccccctaccgcatctcccggttacagtgatgagtacgaggaagatggcttttgccagccgtatcggggaatcgcctgtgccaggtttatcggaaatcggacggtctacatggaatcgcttcatatgcaaggagagatcgaaaatcagatcactgccgcattcactatgataggaacttcctcgcacctgagcgataaatgctcacagtttgctatcccctctctgtgtcactacgctttcccctattgtgacgagacaagcagcgtccccaaaccccgagatctgtgcagggacgaatgcgaaattctggagaatgtcttatgccaaacagaatatatattcgctaggtcaaacccgatgattttgatgaggctaaagctacccaactgcgaagatctgcctcagccagagagcccggaggcagctaattgtattcgcattgggatccccatggccgaccctatcaacaagaatcacaaatgttacaactctaccggagtggactacagaggcaccgtttctgtgacaaagagcgggaggcaatgccaaccttggaacagtcagtacccccacacccacacgtttacagctctacgctttccagagctgaacgggggtcactcctactgtagaaacccaggcaaccaaaaagaggcaccctggtgcttcactctggacgaaaactttaaatccgacttatgcgacattcctgcctgcgactccaaagactccaaagagaagaacaagatggaaattttatatatcctggtaccaagcgtcgccatacctctggcaattgccctcctattcttctttatctgtgtgtgtcgaaacaatcagaagagctcgtccgctccagttcaacgtcaacctaagcacgttaggggtcagaacgttgaaatgagcatgctaaacgcttacaagcctaagagcaaagcgaaagaattgcccctttccgcggtgcgcttcatggaggagctaggtgaatgtgcgttcggtaagatttataagggtcatctgtacttacccggtatggaccatgctcagctcgtggccataaagaccctgaaagactacaataatccacagcagtggacagaatttcagcaggaggcatccttaatggcagaactgcatcaccctaatatcgtctgtctgctcggggctgtgacccaggagcagcccgtgtgcatgctcttcgagtacattaaccagggcgatctccatgagttcctaatcatgaggtcccctcacagcgatgttggatgctcaagcgatgaggatgggaccgtaaagagttccttggaccacggggacttcctgcacatcgcgatccagattgctgcaggtatggaatatttatcaagtcattttttcgttcataaagacctggctgcacgcaacattttgattggagaacagcttcatgtgaaaatttcagatcttggtttgtctagagagatttatagcgccgattattatagggtccaatccaaatctcttctgccaattaggtggatgcccccagaggcaataatgtacggaaagttctcctcagatagtgacatctggtcctttggcgtcgttctatgggaaattttctctttcggtcttcagccatactacggcttcagcaaccaagaagtgatcgagatggtgcgaaagcgccagcttctgccctgcagcgaggattgtccccctagaatgtatagcttaatgactgagtgttggaacgaaatccctagtagaaggccccgtttcaaggatatccatgttaggctcaggagctgggagggattgtcctcacacacctcgagtactacacccagcggaggtaacgccaccacccaaactacttctctcagcgctagcccagtgtctaacctctccaaccctagatatccaaactacatgttcccaagtcagggtatcacccctcagggccagatcgcaggctttattggccctcccatacctcagaaccagcgtttcattcccatcaacggatacccaatccctcctgggtacgctgctttcccagccgcacattaccaacccacagggcctccaagagttatacagcactgcccacctcctaagtccaggtctccttcatccgcttctgggagcaccagtacggggcacgtaactagtctgcctagttctggtagcaaccaggaagcaaatatccctttactgccccacatgtcaattcctaaccaccccggaggcatgggtatcacagtattcggtaacaaaagccagaagccctacaaaattgactccaaacaggcgtcccttctgggggatgccaacattcacgggcacacggagtccatgataagcgccgaactgtag

SEQ ID NO: 238145 - DNA, 1167 bp, Artificial Sequence
  Description of Artificial Sequence: Synthetic coding sequence
atgctgttcgagtacattaaccaaggagatctccacgagttcctaatcatgcgcagtccccacagcgacgtgggttgctcctcagatgaagatgggacggttaagagctctttagaccacggagacttcctccatattgctatacagattgctgcaggcatggagtacctgtccagccatttcttcgtgcacaaggacctagccgctcggaatattcttatcggcgaacagcttcatgtcaagatttccgacctgggtttgagccgcgagatttattcagccgattactatagagtgcagtcaaagtcacttttgcccatcagatggatgcccccagaggcaatcatgtatggaaagttcagctcggacagtgatatatggtcttttggagtcgtcctatgggagatctttagttttggactccagccctattacggctttagcaaccaagaggttattgagatggtgcgaaagcgccagctattgccttgttcagaagactgcccccctcgcatgtactctctgatgaccgagtgctggaacgaaatcccctctaggagaccacgttttaaagacatccacgtgcgcctccgtagctgggaaggcctgagcagccacacatcaagtaccactccctccggcggtaacgccaccacccagaccactagtctgtccgcaagtccagtcagcaatctctcgaatccacggtacccaaactatatgtttccttcgcagggcattaccccccaaggacaaattgccggtttcattggaccacctatcccacagaatcaaagatttatacctattaatgggtaccccattcctcctgggtatgcggctttccccgcagcccactatcaacccaccggtcccccaagggtgatccagcactgtccgcctcctaagagcagaagccccagttccgcatccggatccactagcacgggacatgtgacctcacttcccagttcaggctcgaaccaggaagcaaatatcccccttctgcctcacatgagcatccccaaccatcctgggggtatgggtatcactgtgtttgggaacaaatcccaaaaaccttacaagattgactctaagcaggctagtctactgggtgatgctaacatacatggccacaccgaaagcatgatttccgccgagctgtag

SEQ ID NO: 238146 - DNA, 2832 bp, Artificial Sequence
  Description of Artificial Sequence: Synthetic coding sequence
atggcccgtgggagcgcccttccaagacggcctctgctctgcatccccgctgtttgggctgctgccgcactgcttctcagcgtatcccgaacatccggcgaagttgaagtcttagatcctaacgatccacttggtcctctggatggacaggatggaccaataccaactctgaaaggctacttcctgaactttctcgagccggtgaacaacataacaatcgtgcaggggcaaacggccattctgcactgtaaggtggccggaaatccacctcccaatgtgcggtggcttaaaaacgacgcgccagtggtgcaggagccgagacgtattatcattcggaaaaccgagtacgggtcaaggctcaggatacaggatctggacaccactgacactggttactatcagtgcgttgcaacgaatggcatgaagactatcacagccaccggcgtgctgtttgtgcgtcttgggccaacacacagccctaaccataatttccaagacgattatcatgaagacgggttctgtcagccctaccgagggatagcatgcgcacggttcatagggaatcgaacgatatacgtggactctttgcaaatgcagggagaaattgaaaacaggatcacagccgcttttactatgattgggacttccactcatctcagcgatcagtgcagccaatttgcaataccaagtttctgtcattttgtgttccctttgtgtgacgcccgatctcgtactcctaaaccgcgtgagttgtgccgtgacgaatgtgaagtcctggagtcggacctatgcagacaggagtatacaattgcacggtctaaccccctgatactcatgcgcctgcagttgcctaagtgcgaagcgctgcccatgccggagtcgcccgatgcggcaaattgcatgaggattggtatacctgccgagcgtttaggccgatatcatcagtgctataacggctctggcatggactaccgaggcaccgctagcacaactaagtcaggacaccaatgccagccttgggctctccaacacccccattcccaccacctctcatccaccgatttcccggagctggggggaggccacgcttattgtcgcaatccgggaggccagatggaaggaccctggtgttttacacagaacaagaacgttcggatggaactctgcgacgtgccatcctgttccccgagggatagctccaaaatgggaattctctacattctggttccttccatcgccatccccctcgtgatcgcttgtctttttttcttggtgtgcatgtgcagaaacaagcagaaagcctccgcatctaccccccaacgtagacaactgatggccagcccaagccaagacatggagatgcctctgattaaccagcacaaacaggctaaactgaaggaaatcagcctatctgccgtccgctttatggaagagctgggggaggatcgcttcggaaaagtatataagggacacctgtttggacctgcccctggggaacagacccaggctgttgcgattaaaaccctaaaggacaaagctgagggacctttacgcgaggaatttagacacgaggcaatgcttagagccagactgcagcacccaaatgtagtatgcctcctaggtgtcgtgacaaaggatcagccgctgtcgatgatctttagctactgttcccacggtgacttacatgaattcctggttatgcgcagtcctcacagtgatgttggatcaacggacgacgatcgcactgtgaagtccgccttagagcccccagatttcgtacatctggtggcgcagatcgcggctggaatggaatatctgtcaagccatcacgtggtccacaaagacctggctactcgtaacgtattggtatacgataagctgaacgtgaagattagcgacttgggcctattcagggaagtgtacgccgctgattattataagttgctaggaaactccttgctgcccatcaggtggatggcacccgaagccattatgtacgggaagttcagcattgacagtgatatttggtcttacggcgtagtattatgggaggtcttctcttacggccttcaaccgtattgcggatactccaatcaggacgtcgttgagatgattcgcaatcgacaggtcctgccatgtcctgatgactgtcctgcatgggtttacgcccttatgatcgaatgctggaatgagtttccaagccgacgccctagatttaaagatatccatagccgcctgagggcgtggggtaacctgtccaattataacagctctgcacagacttccggggcaagcaacacaacacagacgtcaagcctctctacaagccccgtctctaacgtctctaacgctcggtacgtcggaccaaaacagaaagcaccaccctttccccagccgcaattcattccaatgaagggccaaatcaggcccatggtccctcccccacagctgtatgtgccagtcaacggctaccagccggttcccgcatatggggcttatcttcctaatttctatcccgttcagatcccaatgcagatggcgccacaacaggtacccccacagatggtgcccaaaccaagctctcaccactccggctctggatctacctccactgggtacgtcactacagccccaagcaacacatctatggctgatcgtgccgctctcctgtctgaaggcgcagatgacacgcaaaatgctcccgaggacggggctcagtccactgtgcaggaagcagaggaggaggaagaaggctccgtccctgagacagagcttctgggagactgcgacacactgcaggttgacgaggctcaggttcagttagaagcctag

SEQ ID NO: 238147 - DNA, 1239 bp, Artificial Sequence
  Description of Artificial Sequence: Synthetic coding sequence
atgggtcaagatcaaaccaaacagcagatcgaaaaggggctgcagctgtatcagtcgaaccagactgaaaaggctctccaggtctggacaaaagttctcgaaaagtcctccgatctgatggggagattcagggtgctggggtgcctggtgaccgctcattctgaaatgggcagatataaagaaatgctgaagtttgcagttgttcagattgacacagcacgtgaactggaggatgctgactttctgctggaaagttacctcaacttagccaggtctaatgaaaaattgtgtgagttccacaagacaatttcttactgcaaaacatgcctcggcctgcctgggacacgagcaggggcacagctcggcggacaagtttctctttcaatgggtaatgccttcctgggcttaagtgtcttccagaaggccctggagtcattcgaaaaggctctccgttacgctcacaataacgatgacgccatgctagaatgtcgtgtgtgttgtagcctgggtagcttctacgcgcaggtaaaggactatgagaaggctctcttcttcccatgcaaggccgctgaactggtcaataattatggtaagggctggtcgctcaagtatcgcgcaatgagccaataccatatggccgtggcctaccggttactcggcaggttgggaagcgctatggaatgttgcgaggaatctatgaagatcgccctgcagcatggggatcggcctcttcaggctctttgcctcctgtgttttgctgacatacaccggtctcgcggagacctggaaacggcctttcccaggtacgacagcgcgatgtccataatgactgaaattgggaatagattgggccaagtgcaggcacttctcggcgtggcgaaatgttgggttgctcgcaaggcactcgataaggccctcgatgccattgagcgagcccaggatctggccgaggaagtcggtaataagctctctcaactcaagcttcactgccttagtgaaagtatatatcggtccaaaggacttcagagggaactgcgagcccatgtggttcggttccacgaatgtgttgaggaaaccgagctttattgtggcctatgcggggagagtatcggcgagaagaatagccgtctgcaagccctgccatgctcgcatatattccaccttcggtgtcttcagaataacggcacccggtcatgtcctaattgtcggcgatctagcatgaagccaggattcgtatag

SEQ ID NO: 238148 - DNA, 1062 bp, Artificial Sequence
  Description of Artificial Sequence: Synthetic coding sequence
atgggccaagaccaaaccaagcagcagatcgagaaggggttgcaattgtaccagtcgaatcagactgaaaaggctctccaggtctggaccaaggtgcttgaaaaatcctctgacctgatggggaggttccgagtgctagggtgtttggtcacagctcatagtgaaatggggcgttataaagagatgctgaagttcgccgtggttcaaattgataccgcccgagagttagaagacgcagattttcttcttgaatcttatctcaatcttgctagatccaacgaaaaactatgcgaatttcataagaccatatcttattgcaagacttgcttgggcttacccggtacgcgggcaggcgcacagctcggtggacaggtgtccttgagtatggggaacgcgtttctgggactatcagtgttccagaaggcgctcgagtccttcgagaaagcgctgagatatgcgcacaataatgatgatgcaatgcttgagtgccgcgtttgctgcagccttggcagtttttatgcacaggtaaaagactatgagaaggcactgttctttccttgcaaggccgctgaactcgtcaacaactatggcaagggttggagcctcaaataccgggcaatgtctcagtaccatatggcagtggcatataggctcctcggaaggctgggcagtgccatggaatgctgcgaggaaagcatgaaaatagccttgcaacatggtgaccgccctttgcaagccctttgcctgctgtgctttgccgacatccaccgctccaggggggacctggagctgtcacaattaaaactacactgtctctccgagtccatatatagatcaaaggggctgcaacgagagttgcgtgcccatgtggtgaggttccacgagtgtgtcgaagagacagaactgtattgcgggctctgcggggagagtatcggcgagaaaaactccaggctgcaggccctgccttgcagccacatatttcacctgcggtgtctgcagaataatggaacgcgttcgtgccccaactgccgccgatctagtatgaagcctggatttgtgtag

SEQ ID NO: 238149 - DNA, 2010 bp, Artificial Sequence
  Description of Artificial Sequence: Synthetic coding sequence
atgggtacagccctggtataccacgaagatatgactgccacaagacttttatgggacgaccccgagtgtgaaatcgaacgccctgaaaggctgaccgcggctctcgacaggctcaggcaaagagggctggaacagaggtgtctgcgattaagcgcacgggaggctagcgaggaggaattgggtttggttcattcaccagaatacgtgagcctggtccgcgaaacccaggttctcggcaaggaggaactccaggcactgtccgggcaatttgacgcgatttattttcacccctccactttccactgcgccagactagctgccggagccggactgcagctggtggacgcggtgctgaccggggctgtccagaacggactggctttggttaggccaccaggtcaccacggtcaacgagccgcagcaaatggtttctgtgtgtttaataacgtggccattgcggcagctcacgcaaaacagaagcatggcctccaccgcattttagtggtggactgggatgtacatcatggacagggcatccaatatctctttgaagacgatcctagcgtcctgtacttcagctggcaccggtacgagcacggaaggttttggcccttcctgcgagaatctgacgcggacgctgttgggcgtggacagggcctcggtttcactgtgaatctgccatggaaccaggtcgggatgggcaacgccgactacgttgccgcattcctacatctcctcttgcccctggcattcgaatttgatccagaacttgtgctcgtatctgccggattcgattccgcgattggtgaccctgagggccagatgcaggcaaccccagagtgcttcgcgcacctgacgcaactgcttcaggtcctggcaggtgggcgtgtctgcgcagttttagagggcggataccatcttgaaagcctggccgaatccgtttgcatgaccgtgcagaccctgttaggcgatccagcacctcctttatcaggcccaatggctccctgtcagtcggcactggagagcattcagtccgcccgtgctgcccaggcccctcattggaagagtctgcagcagcaggacgtcacagccgtcccaatgtccccatcctctcactcccctgagggtcggcctccccctttgctccctggaggacccgtgtgtaaggccgcagcatcagcgccatcatcgctgctggatcagccttgtctctgccccgcacccagcgttcgcaccgccgtagctctaaccaccccagacatcacattagtgctgccgccagacgtgatacagcaagaagcttcggctctcagagaagagactgaagcttgggccagaccgcatgagtcacttgcgagagaagaggcactgacagctctcgggaagctcctctacctgctcgatggtatgctggatggtcaagtgaatagcggcatcgccgctacacccgcttccgccgcagccgcaactctggacgttgccgtgcggaggggactgtcacatggcgcacagaggctcctgtgcgttgctctggggcagctcgaccggccaccagatcttgctcacgatgggaggtctctctggctcaacattagaggcaaggaggctgcggctctgtctatgttccacgtttcgactcctcttccagtgatgacaggtggttttcttagttgcattctagggctggtcttaccactcgcctacggcttccagcctgacctggtcctagttgctctggggccagggcatggactccaagggccacacgccgctctccttgcagctatgctccgtggcctcgcaggaggtagagtgctagctctgctggaggagaactcaaccccgcagctggccggaatactggcacgggtgctcaatggggaagccccaccgagcctggggccttccagtgtggccagtcccgaggacgtgcaagcacttatgtacttgcgcggtcaactggaaccgcagtggaagatgttgcagtgtcacccccaccttgtggcttag

SEQ ID NO: 238150 - DNA, 1206 bp, Artificial Sequence
  Description of Artificial Sequence: Synthetic coding sequence
atgcagcgttgttggcagggagaccccagagtcagacccaccttccaggagattacctccgagaccgaagacctgtgcgaaaaacccgacgacgaggtgaaagaaacggcccatgacctagacgtgaaatcacctccggaaccccgatccgaggtagttcctgcgagattgaagcgagcctcagctcctacattcgataatgactacagtttgtctgagctgctgtcccagcttgactctggtgtttcccaagccgttgaaggaccagaagaactatctagatcaagtagcgagtctaagctcccttcctctgggtcaggaaagaggctttctggcgtgtcaagcgtggacagtgctttctctagccgcggaagccttagcctgagttttgagcgtgagccttctacttccgatttaggaacgaccgacgtgcaaaagaaaaagctggtcgatgccatcgtctctggggacacgagcaagctgatgaaaattctacagccacaggatgtggacttagccctcgactccggcgctagcctcctgcatctcgccgtcgaggctggccaggaggaatgcgccaaatggctgttgctgaataatgctaatcctaatctgagcaaccgcagggggagtacaccactgcacatggctgtggagagaagggtgcgcggagtggtcgaactgctgctggccaggaaaatcagcgtgaacgctaaggatgaagaccagtggacagccctgcactttgccgctcagaacggagatgaaagcagtactaggctcctgctggagaaaaacgctagcgtgaacgaggttgattttgagggtcgcacccccatgcatgtggcttgccagcacggccaggaaaacatcgtcagaatactgctgagacgcggagtggatgtgagccttcagggcaaggatgcttggcactgcaccacactggccggtccaccagcgcaccgacaagcagccggtcaggctgcgggaggggaatgtgaaaggcccgatgcagggtgggaagatgccatcgcacctggccgaactgctcgcgctttgccaagaggccctcatccacatcgcccagttctaagaaggcagagactccagcctgccggaactgacacaccagccaggccacgacggagaggcacccgtgctcttcccggatgttcctgtatcggagccctcgccaggcgaccttag

SEQ ID NO: 238151 - DNA, 2355 bp, Artificial Sequence
  Description of Artificial Sequence: Synthetic coding sequence
atggagggcgacggaggcactccttgggccctggcactgctcaggacattcgatgcgggagaatttacaggttgggagaaggtcggctccggcggtttcggacaagtgtataaagtgcgccacgttcactggaaaacctggctggccataaagtgcagcccttcactgcacgttgacgaccgtgagaggatggagctgctggaggaggctaaaaagatggaaatggcaaagttcagatatatcctcccggtctacggcatctgtcgggagccggtggggcttgtgatggaatatatggagaccggtagcctggagaaactactggcaagtgaacctctcccctgggaccttcgattccggatcattcatgagacggccgtcggcatgaacttcctgcattgtatggcaccaccattgctccacctggacctcaaaccggcaaatatcctcctcgacgcccactaccacgtgaaaatcagcgattttgggctcgccaaatgtaacgggctctcacacagtcacgatctgtccatggatgggttgtttggaactatagcttatttaccccctgaaaggatccgagagaaaagccgcctattcgatacaaagcatgacgtctatagttttgccattgtgatttggggggtcttgacccagaaaaagcctttcgccgacgaaaagaatatcctccacattatggtcaaggtcgtgaagggacatagacccgagctgcctccagtgtgtcgggcacggccaagagcgtgttctcacttgatcaggttaatgcaaaggtgctggcagggcgatccgagggtccgccctaccttccaggaaatcacatcggagaccgaagatctttgtgaaaagccggacgacgaagttaaagaaacagcgcacgacttggacgtcaaaagtccacctgaaccacgctccgaagtagtgcccgctcgtcttaagcgtgcatccgctccaacatttgacaacgattactctctgtccgagctgctgtcccagctagactctggggtgtcccaggctgtggaagggcctgaagagctctcaaggtcttcatctgaatcaaaacttcctagcagtggatccggaaagagattgtccggcgtctcctctgtggatagcgccttttcatccagggggtctctaagcttgtctttcgagcgcgagccaagtacttccgatctggggaccaccgacgtgcaaaaaaaaaaactggtggacgcgattgtcagcggagatacctccaagctgatgaaaatccttcagccccaggatgtcgaccttgctctggattccggggcatctttgctccacctggccgttgaggcgggtcaggaggagtgcgccaaatggctgctcctgaataatgcaaaccctaaccttagcaatagaagaggctctaccccccttcacatggccgtggaacgcagagtccgcggtgtagtggagcttctgcttgccagaaagatttccgtgaatgccaaggacgaagatcaatggaccgcgcttcatttcgccgctcagaatggcgacgagagttcaacacggctgttgctggagaagaacgcatctgtgaacgaggtggatttcgagggcagaaccccaatgcatgttgcctgccagcacggacaggagaacatagtccgcattttgctgcgccgaggggtcgacgttagcctgcagggaaaggatgcttggttacccctgcattatgcagcctggcagggtcaccttccaatcgtgaaactgctcgctaaacaacccggagtaagcgtgaacgctcagaccttggacggcaggacccctcttcacttggcagctcagaggggccactacagagtggccaggatcctgattgatttgtgtagtgatgtgaatgtctgctctctgctggcacagacccccctgcacgttgccgctgaaaccggacacaccagtacagccaggctgctccttcacagaggcgcaggaaaagaagccatgacgtctgatggctataccgcgttacacctggccgctcggaatggccatctagcaacagttaaactactggtggaggagaaggctgatgtcttagcgaggggtcccctgaatcaaactgcgctgcatctcgctgccgctcatggacattctgaggtagtcgaggaactggtgtcggccgacgtgatcgacttgtttgatgagcaaggtctaagtgctctccatctggcagcgcagggaagacacgctcagactgtggagactctgctcaggcatggagcccacattaacctgcagagcctgaaattccaaggaggccacgggccagcggcaaccctgctccggagatctaagacatag

SEQ ID NO: 238152 - DNA, 2499 bp, Artificial Sequence
  Description of Artificial Sequence: Synthetic coding sequence
atggagggcgatggcggaaccccctgggcactagcactcctcagaacattcgacgcgggtgaattcactgggtgggagaaggttggaagcggcggattcggccaggtctacaaggttaggcatgtccactggaaaacttggctggctatcaagtgctctccctctctccatgttgacgacagggaacgcatggagctgctagaagaagcaaaaaaaatggaaatggcgaagtttcgctacattctgccagtttacggcatttgccgggaaccagttggattagtcatggaatacatggaaactgggagtctggaaaagttgttggcttccgaacctcttccgtgggatctgcgtttcaggatcatacacgagaccgcagttggcatgaatttcctccactgcatggccccacctctgcttcacctggatcttaagcctgccaatattctgctggatgcccactaccacgttaaaatcagcgacttcggcctagctaagtgcaacggactgtctcacagtcacgatttgtccatggatgggttattcggaaccattgcgtatctgccaccagaacggatccgagagaaaagccgcctgtttgatactaagcatgatgtctatagctttgctatcgtgatttggggggtactgacacagaaaaagccctttgccgatgaaaaaaatattctccatattatggtaaaagttgtgaaaggtcaccgtccagaactgccccctgtttgtagggccaggccacgcgcatgcagtcacttgattcggctgatgcaacgctgctggcagggtgacccccgtgttcggcctacgtttcagggcaacggccttaacggcgagctgatccggcaggttctagccgctcttctgcccgttaccggacgttggcgctctcccggagaaggttttcgtttggagagcgaagtcatcatcagagtaacatgcccccttagctctcctcaagaaattacaagcgagaccgaagacttatgcgagaagcccgacgatgaagtgaaggagaccgctcacgatctcgacgtgaagtcgccacccgaaccgaggagcgaggtggttcccgcaaggctaaagcgggcttcagcccctaccttcgataacgactactctctatccgaactcttgtctcagcttgatagcggtgtgagccaggctgtcgagggccctgaagagctttcacgtagcagcagcgagtcaaagttaccctcctcaggctccgggaagcgtctgtctggtgtatcttccgttgattcagccttttcaagccgaggtagcctctctctcagttttgagagagagccttccaccagtgatctgggcactactgatgtgcagaaaaagaagctggtcgatgctatagtgtcaggagacacgagtaaactgatgaaaatcctgcagccccaagatgtggatctggccctcgacagcggcgctagcttactgcatttggctgtggaagctgggcaggaggagtgcgccaagtggcttctgctcaacaacgctaaccccaatctgtctaaccggaggggttccacacctctgcatatggctgtcgagcgccgagtgagaggggtagtggagctgctgctcgccaggaagatctctgtgaatgccaaagacgaggaccagtggaccgccctgcacttcgcggcacagaatggcgatgaatcctccacccggttattgctggagaaaaatgcatccgtgaatgaggtggacttcgaaggaagaacgcctatgcacgtggcgtgccagcatggccaggagaacattgtccggattctgttgaggcgaggtgttgacgtgtccctgcaaggcaaggacgcctggctacccttgcactatgcagcctggcaggggcatttgcccattgtaaaactgctggctaagcagcccggagtatctgtgaacgcacagaccttagacgggaggactccactgcatctggcagcccagcggggtcactaccgcgtggccaggatccttatcgacctgtgctccgatgttaacgtgtgtagcctgctggcccaaacacctctgcacgtggccgcagagacgggccatactagcactgctaggttgctcttgcaccgaggagccggaaaggaggcaatgacgtcagatggctatacggctctccacctggctgctcgtaatggccacctggccaccgtgaagcttctggttgaggagaaagccgatgtcctggcaagaggacccctgaaccagacagcactgcacctggccgcagcacacggccactcagaagtggtggaggagctggtctccgcggacgttatcgacctgttcgacgagcagggactcagcgcactccacctggctgcgcaaggcagacatgctcagacagtagaaactctcctacgacatggtgctcacatcaatctacagagccttaagtttcaagggggtcatggtcccgctgcaactctcctgcggcgtagtaaaacatag

SEQ ID NO: 238153 - DNA, 2166 bp, Artificial Sequence
  Description of Artificial Sequence: Synthetic coding sequence
atggagctgctagaagaggccaaaaaaatggagatggcaaagttccggtatattcttcccgtttacggcatctgcagagagcctgtaggactggtgatggaatacatggagaccgggagcctggagaaattgttagcctcagaacctttgccatgggatctccggttcaggatcatccacgaaacagctgtgggaatgaactttctgcactgcatggctcccccactattgcatttggaccttaagccagccaatattctgctcgatgcccattatcatgttaagatatccgattttggcttggccaaatgtaacggcttgtcccactcccacgatctaagcatggacggcctctttgggactatcgcctacctcccacccgagcggatccgggaaaagtctcgactgttcgacaccaagcacgacgtctactctttcgccattgttatctggggagtcctgactcagaagaaacccttcgctgacgaaaaaaacatcctccatattatggtgaaagttgtcaaagggcatcgacccgagctgcctcctgtgtgcagggcacgtccacgcgcatgttcccacttgatccgcctcatgcagcgatgctggcagggtgatccaagggtgcggcctactttccaggaaatcacttccgaaacagaagatctatgtgaaaagcctgacgacgaggttaaggaaactgctcacgatctggatgtgaaatcccctccagagcctcgaagcgaggtcgtaccagccagactgaagagagccagtgcacctactttcgacaatgactatagcctgtccgagttactaagtcagctggactcgggcgtctcccaggccgttgagggccctgaagagctctcgagatccagctcggagtcaaaactcccgtcctctgggtccggtaaacgcctttccggggtatctagcgtcgattctgctttcagcagtcgcggaagcctgagcctgagttttgaacgggagccaagtactagtgacctgggaactaccgacgtacagaagaagaaactggtcgacgcgatcgtttcaggtgatactagtaaattaatgaaaatcctgcagccgcaggatgttgacttggccctggattctggtgccagtctgttgcacctggccgtagaagcaggccaggaagagtgcgccaaatggctcttactaaataatgccaacccgaacctgtcgaatcggaggggcagtacgccattgcacatggccgttgaaaggcgagttcgcggagtcgtggaactccttctcgcccgaaagatttcagtgaatgcgaaagacgaagaccaatggactgccctgcattttgcagcgcagaatggggatgagagctcgacaaggctgttgctcgagaagaacgctagcgtaaacgaggtcgacttcgaaggcaggactcctatgcatgtggcctgtcaacacgggcaagaaaacattgtgagaatcttattgcggaggggtgtggatgtgtccctgcagggcaaagacgcctggctgcccttacactacgctgcttggcagggccacctgcctatcgtgaaactcctagccaagcagcctggagtgagtgtgaacgcgcagaccctcgatgggagaacaccgttacacctggctgctcagcgcggtcactatcgcgtggctaggattctgatcgacttatgttcagatgtcaacgtttgttcattgcttgcacaaacccctctgcacgtcgccgctgaaactggtcacacttctacggctcgtcttctgttacatagaggagccggaaaggaggcaatgacatctgacggttatactgcactgcacctggctgcacgtaatggacatttggctacagtgaagttgctcgtggaagaaaaagcggatgtgctggccaggggcccactgaaccagaccgcgctgcatttggcagccgctcacggacactcagaggtggtagaggaactggtctcggccgacgtgatagacctattcgatgaacaaggcctgagcgcactgcacctcgctgctcaaggcaggcacgcacagaccgttgaaacgctgctccggcacggtgcccatatcaatctgcaaagtttaaaattccagggagggcacggccctgcggcaaccctgcttaggcgatcaaagacgtag

SEQ ID NO: 238154 - DNA, 2166 bp, Artificial Sequence
  Description of Artificial Sequence: Synthetic coding sequence
atggagctgctcgaggaagctaaaaaaatggaaatggccaagtttaggtacatcctacctgtgtatggaatttgccgcgaacctgtgggtctggtaatggaatatatggagacagggtccctagaaaagcttctggcttctgaaccactgccctgggacctgcgcttccgcattatccatgaaaccgcagtggggatgaattttctgcattgcatggccccacccctgctgcacttagacctaaaacctgccaacatactcctggacgcccactatcatgtgaagatcagtgacttcggtctcgccaaatgtaatggcctgagccactctcacgatttgtcaatggacggattgtttggcaccatagcctacctgccccctgagcgcatacgtgagaaatccagactatttgatacaaagcacgacgtgtactcgtttgcaatcgtgatctggggggtgttgacacagaagaagccctttgcggatgagaagaatatcttgcacatcatggttaaggtcgtgaagggccaccgcccagaacttccccctgtatgccgcgctcgtcctagggcatgctctcaccttattagacttatgcagcgctgttggcagggcgaccctagggtcaggccaacgttccaggaaatcacctctgaaactgaggatctgtgtgagaagcccgatgatgaggtgaaagagactgcccacgatcttgacgtgaagagcccacccgagcctaggagtgaggtcgtgccggcacggctgaaaagagccagcgcccctacttttgacaacgattacagcctgtcagaactcctgagccagctcgatagcggtgtcagtcaggcagtggagggacccgaggagctgtcccgttcctcctccgaaagtaaactcccttcatccggcagcgggaagcggcttagcggcgtgagcagtgttgactcagccttcagctctcgcggttcgctgagcctgtccttcgaacgtgagccttctacttcagacctcgggaccacggatgtccagaaaaagaaactcgttgatgccattgtgtcgggagacaccagtaagcttatgaaaatacttcagccccaggacgtcgatctggcactggactctggcgcttccctgctgcacctggctgttgaagccggtcaagaagagtgcgccaagtggttactactgaataatgccaaccccaacttgtccaacaggcgcggaagcaccccactgcacatggctgtcgagcgtagagtgaggggagtggttgagctcctgttggcccgtaagatttctgtgaatgcaaaggacgaggaccagtggaccgcattgcacttcgccgcacagaatggcgacgaaagcagtactcggctgcttttagagaaaaacgctagcgttaatgaagtcgactttgagggacgaaccccaatgcacgtcgcctgtcaacatggacaggagaacatcgtcaggatccttcttaggagaggagtagatgttagcttgcagggcaaagacgcctggctcccgttgcactacgctgcgtggcaaggtcaccttccaatcgtgaagctcctggcaaaacaacccggagtgtccgtcaacgcccagacactggatggaagaacccctctccacctggcagcacagcgcggtcactatcgggtggcaaggatcctgattgatctttgctcagatgtgaacgtctgttccctgttagcccagactcctctccatgtggcagccgagactggccacacctctacagctaggttattactgcaccgcggtgctggaaaggaagcaatgacatcagatggttacactgcccttcacttggccgctcgcaacggccacttggctacagtgaagctgctcgtcgaagagaaggccgacgtcctggccaggggtcccctgaatcagaccgccctgcacctggccgctgcacatggccactcggaggtggtggaggaattggtgagtgctgacgtgattgatctttttgacgaacagggcctgtcagcgctccatctggcggcacagggtcggcatgcgcagaccgtggagacactcctgagacacggagcccacatcaacctgcagagcttaaagttccaggggggacatggcccagccgctacactcttgaggagaagcaaaacctag

SEQ ID NO: 238155 - DNA, 3132 bp, Artificial Sequence
  Description of Artificial Sequence: Synthetic coding sequence
atggctgcctcatttccacccaccctcgggctttccagcgccccagatgagatccaacacccacatattaaattctcggagtggaagtttaaactcttccgggtgaggagtttcgagaaaactcctgaggaagcccagaaggaaaagaaggatagtttcgaaggtaagccatcccttgagcagtccccagctgtgttagacaaagcggacggacagaagcctgttcccactcaacccctcctgaaggcccaccctaagttctcaaaaaaattccatgataacgagaaggctagagggaaggccatccatcaggccaatctgcgccacctctgtcgtatatgtgggaattctttccgagctgacgagcacaataggagatatcccgtgcatgggcctgtcgacggaaagacgctaggtctgcttcgcaaaaaggagaaacgagccacatcatggccagatcttatcgccaaagtcttccgcatagacgtgaaagctgatgtggattctattcatcctacagagttttgccacaactgctggtctattatgcatcgcaagttcagctccgccccttgcgaagtgtactttcccagaaacgtgaccatggaatggcacccacacaccccaagctgtgacatatgcaacactgcccgtagaggcctcaagaggaagagcctacagcccaatttacaattaagtaagaagcttaaaaccgttcttgatcaggcaaggcaagcacgtcagcacaaaagaagagcacaggcccgaatttcttcaaaggatgtgatgaagaaaattgccaactgttccaagatccacctatcgacaaaactcctggcggttgatttccctgaacacttcgtgaagtcgatttcctgccagatctgcgagcacattctggccgaccccgtcgagacaaactgtaaacatgtcttttgtagggtgtgcatccttaggtgcctgaaggttatgggctcatattgtccctcatgcaggtatccctgttttcctaccgatctggaatcaccagtcaagtcttttctcagcgtccttaactctctgatggttaagtgtcctgctaaagaatgtaacgaggaagtctctctggaaaagtataaccaccacatttcttctcacaaggaaagtaaagagatctttgtgcatatcaataaaggcggaagaccacggcaacacctgctctccctgacccggcgagctcagaagcacaggctgagggagctcaaactgcaggttaaggcattcgctgacaaggaggaggggggagacgtaaagtctgtctgcatgacccttttccttctcgctctgagagcacgcaacgaacaccggcaagccgatgagctggaagcaatcatgcagggcaaaggatcagggctccaaccggctgtctgccttgctataagagtcaacacctttctgagttgctctcagtatcacaagatgtatcggaccgttaaagccatcacaggacggcagatctttcaacctcttcacgcattgcgcaatgctgaaaaagtgctcttgccaggatatcatcatttcgagtggcagcctcctttgaagaacgtttcctcttctactgatgtcggcataatcgatggccttagtggcttaagcagtagcgtggatgactacccagtcgacaccattgcaaaacgatttcggtatgatagtgctctggtaagcgcgttaatggatatggaagaggatattctcgaaggaatgagaagtcaggacctggatgactatttaaatggcccttttacggtagtcgtgaaggaaagttgcgatggcatgggagacgtgtccgaaaaacatgggtccgggccagtcgttcctgagaaggctgtgagatttagcttcactatcatgaagatcactatcgcacactcatcacagaacgtcaaggtgttcgaagaagccaaaccaaatagcgagctgtgctgcaaaccgctgtgcctcatgctcgcagatgagtctgaccacgagaccctgacagctattttatcccccctcatcgccgagcgagaagccatgaagtctagtgaactaatgctggagctggggggtatccttcgtacttttaagttcatcttccgcggtacaggatatgatgaaaaactggttagagaggtggaggggctggaagcttccggaagtgtgtatatctgtactctctgcgacgcaacacgacttgaggctagccaaaatctggtgtttcactctataacgagaagccacgcagagaacctggagcggtatgaagtgtggcgttcaaacccttatcacgaatcagtcgaggaactgagagacagggtcaagggcgtttcagctaagccctttatcgagactgttccctccattgacgccctccattgtgacatcgggaatgcggctgagttttacaagatatttcagttggagattggggaggtgtacaagaatcccaatgcaagcaaagaggagcggaaacgctggcaagccaccctcgacaaacatctgcgtaaaaaaatgaatttgaagcccatcatgagaatgaatggcaactttgctaggaagctgatgactaaggagacagtggatgcagtatgcgaactgatacctagcgaggagagacacgaggctctgcgcgagctgatggatttatatctcaagatgaagccggtctggcgatcttcatgccccgctaaagaatgccctgagagcctctgccagtacagctttaattcccagagatttgctgaactgctgtccaccaagttcaaatacaggtacgagggaaaaattaccaattatttccacaaaactctcgcccacgtgcccgagattatcgagcgggatggatccatcggagcttgggccagcgaaggtaacgaaagtggaaacaagttgtttcggagatttagaaagatgaatgcacggcagtccaagtgttacgaaatggaggacgtgctgaaacaccactggctttacacctccaagtatctgcagaaattcatgaatgctcacaatgcacttaagacctctggcttcaccatgaacccccaggcttccctgggagatccattggggattgaagatagtctcgaatcccaggattcaatggagttctag

SEQ ID NO: 238156 - DNA, 1584 bp, Artificial Sequence
  Description of Artificial Sequence: Synthetic coding sequence
atgagtcttcagatggtcacagttagtaacaatatcgcactgattcagcccggattcagcttgatgaacttcgacggtcaggtgtttttttttggccagaagggttggccaaaaagatcctgccctaccggcgtgttccatctggacgtaaagcacaaccatgtcaagcttaaaccaaccatcttctctaaagattcttgttacctgccgcctctgcggtaccctgctacctgtaccttcaagggcagtttggagtctgaaaaacaccagtatatcattcatggaggcaagacaccaaataatgaggtgtccgataaaatttacgtgatgagcattgtgtgtaagaataacaaaaaagtaacttttaggtgcaccgaaaaggacctcgtcggtgacgttccagaggccagatatggacacagtatcaacgtggtgtactcgagaggtaagtctatgggtgttttgtttgggggaagatcatatatgccatctacacatcggaccacagaaaagtggaatagcgtagccgattgtcttccatgcgtgtttctcgtcgacttcgagttcggctgtgctacatcttacattctaccagagcttcaggatgggctttccttccacgtgtctattgcgaagaatgataccatctatatactcggaggacactctcttgccaacaatataaggccagctaacttatatagaattagggtcgacctgcctctgggttctcctgcggtgaactgcacagtcctgcccggaggtattagtgtttctagtgccattttaactcagactaataacgacgagttcgtaatcgtcgggggataccagttagaaaaccagaagagaatgatctgcaatattatctctttagaggataacaaaatagaaatccgagaaatggaaaccccggattggacaccggatatcaagcattcgaagatatggttcggcagtaatatgggcaacggaaccgtctttctggggatccccggagacaataaacaggtcgtgtcggaaggtttctacttttacatgctcaaatgcgcagaagacgatacaaacgaagaacaaaccaccttcacaaattctcagacttcaaccgaagaccctggagactcaaccccctttgaggattctgaggaattttgcttctctgctgaggccaattccttcgacggggacgatgagtttgatacatacaatgaagatgacgaagaagacgaaagtgagacgggctattggatcacatgttgtcctacatgtgatgtcgatattaacacgtgggttccgttttatagtactgagttaaacaaaccggctatgatctactgctcccatggcgacggacactgggtacacgcccagtgtatggatctcgctgagaggacgctgatccatttgtctgccggatctaacaaatactattgcaatgaacacgttgaaatagcccgtgcgcttcatacaccgcaaagagtgctgccacttaagaaaccccctatgaaaagcctcagaaagaaaggctccgggaagatcctgacaccggctaaaaaatcgtttttgcgaaggttgtttgactag

SEQ ID NO: 238157 - DNA, 216 bp, Artificial Sequence
  Description of Artificial Sequence: Synthetic coding sequence
atgtctctccagatggtgaccgttagcaataatatcgcgctgatccaacctggattcagcctcatgaactttgatgggcaggtttttttttttggccaaaaaggatggccaaaacgctcgtgtcccaccggggtgttccatttggatgtgaagcataatcatgttaaattgaagccaacgatattctccaaggacagctgctaccttcccccttag

SEQ ID NO: 238158 - DNA, 453 bp, Artificial Sequence
  Description of Artificial Sequence: Synthetic coding sequence
atgtcactgcaaatggtgaccgtttccaacaacattgccctaatacagccgggtttctccctgatgaacttcgatggccaggtgttcttcttcggccagaaagggtggcccaagagatcctgcccaaccggcgtgtttcatttggacgtgaagcataaccatgtgaagctgaaaccaacaatctttagcaaggattcttgctatcttccacccctgaggtaccctgccacatgtactttcaaaggcagcctcgagtctgaaaaacatcagtacattattcacgggggtaagaccccgaacaatgaagtgtcagacaaaatttatgttatgtcaattgtgtgtaagaataacaagaaagtgacttttagatgcactgagaaggacctggtcggcgatgtgcccgaggcccgatatggccatagcattaacgtggtctatagcagaggaaagtag

SEQ ID NO: 238159 - DNA, 6 bp, Artificial Sequence
  Description of Artificial Sequence: Synthetic coding sequence
atgtag

SEQ ID NO: 238160 - DNA, 1503 bp, Artificial Sequence
  Description of Artificial Sequence: Synthetic coding sequence
atggatcacacagaagggtcccctgccgaagagcctccagcccatgctcccagtcctgggaagtttggcgaacggccaccccctaagcgactcacgcgtgaggcgatgagaaattatctcaaggagcgtggcgatcagaccgtgctgatcctccatgccaaagtcgcccagaaatcgtacggcaacgagaagcgcttcttttgtcctccaccgtgcgtttatttgatgggctctggttggaaaaagaaaaaggagcagatggaaagggacggatgctctgagcaggaatcacaaccctgtgcgttcatagggattggcaactcagaccaggagatgcagcagctaaacctcgagggaaaaaattattgcacagctaagacattgtacatttcagactctgataagcgaaaacattttatgctaagcgtcaaaatgttttacggaaatagtgatgacatcggagtgttcttgagcaaacgcatcaaagtcataagtaaaccttcaaagaagaaacaatcattgaagaacgccgatctctgcatcgcaagcggcactaaagtcgctcttttcaatagactgagatcccagactgtgtccacacgttatctgcacgtcgaaggcggtaactttcatgcatcttcacagcaatggggggcattcttcatccatttactggatgatgacgaatcagaaggcgaagaattcaccgtgcgagatggttatatccattatgggcagactgtgaagctagtgtgctccgtgacaggcatggcgttaccaaggctaatcatcaggaaggtagacaagcagacggctctgctggacgctgacgacccggttagccagcttcacaagtgtgccttttacctgaaagatactgagcgcatgtacctgtgcctgtctcaggaacgtatcattcagttccaagccactccatgccccaaagaacctaacaaggagatgatcaacgacggggctagctggacaattattagcactgacaaggcagaatacactttttacgaggggatggggccagttcttgcacccgtcactcccgtccccgttgtggagtcccttcagttgaacggcggtggggacgtcgccatgctcgagcttacgggacaaaacttcacaccaaatctcagggtgtggtttggcgacgtcgaggccgaaaccatgtatcgctgcggcgaatccatgctctgcgtggtgcctgacataagtgcttttcgagaggggtggcgctgggtgcgccagcctgttcaggtccccgtgaccctggtaagaaatgatggtataatttatagtacgagcctcacgttcacttacacacctgagccagggcctcggccacactgcagcgctgccggagccattctcagagctaactcctctcaggtgcccccaaacgagtccaataccaacagcgaaggctcttataccaatgctagcacgaatagtacaagcgtgacatcgtccacagctactgtggtgtcttag

SEQ ID NO: 238161 - DNA, 1461 bp, Artificial Sequence
  Description of Artificial Sequence: Synthetic coding sequence
atggcctggatcaagagaaaattcggtgaacgacccccaccaaagcggctaacgcgggaagcaatgagaaactacttgaaggagcgtggtgaccagaccgttctcattttgcatgcgaaagtcgcccaaaagtcgtatggaaatgagaaaaggtttttctgcccaccaccctgtgtttacttaatgggatcaggttggaaaaagaagaaggagcagatggaacgagacggctgctccgagcaggaatcacagccctgtgccttcattggcattgggaactcagaccaagaaatgcagcagttgaacctcgaggggaagaactactgtacagccaaaactctgtacatctctgattccgataagagaaagcactttatgctgtctgttaaaatgttctatggcaactccgacgacatcggggtgtttctgagtaaaaggatcaaggtaatcagtaaaccttcaaagaaaaagcaaagtttaaaaaatgctgacctgtgcatagcctccggcaccaaggtggcactgttcaacaggctaagatcgcagaccgtgagcacacggtacttacatgtggaaggcggtaatttccatgcgtcgtcgcagcaatggggagccttctttatacatctgctggacgacgacgagtctgaaggtgaggagttcaccgtgagagacggatacattcactacggccaaaccgtgaagctggtgtgcagtgtgactggcatggcattgcccaggctcattatacgaaaggtggataaacagactgccctgctcgacgccgatgatccagtgagccagctccacaagtgtgccttttacctaaaagacacagagagaatgtacctgtgtctatcccaggagcgaattatccagtttcaggcaacgccatgcccaaaggagccaaataaagaaatgataaacgacggagctagctggaccatcatctcgacagataaggccgagtatactttttatgaaggcatgggaccggttcttgccccagtcacacctgttcccgtcgttgaatccctgcagttaaacggcggtggcgatgtcgccatgctggagctgacagggcagaactttaccccaaatctcagagtctggttcggagacgtggaagcagaaaccatgtaccggtgcggtgaaagtatgctgtgcgtagtgcccgatatcagtgcattccgcgagggatggcgctgggtccgccagccagtgcaggtgccagttactttagtaagaaacgatggaattatctattccactagcttaacattcacctatactcctgaacccggtccccgtccacattgcagcgccgcaggcgcaattctcagggccaacagctcacaggtccccccaaacgaaagtaacacaaattcagaaggatcctataccaatgcaagtaccaactcaacatcggtgacctcctctaccgccacagtagtcagttag

SEQ ID NO: 238162 - DNA, 1458 bp, Artificial Sequence
  Description of Artificial Sequence: Synthetic coding sequence
atggggggttgcagaaagtttggcgagcgccctccccctaagagactgacccgcgaagccatgaggaactaccttaaagaacgcggagaccaaaccgtcctgatcctccatgccaaggtcgcacagaagagctacggaaatgagaagaggttcttttgtcccccaccctgtgtgtacctgatgggtagtggctggaagaagaagaaagaacaaatggaacgcgatggttgttctgagcaggaaagccagccctgcgccttcattgggatcggcaactcagaccaagaaatgcagcagcttaacctggagggcaagaactactgtaccgcaaaaactctttatatatccgactctgataaacgcaagcacttcatgttgtccgtgaaaatgttctacggtaacagcgacgacattggcgttttcctttcgaaacggattaaggtgattagcaagcctagcaagaaaaagcagtcccttaagaacgcagacctgtgtatcgccagtgggaccaaggtggcactgtttaatagactgcgttcgcaaactgtatcaacgagatatctgcatgtggaaggtgggaatttccatgccagctcccagcagtggggcgctttttttattcacttattggatgacgatgagtcagaaggtgaggaatttacagtaagagatgggtatatccactacggacagaccgtgaaattggtgtgctcagtcacaggcatggcgttgccacggctgatcatcagaaaagtggataagcagacagcgttgttggatgcagatgaccctgtcagtcagctgcacaagtgcgctttttatctcaaggatacagagcggatgtacctttgcctcagccaagagagaatcattcagttccaagcaactccctgcccaaaggaacctaacaaggaaatgattaatgatggcgctagttggactatcattagtactgacaaggcggaatacaccttttatgaaggaatgggccctgtgctggccccagttaccccggtaccggtggtggagagcctccaactcaacggcggtggggacgtcgctatgctcgagctgacaggacaaaactttactcccaaccttagagtctggtttggcgatgtggaggctgaaacaatgtaccgttgtggggagtctatgctatgtgtcgtgcctgacatctccgcattccgcgaaggctggcgatgggtgcggcagcctgtccaggtccctgtgactttggtccggaacgacggtattatctactcgacctccctgacgttcacctatacccccgagccagggccacggcctcactgttcagctgcgggtgccatcttaagagcaaattcttcccaggtaccccctaatgagtctaatactaactctgagggcagttatacgaatgcgagcactaattcaacttctgtcactagctcaaccgccacagtggtcagctag

SEQ ID NO: 238163 - DNA, 1464 bp, Artificial Sequence
  Description of Artificial Sequence: Synthetic coding sequence
atggccccagtggtcaccggcaaattcggagaacgccctccccctaagcggctaacacgagaagctatgcggaactacctgaaagaaaggggcgaccagacggtactgatcctccacgccaaggttgcccagaagtcctatgggaacgagaagcgattcttctgccctccaccctgtgtgtatctgatgggaagtggctggaaaaagaagaaagagcaaatggagagagacggatgcagcgagcaagagagccagccttgtgccttcattgggatcggaaacagcgatcaggaaatgcaacagctaaacctggagggtaaaaattactgtactgctaagactctgtatatcagtgatagcgacaagaggaagcatttcatgctgtccgtcaagatgttctatggtaattccgatgacatcggtgtgttcttatctaaacggatcaaggttatatccaaacccagcaaaaagaaacagtctttgaaaaatgctgacctctgtatcgcttctgggaccaaggtggctctgttcaacagactccgcagccagaccgtgtctacacggtacctgcacgtcgagggaggcaatttccacgcttcatctcagcagtggggcgcattctttatccatctactggatgatgatgagagtgagggggaggaatttacagtgcgggatggatacatccactatggtcagacagtgaagctagtttgctcagtcactgggatggcccttcccagacttatcattcgtaaagtagacaagcagaccgccctgctcgatgccgacgaccctgtcagccagctgcacaagtgtgcgttctatctgaaagataccgagcggatgtacttgtgcctgtcacaggagagaatcatccaattccaggccactccttgccccaaagaaccaaataaggaaatgatcaacgacggcgcaagttggacaataatcagtactgacaaggcagagtatactttttacgaggggatggggcctgtattggccccagtgacacctgtgcccgttgtggagagtttacaactgaatgggggaggcgatgtggcaatgttggaactaacagggcagaacttcaccccgaacctgcgggtgtggttcggtgatgttgaagcagagactatgtaccgttgtggagagagcatgctttgcgtcgtgccggacatctccgcgttccgggaaggctggcgctgggtgaggcagcctgtccaagtcccagtgactttggtgaggaatgacgggatcatctactccacttcattaaccttcacttacacacccgagcccggtcctaggccgcattgctccgccgctggggcaattctgcgtgctaactcttcccaggttccacccaacgaaagtaacaccaatagtgaggggtcttacaccaacgccagtaccaactccacaagcgtcacgtcctccacagccaccgtggtgtcttag

SEQ ID NO: 238164 - DNA, 1461 bp, Artificial Sequence
  Description of Artificial Sequence: Synthetic coding sequence
atggcttggataaaacggaaatttggcgagcgaccccctccaaagagacttactagggaagcgatgcgtaactacttgaaggaacgcggtgaccagaccgttctgattctgcatgcaaaggtggcacagaaaagctacggcaatgaaaagcgcttcttctgtccacctccatgcgtataccttatgggaagtggatggaagaagaaaaaggaacagatggaacgagacggctgtagcgagcaagagtctcagccttgtgcatttatcggaatcggaaatagtgaccaagaaatgcagcaactcaacctggaggggaagaattactgcacagcaaaaaccctgtacatcagtgatagtgacaaacgcaagcacttcatgctgtcggtgaagatgttttatggaaacagtgacgacattggtgtcttcctgagcaaacgaatcaaggtcataagcaaaccaagcaagaaaaagcaaagcctgaaaaatgcagacctctgtattgcctctggaacaaaggtcgctttattcaaccggctaaggtcacaaacagtgtctactaggtacctgcatgtggaggggggaaacttccacgcctcaagccaacagtggggggcattctttatccacctactggatgacgatgagtctgagggtgaagagttcactgtccgagacgggtacatacattacggccaaacagttaaactggtgtgtagtgtgaccggcatggcactgccgagactgataattaggaaagtggacaagcagactgctctgttagacgctgatgatcccgtcagtcagctgcataaatgtgccttctaccttaaagatactgagaggatgtatctgtgcctttcacaggagaggattatacagtttcaagctaccccctgccccaaggaaccaaataaagaaatgatcaacgatggcgcttcttggactattatcagtacggataaagcggaatacaccttttacgaaggtatggggcctgttctcgccccagtcacacccgtccctgttgttgagagcctgcagctcaacggaggaggcgatgtcgctatgcttgagctcacaggacagaattttacccccaatctgcgcgtgtggtttggggacgtagaggcggagaccatgtacaggtgcggggagtccatgctctgcgtggtacctgatatcagcgcctttagagaaggctggagatgggttaggcagcccgtgcaagtgcctgttaccctggttcggaatgacggtatcatctactctacttcgctgactttcacctacacgccagagccaggccctaggcctcactgtagcgcggctggcgctatcttgagggcgaatagctcacaagtgccacctaacgagagcaacaccaatagtgaaggttcctatactaacgccagtaccaactccacctctgtgactagttccactgcaactgtggtctcttag

SEQ ID NO: 238165 - DNA, 1503 bp, Artificial Sequence
  Description of Artificial Sequence: Synthetic coding sequence
atggaccacaccgaaggcagcccagctgaggagccacctgcacatgcacccagcccaggcaagttcggagaacgtcccccaccgaaacggctgaccagggaggctatgcgcaactacctcaaggagcgcggagatcagacggttctgattctccatgccaaggtggctcagaagtcctatggtaacgagaagaggttcttctgtccaccgccttgtgtgtaccttatgggctcgggctggaagaagaaaaaggaacaaatggagagagatggatgctcagaacaggaatcacaaccttgcgcttttataggtataggtaactctgaccaagagatgcagcagctcaatctggaggggaaaaattattgcaccgccaagacactctatatcagcgattccgataaacggaaacactttatgctaagcgtgaaaatgttctacggcaactctgatgacattggagttttcttgtcaaaacgcataaaggttatctcaaaacccagtaagaagaaacaaagccttaaaaacgccgatctgtgcatagcatccgggaccaaagttgcgctatttaacaggctgaggagtcagaccgtcagtacccgataccttcacgtggagggtggtaattttcatgcttcatcacagcagtggggcgcttttttcattcatctgctggatgacgatgaaagtgagggcgaggagtttaccgtgagggacggctatattcattacgggcagaccgtaaaacttgtttgctcagtgacggggatggccttgcctcgactgattattagaaaggttgataagcagactgccttgctcgacgcagatgaccccgtctcccaactgcataagtgcgccttttacctgaaggataccgagcggatgtatctgtgcctgtcacaagagaggatcatccaatttcaagctactccctgtcccaaagagccaaacaaggagatgatcaatgacggagcgtcctggacgataatctctactgataaggcagagtacaccttttatgaaggtatgggtccggtacttgcccctgtgacccctgtgccagtggtagagagtctgcaactaaatggcggtggagacgtagccatgctcgagctcacaggccagaattttaccccgaacctgagagtgtggttcggtgacgtcgaagcagagaccatgtaccgctgcggggagtctatgttatgcgtggtcccggatattagcgcgttccgggagggctggcgttgggttaggcagcctgtgcaggttccagtgactcttgtccggaacgatgggataatctatagcacctcattaacatttacatacactcccgagcccggaccgaggccccattgctctgctgcaggcgctattctgcgcgctaacagttctcaggtccctccaaatgagagtaacaccaacagtgagggatcttacaccaatgctagcaccaactctaccagcgtgaccagttccacagccactgtcgtaagctag

SEQ ID NO: 238166 - DNA, 432 bp, Artificial Sequence
  Description of Artificial Sequence: Synthetic coding sequence
atgcgcaattatttgaaagagcgcggagatcagaccgttctcatcctgcacgccaaggtcgcccaaaagtcttacggaaacgagaagcgctttttttgtccacctccgtgcgtctatttgatgggatcaggatggaaaaagaaaaaagagcagatggagagagacgggtgcagcgaacaggagtctcagccttgtgcttttattggaatcggtaactccgatcaggagatgcagcagttgaatctagaaggcaagaattactgtacagcaaagactctatacatctccgactcagataagagaaagcacttcatgctttccgtgaaaatgttttacggaaacagcgacgacatcggagtctttctgtctaaaagaatcaaggtgatttctaagccatcaaaaaagaagcagtctttgaaaaatgcagactag

SEQ ID NO: 238167 - DNA, 87 bp, Artificial Sequence
  Description of Artificial Sequence: Synthetic coding sequence
atggcttggataaaacggaaattcggcgaacgcccaccacctaagcgcttaacgcgggaagccatgcgcaattaccttaaggaatag

SEQ ID NO: 238168 - DNA, 294 bp, Artificial Sequence
  Description of Artificial Sequence: Synthetic coding sequence
atggcgtggataaagcggaagtttggagagaggccaccaccaaagaggctaacccgggaggctatgaggaattacctgaaggagaggggggaccagacagtcctcatcctacacgcaaaagtcgcacaaaaatcctacgggaacgagaaacgattcttttgcccaccaccctgtgtgtacctgatggggtcgggttggaagaaaaaaaaggagcagatggagagagatgggtgctctgagcaggaatctcaaccctgtgccttcatcggcattgggaacagcgatcaagagtag

SEQ ID NO: 238169 - DNA, 1398 bp, Artificial Sequence
  Description of Artificial Sequence: Synthetic coding sequence
atgcgcaattatctgaaagagcgcggagatcagacagtcctgattctccatgctaaggtggctcagaagagctacgggaacgagaagaggttcttttgcccaccgccttgcgtgtatctgatgggctcgggatggaaaaagaagaaggaacagatggagagagacgggtgttcggagcaggaatcacaaccatgcgcgttcatagggatcggcaactcagaccaggagatgcagcagttgaacctcgagggaaaaaactattgcaccgcaaagactctgtacatctctgatagcgacaaacgcaagcattttatgttgtccgtcaagatgttttacggaaacagcgacgatatcggagtcttcttatccaagaggatcaaagtcatttctaagccatccaaaaaaaaacagtcactgaagaacgcagatctgtgtattgcttcggggactaaagtggccctcttcaacagacttagaagccagactgtttctacccgctaccttcatgtggaaggagggaatttccatgcctcgtctcagcaatggggagctttctttattcacttactagacgacgacgagagtgaaggagaagaatttaccgtgcgcgacggatatatccactatgggcaaaccgttaagctcgtgtgttcagtgacaggtatggctctccctagattgatcatcaggaaggtggataaacagacggccctcttagacgcggatgatcctgttagccagctccacaaatgcgccttctacttgaaggacacagagcgcatgtatctatgcctgtcacaggaacgaattatccagtttcaagctaccccttgccctaaggaaccaaataaagaaatgatcaacgacggagcatcatggaccattatttcgaccgataaagcggagtataccttttacgaaggcatgggccctgtgcttgcaccagtgacaccagttcctgttgttgaatccctgcagctcaacggcggaggagatgtggccatgctggagttgacaggccagaactttacaccaaacctgcgggtgtggtttggggacgtcgaggctgagaccatgtaccggtgcggcgagagtatgctctgcgttgttcccgatatctccgctttcagggagggctggaggtgggtccgccagccagtgcaagtcccggtgacgctggtacggaatgacggcatcatatatagcacaagtctcactttcacttacacacctgaaccagggcctagaccgcactgcagtgcagccggagctattctccgagccaattcttcacaagtccctccaaatgagtccaacaccaattcggagggcagctacaccaacgcttccaccaatagtacttccgtgacaagttctactgccaccgtggtttcttag

SEQ ID NO: 238170 - DNA, 474 bp, Artificial Sequence
  Description of Artificial Sequence: Synthetic coding sequence
atgagaaattatcttaaagagcggggagaccaaaccgtgctgattctacatgcgaaggttgcccaaaaatcctacgggaacgagaagcgatttttctgtccgcctccttgtgtctacctgatgggaagcggatggaagaaaaaaaaggaacagatggagcgtgacggctgtagtgagcaggagagccaaccgtgcgcattcatcggcattggtaactcagaccaggagatgcagcagctgaatcttgaaggcaagaactactgtactgccaagaccctttatatcagtgacagcgacaagcgtaaacactttatgctgtccgtcaaaatgttttacggaaacagtgacgacattggtgtctttctctcaaaacggataaaagtgatatctaaacccagtaagaagaagcagtcacttaaaaacgccgatctgtgcatcgcctccggtacgaaggttgctttattcaatcgctag

SEQ ID NO: 238171 - DNA, 150 bp, Artificial Sequence
  Description of Artificial Sequence: Synthetic coding sequence
atggcctggatcaagagaaaattcggcgagcgaccaccgcctaagagattaactagggaagccatgaggaattatttaaaggagcgcggtgatcagaccgttctgattcttcacgctaaggtggcccagaagtcatacggtaatgagtag

SEQ ID NO: 238172 - DNA, 324 bp, Artificial Sequence
  Description of Artificial Sequence: Synthetic coding sequence
atggcttggatcaaacggaagtttggagaaaggcctccgccaaagagactcacaagggaggctatgagaaattacctgaaagaacgaggagatcagacggttcttattctgcacgccaaagtggcgcagaaaagttacggaaatgaaaaacgatttttctgtcctccaccatgcgtgtacctgatggggtcaggatggaaaaagaagaaggagcagatggagagggacgggtgttcagagcaggaaagtcagccttgtgcctttattggaatcggtaatagtgatcaggagatgcagcaactgaacctggaaggcaaaaactag

SEQ ID NO: 238173 - DNA, 285 bp, Artificial Sequence
  Description of Artificial Sequence: Synthetic coding sequence
atggcttggatcaagagaaaatttggcgagaggccccctcctaaaagattgacgagggaagcgatgaggaattaccttaaggagagaggtgaccagacagtccttatcttgcatgccaaggttgctcagaaaagctatggcaatgaaaagagattcttttgccccccaccttgtgtgtacttgatgggtagcgggtggaagaagaagaaagaacagatggagcgagacggttgttccgagcaggaatcacagccctgcgctttcattggtatcggaaactcctag

SEQ ID NO: 238174 - DNA, 537 bp, Artificial Sequence
  Description of Artificial Sequence: Synthetic coding sequence
atggaccatactgagggatcaccggcagaagagcctcctgcccacgcgccttcacccggtaagttcggagagcgaccaccgccaaagagactgacgcgagaagcaatgcgcaattacctaaaagagaggggcgaccagactgtgctcatccttcacgctaaagtggcacaaaaatcctatgggaatgagaaacgcttcttctgcccacctccttgtgtctatctaatggggagcggatggaagaagaaaaaagagcagatggagagggacgggtgttctgaacaggaaagtcagccatgcgcttttattggaatcggcaacagtgaccaggaaatgcaacagctaaatcttgaggggaaaaattattgcacggctaaaacactttacatctctgattccgacaaacggaagcatttcatgctctctgttaagatgttctatggaaactccgacgacatcggagtttttctgtcaaaacgcattaaagttattagtaaaccatctaaaaagaagcagagtctcaaaaacgctgactag

SEQ ID NO: 238175 - DNA, 333 bp, Artificial Sequence
  Description of Artificial Sequence: Synthetic coding sequence
atggcctggatcaagaggaaattcggggaacgccctcctcccaagcgtctgacccgggaggcaatgcgcaactatcttaaagaacgtggtgatcagactgtgttaatcctgcacgcaaaggtggctcagaagtcgtacggaaacgagaaaaggttcttttgcccccctccttgcgtttatctgatgggcagtggatggaagaaaaaaaaggagcagatggagagagatgggtgttctgaacaggaatcacagccttgtgcctttataggcatcggaaattccgaccaagagatgcagcagcttaatctggagggtaagaattattgcacctag

SEQ ID NO: 238176 - DNA, 342 bp, Artificial Sequence
  Description of Artificial Sequence: Synthetic coding sequence
atggcctggattaaacgtaagttcggtgagagacccccaccaaagcggctcacacgggaggccatgcgcaactatctcaaggagcggggtgaccagacagtgctgattctgcacgcaaaggtcgcacagaaatcctacggcaatgaaaagaggttcttctgccccccaccttgcgtatacctgatgggctcaggttggaagaagaagaaagagcaaatggagcgtgacggatgttcggagcaggagagccaaccgtgtgcatttatagggatcgggaacagtgaccaggaaatgcagcagttgaacctggaaggaaaaaattactgtacggctaaaacctag

SEQ ID NO: 238177 - DNA, 147 bp, Artificial Sequence
  Description of Artificial Sequence: Synthetic coding sequence
atggcctggataaaacgaaagtttggagagagaccacccccaaaacgcctgacaagagaggccatgagaaactatcttaaggaacgtggcgaccagacagtgttaatcctgcatgcaaaggtggctcagaagtcctacggtaattag

SEQ ID NO: 238178 - DNA, 570 bp, Artificial Sequence
  Description of Artificial Sequence: Synthetic coding sequence
atgcgaaattacttgaaggagaggggtgatcaaactgtcctgattctgcatgcaaaagtggcccagaaatcatatggcaacgaaaagagatttttttgtcctcctccgtgtgtgtatttgatggggagcgggtggaagaagaaaaaagaacagatggagcgggatggctgctctgaacaggagtctcaaccctgcgccttcatcggaattgggaacagtgaccaggagatgcaacaactcaacctagagggcaagaactattgcaccgctaaaacgctgtacatctccgattctgataagcgtaaacactttatgctatctgtcaagatgttctatggcaactcagacgacataggggtgttccttagcaaaaggattaaggtcatatcaaagccttcaaaaaaaaaacagagcctcaagaatgcagacctctgcattgctagcgggacgaaggtggcactgttcaacaggttaaggagccagactgtatctacacggtacctccacgttgaggggggaaacttccacgcatctagtcaacagtggggtgcattctttatccacctgtag

SEQ ID NO: 238179 - DNA, 600 bp, Artificial Sequence
  Description of Artificial Sequence: Synthetic coding sequence
atggctagtgttagcgccttgacagaggagttggattccattacatctgagctgcacgccgtcgagatacaaattcaagagctcacagagaggcagcaggaactcatccagaagaaaaaggtgctgactaaaaaaattaagcagtgcctggaagactccgacgcaggagcttcaaatgagtacgactccagccctgccgcatggaacaaagaagacttcccctggtctgggaaagtgaaggacatcctgcagaacgtctttaaactggagaaattccgacccctgcagcttgagaccatcaatgtaactatggcaggaaaagaagtttttctcgtgatgcctacgggcggaggtaaatcactctgctatcaactccccgcattgtgttcagatggctttactctggtcatctgccccctaatctccctcatggaagatcagctcatggttctgaaacagcttgggatctctgctacaatgctaaatgcctcgagtagcaaagagcacgtgaaatgggtgcatgccgagatggtcaacaagaactcggagttaaagttgatttacgtcacccccgaaaaaatcgctaagtctaagatgtag

SEQ ID NO: 238180 - DNA, 636 bp, Artificial Sequence
  Description of Artificial Sequence: Synthetic coding sequence
atggcatctgtaagcgctttgacagaggaacttgacagtattacctcagagctgcatgcagtggagatccaaatccaggagctgacagagcggcagcaagagctgatccagaagaagaaggtactgaccaagaagataaagcagtgcttggaggactctgatgccggtgcatccaatgagtatgattcctccccagcagcttggaacaaagaggacttcccatggtcaggcaaggtcaaagatatcttgcagaacgtgttcaaattggaaaagttccggcctctgcagctcgagactatcaatgtgacaatggcgggtaaagaggttttcctagtcatgcccacaggtggtggcaaatccctgtgttatcagttgcctgcactttgtagcgatggcttcaccctggtgatctgtcctttgatctccctcatggaggaccagttaatggtactcaaacagctggggatttccgccaccatgctcaacgcctcatcgagcaaggagcacgtgaagtgggtgcatgctgaaatggtcaataagaattctgagctgaagctgatatatgtcacaccagaaaaaatcgccaagtctaaaatgtttatgagccggttagagaaggcctatgaagcacgctag

SEQ ID NO: 238181 - DNA, 1950 bp, Artificial Sequence
  Description of Artificial Sequence: Synthetic coding sequence
atggctagtgtatctgcgctgactgaggagctcgattctatcacctcagaactgcatgctgtagagattcaaatacaggaactgacggagcgccagcaagaattgatacagaagaaaaaagtactcaccaagaaaatcaaacaatgtctcgaggattcggacgccggagcgtctaacgaatatgacagttcgcccgcagcatggaacaaggaggatttcccctggtccggcaaagtgaaggacatcctgcaaaatgtattcaagctcgaaaaatttcgtcccttgcagctggagaccattaacgtgaccatggctggaaaagaggttttcctggtgatgccaaccgggggaggaaaaagcttatgttaccagctgcccgctctctgttccgatgggttcacgctcgtgatctgccccctgatttctttgatggaagatcagctgatggtgctaaagcagttagggatctccgccacaatgctgaatgcctcctcttccaaagaacatgtgaagtgggttcatgccgagatggttaacaagaactcggaacttaagctgatatacgtcacccctgagaaaatcgccaaatctaaaatgttcatgtctagactggagaaggcctatgaggccaggcggttcacaaggatcgccgtggatgaggtccattgttgttcccagtggggccacgatttccgacccgactataaagctctcggcatcttgaagagacagtttcctaatgctagcctgattggactgacagcgacagctaccaaccacgttttaactgacgcccaaaaaattctgtgcatcgaaaagtgtttcaccttcacggcttctttcaacaggcccaatctctattatgaggtgaggcagaaaccctcaaacactgaggatttcatcgaggacatcgtaaaactgattaacggtcgctacaaggggcagagcgggattatttattgtttctcgcagaaggactccgaacaggtcaccgtctcactccaaaatctcggaatacacgccggtgcctaccacgctaacctggagcccgaggataagaccactgtgcatcgtaaatggtctgccaatgagattcaggtcgtcgtggcaactgttgcctttggaatggggattgataagcccgacgttaggttcgtgatacaccactcaatgtccaaaagtatggagaactactatcaggaatcaggacgggcaggacgagatgatatgaaagctgattgtatactctactacggattcggtgacatcttccgcattagctctatggttgtaatggagaacgtggggcagcaaaagctgtatgagatggtgtcgtattgtcaaaatatctccaagtgtagacgtgtgctgatggcccagcattttgatgaggtgtggaattcggaggcttgtaacaagatgtgcgataattgctgtaaagattcggccttcgaacgcaaaaatatcacagagtactgcagggatcttattaaaatcctcaagcaggccgaggaactgaatgaaaagctgacaccacttaagttaatagatagctggatggggaagggcgcagccaagctccgagtggccggtgtcgtagcgccaacactgccacgcgaagatctggagaaaattattgcacatttcctcattcagcaatacctcaaagaggattattcattcacagcctatgcgactatcagttacttgaaaatcggcccaaaagctaacctgctgaataatgaggcacatgcgattacaatgcaagttacaaagtccacgcagaattcctttcgcgcagagtcgagtcagacctgtcatagtgaacaaggggacaaaaagatggaggagaaaaatagcggaaattttcagaaaaaggcggctaacatgctccagcagagtggttcaaaaaatacaggcgcaaagaagaggaaaatagatgacgcttag

SEQ ID NO: 238182 - DNA, 1950 bp, Artificial Sequence
  Description of Artificial Sequence: Synthetic coding sequence
atggccagcgtgagcgcactgaccgaagaactggactcaatcacgtccgagcttcatgccgtggaaatccagattcaggaattgaccgagcggcagcaggaattgattcagaagaaaaaagtgctaacaaaaaagattaagcagtgcctggaagattcagacgcgggtgccagtaacgagtacgatagtagtcctgctgcctggaataaggaagacttcccctggagcgggaaagtcaaggatatcttgcagaacgttttcaaactagagaagtttaggccactccagctagagacaatcaatgtgaccatggctggcaaagaagtctttctggtgatgcccacgggtggcggtaaatccctgtgttatcagctgccagcgctgtgttctgatggcttcaccctggttatttgccctctcatttcattaatggaagaccagctcatggtgcttaagcaactggggatctcagccactatgctgaacgcttcatccagcaaggagcacgtcaaatgggtgcacgccgaaatggtgaataagaattctgagcttaaattgatttatgttactccagagaaaatcgcgaagagtaaaatgttcatgagcagactggagaaggcctatgaagcacgaagattcacccgtatcgcagtcgacgaagtacactgctgctctcaatgggggcacgactttcgccctgactataaggctctgggcatcctcaagagacaattccccaatgcctccctaatcggactgaccgccactgcaaccaatcatgtgttgacggacgcacaaaagatcctgtgcatagaaaagtgcttcacctttacagcctcttttaaccggccaaatctgtattatgaagttcggcagaagccaagcaatacagaggacttcattgaggacatagtcaagttgataaatggaagatataagggacagtcagggatcatctattgcttctcgcagaaagacagtgagcaggtgacagtgtccctgcagaacctggggatacacgctggcgcttaccacgccaatctggagcctgaggacaagactaccgttcaccggaaatggtctgccaacgagattcaggtggtggtcgccacagtggccttcggcatggggatcgataagccggacgtcagattcgtcattcaccattccatgtctaaaagtatggagaactactatcaggaatcagggagagccggtcgcgatgacatgaaagccgactgtatactgtactatggcttcggcgatattttccgtattagtagcatggtagtgatggaaaacgtggggcagcagaaattgtatgaaatggtatcatactgtcaaaacatttctaagtgccggagggtgctgatggcccaacactttgatgaggtgtggaattccgaggcctgcaacaaaatgtgtgacaattgttgcaaggattctgcctttgagcggaaaaacattaccgagtattgcagggacctcatcaaaattctgaaacaggccgaagagctgaacgagaagctgacccccctaaaactcatcgatagctggatgggcaaaggtgcagccaaactgagggttgcgggagtggtcgctcccacactcccgcgtgaggatttagagaaaattatcgcacattttttaattcagcagtacctgaaggaggactacagctttacggcatacgccaccatctcctacctgaaaatcgggcctaaagctaatctgctcaataacgaggctcacgccatcaccatgcaggtgactaaaagcacccaaaattcctttagagcagagtcttcccagacatgccattcagaacagggggacaagaaaatggaggaaaagaattccggcaacttccaaaagaaagctgccaatatgctgcagcagtccggatccaagaacaccggcgcaaaaaaacggaaaattgatgacgcttag

SEQ ID NO: 238183 - DNA, 321 bp, Artificial Sequence
  Description of Artificial Sequence: Synthetic coding sequence
atggcctcagtgtccgctttaactgaggaactggacagcataacctcagaattacacgccgtcgagattcaaatccaagagttgacagagcggcagcaggagctgatccagaagaaaaaagttctgacaaaaaaaatcaagcagtgtctcgaggactctgatgcaggcgcttctaatgaatacgactcgagtccagccgcatggaacaaagaagacttcccgtggagcggtaaagtcaaggatatccttcagaacgtgtttaagcttgaaaagtttcgccctttgcagctggaaaccattaacgtgactatggcagggtag

SEQ ID NO: 238184 - DNA, 294 bp, Artificial Sequence
  Description of Artificial Sequence: Synthetic coding sequence
atggcatctgtttctgccctgactgaggaacttgacagcatcacaagcgagctccacgctgtggaaatacaaattcaggagctgaccgaaaggcagcaggagcttattcaaaaaaagaaagtcctcacaaaaaagatcaagcagtgcttggaagattctgatgccggagctagtaacgagtatgactcatcaccagcagcatggaacaaggaggattttccatggtcagggaaggttaaagacatacttcagaatgttttcaagctcgagaagttcagaccattgcagctctag

SEQ ID NO: 238185 - DNA, 219 bp, Artificial Sequence
  Description of Artificial Sequence: Synthetic coding sequence
atggctagcgttagcgcactgacggaagagttggactcaattaccagcgagctgcacgcggtagagatccagatacaggagctcaccgagcgccaacaggaactgatccagaaaaaaaaggtcctaactaagaagataaagcagtgtctagaggacagtgatgccggagcttctaatgaatacgactcttcccctgctgcttggaataaggaagattag

SEQ ID NO: 238186 - DNA, 396 bp, Artificial Sequence
  Description of Artificial Sequence: Synthetic coding sequence
atggccagcgtgtcagctctgacagaggagctagactcaattacctccgagcttcacgcagttgagattcagattcaggaactgaccgagaggcagcaggagctgattcagaagaagaaggtcctcaccaaaaagatcaaacagtgcttggaggactccgacgctggcgcatcgaatgagtatgacagctccccagctgcctggaacaaagaggattttccatggagtgggaaagtaaaagatattctccagaatgtgtttaagctggaaaaatttcgtccactgcagcttgaaactatcaacgtcaccatggctggaaaggaggtgtttctggtgatgcctaccggaggtggcaagtctctttgctaccagctccccgcactctgctcagactag

SEQ ID NO: 238187 - DNA, 2976 bp, Artificial Sequence
  Description of Artificial Sequence: Synthetic coding sequence
atgtcctcacatcacaccaccttcccttttgatcctgaacggagagtgaggagcactctgaagaaagtgtttggcttcgattcctttaaaacccccctgcaggagagtgctacaatggctgtcgtgaagggtaataaagatgtgttcgtctgcatgccaaccggtgccggaaaaagtctgtgctatcagttacctgccctattggccaagggcatcactatcgtagtaagcccactcatagccctgattcaagaccaggtggaccacttgctgactttaaaggtgcgagtgtctagcctcaatagcaagttgtcagcgcaagaaagaaaagaactgttggctgatctggaaagggaaaagcctcaaaccaagattctatacatcactccggaaatggcggcttcttccagcttccagccgacattgaatagcctggtcagcagacacctattgtcttatctggtcgtggatgaagcacactgtgtgtcccaatgggggcacgacttccgtcccgattacctcagactcggcgcactccgatccagactagggcatgcaccttgtgtcgcgctgaccgctactgctactccacaggtgcaggaagatgtgtttgcggctctgcacctgaagaagccggtggctatctttaaaacgccatgttttagagcgaaccttttttacgatgtgcagtttaaggagcttatatccgacccttatggaaacctgaaggatttctgcttaaaagccctggggcaggaggccgataaagggttgtctggctgcggaatcgtctattgcagaactcgtgaggcctgtgaacagctggccattgaactgtcatgtagaggtgtcaacgcaaaggcctatcacgccggactgaaggcgagtgagcggactctcgttcagaatgactggatggaggaaaaggttccagtgattgtggccacaatctccttcggaatgggtgtggataaggccaacgtgagattcgtggctcactggaacattgccaagtcaatggccggatattaccaggagtccggaagggccggacgggacggtaagccctcctggtgccgactgtactattcacggaacgatcgcgatcaggtgtcatttctgatccggaaagaggtcgcaaagcttcaggaaaagagaggtaacaaagcctcagataaggccacgattatggcatttgacgcacttgtgacgttctgcgaagaactgggttgtagacacgccgcaattgctaagtacttcggggacgccctccctgcttgtgcaaaaggttgcgatcactgccagaatccaaccgcagtgcgcagacgcttagaggcgctggagcggtcttcctcttggtctaaaacctgtataggaccgtcccagggtaacgggttcgatccagagctttatgagggcggacgcaagggctacggtgacttttcacgatacgacgaaggctccgggggatctggcgatgaggggcgagatgaagctcataagcgagaatggaacctcttctatcagaaacagatgcagttgagaaaaggtaaggacccaaaaatcgaggaattcgtgcctcctgatgagaactgccccctcaaggaggctagttctagacggattcctcgattgaccgtcaaagcacgtgaacactgtctcagactcctcgaggaagcgctgtcgagtaatcgccagtcaacaaggaccgcggatgaggccgacttacgagctaaggccgtcgagctcgagcatgagacttttagaaatgccaaggtagccaatctgtataaggcctctgtcctgaaaaaggttgcagacattcaccgcgctagcaaagatgggcaaccttatgatatgggtggttctgctaagtcctgttcagctcaagctgaaccacccgaacccaatgagtatgacatacctccagccagccacgtgtatagtctgaagccgaaacgggtcggagccggttttcctaagggcagctgtccttttcaaactgctaccgaactcatggaaactacgcgcatccgcgaacaggccccacaacccgagcgcggtggcgagcatgaacccccttcacgaccttgcgggctgctggacgaggacggctctgagcccctgcccggaccgagaggcgaggttccaggcggttcagctcactatggtggcccttcacccgagaagaaggctaagtcttcttccgggggtagctcactggctaaaggaagagcctctaagaagcagcagctgctggcaactgccgcacacaaagactcacaatccatcgcacgatttttttgtcgccgagtggaatcccctgcacttttagctagcgcaccggaggccgagggtgcctgtccaagctgcgagggtgtccaggggccacccatggcccctgagaagtatactggagaggaagacggggcaggagggcacagtcccgctcctccacaaaccgaagaatgcctgcgcgaaaggccttccacctgtcccccacgggaccaggggacgccggaagttcagcccacacctgcaaaagacacatggaaaggcaagagacccagatctcagcaagagaacccagagtcacagccccaaaagcgtcctcgcccatctgccaagcccagcgtggtggccgaagttaagggcagtgtcagtgcctcagaacagggtacccttaatccaaccgctcaggaccctttccagctgagtgcacctggggtgagtcttaaggaagcagctaacgttgtagtaaaatgcctcaccccgttttacaaagaggggaagttcgcttccaaggaactgtttaaggggtttgccaggcacctttcccacctcctcactcagaaaacgagccctgggcgttcagtcaaagaagaagcacagaaccttatacggcacttttttcacggcagagctcgctgcgaaagtgaggcagactggcatggactctgtgggccacaacggtag

SEQ ID NO: 238188 - DNA, 1308 bp, Artificial Sequence
  Description of Artificial Sequence: Synthetic coding sequence
atgagcagccatcacactaccttccccttcgatccggagcgacgagtgcgcagcacgctgaagaaggtgttcgggttcgacagttttaagacccctctgcaagagagcgccactatggccgtggtcaaggggaacaaggacgtgtttgtttgcatgccgaccggcgctggtaagtcactgtgttatcagttacccgctctcctggcgaagggaattacaatcgtggtatctccactgatcgctcttatccaggatcaagtggaccaccttctcactctgaaagtgagggttagctcactcaattctaaactgagcgcccaggaacgcaaggaactcttggctgatcttgagcgagaaaaaccccagactaagatcctgtatatcacaccggagatggccgcaagttcatcatttcagccgacccttaactccctggtgagtaggcatctgttatcctatctcgtcgtcgacgaggcccattgcgtgagtcagtgggggcatgatttccgaccggattacttacggttaggcgctctgaggagtcgtctgggccacgccccttgcgtggcgctgaccgctacagctacaccacaagtgcaggaggacgtgtttgctgcgctgcacctgaagaaacctgtggccatattcaagactccatgttttcgcgctaacctgttttacgacgttcaattcaaggagctaatcagcgatccatatggtaatcttaaagatttttgcctgaaggccctggggcaagaggcagataaagggctgagcggttgcggaatagtctactgcagaacccgggaggcttgcgaacagctggcaattgaactctcttgtcggggagtcaatgcaaaggcctatcacgctggcctaaaagcttccgaacgcactctggtacaaaatgattggatggaggagaaagtgccggttattgtcgctacaatttcctttgggatgggcgtagacaaggctaatgttcgctttgtggctcattggaacatagcaaaaagtatggccggttactaccaggagagcggaagggccggtagagacggaaagccatcatggtgccggctatattatagtaggaatgacagagaccaggtttcgtttctgattaggaaggaagtggcgaaattgcaagaaaaaagagggaacaaagcttcagacaaggcaaccataatggcctttgatgctctcgttaccttttgcgaagagctgggcagatggggcagggggcatggaaaaagcttaagggccgcttggtgcagccaggtggtgagcaggcacgccgaactgtag

SEQ ID NO: 238189 - DNA, 1233 bp, Artificial Sequence
  Description of Artificial Sequence: Synthetic coding sequence
atgagctctcaccacactactttccccttcgatcccgagagacgggtccggtctaccctcaaaaaggtctttgggtttgatagttttaagacccctctccaggagtctgctacaatggcagttgtgaaggggaataaggatgtgtttgtctgcatgcctacgggcgctggaaaatctttgtgctatcagctgcctgccttgctggcgaaaggaatcacaattgttgtatctcctctaattgccctgatccaggatcaggtcgatcatctactcacactgaaagttagagtctcatctctgaactcaaagttgagtgcccaggaacggaaagaattgctggcagatctggagagagagaagccccagaccaagattctgtacatcacccccgagatggctgcatcctcctcttttcagcctacattgaactcccttgtgtcgagacatctgctcagttacttggtggtcgatgaggcccactgcgttagtcaatggggccacgatttcaggccagactacctccggctgggagccctgaggtcacgcctagggcatgcgccttgtgtcgcgctaaccgccactgcaaccccacaggtgcaggaggacgtgttcgccgctctgcacctcaagaaaccggtcgccatcttcaaaacaccgtgctttcgggcaaacctgttttacgatgtgcagttcaaagaactgatctcagatccatacggcaacctgaaggatttttgcctgaaagcacttggacaggaagcggataagggactgtctggttgcggtattgtttactgtcgcacacgggaagcgtgtgagcagttggccatagaactttcttgcagaggcgtcaatgcaaaggcctatcatgcaggcctgaaggcttccgagaggacactggtccagaacgactggatggaagagaaagttcctgtgatcgtggctaccataagctttggcatgggggttgacaaagccaatgtgcgtttcgttgctcactggaacatcgccaaatctatggctggttactaccaggaatccggcagggccggacgtgacggcaagccgtcctggtgtcggctctactacagtagaaatgatcgggatcaggtctcattcctgattcgaaaagaggtggccaaactgcaagaaaagaggggtaacaaagccagtgacaaggctactattatggcttttgatgcactcgttacattttgcgaggaattaggatag

SEQ ID NO: 238190 - DNA, 3057 bp, Artificial Sequence
  Description of Artificial Sequence: Synthetic coding sequence
atgtcatcccaccatacaactttcccatttgatccagagagaagggtgagatcaacactgaaaaaggtcttcggctttgacagcttcaaaacaccactgcaggagtcagctacaatggcagtcgtgaaaggaaacaaggacgtctttgtctgcatgccaacgggcgcaggaaagagtctttgctaccagctgcccgctcttttagctaaagggatcaccatcgtcgtgagtccgttgatcgcactgattcaagatcaggtagatcatctgctgacccttaaggtgagagtttccagcttaaatagcaaactgagcgcccaggagcgaaaagagcttttggcggacctggagcgcgaaaaacctcagactaaaatcctatatatcacacccgaaatggcagctagtagcagcttccagccgactttaaactccttggtcagtaggcacctgctgagctaccttgtcgtggatgaggctcactgtgtcagtcaatggggacatgatttccggcctgactatttgcgcttaggggcattgcggtccaggttgggccacgcgccatgtgtggccttgacagcaaccgctacaccccaggttcaggaagatgtatttgccgctttacacctgaaaaagccagtcgctatcttcaagacaccctgcttcagggcgaatctgttctacgatgtgcagttcaaggagctgatatcagacccttacggcaatctcaaggatttctgcctgaaggccttgggccaagaagccgataagggcttgtcaggctgtggaatagtctactgtcggacgagagaagcttgcgaacagctcgccatagagctctcttgtaggggggtgaacgctaaggcttatcatgctggattgaaagctagcgagaggaccttggtgcagaatgactggatggaggaaaaagtgcctgtcattgtggcaacaatcagctttggcatgggggtggacaaggccaacgtcaggtttgtggctcactggaatattgccaagagcatggctgggtattatcaagaaagcggtcgcgcagggagagatggcaagccatcatggtgccggctgtattattccaggaatgaccgcgatcaggtgagcttcctcattaggaaggaggtcgccaagctgcaggaaaagcggggaaacaaggcctctgacaaagccacaattatggcctttgatgccctagtcaccttctgtgaggagctcggctgtcgccatgcggcaattgctaaatatttcggggatgcgctgcctgcatgcgctaagggctgcgaccactgtcaaaaccccacagcagtacgaaggcgcctggaagcacttgagcgttcgtcttcctggagtaagacatgtattgggccttcacaggggaacggcttcgatcccgaactttacgagggaggcaggaagggctacggtgatttctctagatatgatgagggttccggaggcagcggagatgagggcagggacgaggctcacaagcgagaatggaatcttttctaccagaagcagatgcagctgcggaaaggcaaggatccaaaaattgaggagttcgttcctcccgatgaaaactgcccactcaaagaagcctccagcaggcgcatcccacgtcttactgtgaaagctagggagcattgtctcaggctgttagaggaggcattgagcagcaatcgacagtctacacggacagccgacgaggcagatttaagagccaaggcagtcgaactggagcacgagactttccgcaatgcgaaggtggctaacctgtacaaggcttctgttctgaagaaggtcgccgatattcaccgggctagcaaagatggccagccctacgacatggggggatcagccaagtcgtgctccgctcaagctgaacccccagagcccaatgagtatgatattccacccgcatctcacgtttattcgctaaagcctaaacgagtcggagctggattcccaaagggaagctgtcctttccagactgcaaccgagctgatggagaccaccagaatacgagaacaagcacctcagcccgaacggggaggagagcatgaaccgcctagtaggccctgtggtttactggatgaggatgggtccgaacctttaccgggtccacgtggggaggttccaggaggttccgcacactatgggggtccttcgcccgaaaaaaaggcgaagtcaagcagcggcggtagttcacttgctaaaggaagggcatccaagaagcagcaattgctggcaaccgcagcccacaaggacagtcaatctatcgcacggttcttctgcaggcgcgtggagtcccccgcactgctggcatctgctccggaggctgaaggggcttgccccagttgcgaaggggtgcaaggccctcccatggcgcctgagaagtatacaggtgaggaagatggagccggaggacactcacctgctccaccccagaccgaggaatgcctcagggagcgcccttctacctgccctccacgggatcagggcacccctgaggttcagcctacgccagcaaaggatacttggaaaggcaagagacccagatcacagcaagaaaaccccgaaagtcagccccagaaacgcccaagaccctctgccaagccctctgtggtggctgaagtgaaagggagcgtgtctgcttccgaacaagggacgctgaacccgacggcccaagacccttttcagctgtccgctcctggcgtaagtctgaaggaggccgctaatgtggttgtgaaatgcctgactcctttctacaaggaaggaaagtttgcctccaaggaactgtttaagggtttcgcaaggcaccttagccacctcctaactcagaagaccagcccaggtcggagcgtcaaagaggaggctcagaacctgatacgccactttttccacgggcgagcacggtgcgaatccggtccacacggatgggttttctgggacacgtgtagagggcagaaggtcgaaggagggggagctgccgcaggcagaaggggcagaaaatcaggcccatctccatctagtaaatccggttag

SEQ ID NO: 238191 - DNA, 1761 bp, Artificial Sequence
  Description of Artificial Sequence: Synthetic coding sequence
atgtttctggtgcgttgtaggcacgctgccatcgccaaatatttcggagatgccttgcccgcttgcgctaaagggtgtgatcactgtcagaatcccacagccgtccgtaggcgcttggaggcactcgaacggagctcctcttggagcaagacttgcattggtccttctcaaggcaacggcttcgaccctgaactgtacgagggcggaaggaagggatacggagatttcagccgctacgacgaggggtccgggggaagcggggatgagggacgggatgaggcccacaagagggagtggaatctcttttaccagaagcagatgcaactgaggaagggtaaggaccctaaaattgaagaatttgtgccgccagatgagaattgccctctcaaagaggcctctagccgcagaatcccacgactaacagtcaaggccagggagcactgtcttagattactggaagaagccctttccagtaaccgccagtcaactagaaccgctgatgaagcggatttaagggccaaagccgtggagctggaacacgagacatttcgcaacgccaaagtggccaacctgtacaaggcctctgtgctcaaaaaagtagccgatatacatagagcgagcaaggatgggcagccgtacgacatgggaggaagtgcaaaaagttgcagtgctcaggctgagccgcctgaacccaacgagtacgacatccctcctgcatcgcatgtctattccctcaagccaaaacgggttggagcagggtttccgaagggatcttgtccttttcagaccgcgactgaactcatggaaacaactagaatcagggaacaagcgcctcaaccggaaagaggtggcgagcatgagccaccctctagaccgtgcgggttattggatgaagatggttcagagcccctccccggacctcgcggagaggtgccgggaggctccgcacattatgggggaccgtcgcctgaaaaaaaagccaagagtagttccggaggctcctccctagccaaaggtagagcttcaaaaaaacagcagctgcttgccaccgcagcacataaggattcccagagcattgcacggttcttctgtcgcagggttgaaagccctgctctcctagcaagcgctccagaagccgagggtgcgtgtcctagctgcgagggtgtgcagggcccaccgatggcacccgaaaaatacacaggcgaggaagatggggcaggaggacactcgccagctccccctcagactgaagagtgccttagggagaggccatctacctgcccccctagggaccagggcacccccgaagttcagcccacccctgcaaaggacacatggaaaggaaaaaggcctagaagtcaacaagagaacccggaaagccagccacaaaaaagaccacggccttcggccaagccctccgtggtcgccgaggtgaagggatccgtgagtgcatccgagcagggtaccctgaacccaacggctcaggacccgtttcagttgagtgcccctggggtcagcctcaaggaggctgctaatgtggttgtgaaatgcctcacacctttctataaggaagggaaattcgcttccaaggagctgttcaaaggatttgctaggcacctcagccatttactgacccagaagaccagtccagggcgatctgtcaaggaggaagcccagaatctgatcagacattttttccacggcagggccaggtgcgagtctgaggcagactggcacggcctgtgtgggcctcagcggtag

SEQ ID NO: 238192 - DNA, 1200 bp, Artificial Sequence
  Description of Artificial Sequence: Synthetic coding sequence
atggcccagcgggctttccctaatccatacgcagattataacaaaagtctcgctgagggctactttgatgccgcagggcgacttactcctgaattttcccagcggttgactaataaaattagagagctcctgcaacagatggaaagaggtttaaagtctgccgaccctagggacggaacaggatataccgggtgggctggcatcgcagttctctacttacatctgtatgatgtgtttggcgatcctgcttatctgcagctcgcccatggctacgttaaacagagtctgaattgcctgaccaaacgatctatcacctttctgtgcggcgacgccggaccattagccgtagccgcagttctttatcataaaatgaataacgaaaaacaggcggaggattgtatcacccggttgatccatttgaacaagattgatccccacgctcctaatgagatgctctatgggagaataggctatatttacgctctgctgtttgtgaataaaaacttcggagtagagaagattccccagagtcacattcagcagatttgcgagacaatcctcacctctggcgagaatctggcccgaaaacgcaacttcaccgccaaaagtccccttatgtacgaatggtaccaggaatactacgtcggagccgctcatggattggccggaatctactattacctgatgcagcctagcttgcaggtcagtcagggcaaacttcacagcttggttaaaccctcagtagactatgtttgccagctaaagtttcctagcgggaactatcctccctgcataggggataatagagacctgctggtgcactggtgccacggtgcacccggagtgatctatatgctcatccaggcctacaaggtattcagagaagaaaaatacctctgcgacgcatatcagtgcgccgatgtgatctggcaatatggactgctgaagaaagggtacggactctgtcatggcagcgcaggcaatgcctacgcatttctgacgttgtataacttgactcaggacatgaagtacctgtatagagcttgcaaattcgcggagtggtgcctcgaatacggtgaacatgggtgccggacccctgacacacctttttccctcttcgaggggatggcaggcaccatctactttctggccgatctgctcgtacccaccaaagctaggtttcccgcattcgagctctag

SEQ ID NO: 238193 - DNA, 528 bp, Artificial Sequence
  Description of Artificial Sequence: Synthetic coding sequence
atgctccctcccatggcgctaccttcggtgtcctggatgctgcttagctgcttgatactcttgtgtcaggtgcagggcgaagaaacacagaaggaattgcctagtcccagaatctcatgtcccaagggatccaaggcttacggatctccttgttatgccctctttctcagccccaagtcctggatggacgccgacctggcctgccaaaagcgcccttcgggcaagcttgtctcggtgttatccggtgcggaaggttcattcgtcagtagtctcgtccggtccatatcgaacagctattcgtatatctggataggcctccatgaccctacacaaggcagcgaacccgacggggatgggtgggagtggtcctccacagacgttatgaattacttcgcgtgggagaagaacccctctaccatccttaaccctggccattgcggtagcttaagtaggagcacaggattcctgaagtggaaagattacaattgcgatgccaaacttccttacgtctgtaaattcaaagattag

SEQ ID NO: 238194 - DNA, 528 bp, Artificial Sequence
  Description of Artificial Sequence: Synthetic coding sequence
atgctgccccctatggctctaccatcggtgtcttggatgctcctcagctgtctcatccttctctgtcaggtgcaaggagaggagactcagaaggaattgccatctcctcggattagctgtcccaaaggctccaaagcctacgggagcccatgttatgccttattcctttccccaaagagctggatggacgcagacctggcatgccagaaaagaccctccggaaaactcgtaagtgttctaagcggggctgagggcagttttgtgagcagcctggtaaggagcatctcaaatagttacagctatatctggattggcttacacgacccaacgcagggtagcgaacctgatggagatggttgggagtggtcttcaaccgacgtgatgaactactttgcctgggaaaagaatccatccactatcttgaacccagggcactgtgggtctctctccaggtcgacagggttcctcaagtggaaggactataactgcgatgccaagcttccttatgtgtgtaaatttaaggattag

SEQ ID NO: 238195 - DNA, 390 bp, Artificial Sequence
  Description of Artificial Sequence: Synthetic coding sequence
atgctcccacccatggcgctgcccagcgtgagctggatgctgctttcctgcctgatcctgctctgccaagtacaaggggaggaaactcaaaaggagctaccctcccccaggatatcttgtccaaaaggctctaaggcctatggatcaccttgctatgctctgttcctgtcacccaagtcatggatggacgccgacggatcagagcctgatggggacggctgggagtggtcctctacagacgtcatgaactactttgcttgggagaagaaccctagcacaatcctgaacccgggacactgcgggagcctgagtcgctcgactggcttcctgaagtggaaggactacaattgtgatgctaagctcccatatgtgtgcaaattcaaggactag

SEQ ID NO: 238196 - DNA, 477 bp, Artificial Sequence
  Description of Artificial Sequence: Synthetic coding sequence
atggcttcgaggtcaatgagacttctactgttgctctcatgtctggcaaagaccggggtcctcggcgatatcataatgcggccatcttgcgctcccggatggttctaccataagtccaattgttacggctattttcgcaaactccgcaattggtccgacgctgagcttgagtgtcagtcttacggaaatggagcgcacctagcctccattctgagcctgaaagaagcatccaccattgctgagtacatctccggctaccagagaagccagcctatttggatcggcctgcacgacccccagaaacgtcagcagtggcaatggatagatggagccatgtacttatacaggtcatggtctgggaagagcatgggcggtaataagcactgcgccgagatgtctagcaacaataattttttgacttggtcatcaaatgagtgtaataaacgccagcactttctttgtaaatatcggccatag

SEQ ID NO: 238197 - DNA, 477 bp, Artificial Sequence
  Description of Artificial Sequence: Synthetic coding sequence
atggccagtagaagtatgaggttgttgctattactcagctgtctcgcgaaaactggcgtcctaggagatatcattatgcgcccttcttgtgctcccggatggttctaccacaagtccaactgctacgggtatttccgcaaattgagaaactggtccgatgcagagttggaatgtcaatcctacggcaatggcgctcatctggcaagcatcttgtctctaaaagaggccagcactattgcggagtacatcagcgggtaccaacgatcgcagcccatttggattggtctgcatgatccgcagaagaggcagcaatggcagtggattgatggggctatgtatctgtaccgatcttggtctgggaagagcatgggtggaaacaagcattgcgccgagatgagctccaataataactttcttacttggagctccaacgagtgcaataagagacagcatttcttatgcaaatacaggccatag

SEQ ID NO: 238198 - DNA, 405 bp, Artificial Sequence
  Description of Artificial Sequence: Synthetic coding sequence
atggcctctagatccatgcggctgctgctgttgttgagttgtctggcaaagactggagtcctcggggacattatcatgaggccatcatgtgcccctggctggttctatcataagtctaactgttacggttacttccggaagcttagaaactggtccgatgcggaagtccggaatctgctgccggcttggcccggactgtcaagagccaaggatcaaccagagccccaaatttctttcgacagcggctcttctgtactgcctggccactacgaggagaagcccctgtggctggtcaaatggagagaagagggctgcgtgttcaatagtttcaactcggtctctattgcggaggccggagctgtctgtcaaacgctggatggattgcaggcccacactgatacttag

SEQ ID NO: 238199 - DNA, 375 bp, Artificial Sequence
  Description of Artificial Sequence: Synthetic coding sequence
atggccagtaggtccatgaggttgctgctgttgctgtcatgcctggccaagacaggcgtacttggagacattattatgagaccctcctgcgcccctgggtggttctaccataagtctaactgctacggatattttagaaagctgaggaactggagcgatgccgagctggaatgtcagtcctacggtaatggagcgcacctcgcctctattctgagcctcaaggaggcttctaccattgccgaatacattagtggataccaaaggtctcaacccatttggatcggtctgcatgatcctcagaagcagcccttaaactcttgtcttttcttcctgtggccttgggaaggtctgccagtagagtctctgctgggttag

SEQ ID NO: 238200 - DNA, 900 bp, Artificial Sequence
  Description of Artificial Sequence: Synthetic coding sequence
atgagcagtattaaaattgaatgtgtcctccccgagaattgtcggtgcggagagtcacctgtctgggaggaagtcagtaattcacttctattcgtggacatccctgccaaaaaagtgtgcaggtgggatagttttacaaaacaggtgcagcgcgttacaatggatgcacctgtgtcctctgtggcattacgacagagcgggggttatgtggccaccatcggaactaagttttgtgcgctcaactggaaggagcagagcgcagtcgttttagctaccgttgacaacgacaagaagaacaatagattcaatgatggtaaagttgaccctgctggcagatacttcgctggtaccatggccgaggagacagcaccagccgtcctggaaagacaccagggtgcactgtattcgctgtttcctgaccaccacgtgaagaagtacttcgaccaggttgacatcagcaatggactggactggagtctcgatcataagatcttctactacatcgatagcttgtcgtactctgttgacgcattcgactatgacctccaaacaggccagatctccaaccggcgaagcgtctacaagctggagaaagaggaacagatccctgatgggatgtgtatcgatgcagaggggaagctctgggtcgcttgctacaacggtggaagagtgatcagacttgaccccgttaccgggaagagactccaaacggtaaaactaccagtcgacaagaccacctcctgctgctttggaggcaagaactattcagagatgtacgtgacttgtgcccgtgacggcatggaccccgaggggctgctcagacagccagaggctggaggaatctttaagatcactgggctgggggtgaaaggaatcgcgccatactcttacgctggatag

SEQ ID NO: 238201 - DNA, 900 bp, Artificial Sequence
  Description of Artificial Sequence: Synthetic coding sequence
atgagcagtatcaagatcgaatgtgtgctccctgagaattgtcggtgtggagaaagcccagtgtgggaggaggtgagtaactccttacttttcgtagacattccggcaaagaaggtatgtagatgggactcatttaccaagcaggtgcagagagtgacaatggacgcccctgttagctctgtggcactccgacaatcaggcggatacgttgctaccatcgggactaaattctgcgcgctcaactggaaagaacagtcagcagttgtcctagccacagtagacaacgataaaaagaacaaccgcttcaacgacggcaaggttgaccctgcaggcagatacttcgcgggaacaatggctgaagaaaccgctcctgccgtgcttgaacgtcaccagggagccctctactccctctttcctgaccaccacgtcaaaaaatatttcgaccaagtagacatatcaaatggtctggactggtctctggatcacaagatcttttattatatcgacagcctgtcctatagtgtcgacgcattcgattacgacctccagacaggccagatctctaaccgcaggagcgtctacaaacttgaaaaagaggagcaaattcccgacggcatgtgtattgacgccgagggcaaactgtgggtagcctgttacaatggaggaagggttatccggctagatcccgtcaccggcaagagactacagaccgtgaaactacccgtggacaaaaccacatcctgttgcttcggcggaaagaactattctgaaatgtacgtgacgtgtgcccgagatgggatggatcctgagggccttttgcgccagccggaagcaggcggtatcttcaagatcaccggattgggcgtgaagggcatagcaccatatagctatgccggatag

SEQ ID NO: 238202 - DNA, 900 bp, Artificial Sequence
  Description of Artificial Sequence: Synthetic coding sequence
atgtcttcgataaagatcgaatgtgtgctgcccgaaaactgccggtgcggagagtcccccgtttgggaagaggtgagtaacagcctactgtttgtggacattcctgccaagaaagtctgtcgatgggatagcttcaccaagcaggtccagcgagtaacaatggatgctcccgtttcttcggtagcactgcgccagagcggaggatacgtggccactatcgggaccaagttctgtgctttgaactggaaagaacaatctgccgtggtgctggccacggtggataatgataagaagaataataggttcaacgatggtaaagtcgatcctgcaggtagatacttcgccggtactatggcagaggaaacagccccagctgttttggaaagacaccaaggcgctctgtattctttgttccccgaccaccatgttaagaaatacttcgatcaggtagatattagcaacggtttagattggtcgctggatcataagatattttactatatcgacagtctctcatattccgttgacgccttcgactatgatctccagaccggacaaatttcaaacaggaggagtgtatataaactggagaaggaagagcagattccagacggaatgtgcatagacgcagagggcaaactgtgggtagcgtgttacaacggcggtagagtgataagacttgacccagtgacaggcaaacgtctccagaccgtgaaacttccagttgacaagactaccagctgctgctttggcggtaagaactactcagagatgtacgttacttgcgccagggacgggatggaccctgagggactgctgaggcagcctgaggcgggaggtatctttaagattacaggcctgggagtgaagggtatcgcaccgtattcctatgccggttag

SEQ ID NO: 238203 - DNA, 684 bp, Artificial Sequence
  Description of Artificial Sequence: Synthetic coding sequence
atgagctcgattaaaatagagtgcgtgcttcccgaaaattgcaggtgtggcgagagcccggtctgggaggaagtgtctaattctctactgttcgtggatatccctgccaaaaaggtttgtaggtgggacagcttcaccaaacaggtccaacgggtgactatggatgcgcctgtgtctagtgtggccctccgccagtccggcggttacgtggcaactatcggtaccaagttctgcgcactaaactggaaagaacagtcggccgtggtgctcgcaacagtcgacaacgacaaaaagaacaatcggttcaacgatggcaaggtggatccagccggtcggtacttcgccgcaaacagaagatctgtttacaagctggaaaaggaagaacagatccccgatggaatgtgtatcgacgccgaaggaaaactttgggtcgcatgttacaatggaggaagggttatcagactcgacccggtgactggcaagcgcctgcagaccgtgaaattgccggtcgacaagaccacaagctgttgctttggaggaaagaattactccgaaatgtatgtgacctgtgcaagagacggtatggatcctgagggcctactgaggcagccagaggctggcggtatttttaaaatcacagggttgggggtcaaaggcattgccccttactcttacgcgggatag

SEQ ID NO: 238204 - DNA, 3876 bp, Artificial Sequence
  Description of Artificial Sequence: Synthetic coding sequence
atgagctctgcggtaggtcccaggggaccgcgacccccaactgtgcctccgccaatgcaagagcttccagatttgagtcacctaaccgaggaggagagaaatattattatggcagtgatggacagacagaaagaggaggaagagaaggaggaggctatgctgaaatgtgtcgtgagagacatggccaagcctgctgcatgcaaaacgccacgtaatgcagaaaaccagccccatcagccatctccaaggctgcaccagcagtttgaatcctataaagaacaggtgaggaaaatcggagaggaagccaggcgatatcagggggagcataaagacgatgccccaacttgtggcatctgtcataagacaaagtttgcagatgggtgcggccatctctgctcatactgtcgcacaaagttttgcgcaaggtgcgggggtcgcgtctcactgcgttctaacaatgaggacaagtacgtaatgtgggtctgcaatttatgccggaagcagcaggagattttaacgaaatcaggggcatggttctttggatccggcccacagcaaacctcacaggacgggacactaagcgataccgccacgggggctggatcagaagttccaagagaaaagaaggccaggctacaagagagaagtcggtcccagacccctttgagtactgctgcagcctcttctcaagacgccgctcctccttccgcccctcctgacaggtcaaaaggtgctgagccgagtcagcaggccctgggacctgagcagaagcaagcgtcctcccgctcccggtcagaaccacctcgagaacgcaaaaaaacccctgggctgtccgaacagaacggcaagggggctctgaaaagcgagaggaagcgcgttcctaaaacctccgcgcaaccggtggaaggagccgtggaggaacgcgaacgaaaagagcggcgtgagtcaaggcggctggagaagggacggtcacaggactaccccgatacaccggagaagcgtgacgaaggcaaggccgctgatgaagaaaaacagaggaaagaggaggattatcagactcggtaccgatccgaccctaatctggccagatacccagtgaaacctccccctgaggaacaacagatgcgcatgcacgccagggtctcccgcgctaggcacgagagacggcactccgacgttgcccttccaaggaccgaggctggcgctgccctgcctgagggcaaggcgggtaaaagagcgcctgcggcagcacgcgctagtccgcctgattcccccagagcctattctgcagagaggacagctgagaccagagcacccggtgccaagcagctgaccaaccatagcccccctgccccaaggcatggtccagtcccggctgaagcccctgaacttaaagcgcaggagcccctaagaaagcaatctcgcctggacccgagctcagctgtgttgatgaggaaggctaagagagagaaagtcgagacaatgctccgtaatgacagcctgtcaagcgatcagagcgaaagtgtgcgaccctccccaccaaagccccacaggagtaaacgcggaggcaaaaaaagacaaatgtctgtatcctcttcagaggaggagggcgtgagcactcccgagtacacctcatgtgaggatgtggaactggaatccgagagtgtgtccgagaagggagatctagactactactggctcgatccggcaacttggcacagccgagaaacatcaccaatcagttcgcaccccgtcacttggcaaccatccaaggagggtgaccgcctgattggcagagtcatactcaataagagaacaactatgcccaaagattctggagccctactggggctaaaagttgttggtggcaagatgaccgacctgggaaggttgggcgctttcatcacgaaggtcaaaaaaggaagtctggccgatgttgtgggtcaccttcgtgcgggagatgaagtgctcgagtggaatggtaaacccttacctggcgcaacaaatgaggaagtctacaatataattcttgagtcgaagtctgaacctcaagttgagatcattgtgagtcgtccgatcggggatatcccacgaattcctgaaagctctcatcctcctctcgaatcgagctccagctcttttgagagccagaagatggaacgaccaagcatcagtgtgatttcaccgaccagtcctggcgcactgaaagatgccccacaagttttacctgggcagctgagcgtcaagttatggtatgacaaagtcggccatcaattgattgtaaatgtcctccaggctaccgacctgcctgctcgagtcgacgggcgacctcggaatccctacgtaaagatgtacttcctgcctgaccgctcagacaagtccaaaagacgtacaaagacagtaaaaaagatcttagagccaaagtggaaccagaccttcgtttatagtcatgttcaccgtcgggattttcgagaacgaatgctggagattaccgtgtgggaccagcccagagtacaggaggaagaatcggagttcctaggagaaattcttattgaactcgaaaccgctctccttgacgacgagccgcattggtacaagttgcagactcatgacgagagcagtcttcccttgccacagcccagccctttcatgccgaggcgtcatatccacggcgagagtagctctaagaaactgcagcgctctcagcggatttccgattcagacatatccgattatgaggtggacgatggcatcggcgttgtgccacccggttacagatccagtgctcgagaatctaagtccacgactttgactgtgccagagcagcaaagaaccacacatcacaggtcacggtccgtgtcaccacatcgtggtaacgaccaagggaaacctcgttcgcgattacccaacgttcctcttcagcgctccttggatgagatccaccccaccagaaggtctcgctcccctacaagacaccatgatgccagccggagccctgtggatcataggacacgcgatgtcgattctcagtacctgagtgagcaggacagaatgcatagacagcgctctccaactcagtcaccccctgcagacacatctttctcgtctagacgaggaaggcagttgccgcaggtgcctgtaagatctggctccatagagcaggaaagcggccataaaaagctgaaaagcacaattcagaggtcaactgagacagggatggcagctgagatgcggaagatggtccgccagccctctagggaatcaaccgacggcagtatcaactcctacagctccgagggtaatctgatctttcctggagtgcggctgggcgctgactcacagttctcagatttcttggacggccttgggccagcacagctggtaggcaggcagacactggcaacacctgctatgggcgacattcagatcggcatggaagacaaaaaagggcaactcgaagtggaagtaatccgggcacgctcattgacgcagaaaccaggaagtaaaagcacgccagccccatacgtgaaagtatatttattagagaacggtgcttgtatagccaagaagaagaccagaatcgcgagaaagactctggatccactataccaacagtcgttagtgttcgacgagagtccccaggggaaggtgctccaggtcatcgtgtggggggactacggcaggatggatcataaatgctttatgggcgtcgcccagatcctccttgaggagctggacctcagcagtatggtcatcggctggtataagctttttccacccagttcacttgttgaccccacactcacccctctgaccagaagggcttcccagtcttcgctggaaagtagcaccggcccaccctgtatcagatcttag

SEQ ID NO: 238205 - DNA, 4428 bp, Artificial Sequence
  Description of Artificial Sequence: Synthetic coding sequence
atgtctagcgcagtgggcccacgcggtcctagacccccaacggtgccccctccgatgcaggagctgcctgacctgtcacacctgaccgaggaggaacgcaatattattatggcagtgatggaccgtcagaaagaggaggaggaaaaggaggaagccatgctgaagtgcgtggtgagggacatggccaagcccgctgcttgcaagacacccagaaatgcagagaaccagcctcaccagccatccccacgcctccatcagcagttcgaaagctacaaggagcaggtgagaaagatcggtgaggaggctcggcgttatcagggagaacataaggacgatgcgccaacttgtggcatctgccacaaaacaaagtttgcggacggatgcggccacttatgtagttattgcagaacaaaattttgcgctcggtgtggtggccgagtttctctgcgctcaaacaacgaggacatttgtgtcatgtgggtctgtaatctgtgtagaaagcagcaggagatcctcactaaaagtggtgcttggttcttcggctccgggccacagcagacttcacaagatgggacactctccgacacggcaaccggggctggcagcgaagtccctcgggagaagaaggccagactgcaagagagatccagatcccaaacgcccctatctaccgcagctgcatcttcgcaggatgctgctcctcccagcgctccacctgacaggtccaaaggagccgaaccgagccaacaggctttgggaccagaacagaagcaagcgtcctcgcggtccagatctgaaccaccgagggagcgaaagaaaacccccggactgtccgagcaaaacggcaaaggagccctaaagtctgagcgcaagagggtgccaaagaccagcgctcagcccgtggaaggggctgttgaggagcgcgaacggaaagaacggagagaatctcgaaggctagagaaaggcagaagtcaggactatcccgacactcctgagaagcgcgatgaagggaaagcagctgatgaagaaaagcaacggaaagaagaagattatcagactcggtatcggtcagacccaaatctcgctcggtaccctgtcaagcctcctcctgaggaacagcagatgcgaatgcatgcccgagtgtcaagggctcgtcacgaaaggcgacattcggacgtggctctgccccgtaccgaagcaggagcagctctccctgaagggaaggccggaaagcgtgccccagccgcagccagagcctctccaccagactccccccgtgcctattccgccgagcggacagcggagacaagggcgccaggcgctaagcagctgaccaaccactctcctcctgcacccagacacgggccagtacctgccgaggcgccagagctgaaagcccaggagcctttgcgtaagcaatcccgtctggatccatcttccgctgtcctgatgagaaaagctaaacgtgagaaggttgagaccatgctgagaaacgattccctttccagtgaccaaagtgaatctgtgaggccttcgccgcctaagccccataggagcaagcgcggtggcaagaaacgacaaatgagtgtgagctcatccgaggaggaaggagtaagcacgcctgaatatacaagctgtgaggatgtggagctggagtcggagagtgtaagcgagaagggggacctggactactactggttagacccagcaacttggcactctcgtgaaacgagcccaatcagttctcacccagtgacctggcagccctctaaggaaggggatcgcctcatcggcagagtgattctgaataagagaaccacaatgcccaaagactctggcgctctcctggggctcaaagtggtggggggaaagatgactgacctgggtcggttaggagccttcattacaaaagtcaagaaagggagtctggccgacgtggtggggcacttgcgtgctggtgatgaggtgctggagtggaacggaaaaccattgccgggagcgacgaacgaggaggtctataacatcatactcgagtccaagagcgagccacaggtcgaaatcatagtcagcagacccatcggcgatattcccagaattccagaatcttcccacccacccctggagtcatcgtctagtagttttgaatcccaaaaaatggaaaggcccagcatcagcgtgatctctccaacatcccccggagctctcaaggacgccccacaggtattacccggacagctaagcgtcaagctgtggtatgataaggtcggtcaccagctaatcgtgaatgtgctgcaggccaccgacctgcctgcaagggtagacggacggccacggaacccatatgtgaagatgtactttctgcccgatcgatctgataaaagcaaaagaaggactaagacggtcaaaaaaatactggagcctaagtggaatcagaccttcgtttacagtcacgtgcatcgcagggacttcagggaaagaatgctggaaattacagtctgggaccagccgagggtgcaggaagaggagagtgagttcttaggagagattctcattgaactggagacagccctgttggacgatgaacctcactggtacaagctgcaaactcacgatgagtctagccttcctcttcctcagccctccccctttatgcccagaaggcatatccacggtgagagcagtagcaagaaacttcagcgctcacagcggatttcagattccgatatctctgattacgaagtggacgatggtattggcgtcgttccaccaggatacagatcttccgcacgggagtctaagtctaccactctgaccgtgccggaacagcagagaaccacacaccaccgctcacgctctgtctcaccccaccggggtaatgaccaagggaagcctagaagcagacttcctaatgtgcccttgcaacggtctttggatgagattcatccaactcgaaggtctcgcagtcccacccgccaccatgatgccagtagaagccccgtcgaccataggactcgcgatgtggactcccagtatctcagcgagcaagattctgagcttctgatgttgcctcgggcaaaaagaggcaggtcagcagaatgcctgcataccacccgcatgcataggcagcggagtccgacccaatcaccacccgctgacacgtctttttcttctcgccgtgggagacagctgcctcaggtccccgtcaggtcaggctcaatcgaacaggctagtttagttgtggaagagcggacacgtcagatgaagatgaaagtacaccgtttcaaacagaccacaggttctgggtcgtctcaggagctcgaccgagagcaatatagcaaatacaacatacacaaggatcagtacagatcctgcgataatgttagcgcaaaatcctctgacagtgacgtgagcgacgtgtcagctatctcacggactagctccgcatcacgcctcagttcaacaagcttcatgtcagagcagtccgagagacccaggggcagaataagacggatgggcacgtccgggagatctattatgaaatctacctcagtgtctggcgaaatgtataccctggagcataatgacgggtctcagagtgataccgctgtaggaactgtcggcgctggcggaaaaaagcggagaagttccctgagcgcgaaagtcgtcgccattgtgagccggagatcacggtccactagccaattgagccaaacagagtccggacacaagaagttaaaatccactatccaacgatctaccgagaccggtatggctgcagagatgagaaaaatggtgcggcaaccttcccgcgagagcaccgatgggagcatcaatagctactccagcgagggcaatctcattttccccggtgtaaggttgggggctgactcacagttcagcgacttcctggatgggttgggccctgctcagctggtgggacgccagaccctggcaacaccggcaatgggtgacattcaaatcgggatggaggacaagaaagggcagctggaggtcgaggttattcgagctagaagcctgacccaaaaaccaggtagcaagagtacccccgctccttacgtcaaagtctacctgctggagaatggggcttgtattgcaaaaaaaaaaacccgcattgctcggaagaccctcgaccccctctaccagcagagcctggtgttcgatgagtcaccccaaggaaaggttctacaagtgattgtgtggggagattatggacgcatggatcacaaatgtttcatgggcgttgctcaaatcctgctggaggaacttgatctcagctccatggtaatcggatggtataaattatttccaccgtcctccctcgtggatcccaccctgactccacttacgaggcgcgcatctcaatcctctctagaaagctctacgggtcctccctgcatacgcagctag

SEQ ID NO: 238206 - DNA, 4116 bp, Artificial Sequence
  Description of Artificial Sequence: Synthetic coding sequence
atgtcttccgcagtcggccctcggggaccccgaccccctacggtgccacccccaatgcaggagctgccggacctctcccacttgacggaggaagagcgaaacataatcatggccgtgatggataggcagaaggaagaagaggaaaaggaggaggctatgcttaagtgcgtggttcgagatatggccaaacctgccgcttgcaaaacacctcggaacgcagaaaatcagccacaccagccctcaccccgattgcaccagcaatttgagagctataaggagcaggtccggaagatcggagaggaagcccgacgttatcagggggagcataaggacgacgccccaacctgcggaatctgtcataagaccaagttcgcagacggctgcggacacctctgttcttactgtcggaccaaattctgtgctagatgcggcggacgcgtgtcactcaggtctaataacgaaaataaaattgttatgtgggtgtgtaatctgtgtaggaaacaacaggaaatcctgaccaagtctggcgcatggttctttgggtctggtccccagcagaccagtcaagacggtacactgagtgacaccgcgaccggagcagggagcgaggtgccaagagagaagaaggcacggcttcaagagagatctaggagccagacaccattatctaccgccgcagcttcttcacaggatgccgctcctcccagtgcccctccagacagaagtaaaggtgcagaacctagtcagcaggcactggggccagagcagaagcaagcctcctcacggtcaaggagcgaaccaccacgcgagcgcaagaagaccccaggcttatccgagcagaatggaaaaggagcactaaaaagcgaaagaaagagagtgccaaagacttccgctcagcctgttgagggtgcagtcgaggagagggaacgaaaggagaggcgggagtcaagacgactcgagaagggccgttctcaggactatcccgataccccagagaaaagggacgaaggtaaggcggcagacgaagaaaagcagagaaaagaagaggattatcagacccgttatagatccgaccctaatcttgcccgatatccagtgaagcctcccccagaggaacagcagatgcgcatgcacgccagagtctcacgcgctcggcacgaacgtcgtcactctgatgtcgcactacccagaactgaggcaggagcagcgctgcccgagggcaaagcagggaaacgtgcccctgccgcagctagagcatcacccccagattcaccccgtgcatactctgccgagcggactgccgaaaccagagctccaggcgcaaaacagttgactaatcacagtcctccagcacctcggcatggcccagtcccggcagaagcccctgagcttaaggcacaggagccattgaggaagcagtcccggctcgatccgagctctgcagtgttaatgagaaaggccaaacgggagaaggtagagactatgctccgtaacgacagtttatcctccgaccagtcggagtccgtgcgtccttctccgccaaaaccccaccggagcaaacgcggaggtaaaaaaagacagatgagcgtcagtagcagtgaagaggagggcgtgtccacccccgaatatacctcgtgtgaggatgttgagctcgaatccgaatcagtgtcagagaagggcgacctcgactattattggctggaccccgctacatggcactcccgggaaacatctcctatctcatctcaccccgttacgtggcagccctccaaagagggagacaggttgatagggagggttatattaaataagaggaccacaatgccaaaggattcaggagctctactgggtctaaaagtggtgggtgggaagatgacagacctggggagactgggcgcatttattacaaaagtaaaaaaaggcagcctggcagatgtcgtcggtcacctccgtgccggtgacgaggtactggaatggaacggcaaaccgctgccaggagcaactaatgaagaggtgtataacattatcctcgagagtaagtcagagcctcaggtcgagataattgtgtcgaggcccattggagacattccaagaatccccgagtcctcccacccacccttagagagctcgagttcaagtttcgagtcgcagaagatggaacgcccttccatctccgtgatctcacctacctcccccggagcattaaaggacgccccacaggtgttacctggtcaattgtctgtaaagctttggtacgacaaagtcggccaccagctaattgttaatgttctacaggccacggatctgcccgcaagggtggatgggaggcccaggaacccttacgttaagatgtacttcctgcccgacagatctgacaaatctaagaggagaacaaaaaccgtgaagaaaatactcgagcctaagtggaaccagaccttcgtctattcacacgtccatcgcagggattttcgtgagaggatgctggagatcacggtttgggaccagccacgcgtccaagaagaggagagcgagtttctgggagaaatcctaatcgagcttgaaaccgctctgctggatgatgaaccccattggtataagttgcagactcacgatgagagcagcttgcctttgccccagcccagtccctttatgcccaggagacacatccatggagaaagcagcagtaagaaactacaaagaagccagaggattagcgatagtgatattagtgactatgaagtcgatgatggcataggagtcgtgccgccagtgggttaccgttccagtgcaagagaatcaaaatccactactttaaccgtgcctgagcaacagcgcactacccatcaccgaagtagatctgtgagcccgcatcgtggaaacgaccaaggcaaacctcgctctcggctgcctaacgtgcctttgcagcgttccctcgacgagatccatccaacaaggcggtcccgctccccgacacggcaccacgacgcctctcggagcccggtagatcaccgtactcgtgacgtcgactctcagtatttatccgaacaagactcagaactgctgatgctgcccagagccaagcgtggacgtagtgctgagtgtctccacactacctcagaattgcagccttttcttgatagggcacgcagcgcctctacaaattgtctccggccagacacatctctccatagccccgagcgggagcgcggtcgttggtccccctctctggatagacgaaggcctccctcaccaaggattcagatccaacatgcaagccccgagaatgatagaatgcatagacaacggtcgcccacacagagtcccccagccgacaccagcttctcgtctcgacgcggaaggcagctgccccaggtgccagtgaggtccggttctatcgagcaggaatcaggtcataagaagttgaaaagcactattcaaaggtccaccgaaacggggatggccgctgaaatgcgaaagatggtgagacaacctagccgggaaagcactgacggctccatcaattcgtacagcagcgagggaaacctgatcttcccaggtgttagactgggcgctgatagccagttcagcgatttccttgatggactggggccagctcagcttgttgggcgtcaaactctagccacaccggctatgggagacattcagatcgggatggaggataagaagggacaactagaggttgaagtcatcagggcaagaagtctcacccagaaacccggttccaaatctacccctgccccatacgttaaggtatacctgctggagaatggggcatgcattgccaaaaagaagacccggatcgctcgcaaaaccctggacccactgtaccagcagtcgctcgtgtttgatgagagtcctcaaggaaaagtactccaagtgatcgtgtggggggattacggccgaatggatcacaaatgctttatgggggtagcacagatcttactggaagagctggatctcagcagcatggtcatagggtggtacaaactcttcccaccctcctctctagtggatcccaccctgactcccctgacccggcgagcctctcaatcctcattggaatcatccactggacccccttgtattcgatcctag

SEQ ID NO: 238207 - DNA, 4626 bp, Artificial Sequence
  Description of Artificial Sequence: Synthetic coding sequence
atgagttcagccgtggggcctaggggccctcgtccccctaccgttcctcctcccatgcaagagttacccgacctgagtcacttaactgaagaggagcgaaatataattatggccgtcatggatcggcaaaaggaggaggaggagaaggaggaagcaatgttgaagtgtgtggtgcgagacatggctaagcctgctgcctgcaagactcccagaaacgcggaaaaccagccacaccagcccagccccagattacaccagcaattcgagtcatataaagagcaggttcggaagatcggtgaggaggccagacggtaccagggcgaacacaaggacgacgctcccacctgcggtatttgtcacaaaactaaattcgccgacgggtgcgggcatctgtgcagctactgccgcacaaagttttgcgctagatgcggcggacgcgtgagtcttaggagcaataacgaagacaaatacgtgatgtgggtgtgcaacttgtgcaggaaacaacaggaaatcctcaccaaatctggtgcttggtttttcgggtcagggcctcaacaaacatcccaggacggtactctcagtgacaccgccacaggcgcagggagcgaagtgcccagggagaaaaaagcacgcctccaggagaggagccgttcacagactcctcttagcactgccgctgcatcgtcacaggatgccgcacccccttctgcacctcccgacaggtctaagggcgctgagccctcccagcaagccttgggacccgaacagaaacaggccagttcccgcagccggagtgagcccccaagggaaagaaaaaagactccaggtctgtccgagcagaatggcaagggtgctctaaaaagcgaaaggaagagggtgcccaaaacctctgcacaaccagttgaaggcgctgttgaggaaagagagcgtaaggaacgtcgcgagtctcgcaggcttgagaaaggcaggtcccaggactacccagatactcctgaaaaacgggatgagggtaaggcagcagatgaagagaagcagagaaaggaggaagactaccagacacggtaccgctctgacccaaatctggcccgttatcccgttaaacctccccctgaggagcagcaaatgcggatgcatgcgcgtgttagccgcgctaggcatgaacgtagacacagtgatgttgctcttccccgtacagaagctggcgcagcattaccagagggcaaggcaggtaaaagggcccctgcggctgccagagcgtcccccccagactccccaagagcctactccgcggaacgaacagcggagacgagggcccctggcgctaagcagttgactaatcattcccccccagcgccacgccacggcccagtacccgcagaggccccagagctcaaagcacaggaaccccttaggaaacagtcaagacttgacccatcaagtgccgtacttatgagaaaggccaagagggagaaggtggaaacaatgcttaggaacgactctctaagtagtgaccagtctgaaagcgttcggccaagccccccaaaacctcacagatctaagagggggggaaagaagaggcaaatgtctgtgagcagctcagaagaggaaggagtctccacccctgaatacaccagctgtgaggacgttgagctggagtctgaatctgtgtcagaaaaaggagatttagattactactggttggaccccgcaacctggcactctcgggagacttcgccaatcagctcccatccagtgacttggcaaccaagtaaggagggggataggttaatcggacgcgtcatactaaataaacgtacaacaatgccaaaggactcaggtgctctgttgggcctgaaggtggttggtggaaaaatgaccgaccttggcagactgggagccttcatcacaaaggtaaagaaaggaagtcttgctgacgtggtcggccacctgcgggctggagacgaagtcctggaatggaatggcaagccgctgcctggtgccactaatgaagaagtgtacaacatcatactggagtccaagagtgaacctcaagtggagataatcgtttcgagaccaattggggacatcccgaggatcccagaaagtagtcacccaccactcgagtcaagttctagctctttcgagagccagaaaatggagagaccatcaatttccgtgatctcccctactagccctggtgcacttaaagacgcaccacaagttttgcccggtcagctttccgtgaagctctggtatgacaaggttggtcatcaactgattgtcaatgtgctgcaagctaccgatctgccggctagagtggatggacgtccacgcaacccatacgtcaaaatgtatttcctgccggataggtcagacaagtctaaacggagaaccaaaacagtgaagaagattctggagccgaaatggaatcagacttttgtgtacagccatgtccatcggagagattttcgggaaaggatgttggagattactgtgtgggaccagccacgggttcaggaggaagagtcagagttccttggcgaaattctgattgaactcgaaacggcactgctcgacgatgagccacactggtacaagctacagacacatgatgagtcaagcctgcccttacctcagccctccccgtttatgcccagaaggcatattcacggcgaaagttcatccaaaaagctccaacgctcgcagcgcatttccgattccgatatcagcgattatgaggtggacgatggcatcggcgtggtacccccagtgggttacagaagctccgcgcgagagtcgaagagcactaccctgacggttcccgaacaacagagaaccactcatcatagatctcgcagcgtatctccccaccgcggaaacgatcagggaaaaccacggtcaaggctgcccaatgtccctcttcagcggtcgctcgatgagatacatcccaccaggagatctcggtcccctacccgacaccacgatgcgagcagaagcccggtagaccaccgaacccgagacgttgacagccagtacctgagtgaacaggactcagaactcctgatgctgccgagagcgaagcgaggtaggagtgcagagtgcctacataccactagacacctagtgcggcattacaaaaccctgccgccaaaaatgccacttctgcaaagtagttctcactggaacatttactctgagcttcaaccattcctggatagggcgagatctgcctccacaaactgccttaggcccgacacctccctacatagcccagaacgggaacggatgcatagacagaggagccctacccagtcacccccagccgataccagctttagcagtcggagaggcaggcaactgcctcaagtacccgtaagatctggatcgattgaacaggccagcctggtggtggaggagagaaccaggcagatgaaaatgaaagtccatcgattcaagcagacgactggtagtggcagcagccaggaattagaccgcgaacagtatagcaagtataacattcacaaggaccaatacagaagttgcgacaatgtgtcagccaagagttcagattcagacgtgtccgacgtgtctgctatcagccggaccagttcagcctccagactgtcctcaacaagcttcatgtcagagcagtctgaacgtcctcggggtaggatttcctcttttacacccaagatgcagggacggaggatgggaacctcagggaggtccatcatgaaatctacgtcagtcagcggtgagatgtatacacttgagcataatgacggatcccaaagtgacactgccgtcggcacggttggcgctgggggaaagaaacgccgatccagcctcagcgcaaaggtcgtggctattgtgtcacgccgatcgagaagtacctcgcaacttagtcagactgagtccggccataagaaacttaaatcgacaattcagcgtagtaccgagactgggatggccgcagaaatgcgcaaaatggttaggcagccctcacgagaaagtaccgatggtagcatcaattcctactcatctgagggaaatttgattttcccaggcgtaagactgggtgctgacagccagttttctgacttccttgacgggctgggtcctgcccagcttgtcggacgtcagaccctggccactcccgctatgggggacattcagattggcatggaagataaaaaagggcagctagaggtagaagtaattagggctcgaagcctcacacagaaacctgggtccaagtccactccggcaccttacgtgaaggtatatcttttggagaacggcgcatgcatcgctaagaagaagacacggatcgcgaggaaaaccctggatccactgtaccagcagtccctggtatttgacgagagtcctcaggggaaggtgctgcaagtgattgtgtggggtgattacgggaggatggatcataaatgctttatgggcgtagcccaaatcctgctggaggagcttgacttgtcaagtatggtcatcggttggtataagttgtttccaccatcttcacttgtggatcccacccttacacccctcacacggagggctagtcaaagttcccttgagagttcaacaggcccaccctgtatccggtcctag

SEQ ID NO: 238208 - DNA, 4446 bp, Artificial Sequence
  Description of Artificial Sequence: Synthetic coding sequence
atgtctagcgccgtcggaccacgcggaccccgacctcctaccgttccacccccaatgcaagagctgcctgacctctcccaccttaccgaagaagaacgcaacataataatggctgtgatggatagacagaaagaagaggaggagaaagaggaagccatgttaaagtgcgttgtgagggatatggcaaagcctgccgcttgtaagacacccaggaatgctgaaaatcagccacaccagccttcaccgagactccatcagcagttcgagtcctataaggaacaggtgaggaaaatcggcgaggaggccaggagatatcaaggcgagcataaggatgatgcccctacatgcggcatatgccataagacaaaattcgcggacggctgcggtcatctttgtagttactgtagaactaagttctgcgccaggtgtggcggtagagtgtctttaagaagtaataacgagaataagatcgtcatgtgggtgtgtaacctctgccgaaagcagcaagaaatcctgaccaagtcgggagcttggttttttggcagcggccctcagcagacatcacaggacggcactcttagcgacaccgccacgggtgctggaagcgaggtacccagagagaaaaaggccagactgcaggaaaggtcccgctcccaaacacccctcagcacagccgcagcatccagtcaagacgccgcacctcctagtgctcctccagatagatcgaagggggctgagccctctcaacaggccctaggccctgaacagaaacaagccagctcccgaagcaggagtgagcctcctagagaaaggaagaaaacaccgggtctgagcgaacagaatgggaagggcgcattaaagagtgaaagaaaaagagttccaaagacatcagctcagccagtggaaggggctgtagaggaaagagaacgaaaggagcgaagggaaagccggagattggagaaaggcagatctcaggactatcctgacactccagagaagagggatgaaggaaaggcagcggatgaggaaaagcagagaaaagaggaggactatcagacccgctacagatccgatcccaatctggctcgctatccagtaaagcctccacccgaggagcagcagatgcgtatgcatgccagggtaagccgggcaaggcacgagcggagacactccgatgtcgcactgcccaggaccgaggctggagccgcactgcccgagggcaaagccggaaaacgagcacctgccgctgcacgggctagcccccctgacagtcctcgcgcttactccgcagagagaaccgctgagaccagagcccctggagctaagcagctcactaaccattctcccccagcccctagacacggacctgtgccagcagaggcaccagaactgaaagcccaggagccactgaggaagcagtctaggttggatccctccagtgccgtgcttatgagaaaggccaagcgtgagaaggtcgagacgatgctgagaaacgactctctgtcttcagaccagtctgagtccgttaggccgtcccctcccaagccccatagaagtaaaaggggtggcaaaaagcgccagatgagtgtgtcctcatcggaagaagagggggtatcaacaccggaatataccagctgcgaggacgtggaactcgaaagcgagtctgtgagcgagaagggagatctggactattactggctggatcctgccacctggcactctcgcgagacatctcctatctcctcccatcctgtcacatggcagcctagcaaggagggtgaccggctcataggcagagtgattctgaataagagaaccaccatgccgaaagattcaggcgcattgctgggactcaaagtggtcggcggaaaaatgacagatctaggacgcctcggagcattcattactaaagttaagaaaggctcgttggcggacgtcgtgggacatttgagggccggagacgaggtgctagaatggaacgggaagccactgccaggggctaccaacgaggaggtgtacaacattatcctggaaagtaaaagcgagcctcaggtcgagattattgtgtctaggcccattggggacattccaaggatcccagaatcaagccaccctcccctcgagtcctccagtagcagtttcgagtcacagaaaatggagcggccatccatttcagttatctctcctacctctcctggcgcactgaaagacgcaccccaggtcctcccaggtcaactgtccgtgaaactgtggtatgacaaagtagggcaccagctcatcgtgaacgtgttacaagctaccgatctgccggcacgggtggatggaagacctcgtaacccatatgtgaaaatgtattttctgcccgatagatcagataaaagcaaacgcagaaccaaaactgtgaagaaaattctagaaccaaagtggaaccagacgttcgtgtacagccacgtccatagacgcgacttccgcgaacgcatgctggaaatcacggtatgggaccaacctagggtccaggaggaggaatctgagtttctcggagagatactcatcgagctcgagacggccctgctggatgacgagccacactggtataagcttcagactcatgacgagtccagtctccctttaccccagccctccccatttatgcctcgtcgccatatccatggcgagtcaagctctaagaagttacagcgcagccagagaatctctgatagcgacatatcagactacgaggtagatgacggaataggggtagttcccccagtcggataccggagcagcgcaagggaaagcaagtcaaccaccctgacggttcctgaacagcaacggactacacatcatcgctcccggagcgtgtctccccataggggtaatgatcaagggaagcccaggtcacgtttgcctaacgttccactgcaaaggtccttagatgaaatccatcctaccaggcgttccagatcaccgaccaggcaccacgacgcctctcgctctccagtagatcaccgaacaagggacgtcgactcacaatacttaagcgaacaggactcagaactacttatgctgcctcgtgccaagcgcggtcgctcagcagagtgtctgcacaccacatctgaactgcagcctttcctggaccgtgccaggtctgcctcaacaaactgcctgagaccagatacatctctccacagtcccgaaagagagaggatgcacaggcagcggagccccacccagtctcctccagccgacacttccttctccagcaggagagggcgacagctcccacaggtgccagtgcgcagcggttccattgagcaggcgagtctggtggtcgaagagcgtacacggcagatgaagatgaaagtccaccgatttaaacagacgacaggatccgggtcatcccaggagctggacagagagcagtatagtaagtataatatccacaaggaccagtaccgcagttgcgataacgtgtccgcaaagagcagtgacagcgatgtgagtgatgtctctgcaatctcacgcacctccagtgcctccagactctcatctacctcttttatgagcgagcagtccgagaggcctcgtggcagaatttcttctttcactccgaaaatgcaaggtcggagaatgggaacaagcggcaggagtataatgaaatcaacatcagtgagcggagaaatgtacacacttgaacataacgacggatcccagtccgatacagcggtcgggacagtgggcgcaggtggaaaaaagagaaggtcttcactttcagcaaaggtggtcgctatagtgtcgcggaggagcagatccacgagtcagctgagtcaaacagagagcggacataaaaaactgaagagcaccattcagagaagcacagaaactggtatggccgcagagatgcgtaagatggtgcgccagccctctcgcgagagcacagacgggtccatcaatagttacagttccgaggggaacctaatcttcccaggcgtccggctgggggctgactcacagttttccgatttcctggacggcctgggccctgcacagctcgtgggccgtcagaccctggccactcccgctatggcaccatatgtgaaagtgtatttgctcgagaatggagcttgtattgcaaaaaaaaagactcgcatcgcaagaaagactttggaccctctttatcagcagagcctggtcttcgacgaaagcccacagggcaaggttctccaggtcatagtatggggtgattacgggcgaatggaccacaagtgtttcatgggcgtggcccagattcttctggaggagctcgacctgagttctatggtgatcggctggtacaaacttttccctcctagtagtcttgttgatcccacacttactccactgacaagaagagcttcccagagcagcctggagtcgtcaaccgggcctccttgcataagaagttag

SEQ ID NO: 238209 - DNA, 4446 bp, Artificial Sequence
  Description of Artificial Sequence: Synthetic coding sequence
atgtcaagtgctgtgggtcccagggggccacggccacccactgtcccgcctcctatgcaggagctgccagacctgagtcaccttaccgaggaggagagaaacatcatcatggcagtaatggaccggcagaaagaagaagaggaaaaagaggaagcgatgcttaagtgtgttgtgcgcgatatggctaaaccagctgcatgtaaaacgccgaggaacgccgagaaccaaccccatcagccttcccctcgattgcaccagcagttcgagtcatacaaggagcaggtccgaaagatcggggaggaggcacggaggtatcagggagaacataaggatgatgcacctacctgcggcatttgtcacaagactaaatttgctgatggatgcggccacctatgtagttactgccgcactaagttctgcgctcgttgcggaggccgagttagcctgcggtctaataacgaagataaggtcgttatgtgggtgtgcaatctgtgtcggaagcagcaagaaattctgaccaaatccggcgcttggtttttcggaagtggcccacagcagacctcacaggacggaactcttagcgatacagccacaggagcagggtcagaggtccctagagagaaaaaagcgagactgcaagaacgaagtcggtcccaaactcctctgtctacagcggcagcaagttctcaggacgctgcacctccgtcagcccctccagatagaagtaagggggctgaaccttcacaacaggctcttggacccgagcaaaagcaggcatcttctcgaagcagaagcgaaccccctcgagagagaaaaaagaccccaggattgagtgagcagaacggcaaaggcgcattgaaatctgagcgcaagcgggtacccaagacatccgctcaacctgtggagggcgcagtggaggaacgagagcggaaagaaagaagagagtctcgcaggctggaaaaggggagaagccaggactacccggatacaccagagaaacgcgacgagggaaaggctgccgatgaggaaaagcagagaaaggaagaggactatcagactaggtatcggagcgatccaaatctggctcgctaccccgttaagccccctccagaggagcagcaaatgcgcatgcatgcacgtgtctcgagggccagacacgagcggagacacagcgatgtggccctgcctagaaccgaagccggtgccgctctccccgagggaaaggccggaaagcgagctcctgctgcagctcgggcaagcccaccagattcccctagggcttatagtgctgaacgcactgccgagactcgcgcacccggtgccaaacagctcacaaaccactctcctccagcaccacggcacgggcctgtgccggctgaggctcccgaactaaaagcccaggaaccacttagaaagcagtctcgactggacccctccagcgcggtgctaatgagaaaagcgaaacgtgagaaagtggagaccatgttgaggaatgacagtttgagctccgaccaatccgagtccgtcagacccagccctcctaagcctcacagaagtaagaggggcggaaagaaacggcagatgagcgtctccagctctgaagaagaaggcgtgtctactcccgagtatacatcctgcgaagatgtggagcttgaaagcgaatcagtgtccgagaaaggtgatctggattactactggctcgatcctgccacctggcacagcagggagacttccccaatcagcagccatccggtaacatggcagcctagtaaggagggggaccggcttatcggacgggtgatcctgaacaaacgcaccacaatgccgaaggacagcggcgctctgctggggctcaaggtagtaggaggaaaaatgaccgacttaggaaggctgggcgcattcatcaccaaggtgaagaaggggtctctggccgacgtagttgggcacctgcgagctggtgacgaagtcctggagtggaatggcaaacctttgcccggagcgactaatgaagaggtgtataacattattctcgagagtaagtcagagcctcaagttgagatcatagtgtccaggcccattggggacattcctagaatcccagagagtagccaccctccactagaatcatcatcatcatctttcgagagccagaaaatggagagaccatccatcagcgtaatctctcccactagccccggagccttgaaagatgctcctcaggttctgcccggtcagctgagcgtcaagttgtggtacgataaggtgggccaccagctcatcgtgaatgtgttacaggctacagatttaccagcccgagtggatgggagacccagaaatccttatgtgaaaatgtatttccttcccgataggtctgacaagtctaagagaaggacaaaaaccgtcaaaaagattctggaaccaaaatggaaccagaccttcgtatactcacacgtgcaccgaagggattttagagagagaatgctcgaaattaccgtgtgggatcaacctcgcgtgcaggaagaggagtctgaattcctcggcgagatactgattgaattggaaaccgcccttcttgacgacgagccccactggtacaaacttcaaactcacgatgaatcatcactccctcttccccagccatcaccgtttatgccacgacggcatatacacggtgaaagctcttccaagaaactgcaacgaagccagcgtattagtgatagcgacattagtgattatgaggtagatgacggaatcggagtagtgccacccgtcggctatcgctcaagcgccagagaatctaaatccacaacattaactgtgcctgaacagcagcgaaccactcatcacagaagtaggagcgtgagcccacaccgcggaaatgaccaaggcaagccgaggtcaaggttgccgaacgtgccactacaacgctccctggacgaaatccaccccactaggcgaagcagatcgccaactaggcatcacgacgcctcacgtagtcccgtggaccatcgaactcgagacgtcgattctcagtacctttctgagcaggattccgaattgttgatgctgcctagagctaagcggggtagaagtgcagaatgtcttcacacgacatccgaactgcagccatttttggacagggcaagaagcgctagcaccaattgcctgcgccctgacacctccttgcattcgccagagagggaacggatgcatcgtcaaagaagccccacccagtcgccccctgcagacacgtccttcagctctcgcagaggcaggcagctaccgcaggtacctgtgcggagcggaagcattgaacaggccagtttagtagtggaagagaggaccagacagatgaaaatgaaagtccatcgcttcaaacagaccacgggctctggatctagccaggagctcgatcgagaacaatattcaaagtataacatccataaagatcagtatcgctcctgtgataatgtgtcggctaagtcctctgactctgatgtatccgacgtgagcgccataagtagaacctcctccgcttcccggctttcatcaacttcattcatgtctgaacagtcagaaagaccgagaggcagaatctcttcctttacacctaaaatgcaaggccgacgtatggggaccagcggcagaagcattatgaagtctacttccgtgagtggcgagatgtacaccctggagcacaatgacggttctcaatcagacactgctgtaggaacggtaggtgctggcggaaagaagcgtcgctcctcactgtctgccaaggtagtggcaatcgtcagccggcgatctagatccacaagccagttatcgcagactgagtccggacataagaaactgaaatctacaatccaaagatccactgagacgggcatggccgcagaaatgaggaagatggtgcgccaacccagccgtgagtccacagacggttcgatcaacagttactcttccgaaggcaatcttatttttccaggggtgaggctgggcgctgacagccagttttctgacttccttgacgggctggggcctgcccagctggtcgggagacagaccctggccacccccgcaatggcgccttacgtgaaggtgtatctgttggaaaatggggcttgcattgcaaagaagaagacccggatcgccaggaaaactctcgacccactctaccagcagtctcttgtttttgacgagtctcctcagggcaaggtgctgcaggttatcgtgtggggtgactacggacgaatggaccataaatgttttatgggagtggcccagatattacttgaggagctggatttatcatcaatggttattgggtggtataagcttttccccccttctagcctggtggaccctaccctcactcctctcaccaggcgcgcttctcagagcagtctcgagagttccaccgggccaccctgtatccgctcctag

SEQ ID NO: 238210 - DNA, 5079 bp, Artificial Sequence
  Description of Artificial Sequence: Synthetic coding sequence
atgtcttccgcggtggggccacggggtcctaggcctcctacagtgccacccccaatgcaggaactgccagatctgagccatctcacggaggaggaaaggaacattatcatggctgttatggaccgccaaaaggaggaggaagagaaagaggaggccatgttaaagtgtgtcgtcagagatatggccaaacccgctgcctgcaagaccccacgcaatgcggagaatcagccccaccaaccttctccgagattgcaccaacagttcgagagctataaggagcaggtgagaaagattggtgaggaggcccgacgatatcaaggggagcacaaggacgacgctcctacatgtggtatctgccacaaaactaaattcgcagacggctgtgggcatctatgttcttattgccgcaccaaattctgtgctcgatgtggcggtcgagtttccctgaggagcaacaacgaggataaggtcgttatgtgggtgtgtaacctttgtcgcaagcagcaagagatcctcaccaagtctggcgcttggttctttgggtccggtccacaacagactagccaagatgggactttatccgacaccgccaccggggctgggagcgaggtcccaagggaaaagaaagccaggctgcaggaaagatctaggtctcagaccccactttctactgctgccgcatcctctcaggatgccgctcccccaagtgcccctcctgatagatcgaagggggctgagccaagtcaacaggcgcttggcccagagcagaaacaggcctcctctagatcccgatcagagcctcccagagagcgcaaaaagactcctgggcttagtgaacaaaatggtaaaggtgctctaaaaagtgagagaaagcgagtgccaaagacaagcgcacaacctgtcgagggtgcagtcgaggaaagggagaggaaggagcggcgtgaatcacgtcggcttgaaaaaggccgttcacaggattacccagatacaccggagaagcgcgacgaaggcaaagccgctgatgaagaaaaacagcggaaggaggaggactatcagactcggtaccgatccgaccccaatctagcccgttaccctgtaaagccgccaccagaggaacagcagatgagaatgcatgccagagtgtccagggctagacacgaaaggcggcattcagatgtggccttgcctcggacagaggcaggtgccgcactccctgagggcaaggctggtaagcgcgcaccggctgcagctcgtgcttcgcctcctgacagcccaagagcgtacagtgctgaacggacagctgagacgcgggcaccgggtgcaaaacagctgacaaaccacagtcccccagcccctcgccatgggcctgtgccagccgaggccccagagctgaaggcacaagaacctctcagaaagcagtcccggctggacccctcaagcgcagtccttatgcgtaaggccaagcgggagaaggtcgagacgatgttacgcaacgactcgctgtcctctgaccaatccgagtcagtgcgccctagcccccctaaaccgcacagaagtaagagaggtggcaaaaagcgccagatgagtgtctcaagctcagaagaagaaggcgttagcacgcctgaatacacaagctgcgaggacgtcgagcttgagtcagaatcggtgtcagaaaagggggatcttgactactactggctggaccccgctacttggcactcaagagaaacatccccgatcagctcccatcctgtcacttggcaaccttctaaggagggcgacagactgattggaagagtgatcttgaacaagcgcacaaccatgcctaaagattccggcgctctcctgggtttaaaagtggtcggaggcaagatgacagacttaggtcgcctgggggctttcattacgaaagtaaaaaaagggagcctggccgatgttgttggccacctgagagctggagacgaggtgcttgagtggaatggtaaacctcttccaggcgctactaatgaggaggtctataacatcatcttggagtctaaatccgaaccccaggtcgagataatcgtgtcaagacccataggagacattcctcgtatcccagaatctagtcatccccctctagaaagctccagtagctcgttcgaatctcagaagatggagagacccagcatttccgtcatcagcccaacatcaccgggtgccctgaaggatgcgccacaggtcctgccaggtcaactctctgtgaagctctggtacgataaagtgggacaccagctaattgtaaacgtcctgcaggcaactgatctgccagcacgcgttgacggacgaccaagaaatccttatgttaagatgtacttcctgccagacagatctgacaaaagcaagcgcaggaccaagaccgtgaagaaaatcctggaacccaagtggaaccaaacattcgtgtattctcatgttcaccggcgagatttccgggaaaggatgctggagatcaccgtatgggatcagccgcgtgtgcaggaagaagaaagcgagtttctcggagagatcctcatagagttggagacagccctcctggacgatgagcctcattggtataagctccaaacgcacgacgaaagctcacttccactgccccagccgtcgcccttcatgcccagaagacacatccacggggagtctagtagtaaaaagctgcaaagatcccagaggatctccgactcagacatttccgactacgaggtggacgacggtatcggggtggtaccgcctgtgggttatcgatcttctgcgagagaatccaaatcaaccacattaactgtccctgaacaacagcgaactacgcatcatcggagccgatctgtcagtccgcatagggggaatgaccagggtaagccacgtagccgccttccaaacgttcccctccagaggtcactcgatgagatccatcctaccaggcgctcccgaagtcctacaaggcatcatgatgctagtcggagtcctgtggaccacagaaccagagacgtggatagccaatatctgtccgagcaagacagtgaactcttgatgctgcctcgcgctaaaagagggagatctgctgaatgtctgcacaccacgcgccacctggtacgtcactacaagacactgccaccaaaaatgccactccttcagagctcttcccattggaacatttacagctctattctgcccgcacacactaaaactaagtccgtcaccaggcaggacataagcctgcaccacgaatgttttaactcaactgtattgaggtttacagacgaaattctcgtcagcgagctgcaaccctttctggatagagcacgaagcgctagcactaactgccttagaccggatactagcttgcacagtcccgagagggaaagaggtaggtggtcccccagtttagacagaagaaggccaccctcccctaggatccagattcagcacgcttctccagaaaacgaccgccactcacggaagagcgagaggagttcaattcagaagcaaactagaaaaggcacagcaagcgacgcggaaagggtcctgcctacttgcctgagcagacgcggacacgccgctcctcgggctactgaccagcctgtgatcaggggaaaacacccagctaggtcccgctcctcagaacactcttccatcagaacgctgtgcagtatgcatcaccttgtgcctggaggtagtgcacccccatctcctttgctcaccaggatgcatcgccagcgctctccaacgcagtcccctcccgctgacaccagcttctctagccgcagaggaaggcagctgccacaagttccagttaggagcggaagcatcgagcaggcttcgctggtagtcgaggagcgcacccgccagatgaagatgaaagtacaccgcttcaaacagactaccggatcagggagctcccaggaactggatcgcgaacagtatagtaagtacaatatccataaggatcagtacaggtcctgcgataacgtctcggccaaatcctctgattcggacgtgtcagacgtatccgcgatcagccgtaccagcagcgcatcccgcttaagtagcacatccttcatgtccgagcaatccgagaggcctcgtgggcgaatctcttccttcactccaaagatgcaaggcagaaggatggggaccagtgggaggtctattatgaagtcaacgtccgtgagtggggagatgtacacccttgagcacaatgacggctctcaatccgataccgcagtagggactgttggcgcaggcggaaaaaagagaaggtctagcctgagtgcaaaggtggtggcgatcgtgtctaggagatccagatccacttcccagctatcccagaccgagtccggacataagaagttaaagtctaccatccagagatcaactgagacggggatggctgcagagatgcgtaagatggtgcgacagccatccagagagagcaccgatggaagtattaatagttatagcagcgaggggaatttaattttccccggagtgcggctcggagctgattcacagttcagcgactttctcgacgggcttggaccagcacagctggtcggcaggcagaccctggcaacaccagcaatgggcgacatccagatcgggatggaggataaaaaaggacagctcgaagtcgaagtaatcagggctcggtccttaactcaaaaacccggaagtaaatctacccccgcaccctacgtgaaagtgtatttgcttgaaaatggcgcatgcatcgccaaaaagaagacaaggatcgccaggaaaaccttagatcccctgtatcagcagtctctcgttttcgacgaatcccctcaaggcaaggtcttacaagtgatcgtatggggtgattacggtagaatggatcataaatgcttcatgggggttgctcagatcttgctggaagaactggatctctcaagtatggtgattggttggtataagctatttcccccatccagtctggtagaccccacacttacccctctgactaggcgggcttcgcaatcatctctggaaagctctactgggcctccctgcatacgatcctag

SEQ ID NO: 238211 - DNA, 1497 bp, Artificial Sequence
  Description of Artificial Sequence: Synthetic coding sequence
atgctgccacgcgctaagaggggaaggtctgctgagtgtctgcacaccaccaggcatagtcgcaaaagcgagaggtctagcattcaaaaacaaacacggaagggaacagcatccgatgctgaaaggatgcaccgtcagcggtcccctacccaatccccaccggcagacacttctttctcctcccggagaggaaggcagctgccacaggttcccgtccggagtggatcaatcgaacaggaacaggaaaaatataacagctcaacgaaggcaagtctcgtggtcgaggaacgaacccggcagatgaagatgaaagtgcaccggttcaaacagacgacgggtagcgggagctcacaggagctcgaccgcgaacaatattctaaatacaatatccacaaagaccagtaccgatcatgtgacaatgtgtctgctaaaagtagtgattctgacgtgtctgatgtgtccgccatatcgagaaccagcagtgctagtcgactctcttccaccagtttcatgtctgagcagtcagaaaggccacggggtcgcatatctagcttcactcccaagatgcaaggcagaaggatgggaaccagtggccgaagtatcatgaagagcacaagcgtctccggagaaatgtatacactcgaacacaacgatggaagtcaatcagacaccgctgtgggtacggtgggggcaggcggtaaaaaaagacgaagttctcttagcgcgaaggtagtggcgatagtgtctcgccgaagcaggtcgacttcacaacttagccaaaccgagagcgggcacaagaagctcaaaagcacgattcagaggtccactgagactggtatggccgctgagatgaggaaaatggtgcggcagcccagcagagaaagcacggacggatctattaacagctactcttccgaagggaatctgatatttcccggtgtccgccttggagctgattcacaattctctgattttctggacggactgggtccagctcagctcgtaggccgacagacactcgccaccccggcaatgggcgacattcaaattgggatggaggataagaaagggcaactcgaggtggaggttattcgtgcgagaagtctgactcaaaaaccagggagtaagagcaccccagctccatatgtgaaagtgtatctcctggagaatggagcttgtatcgctaaaaaaaaaacacgaattgcaagaaagacactcgatccgctttatcagcagagcctggtgttcgatgagtctccccagggcaaggtgctgcaggtaatcgtgtggggagattacggtcgaatggaccataagtgctttatgggcgtggcccagattctgctcgaagagttagacctttcgagtatggtgatcgggtggtacaaattgtttcctccttcttcactggtggaccccaccctgaccccactaacaagaagggccagccagtccagcctggaatcttcaaccggcccaccttgtatacgttcatag

SEQ ID NO: 238212 - DNA, 3039 bp, Artificial Sequence
  Description of Artificial Sequence: Synthetic coding sequence
atgtgtgcaccaggtatacacgtctcctcagagggctgggaagaagtgcgctctgtcgacagcgaggagggaaccatcgaggccagacgagccgtagccggtgacctggattactattggttggatccagccacatggcatagccgagagacatcacctatttcgtctcatccagtaacctggcaaccaagcaaagaaggggaccgtctaattggacgcgtgattcttaacaagaggactaccatgcctaaggactccggcgcactattggggttgaaagtcgtgggcggaaagatgacagatctgggtagattaggggcttttatcactaaggtgaaaaaaggctccctggctgacgtcgtcggacaccttcgagcgggagatgaggtccttgagtggaacggtaagcctcttccaggcgcaactaatgaagaagtatataacattattctcgaatccaaatctgagcctcaagtcgagatcatcgtgtccagaccgatcggtgatatccctaggataccggagtcaagccatcctcctctcgagtcgagctctagctcctttgaatctcagaagatggaaaggcctagcatcagcgtaatcagtcctacctctcctggcgcacttaaggacgcccctcaggtacttcccggtcagctttcagtgaaactctggtatgacaaggtgggacatcagctcattgtgaatgtactgcaggctacggatctgcctgctcgcgttgatggcagacccagaaacccatacgtaaaaatgtactttttgccagacagatccgataaaagcaagagaagaaccaaaaccgtaaaaaagatcttggaacctaaatggaatcagacctttgtctacagtcacgtgcacagacgggactttcgggagcgtatgctagagataacagtttgggaccagcctcgcgtgcaggaagaggaatccgagttcctaggggagatactcatagagctggaaaccgccctgttggatgatgagccccactggtacaagttacagacgcacgatgagtcaagcctccccctgcctcagccgtcgcccttcatgccccgaaggcacatccatggagaaagctcctctaagaagctgcagagaagtcaacgcatctctgatagcgatatttccgactatgaagtggatgatggaattggagtggtcccccctggctatcgctccagtgcaagagaatcaaagtctactaccctaacagtgcctgagcagcagaggacgacacaccaccgcagccgcagtgtttctccacatagaggaaatgatcagggcaagccgaggagtaggctcccaaatgttccactccagcggtccctagacgagatccaccccacgcggcgttctagatccccgacccgccaccatgatgcgtcaaggtccccagtggaccaccgcacacgcgatgtcgactcacagtacttgagtgagcaggattcagagctcctcatgttgcccagagcaaagcgaggccgaagtgcagagtgtctgcatacaacttcagaactgcagccttttctggatagggccaggtccgcctctactaattgtctgcggcctgacacttcattacactcccccgagagggaacggcatagtcgtaagtccgagcggagctcgatacagaaacagactcggaaaggaacagccagtgacgccgaacggatgcacagacaaagatctccgacccagagtccacctgcagacacgagctttagcagcagacggggaagacaactgccccaggtccctgtacgctccggaagtattgaacaagccagtctggtggtagaggagagaaccagacagatgaagatgaaagtgcatcggttcaagcagactacggggagcgggagttctcaagagctcgacagagaacagtacagtaagtacaacatacacaaggatcagtacagaagttgcgacaatgtttctgctaaaagctccgattcggatgtgtccgatgtgagcgccatctcccggacatctagcgccagccgccttagcagcacctcttttatgtcggaacagagtgagaggccacgtggccgaatttccagctttacccccaaaatgcagggacggcgaatgggcacaagcggccgttccattatgaagtccacaagcgtgtccggtgaaatgtacacactggaacacaatgacgggagccagagcgacacagcggttggcacagtgggagccggaggaaaaaagagacggtcctccctgtctgctaaggtggttgcaattgtgtcacggaggtctaggtctaccagtcagctgtcccaaaccgagtcaggtcacaagaagttgaagtctaccatccagcgatcaaccgaaacgggtatggccgcagaaatgcggaagatggtgaggcagccctcccgggagagtaccgatggctccatcaatagctactcctccgaggggaaccttatattccctggggtacgtctcggggcagactcacagttctcggacttccttgatgggctgggtcccgcacagttggtgggcagacagaccttagcaacacctgcgatgggggatattcagataggaatggaagataagaagggacaactcgaggtggaagttatccgcgctcgctctctcacacagaagcccggttcaaagagcacaccggcaccttacgttaaggtatatcttttggagaacggcgcttgtatcgcaaagaaaaagactcgcatcgcacgtaagaccctagatccgttgtatcagcaaagcctcgtcttcgacgaaagcccacaaggtaaagtactgcaagtcatcgtctggggggactacggccgaatggatcataagtgtttcatgggcgttgcccagatcctgctggaagagctggacctgtcgagtatggtcatcgggtggtacaagctttttccaccatcaagtttggtggatccaacgctgacacctctgacccggagagccagtcaaagttcactggaaagcagcacgggacctccttgcatcaggtcttag

SEQ ID NO: 238213 - DNA, 660 bp, Artificial Sequence
  Description of Artificial Sequence: Synthetic coding sequence
atggctgccgagatgagaaagatggtgaggcagccctcgcgtgaaagtactgatggttccatcaattcgtatagcagcgaaggaaaccttatctttcctggcgtgaggcttggagcagattctcagttctctgacttcttggacgggctggggcctgcacagcttgtgggcagacagaccttggcaacgcccgctatgggagatatccagatcggcatggaagacaagaaaggtcaactcgaagtcgaggtgattcgggcacgcagcctgacccagaagccgggaagtaagagtactcccgctccatatgtgaaggtctatcttctcgagaacggcgcatgtatcgccaagaaaaaaacacggatcgcccgaaagactttagatcccctctaccagcagtcacttgtttttgatgaatcgccgcagggtaaggtgctccaggtcattgtctggggtgattatggacggatggatcataaatgctttatgggcgtggcgcaaattcttctggaggaactggacctgtcctccatggtaatagggtggtacaagcttttccctcctagcagtctggtggatccaaccctcacgccgttgactcgtagagccagccagtcttccctggaatcttccaccggtccaccctgtatccggtcttag

SEQ ID NO: 238214 - DNA, 2283 bp, Artificial Sequence
  Description of Artificial Sequence: Synthetic coding sequence
atgcccaaggatagtggcgctctcctgggactcaaggtggtaggtggaaagatgaccgacttgggtaggctcggagccttcattacaaaggtgaaaaaaggaagtcttgcagacgtggtaggtcaccttcgtgccggtgatgaggtactggagtggaatggcaaaccactgcctggtgctacgaatgaggaagtatacaatatcatcctggaatcaaagtcagaaccacaggtggaaataattgtgagtaggccaattggagatattccgcgaatccccgagtcttctcaccccccactggagtctagcagttctagtttcgagtctcagaaaatggagagaccgagcattagcgtgatctcaccgacctcacccggagcacttaaggacgccccacaggttctgcctggccagttatcggttaaattatggtacgacaaggttggacatcagcttatcgttaatgttctgcaggccaccgaccttccagctcgcgtcgacggcagacccaggaacccgtacgttaagatgtattttctccccgaccgctcagataagagcaagcgtagaaccaagacagtgaagaaaatactggaacccaagtggaaccagacctttgtgtatagccatgtacacaggcgcgacttcagagagcgcatgctggagattacagtttgggatcagcctagggtccaggaggaggagtccgagtttctcggcgagattttaatcgaactggaaacagccttgttagacgatgagccccattggtataaacttcagacccacgacgaatcgtctctgccattgccacaaccgtcacccttcatgccaaggcgacacattcacggagagagctcttcgaagaagctgcagaggtcccagagaatcagcgactctgatatcagtgactatgaagtggacgatggtattggagtggttcctccagtgggctatagaagttccgctagggaatccaagtccactactctaaccgtgcctgagcagcagcgtaccactcaccacagatcgcggtctgtaagtcctcacaggggcaatgaccagggcaagcctcgatcaaggttgccaaatgtgcctctgcagagatctttagacgaaatccacccgacacggaggtccaggtcgcccactcggcaccacgacgcctcaagatcccccgtagatcacagaacccgcgatgttgactcccagtacctgagtgaacaggactctgaactgctgatgctgccacgcgctaaacgcggtaggtcggctgagtgtcttcataccaccagtgaactacaaccctttttggatagggctaggtccgccagtaccaattgtctgcggcctgatacctcccttcactcacctgagcgcgagaggcactctcggaagagcgagagatcctctattcagaaacaaaccagaaaaggaacagctagcgacgccgagagaatgcatcgccagcgatctcccactcagtctcccccagctgacacgtcattcagttctaggagaggacgtcagttaccacaggtccccgtcagatccggttcgatcgagcaggagtcaggccataagaaacttaagtcaacgattcagcgatctacagagaccggcatggcagcggagatgcgcaaaatggtgcggcagccatctcgggagtctacagacggcagcatcaacagctatagttccgaggggaacctaatcttccctggggtgcgattgggagcagattcccaattcagtgattttctggacgggcttgggccagcacaacttgttggaagacagactttggcgactccggcaatgggtgacatccagatcggtatggaagataagaaagggcagctcgaggttgaagtgatcagggcacggtctttaacccagaagcccggatctaagtccaccccagccccatacgtgaaagtttacctattggaaaatggcgcttgcattgccaaaaagaaaacacgtattgcgaggaagactttagacccgctgtatcagcagtccctcgtctttgacgaaagcccacagggaaaggtgctccaggtcattgtttggggtgactacggcaggatggatcacaagtgctttatgggagtcgcacagattctgctggaggaactggatctgtccagcatggtgattgggtggtacaagcttttcccgccaagctcactcgtggacccaaccctaacacccctgaccagacgcgctagtcagtctagcctggagtcctcaaccggccctccctgtatcaggagttag

SEQ ID NO: 238215 - DNA, 2481 bp, Artificial Sequence
  Description of Artificial Sequence: Synthetic coding sequence
atgttcgccggtttccttcagttcctgctgctacacactctgcattccggtaccggagatctcgactattattggttggaccctgctacgtggcattccagggagacttcacccatatcaagccaccccgtcacctggcagcccagcaaggagggagaccgccttattggaagggtcattttgaataagagaaccaccatgccgaaggactctggtgccctgctgggtttgaaagtggtaggtggtaaaatgacggacctcggtcgactcggagcgttcattacaaaggtaaaaaagggctcactggcagatgtggtgggtcatcttcgagctggggacgaggtccttgaatggaatggaaagcctttgcccggtgctaccaatgaggaggtatacaatatcatcttggaatcaaagagtgaacctcaagtggaaattattgtctctcgacccatcggcgacattcctagaatccctgaatcatctcatccccctctcgagtccagctctagctcgttcgagagccagaaaatggagcgcccttctattagcgtgatcagtcctacttcaccaggcgcacttaaagatgcgccacaggtattacccggtcagctcagcgtgaaactgtggtacgataaagttggtcaccaactgatcgtgaatgtgctccaggccacagatttacctgccagggttgacggcagaccccgaaacccctacgtgaaaatgtatttcctgcctgacaggtcagacaagtctaagcggagaaccaagacggtcaaaaagattctggagccaaagtggaatcagacatttgtctattcccatgttcacaggcgggattttcgggagaggatgttagagattactgtctgggatcagccccgtgttcaagaagaagagtcagaattcttgggcgagattctgattgaactggaaacagcactcctagatgatgaaccgcattggtataagctccagacccacgacgaatctagcttgcccctgccgcagccttctccatttatgccgcgacgccacattcacggtgagagtagctcgaaaaagctgcagaggtcccagaggatcagtgactcagatatctccgactatgaagtggatgacggaattggtgtggttccccctgtgggatatcgctcctctgccagggagagtaagtccacgactctgaccgtcccagagcagcaaaggacaactcaccaccgctcaaggtccgtgtccccccatcgcggaaatgaccaagggaagcctagaagtcggctgcctaacgtgcccctgcagagatccctagacgagatccacccgactcgaagaagccgatctcccacacgtcatcatgacgccagcaggtcccctgttgaccatcggacacgcgatgtggactcccagtatctcagtgaacaggacagtgagttgctcatgcttcctcgcgcaaagcgcggacgctccgccgaatgccttcatactaccagtgagttgcagccatttcttgaccgcgctaggagtgcctcaacaaactgcctccgcccagatacctccctccattcaccagaaagagagcgccactcacgcaaatcggagagaagttcaattcaaaagcagacacgcaaagggacagcttctgacgccgagcggatgcacaggcaacgctctccaacccagtccccacccgctgatacatccttctccagtcggcgaggacgccagctacctcaagtgcccgtcaggagtggatccattgaacaggagtcaggacataaaaagctaaaatcaaccattcagcgaagtactgagaccggaatggcagccgagatgcgaaagatggtgcgccagccaagcagagagtccacagacggttctatcaattcatactctagcgagggaaacttaatatttcctggagtccgcttgggagctgatagtcaattcagcgattttcttgacggccttggccctgctcagctggtgggtcggcaaacactggctacccctgccatgggcgacatccaaattgggatggaagacaagaagggtcagctggaggtggaagtcattagggcaagatctcttactcagaaaccgggttcaaaatcaactcccgcaccgtacgtaaaagtttacttgctggagaatggggcatgtattgcaaagaaaaagacgagaattgccagaaagaccttggatcccctataccagcagtcactggttttcgacgagagtccccaggggaaagttctgcaagtcatcgtctggggcgactacggccgaatggatcataagtgcttcatgggggtcgcccagatcctcttggaggaactcgatctgagctccatggttatcgggtggtacaagctgtttccccctagcagtctggtggaccccactctgacaccgctcacccggcgagcatcacagtccagcctcgaatcgtcaactggccctccctgcattcgctcatag

SEQ ID NO: 238216 - DNA, 2454 bp, Artificial Sequence
  Description of Artificial Sequence: Synthetic coding sequence
atgtgcgctcccggaatccacgtcagttccgaaggttgggaagaagtgagatccgtggactctgaggaaggcacaatcgaggctaggcgagccgtcgcaggagatctggattattactggctggatccggctacgtggcatagccgtgagacttcacctataagctctcacccggtgacctggcagccatccaaagagggagaccgccttattggccgagttatacttaacaaacgcacaaccatgcctaaggacagcggagctttgctaggcctgaaggtggtgggtggcaaaatgaccgacctaggccgtttgggagcctttatcacaaaggtgaagaagggaagcctggcagatgtggtcgggcacctgcgggctggagatgaagtcttagaatggaatgggaagccccttcccggagcgaccaacgaggaagtttacaacatcatcctggagtccaagagcgagccacaagtggagatcatcgtctcacgcccaattggtgacataccacggatcccggaaagttctcatccgccactagagtcgagctcctcgagcttcgagagccaaaaaatggaacggccaagcattagtgtgattagtccaactagccctggcgcactcaaggatgcaccacaggttttgcccggacagctctctgttaaactctggtacgacaaggttggtcatcaattgatcgtcaacgtgcttcaagccacggatctccccgcaagggtggacggacggccacgaaatccatacgtgaaaatgtatttcctgcctgatcgcagtgataagtcgaaaaggagaaccaagaccgtcaagaagatactggaacctaaatggaatcaaacttttgtgtactcacacgtgcaccgccgagactttagagagcgcatgctggaaatcaccgtttgggatcaaccaagagtccaggaggaagaatccgaatttctgggcgagattctgattgaactggagaccgcgttattagacgatgaacctcactggtacaaattgcagacccacgacgaaagcagtctgcctctccctcagccatccccttttatgccacgcaggcacatacatggggagtccagttcaaaaaagttgcaacggtcacagcggattagtgactcagacatctccgactacgaggtggatgacggcataggtgtggtgccacctgtgggttatcgcagcagcgcccgagaatctaagagcaccactttgaccgtgcctgaacaacagcgcaccacacatcaccgttctcgttcagtgagtccacatcggggaaacgatcagggtaagccccgttccagattgcctaacgtccctcttcagcggtctcttgatgaaattcatcccaccaggcgatccagatctcccactcggcaccatgatgcttcacgcagccctgttgaccatagaacacgggatgtggattcccagtacctttccgaacaggattcagagctcttgatgttaccacgcgctaagaggggaaggagcgccgaatgtctgcacaccacctcggaactgcagccgttcctcgatagggccaggtctgcatcaacaaattgtcttaggcctgataccagcctccactcccctgagagagagaggatgcatcgacagaggagcccaacccagtcacctcccgcagacactagtttctcgtcaaggcgcggtcgccagttacctcaagtacccgttaggtctggcagtattgagcaggaatccggacacaaaaagctgaagtctaccatacaacgatctacagaaacaggtatggctgccgagatgagaaaaatggtgagacagccttctagggagtcaaccgacgggagcatcaattcttatagcagtgaaggcaacctgatatttccgggagttcgcctcggcgcagactcgcagtttagcgactttctggacggacttggccctgcccagctggtgggtaggcaaacactggccacgcctgccatgggggacatccagatcggaatggaagacaagaaagggcagctggaggtcgaagtgatcagagcccgttctctaactcaaaagccagggtccaaatctacccccgcaccatatgtgaaggtgtatctcctggaaaatggcgcatgtatagccaaaaagaaaacccggatcgcacggaaaacacttgacccactgtaccagcaatctttagtgttcgatgaatctccgcagggtaaagtgctgcaagtcatcgtctggggggattacggcaggatggatcacaaatgttttatgggggtcgctcagattctgttggaagaactggatctgtcttcgatggtgattggttggtacaagctgtttccgccatctagtctagttgaccctactttaacccccctgacaagaagggcgtctcaatcgtccctcgagtcttccactgggcctccatgcatcagatcctag

SEQ ID NO: 238217 - DNA, 3567 bp, Artificial Sequence
  Description of Artificial Sequence: Synthetic coding sequence
atgcagtttgaaacactccgtcaggtgtgcaacagtgtcctgagccactttcatggcgtattctcttcccctccaaacatcctgcaaaatgagctctttggccagacactcaacaatgctaggaagcgttcaccctctgtttcaagggaccaaaaccgcaggtatgaccagcgggaggagcgtgaggaatactcacagtacgccacaagtgacactgccatgcccagaagcccctcagattatgctgaccggcgatcccagcacgaaccgcagttctacgaagactctgaccacctttcctaccgcgatagtaaccgaagaagtcatagacactcaaaagaatatattgttgatgatgaggacgtggagagccgagatgaatatgagcgtcaaaggcgcgaggaggaataccaatcgcggtatcgtagcgaccctaacctggccaggtatccagtgaaaccacaaccatatgaagagcagatgaggatacacgccgaggtgtctcgggcacggcacgaacgccgtcactccgatgtctctctcgctaacgctgatttagaggactccaggataagtatgctaaggatggataggcctagccggcagcgtagcatttctgagcgccgagccgctatggagaaccagagatcctactctatggagagaacacgggaagctcaggggccttccagctatgcccagcgtaccaccaaccactccccccctaccccaagacgctctccattgccgattgaccggccagatcttagaaggacggactcactcagaaaacagcatcacctagaccctagctctgccgttcgtaagacaaaacgcgagaaaatggaaacgatgctgcgaaacgactccctgagtagcgaccagtccgagagtgttaggcccccaccacccaagcctcacaagtcaaagaagggaggcaagatgagacagatctcattgagctccagcgaggaagagcttgcttcgacacctgagtacacgtcatgtgatgacgtcgaaatcgaaagcgaatcggtgtcagagaaaggcgactctcaaaaaggcaaacgtaaaaccagtgagcaagcagtgctctctgattcaaatacacgcagtgagcggcagaaagaaatgatgtacttcggcggacactctcttgaggaagatttggaatggtccgaaccccagataaaagatagcggagtggatacatgcagttccaccaccctgaacgaagaacacagtcactcagacaaacaccctgtaacctggcagccatctaaagatggcgataggcttatcggcagaatattgctgaacaaaagactgaaggatgggtccgtgccccgtgatagtggcgctatgctgggccttaaagtcgtcgggggaaagatgaccgagagcgggcgtttgtgcgcctttatcaccaaggtaaagaaggggagcctcgctgacaccgtaggacatctgcgccctggtgacgaagtcctcgaatggaacggcaggctactccaaggtgctaccttcgaggaagtgtataacatcattctagagtccaagcccgaaccacaggtggagttggtcgtgagtagacctatcggtgatatcccaagaatccctgactcaacacatgctcagctggagtcatcctctagctcatttgagtcgcagaaaatggacaggccctcaatttccgtgacatcaccaatgagtcccggaatgttacgggatgtgcctcagtttctcagcgggcaactgagcatcaaactttggttcgacaaagttgggcatcagctcattgtgaccatccttggcgcaaaggacctcccttcaagagaggacgggaggccaagaaatccgtacgtcaagatctattttctaccagaccgaagtgacaagaataaacgcagaaccaagactgtcaaaaagacactggaacccaagtggaaccagacattcatatattcgccagtgcaccgcagagagttcagagagcgcatgctggaaatcactctgtgggaccaagcacgcgttcgggaggaagagagtgagttcttgggagagattctcattgaactggaaacagctctgttggacgatgaacctcactggtacaagctgcaaacacatgatgtttcttcacttccgctgccacatccatccccctacatgcctagaagacagttgcacggagagtcccccactcgacgcctccaacggtccaaaagaatttccgacagtgaagtttccgactacgattgtgacgatggcataggcgtcgtgagcgactatcgacacgacggaagggatcttcagagctccactttgagcgtgcctgagcaggttatgagcagtaatcattgttctccttccggcagccctcaccgggtcgacgtgatcggccgtacacgctcttggagtccaagtgtgccccctcctcagtcccggaatgtggagcagggtcttagaggcactcggacgatgaccgggcactacaacacaatttccaggatggaccggcacagagtcatggatgaccactactccccagatagggaccgcgattgtgaggccgcagatcgtcagccctaccacaggtccagatcgacagaacagcgccctcttctggagcgcaccaccaccaggtctagatcaacagagagaccggatacaaatctgatgaggagcatgccatcactcatgacgggtagaagcgcccctccaagtcccgcattatctcggtcacacccccgaacaggttctgttcagacctcaccctcatccacacccgtcgccggtagacgtggaaggcagcttccacagctgccaccaaagggcacccttgaccggaaagctggcggaaaaaagttacgcagcactgtgcagcgcagtacagaaaccggattggcggtcgaaatgagaaattggatgacccggcaggcctctcgcgagtccactgatgggagtatgaacagctatagctccgaaggaaatttaattttccctggtgtgaggctggctagcgacagccaattttctgacttcctagacgggctgggtccagcccagctggtgggtaggcagacgctggcaacacctgccatgggagatattcaagtgggcatgatggacaaaaagggacagctggaagtggagatcattagagccagaggcctggtggtgaaacctggctctaagacattacccgctccttatgtgaaagtctatcttttggacaacggtgtgtgcatcgccaaaaaaaagactaaggttgctcggaagaccctcgagccgctgtaccagcagctgctgtcttttgaagaatcaccgcagggtaaagtattgcaaattatagtttggggtgactacggccgaatggaccataagtcttttatgggtgtggctcagattctcctggacgagttagagttgtcgaacatggtgattggctggtttaagctgttccccccatccagtcttgtcgaccctacccttgccccattaaccaggagggcctctcagtcttcacttgaaagcagtacagggccatcctacagtaggtcatag

SEQ ID NO: 238218 - DNA, 4161 bp, Artificial Sequence
  Description of Artificial Sequence: Synthetic coding sequence
atgagtgcacccgtgggtcctcgcggaagactggccccaatccccgctgcatcacagccaccattacaacccgagatgcccgacttatcacatctgacggaagaagagagaaaaataatactggccgtcatggaccgacagaaaaaggaggtgaaggaggagcataaacctcagttgacccaatggtttcccttcagcggaatcactgagctggtaaataatgttctccagcctcagcagaagcaacagaacgaaaaagaaccccaaacaaagctgcaccagcagttcgagatgtacaaggagcaggtgaagaagatgggagaggagtcacagcaacagcaggaacagaagggtgacgccccaacttgtggaatatgccataagacaaagtttgcggacggttgtgggcacaattgtagttattgtcagactaagttttgtgccagatgcggaggacgggtgagccttagaagcaacaaagtgatgtgggtatgcaatctctgtcggaagcagcaagagattctcacgaaaagcggggcatggttttataacagcggcagtaacacacctcagcagcccgaccagaaggtactgaggggattaaggaacgaagaagcgcctcaagagaaaaaaccaaagctgcatgaacagacacagttccaagggccaagtggggacctgagtgtccccgcagtggagaagtcacgtagccacggccttacaagacaacactcgattaaaaacgggagcggtgttaaacaccatattgcctccgacattgcttccgatcgcaagcggagcccctctgtgtccagggaccaaaaccgcaggtacgaccagcgggaagagcgagaagagtattctcaatatgccacaagcgacacggctatgccgaggtccccctccgactatgctgataggagaagccagcacgagcctcaattttacgaggactctgaccatctgagttatagagactcgaatcgacgctcccaccgccattccaaagagtacatagtggatgatgaagatgttgagagtcgcgacgagtacgaacggcagcgacgagaagaggagtaccaatctcgctaccggtctgaccctaatctggcacgctaccctgttaagccacagccttatgaagaacagatgagaatccacgctgaggtcagtcgcgctcgccacgagaggaggcatagcgacgtgtctctggctaacgcggacttagaggatagtcgaattagcatgttacggatggaccgtccaagccgccagagaagcatcagcgagcggagggcagccatggaaaatcagaggtcatacagcatggagaggacgagagaagctcagggaccctcgtcctacgcccagaggacaacgaaccactcgcctcccaccccaaggagatccccgttacccattgaccgacctgacttgagaagaacagatagtttacgtaaacaacatcatctcgatccctcaagtgctgttagaaagaccaagagagagaagatggaaactatgttgcgaaacgacagtctctcatctgatcagtccgaatctgtccgccctccaccacccaagccacacaagtccaaaaagggtggcaagatgcggcagatatctttgtcttcaagtgaggaggagctggcatccacacccgagtacacaagctgcgacgacgtggagatcgaaagtgagagcgtgtctgaaaaaggggatatggattacaattggctcgaccacaccagttggcactcctccgaagccagccccatgagcttgcatcccgtaacttggcagccatctaaggatggtgataggcttatcggacgtatactgttgaacaagcgactcaaggacggcagcgttcctagagacagtggggcaatgttgggtctcaaggtcgtgggcggtaaaatgactgagtcaggaagattgtgcgccttcatcactaaggtcaagaaaggctccctcgccgacactgtgggccatctgagaccaggagacgaagtgctggaatggaacggccgactgctgcagggcgcaacttttgaggaagtctacaatatcatcttggaaagcaaacctgagccacaggtggaactcgttgtgtcccggccaattggagacattccgcgaattccagacagtacacacgcccagctcgaaagttcttccagttccttcgaatcccagaaaatggataggccgagcatcagcgtaacatcgcctatgagccctggtatgcttcgggacgtccctcagttcctaagcggtcagctaagtatcaaattgtggttcgacaaggtaggacaccagctgatagttaccatacttggggcaaaggacctccctagccgggaagatggaagacctcgtaatccttacgtaaagatctacttcttgccagaccgaagtgataaaaataagcgtaggactaaaacagtaaaaaaaactctggagccgaagtggaatcaaacattcatctattcgcctgtccatcgcagagagtttcgtgagcgaatgctcgaaataacactctgggatcaggctcgcgtgcgagaggaagaaagcgagtttttgggcgagatcctcatcgaactggaaacagccctgcttgatgatgaaccccactggtacaaacttcagacgcacgatgtgagctcattgccactgccgcacccctctccctacatgcctaggagacagttgcacggcgaatccccaaccagacgtctccagcggagcaaacgcatttctgactctgaggtctctgattacgattgtgacgacggaataggagttgtatctgactatagacacgatggtcgtgatctgcagtccagtacgctgtccgtgccagagcaggtcatgagtagtaaccactgctccccatccggaagccctcacagggtcgacgtaatcgggaggactagatcctggtcaccctcagtgcctcctccacagtctaggaatgttgagcagggcctgaggggaacacgcaccatgacgggacactacaatacgataagtcggatggaccggcatcgtgtcatggatgaccactactcccccgaccgagactcccatttcctcaccctgcccaggtcccggtacagccagactatagatcatcaccaccgggacggaagggactgcgaagccgcagatagacaaccatatcatagatctcgatccaccgaacagcggccattgcttgaacggacaacaacccgcagccggagcacagagcgacctgataccaatttaatgcgcagcatgccatctcttatgacaggcagatctgcacccccatctccagctttgtctcgaagccatcctcgaacgggtagtgtacagacctctccatcttccacacctgtcgccggaaggcggggacgacaactgcctcagcttccacccaagggtactctggatagaaaagcaggcggaaaaaagctgcggtctactgtgcagcggtctaccgaaactggtctggccgtggagatgcggaattggatgacccggcaagctagccgtgagagtaccgatggttcaatgaattcatattcaagcgagggtaacctgatcttcccaggggtgcggcttgccagcgattcccaatttagcgactttctcgatgggttggggccagcacagttagtaggccgacagactttagctacacctgccatgggggatatccaagtggggatgatggacaagaagggccaactggaggtcgagattattcgggcaagaggcctggtggtgaagccagggagtaaaaccctgccggcaccatatgtcaaggtttatctgctggataatggtgtttgcatcgccaagaaaaagaccaaagtggctaggaagacactggaaccactgtatcagcaactcttatcttttgaggagtctcctcaaggcaaggtgttgcagatcatcgtttggggcgactatgggagaatggatcataagagctttatgggtgtcgcccagattctgctggacgagttggaattgtcaaatatggtaatcggatggtttaagctgtttcctccaagctcactcgtagaccctaccctggccccactcacaagaagggcttctcaaagtagccttgagtctagcacggggccttcatattcccggtcttag

SEQ ID NO: 238219 - DNA, 858 bp, Artificial Sequence
  Description of Artificial Sequence: Synthetic coding sequence
atggggcgacaggggctgggtggagccagtgctgctggcaggtcgatgcagaggtcacagtcaaggtccagcctaagtgccagcttcgaggcactggctggatactttccttgcatgaactcattggaggaagaagagggggaagctggcggtaagaagctgagatccaccgtgcagaggtccaccgaaactggcctggcagtggagatgagaaattggatgacccgccaagcctcccgtgaatctactgacggctccatgaattcctacagcagtgaaggcaacctgatattccctggtgtgcgactggcgtcagatagccagttctctgacttccttgacggactgggacccgcacagcttgtaggccgacagactcttgctactcctgctatgggcgatattcaggtggggatgatggacaagaagggccagcttgaggtggaaatcatcagggcccgaggccttgtggttaaacctggaagtaaaaccctgcccgctccctacgtgaaggtctacctgctcgataacggcgtgtgcattgcaaagaaaaaaaccaaagtggctagaaagacactggaacccttataccagcagctcctatcattcgaagaaagcccccaggggaaagtgttgcagatcattgtttggggggattatggaagaatggatcacaagtcgttcatgggggtggctcagattcttctcgacgagttggaacttagcaacatggtgatcggctggttcaaactattcccccctagctcccttgtcgaccctacactggcccctctcacaagaagagcttcacagtcctccctcgagtccagtaccggcccatcttatagccggagctag

SEQ ID NO: 238220 - DNA, 384 bp, Artificial Sequence
  Description of Artificial Sequence: Synthetic coding sequence
atgaccgagagcggaaggctctgtgcttttatcacaaaggtgaagaagggctcgctggcagatactgtgggtcaccttcgcccaggggatgaagtgcttgagtggaatgggagattgctacagggggcaacttttgaggaggtgtataatattatcctggaaagtaagccggagccccaagtagagctcgtggtgtccagaccaatcggagatataccgaggattccagactctacacacgctcagcttgagtccagccttccgggactggcttggtggctgacccgagtgattccagccttgtgggaagccgaggctggtggtagcagagggcaggaaattgaaacaattctggctaatacggtgaagcccaggctctattag

SEQ ID NO: 238221 - DNA, 4236 bp, Artificial Sequence
  Description of Artificial Sequence: Synthetic coding sequence
atgagcgcacccgttggcccacgaggaaggctcgcacctattcccgctgcttcgcagccccctctgcagccagagatgcccgacctgtcccacctaactgaggaggagaggaagatcatcctggcggttatggacaggcagaaaaaggaggtaaaagaagaacataaaccgcagctgacccagtggttcccctttagcggaattacagaactggttaacaacgttcttcagccccagcagaagcagcagaatgaaaaggaacctcagaccaaacttcaccagcagtttgagatgtacaaggagcaggtcaaaaagatgggggaagaatctcagcagcagcaggagcagaagggcgatgctccaacttgcggcatctgtcacaagacaaagtttgccgacggttgcggacacaattgttcttattgtcagacgaaattctgtgcccgttgcggaggacgggtcagtttgaggagcaataaggtgatgtgggtgtgtaacctgtgtagaaagcaacaagagatactgaccaagagtggtgcttggttttataattccggcagtaacacccctcaacagcctgatcaaaaggtgctaagggggctccgcaatgaagaagcaccacaggaaaagaaaccaaagttgcacgagcagacacaatttcagggaccttctggcgacctgagcgtccctgctgtggaaaaatctcgaagccatggactgactcgccagcactctatcaagaatgggagcggtgtaaagcaccacattgcctcggacattgcaagtgataggaagaggtctccctctgtgtcacgtgaccagaatagacggtatgaccagagggaagagcgcgaagaatactcgcagtatgcgacttccgatacagctatgcccagaagtcctagtgattacgctgacagaaggagtcaacatgagcctcagttttacgaggactccgatcatttatcctacagggatagtaacagaaggagccatcgccatagcaaagagtatatcgtcgatgacgaagatgttgagtcgagagatgagtatgagcggcagaggcgggaagaagagtatcagtccaggtatcgtagtgaccctaatttggctcggtatcctgtgaagccccagccctacgaggagcagatgcgaatacacgctgaggtgtcccgagctcgtcatgaaagacgacattctgacgtgtcactggctaatgctgacctcgaggacagcaggatctctatgctcaggatggatcgcccatcgagacagcgcagcatcagtgaacgtagggcagctatggagaaccagcgctcctatagtatggagcgaaccagagaagctcaggggccttcttcctatgctcagagaactaccaaccattcaccccctacgccgagaaggtccccgttgcccatagacagacccgatttgagaaggactgactcccttaggaagcagcaccatctggatcctagctccgctgtccgcaaaacgaaacgtgaaaaaatggagacgatgttgagaaatgactctctgtcctcagatcaatccgaaagtgttcgacctcccccaccaaaaccccacaaatcaaagaaaggaggcaagatgcgtcagattagtctgagctcttcagaggaggaactagcttctacgccagagtatacatcatgtgacgacgtagaaattgagagtgagagcgtcagcgagaagggagattcacagaaagggaaacgcaagacgagcgagcaagcagtactctcggacagcaatactagaagcgagcgccaaaaggagatgatgtattttgggggacattcgctcgaggaagatttagagtggtctgagccccagattaaggattccggggtcgacacttgttcctcaactacactaaatgaggaacatagccactccgacaaacatcccgttacctggcaaccctccaaagatggcgatcgtctcatagggaggatactgttgaataagagattgaaggacggatctgtccctagagactccggagcgatgttgggtctgaaggtggtaggcggaaagatgaccgagtcaggcagactctgcgcgtttatcacaaaggtcaagaaagggagtttggccgatacagttgggcatctgcggccaggcgacgaagtgctggagtggaatggaagactgctccagggggctacttttgaggaagtttacaatattatccttgagtcaaaacccgaaccccaggtggaactggtggtttcgcggcctatcggcgatataccgagaatcccagatagcacacacgcacagctggagtcctcttcgagttcctttgaatctcagaagatggaccgcccatccattagcgtcacctctccaatgtccccaggcatgctcagagatgtgccgcagtttttgtctggacagctatccattaaattgtggttcgataaagttggacatcagctgatagtgaccattctaggggcaaaagatttaccaagccgcgaggacgggcgaccaaggaatccatacgtgaagatctatttcctccccgacagatccgataagaataagcggagaaccaaaacagtcaagaaaacactcgagccgaaatggaatcaaacctttatttacagcccggtgcaccggcgagagtttcgggagcgcatgttggaaattaccctgtgggaccaggccagagtgagagaagaagaatcggaattcttgggtgagatcctgatcgagcttgaaacggcactgcttgacgatgagccgcactggtacaaactgcaaacccacgacgtgtcatccctgccactcccccacccgtcaccctacatgccgcgtcgccagctccatggagagtccccaaccagacggcttcagcgctccaagcggatctccgatagtgaagtttctgactatgactgcgatgatgggattggggttgtcagtgattacagacacgacggtcgcgatctgcagtcaagtaccttgagtgtgcccgagcaggtgatgtcatctaaccactgttctcccagcgggagtcctcatcgggtggacgtcatcgggagaactcgatcgtggagcccaagcgtgcctccaccacagtcgcggaacgtagagcagggcctccgcggaacacgcactatgaccggccactataatacaatctcgcggatggataggcatagagtcatggacgaccactacagtcctgaccgagacagggattgtgaagccgcagacaggcaaccttaccacagatcacgatctacagagcaaaggcccctcctggagcgaacgactacacgaagtcgttcaacagaacgccctgacactaacctcatgagatcgatgcctagcctgatgaccggccgtagtgcccctccgtcgcccgctctgtccagaagccatccacgaaccggatctgtgcagacatcacctagctctacccccgttgccggtagaagaggtcggcagctcccacagctgccaccaaagggcaccctggataggaaagctggcggaaagaagctccggtcaaccgtccagcgcagtacagaaacaggcctggccgtggaaatgagaaactggatgactcgtcaagcaagtcgagagtcaaccgatggatctatgaactcttatagcagtgaaggcaacctcatttttccaggtgtgcgcctggcatccgattcccagttcagcgattttctggacggtctcggacccgctcagctggttgggcgacagacactggcaactcccgctatgggggatattcaggtaggcatgatggacaagaaaggacagctggaagtggagattattcgtgcacgcggactggtagtgaaacccggaagtaagaccctgccagcaccctatgtgaaggtatacttgcttgataacggagtgtgcattgccaaaaaaaaaaccaaggtggcaaggaaaactctggagccgctgtatcagcagctgctctcgttcgaagaaagcccccagggtaaggtgctccagattatagtgtggggggactatggcagaatggatcacaagagctttatgggagtggcgcagatccttctggatgagctcgagctctctaacatggtgattgggtggttcaaactctttccaccctcctctctcgttgatcccacactagctcctctcacacgaagagctagccagtcaagcctggaatctagtaccggcccatcgtactctagaagttag

SEQ ID NO: 238222 - DNA, 4050 bp, Artificial Sequence
  Description of Artificial Sequence: Synthetic coding sequence
atgtctgcaccggttggacccaggggacgcctggcacctattcctgcagcttctcagcctccactccaaccagaaatgcctgacctcagccatcttactgaggaggaacggaaaattattctggctgttatggaccgtcaaaagaaggaagaggaaaaggagcagagcgtcctcaagaagctacatcaacagtttgaaatgtataaggaacaggttaagaaaatgggcgaggagtcccagcagcagcaggaacagaagggtgacgcaccgacatgtggaatatgtcataaaaccaagtttgccgacggttgcggacacaattgcagctactgccagaccaaattctgcgcccgatgcggaggacgagtttctctgcgcagcaataaggttatgtgggtctgtaacctgtgcaggaaacaacaagagatcttgacgaagtcaggtgcgtggttctataattccggttctaacaccccacagcaacccgatcagaaggtgttaagggggctgagaaacgaagaggccccacaagagaagaagccaaagcttcatgagcagactcagttccaggggcctagcggagacctctccgtgcctgccgtcgagaaatccagaagccacggactgacacgccagcactccatcaaaaatggttcaggcgtaaagcatcatattgcctctgacatagcatctgaccgaaagaggtccccatcggttagtcgcgatcagaatagaagatatgaccagagggaagaacgggaagagtatagtcagtacgctacatccgacactgcaatgcctcgtagtccttcagattacgcagataggagatctcagcatgagccacaattttacgaagactctgaccatttatcataccgggatagcaatcgcaggtcccacaggcattccaaggagtacattgtcgatgatgaggatgtggagagtcgggacgagtacgagcgacagcgcagagaagaggagtaccagagcaggtacagaagcgatcccaatctggctcgctacccagttaagccacagccgtacgaagagcaaatgcgcatccacgcagaggtgagcagagcccgtcacgaacgaagacattctgacgtgtctctggcaaatgcagatttagaggatagtcgtatctcaatgctgaggatggaccgacccagtcgccaacgttctatttccgagcgccgtgctgcaatggagaatcaacggtcctactccatggaacggacacgggaggcacaaggacctagctcatacgcccagaggaccaccaatcattcgcctccgacacctcggcgaagccccctccctattgataggccagatctgcggaggaccgactcattacgaaaacagcatcatcttgatccctcaagcgccgtcaggaagacaaagcgggaaaagatggagactatgctacgcaacgactctctgagcagcgaccagagcgagtctgtgcggccacccccaccaaaacctcataagagcaaaaagggcggaaaaatgcgccaaatctctctgtcttcatcagaggaggaactggcatctactcctgaatacacaagctgtgacgatgttgaaatcgaaagcgaaagcgtcagcgagaagggcgacatggactacaactggctggatcacacatcctggcacagttctgaggcttctccgatgagtctccatccggtgacctggcagcctagcaaggatggggatcggcttattggaaggatactgcttaataagcgcctgaaggacggatcggtccccagagatagcggggcaatgctcggtctcaaagttgtgggtgggaaaatgaccgagtcgggacgtttgtgcgccttcattacaaaggtgaaaaaaggtagcctggctgatactgtgggccatctgagacctggagatgaggtgcttgaatggaacggcagactgctccagggggcaacctttgaagaggtgtacaatatcatcctcgagtctaaacccgaacctcaagtcgaactcgtcgtgtcccgacctataggtgacattcctaggattcccgattcgacgcatgcacagcttgagtctagctcgtcctcattcgagtcacaaaaaatggatcgtccatctatctcagttacatctccaatgagccctggcatgctccgagacgttcctcaattcctgtccgggcagctttctagtcaatccttgtctagacggactaccccattcgtgccacgagttcaaatcaagctctggtttgataaggtgggacaccagttgatagtgacaattctgggcgctaaggacctacccagtagagaagacggcagaccacggaatccctacgttaagatttacttcctacccgacaggtcagataagaacaagagaaggaccaagactgttaagaagaccctggaacccaaatggaatcagacgtttatatacagccctgtacacaggagggaatttagggagcggatgctggaaattactctgtgggatcaggctcgcgttcgggaggaagagtccgaatttctgggcgagatccttattgaattggaaaccgcactgctcgatgatgaaccccactggtacaagctgcaaactcacgatgtatcaagcctgccactcccccatccgtctccatacatgcctcgcaggcagttacacggcgagtcccccaccaggcggctgcagcgaagcaaaaggatctcagacagtgaagtcagtgattatgattgcgacgatgggattggggtcgtttctgattaccggcatgacggacgcgatttacagtcttccaccctctccgtgccagaacaagtgatgtcttcaaatcactgctcaccgtcaggttcaccccatcgcgtggacgttattgggagaactaggtcatggtccccaagcgtgcctccaccgcagtcgcgaaacgtcgagcaggggttgcgaggcaccagaacaatgacaggccactacaacactatcagccgcatggacagacacagggtcatggatgaccattactcccccgatcgggacagagattgtgaagcagcagacagacaaccttaccacaggtcaaggagcactgaacagaggcctctgctcgagagaaccacaaccaggtcaaggtcaactgaacgacctgacacaaatctgatgaggagtatgccttctctgatgaccgggagaagtgcacccccttcccccgctctgagccgctctcacccacgaaccggttccgtccagaccagtccttcaagcacccctgtggctggaagacgcggacggcagctcccccaacttccccctaagggcaccctggaccgcaaggccggaggcaaaaagttgagatccacagtgcagcggtccacggagaccggactagctgtagagatgcgtaactggatgacaaggcaggcttctagagaatctactgacggctctatgaacagctattcctccgaggggaacttaatttttcctggtgtccgtctggcttcagatagccaattctctgatttccttgacggcctcggtccagcgcagctcgtgggtaggcagaccctagccacaccggctatgggggacattcaagtcggaatgatggacaaaaagggccagctggaagtagagattatccgcgcacgtggactcgtggttaaacccggatctaagaccctcccagccccatacgtcaaagtctacctgctcgacaatggagtctgcatagcaaaaaaaaaaaccaaagttgccagaaagaccctggagcccctgtaccaacagctcctctctttcgaagaatctcctcagggtaaagtgctgcagattatcgtgtggggcgattacggcaggatggatcataagtcatttatgggagtcgctcagattctacttgacgagctggagctatccaacatggtgataggatggttcaagttattccctccgagcagtctggtcgaccctacactcgcgcctctcaccaggagagcttcccaaagttctttagagagctctacggggccttcctattcacgcagttag

SEQ ID NO: 238223 - DNA, 3492 bp, Artificial Sequence
  Description of Artificial Sequence: Synthetic coding sequence
atgcagtttgagactttgaggcaggtgtgtaactccgttctctctcacttccatggagtcttctcctcaccccctaacattctgcagaacgagttattcgggcagacactgaacaatgctcgcaagcgtagcccatcagtttctcgggaccagaataggagatacgatcagcgagaggaaagagaggagtatagtcagtatgcgacatctgacacagccatgccacgcagcccttccgactatgccgataggcgctctcagcacgaacctcagttctacgaggatagcgaccatctctcctaccgtgacagcaacaggagaagtcaccgccactctaaagagtatattgttgacgatgaagacgtggagagtcgcgacgagtatgaacgccagcgccgagaagaggagtaccagtctcgttatagatctgaccccaacctcgcgaggtatcccgtaaaaccccagccttacgaggagcagatgaggatacacgcagaggtgtctcgagccaggcacgagcggagacacagtgacgttagtctcgccaatgctgacctggaggactctcgtattagcatgctacgcatggacaggcccagccggcagcgatccatctcagagcgtcgggcagctatggagaatcaacgctcgtattccatggaacgaaccagggaggcccagggaccaagcagctatgctcagcgcacaactaaccacagccccccaactccacgccgtagcccgttgcctatcgatcgtcccgacctccgtcggaccgacagtctgcgcaagcagcatcacttggacccctcgtccgcagtgcgcaagacaaagagagaaaagatggaaactatgctgcgaaacgactccctgagctctgatcagtccgaatctgtgcgccctccccctcccaagcctcataaatcaaagaaaggcggtaagatgcgtcagatttccctttcctcttccgaagaagagttggcctctaccccggagtatactagctgtgacgacgtggaaattgaatctgaatcagtttccgaaaagggggacatggactacaactggctcgaccacaccagctggcactcgagtgaggcatccccaatgagcctgcatccggtgacctggcagcccagtaaggacggagaccgccttattggcaggatcctactgaataaacgactgaaagatggttctgtgccccgtgattctggggctatgctggggcttaaagtcgtgggcggaaaaatgacagagagcggcagactttgcgccttcatcacaaaggttaagaagggcagtttagcggatacagtcggacacctccggcctggtgatgaagtgttggagtggaatggaagactgttgcagggtgccaccttcgaggaggtgtacaacatcattctcgaaagcaagcccgagccccaagtggagctggtggtcagcagaccgataggtgacattccacgcattccagactcgactcatgcgcaacttgagtcctcttcttcttcttttgagtctcagaagatggacaggccttccattagtgttacatcgccgatgtctccaggcatgctccgagatgtccctcagtttttgagcggccagctgagtataaagttatggttcgacaaagtcggccaccaactgatcgtcacgatactgggagctaaggatcttccttccagagaggatgggagaccacggaatccatacgtgaagatctactttctaccagatagaagtgataagaataagcgtaggaccaagaccgtcaagaagacgttagagcccaaatggaaccagaccttcatttactccccggtgcaccgaagggaattccgtgagcgcatgcttgagatcacactgtgggaccaagcacgggttcgagaagaggagtccgaatttctgggggagatccttatcgagttggagacggcccttctcgatgatgagccccactggtataagttgcagacccacgacgtgtcttccctacccctacctcacccctcaccttacatgccaaggaggcagctgcacggtgaatcacctactaggcgactgcagagatcgaagcggatcagcgattctgaagtgtctgattacgactgcgacgatgggattggcgtggtttcggactaccggcatgacggtagggaccttcagtcttcaacactgagcgttcccgagcaagttatgagctctaaccactgtagcccctccggcagtccacaccgggttgacgtgattggacgtacacgcagttggtcaccatccgtccctccaccccagagccggaacgtcgagcagggactccggggaacacgtactatgactggccattataacaccataagcagaatggacaggcaccgggtgatggatgaccactacagtccagatcgcgacagtcacttccttactctccctcggtcccgatatagccagaccatcgaccaccaccaccgcgatggcagggattgtgaggcggctgatagacagccataccacaggagtaggtctaccgagcaaagaccgttgcttgagaggacgacaactcgttcgagatccaccgaacgcccagatacgaacttgatgcgaagtatgccctctctgatgacgggcagaagtgcccctcctagccccgctctttcgcgaagtcaccccaggactgggtccgttcagaccagcccttccagtacccccgtagcagggaggcgcggaagacagctgccccaactccctcctaaggggaccctagacagaaaagccggtgggaagaaactgcggagtacagttcaacgatctaccgaaactggcttagctgtggagatgcggaattggatgacaagacaagccagccgcgaatccacagacggctccatgaatagctactctagtgaaggcaatcttatcttcccaggggttcggttggcttcagactcccagttcagtgattttttggacgggttagggcctgctcagctggtcggcaggcaaacactggccaccccggcaatgggcgacatccaggttggtatgatggacaagaagggccagctggaagtcgaaattattcgggctcggggactggtggttaagcccggttctaagacgctgccagcaccctatgtaaaggtttacctgctcgacaatggtgtctgtattgccaagaagaagaccaaggtcgcccgaaaaacactagagcccttgtaccagcagttgctgtctttcgaggaatcaccacaggggaaggtgctccaaatcatagtctggggagattacggtcgaatggaccataagagcttcatgggcgtggcgcagatcctgttagatgagcttgagctgtccaacatggtgatagggtggttcaaactcttcccccctagctccttggtcgacccgacactcgcacctcttacaagaagggcctcacagagcagtctggagagttcgacaggcccatcctattcaaggtcttag

SEQ ID NO: 238224 - DNA, 927 bp, Artificial Sequence
  Description of Artificial Sequence: Synthetic coding sequence
atgttcaatggagaacccggtccagcctcctccggagcatctcgcaatgttgtgcggagctcctcaatttctggggaaatctgtggcagtcagcaggccggtgggggtgccggaacgaccacagccaagaaacgccgaagctccctgggtgccaagatggtggcgatcgtgggtctgactcagtggtctaaaagcactctccagttgccacagcctgagggagctaccaagaagctgcgcagcaatattcgtaggtctactgagactgggatagcagtcgagatgcgcagcagggtgacaagacagggcagcagggaatccacagacggctcgactaattcaaatagtagcgatggtacttttatctttcccacgacaagactcggtgccgaaagtcagttctcagacttcctcgatgggctggggccagcacagatcgtgggcagacagacactggcaactccacccatgggtgatgtacatattgctatcatggataggtccgggcagctggaggtggaggtgattgaggctagaggcctaaccccaaagcctggttccaaatcactgcccgcaacatacatcaaagtttacttgctcgagaatggcgcttgcctcgccaagaaaaaaacaaaaatgaccaaaaagacatgcgatccactgtaccagcaagccctcctctttgacgaaggcccacagggaaaggtcttgcaggtgatcgtatggggcgattacggtcgcatggaccacaaatgctttatgggcatggcacagattatgctggatgagcttgatttgtcagctgcagtaactggatggtataaactgtttcccacctcctctgtggccgacagcacactcggatccctgacccgacgcctttcccagtctagcttagaatcagcaacctccccaagctgcagctag

SEQ ID NO: 238225 - DNA, 927 bp, Artificial Sequence
  Description of Artificial Sequence: Synthetic coding sequence
atgttcaacggcgaaccgggacctgcctcctctggtgctagtaggaatgttgtcaggtcgagctccatctctggagagatctgtggatcccagcaggcagggggtggagccggtaccacaaccgctaaaaaaaggagatccagcctgggggctaaaatggtagccattgtaggactaacgcagtggtcaaaatctacattacagctcccccagcccgagggtgctaccaagaagttgaggtccaacatccgtcgctctacagagaccggcatcgccgtcgaaatgcgatcacgagtgacacgtcagggctcgcgtgaaagcactgacggctccaccaacagcaactcttcagacggcacgttcatatttccaaccactagactgggagccgaatcccagttttccgactttcttgacggcctgggcccagcccagattgtgggcagacagactttagccacaccaccgatgggggacgtccatatcgctataatggacaggtcgggtcagctggaagttgaggtgatcgaggcccgaggcttgactcctaagccaggcagtaagtcgcttcctgctacctatattaaagtgtatcttctagaaaatggagcctgtctggcaaaaaaaaaaaccaagatgaccaaaaagacatgtgaccccttgtatcagcaggcgctcctgttcgacgaaggccctcagggaaaagtgcttcaagtcatcgtgtggggagattatggcagaatggatcacaagtgtttcatgggaatggcacagatcatgcttgacgagctcgatctgtccgcagccgtgactggatggtacaagctgtttcccacttctagtgtggccgacagtactctcggctctctgacacgtcgtctgtcacagagctccctcgagtccgcaacctctccctcttgttcatag

SEQ ID NO: 238226 - DNA, 810 bp, Artificial Sequence
  Description of Artificial Sequence: Synthetic coding sequence
atggagcgttcacagagtcggctcagtctgagcgcaagtttcgaagcgctcgccatctacttcccttgcatgaattctttcgacgatgaagatgccggtgattctcggcgtttgaagggagctatccagaggagtacagagaccggccttgcagtggagatgcctagtagaactctgcggcaggcctctcacgagtctattgaggattctatgaactcctatggatcagaaggcaacttgaattacggcggtgtatgtctcgctagcgacgcccagttctccgatttcctgggctcaatgggacccgcacaatttgtcggtaggcaaaccctcgcgaccacacccatgggggacgtggagattggcctgcaggagaggaatgggcagctagaggtggacataatccaggcaagaggcctgacagctaagcctggatccaagaccttgccagcagcctacattaaagcctacttgctggagaatggaatctgcattgccaagaagaagactaaggtcgcacggaaatccctggatccactgtacaatcaggttttactctttccagagagtccccagggaaaagtcctgcaggtcatagtgtggggaaattacggcaggatggagaggaaacagttcatgggggtggccagagtgctgctggaggaactggaccttaccactcttgccgtgggttggtataagctgtttcccacttcctctatggtcgacccagccactggcccactgctccggcaggcttcacagttatccctggagagcactgtgggtccttgcggcgagaggagttag

SEQ ID NO: 238227 - DNA, 813 bp, Artificial Sequence
  Description of Artificial Sequence: Synthetic coding sequence
atggaacggtcccagtcaaggttgtctctatcagcttccttcgaagcactcgccatctatttcccgtgtatgaacagcttcgacgatgaggacgccgagggggattcccgacgcttgaagggggcaattcaacggagcaccgaaacaggcttggcagtggagatgccttctaggacactgaggcaagccagtcacgagtccatcgaggactcaatgaattcgtacggaagcgaaggcaacctcaattatggaggtgtgtgcttagcctccgacgcacagttctctgattttttggggtcaatgggaccagcccagtttgtgggtagacagaccctggcaactactcccatgggagatgtggagatcggcctgcaagagcgaaacgggcagctggaagtggacatcattcaggccaggggtctcactgccaaaccaggttcaaaaactctgccagccgcttatatcaaggcttacttgctggagaatggcatttgtatcgctaaaaagaagacaaaagtggctaggaagtcactggaccctctctacaaccaagttcttctatttcctgaatctcctcagggcaaagttcttcaagtcatcgtttggggtaattatgggagaatggagcgcaaacagttcatgggggtggccagggtcctactggaggaacttgaccttacaacattggcagtgggatggtacaaactgttcccaacatcttcgatggtggatcctgccaccggccctctgttgaggcaggcctcgcagttgtccttagaaagcactgtgggcccttgcggagagcggtcatag

SEQ ID NO: 238228 - DNA, 759 bp, Artificial Sequence
  Description of Artificial Sequence: Synthetic coding sequence
atggaagacggagtcgccggacctcagcttggcgctgcagcggaggcagccgaagctgccgaagcacgggctaggcccggagtaacgttacgcccttttgccccactgtcaggtgccgcagaggcggatgaggggggtggcgactggtcattcatcgactgcgaaatggaggaagtggatttgcaggatcttccatcggcaactattgcttgtcatcttgatccccgagtatttgtggatggcctctgcagggccaagtttgaaagcctctttcgaacatatgataaagatattacattccaatattttaagtcttttaaacgggtgcggattaacttcagtaatccattctcagcggctgacgctcgcctgcaactgcataagactgaatttttgggaaaggaaatgaagctctacttcgctcaaaccttacacatcggaagtagtcacctcgccccaccgaatcctgacaagcagttccttatcagcccgccagccagcccaccagtgggctggaagcaagtggaagacgcaacaccagtgataaactatgatttactgtacgctatttcaaagctggggcctggggagaaatacgagctccacgccgctactgacaccaccccctctgtggttgtgcatgtgtgtgagtccgatcaagaaaaggaagaagaggaagaaatggagcgcatgaggcgaccgaaacctaagataatacagacaagaagacccgaatatacccctatccatctgagttag

SEQ ID NO: 238229 - DNA, 594 bp, Artificial Sequence
  Description of Artificial Sequence: Synthetic coding sequence
atgcactttcgaaactttaattatagcttctctagtctcatagcttgtgtagcgaactctgacatctttagtgagagcgaaacacgcgcaaagtttgaaagtctttttaggacatatgacaaggacataacctttcagtactttaaaagcttcaagcgagtcaggattaacttttccaaccccttttctgccgctgatgctagactgcagctccacaagaccgagttcctgggcaaagaaatgaagttatacttcgcccagacactgcatattgggagctctcacctcgctccaccgaatcctgacaaacaatttctgatctcacccccagcttctcctcccgttggctggaagcaggtggaagacgccacacccgtcatcaattatgacctgctgtacgcgatttctaagctggggcctggagaaaagtatgaattgcacgctgcaacagataccacgccttctgtggtggtacatgtgtgtgaaagcgatcaagagaaagaagaggaagaggaaatggagcggatgcgaaggccaaagcctaagattatacagacacggaggccggagtacacccccattcacttgtcgtag

SEQ ID NO: 238230 - DNA, 729 bp, Artificial Sequence
  Description of Artificial Sequence: Synthetic coding sequence
atgcagggagagcagggcagacggctgttcaggctgttgctgaatgacctccccggaagggaccggctgccttgcagctatcctcagcctcacgtggaacaggcatccactagcgcgtccccccgtctcctggctgtcaacatccccgaagatacactgctcagttacccggaatcgtccctccccctgcagaggcactgtgcattccatcgattctccaaagccaagtttgagtccttgttccgcacctatgacaaagatatcactttccagtacttcaagtcgttcaagcgggtgcgcatcaatttctcaaacccattctccgctgccgatgcccgtctgcagcttcacaaaaccgaatttcttggtaaggagatgaagctttacttcgcccagaccttacatatcggcagttctcacctggccccacctaacccagataagcaatttttgatttctccccctgcgagccctcccgtcgggtggaagcaagttgaggatgcgacgcccgtcatcaactatgaccttttgtatgccatttccaagctggggccaggtgaaaaatacgagttgcacgccgcaactgacactaccccgagcgtggttgtacatgtgtgtgaaagcgatcaggaaaaagaggaggaggaagaaatggaaagaatgaggcgacccaaaccaaagataattcagacgaggcggcctgagtatacgccaatccacctctcatag

SEQ ID NO: 238231 - DNA, 354 bp, Artificial Sequence
  Description of Artificial Sequence: Synthetic coding sequence
atgaagttgtatttcgctcagacattgcacattggctcctctcatctggcgcctccaaaccctgacaagcagtttctgatctccccccctgcttcacctccagtgggctggaaacaggtcgaggatgccacacccgtcattaactacgaccttctatatgccattagcaaactagggcctggtgagaagtatgagctgcacgccgctactgatacaactccatccgtagtggtccacgtgtgcgaatccgatcaagaaaaggaggaagaagaagagatggaaaggatgaggcggccaaagcccaaaataattcagacccgtagacccgagtacacccctatccatctgtcctag

SEQ ID NO: 238232 - DNA, 354 bp, Artificial Sequence
  Description of Artificial Sequence: Synthetic coding sequence
atgaaactctactttgcccaaacgctgcacataggaagttctcatctggccccacctaaccctgataaacagttcctaatatcaccaccagcaagccctccagtgggctggaaacaagtggaggatgctaccccagttatcaactatgacttgctttacgcgatatccaaactgggcccaggcgaaaagtatgaactgcatgccgcaactgacacgacaccatctgttgtcgtgcacgtgtgtgagtcagatcaggagaaagaggaagaggaggagatggagagaatgaggcggcctaagccaaaaattattcagacccgcagacctgaatacacccccattcacctgagctag

SEQ ID NO: 238233 - DNA, 354 bp, Artificial Sequence
  Description of Artificial Sequence: Synthetic coding sequence
atgaagctgtattttgcccaaactcttcacatcggcagctctcatcttgcgccaccgaaccctgacaaacagtttcttatttctccaccagccagtccccctgtaggctggaagcaagtggaagacgccacaccagtaatcaactatgacttgctgtatgccattagcaagctcggccctggagagaaatacgaactccacgctgctactgacacaacaccatcagtggtggttcacgtttgtgagagcgaccaggaaaaagaagaggaagaggaaatggaaagaatgagaagaccaaagcccaaaataatccaaactagaaggcctgagtatacacctatccacttgagctag

SEQ ID NO: 238234 - DNA, 732 bp, Artificial Sequence
  Description of Artificial Sequence: Synthetic coding sequence
atgagaggtgagtcttatttcattggaatgaggtcacccggacaacaggggcacgttcccgaggacggaggtctgttccttctctgttgtattgacagagattgggccgttacgagatgttttgccgaggaggcattccaagccataaccgatttcaacgatctgcctaacagcctgttcgcctgcaatgtgcatcagtctgtgttcgagggcgaggagtcgaaggaaaagtttgaaggcttgttcagaacctatgacgactgtgtgacttttcaactgttcaagtccttccgcagggtccgcatcaacttctcaaacccaaagagcgcagcgagagcgagaatcgaattgcacgagacccaattccgaggtaagaaattgaaactctattttgctcaagtgcagacccccgagaccgatggtgataaactccacctggcccctcctcagccagcgaaacagttcctgatatctccgccttccagccccccagtcgggtggcagcccattaacgacgccactcctgtgcttaactacgatcttctgtacgccgtcgctaaactcgggccaggggaaaagtacgaacttcatgcgggtactgaatctacacccagtgtggttgtgcatgtctgtgacagcgatatagaggaggaagaggacccgaagacatcccctaagccaaagattattcagacacgaaggccaggccttcctccaagcgtcagcaactag

SEQ ID NO: 238235 - DNA, 594 bp, Artificial Sequence
  Description of Artificial Sequence: Synthetic coding sequence
atgcccgcaccctccatggattgcgatgtctcaacactcgtagcatgcgtggtggatgtcgaagtcttcaccaatcaagaagtcaaagagaagtttgaaggattgtttcgcacttacgatgattgtgtgactttccagttgtttaaatctttccgcagagtcagaattaattttagcaatcccaaatctgcggcaagggctcgaatcgaactacacgaaacccagttcagggggaagaaactcaagctttacttcgcacaggtgcagactccggaaacggacggcgacaaactgcatctggctcctccccaacctgctaaacaattcctgatctctcccccttcctctccacccgtaggctggcagccgattaatgacgcgacccccgttttgaactacgatttgctctacgccgtggctaagttggggccaggcgaaaagtacgaactgcacgcagggaccgagtctacaccaagcgtcgtcgtacacgtctgcgattcggatatcgaggaggaggaggatcccaaaacgtcacccaagcctaagattatacagacacggaggccaggactcccgccaagcgtgtcaaattag

SEQ ID NO: 238236 - DNA, 732 bp, Artificial Sequence
  Description of Artificial Sequence: Synthetic coding sequence
atgcgaggcgagtcctactttataggcatgaggagccctggacagcaaggtcacgttccagaggacgggggactctttctgctgtgttgtattgatcgtgattgggccgtcactcgctgctttgctgaggaagcctttcaggccatcactgactttaatgacctcccaaactcacttttcgcctgtaatgtgcaccagtcggtgtttgagggagaagaaagtaaggaaaaattcgagggcctgttccgcacatatgacgattgcgtcacctttcagttgttcaaatcttttagaagagtgcgaattaacttctccaacccaaagtcagcagccagagcacgtatcgaactgcacgaaactcagttcagaggaaagaaactgaagctgtatttcgcccaggtgcaaactccagaaactgacggtgataagctgcacctcgcccctcctcagccggctaaacagttcctcataagtcccccttcctctccccctgttggttggcagccgatcaacgacgctactcccgtactaaactacgacctgctgtacgcagttgcgaagctgggtccaggcgaaaaatatgaactccacgcaggcacagagtctacgccaagcgtggtggtccacgtatgtgattcagatattgaggaggaggaggatcccaagactagcccgaaaccaaagattattcagaccaggaggcctgggctcccgccatctgtctccaactag

SEQ ID NO: 238237 - DNA, 732 bp, Artificial Sequence
  Description of Artificial Sequence: Synthetic coding sequence
atgcgaggcgaatcatatttcattggtatgcggtcccccggacagcagggacacgtgccggaagacggcggtctgttccttctctgctgtatcgaccgtgattgggccgtcacccgctgcttcgcagaggaggcatttcaggctatcactgattttaatgaccttccaaactctctgttcgcatgcaacgtgcaccaatccgtgttcgagggcgaagaaagcaaagagaagttcgaggggctatttaggacctacgatgactgcgtgacctttcaattgtttaagagtttcaggcgagttagaataaacttcagtaaccctaagtcagccgctcgagcccgaatcgaactacacgaaactcagttccgcggaaagaagttgaagttatatttcgcacaggtacagaccccagaaaccgatggagataaactgcatcttgcaccgccacagcccgcaaaacagtttcttatttcacctccaagctctccacctgtcggctggcagccaatcaatgatgcgactccggtccttaactacgatttgctctatgctgtagcgaagctcggtccgggtgaaaagtacgagcttcatgcaggcacggagtctaccccctctgtcgtggtacatgtgtgtgactccgacattgaggaagaagaagatcccaagacaagcccgaagccaaagatcattcaaacgcggagaccaggcctcccgccttctgtgagcaattag

SEQ ID NO: 238238 - DNA, 1596 bp, Artificial Sequence
  Description of Artificial Sequence: Synthetic coding sequence
atggtggacgttggaaagtggcctatttttaccttgctgtccccgcaggaaatcgcatccattagaaaagcgtgcgtcttcggcacgtctgcatcagaggcgctctatgtaaccgacaacgacgaggtttttgtgtttggattgaattactcaaattgcctggggaccggggacaaccagtccaccctagtgcctaaaaaactggagggcctatgcgggaaaaaaatcaaatccctctcctacggcagtggaccgcacgtccttctgtcgacagaggatggtgtggtttacgcgtggggccataacgggtactcccagttgggtaacggcaccaccaaccaggggatagcaccggtgcaggtttgcacgaatctgttgatcaaacaggtggtggaggtggcttgcgggtctcatcactcgatggcactggctgcggacggggaagtgtttgcttggggctataacaactgcggccaggttgggtcaggaagcaccgctaatcagccaacccccagaaaggttacaaactgcttgcacattaaacgggttgtgggtattgcctgcgggcagacgagttcaatggccgtgcttgacaacggcgaagtgtatggttggggatacaacggcaatggtcaattaggcttgggcaacaacggcaatcagttgacacccgtacgggttgcggcattgcactctgtgtgcgtgaaccagattgtctgcgggtatgctcacaccctggccttgactgacgagggtctcctgtatgcttggggtgccaacacatatggacaactcggcaccggaaataaaaataacctcctgtcacctgcccatatcatggttgagaaggagcgagtcgtggaaatcgccgcatgccattcagcgcatactagtgccgctaaaacccaagggggtcatgtttacatgtggggccagtgccgaggccagagtgtcattctgccacaccttacacatttttcttgcacggatgacgtctttgcctgtttcgcaacaccggctgtcagttggcgtctgctctcagtggaacacgaggacttcctgacggtagctgagtcgctaaagaaagaattcgattcacccgagaccgcagatctgaaattccggattgatgggaaatacattcacgtgcataaggcagtgttgaagatccgttgtgaacactttcggtctatgttccagagttactggaacgaggatatgaaagaggtgatagaaatagatcagttcagttatcctgtgtatcgcgcatttctgcagtacctgtatactgatactgtggatttacccccagaggacgccattgggctgctggacctggcgaccagctactgcgagaaccgacttaagaagctgtgccaacatataatcaagcggggaattactgtggagaacgcatttagtctcttcagtgcagcggttcggtatgacgctgaggatctggaagaattttgtttcaaattctgtataaatcacctgactgaagtgacccaaacagcagccttttggcagatggacggaccgctgctcaaggagtttattgcgaaagcatccaaatgcggggctttcaagaattag

SEQ ID NO: 238239 - DNA, 1596 bp, Artificial Sequence
  Description of Artificial Sequence: Synthetic coding sequence
atggtcgacgtcggtaaatggcctatttttactttgttaagcccccaggaaattgcatctatacggaaagcctgtgtatttggaacttcagccagcgaggccttgtacgtgactgataatgatgaagtgttcgtctttggactgaattattcaaactgtctggggaccggagacaaccagagcaccctcgtgccaaaaaaactcgaagggctgtgtggtaaaaagatcaaatccctgtcctatggatctgggccacatgttctgctgagtacagaggatggtgtggtgtatgcttggggacacaacgggtactctcagttgggtaacggcaccaccaaccagggcatagctccagtccaggtgtgcacaaatctgctgatcaaacaggtggtcgaggtcgcttgcgggagccaccactcaatggcactggcggcagacggtgaagttttcgcctggggctataacaactgtgggcaggtgggctctgggagcaccgccaaccagcccacacccagaaaggtcactaattgtttacatattaagagagtggtgggaatcgcctgcggccagacttcctctatggccgtgctggacaacggagaagtgtatggatgggggtataacgggaacggccagctcggcctcggcaataatggcaatcaattgactcccgtgcgggtcgctgccctgcatagcgtgtgcgtgaaccagatcgtttgcggatacgcgcacacacttgctcttaccgacgagggactgctttacgcatggggcgcaaacacctacggtcagctgggtacgggcaacaagaataacctgctgagtccggcacacattatggtagagaaagaaagggtcgtagaaatagcagcgtgccactcagctcatacgagtgctgcaaaaactcaagggggacatgtgtacatgtggggacagtgcagggggcaatctgttattttgccgcatttaacacacttttcctgtactgacgacgtattcgcctgttttgccaccccagcggtttcctggagactgctttcagtggaacacgaggattttttgacagtggccgaaagtctgaagaaagagttcgacagccccgagacagctgacctcaagttcagaatagacggaaaatacattcacgtgcataaagcggtcctcaagattcgctgcgagcacttcagatccatgtttcagtcctactggaatgaagacatgaaggaggttattgaaatagaccagttctcctacccagtgtatagagctttcctacagtacctatatacagatacggtcgaccttccgcctgaagatgcgatcgggctcttggacctagcaaccagctattgcgaaaatcggctcaagaaactttgccaacacatcatcaagagggggatcacagtcgaaaatgcattcagtctgttctcagcagctgtccgatatgacgccgaggacctggaggaattctgctttaagttctgtatcaaccatctgacagaggtcacccaaaccgctgcgttttggcagatggatggaccattactcaaggagttcattgccaaggcaagcaaatgcggggcattcaaaaactag

SEQ ID NO: 238240 - DNA, 1068 bp, Artificial Sequence
  Description of Artificial Sequence: Synthetic coding sequence
atggtagacgtgggcaagtggccgatctttactctcctgtcgccacaggaaattgcaagtatccgcaaggcctgcgttttcggaacctccgccagcgaggctttgtatgtgaccgataacgacgaagtctttgtcttcggtctgaactactccaactgtctgggcacgggcgacaaccaatcaactctagtgccaaaaaaactggagggcctgtgtggcaaaaagatcaagtctttatcatacggaagcggcccacacgtgcttctctccacagaggacggcgtggtgtacgcctggggtcacaatgggtattcccagttgggcaacggtaccactaatcagggaattgccccagtgcaagtctgcaccaacctgctgataaagcaggttgtagaggtggcatgtgggtctcaccattccatggcactagcggctgacggcgaggtcttcgcctggggctacaataattgtggccaagtaggcagcgggtcaacggcaaaccagccaactccacgaaaggtcactaattgtcttcacatcaagcgagtcgtgggcatagcgtgcggtcagacttccagcatggccgttctcgacaatggcgaagtctacggatgggggtacaacggcaatggacaactgggtctagggaacaatggtaaccagttgactccggtccgcgtagccgctcttcacagcgtatgcgtgaatcagatagtctgcggctatgcgcacactctggctttgactgacgagggcctcctgtatgcttggggggctaatacatatgggcaactcgggacaggtaacaaaaacaacctgctctcgccagctcacatcatggtcgaaaaggagcgagtggtagagattgccgcatgtcattccgcccacacaagcgctgctaagacccagggcggtcatgtgtacatgtggggtcaatgcaggggacagagcgtcattctgccacacttgactcacttttcatgtacagacgacgttttcgcttgcttcgcaacccccgcagtcagttggcggctgctgagcgtcgtgtccatagtcatcgggaaatag

SEQ ID NO: 238241 - DNA, 1656 bp, Artificial Sequence
  Description of Artificial Sequence: Synthetic coding sequence
atggaggaggagctgccgctcttctccggagatagcggaaaacccgtacaggccaccctgagctctctgaagatgctcgacgtgggaaaatggccgatattttcactgtgctcagaggaggaattgcagcttatccgccaggcatgcgtctttggaagcgccggtaatgaggttctgtacacaactgttaatgacgagatttttgtgcttgggacaaactgctgcggctgtctgggactaggggacgttcaatcaacgatagagcctaggagactggacagccttaatggaaaaaaaatcgcatgtctcagctacgggagtggaccacatatcgtgctcgcgaccacagagggagaagtatttacatggggtcataacgcgtatagccaactcgggaacggcacaaccaatcacggcctggtgccctgtcacatttccacgaacctaagcaataaacaggtaattgaggtcgcttgtggttcataccactccctggtcctgacctccgacggcgaggtattcgcctggggatataataactccggacaggttggctccggatcaacagtgaaccagcctatcccccgtcgcgtcaccggctgtctccaaaacaaggtagtggtcacgatcgcctgcggccagatgtgttgtatggccgtcgtcgacacaggcgaggtgtacgtgtggggatacaacgggaatgggcagctgggattgggaaactctgggaatcaaccgacgccatgtcgcgtcgccgctttgcaaggtataagggtgcagagggtggcgtgtggctatgcgcacacattggtgctgaccgatgaagggcaggtatacgcctggggagctaattcatatggccagctgggaacaggcaataagtccaaccaatcgtaccctacccccgtgacagtggaaaaagaccggataattgagattgcagcgtgccattcaacccacacaagcgccgctaagacacagggcggacatgtgtatatgtggggccagtgcagaggacagtccgttatcttacctcacttgacccacttctcatgtaccgacgacgtgtttgcttgcttcgccacgcccgctgtcacctggagactcctttctgttgagccggacgaccatctaaccgtggccgaatctctgaagcgggaatttgacaatccggacacagcggatctaaagttcctggtggacggcaagtatatatacgcacataaggtgctgttaaagattcggtgtgagcatttcaggtcctcattagaagacaacgaagacgacattgtcgaaatgtctgaattttcataccccgtgtatagggcctttctggagtatctttacaccgattctatttctctaagcccagaagaagccgtcggactgctggatctggccaccttctaccgagagaaccgactgaagaaactgtgtcagcaaaccataaagcagggcatatgcgaagaaaacgccattgccctgttaagcgcagccgttaaatacgatgctcaggatttagaagaattctgttttcgattttgcataaaccatctcactgtggttacccagacaagtggattcgcggagatggatcatgacctattgaagaacttcatctccaaagcctcacgggtcggcgcatttaaaaactag

SEQ ID NO: 238242 - DNA, 1671 bp, Artificial Sequence
  Description of Artificial Sequence: Synthetic coding sequence
atgtccgccttaccgagggacttggaactttcaaacccacgagagaagttgaccaaaccagtgcaggccacactttcgtctctgaagatgctggatgtgggcaagtggcccattttctccctctgcagcgaggaagagctgcagctgatcagacaagcctgtgttttcggaagcgcagggaatgaagttttatatacaacagttaacgatgagatttttgtccttgggaccaactgctgtggttgcctggggctgggcgacgtgcagtccactatcgaacctcggcgactcgactctctcaacggcaagaagattgcgtgcctctcttatggtagcggcccacatatcgtccttgctaccacagagggcgaagtctttacctggggacacaatgcctattctcagttgggaaacggaaccacaaatcacggtctagtcccatgccatatctctacaaatctgtccaacaaacaggtgatcgaagtcgcctgcggaagttatcattcactggtgctcacttctgatggcgaagtgttcgcctgggggtacaacaactctggccaggttggcagcgggagcacggtgaatcagcccatccctcgtagggtgaccgggtgcttacaaaacaaggtcgttgtaacaatcgcctgcgggcagatgtgctgcatggcagtggtggatacaggggaggtctatgtgtgggggtacaacggtaacggccagcttgggcttggaaacagtggcaatcagccgacgccatgtcgagtagccgcattgcagggaatacgcgtccagagagtggcttgtgggtatgcccacactctcgttctgaccgatgaggggcaggtgtatgcctggggggctaatagttatggccagctgggaacagggaacaaatctaatcaaagctacccgactcccgtcaccgtcgaaaaggataggatcattgaaattgccgcatgccactcaacccatacatcagcagccaaaactcagggcggacacgtgtacatgtggggacaatgcagggggcagtccgtaatactgccacacctgacgcactttagttgtactgatgatgtgttcgcctgttttgccacacctgccgtcacatggcgcttgttgtccgtggagccggatgaccaccttactgttgcagagtctctcaaacgggaatttgacaaccccgatacggcagacctcaaatttttagtggatggcaaatacatctacgcacataaggtccttttgaagattagatgcgaacattttcggtccagtttggaggacaatgaagacgacatagtcgaaatgagtgagttctcctacccagtgtacagggcatttcttgagtatctatatactgacagcatttctctgtctccggaggaggccgtcggcctcctggacttggccacattttatcgggagaaccgactcaaaaagctctgtcagcagacaatcaagcaggggatctgcgaggagaacgccatcgcattgctgtcagcagccgtgaaatatgacgcccaggacctagaagagttttgcttcagattttgcatcaatcatctgacagtggtgacacagacatcagggtttgcagagatggaccatgacctcctcaagaacttcatcagcaaagccagccgggtgggggcttttaagaactag

SEQ ID NO: 238243 - DNA, 1512 bp, Artificial Sequence
  Description of Artificial Sequence: Synthetic coding sequence
atgctccaggatgggagctgtaaacagatgctgttaatgctgcttattgtgcagcccgtgcaggccactctttcttctctgaagatgctggacgttgggaagtggccaatatttagcctgtgtagtgaggaggaactgcagctcatccggcaggcatgcgtgtttggatcagcgggtaacgaggtgctgtacactacagtcaacgacgagattttcgtcctggggactaattgttgcggctgtctgggcttgggagacgtacagtccactattgaacccaggaggctcgactcactcaacggaaagaagattgcatgtctctcttatggaagcggaccccacatcgtgcttgctaccaccgagggggaggtgttcacatgggggcacaacgcctatagtcaactcggcaatggcaccaccaatcatgggttggttccatgtcacataagcacaaatctttccaacaaacaagttattgaagtcgcctgtgggtcctatcactctctagtcctgacatcagatggtgaggtctttgcttggggctacaacaactctggccaggtggggtcaggatcaactgtgaaccagccaattccacgtagagtgactggctgtctccaaaacaaggtagtcgtgactattgcctgcggccagatgtgctgcatggcagtggtggataccggtgaggtatacgtgtggggctacaacgggaatggccagttgggactggggaactccggaaatcaacctactccctgccgagtggctgctcttcaggggattagggtgcaacgtgtggcttgtggctatacacacacgtccgctgccaaaacacaaggaggtcatgtttatatgtggggacaatgtcggggacagtctgttatactcccccatcttacccattttagctgcacagatgatgtgtttgcgtgcttcgccaccccagccgttacatggcgcctactgagtgtggaacctgacgatcacctcaccgtggctgagagccttaaaagagaattcgacaatcccgatacagccgatctgaaattcttggtggatggcaaatatatatacgctcacaaagtgctcctcaaaatacgatgtgaacactttcgctccagcctcgaagataacgaagatgacatagtcgagatgagcgaattctcatatcccgtgtatcgcgcatttctcgaatacctgtatacagactccataagcctatcccctgaggaggccgtgggtttgctcgacctcgctacattctatcgggagaaccggctcaaaaaactgtgtcagcagacgattaaacaaggcatttgcgaagagaacgcgattgccctgctctctgccgctgtgaagtacgatgctcaggatctcgaggagttctgctttcgtttctgcatcaaccacctgactgtggtgacacagactagtggctttgccgaaatggaccatgacttgctgaaaaactttatcagcaaagcgtctcgcgtgggagcgttcaaaaactag

SEQ ID NO: 238244 - DNA, 1671 bp, Artificial Sequence
  Description of Artificial Sequence: Synthetic coding sequence
ccgtgtagcaatcggtaccccggaggcggagctgataaggcccctgcatgcgaggaacccgtgcaggcaacactttcttccctcaaaatgttggatgttggcaagtggcctatcttctctctgtgcagcgaagaggagctccagttaatacggcaggcatgtgttttcggatccgccggtaatgaggtcctatacaccactgtgaacgatgaaatcttcgtgcttggcacaaactgttgcgggtgtctgggacttggcgacgtccagagcacaatcgagccacggaggctggactccctcaacggaaagaagatcgcatgcctgagttatggatcaggtccccacatagttctggcgaccactgaaggggaggtgttcacctggggtcataacgcgtactctcaactaggcaatggaacaacaaaccatggcctcgtgccctgtcacattagtaccaacctctccaacaagcaggtgatcgaggtggcctgtggcagttatcattctcttgttttaacctcggatggcgaggtgttcgcatggggatataataatagcggacaagtgggctcaggaagcaccgttaaccaacccataccccgtagggtgaccggttgcctacagaacaaggtggtcgttaccattgcttgtggtcagatgtgctgtatggcagtcgtggataccggcgaagtgtacgtatgggggtataacggcaacggccagttgggtctgggcaacagtggcaatcagccaaccccatgccgggtggctgcattacagggaattagggtgcagagagtagcttgcggttacgcccacacattggtgttaaccgacgaaggacaagtctacgcttggggagccaattcatatggccaattggggactggaaacaaatctaatcaatcttatccaactcccgtgacggttgaaaaggatcggattatcgaaatcgcagcctgtcacagcacgcataccagtgcagcgaaaacgcaaggcggacatgtgtatatgtggggacagtgtaggggacaatccgtcatcctcccacatctgacacatttctcttgcaccgatgacgtatttgcttgcttcgccacacccgctgtaacctggaggcttctctcggtcgaaccagacgaccacctgactgtcgccgagtcactaaagagggagtttgacaatccagacacggccgatctaaagtttttagttgatggcaaatatatatatgctcataaagtgctgctgaaaatccgttgtgaacattttcggagttctcttgaagataacgaggacgatatcgtcgaaatgtcagagtttagttaccccgtctatcgtgccttcctggaatacctctacactgactctataagtctgagccccgaagaagctgtgggactacttgatctggcgactttctacagggagaacaggctgaaaaaactttgccagcagacaattaaacagggcatctgcgaagaaaacgccattgccctgctgagtgccgcagtgaagtacgacgcgcaagacctggaggagttttgttttagattttgcatcaaccacctgacagtggtcacccagaccagcggattcgctgagatggaccacgatttactgaagaacttcatcagcaaggctagcagagtgggagccttcaagaactag

SEQ ID NO: 238245 - DNA, 834 bp, Artificial Sequence
  Description of Artificial Sequence: Synthetic coding sequence
atgagtggtgtaacgaccgagactgggagcttggactctgccaccgtggcaaccagtcagcccctggctgaatggcagctgtgcaaagcaagcgtgtcccgaggtatcatcgagatcgccgcttgccattctacccacacgtccgccgcaaagacccagggtggacacgtctatatgtggggacaatgccgagggcagtctgtaatcctaccccatctcactcattttagctgcacagatgacgtgttcgcctgcttcgccactccggctgttacatggcgcttactgagcgtggaacctgacgatcacctcactgtggcagagtccctcaagagggaatttgataatccagataccgccgacctcaagtttttagtggatgggaaatatatttatgcccacaaggtgcttcttaagattcgttgtgagcacttcagatcatccctggaggacaatgaggacgatattgttgaaatgtcagaattttcttacccagtgtacagggccttcttggaatacttatacactgactcaattagcctcagcccagaggaggctgtgggccttctggatctcgctaccttctatcgagaaaaccgactgaagaaactctgccaacagaccattaagcagggtatttgtgaagaaaatgccatcgctctgctatctgcagcagttaagtatgacgcacaagacctggaagaattctgtttccgcttctgtatcaatcacttaactgtcgtgacccaaacgagcggatttgccgagatggatcatgatttgctgaaaaattttatcagtaaggcctctcgggtgggagcctttaaaaactag

SEQ ID NO: 238246 - DNA, 846 bp, Artificial Sequence
  Description of Artificial Sequence: Synthetic coding sequence
atgctggacgtgggaaaatggccgattttcagcttgtgctcggaagaggaattgcaacttatccgtcaggcctgcgtcttcgggtctgccggaaacgaagtcctatacacaacggtgaacgatgaaatttttgtgctggggacaaattgttgcggatgcttaggactcggtgatgttcaatccacaatcgagccccgaagactggattctctcaacgggaagaagatcgcttgtctctcatatgggagcgggccacatatcgtgcttgctacgaccgagggggaggtcttcacatggggccataacgcttactcccagctggggaatggcaccaccaaccacgggctggtcccctgccatattagcacgaacctttctaataaacaggttattgaggtcgcctgcggaagctaccactcacttgtgctcactagtgatggagaggtgtttgcctggggatacaacaattcgggccaggtgggctctggttcgacggtaaaccagccaatacctcgacgagtaactgggtgtctgcagaataaggtcgttgtcaccattgcctgcgggcagatgtgttgcatggcagtggttgataccggggaggtgtatgtgtgggggtacaacggcaatggacagctgggcctggggaacagcggcaaccagcctaccccttgtcgggtggccgctcttcagggcataagggtgcaaagagattacagagactgctcgcttagcctccacacccatgtttgcggacaagatgcagggtgggcgcgagttcacgttggtcccgtacctggatctgtgcgagatccccctgccccacacccgctcctgctgcactag

SEQ ID NO: 238247 - DNA, 1359 bp, Artificial Sequence
  Description of Artificial Sequence: Synthetic coding sequence
atgtcaccaaaacgcatcgccaagcgcaggagccctcctgcagatgccattcctaagagcaagaaagtcaaggacacacgcgcagcggcttccaggagagtgcctggggctagatcttgtcagggcgcttgtggaccgagtccacctgaccaaaaaacgcgcccagtaagccataggtcgcacagtaccgaacctggtcttgtcctgacactcggtcagggagacgttggccagctgggtctcggcgagaacgtgatggagagaaaaaaacccgcattggtttctataccggaggatgtggtccaggccgaggccggaggaatgcacacggtgtgtctgagcaagtcaggacaagtctacagcttcggctgtaacgacgagggtgccctcgggcgagacacatctgtggaagggagcgaaatggtacctgggaaagtggaattgcaggaaaaagttgtccaggtgtctgccggtgatagccacacagccgctttaaccgacgatggacgggttttcctgtggggttcattcagagataacaatggggtgattgggcttctggaacctatgaagaagtcaatggttcccgttcaagtgcaattagatgtaccggtggttaaggtggccagcggaaatgatcatctggtcatgctgacagctgacggagacctctataccctaggctgtggggaacagggacagctgggcagagtgcccgagctgttcgctaaccgcggtggcagacagggactggagcggcttttggtccctaagtgcgttatgctgaagagtcgcggatctcggggacacgtaagattccaagatgccttctgcggggcttacttcacctttgcaatcagtcacgagggccatgtgtatgggtttggtctaagcaattaccaccagctcggtactcctgggacagagagctgttttatcccccagaacttgacatcctttaagaatagcaccaaatcctgggtgggcttcagcggtgggcagcaccatactgtgtgcatggacagcgagggaaaagcatactcactggggcgagccgagtatgggaggctgggtctgggagagggggcagaggagaagtccatccctaccctgattagtcgtctgcctgccgtgagctcagttgcgtgtggggcatccgtggggtacgccgtgactaaggatggcagggttttcgcgtggggaatgggtacgaattatcagctaggcaccgggcaggatgaggacgcttggtctccagtggaaatgatgggtaagcaattggaaaatagagtggtgttaagtgtgtcgagtgggggtcaacacaccgttctgcttgtcaaggacaaggagcaaagttag

SEQ ID NO: 238248 - DNA, 1266 bp, Artificial Sequence
  Description of Artificial Sequence: Synthetic coding sequence
atgtcacctaaacggattgcgaaacggaggtcccctcccgctgatgccattcctaagagcaaaaaggtcaaagtgtcacaccgtagccatagcaccgagcccggtctggtgcttacactgggtcagggggatgtggggcagctcgggttgggcgaaaatgtaatggagcgcaagaaacccgctctcgtgagcatacctgaggatgtggtccaggctgaggcaggtggaatgcacacggtgtgcctgtccaaaagcggtcaggtctattcattcggctgtaacgacgagggggctctgggtagggatacctctgtcgaaggctccgaaatggtccccggaaaggtggaactccaagagaaagtggtgcaggtcagcgcaggcgacagccacacagccgctctcactgacgatggccgagtcttcttgtgggggtcattcagggataataatggagttatcggcctacttgagcccatgaaaaaatctatggtgccagtccaggtgcagctggatgtgcctgtcgtgaaggtcgcaagcgggaatgatcacctggtgatgctcaccgcagatggcgacctgtataccctcggctgtggtgagcagggacagctcgggagagttccggagctgtttgcaaatagagggggaaggcaaggtcttgaaagactcctagtgccaaaatgcgtgatgttaaaaagtcggggatcacgcggtcacgtaagatttcaggacgcattttgcggagcctacttcacgttcgctatatcccatgaaggtcacgtctacgggttcggcttatctaactaccaccaactaggtactcccggaaccgagtcctgcttcatcccgcaaaacctaacttcattcaagaatagtacaaagtcctgggttggcttcagtggcggacagcaccacacagtgtgcatggacagtgagggcaaggcttacagtctgggacgcgcagagtacggccgattggggctgggagaaggcgctgaggagaagtccattccaactctcatctcacggcttcctgctgttagcagcgttgcctgtggagcttctgtaggctacgccgtgacaaaggacggcagagtgttcgcttggggtatgggcacaaattaccagctcggcactggccaggacgaggacgcatggtcaccagtggaaatgatgggcaagcagctagaaaatcgggtcgtgctgagtgtgtccagcggcggacagcacacagttctgctggtcaaggataaggaacagtcttag

SEQ ID NO: 238249 - DNA, 1266 bp, Artificial Sequence
  Description of Artificial Sequence: Synthetic coding sequence
atgagtcctaaacgcatcgctaaacgtcggtccccacccgctgacgccatcccaaagtcgaaaaaagtgaaggtgagccacagaagccactccactgagccaggcctggtcttaaccctgggacagggcgacgtcgggcaactcggtctaggcgaaaacgttatggagcgcaagaagcctgccttggtttctattccggaagatgtggtccaggctgaagcaggcggaatgcacaccgtgtgtctgtccaaaagcgggcaagtgtactctttcggctgcaatgatgaaggagccctgggccgagataccagcgtcgagggatcagaaatggtgccaggtaaagtcgaactccaggagaaagtggtccaggtgtccgccggagactcacacacagcggctctgactgacgacggacgtgttttcctgtgggggagcttcagagataataacggagttatcgggctgttagagcctatgaaaaaatctatggtgccagtgcaagtgcagctagacgtgccagttgtcaaggtcgccagtggaaacgatcatctggtcatgctgacagccgacggggatttgtatacgttggggtgtggcgaacaggggcaattaggccgagtgccagagttgttcgccaatagaggcggtcgccaagggctagagcgcttacttgtaccaaagtgcgtcatgctgaaatcccggggaagtcggggacacgtgagatttcaggacgctttttgcggagcctacttcacgttcgcaatttcacacgagggtcacgtgtatgggttcggtttatcaaattatcatcagctagggactcccggaaccgagtcctgctttatacctcaaaaccttaccagttttaagaattctaccaaaagttgggtgggctttagcgggggtcaacatcacactgtgtgcatggattccgaaggtaaagcctattcactaggccgagctgagtacggcagattagggctgggagaaggtgcagaagagaagagcatccccaccttgatctccaggctccccgctgtgtctagcgtggcatgtggggcaagcgtgggctacgcggtgactaaagacgggcgagtgttcgcatggggcatggggaccaattaccaactggggacagggcaggacgaagatgcatggtctccagttgaaatgatgggtaaacagctggagaacagagtggtgttatccgtgtcttcaggcggtcagcacacggtactgcttgtgaaagataaggaacagagctag

SEQ ID NO: 238250 - DNA, 1266 bp, Artificial Sequence
  Description of Artificial Sequence: Synthetic coding sequence
atgtcgccaaagcggatagcgaagcgtcggtcccccccagcagacgccattcccaagtccaagaaggtaaaagtcagccatcgtagccattctactgagcctggacttgtactgaccctgggtcaaggtgatgtgggccagctcggtctgggtgaaaatgtaatggaacgtaaaaaacctgctttggtatccatcccagaagatgtggtacaggctgaggcgggagggatgcatacggtctgcttaagtaagtcgggccaagtgtattcctttgggtgcaatgacgagggtgcgttgggcagggatacctcagtggagggcagtgaaatggtacctggcaaagttgagctgcaagaaaaggttgtccaagtgtccgccggagacagtcacactgctgcgctgactgacgatggacgagttttcctctgggggtcattccgtgacaataacggcgtcataggcttactggagccaatgaagaagtcgatggttccggtgcaggtgcagttggacgtgccagtggttaaggtggcctccggcaacgatcacctggtgatgctgaccgctgatggcgacctgtacaccctgggttgcggtgaacaaggtcagctgggccgtgtgccagaattatttgccaacaggggtgggagacagggactggagcggctgctggtgcctaaatgcgttatgctgaagagccggggttcacgcggtcacgtgcgttttcaggatgccttttgtggggcatacttcactttcgcaatatcacatgaggggcatgtatacggatttggacttagtaactaccaccagctcggtacccccggaaccgagagctgcttcattccccaaaacctcacaagctttaagaactccacaaagtcctgggttggattcagcggcggtcaacatcataccgtgtgtatggattcggaagggaaggcttacagtctgggacgcgctgagtacgggagactgggattgggcgagggggcagaagagaagtctatccctaccctcatcagtagacttcccgctgtgtcaagtgtagcttgtggggcttctgttggttacgcggtgacaaaagacgggagggtgtttgcctgggggatgggtactaattatcagctgggtaccggtcaggatgaggacgcttggtcccccgtcgagatgatgggcaagcaactggagaacagagtggtcttatccgtgtcatccggcggtcagcacacagtgctcctcgttaaggacaaagaacagtcctag

SEQ ID NO: 238251 - DNA, 693 bp, Artificial Sequence
  Description of Artificial Sequence: Synthetic coding sequence
atgtcaccaaagagaatcgctaaacgccgttctcccccagcagatgcaattccaaaatcgaagaaagtcaaggtgtcgcacagatcccattcgaccgaaccaggactcgtactaacacttggacagggcgacgttggacaactaggtttgggggaaaacgtgatggagcgaaagaagccagccctcgtttccatcccggaggacgtagttcaagcggaagccggaggaatgcacaccgtatgtctatccaagagcggacaagtgtattcctttggctgtaatgatgagggcgctctgggccgagacacaagcgtggaaggctccgagatggtgccgggaaaagtggagctccaggaaaaagtggtgcaggtctcagctggggattcacacaccgctgcacttaccgacgatggcagagtttttctgtggggctcctttagggacaacaacggggtaatcggcttgttagagcccatgaaaaagtccatggtgcccgtgcaagttcagttggacgttcccgtggtgaaagtggcatctggcaatgatcaccttgtcatgctaaccgcggacggcgacctgtacactctgggttgtggcgagcaggggcagctgggcagggtcccggagctcttcgcgaaccgcggtggaagacaagggctggaaaggcttctggttcccaaatgtgtcatgtag

SEQ ID NO: 238252 - DNA, 852 bp, Artificial Sequence
  Description of Artificial Sequence: Synthetic coding sequence
atgtctcccaagagaatcgcaaagcggaggagtcctcctgcagatgccatccccaagtcaaagaaggtgaaagtgagccaccgctcacacagcacggagccaggactagtgctgacactcggtcagggcgatgtgggacagctgggactcggggaaaatgtaatggagaggaagaagccggcactggtgtcaatccctgaggacgtagttcaagctgaagccggtgggatgcatactgtgtgtttgtcaaagtcaggccaggtttactcttttgggtgcaacgatgagggagctttggggagagacacttctgtcgaagggtccgaaatggtgccgggaaaagtggagctgcaggagaaagtggtacaggtgagtgcgggagacagccacacagcagccctgaccgacgatggacgggtgtttctttggggaagttttagagataacaatggagtcataggattactggaacccatgaaaaagagtatggtccccgtccaagtccagctcgatgtcccagttgtaaaggtcgcctccgggaacgaccaccttgtgatgcttaccgccgacggtgacctgtacacgctgggctgcggcgaacagggtcagctggggcgagttcctgagctgttcgccaaccgtgggggacgacagggactagagcggctacttgtcccaaagtgtgtgatgttaaaatcaaggggttctaggggacacgtccggtttcaggatgccttttgtggcgcttattttacattcgcaatttcacacgagggacacgtatacggatttggcttgagcaattaccaccaattggggactccagggactgagagctgttttatcccatag

SEQ ID NO: 238253 - DNA, 708 bp, Artificial Sequence
  Description of Artificial Sequence: Synthetic coding sequence
atggccagggaggagtgcaaggccttgctcgacggtctgaacaagacgacggcgtgttaccaccatttagtgctgacagtggggggatccgctgacagtcaaaatctccgccaggagctgcagaaaacccggcagaaggcacaggagcttgcggtgtcaacatgcgccagattaaccgctgtactgcgagataggggtctcgcagccgatgaacgggcagaatttgaaaggctgtgggtggctttctcgggctgcctcgatctactagaagcagacatgagacgggctctggagctaggggcagcctttccactacacgctcctcgacgaccgttggttaggaccggggtggctggcgcatccagcggggtagcggcaagggctctgtccacgcggagcctgagactggaggccgaaggagacttcgatgtggccgatttgagggagttagagagagaagtcctacaagttggcgaaatgatcgacaacatggaaatgaaagtcaacgttcctaggtggacagttcaggccagacaggccgcaggtgccgagctcctttccacagtatccgcgggacctagcagtgtggtaagtttgcaggaacgcggagggggttgtgacccgcgtaaggccctagctgctattctattcggcgctgtactgttagccgcagtggccctggctgtgtgcgtcgctaaactgtcttag

SEQ ID NO: 238254 - DNA, 630 bp, Artificial Sequence
  Description of Artificial Sequence: Synthetic coding sequence
atgcgcgctgcagccatatccaccccaaaactggacaagatgcctgggatgttcttctctgccaatcctaaggaactcaagggaaccacccattccctcctggacgataaaatgcagaaacgccgacccaaaacatttggtatggatatgaaagcatacctgaggtcaatgatcccacacttggaatccggcatgaagagtagtaagagtaaagacgttctgagtgcagccgaagtaatgcaatggtcgcaatctctggaaaaactgctggctaatcaaaccggacagaatgtgttcgggtccttcctaaaaagcgaattcagtgaagagaatatcgagttttggttagcctgcgaggattataaaaagactgagtctgatctcctgccctgcaaagccgaggagatctataaagcctttgtgcactcagacgcagctaagcagatcaatatcgattttaggacccgagaatcaactgccaagaagatcaaagctcccacgccaacctgcttcgatgaagcccagaaagtcatttacacactcatggagaaagactcttaccccagattcctgaagagtgatatatatctcaatctgctgaacgatctgcaggccaatagcctcaaatag

SEQ ID NO: 238255 - DNA, 1044 bp, Artificial Sequence
  Description of Artificial Sequence: Synthetic coding sequence
atgcccggtaagcccaaacaccttggagtgcctaacggccgtatggttctggccgtcagtgacggggaattaagcagcaccaccggtccgcagggtcaaggggaaggtaggggctccagcttaagcatccacagtcttccgtctggaccatcaagcccgttccccacctttgtgagctctaagtctgagagtcacagaaagagcctgggttccacagaaggcgagagcgaaagccgcccaggaaaatactgttgtgtatatcttcccgatggcacggcctctctggccctggctcgcccagggctgacaatccgcgacatgctcgctggcatttgtgagaaacgcggactgagcctccctgatattaaagtatacctggtcggcaacgagcaaaaggcgctcgtcctggatcaggattgtacagttctggctgatcaggaggtgcgacttgaaaaccggataaccttcgaactggagctgactgccctggagcgggtcgtgaggatctccgccaagccgacgaagcgtctccaggaagccctgcagcctatcctggaaaagcatggcctcagccctcttgaagtcgtgcttcataggccaggcgagaaacaacccctcgaccttggcaaactggtctccagcgtggccgctcagaggcttgtgctggatactctaccaggagtcaagataagcaaggctcgtgacaagagcccttgcaggagtcaggggtgcccacctcgaacccaggacaaagcaacccatcccccaccggctagccctagtagcttggttaaagttccgtcatccgccactggcaagcggcagacttgcgatatcgagggcctcgtagaattactcaatcgggtgcagagctctggcgcacacgaccagcgcggactgctccgcaaggaagacctagttttaccagagttcctgcagctcccagctcagggacctagctcagaggaaacaccacctcagacaaagtcggccgctcagccaataggaggctctttgaattccacaacagactcagccctttag

SEQ ID NO: 238256 - DNA, 1701 bp, Artificial Sequence
  Description of Artificial Sequence: Synthetic coding sequence
atgccgggtaagcctaagcacctgggtgtgcctaatggtcggatggtcttggccgtcagcgacggggagctctccagcacaaccgggcctcaaggccagggtgaagggagagggtcctcactaagtatacacagcctgccttcaggaccctccagtccattccctacagaagagcagccagtcgctagttgggccctctctttcgagaggttactccaagatcccctcggcctcgcctactttaccgaatttctcaaaaaagagtttagcgccgagaatgttacattctggaaagcttgcgagcggtttcagcaaatccccgcatccgatacccaacagctggctcaagaggcacgaaatatatatcaagaattcctctctagccaggctttgtcaccggtaaatatcgaccgccaagcatggctgggggaagaagtgttggcagaacccagacccgacatgtttcgagcccaacaactgcagatctttaacctcatgaagttcgattcatacgcccgttttgttaaaagtcccttgtaccgggagtgccttttggccgaggccgaggggaggccgctcagagagccaggaagctcccgacttgggtcccctgacgctacccgcaagaagcccaagctgaagcccggtaagagcttacccctgggggttgaagaattgggccagctaccaccagttgaggggccaggaggacgaccattgagaaagtccttcagacgtgagctcggtggaacagcgaacgcagctctccgccgagaatctcagggctctctcaattcctcagcctctcttgacctgggcttcctggctttcgtctcatctaaaagcgagtcccacaggaaatccctgggttctaccgagggagaatcagaatccagacccggtaagtactgttgcgtctacctgcccgacgggaccgcctcactcgcccttgctaggcccggacttaccatcagggacatgttggctgggatctgcgaaaagcgcggactttcattgcccgatattaaagtgtacctggtaggtaacgaacaggcgctggtgctcgaccaggattgtacagttcttgctgatcaggaagtgagactggagaacaggattacgtttgagctggaactaactgccttggaaagggtggtccggattagtgccaaaccgacaaagcgtctccaggaggccctgcagcctatcctggaaaagcacggcctgtcacctctggaggtggtcttgcatcgacccggagaaaagcagcctctagacctgggcaagcttgtgagttcggttgccgcacagagacttgtgctggatacgttgccaggggtaaagatctctaaagctcgtgacaaaagcccatgccggtcacaaggctgtccacccagaactcaggacaaagctacccaccccccacccgctagcccttcatccttggtcaaggtgccatccagtgcgacaggtaaacgacaaacttgcgacattgaagggctggtagagttattaaaccgcgtccagagcagcggcgcacatgaccagaggggtctgctgcggaaggaggatctggtcctgccagaattcctccagctgccggcacaggggccatctagcgaggagaccccaccccagaccaagtcggccgctcagccgattgggggatccctgaattcaaccaccgacagcgcactgtag

SEQ ID NO: 238257 - DNA, 1314 bp, Artificial Sequence
  Description of Artificial Sequence: Synthetic coding sequence
tgatcaccagtcaatatcgaccgccaagcttggctcggcgaggaggtactcgcggagccaagacccgatatgtttcgcgctcagcaacttcagattttcaatctgatgaagtttgacagctatgcccgattcgtgaaatccccactttatagagaatgcctcctggcagaagcagagggcaggcctctgagagaacctggttcgtctcgccttggatccccagacgccacccggaagaaaccgaagctgaagcctggaaaatcgctccccttaggggtcgaggaactaggccagcttccacctgtcgaaggacctgggggtcgaccacttcggaaatcattccggcgagaactgggcggtaccgccaatgcagcattaaggagagaatctcagggaagcctgaactcctccgccagcttagatttaggatttctggccttcgtgagctctaagagtgagagccaccggaaatctctgggtagcacagaaggcgagagtgagagcagacctggcaaatactgctgcgtgtaccttccggatggaaccgcatccctcgctttagcccgaccaggcttaaccattcgggacatgctagcgggaatctgtgagaaacggggactgtcacttcctgacatcaaagtttacctggtcggtaatgagcagaaagctctggtgctggatcaggattgcacggtcctcgctgaccaggaggtcagattagaaaacaggattacttttgaactcgaacttacagcactggaaagggtggtgcgcatttctgcgaaaccaaccaaacgtctgcaggaggctctccaacccatcctggagaagcacggtctgagccccttagaggtcgtgctgcaccgtcccggtgaaaagcaacctcttgacttagggaaactggtctcctctgtcgccgcacagcgcttggtcctggatactcttccaggagtcaagattagcaaagcacgggataagtcaccgtgcagaagccaaggttgcccgccacgtacccaggataaagcaacccacccaccacccgcttcgccatcctcgctggtgaaagtgccgagttcggccactggcaagaggcagacatgtgacatagagggactggtcgagcttctcaatcgcgtacagtcaagcggcgctcacgatcagaggggcctcctaaggaaagaagacttagttctgcctgagttcctgcaactccccgcacagggcccttcaagcgaagaaactcctccacagactaagtctgccgctcagccaatcggtggcagcctcaacagcaccaccgattccgccttgtag

SEQ ID NO: 238258 - DNA, 609 bp, Artificial Sequence
  Description of Artificial Sequence: Synthetic coding sequence
atgtgccgtacactggctgcgttccctaccacatgcctggaacgagccaaggagttcaaaacgcgtctcgggatctttctgcacaagtcagaacttggttgcgatacaggatcaaccggcaagttcgagtgggggtcaaagcacagtaaagaaaaccgcaattttagtgaagatgtgctgggctggcgggaaagcttcgacctgcttttaagttctaagaatggagtggctgccttccacgcttttctgaaaaccgaattcagcgaggagaacctcgagttctggttggcttgcgaagagttcaaaaagatccgctcagccacgaaactggcttcaagagctcaccaaatctttgaagagtttatctgcagcgaggcccctaaggaagtcaacattgatcatgagacgcacgaactaactcggatgaacctccagacagccactgccacttgtttcgatgctgcccaggggaagacgcgcactctgatggaaaaggacagttacccaaggtttttaaagtcccctgcttaccgagacctagctgctcaggccagcgccgcatcagccaccctgagcagctgcagtttggatgaacccagtcatacttag

SEQ ID NO: 238259 - DNA, 459 bp, Artificial Sequence
  Description of Artificial Sequence: Synthetic coding sequence
atgccagtgaaatgctgcttctaccgatcgccaacggccgaaacgatgacctggtctgaaaacatggataccctgctggccaaccaggccggactcgatgctttccgcatcttcctgaagtcagagttcagcgaagagaacgtcgaattttggttggcctgcgaagacttcaagaaaacaaagaacgccgataaaatcgcatctaaagctaagatgatttactccgaattcatcgaggcagatgcgccaaaggaaatcaacattgattttggtacccgcgacttaatttcaaagaacattgccgagcccaccctcaagtgctttgatgaggcccagaagctaatctattgccttatggcgaaggacagtttcccccgatttctcaaatccgaaatttacaagaagctggtcaactctcaacaagtacctaatcataagaagtggctacctttcctttag

SEQ ID NO: 238260 - DNA, 1809 bp, Artificial Sequence
  Description of Artificial Sequence: Synthetic coding sequence
atggagcgttcattgcacagggtgagtcttggcagccggagggctcatcccgatctgtctttctacttaaccacgtttggtcagctaaggctatccatcgatgcgcaggatcgtgtacttctgttacacatcatcgaggggaaaggcctcatttcaaaacagcccggtacatgtgacccttatgtcaagatatctctcattcccgaggattctcggcttcgacaccaaaaaacacagaccgtgccagattgccgagatcctgcgttccatgaacacttcttcttcccggtgcaggaagaggacgatcagaagcggctactcgtgactgtatggaatcgcgctagccagtcccgccagtccggcctgataggttgtatgtccttcggtgtgaaatccctgctgacccctgataaagaaatctctggatggtattaccttctgggcgagcatcttgggcgtaccaagcacctaaaagtggccaggaggcgtctgaggcccttgcgggatcctctgcttcggatgccaggagggggagatactgagaacgggaaaaagcttaagatcactatacccagaggaaaggacggctttggattcacaatctgctgtgattccccagttcgcgtgcaggccgtggacagcggaggcccagctgagagagcaggcctgcagcagctcgataccgttctccaactcaacgagagacctgtggagcactggaagtgcgttgagctggcccacgaaatacggagttgtccttcggagatcatcctgctagtctggcggatggttccccaggtgaaaccagggccagacggtggcgtgctgcgtagagcctcctgtaaatccacacatgatctgcagtcccccccaaacaagagggaaaagaactgcacacatggtgtccaggcgaggcccgagcagcgacactcatgtcacctggtctgcgactcgagcgacggcttgctacttggcggatgggagagatatactgaggtcgctaaacgcggaggacagcatactttacccgctctgtctagggcaactgcccctacggacccgaattacatcattttggcacccctgaatccaggctcacagctccttaggcccgtttaccaggaagacaccattcccgaggagtccggcagcccctccaaaggaaagtcgtacactgggctgggaaagaagagccggttaatgaaaacggtgcagactatgaaaggtcacggcaactatcaaaattgtccagtggtccgcccacacgcgacgcattcgagctacggaacctacgtaacccttgcacccaaggttctggtcttccctgtgttcgtgcaaccgctggatctctgcaatcctgcacgtaccctgctgctgtccgaagagttactcctgtacgagggaaggaataaggctgccgaagtgacattattcgcctatagcgatctgctgctgtttaccaaggaagacgagccaggtcggtgcgacgtgttgaggaaccccctctatctgcagtccgtcaagctacaggaggggagctcggaagacctgaagttctgtgtgttataccttgctgagaaagccgaatgtctgttcacactcgaggcacactctcaagaacagaaaaaaagagtgtgctggtgtctgtcagagaacatcgctaagcagcaacaactagccgcttctccccctgacagtaaaaagctacacccttttggctcactgcaacaagagatggggcctgtgaacagcacaaatgcgacccaagacaggtcctttaccagccctggacagactcttattggttag

SEQ ID NO: 238261 - DNA, 507 bp, Artificial Sequence
  Description of Artificial Sequence: Synthetic coding sequence
atgaaaaacaaactgggtatattccggaggcgcaatgagagtccaggggcacctcccgcaggcaaagcggacaaaatgatgaagagctttaagcctacaagtgaggaagccctgaagtggggggagagtcttgaaaagcttttggtgcacaagtacgggcttgctgtattccaagcctttcttcggacagaattctccgaagaaaacttagagttctggctggcatgtgaggacttcaaaaaggttaagtctcagtcaaagatggcctcgaaggcgaagaaaatttttgccgagtacatcgcaatacaggcctgcaaggaagtgaatttagactcctatacaagagagcataccaaggacaatctccaatctgtgacccgcggatgctttgacttggcacaaaaacgtatttttggcctgatggaaaaggatagttatcctcgttttttaaggtccgatctctatctggatctgattaaccagaaaaagatgagccctccactgtag

SEQ ID NO: 238262 - DNA, 2754 bp, Artificial Sequence
  Description of Artificial Sequence: Synthetic coding sequence
atgaatcgcttcaatgggctgtgcaaggtgtgctcagaaaggcggtaccgccagatcactattcctagggggaaagatggattcgggtttaccatctgctgtgacagcccagtgagagtgcaggcagtcgatagcggcggaccagccgaaagagcaggcctgcagcagctggataccgtccttcagctcaacgaaaggccagtggaacattggaagtgcgtcgagctcgcccacgagatcagatcttgcccatccgagatcatcttactggtgtggaggatggtgccacaggtgaagcccggtcccgacggaggtgtccttcgcagggcgagttgcaagagcactcacgacctgcagtcacccccaaacaagagggaaaagaattgtactcacggcgtccaggccagacccgaacagcgccattcctgccacttagtgtgtgactcctcagacggactccttctcggcggatgggagaggtacacggaagtagctaagagaggaggacagcatacacttcccgctctaagcagagccaccgctcctaccgatcccaactacatcatccttgctcctctgaacccaggcagccagctgctgcggcctgtgtatcaggaagacacaatcccagaggagtcaggatctcccagtaaaggcaagtcatacactggcctgggaaagaaaagtagactgatgaaaacggtccagactatgaaggggcacggcaactaccaaaattgtcccgtggtacgtccacacgccactcattctagctatgggacatacgtgacgttggcacccaaagtcctggtgtttcccgtcttcgtccagcccctcgatctgtgcaaccccgcacgcacactgcttttaagcgaagagctgctcctgtacgaaggtaggaataaggctgcggaagtgacactgttcgcctacagcgatctgttgctgttcacaaaggaagacgaaccaggcaggtgcgacgtgctcaggaatccgctatacctgcagtccgtgaaactgcaagaaggatccagcgaagacctgaagttctgtgtgctgtatcttgccgaaaaagctgagtgcctgttcacactcgaagcccattcgcaggagcagaagaagcgggtgtgttggtgtcttagtgagaatatcgccaaacagcaacagctcgccgctagccctccagacagcaaaatgtttgaaactgaggctgatgaaaaacgggagatggctttagaggaaggtaagggcccaggcgcagaggacagtcccccttccaaggaaccctcccccggacaagaacttccccctggacaagacttacctcctaataaggactcaccttcggggcaggaaccagccccatctcaggagccactgtccagcaaagattcagccacttccgaaggcagccccccaggtccagacgcacccccttccaaggatgtacctccatgccaagaacccccaccagcacaagacttgtccccctgtcaggatctccccgcaggccaggagccgctgccacaccaggatcctctcctgacaaaggaccttcctgctattcaggagagtccaactcgtgacctgccaccttgccaggatttgcctccaagccaagtctcgctacccgctaaggcgttgaccgaggatactatgagctccggcgatctgctggcagccaccggcgatccgcctgctgcaccacgacctgccttcgtcattccagaggttcgtctggacagtacttatagccagaaagcgggagccgaacagggttgttccggagatgaggaggacgctgaagaggctgaagaagtggaggagggcgaggagggggaggaggacgaggatgaggacacatctgacgacaattatggagagaggtccgaggccaagcggagcagcatgattgagaccggccaaggggcagagggcggtctctccctgcgagtacaaaacagcctccggagaaggactcacagtgaaggctcattgcttcaagagcccaggggcccttgcttcgccagtgacactacgttgcactgttccgacggagaaggtgcggcaagcacttgggggatgccctctccctccaccctcaagaaagagcttgggcgaaatggcggatctatgcaccatctgtccctattcttcactggacaccgaaaaatgtccggcgctgatactgtgggggacgacgatgaagctagtagaaagaggaaaagcaaaaaccttgctaaggacatgaaaaataaacttgggattttcagaaggcggaacgaatccccaggtgctccacccgcaggtaaggccgataagatgatgaagagctttaaacctacaagtgaagaagccttgaaatggggggaatccctggaaaagctcctggttcacaagtacgggctggccgtattccaagccttcctgcgcacagagttctccgaagagaatctagagttttggcttgcttgcgaggacttcaagaaggtgaagtcacagagtaaaatggcgtctaaggctaaaaagatcttcgctgagtatattgctatccaggcatgcaaggaggtcaacctggatagctatacaagggagcacactaaggacaacctccagtcagtgacgcgtggctgttttgatcttgcccaaaagcggatcttcggtttgatggaaaaggactcctatcccaggttcttacggagtgatctgtaccttgaccttataaaccagaagaagatgtcacctcctctgtag

SEQ ID NO: 238263 - DNA, 3597 bp, Artificial Sequence
  Description of Artificial Sequence: Synthetic coding sequence
atgcccgttatccccgcactttgggaggtggagatgggtagaagccagggacaggaaatcgaaaccatcctggctaacagatcacactctgactctacccccctgccaaattttctaagtggcagccatagaccagagtgctgcacttgtagactgctcactgcatcaggggcacaggatagcctgccctttggcagacgtctttacagtggcccttggagatcctgtgaagaagtctgtcatgtgtcggtcctctcagtactctcgaccagctgtggtttgtctctcagcctcccaatattccccggatggatggagtggctgagcccagacattgcgctgcccagaagagatgaatggactcagacatcaccagcccgtaagcggataacgcacgccaaagtccagggagctggtcagctcaggctgagcatagatgctcaggacagagtcctactcctgcacataatcgagggtaaaggtctgatctccaagcagccgggaacgtgtgacccttacgtgaagatatccctaatccctgaagactcccggctacgtcaccagaagacacagaccgtgccggattgtagggatccggcatttcatgagcatttcttcttcccggtccaggaggaggacgatcagaaacggctgcttgtgaccgtttggaatcgtgcctcccaatcgcgccagtctggcctgattggctgcatgtcctttggcgttaaatccttactgactcctgacaaggaaatttcgggatggtactacctcttgggcgagcacctgggacgcaccaagcatttaaaagtcgcacgccgtagactgagacccctgagagaccccctcctgcggatgcccggtggcggagatactgagaacggcaaaaagctgaagattaccattcccaggggaaaggatgggttcggctttactatttgttgcgatagcccagttagagtacaagcggtggatagtggcggtccagcggagcgagctggattacaacaactggatacagtcctgcagctaaacgagagaccggtagagcattggaagtgtgttgagttagctcatgagatcaggtcatgtccaagcgagatcatcctgttggtctggcgcatggtcccacaggttaaaccgggaccagatggcggtgttctgagaagggcaagttgtaagtccactcatgacctccagagtccgcctaacaaaagagagaaaaactgcacccacggcgtgcaggcacgtcctgagcagaggcattcatgtcatctggtatgcgattcatctgatggactgttgttgggtgggtgggagaggtacacggaggtcgcaaagaggggcggacagcacacactgccggctttgagtcgggctactgcacctaccgatccaaactatattatactggccccacttaatcccggaagccaactgctgcgcccagtgtatcaagaagacaccatcccggaagaaagcggctcccctagcaagggcaaatcatacactggacttggcaaaaagagtaggttgatgaaaacagtgcagaccatgaaaggacacggaaactaccaaaattgcccggtggtccgacctcacgcaacccactcctcctatggcacctatgttaccctggctcccaaggtcctcgtgttccctgtgtttgtgcagcccttggacctgtgcaatcccgctcgcacactgctgctcagcgaggagttgctgctctatgagggacgcaacaaggcagccgaggtgacattgttcgcttattccgacctgctgctgtttacaaaggaggatgaacccggaaggtgtgacgtgctgcggaaccctttgtatttgcagtcagtcaagttacaagaaggatccagcgaggacctaaaattttgtgtgctctacttagcggagaaggctgaatgcctcttcaccctggaggcacattcgcaggaacagaagaagcgggtgtgctggtgtctgtcggaaaacatcgccaagcagcagcagctggccgcaagtccccctgactccaaaatgttcgaaactgaggccgacgagaagcgcgaaatggccctggaagagggcaagggcccaggcgctgaagattctcccccttcaaaagagcccagtccaggccaggaattgcctccaggtcaggatctgccgccaaataaggattccccgtccggccaggaacccgcacctagccaggagccactgtctagcaaagactccgctacgagcgagggctctccccctggccctgatgcacccccatcaaaagacgtgcccccatgtcaggagccaccccctgcccaagatctctcaccttgccaggacctccctgcgggacaggagcccctgccacaccaagacccactgctgactaaagaccttcctgccatccaggaatcgccgacccgcgacttgccaccatgccaggacctgccacccagccaagtgtcccttccagcaaaggcccttacagaggatacaatgtcttcgggcgatctgctcgcagccaccggcgatcccccagcggctcctcgaccggcttttgttatccccgaggtccgtcttgattctacttacagccagaaggctggcgcagagcagggctgttccggcgatgaagaggacgccgaggaagctgaagaagtcgaggaaggtgaagaaggggaagaagacgaggatgaggatacctccgacgacaactatggggagaggtcggaagccaagaggagtagcatgatcgagaccgggcagggggctgaaggcggtttgagccttcgggtacaaaactccctgcgcaggcgaacacactctgaaggcagcctcctccaggagcctcgcggaccatgctttgccagtgataccacccttcattgttcagatggagagggggctgcctccacatggggcatgcctagccctagcaccctcaaaaaagagctgggtcgcaatgggggaagcatgcatcacctgtctttgtttttcaccggtcataggaagatgtcaggcgctgatactgtgggcgacgatgacgaggcctcccgtaaacgcaagtcgaaaaatctggcgaaggacatgaaaaataagctgggcatatttcgcaggagaaatgagtcacccggagcccctcctgctggtaaagcggataagatgatgaaaagcttcaaacctacatctgaagaagccttgaagtggggtgagagccttgaaaaacttctcgtgcataagtacggccttgcagtctttcaggcctttctgaggaccgaattctccgaggaaaacttggaattttggctcgcctgtgaggactttaagaaggtgaagtctcagtccaagatggcctctaaggccaaaaaaatcttcgcagaatacattgcaattcaagcctgtaaagaggttaatctggacagctatactcgtgagcacaccaaggacaacctgcagagcgttacaagggggtgcttcgacctagcccaaaaaagaatatttggcctgatggagaaggattcctatccaagatttttacgcagtgatctttacttggacttgataaaccagaagaagatgtccccgccattatag

SEQ ID NO: 238264 - DNA, 1560 bp, Artificial Sequence
  Description of Artificial Sequence: Synthetic coding sequence
atgtttgagaccgaagccgatgagaagcgtgagatggcactggaagagggcaagggccctggagccgaagattctccacccagcaaagagcctagtccaggtcaggagcttccgccaggacaggatttgcccccaaacaaggacagcccttctggacaagagcccgcacctagtcaggaacctttgtcatcaaaggattccgccacctccgagggcagccctccaggaccggatgccccacctagcaaagacgtccctccatgtcaggagccacccccagcacaggatctttcaccttgccaagatctgccagccggtcaggaacctttgcctcaccaggacccactgctgacaaaagacctgccagccattcaggagagccccacccgggacctgcccccttgtcaagatctgccaccgtcccaggtgtccctgcctgctaaggctcttaccgaagacacgatgagtagtggcgaccttcttgctgccacaggcgatccacccgctgcaccgcgtcctgccttcgttatccccgaggtgcggctcgactccacttactcccagaaagcaggagcagagcagggctgcagcggggatgaggaagatgccgaggaggctgaggaggtagaggagggggaggaaggagaagaggatgaggacgaggatacttccgatgacaattacggggagaggtctgaggccaagcggagcagcatgatcgagaccggacagggcgctgaagggggactgtccttgagagttcagaatagcttaagaagacgcacacatagcgagggctcactgctgcaggaaccgaggggcccatgctttgcaagtgatacaacgcttcattgcagcgatggagaaggtgcagctagtacttggggcatgcccagtccctccacccttaagaaggaattgggcaggaatggcggatcaatgcatcacctttcactgttcttcaccgggcacagaaagatgtcaggcgctgataccgtcggagatgatgacgaagcctcaagaaagaggaaatccaaaaacctggctaaggacatgaagaataagctggggatatttcggcgacggaacgagtctccgggagcgcctcccgcagggaaggccgacaagatgatgaaatctttcaaaccaacttccgaagaggccttgaaatggggcgagtcgctggaaaagttgttagttcataagtacggccttgccgtgtttcaagcattcctgcgaaccgagttctccgaggaaaatttggagttctggcttgcatgcgaggactttaaaaaggtaaaatcgcaatccaaaatggcctcaaaagctaaaaaaatcttcgcggaatacatcgccatacaggcctgcaaggaggtgaaccttgatagctatacaagagaacacaccaaggacaatctgcagagtgtgacgcggggatgttttgatctggctcagaagcgtatcttcgggctcatggagaaggatagctatcctcgcttcctccggtcagatttgtacctggacctgattaaccaaaaaaaaatgtctccacccctgtag

SEQ ID NO: 238265 - DNA, 3597 bp, Artificial Sequence
  Description of Artificial Sequence: Synthetic coding sequence
atgccagtgatccccgcactgtgggaggtcgaaatggggaggtcacaaggacaggaaatcgagaccatactcgctaacaggtcacatagcgattcaacaccattaccaaacttcctgtctggctctcaccgacctgagtgttgcacatgtcgcctgctgacagcttcaggggcacaggactctctgcccttcggacggagactttacagcggcccttggcggtcctgtgaggaggtatgccatgttagcgtgttgtcagtgttgagtacctcgtgtggattaagtctaagtctccccattttccctggctggatggagtggctttcaccagacattgcccttccaaggagagacgaatggacccagacatcccctgcccgaaagcggattacccatgctaaggtccagggggctggacagttgaggctgagtatcgacgcccaggaccgcgtgcttttgctgcacatcatcgagggcaaaggattgatctcaaaacagccgggaacctgcgacccctatgtgaaaatatcccttatccccgaggattcccgactgcggcaccaaaagacgcagaccgtgccagattgcagagatccagcctttcatgaacatttcttcttccctgtgcaagaagaagacgaccaaaaaaggctcctagttactgtatggaacagagcctcacagagccgccagtccgggctgattggctgtatgtccttcggagtcaagagcctgctgacgccagacaaagagatctcaggctggtactacctgttgggagagcacctgggccgtactaaacacctgaaggtggcacgcagacgcttgaggccgttgagagatccgcttttgcggatgcctgggggtggggacactgaaaatggaaaaaagctcaagataaccattcctcgaggcaaagacgggttcggcttcaccatttgctgtgactcccccgttagagtgcaggctgttgattcgggagggcctgcagagagagcagggctgcagcaactcgacaccgtacttcagctgaacgaacgcccagtggagcactggaaatgcgtcgagcttgcccacgaaatcagatcatgcccgagcgagattatcctgctcgtatggcggatggtgccacaggtaaagcctggacccgacggaggggtgctcaggcgtgcatcctgtaagtctacccacgacctccagtcaccccctaacaaaagggagaaaaattgtacgcacggtgtccaagccagacccgagcaaagacactcttgtcacctggtgtgcgactctagtgatggtctactactgggcggttgggaaagatacaccgaagtggccaagagaggtggccagcacaccctgcccgcattaagccgcgcaactgccccaacagaccctaactacattatcctggccccactgaacccgggtagtcagctccttaggccggtttatcaggaggataccattccagaggaatcaggctcaccttccaaagggaaatcctacaccggtttaggcaaaaagtcgcgcctcatgaaaacagttcaaaccatgaaagggcacggcaactatcagaattgcccggtggtgcgtccccatgccacacatagcagttacggcacatatgtaaccctggctccaaaggtgttggtgttccctgtctttgtgcaaccacttgacctatgtaaccctgcgagaacccttctgctttccgaggaactgttactgtacgaagggagaaataaggcagccgaggttacattattcgcctactcagaccttcttttgtttaccaaagaggatgagcctggaaggtgtgacgtccttcggaaccctctgtatctgcagtcagtgaagctgcaggaagggagttcagaagacctcaaattttgcgtactttacctagccgaaaaggcagaatgcctgtttactctggaagcgcattctcaggagcagaagaaacgggtctgctggtgtctcagcgagaatatcgctaaacagcagcagcttgccgctagtccccctgacagcaagatgtttgaaacagaggccgatgagaagagagagatggcactggaagaagggaagggtcccggagccgaggatagtccgccatctaaagagccgtcccccggtcaagagcttccacccggtcaggatctgccccctaataaagattcaccatctggccaagaacctgccccttcacaggaaccgctgtcttccaaggactcagctacaagtgaggggagtccgcctggccctgatgcccctccttcgaaagacgtgccaccatgccaagagcccccaccagcccaagacctcagcccctgccaggatctgcccgcaggacaggaacctctgcctcatcaggaccccttactcacaaaggacctgccagcgattcaggaatcccccacccgggatctgcccccatgtcaggatctgcccccatctcaggtatccctgcctgctaaagcacttaccgaagacacgatgagttccggggatctccttgcggcaaccggtgacccacccgctgcgcctcgaccagcatttgtcatacctgaggtgagactggactccacttacagtcaaaaggccggtgccgagcaagggtgttctggggacgaagaggatgccgaggaggcagaagaagtggaagagggagaagaaggtgaagaggacgaggacgaggatacctccgacgacaattacggggaaagatcagaggcaaagcgtagctccatgatcgaaacagggcagggagcggagggcggtttaagcctccgagtgcaaaattccctgcgcagacgcacccactccgaagggtcattgttgcaggagccgaggggaccgtgttttgcatcggacaccactctgcactgtagcgacggagaaggtgctgcctctacgtggggcatgccatcgccttctacactgaaaaaggagctgggtaggaacgggggtagtatgcatcatttgagtctcttttttacagggcacaggaagatgagtggggcagacaccgtaggggatgatgacgaggcctcaagaaagcgtaagtctaaaaatctcgccaaggatatgaagaacaagttgggcatcttcaggagacgcaacgagtcccccggagccccacccgcaggcaaagctgataagatgatgaaaagctttaaacctacctccgaggaggctttgaagtggggtgagagccttgaaaaactgctcgtccataagtacggattggcggtgtttcaggccttcctccgaactgaattttctgaagagaacctggaattctggttagcatgcgaggactttaagaaggtgaaaagtcaatccaaaatggcctctaaggctaagaagatctttgctgaatatattgctattcaggcttgcaaagaagttaacctggactcttatactcgcgaacacaccaaagacaatttacagtccgtgacccgtggctgctttgatcttgctcagaagaggatctttggtctcatggagaaggacagttacccacgcttcctgcggtcggacttgtaccttgacctgatcaatcagaagaagatgtctccgcctctgtag

SEQ ID NO: 238266 - DNA, 1776 bp, Artificial Sequence
  Description of Artificial Sequence: Synthetic coding sequence
atgaatcgtttcaatggtctgtgcaaggtgtgctctgaacggcgatacagacaaattacaatccctaggggaaaagacggattcggttttaccatctgttgtgattccccggtgagagttcaggccgtagacagtgggggacctgcggaacgcgcagggctccagcagctggacacagttctccaattgaacgagcgaccggtggagcactggaaatgtgttgagctggcacacgaaattcgaagctgcccgagtgagataattctattggtctggcgtatggtcccccaggtgaagcctggccctgatggcggtgtcctgcgtcgggcatcgtgtaaatctacccacgatcttcagtccccaccaaataagcgggagaagaactgcactcacggcgttcaggctcggcctgaacaacgtcactcgtgccatctggtgtgcgacagttcagacggcctcttgctgggtggttgggagcggtacacagaagttgccaaaagaggcggtcagcacacacttccagcactatctagagcaaccgctcccaccgatcctaattatatcatattggctcctctgaaccctggttcgcagttgctgcggcctgtgtatcaagaagacaccattcctgaggagagcggatccccgagtaaggggaagtcctacaccgggctgggaaagaagtcaagactgatgaaaaccgttcagaccatgaaaggccacggaaactatcaaaattgccccgtggtgagacctcatgccacacacagctcatacggtacctatgttactctggcccctaaggtactcgtctttcctgtgttcgttcaaccgctggatctgtgtaacccagcccgaacactgcttttgagtgaggagctgttgctatatgagggcagaaataaggcagctgaagtgacgctgtttgcgtactcggaccttctcctctttaccaaggaagacgaacccggacgatgcgacgtgcttcgaaacccgttatacctgcaaagtgtcaagcttcaagaagggagttcagaggatttaaaattctgtgtgctctatctcgccgagaaggccgagtgcctgtttacactggaggcacacagtcaggaacagaaaaaacgcgtgtgctggtgcctctctgagaatattgctaaacaacagcaactagccgctagtccgcctgatagcaaaatgagtggtgccgacacagtcggcgacgatgacgaggccagccgaaagaggaagtctaagaatctggctaaggacatgaagaataagttggggatctttagaagacgcaacgagtctcccggtgccccaccagccggaaaagcagacaagatgatgaaatctttcaagcctacttccgaagaagctctgaagtggggcgagagtctggagaaattactcgtccataagtacggcctcgctgtctttcaggccttcctgcgtactgaattctcggaggagaacctagagttctggctcgcttgcgaggatttcaaaaaggtgaagtcccagagcaagatggcgtcaaaggcaaagaaaatcttcgctgaatacatcgcaattcaggcctgtaaggaggtaaatcttgactcctacacacgtgagcacacaaaggacaacctacagtcggtaactaggggatgctttgatctggctcagaaacggattttcggcctaatggaaaaagacagctatccaaggtttctcagaagcgacctgtacctggatctcattaatcaaaagaagatgtccccacctctgtag

SEQ ID NO: 238267 - DNA, 1560 bp, Artificial Sequence
  Description of Artificial Sequence: Synthetic coding sequence
atgttcgaaaccgaggctgacgaaaagcgggaaatggccctcgaggagggcaagggacctggggcagaggatagtcccccatctaaagagccgtccccaggccaggagctgcccccaggacaggatttgccacctaacaaggattctcccagcggacaagaacctgcccctagccaggaacctctgagctcaaaggacagcgccactagcgagggctcgcctccaggtccagacgctcccccatccaaagatgtaccaccctgccaggagcccccacctgcccaggatctgagcccctgtcaggatctgccagctggccaggagcccctccctcatcaagacccgctcttgaccaaagatctccccgcaatccaagagtctcccactagagacctgcccccatgtcaggacctgcctccatcgcaggtatctttacccgcaaaagctctcactgaagacaccatgtctagtggggatcttctcgcagccaccggcgaccctccagcggctcctcgccctgctttcgtgattccagaggtgcggctggatagtacttactcccagaaggctggcgcagaacaggggtgtagcggcgatgaagaagatgccgaggaagccgaggaggtggaggaaggagaggagggtgaggaggacgaagacgaggacactagtgacgataactacggggagcgttccgaggcaaagagatcgtctatgatcgagacgggtcagggcgctgaaggtggcctttcgctgcgcgtgcagaactcactcaggaggagaactcacagtgaaggaagtctgctgcaagaacctaggggcccatgttttgcatctgatacaactttgcattgttccgacggagaaggggcagcttctacttggggcatgccttctccctcaacccttaagaaggaactgggccgaaatgggggatctatgcatcacctttctctttttttcaccggacatagaaagatgagcggcgcagataccgtaggggacgacgacgaagccagccggaagaggaaatccaagaatcttgcaaaggatatgaagaataagctgggaatctttcgcagaaggaacgagtcccccggagcacctcctgctggtaaggctgacaagatgatgaagtcatttaagcccacctccgaggaagcccttaaatggggggagagccttgagaaactgctggtccacaaatatggactggccgtctttcaggcattcctccgtacagaattctccgaggagaatctcgaattttggctagcctgtgaagattttaagaaagtgaagagccagagcaagatggcatcaaaggctaaaaagatcttcgcagaatatattgctatccaggcttgtaaggaggtaaatctggattcctacacgagagaacatacaaaagataatttgcaatccgtcaccagagggtgctttgacctggcccaaaaacgaatcttcggcctgatggagaaagacagttatccccgattcctcagaagtgatctctacttggacctgatcaatcagaagaagatgtctcccccactgtag

SEQ ID NO: 238268 - DNA, 936 bp, Artificial Sequence
  Description of Artificial Sequence: Synthetic coding sequence
atggtcactaggcggcctgtgactaattcctgggactggctgccagccggtgccgctcctgaagccgtcccctgtcgccacatgcctttaagtagactgccactgcgggttggacagaaagaatttttttttcccctgccacttctggtgccgcctataagttggctcctgttatctgagtcccagccccgattagtacctgggtcgcctgtgatcaggcctggtttccagagggcgtgtgtggccgctgcctgtacagttgctgccagatgtccagggaggggggtgggtgaccgctcacaaagtggagcatcctaccgccctatatgcgggccaaaagtcggaggcccaactgaaatgctacgcggaatgtacttgactagaaacggaaacctccagaggcggcatacaatgaaagaggccaaggatatgaagaataagcttggaatctttaggcgaaggaacgagagcccgggagctccccctgcagggaaagcagataagatgatgaaatcatttaagcccacatccgaggaagctctaaagtggggtgagtccttagagaaattgttagtccacaagtacggcctcgcagtgtttcaggcatttctacgaactgaattcagcgaagaaaacctagagttctggctggcgtgtgaagattttaaaaaggttaagtcacagagtaagatggcttctaaagcaaagaagattttcgctgaatacatcgccatccaggcttgtaaagaggttaatctggactcatatacacgtgagcatacaaaagacaacctgcagagtgtaacgagggggtgtttcgatctggctcaaaagagaatctttggacttatggagaaggatagttaccccaggtttcttcgcagcgatctgtacctggaccttataaatcagaagaaaatgagtccgcctctttag

SEQ ID NO: 238269 - DNA, 564 bp, Artificial Sequence
  Description of Artificial Sequence: Synthetic coding sequence
atgaagcacaggctcggctttcttctccagaagtctgacagctgtgagcacaatagttcacataataaaaaggataaggtcgtcatctgccagagggtgtcccaggaggaggtgaagaagtgggccgaaagtctggagaatctgatttctcacgaatgcggtctggcagcattcaaggcattcttgaagtctgagtattccgaagagaatatcgatttttggatctcatgtgaagagtacaagaaaatcaagtctccatcaaagctgtcaccgaaggccaaaaagatctacaacgagttcattagcgttcaggcaaccaaagaggtgaacctggactcctgtacccgcgaagagacgtcccggaatatgctggaacctacaattacttgcttcgacgaagcccagaaaaagatattcaatttaatggagaaagatagctatcggcgatttctgaagagccggttctatctcgatctggtgaacccatcatcttgcggcgctgagaaacagaaaggcgctaagagctccgccgactgcgccagcctcgtgccacagtgcgcctag

SEQ ID NO: 238270 - DNA, 282 bp, Artificial Sequence
  Description of Artificial Sequence: Synthetic coding sequence
atgtgtaaagggctagccggtttaccagcctcatgcctacgctctgccaaggatatgaaacacagactgggcttcctcctccagaaatcagatagctgcgagcacaactcatcccataataagaaagataaagtggttatttgccaacgggtgtcacaggaggaggttaagaagtgggccgaaagcttagaaaacttgattagccatgagtgtgaacccggttttttgcaccagggacgggataagcccgagcatgccagggcctacaacaacctcctctag

SEQ ID NO: 238271 - DNA, 618 bp, Artificial Sequence
  Description of Artificial Sequence: Synthetic coding sequence
atgtgtaagggcttggccggtctgcctgcgagctgcctgaggagtgccaaggatatgaagcacagattgggctttctgttacaaaaaagtgacagctgtgagcacaactctagccataacaagaaggataaagttgtgatttgccagcgggtttcccaagaggaggtcaagaagtgggccgagtccctggaaaacctcatctcgcacgaatgtggtctggctgcttttaaggcattcttaaaatcggagtactcagaagaaaacattgacttctggatttcatgcgaggaatataagaaaataaagagcccctctaaactctcccccaaggcaaagaagatttacaatgagtttatcagtgtgcaagcaactaaggaggtgaatttggattcctgcacgcgcgaagaaacgagcaggaatatgctggaacccactattacctgcttcgacgaagcccagaagaagatatttaatctgatggagaaggacagctataggcggttcttaaaaagccggttctacctggacctcgtgaaccctagtagttgtggcgctgagaaacagaaaggagctaagtccagcgcggattgcgcctcattagtgccccagtgcgcgtag

SEQ ID NO: 238272 - DNA, 909 bp, Artificial Sequence
  Description of Artificial Sequence: Synthetic coding sequence
atgtacaacatgatgctgcttattcagaaaagaaaagggatcgggtcccaactcctcagggccggagaagccgagggggacagaggggcaggcacagccgagaggtcgtctgattggcttgatgggaggagctgggcgatcaaggaaactcccactgggctcgccggtaggcgcagcgaggattccgacaatatcttcacaggagaggaagccaaatacgcccagtcgagatcacattccagctcatgtcggatcagttttttgttggcaaatagcaagctcctgaacaagatgtgcaagggcctcgccggattgccggcatcatgtctgcggagtgccaaggacatgaaacatcgtttagggtttctgctgcagaaaagtgacagctgtgagcacaactcctctcataataaaaaggataaagtcgtgatctgtcaaagagttagtcaagaagaggtaaagaaatgggccgaaagtctggaaaatctgatttcacatgaatgcgggctggccgcttttaaggcattcttaaagagcgagtactctgaggagaatatcgacttctggatttcttgtgaggagtataagaagatcaagagtccaagtaaattgagtccgaaagccaaaaaaatatataatgagtttatcagtgtgcaggctactaaggaagtgaatctcgactcctgtactcgagaagaaaccagccgcaatatgcttgaaccgaccatcacatgtttcgatgaagcccagaaaaagattttcaatttgatggaaaaggatagctacagacgttttcttaaatcccgcttctacctggatcttgttaatccttctagctgtggcgcagaaaagcagaaaggagctaagtcttctgccgattgtgcctctttggtcccacagtgtgcctag

SEQ ID NO: 238273 - DNA, 564 bp, Artificial Sequence
  Description of Artificial Sequence: Synthetic coding sequence
atgaagcacagactgggcttcttactgcagaaatccgactcatgcgagcataactcatcccacaacaaaaaggacaaggtggtcatctgccagcgtgtgagccaggaagaagtcaagaagtgggcggagtctcttgagaacttgatttcacacgaatgtggcctggcggcattcaaggccttcctcaagagcgagtatagcgaggaaaacatagacttttggatctcatgtgaggagtataagaaaatcaagtccccatccaaattgtctccaaaggcaaaaaagatttacaacgaatttatatccgtgcaagctaccaaggaggtgaacctagacagctgcacaagggaggaaacctcacgcaacatgctcgagccaaccattacatgtttcgacgaagctcaaaagaagatctttaacttaatggagaaggactcctaccgcaggttcttgaaatcccgattctatctggacctggttaacccatccagttgcggagcagaaaaacagaaaggagccaaaagcagtgctgactgtgcatcgttggttccccaatgcgcgtag

SEQ ID NO: 238274 - DNA, 432 bp, Artificial Sequence
  Description of Artificial Sequence: Synthetic coding sequence
atgaagcatcggctgggtttcctcttacagaagagtgattcttgcgagcacaactcttctcacaacaagaaagacaaagtcgtgatatgccagagagtctctcaggaggaggtgaaaaaatgggcagagtccctggagaatttgatcagtcatgagtgtgggcttgccgcattcaaggctttcttaaaatccgaatattctgaggagaatattgacttttggatttcatgtgaagagtacaaaaagatcaagagtcccagcaagttgtcccccaaggccaagaagatttacaacgaattcatcagcgtgcaggctactaaggaggtcaaccttgacagttgtaccagagaagagacaagtagaaatatgctcgagccgacgattacgtgcttcgacgaagcacagaagaagatttttaacctgatggagtag

SEQ ID NO: 238275 - DNA, 546 bp, Artificial Sequence
  Description of Artificial Sequence: Synthetic coding sequence
atgtgcaaagggctcgcggctctacctcatagctgcctggaaagagccaaagagatcaaaatcaagttggggatcctgctgcagaaacccgatagcgttggagatctggtgatcccatataatgagaagccagaaaaacccgcaaaaacccaaaaaacttcactcgacgaggcactgcaatggagggactctttagataaattactccagaacaactacgggctggcctcctttaaaagctttctgaagtctgaattttcagaagagaacctggagttctggattgcatgcgaagactacaaaaagatcaaatcacctgctaagatggctgaaaaggccaagcagatatacgaggagtttatccagactgaggcacctaaggaagtgaatatagatcatttcaccaaagacatcaccatgaagaatctggtcgaacctagtttatccagctttgacatggcacagaaacgaattcatgctctaatggagaaagattctctgcccaggttcgtccggtccgagttctaccaggagctgattaaatag

SEQ ID NO: 238276 - DNA, 606 bp, Artificial Sequence
  Description of Artificial Sequence: Synthetic coding sequence
atgtgcgccagaaacattagtcaagatatcctgattctgcagatgcacagcgcacattggcatatcaatggcaagtacgaggagaaatccaacctgatgttctgggctaaggaaatcaagatcaagttgggtatcctcctgcagaagccagattcagttggtgatctggtgataccatataacgagaagcccgagaaacctgccaaaactcagaagacttccctcgatgaggcactgcaatggagggatagtctcgacaaattactgcagaacaattacgggcttgctagctttaaaagctttctcaagtctgagttctccgaggagaatcttgagttctggatagcttgcgaggactacaaaaaaatcaagtctccagccaaaatggcagagaaggcgaaacagatctatgaggaatttatccagacagaagcccctaaggaggtgaatattgatcatttcaccaaagacatcactatgaaaaatctggtggagcccagccttagctcattcgacatggctcagaagcgcatccacgctctcatggagaaggactccctgccccgtttcgtccgctccgagttttaccaggaactgataaagtag

SEQ ID NO: 238277 - DNA, 222 bp, Artificial Sequence
  Description of Artificial Sequence: Synthetic coding sequence
atggcggagaaggcgaagcaaatctacgaggaatttatccaaaccgaggcccctaaagaggtgaatatcgatcacttcaccaaagacatcaccatgaaaaacctcgtggaaccgtctctgagctcctttgacatggcgcagaaacgcatacatgccctgatggagaaggattcactacctagatttgtgaggagcgagttctaccaggaactcattaagtag

SEQ ID NO: 238278 - DNA, 1362 bp, Artificial Sequence
  Description of Artificial Sequence: Synthetic coding sequence
atggcccagggtagcggggaccagagggcagtgggggtagcagaccctgaggagagctcccccaatatgattgtttattgcaagattgaggacattataaccaagatgcaggacgacaagacaggcggagtacccatcagaacagtcaagagctttcttagtaaaatcccaagcgtggttaccggtacagacatcgtacaatggctcatgaagaacctctcaatcgaggatccagttgaggctattcatctcgggtccctcattgcggctcagggatacatctttccgattagcgatcatgttttaactatgaaggatgatgggactttctaccgattccaggcaccctacttttggccaagcaactgctgggaacctgaaaatacggactacgccatttatctttgtaaacgcaccatgcagaataaagccagacttgaactggccgactacgaagccgaaaacttggcaaggttacaaagagcgtttgcccgaaaatgggaatttatattcatgcaggcagaagcccaggttaagattgatcggaagaaggacaagactgagcgcaaaatcctcgatagccaagaacgggctttttgggatgtgcaccggcctgtcccaggttgcgtcaacacgaccgaaatggacattcgcaaatgcagacgactgaagaacccacaaaaggttaagaagagcgtctacggagtaacagaagaatcccaagcgcagtctcccgtgcatgtactttcccaaccaattagaaagactactaaggaggatatccggaagcaaatcacattccttaatgcacaaattgatcggcattgtctgaagatgtcaaaagtggctgagtcaaaggagcccagccagcagcgcgtgaagcgttggggattctcctttgatgagattctgaaggatcaagtgggaagagaccagttcctgcgattcctggaaagcgaatttagctcagagaacctgcggttctggctggctgtgcaggaccttaaaaagcagcccttacaggatgttgccaagcgcgtggaggaaatttggcaggagtttttggctcctggcgctcccagcgcaattaatctagattctcactcttacgagatcaccagccagaatgtgaaagatggaggcaggtacactttcgaggacgcccaggagcatatctacaagctcatgaaatccgattcctacgccagatttctgcgcagtaacgcttatcaggatctgctgctcgcaaaaaagaagcctgagtccgaacagggcaggagaacaagcctggagaaattcacccgctctgtcggcaaatcactagctggaaaacgactcacaggtttgatgcagagttcctag

SEQ ID NO: 238279 - DNA, 1383 bp, Artificial Sequence
  Description of Artificial Sequence: Synthetic coding sequence
atggcacagggatccggtgaccagcgggctgtcggggttgccgaccctgaggagtccagtccaaacatgatcgtatactgtaagattgaagatataataacaaaaatgcaggacgacaaaactggaggtgtcccaatccgaacagtcaagtcatttcttagtaaaattccaagcgtggtaacagggaccgacattgtgcaatggctgatgaaaaatctgagtatagaggacccggttgaggctatccatctaggtagcctgattgctgctcagggctatatctttcctatctccgatcatgtgctgactatgaaggatgatgggacattctaccgcttccaggctccatacttctggccttccaattgctgggagcccgagaacacggattatgccatctatttgtgtaaaagaacaatgcagaacaaagcacgactagaactggctgactacgaagctgagaatctggccagactgcagagagcctttgctcgaaaatgggagttcatcttcatgcaggcggaagcgcaagttaaaattgataggaagaaggacaagacagaacggaaaattctcgattctcaggagagagccttctgggacgtgcaccggccagtccctgggtgcgtgaacacaactgagatggatatccggaaatgtagacgccttaagaatccacagaaggtgaagaagagcgtttatggggtgaccgaagaatcacaggcccagtctcctgtgcacgtgttgagccagcctatccgcaagaccaccaaagaagacattaggaagcagattacattcctgaacgcccaaattgataggcactgcttgaaaatgtcaaaggtagcggagtcccttatcgcttataccgagcagtatgttgagtacgaccctctgatcacccctgccgagcctagcaatccctggatcagcgacgatgtggccctgtgggacatcgagatgagcaaagaacctagtcagcagcgggtcaagaggtggggattcagcttcgatgagatactcaaagaccaggtggggagagaccagttcctgagatttttagagagcgagttctcctcagaaaatctcaggttttggttggccgttcaggatcttaaaaagcagcctctccaggacgttgccaagagggtggaagagatctggcaggaattcctggcccctggcgctccttctgcaattaacctggatagccactcatatgaaataacatcccagaatgtgaaggacggcggacgatatacttttgaagacgcacaggaacatatatataaattaatgaagagcgactcttatgcacggtttctgcgctccaatgcctaccaggacttgttactcgccaagaaaaaagtctggctgttgtag

SEQ ID NO: 238280 - DNA, 1419 bp, Artificial Sequence
  Description of Artificial Sequence: Synthetic coding sequence
atggcccagggatcgggggatcagcgagccgttggcgttgccgatcctgaggagtcctctccgaatatgattgtgtattgtaagatcgaggacattatcacgaagatgcaagacgacaagacaggcggtgtgcccattcgcaccgtcaagtcctttttgtcgaaaattccatcagtggtgaccgggaccgacatcgtacagtggctgatgaaaaatctcagcattgaggatccagtagaggcaatccacttaggtagtctgattgcagctcaaggctatattttccccataagtgaccacgtgctaacaatgaaagacgacggcactttctatcggttccaggctccttatttttggccatccaattgttgggaacccgaaaatacagactacgccatctatttgtgcaaaagaacgatgcaaaacaaagcacggcttgaactggccgactacgaagcagagaatctcgcaaggctgcagcgggctttcgcccgtaagtgggagttcatctttatgcaggcagaggcacaggttaaaattgatagaaagaaggataagaccgaaaggaagattctggacagccaggagcgagcattctgggatgtgcatcggcctgtgccaggatgtgtgaatactacggaaatggatatacgcaagtgtaggcgcctcaaaaatccccaaaaagtcaaaaagtcggtgtatggcgtaaccgaggagtctcaggctcagtctcccgtgcacgtactgtctcagccgatacggaaaacaaccaaagaggacataaggaaacaaatcaccttcctgaatgctcaaattgaccgccactgtctgaagatgtccaaagtggccgagtcacttattgcctatactgaacagtacgtagagtacgacccactcattacgcctgcagagccatccaatccttggatcagtgatgacgtagccctgtgggacatagaaatgagcaaagagcccagccagcaacgcgtgaaaaggtggggtttcagtttcgacgaaattctgaaagatcaagtcgggagggatcagtttcttagattcttggagtcagagttttcgagcgaaaacctgcgattttggttagctgttcaggacctgaaaaaacagccactgcaagatgtagcgaaacgcgtggaagagatctggcaggaattcctcgcccctggagcaccctcggctatcaatctggattcgcacagctatgaaatcaccagccagaacgtgaaggacggaggacggtacacctttgaggacgcacaagaacacatctataagctcatgaagtctgactcgtatgccagatttcttaggtctaatgcctatcaagacttacttctcgccaagaaaaaagggaagtcgttggccggtaaaaggctgacgggtcttatgcagtcttcatag

SEQ ID NO: 238281 - DNA, 1443 bp, Artificial Sequence
  Description of Artificial Sequence: Synthetic coding sequence
atggcacagggatcaggcgaccagagggccgtgggtgtggcagaccctgaggaaagcagccctaacatgatcgtgtactgcaagattgaagacataataaccaaaatgcaggacgacaagacaggaggagttcctatccgaactgtgaaatcttttctctctaaaatcccctcagtggtgactggaacggacatcgtgcagtggttaatgaaaaacctctccatcgaggaccccgtcgaggcgattcatctgggatctctaatcgccgctcagggatatatcttccccatatccgaccatgtcctgacaatgaaagatgatggcactttttataggtttcaagcgccttacttctggccatctaattgttgggaaccagaaaacactgattacgccatctatttatgtaagcgcaccatgcagaacaaagcgaggctggagctggctgattacgaagccgaaaacctcgccagactgcagcgggcattcgctaggaagtgggaattcatattcatgcaagcagaagcacaggtgaaaattgaccgcaaaaaggataagacggaacgcaagattctggatagtcaagagagggccttctgggatgtccataggcctgtgcctggttgtgtgaacaccacagaaatggatatcaggaagtgccggcgtctcaagaatccacagaaggttaagaaaagcgtctatggggtgacagaggagtcccaggcacaaagtcccgtccacgttctcagccagccaatacggaagacaactaaggaagacatccgtaagcagatcacgtttctgaacgcgcagatcgatcgacactgtctgaaaatgagtaaagtcgccgagagtctaattgcctacacggagcagtatgtggaatatgacccgctgattacaccagccgagcccagcaatccctggatctccgacgacgtggccctctgggacatcgaaatgtctaaagaaccatctcagcagcgggtgaagcgttggggcttttctttcgacgagattctaaaagatcaagtcggtcgcgatcaatttttaaggtttcttgagagtgaattttcgtcagaaaaccttcgattctggctggctgtccaagatcttaaaaaacaaccactgcaggacgtagccaagcgtgtcgaagaaatctggcaggagtttctggcccctggggcaccctctgctattaatctggactcacactcttacgaaattacttctcagaacgtgaaagatggtgggaggtatacatttgaagacgcccaagagcacatctacaaattgatgaagtcagacagctatgccagattcctgcgatcaaacgcataccaggacctgttgctggccaagaagaagcctgagtcagagcagggcaggcgaacctcattggagaagttcacaaggtccgtgtgcctgcagcttcttttttag

SEQ ID NO: 238282 - DNA, 1428 bp, Artificial Sequence
  Description of Artificial Sequence: Synthetic coding sequence
atggcacagggttctggagatcagagggcagtaggtgtcgcagatcccgaagaaagcagtcctaatatgattgtctactgcaagattgaggatattattacaaagatgcaagatgataaaacgggaggtgtgcctatcaggactgtgaaaagcttcctcagtaaaattccatctgttgttaccgggacagacatcgtgcagtggctgatgaagaacctgagtatcgaggaccccgttgaggccatccatttgggaagcttaatcgccgctcagggctatatcttccctatctctgaccatgtgttaacaatgaaggacgatggtaccttctacaggttccaggcgccttatttctggcctagcaattgctgggaacccgaaaatactgactacgccatttatctctgtaagcgaacaatgcagaataaagctaggctggaactggctgactacgaggcagagaacttagcgcgattacaacgcgcattcgctcgtaagtgggaatttatctttatgcaagcagaagctcaagtgaagatagataggaaaaaagataaaactgaaagaaagatactggattcccaggaacgggcattttgggacgtgcatcgtcctgtcccgggatgtgtcaacaccactgagatggacatccggaagtgtcgtcggctgaagaatccacagaaagtgaagaagtctgtctacggagttaccgaggagtcacaggctcaatccccagtgcacgtgctctcccagcccatcagaaagaccactaaagaagatataagaaaacagattaccttcctgaacgcgcaaatcgaccgccactgccttaagatgtcaaaagtggcagagagtctcatcgcgtatactgaacagtacgtggaatacgatcccctgattactccggcagaacccagtaatccgtggatttccgacgacgtcgcgctttgggacatcgaaatgtcgaaggaaccttcgcagcagcgagtgaaaaggtggggtttttcctttgatgagattcttaaagaccaggtggggagggatcagttcctgcggtttctggagagcgaattttctagcgaaaacctccgattttggcttgccgttcaggatctcaagaaacaaccgttacaggatgttgccaagcgggtggaggaaatctggcaggagtttttggccccaggcgcacctagcgcaatcaaccttgactcacacagttacgagattacgtcccaaaacgtgaaggatggaggacgctacacttttgaagatgcgcaggagcacatctataagctgatgaaaagcgatagctacgcgagattcctaagatcaaatgcttaccaggatctgttattagccaaaaaaaagcccgaatcggaacagggccgtagaacttccctggagaagttcactcgctcagtgggttag

SEQ ID NO: 238283 - DNA, 1434 bp, Artificial Sequence
  Description of Artificial Sequence: Synthetic coding sequence
atggcccagggaagcggggaccagagagccgtgggcgtggccgaccccgaggaatcgtcacctaatatgattgtgtattgtaaaatagaggacattatcactaagatgcaggatgacaaaacgggcggagttccaatcagaactgtcaaaagcttcctttccaaaatccctagtgtggtgacgggcactgatatcgtgcagtggctcatgaagaacctttccatcgaagaccctgtcgaggccatccatctggggagtcttattgccgcacaggggtatatttttccgatttctgaccacgtacttacaatgaaggacgatggcacgttttataggttccaggcgccatacttctggccgagcaactgttgggaacccgaaaacactgattacgccatctatctgtgtaaaagaactatgcagaataaagcgagacttgaactagctgattatgaggcagaaaatctcgcgaggcttcagagggcctttgcccgtaagtgggagttcatctttatgcaggctgaggcacaggttaagattgatcgtaagaaggacaaaacagagcgcaagattctcgatagccaggagcgcgctttctgggacgtgcatcgtcccgttcccggatgcgtaaacacaacagagatggacattcgcaagtgccgccgattaaaaaacccccagaaggttaaaaaatctgtgtacggcgtcacagaagagtcccaggcccagtccccagttcatgtgttgtcacagccaataaggaagaccaccaaagaggacattcgcaagcaaattacttttttgaatgcacagattgacagacattgtttaaaaatgtcaaaggtcgcggaaagcctaatagcgtataccgaacagtatgtcgagtatgatccattgataacccccgcagagccatctaatccttggattagcgacgacgtcgcactgtgggatattgaaatgagcaaagagcccagtcaacagagagtaaagcgctggggattttcttttgatgagattctcaaggatcaggtcggaagggaccagtttctgaggtttctggagtcagagttctcgtcagagaatttgaggttctggctggccgtccaagacttaaaaaagcagccactgcaggacgtagctaagcgagtcgaagagatttggcaggagtttctggcgcctggggctccatctgcaattaacctggacagtcactcatacgaaatcacaagtcagaacgtgaaggacgggggacggtatacatttgaggatgcccaagagcacatctataaactgatgaagtctgactcctacgccaggttcctgcggagtaacgcttaccaagacctgcttctggcgaagaaaaagcccgaaagcgaacagggtcgcaggacctctctggagaaatttactagaagcgtcctgttgttctag

SEQ ID NO: 238284 - DNA, 1620 bp, Artificial Sequence
  Description of Artificial Sequence: Synthetic coding sequence
atgaagaacctgagtatcgaagatccggtcgaagcaattcatcttggaagcctgatagccgctcagggctatatttttcccatcagcgaccacgtgctcacaatgaaggacgacggcacattctatagattccaggccccttacttctggccttctaactgctgggagcccgagaacacagattacgctatatacctctgtaaacgcaccatgcagaacaaggcaaggctggaactggccgactacgaggccgagaacctggcaagactgcaaagagcctttgcacgcaagtgggagtttatattcatgcaggctgaagctcaggttaaaatagatcgaaaaaaagacaagacggagcgaaagatcctggattcccaggaacgcgctttctgggacgtacatcggcctgtgcccggttgcgtgaatactactgagatggacataaggaagtgccggagactaaaaaacccacagaaagtgaaaaagtccgtttacggagtcacagaagagtctcaggcgcagtcgccagtgcacgtgctctcccagcccatcagaaaaaccactaaggaggacattagaaaacaaatcacctttctgaatgcacagattgatcggcattgtctaaaaatgtctaaagtggcagaaagtctgatcgcctatacagagcagtacgtcgagtatgatccactgattactccagctgagccaagcaatccatggatcagcgacgatgtggcattgtgggatatcgaaatgtccaaggaaccctctcagcagcgggtgaaaagatggggcttcagtttcgatgaaatcctaaaagatcaggtggggcgagaccaatttctgaggtttctcgaatctgaattttcaagcgaaaacctccggttttggctcgcggtgcaagacttgaaaaaacaacccttgcaagacgtggccaaacgcgtggaagaaatttggcaggagtttttagctcccggagccccttctgcaatcaaccttgatagccacagttacgagatcacttcacagaatgtgaaggacggaggaaggtacacctttgaggacgctcaggagcatatttataagctcatgaagtctgactcatacgctcgttttttaaggagtaatgcttatcaggatttgctgctggcaaagaaaaaaccagaatccgaacaaggtaggcgaacatccttggaaaaattcactaggtcggtaaacgtgcagaacacgcgacctgccggagcatggagcatattcatggccgcactccccatggctgtgtggttaagaacacccagatcctgccatggactgtctgaatcaagacttctgggcctgccgagcctgcacgatggcttacgggaaggccaatcgctacctcagagctgcccaggatcctcttcgacggcggcagagggagctcgggagcgagcaagtaacggacggtcacttgcacgaaggcagcactgtcagtgtcacgggcagggagaggagacacagctttgcctttggagccgtctcgagtcatctaagcgttcccagagggcctcctccctgaggactagcaaagccaagaaaaaaagacagacagtgaaacagggacccaaggcctggccatag

SEQ ID NO: 238285 - DNA, 1299 bp, Artificial Sequence
  Description of Artificial Sequence: Synthetic coding sequence
atcgaggatatcatcactaagatgcaggatgataagacggggggagtgccaattcgtacagtgaaaagcttcttgagcaagattcctagcgtggtgacaggtacggatatcgtgcagtggttgatgaagaacctgtccatcgaggaccccgtggaggccatccacctcggtagcctgattgccgcacaaggctatatatttccaatatccgatcacgtcctgaccatgaaagacgacgggaccttttatcgcttccaagccccatacttctggccatcgaactgctgggagccagagaatactgattacgccatctatctgtgtaagcggaccatgcagaacaaagctagacttgagctggctgattacgaggcagagaacctagccagacttcagagggcatttgcgcgaaagtgggagtttatctttatgcaagctgaggctcaggtgaaaattgatcgtaagaaagacaagaccgagagaaaaatccttgattcacaggaaagggcattctgggacgtgcacaggccagtgcccggatgcgttaacacaactgagatggacatcaggaaatgtagaaggctgaaaaatccgcagaaggtgaagaagagcgtctatggcgtcacggaggagagccaggcacaatccccagtgcacgtcctttcccaaccaatcagaaaaactaccaaggaggacatccgcaaacaaatcaccttccttaacgcccagatcgacaggcattgcctgaagatgtccaaggtcgccgaatcactgatcgcctacaccgaacaatacgtggaatacgatcccctgattacccccgctgagccctcgaacccatggattagcgacgatgtagcactatgggatattgagatgtcaaaagagccatcacagcaacgcgtcaagcgatggggcttttctttcgatgagattctgaaagaccaggtgggcagagatcagtttctgcgttttttagagtctgagttctcatctgaaaacttacgcttttggctggctgtgcaggatctgaagaaacaacccctgcaggacgtggccaagcgcgtggaggagatttggcaggagttcctggcgcctggtgctcccagtgccattaatttggacagccacagttacgagataacctcccaaaatgtcaaggatggtggcagatacacctttgaggatgcccaagaacacatttacaagctgatgaagagtgactcttacgctcggttcctgcggtccaatgcatatcaggacctgttactcgcaaaaaagaaggtttggctgctatag

SEQ ID NO: 238286 - DNA, 1041 bp, Artificial Sequence
  Description of Artificial Sequence: Synthetic coding sequence
atgcagaataaggctcggctcgagctcgctgattacgaggccgagaatcttgcccgactacagcgggctttcgccaggaagtgggagttcattttcatgcaggccgaagctcaggtgaaaatcgacaggaagaaggacaagactgagagaaagatccttgactcacaagaacgggctttttgggatgtgcacaggccagtccctggctgcgtcaatacgaccgaaatggacatccggaagtgcaggaggttaaagaacccacagaaagttaaaaaaagcgtttatggggtcacggaggaaagtcaggctcagtctcccgtgcatgttctttcgcagccaattcggaaaactacaaaagaagatattcgcaagcagattacattcctgaatgcacagatcgacaggcactgcctcaagatgagcaaggtggccgagtccctgatcgcttacacagaacagtacgtcgagtacgatcctctgatcacgcctgctgagcctagtaacccttggatctccgacgacgtggcactttgggatatcgagatgtcaaaggagccctcacagcagagagtcaaaagatggggattctctttcgacgaaatcctgaaagaccaggtggggagagatcagttcctaaggttcctggagagtgaatttagttctgagaatctgaggttctggttggccgtgcaggatctcaagaagcagccgttgcaggatgtagcaaagcgagttgaagagatctggcaggagttcctggcccctggtgccccttctgcaataaacctcgactcccattcgtacgagatcacatcccagaatgtcaaggatggtggcagatacaccttcgaggacgcacaagaacacatctacaaactcatgaagtccgacagctacgccagatttctgcgctctaacgcctaccaggacttgctgctggcaaagaagaaacccgagtctgaacagggcaggcggacttctctcgaaaaatttactcgatctgtgctgtggctgttatttcctcttgggaagaggccttag

SEQ ID NO: 238287 - DNA, 1473 bp, Artificial Sequence
  Description of Artificial Sequence: Synthetic coding sequence
atggctcagggctccggtgaccagcgtgcagttggcgtagcagatccggaagagtcttccccaaacatgatagtgtattgcaagattgaggacatcattacaaaaatgcaggatgataagacgggtggcgtgccaatccgaactgttaagtcttttctgagcaagatcccctccgtcgttaccggcacagacatcgttcagtggttaatgaagaatctgtctattgaagaccccgtggaggcgatccatctgggctcactgatagcagcccagggttacattttcccaatctccgatcacgtactgacaatgaaggatgacggaacattttacagattccaagctccatacttctggccgagtaattgttgggaaccggaaaataccgactatgctatctatctgtgcaagcggacaatgcagaacaaggccagactagaactggctgattacgaggccgagaacctcgcaaggttgcagagagccttcgctcgcaaatgggaatttattttcatgcaggccgaagcccaggtcaagattgaccgcaagaaagacaaaacagagagaaagatcttagattctcaggagcgtgctttctgggacgtgcacagaccggtcccgggatgtgtcaacacaaccgaaatggatatcaggaaatgccgcagactgaaaaaccctcagaaagtcaaaaagtccgtctacggcgttactgaggaaagccaagcccagtcacccgtgcatgttctcagtcagccaataaggaagactacaaaagaagatattcgtaagcagatcaccttcctgaatgcgcagatcgataggcactgcctgaagatgtctaaagttgccgagtcactcatagcatacactgagcagtacgtggaatacgatcctctcattacacctgccgagcccagcaatccctggatctctgatgatgtggccttatgggacatagagatgagcaaggaaccatctcagcagagggttaagaggtgggggttttcatttgatgaaatcctcaaggatcaggtcggccgagatcaatttctccggttcctagagagcgaatttagtagtgagaaccttcgcttttggctagctgtccaagatctgaagaaacagccactgcaagacgtggcaaaacgggtggaagaaatttggcaagagtttctggctccgggtgccccatccgctattaacctagactcacactcgtatgagataacaagtcagaatgtgaaggatggaggcagatacacatttgaagacgctcaggagcatatctacaagttgatgaaatccgactcatatgccaggtttctgcgatccaatgcttaccaggatctgctcctcgccaaaaagaagcctgagagtgaacaaggacgtaggacaagcttggaaaagttcaccaggagtgtcggtaaatccctggctgggaaaagactcacaggcctcatgcaaagctcttag

SEQ ID NO: 238288 - DNA, 1419 bp, Artificial Sequence
  Description of Artificial Sequence: Synthetic coding sequence
atggcccaaggaagcggagaccagagggctgtaggggtggctgacccagaagagagctctccgaatatgatcgtatactgtaagatcgaagatatcatcaccaagatgcaggacgataagacaggtggagtgcctatacgtaccgtcaagtcatttctttcaaagatcccttccgtggtgacggggactgatatagtgcagtggctaatgaagaacctgtccatcgaggatccagtggaagccattcatctgggtagccttatcgccgctcaagggtatatcttccctatcagcgatcatgtcctcacaatgaaagatgatggcaccttttatcgttttcaggccccatacttttggccatccaactgttgggagcctgaaaatacagattatgcgatctatctttgcaaacgcacaatgcagaacaaagcaaggctggaactggcagattacgaagctgaaaatctggctcgactacagagggctttcgcgcgtaagtgggaatttattttcatgcaggctgaagcccaagtcaagatagacaggaagaaagacaagacggagcgcaaaatcctagatagccaagagagagcgttttgggacgtacaccggccagtaccaggatgtgtgaataccaccgaaatggatattcggaagtgcaggcgtctaaagaacccccagaaggttaagaaatcagtctatggcgttaccgaagagtctcaggctcaatctccagtacacgtccttagtcagccaattcgcaaaactactaaggaggatatccggaagcagattactttcctgaatgcacagatcgaccggcattgcctcaaaatgtcaaaggttgctgagtctctgatagcatacaccgagcagtacgtggagtacgaccctcttatcactcccgctgagccctccaacccctggataagtgatgacgtggccctgtgggatatagagatgtccaaggagccttctcagcagagagtaaaacgctggggtttttctttcgatgaaattttgaaagaccaggtcggacgcgatcagttcctaagattccttgagtccgagttttcctctgagaatttgagattctggctggccgtgcaggacttgaaaaaacaaccactccaagacgttgcaaaacgtgtcgaggagatctggcaggagttcttggcccctggcgcaccttccgctataaacttggactctcactcgtacgagatcaccagccagaatgtaaaggacggtggccgttatacattcgaagatgcccaagaacatatatacaaactgatgaaatctgatagttatgccagatttttacgaagcaacgcctaccaggaccttctactcgcaaaaaagaaaggcaagtcactcgctggaaaaaggctgaccggcctgatgcagagcagctag

SEQ ID NO: 238289 - DNA, 1041 bp, Artificial Sequence
  Description of Artificial Sequence: Synthetic coding sequence
atgcaaaataaagcccgactggaactggccgattatgaagcagagaatttagctcgactgcagcgagcttttgcaagaaagtgggaattcatttttatgcaggctgaggcacaggtcaagattgatcgaaagaaagataaaaccgaacgtaagatactagactctcaggaacgggctttttgggatgtgcatagacccgtcccaggatgcgttaacaccaccgagatggacattagaaagtgcagacgcctcaaaaatccacagaaagtgaagaagtccgtgtatggagttactgaagaatcccaggcccaaagtccagtccacgtgcttagtcagccaatccgtaagaccacaaaggaggacattaggaagcagattacgtttctcaacgcccaaatcgatagacattgtttgaagatgtctaaagtagcagagagcctcatcgcatatactgaacagtacgtagaatacgatcccctcatcaccccagcagagcccagcaacccatggatctcagatgacgtggcgctatgggatatagaaatgtcaaaagaaccttcccagcaacgagtaaagagatggggtttctctttcgatgaaatactgaaagaccaagtcggacgcgaccagtttctaagattcctggaatctgagttcagttctgaaaacttacggttctggctggcagtgcaggatctgaagaagcaaccactgcaagatgtcgcaaagagagttgaagagatttggcaggagtttctggcaccaggcgctccctccgccataaacctcgatagtcattcgtacgaaattacgagtcagaatgtgaaggacggcggtagatacacgtttgaggacgcccaagaacacatctataagctgatgaaaagcgattcctacgcccgattcctgcgatctaacgcatatcaggaccttttactcgcaaagaaaaagccggagtccgagcaaggcaggcgcactagtttggagaagtttacaagatctgtgctctactctaacactcctctcgcaaagcgaccctag

SEQ ID NO: 238290 - DNA, 1419 bp, Artificial Sequence
  Description of Artificial Sequence: Synthetic coding sequence
atggcccaaggatccggcgaccagcgtgctgtcggagtagcggaccccgaggagagcagcccaaacatgatagtttactgcaaaatcgaggacatcatcactaagatgcaggatgacaaaacggggggagtccccatcaggaccgtgaagtcctttctaagtaagattcccagtgtggttaccggcaccgatatcgtccagtggctcatgaagaatctctctatcgaagaccctgtggaagccatccatttaggatctctcatcgccgctcaaggctatatcttcccgatcagcgatcatgttctcacgatgaaagatgacgggaccttctatcggttccaggccccttatttctggccctctaattgctgggagccggaaaacaccgactatgctatctacctgtgcaaacggacgatgcagaataaagcccgactggaacttgcggactatgaagccgaaaatctcgcccgactccagcgagcattcgcgcgtaaatgggagtttatcttcatgcaggccgaggcccaggttaaaattgacagaaagaaggacaagactgaacgtaagattctggactcccaagagcgggcattctgggacgtccataggccagtgccagggtgcgtgaatacaaccgagatggacatccgcaaatgccgccgactgaagaacccgcagaaggtcaagaaatccgtatatggcgttacagaagaatcacaggcccagtctcctgtgcacgtgctctcccagcccatcagaaaaactactaaggaagacatacgcaagcagatcacgttccttaatgcccagattgaccgacattgtctgaagatgtcgaaagtggcagagagtctcatcgcctacaccgagcaatacgtggagtacgatcctcttataaccccagccgaaccttccaacccctggatatccgatgatgtggctctctgggacattgaaatgtccaaggaaccctcacagcagagagtgaaaaggtggggcttctccttcgatgagattcttaaagaccaggtggggcgagaccagtttctccgctttctcgagtccgaattcagttctgagaatctgaggttctggctcgctgtgcaggatctaaaaaaacagccactccaggacgtggcaaagcgcgtggaagagatatggcaggagttcctagcacctggagccccttccgccataaacctcgatagccactcgtacgagatcacctcccaaaatgtgaaagacgggggaagatacacgttcgaggacgcacaggaacatatctacaaactgatgaaaagcgactcgtacgcccgatttctgcgatctaacgcctatcaggacctgcttctggctaaaaaaaaggggaaaagcctggccggaaaaaggctcaccggcttaatgcagtcatcttag

SEQ ID NO: 238291 - DNA, 1473 bp, Artificial Sequence
  Description of Artificial Sequence: Synthetic coding sequence
atggcccaaggaagtggcgaccagcgagcagttggcgtcgccgatcccgaagagagtagcccaaatatgatcgtctactgtaaaattgaggatattataacaaagatgcaggatgataagacaggtggagtgcccatcagaactgtcaagagtttcctatctaagattcctagcgtggtaactggaacggacattgtccagtggctcatgaagaacctctcaatcgaggacccggtggaggcgatacacctgggctcactcattgcagctcaggggtacattttccccatctccgaccacgtattgacaatgaaggacgatggaactttctatcggtttcaagccccatatttctggccgtccaactgctgggagcctgaaaatacagactatgctatatacctgtgcaaacgaaccatgcagaacaaggctagactggagttagctgactatgaagccgagaatctcgcaagactgcagcgggcattcgccagaaaatgggaattcatattcatgcaggctgaagcgcaggtgaaaatcgacaggaagaaagacaaaacagaacggaaaattctggactcacaggaacgggctttctgggacgtgcatagaccagtgcctggttgtgtgaacactaccgagatggacatcaggaaatgccgtagactgaagaaccctcaaaaagtgaaaaagtccgtttatggcgtcacagaggaatctcaggctcagagcccagttcacgtcctgagtcagcccatacgtaaaacaactaaagaagatatccgaaaacagatcactttccttaatgctcagattgacaggcactgcctaaagatgagtaaggtggcagagagtctgattgcgtatacagaacaatacgttgagtacgaccccctgatcacacctgcagagccatctaacccatggatctctgacgatgttgcactgtgggatatagaaatgagtaaggagccatcccagcaaagggtcaagaggtggggattctcttttgacgagatactcaaggaccaagtcggccgagaccaattccttcgcttcctagagtctgaattttccagtgaaaacttgcgcttttggcttgcagtgcaagaccttaaaaagcagcctctccaagacgttgcgaagagagtagaagagatatggcaggaattcctggccccaggcgctccaagtgcaattaacttggatagccactcttacgagatcacaagtcagaacgttaaggatgggggacggtatacattcgaggacgcacaggagcacatctataagctcatgaaaagtgactcgtatgctcgtttcctcagatccaacgcctaccaggatttactgttagcaaaaaagaaaccagagtcagaacagggacgcagaacaagcctagagaagtttacacgttccgtcggtaagagcctggccggtaagcgcctgacggggctcatgcagtcctcgtag

SEQ ID NO: 238292 - DNA, 1398 bp, Artificial Sequence
  Description of Artificial Sequence: Synthetic coding sequence
atggctcaaggaagtggggatcagcgggcagtaggcgtcgccgaccccgaagagtctagccccaacatgattgtgtattgtaagattgaagacatcatcacaaaaatgcaagatgacaagacgggtggtgttccaatacgcaccgttaagtctttcttgtcaaaaattccctccgtcgtgacaggcacagacattgtgcagtggcttatgaagaacttgagtattgaagaccctgtggaggcaatccatctaggcagcctaatcgcagcacaagggtacatctttccaatctctgaccatgttctcactatgaaagatgacgggaccttttacagatttcaggcaccttatttttggccatcgaattgctgggagcctgagaatacagactatgcgatttatctctgtaagcgaacaatgcaaaacaaagcccgattggagctagcagattatgaagcagagaacttagcaaggctgcagcgggcatttgctcgtaagtgggaatttatattcatgcaagctgaagctcaagtgaagatagaccgaaagaaagacaagaccgagagaaagatcttagactctcaggaaagggccttttgggacgtgcataggccagtgccgggttgtgtgaacactactgaaatggacatacgcaaatgtcggaggctgaagaatccccagaaagttaaaaagtctgtgtatggcgtcacagaggagtctcaggcccagagccctgtccacgtactcagtcaacccattcggaagactaccaaggaggatattcggaaacagattacattcctcaacgcacaaattgatcgccattgcttgaagatgagcaaggttgctgagtcactgatcgcatacacggagcagtacgtggagtacgacccgctgataacacctgctgaacctagcaatccctggattagcgacgatgtagcactgtgggacatcgagatgtccaaggagcccagtcagcagagggtgaaaagatgggggttttcctttgacgaaattttaaaagatcaggtgggcagggaccagttcctgcggtttttggagtcagaattttcaagtgagaacctgagattctggctggctgtacaggacctcaagaagcaacctctccaggacgtggccaagcgggtcgaggagatatggcaggaatttctagccccaggagcccctagcgccatcaatcttgattctcacagctatgagattacctctcagaatgtcaaggatggcggtcggtatacatttgaggatgctcaggagcatatctacaagctgatgaaaagcgatagctacgctcgctttctgaggagcaatgcctaccaggatctcttgcttgcaaagaagaagaaagtgtccaaagtcgtagagctaccgtag

SEQ ID NO: 238293 - DNA, 1356 bp, Artificial Sequence
  Description of Artificial Sequence: Synthetic coding sequence
atggaggatgtgattgctagaatgcaggacgagaagaatggcatccccataaggaccgtgaaatcatttctcagtaaaattccctcagtgttttctggctcggatatcgtccagtggctaatcaaaaaccttaccatcgaagatcccgttgaagccctccacttagggacgctgatggccgctcacgggtatttttttcccatctcagatcacgtattgacactaaaggatgacggcaccttctaccgctttcagaccccatatttttggccaagcaactgctgggaacctgaaaacactgactacgccgtgtacttatgtaaacggaccatgcagaataaagcacgcctggagctggctgattacgaggcggagagtcttgcgaggctacagcgtgctttcgcgagaaaatgggaattcattttcatgcaggctgaagcgcaggccaaggtggataagaaacgggataagatcgagaggaaaatactggatagccaggagagggccttctgggatgtgcaccgtccagttcccggatgcgtcaacacaacggaggtggatatcaaaaaaagctccagaatgcggaacccgcataagactcgtaaatctgtgtatggattgcagaatgatatcaggtcacactcccccacacatacacccactcctgagacaaaacctcccaccgaggacgagctgcagcagcagattaagtactggcagattcagctggaccggcatagacttaaaatgtccaaagtcgcggactccctgctttcctatacagagcagtacctggaatacgacccctttctactgccccctgatccctcaaacccctggctcagcgatgatacaaccttctgggagcttgaggcctcaaaagaacccagtcagcagcgggtgaagcgttggggctttggtatggacgaggccctcaaagacccggtcggcagagaacaattcctaaaattcctcgagtccgaattctccagcgaaaatcttaggttctggctggccgtggaagacctgaagaaacgaccaattaaagaagtacccagcagagttcaggaaatttggcaggagttcttagctccgggagcacccagtgctatcaatcttgactcaaaatcttacgacaagaccacacagaacgtgaaggaacccggtcgctacacttttgaggacgcccaggagcacatttacaaactaatgaagtcagactcctatccccgatttatacgctccagcgcgtaccaggaattactgcaagccaagaagaaaggcagaaatatcccgatcttcccttgccacaaaaactgtactcctaccttgagggcctctaccaacctcctttag

SEQ ID NO: 238294 - DNA, 1275 bp, Artificial Sequence
  Description of Artificial Sequence: Synthetic coding sequence
atggcccagggaaacaactacggccaaacctctaatggggtggccgacgaatcacctaacatgctcgtgtatagaaaaatggaggacgttatcgcacgaatgcaagacgaaaagaacggtattccaattcgaactgtaaaatcattcctgagtaaaatcccctccgtcttttcaggctcggacatagtccaatggttaattaagaacttgaccatcgaggatcccgctgtgtacctatgcaagaggaccatgcagaataaggcgagactcgaactcgcagattatgaagccgaatccctggcaagactgcaaagagcctttgcacggaagtgggaatttatcttcatgcaggcagaggcacaggccaaggtggataaaaaaagagataagatagagcggaagatcctcgatagtcaagaaagggcgttttgggacgtgcaccgacccgtacccggatgtgtcaacaccacagaggtcgacatcaaaaaatcctcccggatgcgaaacccccataagacccggaaatccgtgtacggactccagaacgatatccgatcacactcaccaacccatactcccactcccgagacgaagcccccaaccgaggacgagcttcaacagcagatcaagtactggcagatccagctggacaggcacagactcaagatgtcaaaggtggccgatagtctgctatcctatactgagcagtatctggaatatgacccatttttattaccaccagacccttccaatccctggctgtccgatgatactactttctgggagttggaggcttcaaaggaaccttctcagcagcgcgtcaaaagatggggctttggcatggacgaggctttgaaggacccggtcggcagggagcagtttctgaagttcttggagtccgaattcagtagcgaaaatctgagattctggctggctgtggaggatttgaagaaacgccctattaaagaagtgccgtctagagtacaggagatctggcaagagttcctggccccaggtgcccctagcgccatcaatctcgacagcaagtcttacgataagacaacccaaaacgtaaaggagcccggacgttatacatttgaagacgctcaagagcacatctataagctgatgaaaagtgactcctaccctaggttcatccgttctagcgcttatcaggagctgctgcaagcaaagaagaaggggcgaaatattccaatttttccttgtcataagaactgcaccccaacactgagagcctctaccaacctcctctag

SEQ ID NO: 238295 - DNA, 1410 bp, Artificial Sequence
  Description of Artificial Sequence: Synthetic coding sequence
atggcacaggggaataactacggccaaacctcaaatggggttgccgacgagtctccaaatatgctagtataccgcaagatggaggatgtgattgcgagaatgcaggacgagaaaaacggtatcccaattcggacagtgaagagtttcctatccaagatccctagcgttttttctggttctgatattgtacaatggcttatcaagaacttaaccattgaagatcccgtggaagctctgcacctgggtactctcatggccgctcacggatacttctttcccatatccgaccacgtgttgactcttaaagacgatggcactttttataggtttcagaccccctatttctggccgagcaactgctgggagccggagaacaccgattatgcggtgtatctctgtaaaagaacaatgcaaaacaaggccaggctggaactagctgattacgaggctgaatctctggctcgccttcagcgcgctttcgcgaggaaatgggagttcatcttcatgcaggcagaggctcaagctaaagtcgacaaaaaaagagacaaaatcgaacgtaagatacttgactcccaggagcgagccttttgggacgttcataggcctgttcctggctgcgtgaataccacggaagtggatataaaaaagtcatccagaatgcgcaacccgcacaagactagaaagtcagtctacggcctccagaatgacattagatcgcacagtccaacccacactcccactccggagaccaagcccccaactgaagacgaactgcaacagcaaataaaatactggcagattcagctggatcggcatcgactcaaaatgtctaaagtggctgacagtcttctatcttatacggaacagtacctggaatacgacccattcctgttgccccctgatccgtccaacccttggttgtccgacgacaccacattttgggagctagaggccagtaaagagccctctcagcagcgagtcaaacgatggggctttggtatggacgaagccctgaaggaccccgttggtcgcgaacaattcctaaagtttctggagtccgaattctcgtctgaaaatctcaggttttggctggctgtcgaagatctgaaaaagagacctatcaaagaagtgcccagtcgggtgcaagagatatggcaggagttcctcgcccctggcgcaccaagcgccatcaacctcgattctaagagctacgacaaaaccacacagaatgtgaaggagcctggtcgctacacgttcgaggacgcacaggagcacatctataagctgatgaagagcgatagttaccccagatttatacgatcatccgcgtatcaagagctgctccaggccaagaaaaaagggaagagcctgacctccaaacggttgacaagcctggctcagtcctactag

SEQ ID NO: 238296 - DNA, 1434 bp, Artificial Sequence
  Description of Artificial Sequence: Synthetic coding sequence
atggcgcaaggtaacaactacggtcagacatctaacggagtggctgacgagagcccgaacatgctcgtgtaccgaaagatggaggacgtgattgctaggatgcaggacgagaaaaatggtatccccatacgaactgtcaaatccttcttgtctaagatacctagcgtctttagcggatccgacatcgtgcagtggctgattaaaaacctaaccatcgaagatccagttgaggcactgcacctcggtaccctgatggccgctcatggatatttttttcccatctcagatcacgtactgactttgaaggatgatggcaccttttaccggttccagacaccatatttctggcccagcaattgctgggagccggagaacaccgattacgcagtctatctttgtaagcgcacaatgcagaacaaggccagattggagctagccgattatgaggccgagagtctggctcggctacagagagctttcgcacgaaagtgggaattcatatttatgcaggctgaagctcaggccaaagtggacaagaagagagataagatagagagaaagattcttgactcacaggaacgagccttctgggatgtgcaccgcccagtgccaggatgtgtgaacaccacagaggtggacataaagaaatcctctcggatgcgcaatccccataaaaccagaaagtcagtttatggcctgcagaacgatatccgcagccactcgcctacacacacccctaccccagaaaccaagccccctaccgaggacgaactacaacaacagattaagtactggcagatccagctggaccggcaccggctgaaaatgagtaaggtcgccgattcattgctgtcctatactgagcagtatcttgagtatgatccctttcttctgccgccagatcctagcaacccatggctttcggatgacactactttctgggaattagaggccagcaaggagccatcccagcagcgggtgaagcgttggggttttggtatggatgaagctctgaaagaccctgtcggcagggaacagtttctcaagtttctggaatctgagtttagcagtgaaaacctgcggttttggttggccgtggaagatctgaaaaagcgtcctatcaaagaagtccccagtagggttcaggaaatatggcaagaatttttggcgccaggtgccccatcagcaattaaccttgacagtaagtcctatgataagaccacccagaacgtgaaggaacctggtcgctacacctttgaggacgcacaagagcacatttacaaacttatgaagtcggatagctacccccgttttatcagaagcagcgcctatcaggaacttttacaggctaagaagaaaggacgaaatatacccattttcccctgccacaaaaactgcacaccgacattgcgagccagtacaaatctcctgtag

SEQ ID NO: 238297 - DNA, 1410 bp, Artificial Sequence
  Description of Artificial Sequence: Synthetic coding sequence
atggcacaaggaaacaactacggccagacctctaacggcgtggctgatgaatcccccaacatgctggtctatagaaaaatggaagacgtcatcgctaggatgcaggacgaaaagaatggaattcccatacgcactgttaagtcctttctgagtaagatccctagcgtgttttcaggatctgatatcgtacagtggctgataaagaacctgaccatcgaggacccggtggaagccttgcacctcggtacactgatggcggctcatggctacttcttcccgattagcgatcacgtccttaccctgaaagacgatggtaccttttacagatttcaaaccccctacttctggccttccaattgctgggagccagaaaacacagattatgccgtttatctctgtaagcgcaccatgcagaacaaagcacgcctcgagttggccgattatgaagctgaatccctcgcgcgtcttcaacgagcatttgccagaaaatgggaattcatttttatgcaggcagaagcgcaggcaaaagtggacaagaaacgggacaaaatagaaagaaagatcctggactcccaggaaagagctttctgggacgtacaccggccagtgccaggatgcgtgaacacaaccgaagtggatatcaagaagagctcacggatgcgaaatccacataagaccagaaaatctgtctacggcctccagaacgatatcaggagccactcccccacacatacaccaacaccagaaaccaaacccccaaccgaagacgaattacagcaacagatcaagtattggcagattcagctggatcgtcaccgtctgaagatgagtaaggtggccgacagtctcctgtcatatactgaacaatacttagagtatgacccctttttgttgcccccagacccgagcaatccatggctgagcgatgatacaactttttgggagctggaagccagcaaagaaccatcccagcaacgggtgaagcgctggggctttggaatggacgaggcactcaaggacccagtcgggcgagaacaattcctgaaattcctcgaaagcgagttttcttccgagaacctgcgcttttggctggcagttgaggaccttaagaagagacccatcaaggaagtcccgagcagggtgcaggaaatatggcaagaattccttgctcctggcgctcctagcgctatcaacctggacagtaagagttatgataagaccacgcagaatgtgaaagagcccggacgatatacatttgaagatgctcaggagcacatctacaagctgatgaaatccgactcctacccacgttttattcgtagttccgcataccaagaactgctgcaggcgaagaaaaaaggtaagtccctcacctctaagcgcctcaccagcttggcgcaatcttactag

SEQ ID NO: 238298 - DNA, 1464 bp, Artificial Sequence
  Description of Artificial Sequence: Synthetic coding sequence
atggcacaaggcaacaattatgggcagaccagcaacggggtggcagacgagtctcccaacatgctggtttaccggaagatggaggacgtaatcgcacgaatgcaggatgaaaaaaacgggatccctatccggacagttaagagcttcctctcaaagattccctccgtattttcaggaagcgatattgttcagtggctgataaaaaacctgacaatcgaagatcccgtcgaggctttacacctgggcactcttatggctgcccacggctacttttttcccattagcgaccacgttctgacactgaaagatgacggcacgttttacagatttcagaccccttacttttggcccagtaactgttgggagccagaaaacaccgattacgccgtatacttatgcaagcggacaatgcagaataaggcacgtctggagttggcagattatgaagccgaatcgctcgcgaggctccagcgtgcttttgctaggaagtgggagttcattttcatgcaagctgaagcacaggcaaaagtcgacaagaaaagagacaaaatagaaaggaagattctggattcacaggaaagggccttttgggacgtgcatcgcccagtaccaggctgtgtgaatacgactgaggtggatattaagaagtcaagccgcatgaggaatccacacaaaacaagaaagagcgtctatggcttacaaaatgacatccgttcacactcccccacccacactcctactcccgagacgaagcccccaactgaggatgaactgcaacagcagatcaaatattggcagatccagctggaccgccaccggctgaagatgagtaaggttgctgatagcctcctcagttatacagagcagtacctggaatatgacccattccttctccccccagatcccagcaatccatggctgtcggacgacaccaccttttgggagctggaagcatcaaaggagccgagtcaacagcgggtgaagcgttggggcttcggcatggatgaagccctgaaggatcctgttggaagggagcaatttctgaagtttctcgagagcgaattttcttcagaaaacctgcggttctggctggccgtggaagatcttaaaaagcggccaatcaaggaggtgccgagtcgcgtgcaggagatttggcaggagttccttgcccctggtgccccaagcgcgatcaatctagattcaaagtcgtatgacaagaccacccagaatgttaaggaaccagggcgatatactttcgaggacgcccaggagcacatctacaagttaatgaagagtgatagctaccccaggtttatacgctcttccgcctaccaggagctgctgcaggcgaaaaagaaatctggcaacagcatggaccggaggacaagcttcgaaaagttcgcccagaacgtgggcaaatctctcacatccaagcgcttaacctccttggcgcagagctattag

SEQ ID NO: 238299 - DNA, 1275 bp, Artificial Sequence
  Description of Artificial Sequence: Synthetic coding sequence
atggcacaagggaataactatggacaaacatcaaatggcgttgctgacgaatctcccaatatgctggtataccgcaagatggaggatgtgatcgccaggatgcaggacgaaaagaatgggatccctatccggactgtgaagtctttcttgtcaaagattccatcggtgttctccggcagcgacatcgtccagtggttgatcaagaacctgactatcgaggatcctgctgtgtacctgtgcaagcgcacaatgcagaacaaggcgcgtcttgagctcgccgattatgaggctgaaagcctggcgcgtctacaaagggcgttcgctagaaagtgggaatttattttcatgcaagctgaggcccaagcaaaggttgacaagaaacgggataaaatcgaacgaaagatcctggacagccaagagagggcgttttgggatgtccaccggccagtgcccggatgcgtgaacacaacagaagtcgacattaagaagtccagtcgtatgagaaatccccataagacaagaaagagcgtgtatggcttgcagaacgacatccgttcccacagccccacgcatactcctacacccgagaccaaaccgccaactgaggacgaactgcagcagcaaatcaagtattggcagattcagctggatcggcacaggctgaagatgagtaaagtggcggatagcttattgtcttacacggagcaatacctggaatacgacccctttctgctgccgcctgacccaagcaatccttggcttagcgacgacacaacattttgggagctggaggccagcaaggagcccagtcagcagagggtcaaacgctgggggtttggtatggacgaggcgttgaaagacccagtgggaagggagcagtttttgaagttccttgagtccgagtttagctcggagaacctgcgtttctggctcgcagtagaggatcttaaaaaaagacccattaaggaggtgccatctcgggtccaagagatttggcaggagttcttggccccaggcgcacctagcgcgataaatctcgacagtaaaagttatgacaagaccacccagaacgttaaggaacctggccgatatacattcgaggacgcccaggaacacatctacaagctgatgaagagtgacagctaccccagattcattaggagctcggcttatcaggaactgctccaagccaagaagaagggacgaaacatcccaatctttccatgtcataaaaactgcacgcccacccttcgggcttccacaaacctcttgtag

SEQ ID NO: 238300 - DNA, 1488 bp, Artificial Sequence
  Description of Artificial Sequence: Synthetic coding sequence
atggcccaggggaacaattacggacagacatctaatggagtggcggacgagagtccaaatatgcttgtgtacaggaagatggaggacgtaatcgcacggatgcaagacgaaaaaaatggtatccccattagaaccgtgaagtcttttctgagtaagattccgtccgtgtttagtggcagcgacatcgttcagtggctgatcaagaacctaactattgaagatccagttgaggcattgcatctgggcacactgatggccgcacatggctatttcttccctattagtgaccatgtcctgactttgaaagatgatggcacattttaccgattccagacgccttacttctggccatctaattgttgggaacctgagaataccgattacgccgtgtatctctgtaaacgcacaatgcagaacaaggccaggctggagttagccgactatgaggccgaatccctggcgagattgcaaagggccttcgcacggaagtgggaattcatatttatgcaggcggaggctcaggcgaaagtggataagaaacgagacaaaatcgaaaggaaaatactggatagccaggagagggccttctgggatgtgcaccggccagtgcctgggtgcgttaataccaccgaggtcgacatcaagaaatcatccaggatgagaaacccccataagacccgaaagagcgtctatggcctgcagaatgacattcgatctcattcccccactcatacccctacacccgaaactaagcctcccactgaggacgaactccagcaacagatcaaatattggcagattcaactggaccgtcacaggctgaagatgagcaaggtggcagacagcctcctctcctatacagaacagtaccttgaatacgatccgttcctattaccgccagacccgtctaacccttggctgtcagacgatacgacattctgggagctcgaggcgtcgaaggagcccagtcagcagagggtcaaacgatggggattcgggatggacgaagcactgaaggatccagtaggcagggagcagttcttaaagttcttggaaagtgagttctctagcgagaacttacgtttttggctggcagtagaagatcttaaaaagaggcccatcaaggaagtgccaagccgcgtgcaagagatctggcaggagtttcttgcaccgggtgcacctagcgccatcaatctcgacagtaagtcttatgacaagactacacagaacgtaaaggagcccggaagatatacgttcgaggacgcccaggaacacatatataaattaatgaagtcagattcataccctagatttatcaggtcaagcgcctaccaggagttgctacaagccaaaaagaaatcgggtaactcaatggaccggaggacatcttttgagaagttcgctcagaatgtggggcgaaacattcctatcttcccctgtcataagaattgcactccgactctcagggcctcaaccaatttgctgtag

SEQ ID NO: 238301 - DNA, 981 bp, Artificial Sequence
  Description of Artificial Sequence: Synthetic coding sequence
caggctgaggctcaggcaaaagtggacaaaaaaagagacaagattgagcgcaaaattctcgactctcaggagcgcgcattctgggatgtgcacagacctgtccctggctgcgtcaatacaactgaggttgacattaagaagtctagccggatgagaaacccgcacaaaacaagaaagagcgtgtatgggctccagaatgatattagaagtcacagcccgactcatactcctacaccggagaccaagccaccaaccgaagatgaactgcagcagcagatcaaatactggcagatacagctggatagacatagattaaagatgtctaaagtggccgattctctgttgagttacaccgagcagtacttagaatatgacccctttttgcttccccctgacccaagcaacccgtggctgtcagacgatactaccttttgggagcttgaggcttccaaagagccctcacaacaacgagttaagcgctgggggttcgggatggatgaagccctgaaggaccccgtgggccgagaacaattcctgaaattcctagagtccgaattctcttccgaaaatctccgtttttggctcgcagtcgaggatctgaagaaacgtccaatcaaagaagtgccgagcagggtgcaggagatttggcaggagttcctagctccaggggctccttcagcaataaacctcgacagcaagtcctacgataagacaacccaaaacgttaaagaaccaggacgatacactttcgaggacgctcaggaacacatctacaaactcatgaaatccgattcctaccccagatttatcaggtcaagtgcctatcaggagctgctgcaggccaagaagaaatctggcaatagtatggaccgtaggacgagctttgaaaaatttgcgcagaatgtagggagaaacattccaatttttccctgccataaaaattgcacccctactcttcgcgcatcaaccaaccttctttag

SEQ ID NO: 238302 - DNA, 1182 bp, Artificial Sequence
  Description of Artificial Sequence: Synthetic coding sequence
atggccgctcacggctattttttccccatctctgaccatgtcctcaccctcaaggacgatgggactttctaccgattccagaccccttacttttggccgtccaattgctgggagccagagaacaccgactacgccgtgtatctgtgtaaaaggacaatgcagaataaggctagactggaacttgcagactacgaggctgagtccctggccagactgcagcgcgctttcgcacgcaagtgggagttcatctttatgcaggcagaagcgcaggctaaagtggacaaaaagcgtgataaaatcgagcgcaaaatacttgactcccaggagagggccttctgggacgtccaccggcctgtccccggatgcgtcaacaccacagaagttgatatcaagaagagctcgcgcatgagaaacccacacaagacaagaaagtcggtgtatgggctgcagaacgacattaggtcacactcgcccacacatacgcccactcctgaaactaagccacctaccgaggatgaacttcagcagcagattaagtactggcagatccagctggataggcacagattgaagatgtctaaagttgcagatagtctccttagctacacagaacaatacttggaatatgatccgttcctgctgccacctgaccccagtaatccatggctctcagatgacaccactttctgggaactagaagcctctaaggagcctagtcagcagcgtgtgaagagatggggatttggaatggatgaagccctgaaggaccctgtcgggagggaacagttcttaaagttcctggaaagtgagttctcaagcgaaaacttaagattttggctagccgtggaagacttgaaaaaaagacccatcaaggaggttcctagccgagtgcaagaaatctggcaagagttcctggctccaggggcaccgtccgcaattaatctcgactctaaaagctatgacaaaacgacccaaaacgtaaaggagccaggcagatacaccttcgaggacgctcaggagcatatttataagctgatgaagtcagactcctaccctcggtttattcgcagtagcgcgtatcaagaactcttacaagccaagaaaaaaggtcgcaatatcccaattttcccatgccataagaactgcaccccgacactgagagcatcaacaaacctcctgtag

SEQ ID NO: 238303 - DNA, 774 bp, Artificial Sequence
  Description of Artificial Sequence: Synthetic coding sequence
atgtcctccgcaccgaacggcagaaagaagcgccctagtaggagcacaagaagttctattttccagatctccaagccacctcttcagtccggcgattgggaacgcagaggctccgggtctgagagcgcccataaaactcagagagccctcgatgattgtaagatgctggtgcaggagttcaatactcaggttgccctgtacagagagctggtgatctccattggggacgtcagcgtgtcttgcccctcactgagagccgaaatgcacaagacccgtaccaaagggtgcgagatggcgaggcaggctcatcagaaactggcagcgatctctggacctgaagacggtgagatccacccagaaatctgtagactgtacatccagctgcagtgttgtcttgaaatgtacacgactgaaatgttaaagagcatctgtctcctcgggtcgctgcaatttcacaggaagggcaaagagcccggtggaggtacaaagagcctggactgcaagattgaggagtccgccgaaacccccgctttggaggattcatcctctagccccgtggacagccagcaacattcttggcaagtttccacggatatcgagaatacggagcgcgatatgagggaaatgaagaaccttttaagtaaactgcgagagacaatgccactgcccctgaaaaatcaggacgattcttccctattaaatttgactccctaccccctggtccgaagacggaagaggcgattctttggcctctgctgtcttatctcctcttag

SEQ ID NO: 238304 - DNA, 2025 bp, Artificial Sequence
  Description of Artificial Sequence: Synthetic coding sequence
atgaccattagacaccagggacagcagtatagacccagaatggcttttcttcagaagatcgaggccctagtcaaagacatgcagaaccctgagaccggagtgcgtatgcagaatcaacgggtcttggtaacatcggtcccacatgctatgactggtagcgacgtcctgcagtggatagtgcagcggctgtggatcagctcattggaagcccaaaatctggggaatttcatcgtaaggtatggctacatttatccactgcaagatcccaagaaccttattcttaagcctgacgggtctctgtatagatttcagactccatacttttggcccacccaacagtggccagccgaagacacagattatgcaatatatctggccaaacgcaatattaaaaagaagggcatcctggaagagtatgagaaagaaaattataatttcctgaatcagaagatgaactacaaatgggatttcgtgattatgcaagcgaaagagcagtatcgggctggtaaggaacggaataaggccgatagatacgccctggactgtcaagagaaagcctattggctagtccaccgctgtccacccggtatggacaacgtgctcgactacgggctggatagggtaactaaccctaatgaggtcaaggtgaaccaaaaacaaaccgtggttgcagtcaaaaaggaaattatgtactaccaacaggcacttatgcgtagcacggtaaagtcttccgtgagcctcggagggattgtgaagtattctgagcagttctcctccaatgacgccataatgagcggctgtcttccctccaacccctggatcaccgacgatacccagttttgggaccttaatgctaagctcgttgaaatccccactaagatgagggtcgagcgctgggcctttaattttagtgagctaattagggatcccaaaggaaggcaatcttttcagtactttttaaaaaaagaatttagcggcgagaatttaggcttctgggaggcctgtgaagacctaaaatacggcgatcaatcaaaggtgaaggaaaaagccgaagaaatttacaaattgttcctggctcctggtgccagacggtggatcaacatagatggcaagacaatggacatcactgtgaagggcttgaaacaccctcaccggtacgtgttagacgccgctcagactcatatatacatgttaatgaaaaaagactcttacgcaaggtacctcaaaagccctatatataaggacatgctagcaaaggccatcgagccacaggaaactactaagaaatcttctaccttaccttttatgcgcaggcacctgcgctcgagcccatccccggtcatactgaggcagctcgaagaagaggcaaaggctagagaagccgcaaataccgtagatatcacacagcccggacagcatatggctccttcccctcatctgaccgtttatacggggacttgtatgccaccatcacctagctcacctttttccagtagctgtaggagtcccagaaaaccattcgctagccctagccgctttattcgccgaccatctacaactatctgcccttctcctatcagagtggcactggagtctagctccgggctggagcaaaaaggtgagtgcagtggctccatggcaccgagagggccaagtgtcactgagagcagtgaggcgagcctcgatacgagctggccaaggagtaggcccagggccccaccgaaagctagaatggccttgtcattctcccggttcctgaggcgcggttgtctggcctcacccgtgttcgcccgattatcccccaagtgtcctgctgtctctcacgggcgagtgcagcccttaggagatgtgggtcagcagttgccaaggttgaagagtaagcgtgtggccaactttttccagattaaaatggacgtcccaactgggtccggcacgtgcctgatggattctgaagacgctgggaccggcgagtctggtgatcgagcaacagagaaggaagtcatctgtccctgggaatcgctttag

SEQ ID NO: 238305 - DNA, 2016 bp, Artificial Sequence
  Description of Artificial Sequence: Synthetic coding sequence
atgaccatcaggcaccaaggccagcaatatagaccccgtatggcgtttctgcagaagatcgaggctctggtgaaggatatgcagaaccctgagaccggcgtgagaatgcaaaaccaaagagtgctggttactagtgtaccccatgccatgactggatccgatgtactgcagtggatagtgcagcggctttggatttcttctttagaggctcagaatttgggcaacttcattgtgaggtacggctatatctatccattgcaggacccaaaaaatctgatattgaagccagacggaagcttgtaccgctttcaaacaccctatttttggcccacacaacagtggccagcggaagataccgattacgccatctatcttgcaaagcggaatatcaagaaaaaaggtatcttggaggagtatgaaaaggagaattataacttcctcaaccagaaaatgaactacaaatgggattttgttatcatgcaagccaaggagcagtacagagctgggaaggagcgcaacaaagcagaccgctacgccttggattgtcaagagaaggcatattggttagtgcacaggtgtcctcccggtatggataacgtcctggattacgggctggatagagtcaccaatcctaatgaggtgaagaagcaaacggtggtggccgtgaaaaaagaaatcatgtattatcagcaggcactgatgcggagcactgttaaaagcagtgtgtcattgggaggaatcgtcaaatatagtgagcagttttccagcaacgatgctattatgtctggctgcttgcctagcaacccttggatcacagacgatacacagttctgggatttgaatgctaagctggtggagatcccaaccaagatgagagtagagaggtgggcctttaacttttccgagctcattagggatccaaagggcaggcagagcttccagtacttcttaaagaaggaatttagtggggagaatctgggcttctgggaggcgtgcgaggacttaaaatacggagatcagtcaaaagtgaaagaaaaggcagaagagatctacaagctgtttctcgcccctggtgcaaggagatggattaacattgacgggaagaccatggatatcaccgtgaaaggcctgaaacatccccacaggtatgtgttagacgccgcacagacccatatctacatgttgatgaaaaaggacagttacgctaggtacctcaaatcacccatctataaagatatgctcgcaaaagctatcgagccccaggaaacaaccaagaaaagttccactcttccatttatgaggcggcacctacgcagctctccaagcccagtcattcttagacaattggaggaggaagctaaagcccgtgaagcagcaaatacagttgacataactcagcccggtcagcatatggctccctctcctcatcttactgtgtacacaggcacatgtatgcctccttctccttccagccccttctctagctcatgcagatccccacggaagccattcgcaagtcccagcagattcataagacggccttccacaacaatttgtccatcacctatccgtgttgcactggaatcatcttctggcctagagcaaaaaggagagtgtagcgggtccatggcccctcgcggtccatccgtcacagaaagttccgaagcatctctggacacatcgtggccgaggtcccgccctagggcccctcctaaggccagaatggctttgtcctttagtagatttcttagaagaggttgcctggcctctcccgttttcgctcgcctttctccaaagtgccccgctgttagtcacggacgagttcagcccctcggcgatgtcggtcaacagctgcctagattaaaatccaagcgggtggcaaacttctttcagataaaaatggacgtacctaccggctcaggaacatgcctaatggactctgaggacgcagggacaggcgagtccggagacagagccacggagaaggaagtgatctgtccatgggagtccctgtag

SEQ ID NO: 238306 - DNA, 4008 bp, Artificial Sequence
  Description of Artificial Sequence: Synthetic coding sequence
atggagagtgagatgctccagagtccactccttggattgggggaagaggatgaagcggacctgacagattggaacctgcctttggctttcatgaagaagaggcactgcgaaaaaatcgaaggctccaaatcattggcgcaatcgtggagaatgaaggatcgaatgaagactgtatcagtggccctggtgctctgtctaaacgtgggggtggatcctccggatgtggtgaaaacaactccatgtgctaggctggagtgctggatcgacccattgtctatgggtccccagaaagcccttgagaccataggcgctaacctccagaagcagtatgaaaactggcaacccagagccagatacaagcagtcactggaccccacagtggacgaggtcaaaaaactgtgcacaagcctgagacggaatgcgaaggaggaaagggtgctttttcattataacggccatggcgtgcccagacctactgttaacggcgaagtgtgggttttcaacaaaaactatacccagtatatcccactgtctatttacgatctacagacatggatgggaagtcctagcatcttcgtatatgactgctctaacgccggactgattgtgaaatcctttaaacaattcgccctgcagcgtgaacaggaactagaagtggcagcgatcaatcccaaccaccccctggcacaaatgcccctccctccctcaatgaaaaattgtattcaattggccgcttgcgaggccactgagctgttgccaatgattccagatcttcccgcagacctctttacctcctgtctcacaacccccataaagatcgctctgaggtggttttgtatgcagaaatgtgtgtccctagtgcccggagtcacacttgacctgatcgagaaaatccccggacggctgaacgatcgacggacacctctcggagaacttaactggatcttcaccgccattaccgatacaattgcgtggaacgtcctacctagagatttgttccagaagctttttcgacaggaccttttggtagcgtccctgtttcgaaattttctgctcgctgagcggatcatgcgctcctacaattgcaccccagtgtcgagtcctcgattaccaccaacttacatgcacgctatgtggcaagcatgggatctagcggtagacatctgcctgagccaactccctacaatcatagaggaggggaccgcctttcgccactcaccctttttcgccgaacagcttacggcatttcaagtctggctgacgatgggggttgaaaatcgcaacccccctgagcagctacccatcgttctccaggtgctgctgtcacaggtgcacagacttcgggcacttgatctactggggagatttctcgacttaggaccctgggctgtgtccttagcactgtccgtgggcattttcccatatgtgctcaaactgctccaatcatctgctcgggaactgaggccgctgttggtcttcatctgggccaagatcctggccgtcgattcgtcctgccaagccgacttggtgaaagacaacggccacaagtactttttatccgtcctcgctgatccatatatgccagccgaacaccggactatgactgcattcatcctagcggtcatcgttaacagctaccacacaggacaggaagcatgtctgcagggaaacttaatcgccatctgcctggagcagctcaatgacccacacccacttcttcgccagtgggtggctatctgcctggggcgtatatggcagaatttcgattcagcacgctggtgcggtgtgagagacagcgcccacgagaagctgtacagcctgttaagcgatccaatccctgaggtgcggtgcgccgctgtgtttgccctaggaaccttcgtcggaaatagcgctgagagaactgatcactcgacgacaatagaccataacgtagcaatgatgctggcccaactggtgagcgatggcagtcccatggtgaggaaagaattggtggtcgccctgtcccatctggtggtgcaatacgagagtaatttctgtacggtcgctcttcagttcatcgaagaagagaagaactacgcactccccagtccggcaactactgaaggaggctccctcacaccagtgcgtgacagtccatgtacacccaggcttcgcagcgtgagtagttatgggaacattcgggctgtcgctaccgccaggtccctgaacaagtctcttcaaaatctgtcgcttacagaagagtctggaggcgctgtggcttttagtccagggaatcttagcacgagctcgtccgcctctagcactctagggtcacctgaaaacgaggagcacattctctctttcgaaaccattgataaaatgaggcgcgcatccagttattcctccctaaattcactcatcggggtgtcgttcaattctgtctatacccaaatatggcgggtgctgcttcatctcgcggctgacccataccctgaggtaagcgacgtggccatgaaagtgttgaattccatcgcctataaggctaccgttaacgcacgtcctcagcgcgtccttgatacctcttccttgacccaatcagcaccggctagccccacgaacaagggggtccacatccaccaggccggtggttctcctcctgcatctagcacatcgagcagcagcctgacgaatgatgtggccaagcagccagtgtccagagacctaccaagcggcagaccaggcactactgggcctgctggcgcacagtacaccccccattcccaccaatttcctcgaacccggaaaatgtttgacaaaggaccggagcagacagccgatgacgctgacgacgctgccggtcacaagagcttcatttccgccaccgtacagaccggcttttgtgattggtcagcccgttacttcgctcagcctgtcatgaaaatccctgaggaacacgatctggagtctcagatcagaaaggagcgcgaatggcggttcctccgcaattcaagagttaggcggcaggcacaacaggtgatccaaaagggcataacgcgtctcgacgaccagatctttctgaacagaaatccaggagtgccctctgtggtaaagttccacccatttactccatgtatagcagtagccgataaagactccatttgcttctgggattgggagaagggcgaaaagttagactacttccataatggcaacccaagatatactcgtgtgactgccatggaatacctcaacggccaggattgtagtctcctgcttaccgcgactgacgatggggcaatcagggtctggaaaaatttcgcggatctcgaaaaaaatcctgaaatggtgaccgcgtggcagggcctgtccgatatgctgcctactacgagaggcgctgggatggtcgtcgactgggaacaggaaaccggcctccttatgtctagtggcgatgttcgtatagtgcgaatctgggatacagacagagagatgaaggtgcaggatatccccactggagcagattcttgcgttacaagtttaagctgtgatagtcacaggtcgctcattgtagctggactgggtgacggctccattagggtgtatgataggcgcatggcgctgagtgaatgcagagtgatgacttaccgagaacacaccgcctgggtggtaaaagccagcctgcaaaagcgccctgacgggcatatcgtgtcagtctcggtcaacggtgacgtcaggatcttcgatcccagaatgccagagtccgtgaacgtgctgcagatcgtcaaaggcctcactgccctggacattcacccacaggctgatttgatagcatgcggtagcgtgaatcagttcacagccatctacaacagctctggggagctgattaataatataaagtattacgacggttttatggggcagagagtgggcgcaatctcttgccttgcctttcacccacactggccccacctagcggtgggaagcaacgactattatatcagtgtatacagtgtcgagaaaagagtccgatag

SEQ ID NO: 238307 - DNA, 990 bp, Artificial Sequence
  Description of Artificial Sequence: Synthetic coding sequence
atgggatcaccctccatattcgtctatgattgtagcaatgccggtctgatcgtcaagagttttaagcagtttgcccttcagcgggagcaggagctagaggtggctgcgataaaccccaaccacccattggcccagatgcctctgcctcccagcatgaagaattgcatacagttggccgcttgcgaggctaccgagctgcttcctatgatacccgatctgcccgctgatctgtttacatcctgtcttacaaccccaataaaaatagctctacgatggttctgcatgcagaaatgcgtcagtcttgtgcctggagtcacactggacctgatcgaaaagattcccggaaggctcaatgatcggaggaccccacttggtgaactgaactggatattcaccgcgattacagacactattgcctggaacgtgctgccccgagatctgttccaaaagctcttccgacaagacctgctggttgcgtccctgttcagaaattttctgcttgccgagagaattatgagaagttataactgcacccccgtgagcagccctaggctgcctccaacatacatgcacgcaatgtggcaagcttgggacctggccgtggacatctgtctgagtcaactgccaacaattatcgaggaaggaacagcctttaggcatagtcctttctttgccgagcagcttactgcatttcaagtgtggctgacaatgggggtggagaaccgaaacccgccagagcagcttcctatcgtacttcaagttctgcttagccaagtgcataggctgagagctctggatctgctcggacggttccttgacctcggcccttgggctgtaagcctggccttgtctgtggggatttttccgtacgttcttaagttgctacaatcgtcagctcgggagttgcggcctttactggtgtttatttgggccaaaattttagccgtggactctgtttccatccctgctctgttaccacgcgtcatgtag

SEQ ID NO: 238308 - DNA, 3534 bp, Artificial Sequence
  Description of Artificial Sequence: Synthetic coding sequence
atggaaagtgagatgctgcagtctccgttgctggggctgggagaagaagatgaagccgacctcaccgattggaacttgccactggcattcatgaagaagaggcactgtgaaaaaatcgagggatctaagtctctcgcccagtcatggcgcatgaaggaccggatgaaaacggtgagcgttgcgttagtgctgtgtttgaacgtgggcgttgatcccccagacgttgtgaaaacaacgccatgtgcaagacttgaatgttggattgatcccctctctatgggaccccagaaggcgctcgaaactatcggggcaaatcttcagaaacaatacgaaaactggcagccacgggctaggtataaacaatcgctggacccaactgttgatgaggttaaaaagctttgtacatctctaagacgaaatgcaaaagaggaacgcgtcctatttcactataacggccatggggtaccccgaccgacagtgaacggggaggtgtgggtctttaataagaattatacacaatatatcccattaagcatctatgatctgcagacatggatgggctcaccatccatttttgtatacgattgctccaatgccggattgatcgtcaaatcctttaaacagttcgccctgcaacgcgagcaggagctcgaagttgctgctatcaaccccaatcatccgctggcccagatgcctttgccacccagcatgaaaaactgtattcagctcgcagcctgcgaggccacagagctgctgccaatgattcctgacctcccggctgatctctttacatcttgtctgactacgcctatcaaaatcgctttgcgatggttctgcatgcagaagtgcgtgtccctagtgccaggcgtgacactcgaccttatcgagaagattcccggacggctgaacgacaggagaaccccactgggcgagttgaactggatctttaccgctatcacggatacaatcgcttggaacgtgctacctcgggacctgtttcagaagttattccggcaggatctgctagtggcatctttgttcagaaatttcctcctagctgagcggatcatgcgctcatataattgtacccccgtgtctagtcctcggctcccgccaacctatatgcacgcaatgtggcaggcctgggatctcgcagtggacatctgtttgagtcagctgcccacaattattgaggaaggtactgccttcaggcactcacccttcttcgcagagcagctaaccgcttttcaggtttggctgactatgggggtggagaaccgtaatcccccagagcagctcccaattgtccttcaggtcctcttgagccaggtgcatagattgcgcgcacttgacctgctgggccgattccttgatctgggaccctgggccgtatcgcttgctttatcagtgggcatattcccatatgtgctgaagcttttacaatcctccgccagagagctgcgcccactcctagtttttatttgggccaagattctggccgttgacagtgaactggtggtggctctgagtcatctggttgtccagtacgaatctaatttttgcacagtcgctctgcagttcatagaagaggagaagaactatgcgctacccagccccgcaacaaccgagggagggtctctcacacctgtccgagattctccatgtaccccacgactgcgttcggtgtcgtcttacggcaacatccgcgcagttgccaccgcacggtccctgaataaatctctgcagaacctctcgctgactgaagaatccggcggagccgtggcatttagccctggcaatttgtcaaccagcagctctgcttcctccactttaggatcccctgagaacgaggaacacatcctgagcttcgagacgatagacaagatgaggagagccagctcttactcttctctgaacagcctgatcggagtctcgtttaacagcgtctacacccaaatttggagagtcttgctacatctggcggcagacccctaccctgaggtttctgacgtcgccatgaaggtgttaaactccatcgcgtataaagcaactgtgaacgccaggccccagagggttctggacacgtccagcctgactcagtcagctcccgcttcccctaccaataaaggcgttcacattcaccaggctgggggtagtcctccggcatctagcacgtcctcatcctccctgactaatgacgttgcaaagcagccagtgagtcgtgacttaccaagcggaagacccggaaccaccgggcctgccggagctcaatacacaccccatagtcaccaatttccccgaactcgaaagatgtttgataagggtcccgagcagaccgcagacgatgctgatgacgccgcagggcacaagagctttatatccgccactgtgcaaaccggcttctgcgactggtctgccagatactttgcccagcccgtgatgaaaataccagaagagcacgatcttgaatcccagataagaaaggagagagaatggagatttctgagaaatagccgagtgcgcaggcaagcacagcaggtcattcagaagggtattactcgcctcgacgaccaaatcttcctgaacagaaaccctggagtgcccagtgtcgttaaattccatccttttaccccatgtattgctgttgccgacaaggacagcatctgcttctgggattgggaaaaaggagaaaaactggactactttcacaatgggaatcctaggtatacccgcgtgacagccatggaatacctcaacggccaagactgctcactgcttcttaccgcgaccgatgacggtgcaatccgagtatggaagaattttgccgacctcgaaaaaaaccctgagatggttactgcctggcaggggctatctgatatgctcccaaccactcggggtgcaggcatggtggtggactgggaacaggaaacaggcctgttgatgtcgagcggggacgtccgaatcgtccggatctgggacacggacagagaaatgaaagtgcaagacattcccaccggtgcagatagctgcgtgacaagcctctcttgcgactcgcacagatcgctgattgtagctgggctgggcgacggtagcatcagagtttatgaccgccgtatggccttatctgagtgtcgagtgatgacctacagggaacataccgcctgggtcgtgaaagcgtcattacagaaaaggcccgacggccatatcgtatctgtgtctgtcaatggtgatgtgcgtatattcgatccaaggatgccagagagcgttaatgtcctccagattgtaaagggtttaaccgcgctagacatacacccccaggcagatttgattgcatgcggatctgtgaaccaattcacggcaatttacaactcctctggagagttaatcaacaatattaaatattacgacggattcatggggcaacgggttggggcaatcagctgtctggccttccacccccattggccacacctggccgtgggaagcaacgattattatatatcagtgtactctgtcgaaaaacgcgtgcggtag

SEQ ID NO: 238309 - DNA, 2097 bp, Artificial Sequence
  Description of Artificial Sequence: Synthetic coding sequence
atgcagaactcagagggtggagccgacagtcccgcatctgtagcccttcggccaagcgccgcagctccccctgtgcctgcctccccacagcgcgtattagttcaggcagcgtcctcaaacccaaagggggctcagatgcagccaatctccctcccacgggtgcagcaggtcccacagcaggttcagcccgtgcaacacgtctatcccgctcaagtccagtatgtcgaaggaggggacgcagtctatactaatggagctattaggacagcctatacctataatcccgaaccccaaatgtacgcaccttcttcgacagcttcttatttcgaggccccaggcggtgctcaggtcaccgtcgcagcgtccagccccccagcagtgcccagtcactctatggtcggaattacaatggatgtcgggggaagccctattgtttcctctgccggagcctacctgatccacgggggtatggatagtacacgtcatagcctggctcacacctcccgatcctctccggctaccctgcagtggctcctagacaactacgagactgccgaaggcgtgagcctcccccgtagttctttgtacaaccactatctacgccactgtcaggagcacaagctcgacccagtaaatgcagcttcctttggcaaattgattcgctcagtatttatgggccttaggacgcggcgtctcggaacacgaggcaattccaaatatcattactatggtataagattgaagcccgatagcccactgaatcggctacaggaagacacacagtatatggccatgcgtcagcagccgatgcatcagaagccgagatatcggccagcacagaaaactgactcactcggggattctggctctcattcgggtctccattccaccccggagcagactatggctgtccaatctcaacaccatcaacagtacattgatgtctctcacgtgttccctgagtttcctgctcctgatctgggcagtttcctgctacaggatggtgtgactcttcatgacgtgaaagctttacagctggtatacaggcggcattgtgaggctacagttgacgtcgtcatgaacctgcagtttcactacattgagaaactctggctgagtttttggaattctaaggccagctcttcggatggccctacttccttgcctgcatcagacgaggatcccgagggagcagtcctccctaaggacaagctgattagcttgtgtcagtgcgatcctatcctccggtggatgcggagctgtgaccacattctctaccaagctcttgtggagatcctgattccagatgttctgaggccagtgcccagcactctgactcaggcaatccgcaactttgccaaaagcttagagggctggctcacaaatgccatgagcgacttcccccagcaagtaattcagacgaaggtgggagtggtgtccgctttcgcccaaacccttcgccgatatacgagtttgaatcatttggcgcaggctgccagggccgtgttacaaaatacctctcagattaaccagatgctcagtgatctcaacagagtcgactttgcaaacgtccaagagcaggcttcctgggtgtgtcaatgcgaggaaagtgtggtgcagaggttagaacaggatttcaaactgactctccagcagcaatccagcttagatcagtgggcctcttggcttgatagtgtggtgacgcaggtgttgaagcaacacgcaggttctcctagtttcccaaaggccgcacgtcagtttctcctgaagtggtcattctactcaagtatggttataagagatcttacccttagatcagcggcatcatttggcagctttcaccttattcgactcttatatgatgagtacatgttctatctggttgaacatagggttgcagaggctaccggagagactcctatcgcagtaatgggcgagtttaatgatcttgcgagtctcagcctgacgctgttggacaaagacgatatgggggatgagcaaagaggttcagaagccggtcccgatgctagaagcctcggcgagccccttgtcaagagagagcggagcgaccccaatcattctctgcagggaatctag

SEQ ID NO: 238310 - DNA, 2940 bp, Artificial Sequence
  Description of Artificial Sequence: Synthetic coding sequence
atggctacccaagcatatacagagctccaggctgccccacccccttcccaaccccctcaagcccctccccaagcacagccacagcccccaccccctcctccccctgccgcaccccagcctccccagccacccacagcggctgctacaccacagccgcaatatgtgaccgagctgcagtccccacagccacaagctcagcctccagggggacaaaaacagtacgtcacagagctgcccgcagtgccagcaccatcacagcctaccggcgcacctactccttcgccagcacctcagcagtatatcgttgtcactgtaagcgagggagcaatgagagctagcgagactgtgagcgaggcctcaccaggatctactgcctcgcagactggagtcccaacccaggtggtccagcaggtgcaggggacccagcagagactcctggtacagacaagtgtccaagccaaaccgggtcatgtgagcccattacagcttaccaatatccaggtgcctcagcaggcccttccgacacaacgccttgtggtacagtccgcagccccaggctccaagggaggccaggtgagtttaaccgtgcacggaacgcaacaagtgcatagccccccagagcagagtccagtgcaggccaattccagctccagcaaaactgccggtgctcccaccggtactgttccgcagcagctgcaagtgcatggggtgcagcagagcgttccagtgactcaggagcgcagcgtggtgcaggctaccccccaggcccctaagcccggacccgtgcaacccctcacagtccaaggcctgcagccagttcatgttgcccaagaggtgcaacaactccagcaggtgccagtgccccacgtatatagctcacaggtccagtatgttgaaggaggtgacgcctcttatacagcctctgccattagaagctccacctactcttaccccgagacaccactgtatacccaaacggcctccactagctattacgaagccgctgggactgccacgcaggtatccacacctgctactagccaggctgtcgcaagcagcggctcaatgccaatgtacgttagcggttctcaggtcgtggcctctagcacgtccaccggtgctggggcttctaattcatccggtggagggggtagtgggggaggcggagggggaggcggaggcggtggtggcggtgggtcaggcagcaccggcggaggaggctcaggggctgggacttatgtcattcaaggtggatacatgctgggcagtgcctcacaatcttactctcacactacaagagccagccccgctacggttcagtggctactggacaactacgaaaccgccgaaggcgtctccttgcctagaagcacgctctactgtcactacctgctacattgtcaggagcaaaaactggaacccgtgaatgccgcttcttttggcaagctgattagaagcgttttcatgggcttgcgaactaggcgcctgggtacccgtggaaattcaaaataccattattatggcctacggatcaaagctagcagtcccttactgcgactgatggaggaccaacaacatatggctatgcgaggacagccgttttcccagaaacagagattgaagcctatccagaagatggaaggcatgaccaatggtgtggctgtcggacagcagccatccacagggctgtcggacatctccgcgcaggtgcagcagtatcagcagttcctcgacgcctcccgctctcttcccgattttaccgaactggacctgcaggggaaagtcctcccagaaggagttggccctggggatatcaaagcgtttcaagtgttataccgcgagcactgcgaagccatcgtggacgtgatggttaacctacagtttaccctcgtggagaccctgtggaagactttctggcgatacaacctgtcccagccgtcggaagcaccacccctcgccgttcacgacgaggctgagaagcgacttccgaaggctattttggtcctgctctcaaagttcgagcccgtgctgcagtggaccaagcattgtgataatgtgctgtaccaaggcctcgtggagatccttatccctgacgtgctgcggccaatccccagtgcccttacccaggccattagaaacttcgccaagagtttagagtcttggctcacacacgctatggtgaatattccagaagaaatgctgagggtgaaagtggccgctgcaggcgctttcgcacagaccctcaggagatatacttcactcaaccaccttgctcaggcggcaagggccgtgctccagaacacagctcagatcaatcaaatgctctccgacctgaacagggtggacttcgcaaacgtgcaggaacaagcctcctgggtgtgtcgctgcgaagatcgcgtggtccagcgactcgaacaggatttcaaggtcaccctgcaacagcaaaacagtcttgagcagtgggctgcttggctggatggagttgtctcccaggttctcaaaccttaccaggggtccgcgggattccctaaggctgccaagttatttctgcttaaatggagcttttactctagcatggtgattcgcgacttaacattgcgatccgctgccagcttcggcagcttccacttaatcaggctactgtatgatgaatacatgtactatttgatcgagcatcgagttgctcaggccaaaggagagacacccatcgcggtgatgggtgaattcgctaatctggctacctccctgaatcccctggacccagataaggatgaagaagaggaggaggaggaggagtcagaagatgagctcccccaagacatctctctggccgcagggggagaaagcccagctctgggaccggagaccctggaaccccctgccaaactcgctagaaccgatgccagagggctcttcgtgcaggccctcccgtcatcctag

SEQ ID NO: 238311 - DNA, 2172 bp, Artificial Sequence
  Description of Artificial Sequence: Synthetic coding sequence
atgcagaatagtgaaggcggtgccgacagccctgcctccgtggccctgcgcccttccgcagccgcaccgcctgtgcctgcttcaccacagcgtgtactcgtccaagcagcttcctccaaccctaagggggctcagatgcaacccattagcctaccaagggtgcagcaggtgcctcaacaggttcaacccgtgcagcacgtttatcctgcccaggtccagtatgttgagggaggggacgcagtttacacgaatggtgccattcggactgcttatacatacaatccggagcctcaaatgtatgccccttcgagtaccgcctcctacttcgaggcccctggtggagctcaagttactgtcgccgcatccagcccgccagcagtcccatcccattctatggtgggtatcacgatggacgttggcggatctccaatcgtgagcagtgccggagcctacctaattcacgggggaatggatagcacccggcactctttggcccacacaagtcggagtagccccgctactctcgagatggcaatagaaaacttacagaaatctgaaggtatcacatcacacaaatctggactgctcaacagccacctacagtggctcctcgacaactatgaaactgcggaaggcgtgtccctgccgagatccagcctttacaatcactacctccgtcactgccaagagcataagctggaccccgtgaatgccgcttcttttggcaaattgattagatcagtatttatggggctgagaacacgtagactgggcactcgcggaaattcaaagtaccactactatggcatcagactgaagcctgactcccctcttaatcgacttcaagaagatacccagtacatggctatgcgccaacaacccatgcaccagaaacctaggtatcgaccggcacaaaagactgactccctaggggatagtggatcccactctgggttacattccactccagagcagaccatggccgtccaatctcagcaccaccagcaatatatcgatgtaagtcacgtgttccccgagttcccagcacccgatctcgggagtttccttctgcaggatggggtaacactgcacgacgtaaaagctctgcagttagtctataggagacactgtgaagcaacagtggacgttgtgatgaacctgcagtttcattacatcgagaaactttggttgagcttctggaattccaaagcatcttcctcagatggaccaacctcattacctgcctcagacgaggaccctgagggtgctgtgttaccaaaggacaaactaatctcgctttgccagtgcgacccaattctgcgctggatgcggtcctgcgatcacatcctttatcaggccctagtcgagatccttatccccgacgttctcaggccagttccctctactctgacacaggccatccgcaactttgccaaatctctggaaggttggctgacgaatgctatgtcagattttccccagcaggtgatccaaactaaggtgggcgtagtgagcgcattcgctcagacactgcgacggtacacttccttaaaccatcttgcccaggctgcaagggctgttctgcagaatacgtcccagatcaatcaaatgttatctgatctaaatagggttgattttgccaacgtgcaagagcaagctagttgggtgtgccagtgcgaggaaagcgtcgtacagaggttggaacaggacttcaagctgactttgcagcaacaatcctctcttgatcagtgggccagttggctagacagcgtcgttacacaggttctcaagcaacatgctggatctccttccttccctaaagctgccagacaatttctattgaagtggtccttctactcttccatggtaattcgggacctgacactgcgctcagcggcttcatttgggagctttcatctcattcgcctgctgtatgatgagtatatgttctatttagtcgagcacagggttgctgaggcaactggtgaaacccccatcgctgttatgggcgagttcaacgatttagcttctctcagcttaactttgctcgacaaggatgacatgggagacgagcaacgcggatccgaggctggtccagatgcccgatctctgggcgaacctttggtcaagagagagagaagcgatccgaaccatagcttgcaggggatctag

SEQ ID NO: 238312 - DNA, 2097 bp, Artificial Sequence
  Description of Artificial Sequence: Synthetic coding sequence
atgcagaattctgaaggcggtgcggactctccagcgtctgtcgcacttcgtccaagcgctgctgcacccccagtgcccgcaagcccacaaagggtgcttgtgcaggcagctagctccaacccaaagggcgcacagatgcagcctattagcttgccgcgtgtgcagcaagtacctcagcaggtgcagccagtgcaacacgtctacccggctcaggtccagtacgtggagggcggagacgccgtctatacaaatggggctatcaggacagcttatacttacaatccagagccacaaatgtacgctccctccagcaccgcatcctactttgaagctccgggtggcgctcaggtgaccgtggcagcttccagcccccctgcggtccctagccactcaatggtcggtataactatggacgtggggggttccccaatagtgtcatccgccggagcctacctaatacatggtggcatggatagcactcgccacagtctggcccacacctctagaagctctcctgcaaccctacagtggctcctcgataattatgaaaccgctgagggagttagcctgcccagatcttctctttacaatcattatctccggcattgccaggagcataaattagacccggtgaatgccgcatcctttggcaaacttataagaagcgtcttcatgggacttcgaacaaggaggctggggaccaggggaaacagcaaatatcactattatggtattcggttaaaaccagatagcccgcttaacaggctccaggaagacacgcagtatatggccatgaggcaacagccgatgcatcagaaaccaaggtatagacccgctcagaaaaccgactccctgggtgactccggatcacatagtggactgcactccactcctgagcaaactatggcagtacagtcacagcaccatcagcagtatattgatgtttcacatgtgttcccagagttcccagctccagatctgggcagctttctgctgcaggacggtgtgaccttgcacgatgttaaggcactgcagttagtataccgcaggcattgcgaagccacagtggacgtggtaatgaatctgcagtttcattatatagagaaactctggttgtccttttggaactctaaagcaagctcttcagatgggcctacctccctgcctgcgagtgacgaggatcccgagggagccgtgcttcccaaggacaaactgatttccctgtgccagtgcgatccaatattgagatggatgcgctcatgcgaccatatcttataccaggctctcgtcgaaatcctgattccagacgtgctcaggccagttcccagcactcttacccaggctatccggaactttgccaagtccctggagggttggttaacgaacgctatgtctgatttcccgcagcaggtgatccagactaaggtcggcgtggtgtcggctttcgctcagaccttgcggaggtataccagcctcaaccatctggcccaagcggctagagccgtcctgcagaatacaagtcagattaaccaaatgctgagtgatctcaatcgagtcgattttgccaatgtgcaggagcaggcatcctgggtgtgccaatgtgaggagtccgtggtccagcggctggagcaagactttaagttgacactgcagcagcagagcagtcttgatcaatgggctagctggttggactcggtcgtgacacaagtcctcaagcagcatgctggttctccctctttccctaaggcagccaggcagttccttttgaaatggagtttttacagttcaatggttatcagggacctcaccctgcgctctgcggctagtttcgggtcttttcacttaatccgccttctctatgacgaatatatgttttatttggtggaacatagagtggctgaagcaaccggagaaacacccatagcagttatgggcgaattcaacgatctggcctctctctctttaaccctactggacaaggatgacatgggcgatgagcagaggggttctgaagccggaccagatgccaggagcctgggggagcccctcgtgaaaagagagcgctctgatcccaaccatagccttcaaggaatctag

SEQ ID NO: 238313 - DNA, 1851 bp, Artificial Sequence
  Description of Artificial Sequence: Synthetic coding sequence
atggccgaggacgagccagacgccaagtccccaaagactgggggtcgcgctcctcccggaggtgctgaggccggagagccgaccaccctcctgcagagactccgcggaactatctccaaagcagtgcagaataaagtggaaggcattcttcaagatgttcaaaaattctccgacaatgacaagctttacttgtacctgcagctgcccagcggccctactactggggacaagtcctctgagccttctacattgagtaatgaggagtacatgtacgcataccgatggatacggaaccatctcgaagagcataccgacacctgcttacctaagcagtctgtttatgacgcatacaggaaatactgcgagagtcttgcttgttgtaggcccctctccacagcaaatttcggcaaaatcattcgggagatcttccctgacattaaagctaggaggttggggggaagaggtcagtcaaagtattgttattccggaattaggcgtaagacactggtgtccatgccccctcttcccggactcgacctgaagggcagtgagtcccccgaaatgggcccagaggttacccccgcacccagagatgagctcgtggaggccgcatgtgcgctgacgtgtgactgggccgaacggatcctaaagagaagcttcagcagcattgttgaagtagcaaggttcctcctgcagcagcatctcatatccgccagaagcgctcacgcccacgtcctaaaagccatgggattagcagaggaggacgaacatgcacccagggaacgttcaagcaagcccaaaaatggactggagaaccccgaagggggtgcacacaagaagcctgagcggctggcacagccacccaaagatctggaagcacgtacaggcgctggacccctggccagaggggagcggaagaaatccgtggttgagagcagtgcccctggtgccaataatctccaggtgaacgctctggtggcgaggttgcctctcctactccccagagctcccagatcactaatacctcccattccagtgagccctccgattcttgcgccacggctgtcctcgggtgctttgaaagtcgcaaccctgcctctgagttctcgagccggtgccccacccgctgctgtccctataattaacatgatcctacccacagtgccagcccttcccggaccgggacctgggccaggccgtgcccctcccggaggcctgacgcagcctcggggtacggagaatcgggaggttggcatcggcggtgaccaaggaccccacgataaaggcgtgaaacgcactgcggaagtgccagtttcagaagccagtggccaggcgcctccagccaaggcggctaagcaagatatcgaggacactgcctccgatgccaaaaggaagcggggacgtccgagaaagaaatccggagggagtggggaacgaaacagtactcctctaaagagtgccgctgccatggaaagcgcccagtcaagccgcttgccctgggagacttgggggtccggtggagaggggaactcagctggaggcgctgagcgtcccggtcctatgggggaggctgaaaagggggctgtgcttgcacaggggcagggggacggtaccgtatcgaaggggggtagaggtcccggaagccagcatacgaaagaagcggaggataaaattccactcgtgccgagcaaagtttcagtcatcaagggctcaaggtcccaaaaagaagccttcccactggcgaaaggggaggtggacacagccccacagggcaataaggacctgaaagagcacgtgctccaatcaagcctcagccaggaacataaagaccccaaagccacgcctccttag

SEQ ID NO: 238314 - DNA, 1851 bp, Artificial Sequence
  Description of Artificial Sequence: Synthetic coding sequence
atggcagaggacgagcctgacgccaaaagcccaaagactggcggacgcgcaccgcctgggggtgctgaggcaggcgaaccgactactctgctgcaaagactgcgtggcaccataagtaaagctgtgcaaaataaagtggagggtattctgcaggacgtgcagaaattcagtgacaatgataaactgtacctatatcttcagcttccatctggcccaactacgggagataaatcaagcgagccctcgaccctcagcaatgaggagtatatgtatgcctatagatggatccggaatcaccttgaggaacatacggacacttgcctccccaaacagagtgtctacgacgcttataggaaatattgcgagtctttggcttgctgtaggcccctctcaactgccaacttcgggaaaatcatacgcgagattttcccggatataaaggccagacggctggggggtaggggccagagcaaatattgctactctggtatcagaagaaagaccctggtgtccatgcctcccctgccaggactggacttgaagggcagcgagtcacccgagatgggccctgaagtcactccagcccctagagatgagttggtagaggcggcatgtgccctgacgtgtgattgggctgagcgcatcctcaaacgctcattcagcagtatcgtggaagttgcaagattcctcctgcagcaacacctcatttccgcccgatccgctcacgcccatgttcttaaggcgatgggcttggcagaggaagacgagcatgccccacgagagaggagtagtaagcccaagaacggcctggaaaaccctgagggcggagcccacaaaaagccagaacggctagcgcagcctcctaaagatctggaggctagaaccggtgctgggccactcgcaaggggggaaagaaaaaaatccgtggtagaatcttccgcccctggggctaataacctgcaggtcaacgctctggtcgcacggctgcctctccttctgcctcgagccccacggtccttaatccctcccatccctgtgagcccaccaatccttgctccacgattgagcagtggcgcactcaaggtggcaaccctgccactgtcttctagagccggagcccctccagctgcagtgccgattatcaacatgatcctaccaaccgtgccagctctgcctgggcctggcccaggccctggaagagcaccacctggcggtttgactcagccccgtggaacggagaaccgagaagttgggattggtggagaccaagggccacacgataagggcgtgaagagaactgcggaagtaccagtatcagaggcatccggccaagcccctccagctaaggccgcaaagcaggacattgaagacacggcgtctgatgccaaacgcaagagggggagaccccgaaaaaagtctggaggctctggcgagcggaacagtacccctttgaagtccgcagccgctatggagtccgcccagtctagtcgtttaccctgggaaacatgggggtctggcggtgaaggaaacagtgctggcggtgcagagcgccctggccctatgggcgaggcggaaaaaggggctgtcttggcccagggacagggcgacggtaccgtatccaaggggggaagaggccctggctcccaacatacgaaggaagctgaagacaagatcccactcgtccctagcaaggtgagcgtcatcaaaggcagtagatcccagaaagaggcttttccccttgcgaagggtgaagttgatacggcaccccaagggaacaaagacctgaaggaacacgtccttcagtcatctctaagccaggagcataaagaccccaaggccacacccccatag

SEQ ID NO: 238315 - DNA, 1791 bp, Artificial Sequence
  Description of Artificial Sequence: Synthetic coding sequence
atggcagaggatgagcccgacgcgaagagccccaaaaccggaggcagggcccctcccggaggcgcagaagcaggcgaacccacaaccttgctgcagcgcctaagaggaacgatcagtaaagccgtccaaaacaaggttgagggcatacttcaggacgtgcaaaagtttagcgacaacgataaactctatctatatctgcagttgccttccggacctactaccggagataaatccagcgaaccatctactctttctaacgaggagtatatgtatgcatatcgctggatcagaaatcacttggaggaacataccgacacgtgcctgcccaagcagtctgtgtacgacgcgtaccgcaagtattgcgaatctcttgcgtgttgccggccactttccacagcaaattttggcaagatcatcagagagatcttccccgacataaaggctaggcgcctgggtggacggggacagagtaaatactgttattccggaattcggcgtaaaaccctcgtgtccatgcctccactaccgggtctggatttaaaaggaagcgaaagtccagagatgggccctgaagtcaccccagcacccagagatgaactggtagaggccgcatgcgctttgacttgtgattgggccgaaaggatactcaaacgtagtttctcttctatcgtggaggtggccaggtttctgcttcagcagcatctgatcagcgcacgcagtgcacacgcgcatgtgctcaaggcaatgggattagctgaggaggatgagcacgctccaagagagaggtcttccaaaccgaaaaatggcctggaaaatcccgagggcggagcgcataagaagcccgagagattggcccagccccctaaagacttggaagcccgaacaggcgctggaccactggccagaggagaacgtaaaaaaagcgtagtagaatcctccgccccaggtgctaacaacctccaggtcaatgccctggtcgccaggcttcctctgctcctaccgagagctcccaggtcattaataccgcctataccagttagcccacccatactggcacctcggctctcaagtggggctctgaaagtggcaacactaccgctaagtagcagagcaggcgcaccacccgctgctgtgccaattatcaatatgattctacctacagtgcccgcactgcctgggcctggtccagggcctggtcgcgctcccccaggaggcctaacacaacccagaggtacggaaaatagagaagtcggtattgggggagatcaaggcccacatgacaagggcgtcaaacgtactgcagaagtcccagtatcagaggcatccgggcaggcaccacctgccaaggctgcaaaacaggatattgaggatactgcctcggatgccaaaagaaagcgcggaagaccacgcaaaaaatcaggaggtagcggagagaggaacagcacacctctgaaatcggccgctgccatggagagcgctcagagctctcgcctgccctgggaaacctgggggtcgggaggagagggtaatagcgctggcggagctgaacgtcccggtcccatgggtgaggcagaaaaaggggcagtgctggcacaggggcagggtgacgggaccgtgtccaagggcggacgtggaccaggaagtcagcacaccaaagaagccgaggacaaaatacctcttgtgcccagcaaagtgtctgtcatcaaggggagtcgttcccagaaagaggctttcccgttagccaaaggtgaggtggacacggcccctcagggcaataaggatttgaagtag

SEQ ID NO: 238316 - DNA, 357 bp, Artificial Sequence
  Description of Artificial Sequence: Synthetic coding sequence
atggcggaggacgagccggatgcaaagagcccaaagactggcggtagggccccaccaggcggtgcagaagcaggggagcccacgacactgttgcagcggcttagggggactatctctaaagcagtgcagaacaaggtggagggtatccttcaggacgtgcagaagttctcggataacgataaactgtacctatatttgcagcttccctctgggcctaccactggtgataaaagttcggagccttcaactctctctaatgaagagtatatgtacgcttaccggtggatcaggaatcacctggaggagcacactgatacatgtctgccaaaacagagcgtgtacgacgcttataggtag

SEQ ID NO: 238317 - DNA, 693 bp, Artificial Sequence
  Description of Artificial Sequence: Synthetic coding sequence
atggctgaagatgaaccggatgcaaagtcacccaagacagggggtcgggcacctcctggaggagccgaagcaggcgaacctaccacgttacttcagcggctgcggggtaccatttcgaaggcagtccagaacaaagtggaaggaattctgcaggacgtgcagaagtttagtgacaacgataaactctatctttatctccagctcccctccgggcctactacaggcgacaagagttctgaaccgagcaccctgtctaacgaggaatacatgtatgcgtatcggtggatccgcaatcacctggaggagcacacagacacctgtttgcccaagcagtctgtgtatgatgcctatcgtaagtattgtgaaagtctggcctgttgtcgaccccttagcacggccaacttcggcaaaattatcagagaaatttttcctgacatcaaggcccgacggctcggcggtcgaggccagtccaagtattgttattcaggaatcaggcgcaaaactctggtaagcatgcctccccttccaggtctggatttgaagggttccgagtcccccgagatgggccctgaggtcacacctgctcccagggacgaacttgtggaagcggcttgtgcacttacatgcgactgggctgagagaatcttgaaacggagcttctctagtattgtagaagtagcccgttttctttag

SEQ ID NO: 238318 - DNA, 372 bp, Artificial Sequence
  Description of Artificial Sequence: Synthetic coding sequence
atggccgaggacgaaccagatgccaagtcacctaaaacaggcggacgcgcacccccaggaggggcagaagccggtgagcctacgacgcttctccagagactgcgagggactatatcaaaggcagtccagaataaggtagaagggatattacaagatgtccagaagttctccgataacgataagctgtacttatatctccaattgccaagcggtccaaccactggcgacaaatcctccgagcctagcaccttaagcaacgaggagtatatgtacgcttaccgctggatacgcaaccacctcgaagaacacacagatacatgtttacctaaacaaagcgtgtatgacgcttatcgaaaatactgtgagtcttag

SEQ ID NO: 238319 - DNA, 291 bp, Artificial Sequence
  Description of Artificial Sequence: Synthetic coding sequence
atggcggaggatgagcctgatgccaaatccccaaagaccggcggtcgtgccccacctggtggagcggaggcaggtgagccaacgactctgttgcaacgcctgcggggtactatcagcaaggcagtccagaataaagtcgagggcattctccaggacgtccaaaaattctctgataatgacaagttgtacttgtatttgcagctaccatctggcccaaccaccggcgacaagagcagcgaaccaagcacgttgagcaatgaagagtacatgtatgcttaccggtggatatag

SEQ ID NO: 238320 - DNA, 321 bp, Artificial Sequence
  Description of Artificial Sequence: Synthetic coding sequence
atggcggaggatgagccagatgctaagtcaccaaaaacaggaggcagagcacctcccggtggcgctgaagctggcgaacccactacgttactgcaacgccttcggggtacaatcagtaaggctgtccaaaacaaggttgagggaattctgcaggatgttcagaagtttagtgacaacgataaattgtacctctatctccagctcccttcagggccaaccactggtgacaagtcctccgagccctcaacgctgtctaatgaggaatacatgtacgcataccgatggatacgcaatcacctcgaggaacatacagacacgtag

SEQ ID NO: 238321 - DNA, 555 bp, Artificial Sequence
  Description of Artificial Sequence: Synthetic coding sequence
atggcagaagacgaaccggatgctaaaagccccaagaccggagggagggctcctccaggtggcgctgaggccggagagcccactacactcttgcagcgcctcaggggcacgatttcaaaggctgtgcaaaacaaagtcgaggggattctgcaagatgtccaaaaattctcagataatgacaaattgtacctgtatctccagctgccgagtggtcctaccactggcgataagtcttcagagccctccacactgtcaaacgaggagtatatgtatgcctatcggtggattcgtaatcacttggaagaacatactgatacctgtcttcctaagcagtctgtgtatgacgcctacagaaagtactgcgagtccctggcctgttgccgcccattgtccaccgcaaatttcggaaaaatcatccgcgaaatcttccctgacataaaggctcgacgattaggaggtcgcggtcagagtaaatattgctacagcggcataaggcgcaagacactggtgagcatgcccccactgccgggtctcgatctcaaagggagtgaatag

SEQ ID NO: 238322 - DNA, 1731 bp, Artificial Sequence
  Description of Artificial Sequence: Synthetic coding sequence
atggctgaggacgagcccgatgctaagagccctaaaacaggcggacgtgcccctccgggaggagccgaggccggtgagcctaccacgttgcttcagcgccttcgaggaactataagtaaggccgtccaaaacaaggtagagggtattctccaagatgtgcaaaaatttagcgacaatgacaagctgtacctatatttacagctccctagtggccctacgacaggcgacaaaagaaagtactgcgaatctcttgcatgctgtaggccattgtccaccgcgaactttggcaagatcataagagagatctttcctgacatcaaggcaaggcgcctggggggaaggggccagagtaagtactgttacagcggaatccgcaggaagactctcgtgtcaatgccccctctgcctggtctagatctcaagggatcagaaagccccgagatggggcctgaggtgaccccagctcctcgggatgagctcgttgaggctgcctgcgctctcacgtgcgactgggcagaacgaattctgaaaagaagcttcagttcaatcgtggaggtagccagattcttgctgcaacagcacctcatttctgcacgcagtgcccatgcccatgttttgaaggccatgggcctcgccgaggaagacgagcatgcaccccgtgagagatcaagcaaacctaagaacggcctcgagaatcccgaaggcggagcgcacaagaaacctgagaggctggcccagcctccaaaagacttagaggccagaaccggagcaggtccccttgccaggggagagcgcaagaagagcgttgtcgagagctccgcccctggggcaaataacttgcaagtgaatgcacttgttgccagattacctctgctgctgcccagagccccaaggagtcttattcctccgattcccgtgtccccaccaatacttgcacctagactaagttccggcgctctaaaggtggccactctccctctttcttcgcgcgcaggcgcaccaccagcagccgtgcctattattaacatgatactcccgaccgttccagccttgcctggcccaggccctggaccaggacgtgcccctcctggaggcctgacacaacccagagggactgaaaaccgggaggtaggtatcggcggagaccagggccctcatgataaaggtgttaaacgtaccgctgaggttccggtcagcgaggcttcaggccaagctcctcctgccaaggccgctaagcaggacatcgaagataccgcgtccgatgcaaagcgcaagaggggcaggccaaggaagaagtccggcggatccggtgaacggaactccactccactgaagtcagccgctgcaatggaatcagcacagagtagtaggctaccctgggagacatggggatcagggggagaaggaaattcagctgggggagcagagagacccggacccatgggagaagcggagaagggagctgttttggcccagggacagggagacggtacagtgtccaaaggtggtcgcggacccggatcacagcatactaaggaagccgaagacaaaattcctctcgtgcccagcaaagtgtccgtgatcaaagggagccgttctcagaaggaggcctttccactggccaaaggcgaggtggacaccgcaccacagggcaacaaagatttaaaggaacatgtgctgcagtcgtctttaagtcaggagcataaggaccctaaggccacaccgccttag

SEQ ID NO: 238323 - DNA, 1851 bp, Artificial Sequence
  Description of Artificial Sequence: Synthetic coding sequence
atggctgaggatgagcccgatgcaaagtctccaaaaacaggcggaagagctccacctggcggtgcggaagcaggtgagcctaccaccctcctgcagcggctgcgaggaacaatttcaaaggcagtccagaacaaggtcgagggtattctgcaagatgtccaaaagttctccgacaatgataagctgtacctatacctacaactgccctcaggtccgaccaccggagataagagctccgagccatccactttatctaatgaggaatacatgtacgcatacaggtggattcggaatcacctggaggagcacacagatacgtgcctgcccaaacagtcagtttacgatgcatatcgtaaatattgcgagtcattggcttgttgtcggcctctgagtacagcaaacttcggtaagatcatccgggaaatatttccggacataaaggccagaagactgggcggtcgaggtcagagtaaatactgctacagcggaatccgccgtaaaactctggtcagtatgccccctctcccgggactcgacctgaaggggtccgaatcaccagagatgggaccggaagtgacacccgcacctcgggacgagcttgtagaggccgcatgtgccctgacttgcgattgggctgagcgcattctgaagcggagcttctcatccatagtggaggttgcaagatttctgctccagcagcaccttatctctgcgaggagcgcccatgcacacgtgctgaaggccatgggcttggccgaggaagatgaacatgcccctagggagcggtcttcaaaacccaaaaacgggctggagaacccagaggggggtgcacataagaaacccgagaggctggcacagccccctaaagatctggaagcacgtaccggagcagggccacttgcacgcggagaaaggaaaaagtccgtcgtagagtccagcgcccctggtgcaaataacctgcaggtgaacgcactagttgcacgactgcctttgctcctcccgcgagcccctagatcgctgataccaccaatcccagtcagcccccctatcctggcacctagattgtcatccggcgctctgaaagtggccacgttgccactctcgtcgcgggctggcgcaccgcctgccgctgtcccaatcattaacatgatcctacccactgtgcccgctctgcccggacctgggccagggccaggccgtgcccctcccggaggcctgacccagcccagaggcacggaaaacagggaggtgggaattggcggagaccagggaccacacgacaagggcgtaaagagaactgccgaagttcctgtgtcagaggcatcaggacaggcacctcccgctaaagccgcaaaacaagatatagaagatacagcctcagacgcgaaacggaagcggggacgcccacggaaaaaatctggcggttccggggaacgcaatagtacacccctgaaaagtgcggctgctatggagtcagctcagagttctaggttgccttgggagacctggggctccggcggagaggggaattccgccggaggggcagaacgacctggacccatgggagaggcagagaaaggggctgtgctggctcagggtcagggagatggaactgtctccaaggggggacgcggtcccggatcccagcacacaaaggaggccgaggacaaaatccccctggttcccagtaaggtgtcagtgattaaagggagtagatctcaaaaggaagcattccctttggcaaagggcgaagttgacaccgctccgcaggggaataaggacctgaaggagcacgtgctccagagttcattgagccaggagcacaaggatcccaaggcaacccctccttag

SEQ ID NO: 238324 - DNA, 498 bp, Artificial Sequence
  Description of Artificial Sequence: Synthetic coding sequence
atggcggaggacgaacccgacgctaaatccccaaagactggcggtagagcgcctccaggtggcgctgaagccggtgaacctaccacccttctacagcggttgcgtggcacaataagcaaagccgtgcaaaataaggtggaggggatcctgcaggacgtccagaaatttagcgataacgataaactgtacctttacctgcagctcccaagcggacctaccacaggggacaagagttcagagcccagcacgctgtctaacgaagaatacatgtatgcatataggtggatccgcaaccacctggaggaacatacggacacttgcctcccaaagcaatcagtttatgacgcctaccggaagtactgtgagtcactggcatgctgtaggcccttgagcactgctaatttcgggaagatcattcgcgagatttttcctgatataaaagccaggaggctggggggacggggacagtccaagtactgctatagcggaattaggtag

SEQ ID NO: 238325 - DNA, 2787 bp, Artificial Sequence
  Description of Artificial Sequence: Synthetic coding sequence
atggccaaagtacctgagctggaggacacattcttacaagcccaacctgcccctcagctctcccctggcattcaggaggactgttgtgttcagctccttggcaagggattgctggtataccctgaggaaacagtgtacctggccgcagaaggacagcccggaggtgagcagggcggaggggaaaagggcgaagaccctgagctcccaggagccgtcaaatccgagatgcatctgaacaacggcaacttctcgtcggaggaagaagatgccgacaatcatgactcaaagaccaaagcggctgatcagtacctgtcacagaagaaaactataacccagatcgtgaaggacaaaaaaaaacagactcagctgacgcttcagtggttggaagagaactacattgtttgcgaaggcgtgtgtctccctcggtgcattctgtacgcccactacctggacttctgcaggaaagagaaactggagcccgcatgtgccgcaacgtttgggaagaccatccgccaaaagtttcccctattgacaaccaggagactgggtacccgtggacacagcaagtatcactattacgggatcgggatcaaggaatccagcgcatactaccactcagtctacagcgggaaaggcctgactcggttctccggctctaagctcaagaacgagggcggtttcacccgaaaatattctctgtcttcaaagacaggcaccctcctccctgagtttcccagcgcccagcacttggtgtaccaaggttgcatttccaaagataaagtggacacactgataatgatgtacaagacacactgtcagtgtatcctggacaacgccatcaacggtaacttcgaggagatccagcacttcctcttacacttttggcaggggatgccagatcaccttctgcctttactagagaacccagtgataattgacattttttgcgtttgcgattctatcctgtataaagtgctcaccgacgtactgatacccgctacaatgcaggaaatgccagagtctttactcgcagatatccgcaacttcgctaaaaattgggaacaatgggtcgtgagcagcctggaaaacctgcctgaagctctgacagacaaaaagatccctattgtgaggagattcgtctcaagcctcaagcgacagacctcattcttacaccttgcccagatcgcacgtccagccctgtttgatcagcacgtggtaaactctatggtcagcgatatcgagcgggttgatcttaacagtataggatcacaggcactgctgactatatctgggtctacagacaccgagagcgggatctataccgagcacgattccataaccgtgttccaggagctgaaggacctcctcaaaaagaacgcaaccgttgaagcttttattgagtggttggacacagttgttgaacaacgtgttatcaaaacctcaaaacagaacggccgttccctgaaaaaaagggcccaggatttcctgcttaaatggagttttttcggtgccagggtcatgcacaatctgactctcaataatgcgtcctcgtttggaagcttccacttgatccgcatgctgcttgacgagtacatactgctggccatggaaacacaatttaataacgacaaagagcaggagctgcagaatttgctggacaagtacatgaagaattcggacgccagcaaggccgctttcaccgcgtctccgagctcatgtttcctcgctaaccgtaataagggctcaatggtatcctcggatgcggttaagaatgaaagccatgtggaaaccacttacctgcctctgccatcttcccagcctggcggtctcggcccagcacttcaccagttcccggcaggaaatacggacaatatgccacttaccggacagatggagctcagtcaaatcgctgggcacttgatgacaccaccaattagccctgccatggccagtcggggaagtgtgattaaccagggccctatggccggaaggcctccatctgtgggacccgtgctctccgccccatcccactgttcaacctatcctgagcctatttatcccaccttgccacaggccaatcacgacttttattcgacttctagtaactatcagacagtgttccgcgcacagccgcattctacatccggtttgtatcctcaccacactgagcatggtaggtgtatggcatggacagagcagcagttgtcaagagactttttcagcggcagttgtgcaggaagtccatataatagtcgcccaccgtccagctacggaccctcactgcaggctcaggatagccataatatgcagttcctaaacaccggctcttttaactttttgagcaataccggggcagcatcgtgccagggagcaactttgcctcccaacagtccgaacggctactacggttccaacatcaactaccctgaaagtcacagattggggagcatggtgaatcagcatgtctcagtgatcagctcaatcaggtccctcccaccatattccgatatccacgatcctctgaacattttggatgatagcgggagaaagcagacgtcatcattctacaccgatacctcatcccctgttgcgtgccgcacccccgtccttgctagcagtcttcagacaccaatcccatcctcgtcaagccagtgtatgtatgggacttctaaccaataccctgcccaagaaaccctagatagccacggaaccagttcaagagagatggtgagtagtttacccccaattaacactgtgttcatgggtaccgctgccggaggcacatag

SEQ ID NO: 238326 - DNA, 4122 bp, Artificial Sequence
  Description of Artificial Sequence: Synthetic coding sequence
atggctgaagagcaacagcagccacctccccagcaacccgatgctcaccagcagttgcccccttccgctcccaacagtggcgtggctttgccagcccttgttccaggattacccggaacagaggcctccgctctccagcacaagatcaagaactcgatttgcaagactgtgcagtccaaggtggattgcatcttgcaggaagtggaaaaattcacagatctagagaaactctacctgtacctgcagcttccatcaggactttcaaacggagaaaagtcagaccagaatgcaatgtcctcaagccgggctcaacagatgcacgccttttcctggattcgcaatacgctcgaagagcaccccgagacttctctcccgaagcaggaagtctatgacgaatataaatcatattgtgacaatttgggctaccacccactttctgctgcagatttcggtaagatcatgaagaatgttttccctaatatgaaggccagacgccttggtactaggggcaaatccaagtactgctactccgggctccggaaaaaagctttcgttcacatgcctacattgcctaatctggatttccacaagacaggcgacggactcgagggcgcagaacctagcgggcagctgcaaaacatcgacgaagaagttatttcctcagcgtgtaggctcgtctgcgaatgggcccaaaaggttttatctcaaccttttgatacagtgcttgaactggccagatttctcgttaagagtcactatattggcacaaaatccatggcggcattaactgtgatggcagctgccccagctggaatgaagggcatcactcagccatctgccttcattcctacagccgaatcaaatagcttccaaccccaggtaaagaccttgcctagccctattgatgccaagcagcaactacagcgaaagatccagaagaagcagcaggaacagaagctacagtcccccctgccaggtgagtctgccgctaaaaagagtgaatcagccacctctaacggcgttacgaacctacccaatggcaacccctccattcttagtcctcagcccatcggcattgtggttgccgctgtgccgtcccctatcccggttcagaggaccaggcagctggtgacgagcccatctcctatgtctagctccgatggtaaggttctgccgctgaatgtgcaggtggtaactcagcatatgcagtctgtgaagcaggccccaaagaccccccagaacgtacccgcttctcccggaggagacagatccgcacgacacagatatccccagatacttccaaaaccagccaatacctctgctctcacaattagatccccaactactgtgctcttcacatcatctcctatcaaaacagccgttgtgcccgcttcacacatgtcaagcttgaatgtagtgaagatgaccactatttcattgaccccaagcaactccaatacgcccctgaaacacagcgcctccgtatcttcagccacaggcaccaccgaggaatctcgctctgtcccgcagataaaaaacggctcggtggtatctctccaaagtcctgggagtagatcttcgtcagctggtggaacatcagcagtagaggtcaaagtggaaccagagacatctagcgatgaacaccctgttcagtgccaggagaactcagacgaagctaaagctccccaaacaccctctgcgctgctcgggcagaagagcaacacggacggagccctccagaagcccagcaatgaaggggtgatcgagatcaaagcgacaaaagtctgcgatcaacgaactaaatgtaaatccaggtgcaacgaaatgcttccgggaacttcaacagggaacaaccagtcaactattaccctcagcgtggccagccagaatttgacttttactagctcatcgtctccaccaaacggcgactcgattaacaaggatcctaagctttgcaccaagtctcctaggaaaagactgtcctctacactccaggagacacaagttccacccgtaaagaagcccattgtcgaacaactgtctgccgctaccattgagggccaaaagcagggctctgtcaaaaaggatcagaaagtgccacactcagggaagacagaggggagcacagcgggtgctcagatcccatctaaagttagtgtgaatgtctccagccacatcggagctaatcagcctttgaattctagcgctcttgttatctctgactctgccctcgagcaacagactacacccagcagcagtccagatattaaggtgaagctggaaggctcggtgttccttttagattcggactccaaatctgtgggttcattcaatccgaatggttggcaacagataacaaaggactccgaattcatatcagcatcatgtgaacagcagcaggatatcagcgtgatgactatacccgaacatagcgacattaatgatctggaaaaaagcgtttgggaattggaggggatgcctcaagatacctactcccagcagctgcactctcagattcaagagtccagcctcaaccagatccaagcccattccagcgatcagctgcctcttcaatcagagctgaaggagtttgagccatctgttagtcagactaacgaatcatacttccctttcgacgacgagttgactcaagattctatcgtcgaagaactggtcctcatggaacagcagatgtctatgaacaactcgcattcatacggtaactgtctgggtatgaccttacaatcccaaagtgtaactcctggggctccaatgagcagccatacctcttccacccatttttaccaccccatccattccaacggtaccccaattcatacaccaacacccactcctacccctacccccaccccgacgcccactcctacgcccaccagcgagatgatcgccggttcacagagcctgtcacgcgaatctccttgcagccgactggcccaaactacacctgtagactctgcgctcggatcgagtcggcacacgcccattgggaccccacatagcaactgctcgagctctgttcctcctagccctgtggaatgcaggaaccccttcgcctttacccccatttcaagcagtatggcatatcacgatgctagcatcgtcagcagctcgcccgtgaaacctatgcagagacccatggcgacccatcccgacaaaacaaaactggagtggatgaataacggctattccggagttggaaatagctcggttagtgggcacggcatcctcccatcctaccaagagctggttgaagatcgtttcaggaagccacatgcattcgccgtaccaggacagtcgtaccagtctcagagcagacaccacgatacgaattttggccgactcactcccgtctctcctgtccagcatcagggcgctaccgtaaacaacacaaacaaacaggaagggttcgccgtacctgctcctttggacaacaagggcacaaattcttctgcgtcttccaatttccggtgtcggagcgtctcaccggctgtccataggcaacgaaacctgagcggatccaccctctatccggtatcgaatatccctcgctctaatgtgactcctttcggcagcccagtaacccctgaggtgcacgtctttacaaacgtgcacaccgacgcatgcgctaacaatattgcacaaagatctcaaagcgtgcccctcactgtgatgatgcaaacagcattcccaaatgcgctgcaaaagcaggcgaattcgaagaaaataactaatgtcctcctgagcaagctagacagcgacaacgatgatgccgtgagaggactggggatgaacaacctcccgagcaattacaccgctcgcatgaatctgacccagatcctcgaaccaagcacggtgtttcccagtgccaaccctcaaaatatgatcgactcctctaccagtgtctacgaattccaaacaccttcttatctgaccaagtctaacagcacaggacagattaacttctctcccggagataatcaggctcagagcgaaataggggagcaacagctggattttaattccacggtgaaggaccttttatcgggagattccctacagactaaccagcaattgaagtatcctgatgtcctgggtgagtag

SEQ ID NO: 238327 - DNA, 3846 bp, Artificial Sequence
  Description of Artificial Sequence: Synthetic coding sequence
atgtcctcgtccagagcccaacagatgcatgcattctcatggatcaggaataccctggaggagcacccagagacatccctcccaaagcaggaggtatacgacgagtacaagagctactgcgacaacctgggctaccatcccctttcagcagccgatttcggaaagattatgaagaatgtatttcctaatatgaaggctaggagacttggtactcggggaaagagtaagtattgctacagcggactgcgaaagaaagcattcgtccacatgcccacccttccaaaccttgacttccacaagacgggtgatggtctagagggggcagaacccagtggccagctccagaacattgacgaagaggtaatctcctcagcctgcaggctggtgtgtgaatgggctcaaaaggttctatcacagcccttcgataccgttcttgaactggcgagattcttggtgaaaagccactacatcggtaccaaatccatggccgcactgaccgtgatggccgctgctcctgccggaatgaaaggtattacgcaaccgtccgcttttatcccaacagcagaatctaactcgtttcaaccacaagtgaaaactcttccgtcccctatagatgcaaaacaacaactgcagcggaaaattcagaagaagcagcaagagcagaaactccagagtcccttgcctggtgaatccgctgccaaaaagtccgagtcggcaactagtaacggtgtgactaacctccctaacggcaatccgtctatactctcgccacagccgatcgggatcgttgttgcagctgtcccatcccccatccccgtgcagcgcacacgtcagttagtgacctccccctcgcccatgtcttcttctgatggcaaggtgctacctctaaacgtgcaggtggtgacacagcacatgcagtcggtgaagcaggctcctaagaccccccaaaatgtgccagcgtccccaggcggagatcgctctgcacgccacagataccctcagattctacctaaacccgcaaatacgtcagccttgaccattcgttcacctacaacagttttgtttacctcatcccctatcaagaccgccgtggtcccagctagccatatgagcagcctgaacgtcgttaagatgaccactatctcacttacccccagtaatagcaacacccccctcaagcattccgcttcagtcagctccgctaccggaaccacagaagagtctcgatctgtccctcagataaagaatggatccgtggtcagcctacagtctcctggaagtaggagtagctccgcaggcggaactagtgcagtggaagtgaaggtcgaacccgagacttcttcagatgagcatcctgtgcagtgccaggagaattcagacgaggctaaggcccctcagacaccatctgcgttgttgggtcagaagagcaataccgacggcgcactgcagaaaccatctaacgaaggcgtcatagaaatcaaagccacaaaggtatgtgatcagagaaccaaatgcaaatcacggtgcaatgagatgttgcctggcacttcaaccgggaataatcagagtacgatcactttgtctgtagcctcccagaatctcacttttacctcttcgagcagtcccccaaatggtgatagcatcaataaggaccccaaactctgtacaaagtctccccgtaagcgtctcagctccacactccaagagacacaagtcccacccgtcaaaaagcctatagtggagcagctgtccgcggcaacaattgaaggacagaagcaaggcagcgtgaagaaagatcagaaggtcccacactcaggaaagaccgaaggatccacagccggagcccagatcccaagtaaggtgtcggttaacgtttcaagtcacatcggagccaaccaacccctcaattccagtgccctggtgatcagtgattctgctctggagcaacagaccactcccagcagttcacccgacataaaggtcaagctcgagggatccgtgttcttgcttgattccgactccaaatctgtaggcagctttaatccaaacggttggcagcaaatcacgaaggattccgaattcatttcagcctcatgtgagcaacagcaggacatctcggtcatgacaattccggagcactctgacatcaatgatctcgaaaagtcagtttgggaattggagggaatgcctcaagatacatacagtcagcagctgcatagccagattcaggagtcctcactcaatcagatccaagctcactcctccgatcagttgccattgcagagcgagcttaaagaatttgaaccatcagtgtcccagaccaatgagtcctatttccccttcgacgatgaactgacccaggattccatcgtggaagagctggtgctcatggagcagcaaatgtccatgaacaattcacacagctatggtaactgtctcggaatgaccctacagtcccagtctgtcaccccaggcgctccgatgtcttcacacacttcctccacgcatttctaccacccgatacacagcaacggcaccccaatccatactcccacccctactccaacgcccaccccaacccccacacccacgcccactcctacgtctgagatgatagcaggcagccagagtcttagcagggagagcccatgttcaagactggcccaaactacaccggtcgattcagcgttaggcagtagcagacacactccaatcgggactcctcattctaattgttcaagctctgtgccgccatcacccgtcgagtgcagaaatccgtttgcatttaccccaatttccagctcaatggcgtatcacgacgctagcattgtgagtagctctccggtgaaacccatgcagagacccatggctacacaccccgataaaactaagctggagtggatgaacaacggctattccggtgtcgggaattcatccgtttccggtcacgggatcttaccgagctatcaagaattagtcgaagaccgatttaggaagcctcacgccttcgccgtcccaggccaatcctatcagtctcagagcagacatcatgatacaaatttcgggaggctcactcccgtgagccctgttcagcaccagggagccactgttaacaacaccaataaacaggaggggttcgctgtcccagcccctctggataataagggcactaacagctccgccagtagtaactttaggtgccgatcagtgtctcctgcggtccatagacaacgcaacctgtccggctcaactctttatcccgtttccaatatcccacgctctaatgtgactcctttcggtagtccagtcacaccagaagtgcatgtgttcaccaacgtgcacacggacgcctgtgctaacaatatagctcagcgatcacagagcgtgcctctgactgttatgatgcagactgcctttccaaatgccttgcagaaacaagcaaactccaaaaagatcaccaacgttctgctaagcaagttggatagcgataatgatgatgccgtccggggtctaggaatgaataatctcccctcaaactacaccgctaggatgaacctcacccagatcctcgagcctagtacagtctttccgtctgccaatcctcaaaacatgattgacagctccacaagtgtttatgagttccagactcccagttacctgaccaaatctaacagcaccggccagattaacttcagccccggtgataatcaagcgcagagcgagattggggaacagcaactggatttcaatagcactgtgaaagatctcttgagcggcgattccctccaaactaatcaacagttatgttcctgcccttcatccctgcttgcaggtatgcagatgtag

SEQ ID NO: 238328 - DNA, 4383 bp, Artificial Sequence
  Description of Artificial Sequence: Synthetic coding sequence
atggcggaggagcagcagcaacctccgcctcagcagcctgacgctcaccagcagctgccgccatctgctcctaacagtggcgttgctcttcctgccctcgtgccaggactgcccggaaccgaggccagtgccctccaacataagatcaagaactctatctgtaagaccgtgcagagtaaagttgactgtatcctgcaggaagttgagaaatttactgatctggagaagctttatctctatttgcagcttccatcaggattatccaatggagagaagagtgaccagaatgcaatgtccagctcccgtgcgcagcagatgcatgctttctcctggatcagaaacacgcttgaggaacatcctgaaactagtttacctaaacaggaggtatacgatgagtacaagtcatattgtgacaatctgggctatcacccactgtcagccgctgattttgggaaaattatgaaaaatgtattccctaacatgaaagctcggcgactgggcacgcggggaaagagtaagtattgttattcaggtctgcggaagaaggctttcgtccacatgccaacgcttccgaacctcgatttccacaaaaccggggatggcctcgagggagccgagccctccggccagctgcagaacattgatgaggaagtgatttccagcgcttgccgcctcgtctgcgagtgggcacagaaggtactgtcacagccatttgacaccgtcctggagctggcaagatttctggtaaaaagtcactatataggcacaaagtctatggctgccctcacggtcatggcagccgctcctgcaggcatgaagggaattactcagcccagcgcttttatccctacggccgagagcaatagtttccagccacaagtgaagactttgccatccccgatcgacgctaaacagcagcttcagagaaagatacagaagaagcaacaggagcagaagctccagtcccccctccctggcgagagcgcagctaaaaaatcagaaagtgcgacctccaacggggtgaccaatttaccaaacggcaaccccagcatcctgagcccccaaccaattggcattgtcgtggccgcagtgccaagccctatccccgttcagcgcacgagacagctggtgacgtccccatcacctatgagctccagcgacgggaaagtcttaccactgaatgttcaggtggtaactcaacacatgcagtcagttaaacaggcaccaaagacaccacagaatgtgcccgcttcgccaggcggagaccggtctgccagacaccggtatccacaaattctgccaaaacccgcaaacacgtctgctctgaccatccgctccccaactactgtcctgtttacgagctcacccatcaaaacggccgtggttcctgccagtcacatgtcttccctgaacgttgtgaaaatgaccacaattagtctcaccccatccaactccaacacaccattgaaacatagtgctagcgtgtcttctgctactgggaccaccgaggaaagccggtcagttccacaaataaagaatggatctgtagtatcgctgcagtctcccggatcgcggagttcatccgccggaggaacaagtgcagtggaggtgaaagtcgagcctgaaacctcctctgatgagcatcctgttcagtgccaggagaacagtgatgaggcgaaggctccacagacgccatctgcgctgcttggacagaagtcaaatacagatggtgcattacagaaaccttctaacgagggcgtgatagaaatcaaggccaccaaggtgtgtgatcagagaactaaatgcaagtcccgttgtaacgaaatgctccccggtacctcaacaggaaataatcagagtactattaccctttcggtggcatcccagaacctaacgtttactagtagtagttcccctccaaacggggattcaatcaacaaagatccaaaactgtgcacaaagtcaccaagaaagagattgtcctcaaccctccaggaaacacaggtccctcccgtaaagaagcccattgtcgagcagctgagcgctgctacaatcgagggccagaaacaggggtccgtgaaaaaggatcaaaaggtccctcatagcggcaaaaccgagggaagtactgccggagctcagatccccagcaaagtctccgtgaatgtgagcagccacataggagccaaccagccattaaattccagcgccctggttatttcagactcagcactagagcagcagaccacccccagctcctcccccgacattaaagtgaagctggaggggtcagtgtttctgctcgacagtgattccaaatccgtaggttcatttaaccccaatgggtggcagcagattacgaaggattccgagttcatttctgccagctgtgagcaacagcaggatattagtgtgatgacaattcctgagcactccgatatcaacgacctggagaaatctgtttgggagctggaaggcatgccccaggatacgtactcccagcagctgcattcacagattcaggagtcttccctgaaccagatccaggcgcattcatccgaccagctcccactccagtccgaattaaaggagtttgagcctagcgtgagccagaccaacgaatcttacttccctttcgacgacgagctgacacaggattctattgtcgaggagttagtccttatggaacagcagatgtcaatgaacaattcgcattcttacggcaactgcctcgggatgacgctccagagccaatcagtgactccgggtgcacccatgagctcgcataccagtagtacgcacttctatcatccaatccacagtaacggcactcccatccacaccccaacacctaccccgacccccacccctacaccgacaccaaccccaacccccacgtccgaaatgattgcgggttctcagtccttgtcccgcgaaagcccgtgtagccgtttggctcagacgaccccagtggattcagcgttgggctctagccggcacacgccgattggaacaccacactctaactgcagtagctctgttccacctagccccgtagagtgtcgcaatccttttgccttcacaccaattagcagcagcatggcttatcatgatgccagcatcgtttcgagctctcctgttaagccaatgcagcgacctatggccacacacccagataagaccaagttggaatggatgaacaacggatactcaggggttggaaactcaagtgtgagtggccacggcatactgccttcatatcaggagctggtggaagacagatttagaaaaccccacgcattcgctgtgcctgggcagtcttaccaatcgcagagccggcaccatgacaccaattttggcagactaactcctgtgagtcctgttcaacatcagggcgcaacagttaacaacaccaacaaacaggagggtttcgcagtccccgctcccctcgataataaagggactaactcctcagcctctagcaacttccgctgcagaagcgtgagcccggcagtgcatagacagcgaaatctgagtggttctaccttgtaccctgtttcaaatatccctcgcagcaacgtgactcccttcggctcccctgtgacccccgaggtccatgtcttcaccaatgtccatacagatgcctgcgctaacaatatcgcgcagaggagtcagtccgtgcctctgaccgtgatgatgcagacagcctttcctaacgccctgcagaaacaggctaactccaaaaagattacgaatgtacttctgtccaaacttgatagcgataacgacgatgccgtgcgtgggctcggcatgaacaatcttccatctaactatactgcccgtatgaatcttacacagatccttgagccatcaacagtgttcccttcagcaaatcctcagaacatgattgattcgtctactagcgtgtacgagtttcagactcctagctacctgacaaagtccaactctacaggtcagatcaacttcagccccggagacaatcaggcccaatcagagatcggcgaacaacagctggactttaatagtactgttaaggacctacttagcggcgactctctgcagacaaaccagcaactcgtcggacagggcgcatccgatctgaccaatactgcgagtgacttcagctctgatataaggttatccagcgaacttagtggctctatcaacgatctgaatacactggatcccaacctgttatttgatcctggcagacagcagggacaagatgacgaggctaccctggaggagttgaaaaacgatcccctttttcagcagatctgttctgagtccatgaactctatgacctcttccggctttgaatggatcgagtcaaaggatcatccaacagtggagatgttaggctag

SEQ ID NO: 238329 - DNA, 4092 bp, Artificial Sequence
  Description of Artificial Sequence: Synthetic coding sequence
atgagctccagccgcgctcagcaaatgcacgccttctcttggatacgcaacacactggaagagcaccccgagacctcactgcctaaacaggaagtttacgacgaatacaagagctactgtgataacctaggctatcaccccctttccgccgcagacttcggcaaaatcatgaaaaacgttttccccaacatgaaggctcgcaggctcggtaccaggggcaaaagcaagtactgctactcaggactgcggaagaaagctttcgtgcacatgcctactctgcctaacctggatttccacaaaaccggggatggtctggaaggtgcggaaccttccggacagctgcagaacattgatgaggaggtgataagcagcgcttgtcggctcgtgtgtgagtgggcccaaaaggtcctctcacagcccttcgacactgtgctggagttagcccgattcttagtgaagtctcattacatcggcacaaaatcgatggcagccctcactgtgatggctgccgctccggctgggatgaaaggtattacccaaccgagtgccttcattcccacggcagagagtaattcctttcagcctcaggtgaagaccctccccagcccaatagatgcaaagcaacagcttcaaaggaagatccagaagaagcagcaggagcagaaactgcaatcccccttgcctggggagagcgctgcaaaaaaatccgagtccgcaacctcaaatggggtgacaaacctccccaatggcaatccaagtatcctgtcccctcagccaatcggcatcgtggtagccgctgtcccctccccgatccccgtccagcgcacaaggcagttggtcacatcaccaagccccatgagtagtagcgacgggaaagttctgcctttgaacgttcaagtggtgactcagcatatgcaatccgtgaagcaggccccaaaaactccccaaaatgtgcctgcatccccagggggagaccggtcagccagacacaggtacccccagattctccctaagccagccaacaccagtgcgctgaccatccggtctcctaccacagtgctcttcaccagttcacctattaagaccgcagtcgtgcccgctagccatatgagctccctgaacgtcgtcaaaatgaccacgattagccttacaccatcaaattctaacacaccgctaaagcacagcgcatccgtgtcatctgcaacggggaccactgaggagtcaaggagcgtgccgcaaatcaagaatgggagtgtggtgagcctgcagtcacccggatctaggtctagcagcgctggaggaacttccgccgtcgaggtcaaggtggaaccagaaacttcctctgatgagcaccccgtgcagtgccaagagaactctgatgaagctaaagccccacagaccccaagcgctttacttggacaaaaatctaacaccgatggggcactgcagaagccgtctaatgagggggtaatagagattaaggcaacaaaagtgtgtgaccagcggaccaagtgcaagtccagatgcaatgaaatgctccctgggacttctacaggaaacaatcagagtactatcacactttctgtggcctcacagaatttaacattcacctcttcgagctcccctcctaacggagattctattaacaaagatcctaaattgtgtactaagtctccaagaaaacggctttcctccacattgcaggaaacgcaggtgccgccagtcaagaagccaatagtggaacaactttctgccgcaactatcgaggggcagaagcagggatctgtgaaaaaagaccagaaagtcccacatagcggaaaaactgagggctcaaccgctggtgcccagatccccagcaaagtgtcggtcaatgtctccagccatattggcgctaaccagcctctgaactctagtgccctggtaatttcagattccgcactagagcagcagactacaccgagcagctcgcctgacatcaaggtgaaactggaagggtcggtcttcctgttagacagcgattcaaagagcgttggtagcttcaatcccaatggctggcagcaaataaccaaggacagcgaatttatcagcgcttcttgtgaacagcagcaggatattagcgtgatgacgattcccgaacactctgatataaacgatctagagaagagcgtgtgggaacttgaaggcatgccccaggacacgtacagtcagcagctccattctcaaatacaggaaagctccctgaatcaaatccaagctcacagctctgaccaactgccactgcagtcagagttgaaggagttcgaaccgtcagtgagccagaccaatgagagctactttcctttcgacgatgagctgacacaggattctattgtcgaggaactggtgttgatggagcaacagatgagcatgaacaactctcatagctatggaaattgtctgggcatgactttgcagtcccagagcgtgaccccgggtgctcccatgagcagtcacacatcatctactcatttctatcatcctatccactccaacgggactcccattcacactcctacaccaacaccaacccctacgcccacacctacaccaactccgactccaactagcgaaatgatagctggctcacagtcattgagccgagaatctccttgcagccgtttggcccagaccacacccgtggatagcgctctcggttcctcgcgccacacccctatagggacccctcattccaattgctcatcaagcgtacccccttctcctgttgagtgtaggaaccctttcgccttcactccgatcagctcaagtatggcctaccatgacgcctcaattgtgtcctccagcccagtgaagccaatgcaaaggccaatggcaacgcaccctgacaagaccaaacttgagtggatgaacaacggatacagcggagtgggtaattcctctgtgtccgggcatggcatactaccatcctatcaggagctcgttgaggaccggtttaggaaaccacatgcttttgcagtccctggccaaagttaccagtcccagtcccgccaccacgatacaaacttcggtcggctgactcctgtgagtcctgtgcagcaccaaggtgcgaccgttaataacacaaataaacaggaggggttcgccgtgcctgccccactcgataacaagggcaccaatagctcagcaagttcgaatttccgttgtagatccgtatccccagcagtccacagacagcgtaatctctcaggttctaccctgtaccccgtttcaaatattcccagatctaacgtcacaccatttggctctcccgtcacacctgaggttcacgtgttcactaatgtccacactgatgcctgcgctaataatatagcacagcgttctcaatcggtccccctgactgtgatgatgcagacagcatttccaaacgccctccaaaagcaggcaaacagtaaaaagatcactaacgtcttactgtcaaagttggacagcgataacgatgatgccgtgagaggactcgggatgaacaatctgcccagcaattatacagcgaggatgaatttgactcagatccttgaaccctcgacagtgtttccgtctgctaatccccagaatatgatcgattcatctactagtgtgtacgagttccaaactccatcatacctgacgaagagtaactccaccgggcaaatcaacttctcaccgggagataatcaggcacagagcgaaatcggggagcagcagttggactttaacagcactgtcaaggacctcctctctggcgactcgctgcagacgaatcagcaattggtgggccagggcgcatccgatctgacaaatacggcttctgatttcagttccgacatccgtttgtcatctgaactcagcgggtctattaatgatttgaacactctagaccccaatctgctgtttgatccagggaggcaacagggccaggacgacgaggccacgttggaagagctaaagaacgatcctcttttccaacagatatgctctgagagtatgaacagcatgacctcgagtgggttcgagtggatcgagtccaaagatcatccgaccgtcgaaatgctcgggtag

SEQ ID NO: 238330 - DNA, 783 bp, Artificial Sequence
  Description of Artificial Sequence: Synthetic coding sequence
atggagctcactcagcccgctgaagatctgatacaaacccagcagactcccgcttccgaactgggcgacccagaagacccaggtgaggaggctgccgacggcagtgacacagtcgtgctttcgctattcccttgcacccctgaacccgttaaccccgagccggacgcgagcgtctcatcaccacaagccggaagttctcttaagcattccactaccctgacaaataggcagaggggcaacgaggtgtcagccctaccagctacactagactcgctgtccatccaccagctggctgctcagggggagcttgaccaattgaaagagcacctccggaagggagacaacttggtgaacaagcctgacgagagaggatttactcctttgatttgggcttccgctttcggtgagatcgagaccgtgcgatttttgctggagtggggggcagacccccatattcttgcgaaagaacgcgaaagcgctctgagcctggcaagtacaggaggctacactgacatcgtcgggctccttctggagcgcgatgtggatataaatatatatgactggaacggcggaacccctctgctgtacgccgtccgaggaaaccatgtaaagtgcgtggaagccctcctggctagaggagctgatctgacaaccgaagccgattctggctataccccgatggacttggcggtggcattgggctaccgaaaggtgcagcaagttattgagaatcacattcttaagctcttccagtctaatctggtacctgcggatcctgagtag

SEQ ID NO: 238331 - DNA, 714 bp, Artificial Sequence
  Description of Artificial Sequence: Synthetic coding sequence
atggaacttactcagcccgctgaggatttgattcaaacacagcagacccccgcatctgaactgggggacccagaagacccgggagaggaggcagctgacggtagcgatactgtcgttctgtccctgtttccgtgcaccccggagcccgtgaatcctgaacctgacgctagcgtgagtagcccacagggaagctcacttaaacactcgaccacgttgactaaccgacagcgagggaacgaggtctctgccttgcccgcaaccctggattgcgacaacctggtcaacaagcctgatgagcggggattcaccccattgatctgggcttcagcgttcggggaaatcgagacagtgagattcctacttgagtggggcgcagacccacatatcctcgccaaagaaagagaatccgcgctgtccttggcatccactggcggatacaccgatatagtgggactactcctggaaagggatgtcgatatcaacatctatgattggaatggcggtaccccactcctgtacgctgtgaggggaaaccacgtgaaatgcgtggaggctttactagctagaggcgcagaccttaccacagaagcagatagtggctatactcccatggacttggctgtggccctcggttatcgaaaagtgcagcaggtgatcgagaaccacatcctcaaattattccagtccaatctggttcctgccgatcctgagtag

SEQ ID NO: 238332 - DNA, 192 bp, Artificial Sequence
  Description of Artificial Sequence: Synthetic coding sequence
atggaactcactcagccagctgaggatctcatccaaactcagcagacccccgcttctgagctgggagaccctgaagatcccggtgaagaagccgctgacggaagcgacacagtggtgctgagcctcttcccttgcaccccagaacccgtgaatcctgaacctgacgcctccgtgtcttctccccaggcttag

SEQ ID NO: 238333 - DNA, 717 bp, Artificial Sequence
  Description of Artificial Sequence: Synthetic coding sequence
atggagttgactcagcctgcagaggacctgattcagacacaacagacacccgcaagcgagttaggcgatcccgaagacccaggggaagaagccgcagacggatctgacaccgtggtgctctctctgttcccatgcactccggagcccgtgaatcccgagcctgacgccagtgtttcctctccacaggcaggttcaagcctgaagcatagcaccactctgactaataggcagcgtggtaacgaagtctctgctctgcccgctacccttgattgtgacaacttggtgaataagcctgacgaaagggggtttacacccctgatttgggcctctgcattcggcgagattgagaccgtgcggtttctcctagagtggggagcagaccctcacattctagcaaaagagagggaatccgcgctcagtctggcctctactggaggctataccgacatcgttggacttctgctcgaacgtgacgtcgacatcaatatttatgattggaacggaggaaccccattgctatacgctgtcagggggaaccacgtcaagtgcgtagaggctctcctcgcacgcggagccgatttgacaacagaagcagacagcggttacacgccaatggatctggctgtggcccttggttatcgtaaggtccagcaggtgatcgagaaccacatcttgaagttatttcagtccaacctggttcctgcagacccagaatag

SEQ ID NO: 238334 - DNA, 819 bp, Artificial Sequence
  Description of Artificial Sequence: Synthetic coding sequence
atggaggctcagggcgtggctgaaggggctggaccgggtgctgcaagtggcgtacctcatcccgcagcattagcaccggcagctgcaccaactcttgcccctgcgtctgtggctgcagccgcttcccagtttactctcctggtcatgcagccatgcgcaggacaggatgaggcagctgctcccggaggcagcgtgggagctggcaagcctgtgcgctacctgtgcgagggcgcaggtgacggtgaggaagaggctggggaggatgaagcggatctgttagataccagcgatcctcccggtggcggagagtctgcggcatctttagaggatctcgaggacgaggagactcattcagggggtgaaggatcttccggcggtgcgcgacgcaggggctccggagggggatccatgagtaagacttgcacatatgagggctgttctgaaaccactagccaagtggctaaacaacgaaaaccatggatgtgcaaaaagcatcggaataagatgtataaggacaagtataagaagaagaaatccgaccaagcactcaattgcggcggaacagcctcgacagggtcagccggtaatgtcaagctcgaggaatccgccgataatatcctcagcatcgtgaaacaacgcactggctcattcggcgatcgtcctgctagacctaccctgctggaacaagtacttaatcagaagaggctatccctgctgaggagccccgaggttgttcaatttctccagaagcagcagcagctgctgaaccagcaggtactggagcaacgccaacagcagtttcctggcacttctatgtag

SEQ ID NO: 238335 - DNA, 1854 bp, Artificial Sequence
  Description of Artificial Sequence: Synthetic coding sequence
atgtcttcgctgcccacctctgacgggttcaaccacccagccagatcttccggacaatctcccgatgttggcaaccccatgagcctggccaggagcgtttctgcctcagtttgccccattaagccaagcgattcagatagaatcgaacctaaagcagtaaaagcacttaaagcctcagctgagttccagctgaactccgagaaaaaagagcatctaagcctgcaagacctgtcggaccacgctagtagcgcggaccatgctcccaccgatcagtcacccgcaatgccgatgcagaatagctccgaggagattaccgttgccggaaacctagagaagagcgctgaaagatcaactcagggcctgaagtttcacctacatacaagacaggaggccagtctttctgtgacgtctaccaggatgcacgagccacagatgtttttgggtgagaaagactggcaccccgaaaaccaaaatttaagccaggtgtcagacccacagcaacatgaggaacccggtaatgaacaatacgaggtggcacagcagaaagcctcgcacgatcaggaatatctgtgcaacatcggagatctcgaactgcctgaagaacggcaacagaaccaacataaaatcgtggatctggaagctacaatgaaagggaatggattaccccaaaacgtcgaccctccgagtgcaaagaagtctatacccagttccgaatgtagtggatgctcaaatagtgagaccttcatggagattgacacggcccagcagtctctggttacactgctaaatagcacgggtagacagaacgcaaacgttaagaacatcggggcattagacctgactctggacaatccacttatggaggtcgagacatctaagtgtaatccgtcaagcgagatcctgaatgatagcatctcaacgcaggacctccaaccccctgaaaccaacgtcgaaattccagggaccaataaggaatacggtcattacagctccccatccttatgcggcagttgccaacctagcgtggagtctgcagaagagagttgtccatccatcacagccgcactcaaagagctgcacgagctcctcgttgtgtcttcgaagccggctagcgaaaacacaagcgaggaggtgatttgccagtccgagaccatcgccgaaggccagacttcaatcaaggatctgtccgagagatggacacagaatgagcacctcacacaaaacgagcagtgcccccaggtgtcgttccaccaggcaatctccgtgagcgtggagacggagaagctcacgggaaccagctccgacacaggacgggaggctgtcgaaaatgttaacttcagatcactaggtgacggcttgagcacggacaaggaaggagtgcccaaaagtagagagagcattaacaagaaccggtcagtgaccgtaaccagtgcaaaaacctctaaccagctccattgtacactaggagtggagataagccctaaactgctcgccggtgaggaggacgcgctcaatcaaacctccgaacagactaagtcactctcttccaattttatcttggttaaggacctggggcagggcatccaaaacagcgtcactgatcgtcctgaaactagggaaaacgtctgccctgacgcgtctcggccactgcttgagtacgagcctcccacttctcatcccagctccagccctgccattctcccgccactcatctttcctgccacagacatcgaccgcatcctcagggctggatttaccttacaggaagctctgggggcacttcaccgcgtgggtggcaacgcagatttggcgctgcttgtgctgctcgcgaaaaatatagtggtgcctacctag

SEQ ID NO: 238336 - DNA, 657 bp, Artificial Sequence
  Description of Artificial Sequence: Synthetic coding sequence
atgagcagcggcgctgccagcggcacaggcaggggccgaccgaggggtgggggacccggacccggtgatccgccaccatcagaaacgcataaactggtggtggtaggcggtggcggtgtcggaaagtctgcccttaccatacagttcatccagtcttactttgttagtgactacgatcctactattgaggacagttatacaaaaatatgcagtgtggatgggataccagccagactggacatcctagacacagccggtcaagaggagttcggagctatgagagaacagtacatgcgggctgggcatgggtttttgctcgtatttgcaataaacgacaggcaatcatttaacgaagtgggtaaactgttcacccaaatcctcagagtgaaggatcgagatgattttcccgttgtgctggtggggaataaggccgacttggagtcccagcgccaggtgcccagatctgaagccagtgcattcggcgcaagccatcacgtagcgtactttgaagcaagcgccaaactgagactgaacgtggacgaggcctttgagcaattggtgcgtgcagtcaggaagtaccaggagcaggagttacctccaagtccgccttctgccccacgcaagaagggaggcggatgcccatgcgtgctgctgtag

SEQ ID NO: 238337 - DNA, 615 bp, Artificial Sequence
  Description of Artificial Sequence: Synthetic coding sequence
atggcagccgcaggatggagagatggttcagggcaggaaaaataccgcctcgtggtcgtcggcggagggggagtggggaagtccgccctgacaatccagttcatccagtcttactttgtgacggactatgaccccacaatcgaagacagttacacaaagcaatgcgtgattgacgatagggcagccagactcgatatcctggacacagccggtcaagaagagtttggcgctatgcgagagcaatatatgcgcacgggcgaaggattcctgctggtgttctctgtgactgaccgcggatcctttgaagaaatctataagtttcagcggcaaatcctcagagtgaaagatcgtgacgaattcccaatgatattgattggaaataaggcggatctggatcaccaacgacaggtcacacaagaagagggccagcagttggctaggcaactgaaggtgacgtacatggaagcctctgctaaaatccgaatgaacgtcgaccaagccttccacgaactggtgcgggtaatccgaaagttccaggaacaggaatgccccccatcgcccgaaccaacacgaaaggaaaaggacaaaaagggatgccattgtgtcattttttag

SEQ ID NO: 238338 - DNA, 384 bp, Artificial Sequence
  Description of Artificial Sequence: Synthetic coding sequence
atgcgcgagcagtatatgagaacaggagagggctttctgctggtcttctccgtgacggaccggggaagtttcgaggagatatacaagtttcaacggcagatccttagagtgaaggacagagatgaatttccaatgatcttaatcggaaataaggcagacctggaccatcagaggcaggtcactcaggaggagggccaacagctggctcgccagctgaaggtgacgtacatggaagcttctgccaagatccggatgaacgtcgatcaggcctttcatgaactagtcagagtcatcagaaagttccaggagcaagagtgcccaccaagccctgagccaacccgcaaggagaaagataagaagggttgtcattgcgtgatcttctag

SEQ ID NO: 238339 - DNA, 384 bp, Artificial Sequence
  Description of Artificial Sequence: Synthetic coding sequence
atgcgggaacagtacatgaggaccggcgagggcttcctcttggttttcagtgttaccgaccggggttccttcgaggagatatacaaattccagcgacagatcctgcgggtgaaagaccgtgacgagtttccaatgattctgatcggcaacaaggccgatctggaccaccaacggcaagtaacccaggaagaaggacagcagctagcacgccagctcaaagtgacgtatatggaggcaagcgccaagattcgaatgaatgtggaccaagccttccatgagctggttcgcgtgatcagaaaatttcaggaacaggaatgcccgccatcccccgaacccaccaggaaggagaaggacaagaagggctgtcattgcgtcatcttttag

SEQ ID NO: 238340 - DNA, 384 bp, Artificial Sequence
  Description of Artificial Sequence: Synthetic coding sequence
atgcgagaacagtatatgcgtaccggggaaggttttctgctggtgttcagtgtgacggaccgcggatcattcgaagaaatctacaagttccagcgacagatcctcagagtgaaggaccgcgacgagttccccatgatccttattggcaacaaggctgatctggatcatcaaagacaggtgacacaggaagaaggtcagcaactggccaggcagttgaaagtgacttacatggaggcctctgcgaaaatccggatgaatgtggaccaagcatttcatgaacttgttagggttatcaggaagttccaagaacaggaatgccctccaagtccagagcccacccggaaagaaaaggataagaagggatgtcactgtgtgattttttag

SEQ ID NO: 238341 - DNA, 210 bp, Artificial Sequence
  Description of Artificial Sequence: Synthetic coding sequence
atgcgagagcagtacatgcggactggcgagggctttctacttgttttttccgtgactgaccgagggagctttgaggagatttataagttccaacgccagatcctgagagtgaaagatcgagacgagttccccatgatcttaattgggaacaaggcggacttggaccaccagagacaggttacccaggaggaaggacaacaattagcctag

SEQ ID NO: 238342 - DNA, 384 bp, Artificial Sequence
  Description of Artificial Sequence: Synthetic coding sequence
atgcgcgaacagtacatgcgaacgggggagggtttcctcctcgtgttcagtgtcaccgacagggggtcgttcgaagagatctataagtttcagaggcagattttaagggtgaaggaccgggacgagttcccaatgatcttaattggcaacaaggcagatctcgaccaccagcgccaggttacccaggaggaagggcagcagctagcgagacagctgaaggttacttatatggaagcctctgctaagatccgcatgaacgtcgatcaggccttccacgagctcgtccgggttatcaggaaattccaggagcaggagtgtccaccaagcccagagccgacccgaaaggagaaagacaaaaagggatgtcactgtgtgatcttctag

SEQ ID NO: 238343 - DNA, 384 bp, Artificial Sequence
  Description of Artificial Sequence: Synthetic coding sequence
atgcgtgagcagtacatgcggacaggcgaaggatttctactagtatttagtgtgaccgaccgcggatctttcgaagagatctataagttccagcgacaaatattacgggttaaggaccgggacgagttcccgatgattctgattggcaacaaggctgacctggaccatcagaggcaggtgacccaggaagagggacagcagcttgccaggcagcttaaggtgacctatatggaagcatcagctaagatacggatgaatgtcgatcaggctttccacgagctcgtgagagttattagaaagttccaggaacaggagtgccctccttccccagaacccactaggaaagaaaaagataagaagggatgccattgtgtaatcttttag

SEQ ID NO: 238344 - DNA, 510 bp, Artificial Sequence
  Description of Artificial Sequence: Synthetic coding sequence
atgagttactttgtgacagattacgatcctaccatcgaagatagctacactaagcagtgtgtgattgacgatagagccgcaaggctagatatcctcgataccgcgggtcaggaagaattcggcgctatgcgcgagcagtacatgcggaccggggaaggatttctgctcgtttttagcgttaccgatcgcggatctttcgaagaaatatataagttccaacgacagatcctgcgcgtgaaggacagagacgaattcccaatgattttgattggaaacaaagcagacttggaccatcagagacaggtgactcaagaggaaggacagcaactagcacgccagcttaaagtgacttacatggaagctagcgcgaaaatccgtatgaacgtggatcaggcatttcacgagctggtcagagtgattagaaagttccaggaacaggagtgtcccccatcaccggagcccacgcgtaaggagaaggacaagaaggggtgtcactgcgtcattttctag

SEQ ID NO: 238345 - DNA, 633 bp, Artificial Sequence
  Description of Artificial Sequence: Synthetic coding sequence
atggccgcagccggatggagggatggctccgggcaggaaaagtataggttggttgtcgttggtggagggggagtcggcaagagcgctttaacgatccagtttatccagttctttctgttcctgcagtcgtatttcgtcaccgattacgacccgacaattgaggattcttataccaaacagtgcgtgattgatgaccgtgctgcgagattggatattctggacaccgcgggtcaagaggagtttggtgctatgagggagcagtacatgcggacaggtgagggcttcctgctggtgttcagcgttacagacagggggagctttgaggaaatttataagttccaaagacagatcctgcgtgttaaggacagagacgagttcccaatgattctgattggaaataaggccgacctggatcatcagaggcaagtgacccaggaagaggggcagcagttggcaagacagctgaaggtgacttacatggaagctagcgccaagatccggatgaacgttgatcaggcattccacgagctggtccgggtcattcgcaagtttcaggagcaggagtgccccccaagtcctgagccaactcgcaaagaaaaggacaagaaagggtgccattgtgtgatcttctag

SEQ ID NO: 238346 - DNA, 633 bp, Artificial Sequence
  Description of Artificial Sequence: Synthetic coding sequence
atgggttgttgctctagtagcgacccacgacgagaagatgacctgagagccagggagaaattgaagaagacaaagattattttcgtggtgggaggtccaggctcaggaaagggcacgcaatgtgagaaaatcgtgcaaaagtatgggtacacgcacttgtctacaggggatctacttcggtcagaagtctcatcgggctcagcaaggggtaagaagctgtccgagattatggagaaagggcaattggtgcccctagaaactgtgttggacatgctgcgggatgctatggtggccaaagtcaatacaagtaaaggattcctgattgatgggtaccccagggaggttcagcaaggtgaggaatttgaacgcagaattggccagccaactctattgctctacgtggacgcagggccagagaccatgacacagaggctcctcaaaagaggggagacgtcgggaagagtggacgacaatgaggaaactattaagaaacgacttgaaacatattataaggcaaccgagcctgtgatcgccttttatgaaaagagaggaatcgtcagaaaagtgaacgcagaaggaagtgtggactctgtcttctcacaagtgtgcactcacctcgacgccctgaagtag

SEQ ID NO: 238347 - DNA, 354 bp, Artificial Sequence
  Description of Artificial Sequence: Synthetic coding sequence
atgcctcgactgttcctctttcacctactcgaattttgcctgttactcaaccaattctctcgggcagtggccgcaaagtggaaggatgatgtgatcaagttatgcggacgcgagctcgtcagagcacagattgctatctgtgggatgtccacctggtccaaacgctctctgtcccaggaggacgcccctcagacacctaggcctgtcgcgggtgacttcattcagactgtgagcctgggtatctctcctgatggtggcaaggcattaaggacgggctcttgcttcacccgcgagtttctcggcgcactcagtaagctgtatcaccccagctccacaaagattcagaagttatag

SEQ ID NO: 238348 - DNA, 429 bp, Artificial Sequence
  Description of Artificial Sequence: Synthetic coding sequence
atggcccgatatatgctgctgctgctgttggcagtttgggtgctgactggcgaactttggcccggtgccgaagcaagggctgcaccttacggggtccgtctgtgtggcagggagtttatccgggcagtcatctttacctgcgggggaagtcgatggcggagaagcgacatcctggcccatgaggcgatgggggatacgtttcctgacgctgatgctgatgaggattctctcgcaggtgagctggacgaggccatgggaagtagtgagtggttagctctgaccaaaagcccccaggctttttaccgagggagacccagttggcagggcaccccgggagtgctgcgcggaagtcgggacgttctggccggtctgtcaagtagctgttgcaagtggggctgttcaaagtcagagatctcaagcctctgctag

SEQ ID NO: 238349 - DNA, 1293 bp, Artificial Sequence
  Description of Artificial Sequence: Synthetic coding sequence
atgaagccttcgcttttgtgtaggccgctgagttgctttctcatgttgctgccctggcccctcgcaacccttacatcaacaaccctctggcagtgcccccctggggaagaaccggacctggatccagggcaggggacattgtgcagaccttgccctccaggaaccttctccgcggcttggggcagcagcccttgtcagccacacgcaagatgctcactgtggaggcggctggaggcccaggtgggaatggcaacaagggataccctgtgtggtgactgctggcctgggtggttcggtccatggggtgtccctcgggtgccatgtcaaccttgtagctgggctccactgggtacacatgggtgtgacgagtggggcagaagagcacgtcgcggtgtggaagtagcggcaggtgcctccagcggcggagaaacaaggcaacccggaaacggtacacgggcaggtggccctgaggagactgccgcacagtacgcagttatagctatcgtgcccgttttttgcttgatgggtctgcttgggattctggtttgtaatttactgaagaggaaggggtatcactgtacagctcataaagaggtcggccctgggcctggcggtgggggatcgggaataaatcctgcctaccggactgaggatgctaacgaagacactatcggcgttctagttcgccttatcaccgagaagaaagaaaatgctgccgctttggaggagctgctgaaagaataccactccaaacagctggtccaaacctcccaccgtcccgtttcgaaattgccaccagccccacccaatgtgcctcacatatgccctcataggcaccacctgcatacggtgcaagggttagcatcactcagcggcccatgctgtagtaggtgttcccagaaaaaatggccagaagttctcctgagtcctgaagctgttgcggctaccacccccgtgccttccctgctgcccaaccccacacgagttccgaaagctggagctaaagccggtcgccaaggggaaataaccatcctatccgtcggaagattcagggtagcgagaatcccggagcaaaggacctcaagcatggtgagtgaagttaaaaccatcacggaggccggaccgagctggggggacctcccggatagtccacagccagggctccctcccgagcagcaggccctgctgggttccggcggaagtcggactaagtggttgaagccacctgccgaaaataaggccgaagaaaacagatacgtcgtgcgcttaagcgagagtaatcttgtcatttag

SEQ ID NO: 238350 - DNA, 1293 bp, Artificial Sequence
  Description of Artificial Sequence: Synthetic coding sequence
atgaagccttctctgttatgtaggccgctatcttgctttcttatgctgctgccttggccattagctacacttacatccactaccctctggcagtgtccaccaggcgaggaacctgatctcgaccccggtcagggaaccctctgccgtccctgcccaccaggcacttttagtgccgcatggggctcgtccccgtgtcagccacacgcccgttgctccctttggcgaagacttgaagcccaggtgggcatggcgacaagagataccctttgtggagattgctggccagggtggttcgggccatggggcgttcctagggtcccctgtcagccatgctcatgggctcctctcggaacccatggttgcgacgaatggggccgacgggcacgtcggggagtggaggtggccgcaggcgcttcaagcgggggtgaaactagacagcctggcaacggtacacgcgcaggtggaccggaagagaccgccgcacaatacgctgtgattgccatcgttcccgtattttgtctcatgggtttgctgggcatccttgtgtgcaatctgctcaagagaaagggataccattgcaccgcgcacaaagaggtgggcccaggccctgggggtggaggctcaggcatcaatcctgcatatcgcaccgaagatgcaaacgaggatactatcggagtgctggtgagactgatcacggaaaaaaaagagaatgcagctgccttggaggaattgctgaaggaataccactctaagcagctcgtccagacctctcaccgtcccgtttcgaagctgccgcctgcaccacctaatgtcccgcacatctgcccacaccgccatcacttacataccgtgcagggcctggcttctctttccggtccctgctgctccagatgctcccagaagaagtggcccgaagtgttgctctcacctgaagccgtggccgctaccacaccggtaccttcactccttccgaatcccaccagggtacctaaagctggggctaaggccggaaggcaaggcgagattacaattctctccgtcggacgctttcgtgttgccagaatccctgagcagcgcacatcctcaatggttagcgaggtgaaaacaatcactgaggccggtccatcctggggagatctgcccgacagcccacagcctggtctcccacctgagcagcaagccctcttgggatcaggcggttcgagaacaaagtggctgaagcctcctgctgagaataaggcagaggaaaacaggtacgtggtgaggctgagtgagtctaatctggtgatctag

SEQ ID NO: 238351 - DNA, 897 bp, Artificial Sequence
  Description of Artificial Sequence: Synthetic coding sequence
atgcatcctggttgctgggtgcaggaagctctagtacttaatcatgaaggagacatgggattctccgaacctgggagtcacatctgtagagctcttggtgggctatctccgaaatgtacatgctcagggcctcttaggagacctggtctcccatctgcaggccgttcctggttctcttctggcgtgaggttgccgccttccccaggatcaggaccattttcctcgcccggtatcaacccagcatacagaaccgaggacgctaacgaggatactatcggcgtgctggtgcgcttgatcaccgaaaagaaggagaatgccgctgcactggaagagctgctaaaagagtaccactccaagcagctggtgcagaccagccacagaccagtgagcaaactgccaccagcacctccgaatgtgccacacatttgcccacatcgccaccatctgcatactgtgcaagggcttgcatccctgtctggaccatgctgcagccggtgttcccagaagaaatggcccgaagtcctcctgtcgcctgaggctgttgcagctacgacccctgtcccatccctgttgccaaaccccacacgagtgccaaaggctggcgctaaagccggtcgccagggagaaattactatcctaagtgtcgggaggtttcgcgttgcccgaattcctgaacaaagaactagctccatggtgtccgaggtcaagacgatcactgaggccggaccatcgtggggggacctgccggactctccgcagccaggcttaccgcctgaacagcaggctcttctggggtccggagggtctagaactaagtggctgaagccacctgctgagaacaaagcagaggaaaaccgctatgtggtgcggctgtcggaatcaaacctggttatttag

SEQ ID NO: 238352 - DNA, 306 bp, Artificial Sequence
  Description of Artificial Sequence: Synthetic coding sequence
atgaagccatctctgttatgccgtccgcttagctgcttcttgatgctcttgccatggcccctggcaactcttacctccacaacactttggcaatgcccacccggtgaggagccagatttggacccaggtcagggaacactatgccgcccttgtccgccaggcactttcagtgcagcctggggatcaagtccttgtcagccgcacgcacgatgttccttatggagacgcttagaggcccaggtcggcatggccactcgagacaccctgtgtggcgattgttggcccggttggtttgggccatggtag

SEQ ID NO: 238353 - DNA, 4325 bp, Artificial Sequence
  Description of Artificial Sequence: Synthetic coding sequence
atggctactgccgctgccgcagccgcagttatggcccctccaggctgccccggatcctgcccaaactttgcggtggtttgctcatttctggagcgatatgggccactcctagatctcccagaactgccgttcccagagttggagagagtcctccaagctcctcctccagatgtgggcaacggtgaggtgccaaaggaattggtggaactgcatctgaagctgatgaggaaaataggaaaatctgttacagctgatagatgggaaaagtaccttatcaagatatgtcaagaatttaacagcacatgggcatgggagatggagaagaaggggtacctagaaatgtcggtggagtgtaaactagcgctgctaaaatacctttgcgaatgccagttcgatgataatcttaagtttaagaatatcatcaacgaagaggacgccgatactatgcgattgcaacccattggtcgggacaaggacggcctgatgtactggtaccaattagatcaggaccacaacgtgcgcatgtatattgaagagcaagacgatcaggacgggtcctcatggaagtgtatcgtgagaaaccgaaacgagttggctgaaacactggcactgctcaaagctcaaatcgacccagtgctgctgaaaaacagtagccaacaagacaattcttctcgcgaaagtccctccctggaagatgaagaaaccaagaaagaggaggaaacaccgaagcaggaagaacaaaaagagtctgaaaaaatgaagtcagaggaacagcctatggatcttgagaatcgcagtaccgctaacgtgttggaggagacgacagtaaaaaaagagaaagaagatgaaaaagaactcgtgaaattacctgttattgttaagttggagaaaccactgcctgaaaatgaagagaaaaagattattaaagaagagagcgattcgttcaaggaaaatgtaaagcccatcaaggtggaagtgaaggaatgtcgcgctgatcccaaggacacaaaatcttcaatggagaagccagtggctcaggaacccgagcgaatcgagtttggagggaatataaagtccagccatgagattactgaaaaatctactgaggaaactgagaaactaaaaaatgaccagcaggcgaagatccccctgaagaaaagagagatcaaactcagtgacgatttcgatagccctgttaagggccctctttgcaagtccgttaccccaaccaaggaattcctgaaagacgagattaaacaagaggaggagacgtgcaagcggatctccacaatcacagcactgggccatgagggcaagcagctcgttaacggggaggtttcggatgaacgcgtggcaccaaacttcaaaacagaacccatcgagaccaaattctacgagacgaaagaggagtcttacagcccaagcaaggacaggaatattataactgagggcaacggcacagagagcctgaattcagtgataactagcatgaagacaggtgagttggagaaagagacggcgcctctgcgtaaagatgctgattctagcatttccgtactggaaatccattcccagaaagctcagattgaagaacccgacccaccagaaatggaaaccagcctggactcaagcgaaatggcgaaagatctgtcgtccaagacagccctgtctagcaccgaaagctgtactatgaagggcgaggagaaatcacctaagacaaagaaagataaacgacccccaatattggagtgtttagaaaagttggaaaagagtaaaaagacctttcttgataaggatgctcagaggctctcaccgatccccgaagaagtccctaagtcaactctagaaagcgagaagccgggaagtccagaggccgcagagactagccccccatccaacattatcgatcactgcgagaagctggcctccgaaaaggaggtggtagagtgtcagtctactagcaccgtgggtgggcaaagcgtgaaaaaggtcgacctcgagacactgaaagaagatagtgaatttactaaggtagaaatggataatctcgacaatgcgcagacatctggaattgaagagccctccgaaacgaagggcagcatgcagaaatcgaagtttaagtataaactggtgcccgaagaagagacaactgccagtgagaatacagagattacttcggaacggcagaaggaaggaattaagctaacaatacgcatctctagtaggaaaaagaaacccgacagccccccaaaagtacttgagccagaaaacaaacaagagaagaccgaaaaggaggaggaaaagacaaacgtcggcaggacccttcggagaagtccccgtatatcccggccaaccgctaaggtggcagagattcgcgatcagaaggccgacaagaagagaggggaaggggaggacgaggtggaagaagaatcaacggccctgcagaaaacagacaaaaaagaaatcctgaaaaaaagcgagaaggacactaattcgaaggtctcaaaagtgaagccaaaggggaaagtaagatggacgggaagtagaactaggggcagatggaaatactcttccaacgatgagagtgagggatcaggatcagaaaagtcgtcggcagctagcgaggaagaagaggagaaagagagcgaggaagctatccttgccgatgacgacgaaccatgcaagaaatgcggcctccctaatcatcccgaactgattcttctgtgcgattcttgcgacagtggctatcacactgcctgtctcaggccgccactcatgatcatcccagatggagaatggttttgccccccatgccagcacaagttgctttgcgaaaaactagaagagcagctacaggacttggatgttgcgcttaagaaaaaggagcgcgcagagcgcagaaaagagagattagtctatgtgggcatcagcattgagaatattatccctcctcaagagccagacttctccgaagaccaagaggagaaaaaaaaagattctaagaagagtaaggcgaacctcctcgaaaggagatcaactcggaccaggaaatgcatctcttacagattcgatgagttcgacgaggcaatcgatgaggctattgaagatgacattaaggaagcggatggtggtggcgtgggcagaggcaaggacataagcactattactgggcaccgagggaaggacatctcgacaatcttagatgaagagcgcaaggagaacaagaggccacagcgcgcagcagctgccaggcgcaagaaacgtcggcgtctcaacgacctggactcagattcaaatctagatgaagaagaaagcgaggacgaatttaagatttcagatggatctcaagacgagtttgttgtcagcgacgaaaacccggatgagagcgaggaagatcctccaagcaacgatgactctgacacagacttttgcagtcgaaggcttcgtcgccacccctcccgccctatgcgtcagtcccgcagactcaggcgaaaaactccaaagaaaaagtatagcgacgacgacgaggaagaggagtccgaagaaaatagccgggactccgagtcagattttagcgacgacttctctgatgattttgtcgagacccggaggcgaagatctagaagaaatcagaagcggcagattaactataaggaggactcggaatctgacggatctcaaaagtccctccgtcggggtaaggaaataagacgggtacataaaagacggctaagctcaagcgagagcgaggagtcctatctgagcaaaaacagcgaggacgacgagctggcaaaagagagcaaacgtagcgttcgaaagcggggtcgaagtacggacgagtacagcgaagccgatgaagaagaagaagaagaggagggtaaacccagcagaaagcgcctgcatcggattgagaccgatgaggaagagagctgcgataatgcacacggggacgcgaatcaacctgccagggattcacaacctcgggtattgccttctgagcaggagagtaccaaaaaaccttaccgcattgaaagcgacgaagaagaggactttgaaaatgtggggaaagttggcagtccactcgactatagtctcgtagatctgccttccaccaatggacagagccccggtaaagccattgagaacctcattggcaagcccactgagaaatcccagacacccaaggataactctaccgcaagtgcgtctctggcatcaaacggaacgagtggtggtcaagaggcaggtgcgccagaggaagaagaggacgaacttcttcgggtaaccgatctcgtcgattacgtatgcaattctgaacagcttta

SEQ ID NO: 238354 - DNA, 4233 bp, Artificial Sequence
  Description of Artificial Sequence: Synthetic coding sequence
atggcgaccgccgcagctgctgcggctgtaatggcaccccctgggtgtcccggaagctgtcccaatttcgccgtggtgtgtagctttctcgaaagatatggtcccctgcttgatcttccagagctgccattccccgagctggaaagagtcctacaggcccctcctcccgatgtcggtaacggggaggtgcccaaagaacttgtggaactccatctgaagttaatgcgtaaaatcggcaaatccgtcaccgccgaccgctgggaaaaatatctcattaaatacttgtgtgagtgccagttcgacgacaatctaaagttcaagaacattattaacgaggaggatgcagacaccatgagactccaacctatcggcagagacaaagatgggcttatgtactggtaccagctggaccaggatcacaatgttcgtatgtacattgaggagcaagatgatcaggatggttcctcctggaagtgcatcgtgcgtaatcgaaacgagctagctgaaaccttggctctgctgaaagcccaaatagacccagttctacttaagaatagctcccagcaggacaacagcagccgggagtcacccagcctcgaagacgaggagaccaagaaagaggaagaaacaccaaagcaggaagaacagaaggagtcagaaaaaatgaaatcagaagaacaaccaatggatctggagaatcggtcaactgccaacgtgctcgaagagactactgtcaagaaagagaaagaggacgagaaggagctggtcaaactccccgtgattgtgaagctggagaaacccctgccggagaacgaagaaaagaagatcattaaggaggaaagtgattcctttaaggagaacgtgaaaccaattaaagtggaagtcaaggagtgtagggctgacccaaaagacacaaagtcttctatggaaaagccagtcgcacaggagccagaacgtatcgaatttggcggtaacataaagagctctcatgaaattactgagaaaagcaccgaagaaacagagaagcttaagaacgatcaacaggcgaaaatcccactaaaaaagcgcgaaatcaagttgagtgacgactttgacagtccagtgaagggacccctgtgcaaatcagtgacccccaccaaggaattcttgaaagatgaaatcaagcaggaagaagagacctgtaaaaggatctctactattactgccctcgggcatgagggcaagcagctggtaaatggggaagtctccgatgagagggtagcacctaacttcaagactgagccaatagagacaaagttctacgaaaccaaagaagagagctattccccgagtaaggatcgtaatattataactgaaggcaacgggactgagtccttgaacagtgttattacctcgatgaaaacaggagaacttgagaaggaaactgcccctcttagaaaggacgccgattcctctatcagcgtgctcgagattcactcacagaaggcccagatagaggagcctgatccccctgaaatggagaccagcttggattcttccgaaatggctaaggacctgtccagcaagacagcgctgagctcaaccgaatcttgcacaatgaaaggtgaagaaaaatcacctaagactaagaaggataagagaccacccatactggaatgcttggaaaaactggaaaagtctaagaagacatttctggacaaagacgcacaacgtttgtcaccaatcccggaagaggtacccaagtctactctggagtccgagaagccgggaagcccagaggcagctgaaacttctcccccaagcaatattattgatcattgcgaaaaactggcctcggaaaaagaggtcgttgagtgtcaatcaacgagcaccgtggggggacagtccgtaaagaaagttgatctggaaactctgaaggaggatagtgaatttacaaaagtagaaatggacaacctggacaatgcacaaaccagtggaattgaagagccatctgaaaccaaggggagcatgcagaagtccaagtttaaatacaaactggtgcctgaagaagaaaccacagcctctgagaacactgaaatcaccagtgagcgacagaaggagggcattaaactcactatccgaatttcttcacggaagaaaaagcctgactcaccaccgaaggtgttagaacctgagaataagcaagaaaaaacagaaaaggaagaagagaaaacgaacgtagggcgaaccctgcgtcgatctccacgtattagcaggcccacagccaaggttgccgaaatccgcgatcagaaggcagacaagaagaggggtgaaggtgaggacgaggtagaggaggagtctaccgctttacaaaagactgataagaaggagatcctcaaaaagtccgagaaagataccaactctaaggtgtcgaaggtgaagccgaaaggcaaagtccgttggaccggttctaggaccagaggccgatggaagtactcctctaatgacgaatcagagggaagcggaagtgagaagagctctgctgcaagcgaggaggaggaagaaaaggaatcagaggaggcaatcctggccgatgatgacgaaccatgcaagaagtgcggcctccctaaccacccggagttgatcctgctgtgcgattcctgcgattctggctaccatactgcctgtcttcggccacccctgatgattataccagacggtgagtggttttgccccccttgtcaacacaaactgttatgtgagaagctggaggagcagcttcaggaccttgacgtggccttgaagaagaaggagcgcgcagagaggcgtaaggagaggctggtatacgtcggtattagcattgaaaacatcatcccccctcaggagccagacttttccgaggatcaagaagagaaaaaaaaagattccaaaaaatctaaagctaacctcttggagagacgctcaaccagaaccaggaaatgcatatcttacagatttgatgaattcgacgaagccattgatgaagccatagaggatgatattaaagaggcggacgggggtggagttggacgaggcaaggatatcagcacaatcactggacacagagggaaagacatctctaccattcttgatgaagaaagaaaggaaaacaagagaccacaaagagctgctgccgcaagacggaaaaaacgcaggcgcctcaatgatttggatagcgacagcaatcttgacgaggaggagtctgaggacgagtttaaaatatcagacgggtcccaagacgaattcgtggtgtcagatgagaacccagatgagagcgaggaagatcctccatccaatgacgacagcgataccgatttttgctctcggaggttgcgcagacacccctcacggcctatgcgacaatcccgcagactcagacggaaaacccctaagaagaaatactccgacgacgatgaggaggaagagtcagaggagaactcgagagacagcgagagtgactttagtgacgatttttcagatgattttgtggagacccggcgtcggaggagtagacgcaaccaaaagagacagataaactataaagaggactctgagtctgacggcagtcagaaatctttgcgtagggggaaggagatacggagagtccacaagagaagactttccagctctgaaagcgaagagtcatatctgagtaagaactctgaggacgatgaactggccaaggagagcaagagatcagtccgtaagagagggagatctacagacgaatattcagaggccgatgaggaagaagaagaggaagaggggaagccaagccgaaaacggcttcatagaatagagaccgacgaggaagagtcttgtgataatgctcatggcgatgccaatcagccagcaagggacagccagccccgagtgcttccaagcgaacaggaatccacgaaaaagccatataggattgagtccgatgaggaggaggactttgagaatgtaggaaaggtcggcagcccactcgactattcgttagttgacctgccatccacaaatgggcagtctcccggaaaggctattgagaatctgataggcaagcctaccgagaagtcacaaacccccaaggataattctaccgcctccgccagtctggcaagcaacggcacgtccggcggacaagaggcaggcgcacccgaggaggaagaggacgagctgctaagggtgaccgacctggtggattatgtgtgcaactctgaacagctatag

SEQ ID NO: 238355 - DNA, 3570 bp, Artificial Sequence
  Description of Artificial Sequence: Synthetic coding sequence
atgaaatcagaagaacagcccatggacttggagaatagatcgacagccaacgtcctcgaggaaaccacggttaagaaagaaaaggaggatgaaaaggaactggttaagctccccgtcatcgtgaagttggagaaaccattgccagaaaatgaagagaaaaagatcattaaggaagaaagcgacagcttcaaagagaatgtgaaacccatcaaagtcgaggtgaaagaatgccgtgctgaccctaaagacactaagtcaagcatggagaaaccggtagcacaagagcccgaaaggatagaatttgggggtaatatcaagagtagccacgagataaccgagaagtcaacggaagaaacagaaaagttgaagaacgaccaacaagctaaaatcccacttaaaaaacgcgagattaagctgagtgacgactttgacagtccagtcaagggacctttgtgtaagagcgtcacccccacaaaagagtttctcaaagatgagatcaaacaggaagaggaaacttgtaagcggatcagcacgatcacagcgcttggccatgaggggaagcagctcgttaacggtgaggtcagcgacgagagggtggccccaaattttaaaacagagccgatcgagaccaaattctatgaaaccaaggaagagtcctatagtcccagcaaggaccgtaacatcatcacggaaggtaatggcactgaaagcttaaactctgtcattacctcaatgaaaaccggagaactcgagaaggagactgcccctctgcgtaaagacgccgactccagcatttctgtactggaaatccattcacagaaagcacagattgaagagcctgatcctcccgagatggaaacatcgcttgatagctctgagatggctaaggacctcagctctaagaccgcgctgtctagcacggagtcgtgtactatgaagggggaggaaaaaagccctaagaccaagaaggacaagaggccacctatattggagtgcttagagaagctggagaagtctaaaaagacctttttagacaaagatgcccaacggctgagtccaattcccgaagaagtgcctaaaagtacccttgagagcgaaaaaccaggttcgcctgaagccgcagaaactagtcctcctagcaacatcatagatcactgcgaaaagctcgcaagcgaaaaggaggtcgtggaatgtcagagcacctctacagtgggtggtcagtctgtgaaaaaagtcgatctggaaacactgaaagaagactcggaattcacaaaggtagagatggacaacctggataatgcacagacaagcggaattgaagaacccagtgaaactaagggctcaatgcagaagagtaaattcaagtataagttggtacccgaagaggaaacaactgcttctgaaaacacagagattacctcggagcggcagaaagaaggcatcaagctgacaattcgtataagttcacgaaaaaaaaagcctgattcaccaccaaaagttctggagcccgaaaataagcaggagaaaactgagaaggaggaggaaaaaaccaacgtgggcaggactctccgaagaagcccccgtatctcaaggcccacagcaaaggttgccgaaatccgggatcagaaggccgataaaaagcggggagaaggagaggacgaggtcgaagaggagagcaccgccctgcagaagacagataagaaagagatattgaagaaaagcgagaaggatacaaacagtaaggtttcaaaagtcaaacccaagggtaaggtccgatggacaggaagtcgtacacgcggtagatggaaatatagttccaacgacgaatccgaagggtccgggtccgagaaatcttccgccgcttccgaggaggaggaggaaaaggagagtgaggaggctattctggctgatgatgatgaaccatgtaagaagtgcgggctacccaatcacccagagctcatattgctctgcgacagttgtgactcaggatatcataccgcttgtcttcggccaccgctgatgatcatccctgatggcgaatggttttgtcctccctgccaacacaagctcctgtgtgagaaacttgaggagcagctccaggacctggacgtggccctgaagaagaaagaacgggcagagcggcgaaaagagcgattagtctacgttggcatctctatcgagaacattattccaccccaagaaccagatttttccgaggatcaggaagaaaagaagaaagactcaaagaagtccaaagctaacctgctggagaggcggagtacccgcacaagaaaatgcattagttacaggtttgatgaatttgacgaagctatcgacgaggcaatcgaggatgatatcaaggaagctgatggaggcggtgtgggccgaggcaaggatatttcaacaatcacaggacatcgcggaaaagacatcagtactattttggatgaggagcggaaggaaaataagaggccccagagggccgctgccgctaggaggaagaagcgacgccgtctgaacgatctagactccgattccaatttagatgaggaggaaagcgaggacgaattcaagatttcagatggttcccaggatgagttcgttgtgtcagacgagaacccggacgagtccgaggaggatcctccttctaacgacgatagcgatactgatttctgctcccgcaggctgcgtaggcacccatcaagaccaatgcgccagagccggagattacggaggaagacacccaagaagaagtatagcgatgatgatgaagaggaggagtctgaagagaatagtcgggattcagaatccgatttctccgacgatttctcggacgattttgtcgagacgcggcgaaggcggtcacgacgaaaccaaaagcggcagattaattacaaggaggacagcgaatctgatggaagtcagaaaagtctccgcaggggtaaggaaatccgcagagtgcacaagcggaggctcagcagctccgaaagcgaagagtcgtatttaagcaaaaatagcgaggacgatgaactggcaaaagagagcaagagatccgtaaggaagagaggtcggtcgactgatgaatattctgaggctgatgaggaagaggaagaggaagaaggcaaaccttcccgcaagcgtctacaccgcatcgagactgacgaggaggagtcctgtgacaatgcccacggcgacgctaatcagcctgcccgagactctcagccacgggtgctccctagtgagcaggagagtaccaaaaaaccgtaccgtattgagagtgatgaggaggaggactttgagaatgtcgggaaggtgggatctcccctggactattccctggtggatctgccctccacgaacggccagagtcccggaaaagctattgagaacttgatcgggaaacccactgagaaatcccagacccctaaagacaatagtaccgcatctgcaagtttggccagtaatgggacttcaggaggccaggaagcgggtgcgccagaagaagaggaggacgagttactgcgagttaccgatctggtggattatgtgtgtaatagcgaacagctgtag

SEQ ID NO: 238356 - DNA, 2412 bp, Artificial Sequence
  Description of Artificial Sequence: Synthetic coding sequence
gaaacactcgctctactgaaggcccaaatagatccagttctactaaagaatagttctcagcaggataatagctcccgggagtctccgtctctggaggatgaggagactaagaaagaagaggaaaccccaaaacaggaggagcagaaagagagtgagaagatgaaaagtgaggagcagccaatggatcttgagaaccgaagcaccgctaatgtgcttgaagagacaacagtgaagaaggaaaaggaagacgagaaggaactagtcaagctccctgtgatagtgaagcttgagaagccccttcccgaaaatgaagaaaaaaaaatcatcaaggaggagagcgactccttcaaggagaacgtaaaacccattaaggttgaagtgaaggagtgtagagctgacccgaaggacacaaagtctagtatggagaagcctgtagctcaggaacccgagcgcattgagtttggtggtaatattaagtcttcacacgagataactgagaagtctactgaagaaacagagaagctcaagaatgatcaacaggcaaaaattcccctaaagaaacgggagatcaaactgagcgacgactttgattctccagtgaaaggaccactgtgtaaaagcgtgactccaacgaaggaattcttgaaagatgaaattaaacaggaggaggagacctgtaaacggataagtactatcacagctctggggcatgagggaaagcagttagtgaatggagaggtctccgacgaaagagtggcccctaacttcaagactgaaccgatcgagaccaagttctacgagactaaagaggaaagttacagtccctcaaaggatcggaatatcatcaccgagggaaacggaaccgaatccctgaatagcgtgattacaagcatgaaaaccggagaactcgagaaggagacagccccactgcggaaggacgctgactcttccatctctgtgctcgagattcactctcagaaagcacagatcgaagagcctgatcccccagagatggagacttcactggacagctctgaaatggctaaagacctcagctcaaaaacagccctctcaagcactgagagctgcacaatgaaaggcgaagagaagtcacccaaaaccaagaaagataagcggcctcccatcctggagtgcctggagaagctggagaagagcaagaagacctttcttgacaaggatgcccagagactcagtcccatccctgaggaggtgccgaaaagcacccttgagagtgagaagcccggttcaccagaggccgcagagacttctcccccatcaaatattattgatcattgcgagaaactggcgtctgaaaaagaggtcgtcgaatgtcaatcaacgagcaccgttggcggacaatccgtaaagaaagtagatctggagacgcttaaggaagacagtgagtttacgaaggttgagatggataaccttgacaacgcacagaccagcggaatcgaagagcccagcgagactaaggggagcatgcaaaagtccaagttcaaatacaaactggtgccggaagaggaaacgacagcaagcgagaatactgaaattacaagtgaaaggcagaaggagggcattaagcttacaattcgaataagttctcggaaaaagaagcctgacagccctcctaaagtattggagccagagaataaacaggagaaaaccgagaaagaggaagagaaaacgaacgtgggcaggaccttgaggcgcagcccccgaatcagcagaccaacagcaaaagtagccgagatccgggaccaaaaagcggataagaagaggggtgaaggagaggatgaggttgaagaagaatctactgctctccagaagacagacaagaaggaaatcctgaagaaatccgagaaagatacaaacagcaaggtttctaaagtgaaacctaaaggaaaagtacgatggacaggcagccgcacaaggggccgttggaagtattcctctaatgacgagagtgaaggctcaggctccgagaaatccagcgctgcttctgaagaggaagaggagaaagaaagtgaagaagcaattcttgctgacgatgacgaaccgtgcaagaaatgcggattgccaaatcacccagaactgatattactttgcgactcctgtgattctgggtaccacacagcctgcctccgcccaccccttatgattatacctgatggtgaatggttttgtcctccatgtcaacacaagctgctgtgcgaaaagctggaggaacagctacaagacctggatgtcgctctgaagaaaaaggaaagagctgagcggagaaaggagagactggtttatgtcggaatttccattgagaacatcataccccctcaggagccagacttttcggaagaccaggaagagaagaaaaaagatagcaaaaaatag

SEQ ID NO: 238357 - DNA, 2109 bp, Artificial Sequence
  Description of Artificial Sequence: Synthetic coding sequence
gcaactgcggcagctgctgccgctgtcatggcacctccaggatgtcctgggtcatgtcctaacttcgccgtggtctgcagctttctggagcggtatggtcctctgctggatcttcctgaactgcctttccccgagcttgagcgcgtgctgcaagctccccctcctgacgtgggcaacggtgaagtgccaaaggagctggtcgagctgcaccttaagctaatgcgaaagatcggaaagtcagtgaccgcagatcgttgggagaagtacctgatcaaaatttgccaggaattcaactcaacttgggcttgggaaatggagaaaaaaggctacctcgaaatgtcggtggagtgcaaactggccctgttaaaatacctctgtgagtgtcagttcgacgataatctcaagttcaaaaatattattaatgaagaagacgctgatacgatgcgcctgcagccgatcggaagggacaaggatggcttgatgtactggtatcagctcgaccaagaccacaatgttcgcatgtatatagaagaacaggatgaccaggacggttcttcttggaagtgcattgtgcgtaatcggaatgagttagcagagacattggctctgctgaaggctcagatcgatcccgtcctcttgaaaaacagctcccaacaggacaacagtagtcgggaaagcccttctctggaggacgaagaaactaaaaaagaagaagagactcccaagcaagaggaacagaaagaaagcgagaaaatgaagtctgaggagcagccaatggacctggagaaccgctccaccgcaaacgtgttggaggaaaccactgtaaagaaagaaaaagaagatgagaaggagctcgttaaactccctgtgatagttaagttggaaaaaccactgccagaaaacgaagagaagaagattatcaaggaagagtctgatagctttaaagagaacgtgaaaccaatcaaagtggaagtgaaggaatgcagagccgatcctaaggacactaaatcatccatggagaaacctgtggctcaggagcccgaacgaatcgaattcggcggtaatattaagtcttctcatgaaattaccgagaagtctactgaggagaccgaaaagttaaagaacgatcaacaggctaagattcctctcaagaaacgggagatcaagctgtcagacgatttcgacagccctgtcaagggtcccctgtgcaagtcagtgaccccaactaaggagtttttgaaggatgagatcaagcaagaagaggaaacttgtaaaaggatctcaactatcacagctctgggtcacgagggcaaacaactcgtcaatggcgaggtgtccgatgaacgtgtggcacctaacttcaagaccgagccaatcgagactaaattttatgaaaccaaagaggaatcctattcgccgtcaaaagataggaacattattaccgagggcaacggaaccgaatctctgaactccgtgatcacgagcatgaagacaggagagctcgagaaggaaaccgctcccctgcgtaaggatgccgatagctcaatctctgttctggaaatccactctcagaaggcacagattgaggaacccgatcccccagagatggaaacttcactggactctagtgagatggcgaaagacctgtccagtaaaactgccctgtctagtacggagagttgcactatgaaaggtgaggagaagtcacccaagactaagaaggacaagcgccctccaattctggagtgtctggagaagctcgagaagtctaagaagaccttccttgataaagacgcccaacggctttcacccatcccagaggaggtgcccaagtcaaccttggaaagcgagaaacccggttcacccgaggctgccgaaacttcgcccccttcaaatattatagaccattgcgagaagctggcgagtgaaaaggaggtggtggaatgtcagagcacaagcaccgtcggcggtcaaagtgtgaagaaagtggacctcgaaacactcaaggaggactctgagttcaccaaggtcgaaatggacaatctggacaacgcacagacctcaggaatagaggaaccttctgagactaaaggatcaatgcagaaatag

SEQ ID NO: 238358 - DNA, 831 bp, Artificial Sequence
  Description of Artificial Sequence: Synthetic coding sequence
gaaccctgtaaaaagtgcggactgccaaaccacccagaacttatcttgttgtgcgacagctgcgattctggctatcacactgcatgtctgaggccccctctgatgattatccccgacggagaatggttttgcccaccttgtcaacacaaactcctctgcgaaaagctcgaggagcagctgcaggatctggatgtggcccttaagaaaaaggaaagggcggagcggaggaaggagcgcctggtttatgtgggtatttccatagagaacatcatacctccccaagaacctgatttcagcgaggatcaagaagaaaagaagaaagacagcaagaaatctaaagccaacctgctggaacggaggtccaccagaacacgaaaatgcatttcttacagatttgatgaattcgatgaggcaatcgacgaggcaattgaagatgatatcaaagaagccgatggcggaggcgtagggagagggaaggacatatcaaccataactgggcatagggggaaagatataagcaccattctggatgaggaacgaaaagaaaacaaaaggccacagagagctgctgccgcaagaaggaagaagaggcggcgactcaatgatttggactccgactctaatctggatgaagaggagtcagaagacgagtttaaaattagtgacgggagtcaggacgagttcgtagtgagcgacgagaatccagacgaatctgaggaagatcctcccagtaatgatgacagtgatactgatttctgtagtagacgcttgaggaggcacccaagcagaccaatgaggcagtcaaggcgactgagaagaaaaacaccatag

SEQ ID NO: 238359 - DNA, 1029 bp, Artificial Sequence
  Description of Artificial Sequence: Synthetic coding sequence
atggcccaggttctgatcgtcggggcagggatgaccggttctctctgcgctgccttgcttaggaggcagactagtggacccctgtatcttgctgtttgggacaaagctgaggatagtggaggtagaatgaccactgcctgctctcctcacaatccccagtgtacagccgatctgggcgctcaatatattacttgtacaccacactacgctaagaaacatcaaaggttctacgacgagctgctggcttatggggtgctacgcccactgtcctcacccattgaaggaatggtgatgaaggaaggagactgtaattttgtggctccacagggaatatcatctattatcaagcattatttgaaagaaagcggcgctgaggtatactttagacatcgcgttacacagattaatctcagagacgataaatgggaggtctccaaacagacaggttccccggaacagttcgacctcatagtattaacaatgccagtccccgagattctgcagctgcagggagacatcactacactaatcagcgagtgccagagacagcagttggaggctgtcagctacagtagtagatatgccctcggactgttctatgaagcgggtacaaagatagacgtgccctgggccggtcaatacatcacaagcaacccctgcatccgttttgtgagcatcgacaacaaaaagagaaatattgaatctagtgagattgggcctagtctggtcatacatacaactgtgccattcggagtcacatatctcgagcactctatagaggacgtgcaggaactggtcttccagcagctggagaacatactccctggactcccacagccaatcgcaaccaaatgtcagaaatggcggcactcccaggttacaaatgcagccgctaattgtccgggacaaatgactctccaccacaaaccatttctggcctgtggcggtgacgggtttacgcagtctaatttcgacggctgtataacctccgccctgtgcgtgctagaggccctgaagaactacatttag

SEQ ID NO: 238360 - DNA, 948 bp, Artificial Sequence
  Description of Artificial Sequence: Synthetic coding sequence
atggctcaagtcctcatcgtcggcgctggcatgactggttctctgtgcgcagctctgttgcgacgccagacaagtggtcctctgtacttggcggtttgggataaggccgaagattctggcggacgcatgaccactgcctgttcaccccataaccctcagtgtacagcagacttaggagcgcaatatatcacgtgcacaccccattatgctaaaaaacaccaacggttctacgatgagttactggcctacggcgtgcttagaccattgtccagtcccattgaaggcatggtgatgaaggagggcgactgtaacttcgtggcaccacaaggaatttcatccattatcaagcattatctcaaagaatcaggggctgaggtgtattttcgacatcgggtgacgcaaattaatctccgggatgacaaatgggaggtgtcaaagcagaccggatcccccgagcaatttgacctgatagtgctaaccatgccagtacctgaaatcttgcaactgcagggcgacatcaccactttgatcagcgagtgtcagagacagcagctggaagcagtgagctactcctctcggtacgctctcggacttttctacgaagctggcaccaaaatcgacgtaccctgggccggtcaatacataacaagtaacccatgtataaggtttgtgtccatagacaacaagaaacggaatattgaaagctcagagattggcccaagcctggtgattcacactaccgttccttttggcgtgacctacctggagcacagcatcgaggatgttcaggagctcgttttccagcagctcgagaacatactccctggcctgccacagcctattgctaccaaatgccagaagtggaggcattctcaggtcccatctgctggagtcatccttggctgcgccaagtccccgtggatgatggcaattgggttccccatttag

SEQ ID NO: 238361 - DNA, 699 bp, Artificial Sequence
  Description of Artificial Sequence: Synthetic coding sequence
atggcccaggtcctcattgtgggtgcaggcatgacaggatctctttgcgctgcacttctgcggagacagacctccggcccactctacctagcagtatgggataaggcggaggacagcggcgcagaggtgtactttcggcatcgtgtaacccaaatcaatttacgcgatgacaaatgggaagtcagcaagcagaccgggtcgcctgagcaatttgacctgatagtccttactatgccagtgccagaaatactgcagctccaaggagacataacgacgctgattagtgaatgtcaacggcagcagctcgaggcagtgtcgtatagttcgcgatatgctctgggtctgttttacgaggctggcacgaaaatcgatgtgccctgggccggacaatatattactagcaacccctgcattcgatttgtcagtatcgataataaaaagcgcaacattgaaagtagtgagattgggccatcgctagtgatacacacaactgttcctttcggggttacttatctcgagcactccattgaggatgtccaggaattagtttttcagcaactcgagaacatcctgcctggcctgccccagcctatagctacaaagtgccaaaagtggcgccactctcaggtgccaagtgccggagtgatattggggtgtgcaaagagcccgtggatgatggctattggttttccaatctag

SEQ ID NO: 238362 - DNA, 1221 bp, Artificial Sequence
  Description of Artificial Sequence: Synthetic coding sequence
atggacggatggcgaaggatgccaagatggggcctccttctgctgctttggggatcatgtacctttggcttgcctacagatactacaacatttaagcggatctttctcaagagaatgcccagtatccgcgaatcgctgaaagagaggggagtggacatggcacgcctggggcctgagtggagtcagcccatgaagagacttacgttgggaaacacaacttcttctgtaatacttactaattatatggacacccagtactatggagagatcggcatcggcaccccaccacagaccttcaaggtggtgttcgacacggggagctcaaacgtctgggtgccttcaagtaaatgcagccggttgtacacagcttgcgtctatcacaaattatttgacgcctcagactcttcctcatacaagcacaatggtacagagctgaccttacggtactccaccggaaccgtcagcggctttctctcacaagatatcataacagtaggcggaatcaccgttacgcaaatgtttggcgaggttacagaaatgcctgctctacccttcatgctggcagagtttgacggtgttgtcggaatgggtttcattgaacaggctatcggacgggttactcccatattcgataacattattagtcagggtgtgctgaaggaggatgtgttttccttttattataaccgagatagtgagaattcccagtctttaggaggtcagattgtgctgggcggtagcgacccgcaacattacgaggggaactttcactacatcaatctaatcaaaacaggagtgtggcagattcaaatgaaaggtgtttctgttgggtcctccacccttctgtgcgaggacggctgcctggcactcgttgacaccggagctagttacatttctgggtccacatcaagcatcgaaaaattgatggaggctctgggggcaaagaaacgcctctttgactatgtcgttaagtgtaacgagggtcctacacttcctgatatctcttttcaccttggagggaaggagtacacactaacgtccgccgattacgtgtttcaggagtcttactcttcaaaaaaactgtgtacactggccattcatgctatggacatcccaccaccaacagggccaacctgggcactgggggcaaccttcatccgaaaattttacactgagttcgatagacggaacaataggatcgggttcgctctggccagatag

SEQ ID NO: 238363 - DNA, 1212 bp, Artificial Sequence
  Description of Artificial Sequence: Synthetic coding sequence
atggatggttggcggcgtatgcccagatgggggcttctgttgctcctgtggggatcctgtacatttgggctccctactgacacaaccaccttcaaaaggatcttcctgaagaggatgcctagcatccgggagagtcttaaggagcgaggggtcgacatggcccgactcggcccagaatggagccaaccaatgaagcggcttactctggggaacaccacttcttcagttatcttgaccaactatatggatacccagtactatggggaaatcggcatcggcactcccccacaaacatttaaggtggttttcgatacaggctcctccaatgtgtgggtcccatctagtaagtgttcccggctgtataccgcgtgtgtttatcacaaactctttgatgcatcagactcctcctcctataagcacaatggcacggagctgactctgcgatattcgactggcacggtgagcggttttcttagtcaggatatcattaccgtcgggggtataaccgtaacacagatgtttggcgaggtcaccgagatgcctgctctcccattcatgctggccgagtttgacggagttgtcggcatgggattcatcgaacaggcgatcggcagggtcactcccatcttcgataatataatcagtcaaggggtgctaaaggaggatgttttctccttctactacaaccgtaattcccagagcctcggcggacagatagtcctcggcggatcggatccccagcactacgagggcaactttcattacattaatctgatcaagaccggggtctggcagatacaaatgaagggcgtgagtgttggaagcagcaccctgctgtgcgaagacggatgtttagcgctagtggacacgggcgctagctatatatctgggagcacatccagcatcgagaagctcatggaagccttgggggctaaaaaaagacttttcgattatgttgtcaaatgcaacgaaggaccaaccctgccggacatcagcttccacctgggtgggaaggagtacaccttgacttctgctgactacgttttccaggagtcctactcgtctaagaaattatgtaccctagcgattcacgcgatggacatcccacccccaacaggacccacctgggctctgggcgctaccttcattcgcaaattttacaccgagttcgacagacgtaataatcgcatagggttcgctctcgcgagatag

SEQ ID NO: 238364 - DNA, 978 bp, Artificial Sequence
  Description of Artificial Sequence: Synthetic coding sequence
atggatactcaatactacggcgagatcggcatcgggaccccccctcagacattcaaagttgtgtttgatacgggtagttccaatgtatgggtgccttcctctaaatgttcccggctttatactgcctgtgtttatcataaactctttgacgccagcgattccagttcgtataagcataacgggactgaactcactctgcgctattccacaggaactgtcagtggattcctgtcgcaggatatcatcacagtcgggggtatcactgttacacagatgttcggggaagtcaccgagatgcctgccttgccatttatgctggccgaattcgacggggttgtcggcatggggttcattgaacaagctatcggcagagtgactcccatatttgacaatatcatttcgcagggcgtgctgaaggaggacgtcttctctttctactacaaccgcgacggcgaaaactcacaatctcttggcggacagatcgtcctggggggtagcgatcctcagcactatgaaggaaattttcactacatcaatttgattaaaacaggggtgtggcaaatacaaatgaaaggtgtaagcgtcgggtcaagtacgctcctgtgtgaggacggctgcctggcccttgttgacactggagccagctatatctccggtagcacttcaagtattgagaagctgatggaggccctgggtgcaaagaaacgcctgttcgattacgtggttaagtgtaacgagggtcccactctacctgacatttcattccatttgggtgggaaggagtacacactgaccagtgcagattacgtgtttcaggagtcctatagtagcaagaaactttgcacgctggcaatccatgccatggatattccaccacctaccggacccacttgggccctgggagcaaccttcatcagaaagttttataccgagtttgaccgcaggaacaataggattggcttcgctctagcacggtag

SEQ ID NO: 238365 - DNA, 1284 bp, Artificial Sequence
  Description of Artificial Sequence: Synthetic coding sequence
atgagtaaaggccttccagccagacaggatatggagaaggagcgcgagactctccaagcgtggaaagaacgtgttgggcaggaactggaccgggtagtggccttctggatggagcacagccacgaccaagagcacggtggcttttttacctgcttggggagagagggtagggtgtacgatgacttgaagtacgtgtggcttcagggcaggcaagtgtggatgtactgcagactatatcggactttcgagcggtttagacatgctcagttgcttgatgctgccaaggctggcggtgagtttcttctgcgatacgctcgcgtcgcccctcctgggaagaaatgtgcatttgtcctcactcgagacggtagacccgtgaaggtccagcgcacaatcttcagcgagtgcttctacaccatggcaatgaatgagctttggagggccacaggcgaggtcaggtaccaaacagaggccgtggaaatgatggaccagatcgtccactgggtccaagaagacgcatccggcttgggacgccctcagcttcagggtgctcccgcagccgagccgatggctgtgcctatgatgctgttgaacctcgttgagcagctaggagaagctgacgaagaactggctggcaagtacgcagaactgggcgactggtgcgccagaagaatcttacagcacgttcagagggacggccaagctgtgctagagaacgtgtcggaaggcggtaaggagctgcctggatgccttgggaggcaacaaaacccaggccacacgcttgaggctggttggttccttctgcgccactgcatccgcaagggcgacccagagctcagagcgcatgttatagacaaatttcttctgcttccttttcactcgggctgggatcctgaccatgggggactgttctacttccaagacgccgacaatttttgccctacacagctggaatgggcaatgaagctgtggtggccccactctgaggcgatgatagcatttttaatgggctactcagattcgggcgaccctgttcttcttaggctcttttatcaagtggcagaatatacgttccggcagttccgggacccagaatacggtgaatggttcgggtacctgagccgggaggggaaggtggcactgtcaataaagggaggacccttcaaagggtgtttccacgtgcctaggtgtttggcaatgtgcgaggagatgttaggtgcactgctgtctcgccctgcccctgctcctagccccgcacctacgcctgcatgtcgaggcgcagaatag

SEQ ID NO: 238366 - DNA, 765 bp, Artificial Sequence
  Description of Artificial Sequence: Synthetic coding sequence
atgagtaaaggactaccggcaagacaggatatggaaaaggagagagaaacactgcaggcgtggaaggagcgcgtcggccaggagctggatcgagtcgtagctttttggatggagcacagtcacgaccaggaacacgggggattttttacctgccttggcagagagggccgagtctatgacgatttaaagtacgtatggcttcagggacgacaggtgtggatgtactgccgcctctaccgaacatttgaacgctttagacacgcacagttgctggatgctgcaaaggcaggcggagagttcctcctgcgttacgcacgcgtggcgcctccagggaaaaagtgtgctttcgtcctgacccgcgatggccgtccagtcaaagtccagaggacaatcttctctgagtgcttttacacaatggccatgaacgaactctggagggctaccggggaggtgcggtatcagaccgaagctgtagaaatgatggaccagatcgtgcactgggtccaggaagacgcatccggtctgggcagaccacagttgcaaggagctcctgctgcagaacccatggctgtgcccatgatgttgttgaaccttgtcgagcagctcggcgaggctgacgaagagctggctggcaaatacgccgagctcggggattggtgtgctcggagaattctacagcacgttcaggcaactcggtggaagcctgcgggattttgtagcgtcatagccttcggcaaggctaccccgaactttgagcctacctag

SEQ ID NO: 238367 - DNA, 2355 bp, Artificial Sequence
  Description of Artificial Sequence: Synthetic coding sequence
atggcgcaactcctgaattcaatactgtcagttatcgacgtctttcacaagtatgcgaaaggaaacggagattgtgccttgctgtgcaaggaggaacttaagcagctgctcctcgccgagtttggggacattctgcaacggccaaatgaccctgagacagttgagacaatcctgaatcttctagaccaggaccgcgacggccacatcgattttcacgagtacctactccttgtgtttcagctcgtgcaagcatgttaccataaattggataataaaagccacgggggaagaacgagccagcaagagagaggtcaggagggggcacaggactgcaaattccctggaaacactggcagacagcatcgtcaacggcatgaagaggagaggcagaactctcatcatagtcagcccgaaagacaagacggcgactcacaccatgggcagcctgagcgacaggacagggacagccatcacgggcagagcgaaaagcaggaccgcgactctcaccactcccaaccagaacgacaggacagagactcacaccacaatcagtcagaaaggcaagataaagacttctcattcgatcagtcggagcggcaatcccaagacagtagcagtggaaagaaggtcagccacaaatccacatctgggcaggccaagtggcagggacatatttttgccctgaaccgctgtgagaagcccattcaggattcacattatgggcaatccgagcggcacacgcagcagagcgagacccttgggcaggcgagtcactttaaccaaaccaatcaacaaaaatctggatcctactgtgggcaaagtgagcgcctaggccaggagcttgggtgcggccagactgacagacaggggcagtcatcccactacggccaaacagaccgtcaggaccagtcttatcattacgggcagaccgatcgccagggccagtcatctcactattctcaaacagatcgacaaggccagtcctcccactattcccagcccgatagacagggacaaagttcccattatggacaaatggacaggaaaggtcagtgctatcattacgaccagacgaataggcagggacaggggagccattactcccagcctaacaggcaggggcagtctagtcactacgggcagcctgatactcaagatcaaagtagccattacggacagacggacagacaagatcagagttcccactatgggcagacagagcgtcaggggcagtccagccactatagtcaaatggacagacagggccagggttcgcactacggccagacagacaggcagggccagagctctcactacggccagcctgataggcaaggtcagaactcccactatggacagaccgatcggcagggccagtcatcccattacgggcagacagaccggcagggtcagagcagccactattcccagccagataagcagggacaaagctcccattacggtaaaatagatcggcaagaccagagctaccactacggtcagcctgacggacagggacaatcctcccactacggccaaactgatcgccaagggcaatctttccactacggacagcccgatcggcagggacagagttcccattacagccaaatggaccgtcaaggccagtcgtcccactatgggcagacggacagacaaggtcagtcctctcactatgggcaaacggacaggcaaggacagtcctatcattacgggcagaccgataggcagggacagagctcccactacattcagagccagacgggggaaatacaggggcagaacaagtacttccagggcaccgaaggcacccgaaaggccagctacgtagagcagtcaggccgatccgggcgtctttcccaacagacgccaggtcaagaggggtatcagaaccagggacaaggcttccaatcgcgagattctcagcagaatggccatcaagtttgggagcctgaggaagactcacaacaccaccagcataagctgctcgcgcagatccagcaggagcgccctctgtgtcacaaaggcagagactggcagagttgcagttccgagcagggccaccgccaggcacagactagacagtcacatggcgagggactttcccattgggccgaggaggagcaaggtcaccagacttgggatcggcactcccacgagagccaggaaggcccatgcgggacccaggatagaagaactcacaaagacgaacaaaaccatcagcgtcgagataggcagacccacgaacacgagcaatcgcatcagagaagggaccgccagactcacgaagacaaacaaaatagacagcgtcgggaccggcagacccatgaggatgagcagaaccaccagcggtag

SEQ ID NO: 238368 - DNA, 1320 bp, Artificial Sequence
  Description of Artificial Sequence: Synthetic coding sequence
atggatcgcaagggccagtgctaccactatgatcagaccaaccgccaggggcaagggtctcactatagccagccaaacagacaggggcagagttcacactatggacagcccgacactcaggaccaaagtagtcactacggccagaccgacagacaagaccagtcgtcccattatggccagaccgaacgccagggtcaatccagtcattattcccagatggatcgtcagggtcaggggtcccattacggccaaaccgatagacaggggcaatctagtcactacggacagcccgatagacaaggccagaactctcactacggacagacagatcgccaaggccaaagctcccattacggccaaaccgaccggcaggggcagtcgtcccattactcgcagcctgataagcagggacagagttctcactacggcaaaatagaccgacaggaccaaagctatcactatggacagccagacgggcaggggcagagtagccactatggccagactgacaggcaggggcagagttttcactacggtcagcctgaccgtcagggccagtcttcccactacagccagatggaccgccaggggcagtcaagccactacgggcagaccgacagacagggccagagctcacattatgggcaaaccgaccgtcaaggccagtcttaccactacggccagactgaccgacagggacagagctctcattacatccagtcacagaccggggaaatccagggccagaacaagtatttccaagggactgaagggaccaggaaagcgagctatgtcgaacagagcgggagatcagggcgtctgtcgcagcagacacctgggcaagaggggtatcagaaccaaggccaaggatttcaatcaagggatagccagcaaaacggtcaccaagtgtgggaacccgaggaagattcgcagcatcaccaacacaagctgttagctcagattcagcaagaaagacccctgtgtcacaagggacgggactggcagagctgtagcagtgagcagggacatagacaggctcagacccggcagtcccacggggagggattgtctcactgggccgaggaggagcagggccatcaaacttgggacagacatagccacgaatcccaggaaggaccctgcggcacccaggatcgacgcacccacaaggacgaacaaaatcatcagcggcgagataggcagacacacgaacacgaacagagtcatcagcgcagagatcgccagactcacgaagataagcagaaccggcagcgcagagaccgccagacccacgaagatgagcagaatcatcagaggtag

SEQ ID NO: 238369 - DNA, 1065 bp, Artificial Sequence
  Description of Artificial Sequence: Synthetic coding sequence
atggaggtcgaagcagtgtgcggcggtgctggagaggtggaagcacaagattcagaccccgcacccgcattcagcaaggcccctgggtcagctggccactatgaactcccgtgggtcgagaaatatcgacccgttaagctcaatgaaatagtgggaaatgaggataccgtctccagactggaagtgtttgcaagagaggggaacgtaccgaatatcattattgcaggcccaccagggactggtaagaccacaagcatactttgccttgcacgggcattacttggacctgccctgaaggacgcaatgctcgaactgaacgccagtaacgacaggggaatagatgtggttcggaataagattaagatgttcgctcagcagaaggttaccctcccaaagggcagacataaaatcatcatcctggacgaggcggatagcatgacggacggtgcacagcaggccttaaggcgaacgatggagatctattccaagacgactcggtttgctttggcttgcaatgcctcagacaagattattgagcctattcaatctcgatgtgccgtgctccgctataccaaactcactgacgcccagatcttaacacgacttatgaatgtgatcgaaaaagagcgagttccctacacagatgatggcctggaagctatcattttcaccgcccagggcgacatgcggcaggccctgaacaatctacaatctactttttccgggttcgggttcataaatagtgagaacgtctttaaggtttgcgatgaacctcatcctctgttggtgaaagaaatgatacagcactgcgttaatgcaaatatagacgaggcatacaagatcctggcccatctctggcacctggggtatagccctgaagatattatcgggaacatatttagggtctgcaagacgttccagatggcagagtatctgaagctggagtttatcaaggaaatcggctacacacacatgaagatagccgaaggggtcaatagccttctccaaatggccggtctgctggctaggctctgtcaaaagaccatggcccctgtggcaagctag

SEQ ID NO: 238370 - DNA, 963 bp, Artificial Sequence
  Description of Artificial Sequence: Synthetic coding sequence
atggaagtcgaggcagtgtgcggaggtgctggcgaggtggaggcacaggacagcgaccccgctcccgctttcagcaaagccccaggctcagcgggacactatgagctgccatgggtggagaagtacagacctgtcaaattaaatgaaattgtcggtaacgaggataccgttagtcggctggaagttttcgccagagaaggcaatgtgccgaatatcattatcgctggcccacctggaacgggcaaaactacgtcaatactgtgtttggccagggccctcctcggaccagctttgaaagatgccatgctcgaactgaatgcaagcaatgatagcatgacagacggagcacagcaggcattaaggcggaccatggaaatctattctaaaacaacaagattcgctctcgcctgcaacgcatcggacaagatcatcgagcccattcagtctaggtgcgccgtgcttagatacacaaagctgacagatgcccagatcttgacacggctcatgaacgtcattgaaaaggaaagggtaccatatactgacgatggcttggaggccattatctttacagcacaaggcgatatgaggcaggccctgaacaatcttcaaagtacattctctggctttggctttatcaattccgaaaatgtctttaaagtgtgcgacgaaccacatcctctgttagtcaaggagatgatccagcactgtgtgaacgccaatattgatgaagcttacaagattttagcacatctgtggcatctgggatactccccagaagatatcattggtaacatttttcgcgtgtgtaaaaccttccaaatggccgaatacctcaagctcgagtttatcaaagaaatcgggtacacccacatgaagattgcggaaggcgtaaattccttgcttcaaatggctggtttgctggccagattgtgccagaagactatggcaccagtggcgagctag

SEQ ID NO: 238371 - DNA, 1071 bp, Artificial Sequence
  Description of Artificial Sequence: Synthetic coding sequence
atgtccctttgggtagacaaatatcgcccatgcagcctgggaagactcgattaccataaagaacaagccgctcagctgcgcaatcttgtgcagtgcggggactttcctcaccttttggtgtatggtccaagtggggctgggaagaagacccggattatgtgcatcctccgagagctgtatggcgtcggggttgagaagctgcgaatcgaacaccaaaccattacgacacccagcaaaaaaaaaatcgaaatctctacaattgcttcgaattaccatctggaggtgaatccctcggatgccggaaattcagacagagtggtcatccaggagatgttaaaaaccgtcgcgcagtctcagcagttggaaactaacagccagcgtgatttcaaggtcgtgctgctgacagaggtggacaaactgaccaaggacgcacagcacgcgttgcgaaggacaatggagaagtatatgagtacgtgtaggctgatcttgtgttgtaattccaccagtaaagtgattcctcccataaggtccagatgcctggctgtgcgagtgcccgcaccaagcattgaggacatttgccatgtcctcagcacagtctgtaagaaggagggccttaatctacccagccagctcgctcatcggctcgccgaaaagtcctgcagaaatctccggaaggcattgctcatgtgcgaggcatgccgggtacagcagtacccgttcactgccgaccaggaaatccctgaaacggactgggaggtgtatttgcgcgaaacagcaaatgcaatcgtctcccagcagacccctcaaagactgttggaggtgcggggtcgattatatgaactgctgacccattgcattcccccagaaatcataatgaagggcttgctcagcgagttgttgcacaattgtgacggccagctgaaaggagaggtcgcccagatggctgcctattatgagcatagactgcagttagggtccaaggcaatttatcacctggaagccttcgttgcaaagttcatggcgctttataagaagttcatggaggatggcctagaggggatgatgttctag

SEQ ID NO: 238372 - DNA, 918 bp, Artificial Sequence
  Description of Artificial Sequence: Synthetic coding sequence
atgtccctttgggtggacaagtatagaccctgtagtttgggacggcttgattatcataaggagcaggccgcacagttacgcaacttggtgcagtgcggagacttcccccatctgctagtgtacggccctagcggggcagggaagaaaacaagaataatgtgcattctgcgagagttgtatggcgtcggcgtggagaaactgcgcatcgagcaccagaccatcaccactcccagtaaaaagaaaattgaaatctcaaccattgcctccaattatcatctggaagtcaaccccagcgatgccggtaacagcgaccgagtagtgatccaggaaatgctcaaaacagtagcccagagtcaacaactggagacgaactctcaacgggacttcaaagtggtgctcctgaccgaggttgataagctgacgaaggacgcccaacatgccctgcgcagaactatggagaagtacatgtccacctgccgcctgattctgtgttgtaatagcacgagtaaagtgatccctccaatccgctcacggtgtctggctgtccgggttccggctccaagcatagaagatatttgccacgtgctgagcactgtgtgtaagaaagaaggcctgaaccttcccagccagctcgctcatcggttggccgaaaagagctgcagaaatcttcgtaaggctttgctgatgtgtgaggcatgcagggttcaacagtaccccttcacagcggatcaggaaatccctgagacggattgggaggtgtatctgagggaaactgccaacgcaattgtttcccagcaaacaccccaaaggctccttgaagtcaggggacgcctgtacgaactgctcacccattgtatcccgccagagattatcatgaaagcctgcaaggaggagagcaggagctgcgacatattttag

SEQ ID NO: 238373 - DNA, 1092 bp, Artificial Sequence
  Description of Artificial Sequence: Synthetic coding sequence
atgcaagctttcctgaaggggacctccatctccacaaaaccccctctgacaaaagatagaggggtcgccgcatctgcaggcagctctggggagaacaagaaagctaagccagtgccctgggtggaaaaataccgaccaaaatgcgtagatgaggtggcttttcaagaggaggtagttgcagtcctgaagaagagcctcgagggggcagatttgcctaatctgctgttctatgggcctcctggaactggcaagacttccacaatcttagccgcagctagggaacttttcggccctgagctgttcagactcagagttctggagctgaacgcgtctgatgagcgaggcattcaggtggtgagggaaaaggtgaagaatttcgctcagctgacggttagtggtagccgtagcgacggaaagccatgtcctccttttaagatcgtaatcctggatgaggctgactctatgacaagtgctgcccaggccgctctcaggcgcacaatggagaaggaaagcaaaactacacgcttttgcctgatatgcaactacgtgtccagaatcattgagccactgacatcacggtgtagcaaatttcgattcaaacctctttcggataaaattcagcagcagcgtctgctggacattgccaagaaggaaaatgtaaaaataagtgatgaggggatcgcctaccttgtgaaggtttccgagggcgacttgagaaaggcaattaccttcctccagtctgcaaccagattgacgggaggtaaggagatcaccgaaaaggtcatcaccgacatcgcaggcgtgattcccgctgagaaaattgacggcgtgttcgcagcgtgccagtccgggagcttcgacaaattggaagcagttgtcaaggatcttattgatgagggacacgctgccacccagctggtgaatcagctacacgacgtcgtggtggaaaacaacctgagcgacaagcagaagtcaatcatcactgaaaagcttgctgaagtggataagtgcctggccgatggagccgatgaacatcttcagctcatcagtttgtgcgccactgtgatgcagcagctgagccagaattgctag

SEQ ID NO: 238374 - DNA, 1092 bp, Artificial Sequence
  Description of Artificial Sequence: Synthetic coding sequence
atgcaggcatttctgaaggggacatctatctctactaagcccccactgacgaaggacaggggggtagctgcaagtgctggctcctctggagagaacaagaaggcaaaaccggtcccttgggtggaaaagtaccgtcccaaatgtgtagatgaggtagcctttcaggaagaagtggtcgctgtgctgaagaaaagtctcgagggcgcagatctacccaatctgctcttctatggtccaccgggtactggcaagacatcaactatcttggccgcagccagggaactttttggccctgagttgttccgcttgcgagtgttagagctcaacgcaagtgacgaacggggaattcaggtagttcgagagaaggtgaagaatttcgctcaactaaccgtgagtggttcccgcagcgacgggaagccctgccctccatttaaaattgtgatcctggatgaggccgactccatgacatcggctgcccaggctgccctgcgcaggacaatggagaaggagagtaagactacaagattttgtctgatctgcaattatgtctcaaggatcatcgagcctctcacctctcgttgttcgaagtttagattcaaacctttgagcgacaagattcagcagcagcggctacttgacatagccaaaaaagagaatgtaaagatctctgatgaggggatagcctatttagtcaaagtgtcggaaggtgacttgaggaaggccatcaccttcttacaatccgccacacgcttaactggtggtaaagagataaccgaaaaagtcattaccgatatcgccggtgttatccccgcagagaagatagacggcgtgtttgctgcgtgccagtcgggttctttcgataaactcgaagctgtggttaaagatctgattgatgaaggtcatgccgcaacacagctggtgaatcagcttcacgacgtggtggttgagaacaacttatctgataaacaaaaatctattatcacggaaaaacttgccgaggtcgataagtgcctagccgatggggctgatgaacacctgcagcttatcagcctgtgcgcaacagtgatgcagcaactcagccagaactgctag

SEQ ID NO: 238375 - DNA, 132 bp, Artificial Sequence
  Description of Artificial Sequence: Synthetic coding sequence
atgcaggcctttttgaagggaacctcgatttccacaaagccccctctaacgaaagaccggggagtggccgcatcggcaggctccagtggcgaaaataagaaggccaagccagtgccctgggtggaaaagtag

SEQ ID NO: 238376 - DNA, 645 bp, Artificial Sequence
  Description of Artificial Sequence: Synthetic coding sequence
atgcaggccttcctcaaagggacctccataagtacaaaacccccactgactaaggatcggggtgtcgccgcaagtgccggatcttctggagagaacaagaaggctaagccggtcccctgggtagagaaatatcgcccaaagtgtgtagatgaagtggctttccaggaagaagtagttgccgtgctgaagaagagtttagagggggctgacttaccaaatttgctcttctacgggccaccaggaactggcaaaactagcaccattttggcagcggcacgagagttgttcgggcctgagctttttcgtctgcgggtcctagagttaaatgcttctgacgagagggggatccaggttgtgagagaaaaagtaaaaaattttgcccaattgaccgtgtccggctcgcgatccgatgggaaaccatgtccaccttttaaaattgtgatcttagatgaggctgattccatgaccagcgccgctcaggcggctctgcgcagaactatggaaaaggaaagcaaaaccacgcgattctgtctgatctgcaattatgtcagccgtatcattgaaccactaactagcagatgtagcaagtttagatttaaacctctgtccgataaaatacaacagcagaggctcctcgacatctag

SEQ ID NO: 238377 - DNA, 372 bp, Artificial Sequence
  Description of Artificial Sequence: Synthetic coding sequence
atgcaggctttcttaaagggaacgtctatctcgactaagccccctttgacaaaagataggggcgtggccgctagcgccggatccagtggcgagaataaaaaagccaagccggtcccttgggttgagaaataccgcccaaagtgtgtggatgaggtggcgttccaagaggaagtggttgccgtcctgaagaaaagtctagagggcgctgatcttccaaacctccttttctatggccctcccggaactggtaaaacttctactattttagcagcagccagagaactattcggtcctgagctcttccggctccgcgttcttgaactgaacgcatctgacgaacgaggcattcaggtcgtgagagaaaaagtgtag

SEQ ID NO: 238378 - DNA, 504 bp, Artificial Sequence
  Description of Artificial Sequence: Synthetic coding sequence
atgcaggcctttctcaaggggacctctataagcacaaagccccctctgacaaaagatagaggggtcgccgctagcgccggatcgtccggagagaacaaaaaagccaaacccgtgccttgggtcgaaaagtaccgtcccaagtgtgtggatgaagtcgccttccaggaggaggtagttgcggtgctgaaaaagtcactggaaggcgctgacctgcctaaccttcttttctacggcccacctggcacagggaagacatctacaattttagctgcagccagagagctcttcggcccagagctcttccgcctacgggtgctggaactcaacgcctctgacgaaaggggcattcaagtcgttcgtgaaaaggtcaaaaacttcgcccagctgaccgtgtctggaagccggtccgatggtaaaccttgcccgccttttaaaattgtcattctggacgaggcagattcgatgacctccgccgctcaggctgccctgaggcggaccatgtag

SEQ ID NO: 238379 - DNA, 288 bp, Artificial Sequence
  Description of Artificial Sequence: Synthetic coding sequence
atgcaggcctttcttaaggggacaagtattagcaccaaacccccactgactaaagatagaggggtcgccgcatcagcgggaagctcaggggagaacaaaaaagccaaacccgtcccttgggtagagaagtatcgacccaaatgcgtggatgaagtcgcgtttcaagaagaggttgtcgccgtcctgaagaaaagtctggagggcgcagatctgccgaacctcctcttctacggtccccctggcaccggcaagacctccactattcttgccgctgctagagagctttag

SEQ ID NO: 238380 - DNA, 1746 bp, Artificial Sequence
  Description of Artificial Sequence: Synthetic coding sequence
atgcagagaccaggccctcgcctgtggctagtgctgcaggttatgggatcttgcgctgccatttcttcaatggacatggagaggcctggcgatggtaagtgccagccaatcgagatacctatgtgtaaagatattggctacaatatgactagaatgccgaatctgatgggccatgaaaatcagagagaagctgccatacaactgcacgagtttgcccctctcgtcgaatacgggtgtcatggtcacttacgctttttcctgtgttccctctatgctccgatgtgcacggagcaggtgtctaccccgatccccgcatgtcgggttatgtgcgaacaggcccgacttaagtgctcccccatcatggagcaattcaatttcaaatggccggattctcttgactgcagaaaacttccaaacaagaacgacccaaactacttgtgcatggaggctcccaataatggctccgatgagccgacacgcggatcaggtctgtttccccctctgttccgcccacaacgcccacactctgcacaggagcaccccctcaaagatggtgggcctggcagagggggatgcgacaatcctggcaagtttcaccacgtggaaaaatctgcttcctgtgccccactatgcacacctggggttgacgtttactggtcacgcgaagacaaacgattcgccgtggtctggctggctatatgggccgtactgtgttttttcagttcagctttcacagtgctaacatttctgatagatccggctagatttcgttacccagagcgccctatcatcttcctatctatgtgttattgcgtatacagtgtggggtaccttattagactgtttgccggtgccgagagcatcgcctgcgacagggatagcggccagctgtatgttattcaagaggggttagagtcaacgggatgtacgctcgtgttcctagtgctttactacttcggcatggccagctccctgtggtgggtagttctcacactaacctggttcctcgcagctggcaagaaatgggggcatgaagccattgaagctaacagcagctactttcacctcgctgcctgggccatccctgccgtaaagacaatcttgattctggtgatgcgaagagtggcgggagacgagctaactggcgtgtgctacgtaggctccatggatgtcaatgcactcaccgggtttgtgctcatcccgctagcatgctacctggtcataggtactagttttattttatccggctttgtggctctctttcacataagaagagtgatgaagacagggggagaaaacacagacaagcttgagaagctaatggtgaggatcggattgttttcagtactgtataccgtgcctgccacttgtgtcattgcttgctatttctatgaaagactgaatatggattactggaaaatccttgccgctcagcacaagtgcaagatgaataatcagacaaagacgctcgattgcctgatggcggctagcatccccgctgtggagatattcatggttaagatctttatgcttctggtggtcggcatcactagcggcatgtggatatggacttcaaaaacactacagtcttggcagcaagtgtgctcaaggaggctgaaaaagaaatcacgtcgtaaacccgctagcgtcatcacaagcggcggtatctataagaaggcccagcatccacaaaaaacacatcacggcaagtacgagatccccgctcagagcccgacctgcgtttag

SEQ ID NO: 238381 - DNA, 960 bp, Artificial Sequence
  Description of Artificial Sequence: Synthetic coding sequence
atggttgagaagtataggccccagacactaaatgacttaataagccatcaagatatcctgtccaccatccagaaattcattaacgaggatcgattaccacacctgctgctttacggcccaccgggtactgggaagacatcaactatcctggcttgcgccaaacagctatacaaagacaaggagtttggctctatggtgctggagcttaacgcatccgacgatagagggatcgatatcattcgaggacctatcttaagctttgctagcacaagaacgatttttaagaagggctttaaacttgtcatactggatgaggcagacgccatgacacaggatgcccaaaacgctctgagaagagtaatcgagaagttcactgaaaacactcggttctgccttatctgtaactacctcagtaaaatcattcctgctttgcagagcagatgcacccggtttagatttgggccactcactccagaactgatggtgccaagactcgaacacgtcgtggaagaggagaaagtcgatatctctgaggatgggatgaaagcactcgtgactctttcatcaggggatatgaggagagccctgaacatcctgcagtcaactaacatggcttttgggaaagtcacagaagagactgtatacacctgcaccggacatcccttgaaaagtgatattgcaaatatccttgattggatgttaaatcaggactttactacagcttacagaaacatcaccgaactcaagaccttgaaaggactggccttgcacgacatactcactgaaattcacttgttcgtgcatcgggttgattttccttcttcggtgcgcatccaccttttgacaaagatggcagacatcgagtataggctctctgtcggtactaacgagaagatacagctgtcctcgttaatcgcagcattccaggtgacacgcgacctcattgtcgccgaagcatag

SEQ ID NO: 238382 - DNA, 315 bp, Artificial Sequence
  Description of Artificial Sequence: Synthetic coding sequence
atggtggagaaatacaggccccaaactcttaatgacctcattagccatcaggacatcctgtcaaccatccaaaagtttatcaacgaggatagattgccacatctgctgctatacggtcctcctggcaccggcaagacctcaacaatcctggcttgcgcaaaacagctgtataaagacaaggaatttggctccatggtactggaactcaacgcgtccgatgacagggggatcgatatcattcgtgggccaattctctcctttgcttcaacacgcacaatttttaaaaaaggcttcaaacttgtaatcctggattag

SEQ ID NO: 238383 - DNA, 1023 bp, Artificial Sequence
  Description of Artificial Sequence: Synthetic coding sequence
atggaaacatccgccctcaagcagcaggaacagcctgccgcaacaaaaattcgaaatcttccgtgggtggagaaatatcgaccccagacactcaatgatctgatcagccatcaggatatcctctcaactattcagaagtttatcaatgaagaccggttgccgcatctccttctttatggaccgcctgggactggcaagacgtccaccatacttgcctgcgccaagcagctgtacaaggataaggagttcgggtctatggtccttgaattaaacgcctcagacgaccggggaatcgacatcattcgaggtccgatcttgagtttcgccagcacccggactatcttcaaaaaggggttcaaactagttattctcgatgaggctgatgccatgacccaggatgctcagaacgcactgaggagggtcatagagaagttcacggagaatacgcgcttttgccttatatgcaactatctgtctaagatcatccctgccttgcagagtcggtgcactcggtttcggtttggaccactgacacctgaactaatggtccccagattggagcatgtggtagaggaggagaaagtggacatctccgaggacggcatgaaagctctcgtcaccctgagttccggggacatgcggagggctctaaacatccttcagtcaactaacatggcctttggcaaggttaccgaggaaactgtgtacacttgcacaggccaccccttgaaaagcgacattgccaatattctggattggatgttgaatcaagattttacgactgcctaccggaacattactgagctgaagactttaaaaggtctggctctgcatgacatcctgacggagattcacctcttcgtccatagggtggatttccctagctccgtcaggatacacctgttaaccaagatggccgatattgagtaccggctgagcgtcggcacaaacgagaagattcagttatcttcactgatcgccgcatttcaagttacccgcgatctgatcgtggctgaagcctag

SEQ ID NO: 238384 - DNA, 192 bp, Artificial Sequence
  Description of Artificial Sequence: Synthetic coding sequence
atggtggaaaagtacaggccccagacattgaatgacctaatcagccatcaggacattctgagtacaatccagaaattcatcaacgaggaccggctgcctcaccttttattgtatggccctccgggtaccggtaagacctcgactatattggcttgcgcaaaacaactgtacaaggataaggagtttggttag

SEQ ID NO: 238385 - DNA, 1077 bp, Artificial Sequence
  Description of Artificial Sequence: Synthetic coding sequence
atgtggaactcaaacgatggcggagctggttggaggcggaagcggatagctggcggtttctctaaacgagccagccttgggtctgagaggagagtggttgccggagaagagggacgggaacggtcttggggcgtatggggctcccctgcaggacggaggcgcggtcgcctcgggaggctcggacagtgtctcaagggccgtagcctgcgcgagcctgctggcttttccgaggcttgggatgttgcacaggccctgatcctgctgtttaagactggaggatttgagtcgtacgggtcaagttcttatggcggagccggagggtatacccagagcccaggcggtttcggcagtccagcccctagccaggcagagaagaaaagccgtgcacgggctcagcatattgtaccctgcaccatctcccagctgctatcggcgaccctggtcgacgaggtgttcaggatcgggaatgtcgaaataagccaggtcactatcgtgggaataattaggcacgcagagaaagcgccaaccaatatcgtgtacaaaattgacgatatgactgctgcgcctatggacgtgcgccagtgggtggacaccgacgacacttcctccgagaacaccgttgttccgcctgagacctacgtgaaggtcgccggacatctgcggtctttccagaataagaagagtttagtggcttttaagatcatgcccttagaagacatgaacgaatttactacacatatccttgaggtcatcaacgcacatatggtattaagcaaagcgaattcgcaaccaagtgccggtcgcgcacctatatccaaccctggcatgtcggaggctgggaatttcgggggaaatagctttatgcctgctaacggcctgaccgtagcccagaaccaggtcctcaatctcatcaaggcctgtcccagacccgaaggcttaaactttcaagacctgaagaaccagctaaaacacatgtcagtatcctcaatcaagcaagctgtcgactttctgagcaatgaggggcatatatactcgaccgtggacgacgatcattttaaaagtactgacgccgaatag

SEQ ID NO: 238386 - DNA, 837 bp, Artificial Sequence
  Description of Artificial Sequence: Synthetic coding sequence
atgggacgcggtgatcggaataagcggtcaattcgcggattcgagagctacggtagctcgagctacgggggagccggtggctacacacaaagcccgggagggttcggctcgcccgctccatctcaagccgagaagaagtctagggcccgagctcaacatatcgtcccttgtactatcagtcaacttttgtccgccacccttgtggatgaggtgtttaggatcggcaacgtggagatatcacaggtgactattgttggcattatcagacacgcagagaaggcccctactaacatagtgtataaaatagatgacatgaccgccgctcccatggacgtgcgacagtgggtggatacagacgacaccagttctgaaaatacagtagtcccgccagaaacatatgtgaaagtcgccggacatctccgctctttccagaataagaaatccctggtcgcatttaagatcatgccattggaggatatgaacgagtttaccacccacattttggaggtgataaatgcccacatggtgctgtctaaagctaactctcaaccctcagccggacgagccccaatatcaaatccagggatgtccgaggcaggtaatttcggcggaaatagtttcatgcccgctaatggactgaccgtggcacagaatcaagtgctcaacctcattaaggcctgtccgaggccggagggtctgaattttcaagatttgaaaaatcagctaaagcatatgtccgtgagctccatcaagcaggctgtcgactttctgtctaacgaagggcacatctattcaacggttgacgacgaccacttcaagtctaccgacgcagagtag

SEQ ID NO: 238387 - DNA, 813 bp, Artificial Sequence
  Description of Artificial Sequence: Synthetic coding sequence
atgtggaacagtggctttgaatcttatggttcatcttcttatggcggagccggtggctacacacagagcccgggagggttcgggagcccagctccatcacaggctgaaaagaagagccgggcaagggcacaacacatcgttccatgcacgatcagccagttactctcagccactctcgttgatgaggtcttccggataggtaatgttgaaatttctcaagtgacaattgtgggaatcatacggcacgcggagaaagcgccaacgaatatagtatacaagattgacgacatgacagccgcaccgatggacgtccggcagtgggtcgatacggacgacacatcttccgaaaatactgtagtgccacctgagacttatgtcaaggtcgcaggtcatctgagatcgttccaaaacaaaaaaagtttggttgcatttaaaattatgcctctggaagacatgaatgaatttactacacacatactggaggtaataaatgcacatatggttttgtcaaaggcaaactctcagccctctgctggccgtgcccctatctctaatccgggaatgtccgaggcagggaatttcggtggaaattcattcatgccagcaaacggactgaccgtggcccagaaccaggtgctgaaccttatcaaggcctgtcccaggcctgaaggccttaatttccaggacctgaagaatcagctgaaacacatgagcgtctccagcatcaaacaggcggtagacttcctttccaatgaagggcatatttactccaccgtggacgatgaccacttcaagagcaccgatgctgagtag

SEQ ID NO: 238388 - DNA, 369 bp, Artificial Sequence
  Description of Artificial Sequence: Synthetic coding sequence
ctagaagacatgaacgagttcaccacacacatcctggaggtaattaatgcccacatggtcttaagcaaggccaactcccaaccttctgcgggtcgtgcccctatctcaaacccaggtatgtccgaagccggaaacttcggcggaaattccttcatgccagcaaacgggctcacggtggcacagaaccaagtgctgaatttgatcaaagcttgcccacgccctgaaggcctaaatttccaggatttgaagaatcagctgaaacatatgtccgtgagctctatcaaacaggcagtggacttcttgtcgaatgagggacacatttattccaccgtggacgatgatcattttaaaagcaccgatgctgagtag

SEQ ID NO: 238389 - DNA, 540 bp, Artificial Sequence
  Description of Artificial Sequence: Synthetic coding sequence
atgtggaacagcaatgacgggggtggctttgagtcatatggaagttcttcctacggaggtgctgggggttacacccagtcccctggcggatttggctcccctgcaccatctcaggctgagaagaagtccagagccagggctcagcacatcgtcccctgcactatctcccagctgctatctgctaccttagtggatgaggttttccggataggcaacgttgagatttcccaggtgaccattgtaggcataatccgccacgccgaaaaggcaccaaccaatatcgtttataagatcgatgacatgacagctgcccctatggacgttaggcagtgggtcgataccgacgatacatcatcagagaataccgtcgtgccccctgaaacctacgttaaggtggcaggtcatcttaggagctttcagaataaaaaatccctggtggctttcaagattatgcctctcgaggacatgaacgaatttactacacatattttggaggttattaatgcacacatggtgctgtcaaaagctaactcccagtag

SEQ ID NO: 238390 - DNA, 786 bp, Artificial Sequence
  Description of Artificial Sequence: Synthetic coding sequence
atgtccaagtccggtttcggatcctatggatcaatcagtgctgccgacggagctagtggaggaagtgaccagctctgtgagagagatgctactccggcaatcaagacccaaaggccaaaggttcgcatacaggacgtggtaccttgcaatgtgaatcaactgctttcctccactgtttttgatccagtgttcaaggttcggggaatcattgtgtcccaggtatccatcgtgggcgtgatccgcggagctgaaaaggctagcaaccatatctgctataaaatcgatgacatgactgcgaaacccatcgaagcgcgtcaatggttcgggagagaaaaggttaaacaggttacccccttatcggtgggcgtgtatgttaaagtctttggcatcctcaagtgtcccactggtactaaatctctggaagtattaaagatacacgtgttggaggatatgaacgaattcacagtccacattctggaaactgtcaatgcccacatgatgctggacaaagcacgccgtgatactacagtcgagtccgtgcctgtaagtccatcagaggttaacgatgcaggagacaacgatgagtcacaccgaaacttcatccaagacgaagttcttaggctgatccacgaatgtccgcatcaggaaggaaagagcattcacgaactgagagcacagctgtgcgaccttagcgtaaaagccatcaaggaggccatcgactacctgaccgtagaaggccacatctatcccaccgtggatagggagcactttaaatctgccgattag

SEQ ID NO: 238391 - DNA, 330 bp, Artificial Sequence
  Description of Artificial Sequence: Synthetic coding sequence
atgaatcccgcactggggaaccagaccgacgtagcaggcttgtttttggccaactcttctgaggcccttgaaagggccgtgcgctgctgcacgcaggcctccgtagtaactgatgatggattcgccgagggcggaccagatgagcgcagtctatacattatgagagtggtgcaaattgctgtcatgtgcgtgctctcactgacagtcgtgttcggaatttttttcttgggctgcaatctactaattaagagtgaggggatgatcaattttctggttaaggatcgtcgtcctagcaaagaagtggaagccgtggtcgtcgggccttactag

SEQ ID NO: 238392 - DNA, 1893 bp, Artificial Sequence
  Description of Artificial Sequence: Synthetic coding sequence
atgcaagggtcttccctgtggctatcgctgacattccgttcagctcgggttctcagtcgggctcgatttttcgagtggcagagtcctggcttgcccaacacagccgctatggaaaatggcactggaccatatggcgaggaacgccctcgagaagttcaggagacaacagtgaccgagggtgccgcaaagattgccttcccatccgccaatgaggtgttctacaaccctgtgcaggaattcaaccgggacctgacatgtgctgtgatcaccgaattcgccaggattcagctcggagcaaagggtattcaaatcaaggttcccggagaaaaggatacacagaaagtcgttgtagatctgtccgagcaggaagaggagaaagtggagctaaaagagagcgagaatctggcgtcaggagaccaacccaggacagctgccgtcggggaaatctgcgaggagggactgcacgttttagagggcctggccgcaagcggcttgcgatctattcgatttgctctggaagtccccggactacggtcagtggtcgctaatgatgcctctactagggcggtcgatttgattaggcgaaatgtacaactcaacgacgtggcccaccttgtgcaaccttcccaagccgacgcgaggatgttgatgtaccaacatcagcgggtgtcagaacggtttgacgtcatcgacctggacccatacgggagtcctgcaacatttttggacgccgcagtacaagccgtctcggaaggaggccttctgtgtgtgacatgtacagacatggctgttttggccggtaattccggagagacatgttacagcaagtacggagcaatggccctcaaatcccgtgcctgccacgaaatggcgctacgaatcgtgctccactccctcgacctaagggcgaattgctatcagcgttttgttgttcctttgctgtccatctctgccgatttctatgtgagagtgtttgtgagagtgttcactggccaggctaaggtcaaggcttccgctcgtgcgaagttttccgctgcttgcggtccgccagtgacacctgagtgcgagcactgcggacagcgccaccaactgggaggtcccatgtgggccgaacccattcacgaccttgactttgtagggcgtgtgctggaggccgtatctgccaaccccggtcggtttcacaccagtgagagaatacgtggggtgcttagtgttattacggaggagctgcctgatgtgcccctttactatacattagatcagctgtcctcaacaatccattgcaacaccccttctctgttacaactacggtcagcactgctgcatgcagattttagggtatctctgtcacatgcgtgcaaaaacgccgttaaaactgacgcacccgcatcagcgctctgggatataatgcgctgttgggaaaaagaatgtccggtcaaacgcgaacggctgagtgagaccagtccggcattcagaatattatcagttgaacccagacttcaggctaactttacaatcagagaggacgccaatccaagctcccgtcaacggggactgaagagatttcaggctaaccctgaggcaaactgggggccacgtccgcgagcaagacctggaggtaaggccgctgacgaggctatggaggagcgtagaagactactacagaataagaggaaggaaccaccagaagatgtagctcagcgggctgccagactaaaaaccttcccctgtaagcggttcaaggagggaacctgccaacgcggtgaccaatgttgctactctcattccccacctacacctcgggtgtcggcagatgccgctcccgactgcccagagacttcaaaccaaacacccccaggcccaggagccgctgcgggacccggtattgactag

SEQ ID NO: 238393 - DNA, 249 bp, Artificial Sequence
  Description of Artificial Sequence: Synthetic coding sequence
atgaaggcgttgtgcctcctcctgctcccagtgctcggacttctagtgtcatccaagactctgtgctctatggaggaggccatcaatgagagaattcaggaggtggccggatcactctcctttgcagttacggggtgcacatgtgggagcgcctgcgggtcttgggacgtccgggcagagaccacatgccattgtcaatgcgccggaatggattggaccggtgccaggtgctgccgagttcaaccctag

SEQ ID NO: 238394 - DNA, 954 bp, Artificial Sequence
  Description of Artificial Sequence: Synthetic coding sequence
atgaaaaggctctctctcgtcaccacaaatcgtctcagccctcatggcaactttcttccattgtgcactttccccctggctgtcgatatggccgctctcttccaggaagcatccagttgtccagtgtgcagtgattatctggagaaacccatgtctctcgaatgcggatgtgccgtgtgtttcaaatgtattaattctctgcaaaaagagcctcacggcgaagatcttctctgctgctgttgtagcatggtttctcaaaaaaacaaaatccgcccatcatggcagctggagcgtttagcatcccatatcaaggaactcgaaccgaagctgaagaagattctgcagatgaaccctaggatgagaaagtttcaggtcgatatgacgctcgatgccgacaccgccaacaacttccttctgattagcgatgacctacgctcggtgcggtcaggctgcatcacccaaaaccgccaagacctggctgagcgatttgatgttagcatatgcatccttggctctcctaggttcacctgtggaagacactattgggaagtggatgtgggcacatcaactgaatgggatctcggagtgtgcagggagagcgttcatcgaaagggtagaatccacttaactacagagcgcggattctggacagtgtccctgcgcgacggtagtagattgtccgcgtcgaccgtaccactcactttcctgttcgtagaccgtaaactgcaaagagtggggatcttcctggacatgggaatgcagaatgtatcattttttgacgcagaaggtggttctcatgtgtacacgtttagaagcgtaagtgcagaagagcccctgcatctctttttcgcccctccttcccctcccaacggtgataaatccgttctctctatttgccccgtgatcaatcctggaaccaccgacgctcctgtgcatccaggggaagcaaagtag

SEQ ID NO: 238395 - DNA, 954 bp, Artificial Sequence
  Description of Artificial Sequence: Synthetic coding sequence
atgaagaggctgagtttggtgaccaccaaccgactgagcccacacgggaatttcttcactctgtgcactttcccgctcgctgtggacatggctgccctgtttcaggaagcctcttcatgcccagtttgctctgactatctggagaagccgatgagtctggagtgcggttgtgcagtgtgtctgaaatgcattaacagcttgcagaaagaaccacacggagaggacctgctctgttgctgttcttccatggtgagcaggaaaaataaaattagacgaaatcgacagcttgaacggttagctagccacattaaggaactggagcctaagctgaagaaaattctccagatgaaccctcgcatgcggaagttccaagtggatatgaccctggatgccaacacagctaacaatttcctgctgatttctgacgacctccgtagcgtgcgctccgggcgtattcgccagaaccggcaggatttggcagagagattcgatgtttcagtttgtatcctgggttcccccagatttacatgcggaaggcactgctgggaagtggacgtgggcacgtcaacagagtgggacctcggggtatgtagagaatctgttcatcgtaaagggcgtatacagctgaccaccgagctaggtttctggaccgtatcactaagggatggcggtcgattgtcagctacgacagtcccgctgacatttctctttgtggacaggaagctgcagagagtgggtatttttctggacatggggatgcagaacgtgtcttttttcgacgcagagtcaggctcacacgtgtacactttccgcagtgtgagtgctgaggaacctttgaggccttttctagccccttctgtccccccaaatggagatcaaggcgtactgtccatatgcccactgatgaacagcgggacaacagatgcccctgtcagaccaggggaggcaaagtag

SEQ ID NO: 238396 - DNA, 867 bp, Artificial Sequence
  Description of Artificial Sequence: Synthetic coding sequence
atggcagccctgtttcaggaggctagctcctgcccagtctgctctgactatcttgaaaagcccatgtccctagaatgtggatgcgcagtgtgcctgaagtgcatcaactcgctgcagaaggagccacatggggaggatctgctctgctgctgttcctctatggtatcccggaaaaataagattcgtcgcaaccgtcaactcgaaaggctggcttctcacatcaaggagctcgagccaaaactgaagaagattctgcaaatgaacccacgcatgcggaagttccaagttgacatgacccttgatgccaacactgcaaataactttttgcttattagcgacgatttacgctctgtaaggtcgggtcggatccgccagaacaggcaggaccttgcagaaagatttgacgtgtccgtgtgcatcctgggaagtcccagattcacctgtggccgacactgttgggaggtagacgtcgggacctcaacagagtgggatctcggagtgtgtcgggaaagcgttcacagaaaggggcgaattcagttgactactgaactggggttttggaccgtgagccttagggacggtggaaggctatccgccaccactgttccacttactttcctttttgtggatagaaagttacagagagtgggcatctttctggacatgggcatgcaaaatgtgtccttctttgacgccgagagcggttcccatgtgtacacttttagatcagtgtccgcggaggagcccctacggccatttctggcgccaagcgtccctccaaatggggaccaaggggttctgagcatctgcccactgatgaacagcggtactaccgacgcccctgtgaggcccggtgaagcaaaatag

SEQ ID NO: 238397 - DNA, 867 bp, Artificial Sequence
  Description of Artificial Sequence: Synthetic coding sequence
atggccgcactcttccaggaagcctcatcgtgtccggtgtgtagcgattacctagagaagcccatgtcattagaatgcggctgtgccgtatgtctgaagtgtataaacagcctgcagaaggagccccacggtgaggaccttttatgctgctgttcatctatggtttcacgcaaaaacaaaattcgcaggaaccgccagttagaacgattagcctcacatatcaaggaactcgagcctaaactgaagaagattctccagatgaacccacgtatgcggaagtttcaggtggatatgacactggacgccaataccgcaaataactttttgctcattagcgacgatttgagaagtgttcggagcggacggatccggcagaaccgtcaggacctggcagagagatttgatgtatcagtgtgcattctcggatctcccaggtttacatgcggaagacattgttgggaggtcgacgtggggactagcaccgagtgggatctgggagtttgtagagaaagcgtccatcggaagggacgaatccagctgaccaccgaacttggcttttggacagtatccttaagagacggtggtaggttaagcgcgactaccgtaccactcacatttctttttgtcgatcgtaaactccagagagtcgggattttcttggacatgggaatgcagaacgtgtccttctttgatgcggagtcggggtcgcacgtgtataccttcagatcggtttctgcagaagaaccgctgcgcccatttctggcccctagcgtgcccccaaacggcgatcagggggtgctgtctatttgtccacttatgaatagcggcaccactgacgctccagtgagacccggagaagccaagtag

SEQ ID NO: 238398 - DNA, 1137 bp, Artificial Sequence
  Description of Artificial Sequence: Synthetic coding sequence
atggaagtcgctgaactcggcttccccgagactgccgtctcccaatcacgtatctgcctctgcgccgtgctgtgcggacactgggactttgctgatatgatggtgattcggagcctgtccttaattcgtttagaaggcgtcgaaggaagggacccagtcggtggaggcaacttgaccaacaagagaccctcctgcgcaccatccccacaggacctgagcgcccagtggaaacagcttgaagaccgcggagcgtcctcccgtagggtcgatatggccgctttgtttcaggaagcttcttcatgccctgtctgcagcgattatttggagaagcctatgtcccttgagtgcggttgcgcagtctgtctgaaatgcatcaactccctgcagaaggagccccacggcgaagacctgctgtgctgttgcagtagcatggtcagtcgcaagaacaaaatcagacgaaaccgacagctggaacgcctggcttctcatatcaaagagctggagcccaaactgaagaaaattctgcaaatgaaccctcgaatgagaaaattccaagtggatatgaccttagatgctaacaccgcaaataattttcttctgatttcagacgatctgcgaagcgtaaggagcgggaggatacgccaaaatcgtcaagacctggccgagcgcttcgatgtgtctgtgtgcattttgggcagccccagatttacctgcggccgtcactgctgggaggtcgacgtcggaacaagcaccgagtgggatctcggcgtttgtcgcgaatcggtccatcgaaaaggaagaatacagcttactacagagctcgggttctggacagtgtctctgagagacggcggtaggttaagcgccaccaccgtacctttgacattccttttcgtagatcggaagctacagcgggtcggcatcttcctggacatgggaatgcaaaacgtgtcctttttcgacgcggaaagtgggtctcacgtttacactttccgtagcgtctccgcggaggaaccactgagaccattcctggctccttcggtgccgcctaatggcgaccagggagtgctgagtatctgtcccctcatgaattcaggaactacggatgcgcctgtgcggccaggcgaggccaaatag

SEQ ID NO: 238399 - DNA, 954 bp, Artificial Sequence
  Description of Artificial Sequence: Synthetic coding sequence
atgaagaggctgagcctggtgaccactaatcgcttatcgccccaggggaactttctgcctctgtgcacttttccactagccgtggacatggccgcactcttccaagaggcaagcagttgccccgtgtgcagcgactacctggagaaaccgatgagcttggaatgtggctgcacggtgtgtttaaagtgcataaattctcttcagaaagaaccccacggggaagatttgctttgctgctgttgctctatggtgtctcagagaaataagatccgtccgaatagacaacttgaaaggcttgtctcacacattaaagagttggaacctaagttaaagaagatcctccagatgaaccctcgcatgcggaagttccaggtcgatatgaccctggacgccgacacagcaaacaacttccttctgatcagcgatgatttaagaagtgtccgctcgggcttgattacgcagaacagacaggacttggcagaacggtttgacgtttctgtatgtattcttggttcaccacggttcacctgcgggagacactactgggaggtggatgtaggtacgagtacagaatgggatttaggcgtgtgccgtgaatctgtccattgtaagggaaaaattcagctcaccactgagctgggcttctggactgtttccttgcgggatggatctcggctctctgctagcactgtccctttgacgtttctattagtggacaggaaattgcagcgggtagggatcttcctcgacatgggcatgcagaacgtgtccttcttcgatgccgagtccggtagccatgtgtacacctttcggagcgtgtcagcagaagagccactcaggccattcctcgcgccaagcatacctcccaatggagatcagggtgtcctgtccatttgccccctgatgaactcaggaacaactgacgccccagtgcggcctggggaagccaaatag

SEQ ID NO: 238400 - DNA, 867 bp, Artificial Sequence
  Description of Artificial Sequence: Synthetic coding sequence
atggctgcattattccaagaagcgtcttcatgcccagtctgcagcgattatcttgaaaagccaatgagtctggaatgcggatgtaccgtgtgtctaaagtgcatcaattcattacagaaggaaccccatggtgaggatctcttgtgttgttgctgcagcatggtcagtcagcgaaacaagatccgacccaacagacagctcgagagattggtgagtcacattaaggagctcgaaccaaagctgaaaaaaattctacagatgaacccaaggatgcgcaagttccaagtggacatgacccttgacgccgatacagccaacaatttcctcctcatctctgacgacctgcgttcagttaggagcggcctgatcacccaaaatcgccaggaccttgctgaacgctttgatgtctccgtgtgtattttggggtcaccgaggtttacctgtggaagacactattgggaggtagacgtcggtacctctacagagtgggacttgggcgtgtgcagagagagcgtgcattgcaaaggaaaaattcagcttacaaccgagctagggttttggactgtgtcactcagggacgggtctcgcctctcagcttctacggtacctttgaccttccttctggtggaccggaagctgcagcgagtaggcatcttcctcgatatgggcatgcaaaacgtcagcttctttgacgcggaatcagggtctcatgtctacacatttaggtccgtctctgcagaggagccgttgcggccatttctggcgccttctattccaccaaatggggatcagggagtgctcagcatctgcccattgatgaacagtggcactacggatgctcccgtacggcctggcgaggccaagtag

SEQ ID NO: 238401 - DNA, 867 bp, Artificial Sequence
  Description of Artificial Sequence: Synthetic coding sequence
atggccgcactatttcaggaagcgtcatcgtgccctgtgtgcagtgattaccttgaaaagcccatgtctctggagtgcgggtgcaccgtttgtctcaagtgcattaactctcttcagaaagaacctcatggggaggaccttctctgttgttgctgcagcatggtgagccaacggaataagattaggcctaatagacaactagaaagactagtctcacacatcaaggagctcgagcccaagttaaaaaaaatccttcagatgaacccacgcatgcggaagtttcaagtggatatgacactcgatgctgacacagcaaacaactttctgctcatatcggacgatctgcgctctgttaggagtggattgatcacacagaacaggcaggacttggcggagcgctttgacgtgagtgtgtgcatcttgggatctccccgattcacatgcggaaggcactactgggaagtggacgtcgggacatcgaccgagtgggaccttggggtatgtcgggagagcgtacactgcaaggggaaaatccagctcaccaccgagctcgggttttggacggtatctctaagagacggatctcgcctgagcgcgagcacagtgcccttgacattcttgctggtagatcggaaactgcagcgtgttggtattttcttagatatgggcatgcaaaatgtgtctttctttgacgcagagagcgggagtcacgtttataccttccgcagcgtttccgctgaggaacctctgagaccattcctcgctccttccatccctccaaatggcgatcagggagttctgtctatttgccctttgatgaacagtggcaccactgacgccccagtccgcccaggggaggcaaaatag

SEQ ID NO: 238402 - DNA, 3219 bp, Artificial Sequence
  Description of Artificial Sequence: Synthetic coding sequence
atggcgaaagccaccagcggagccgctgggctccgacttctgctactgctgcttctgccactcctcggcaaggttgcgctggggttgtacttctctcgggatgcctactgggagaagctttacgtagaccaggctgcaggcactcctctgctgtacgtgcatgcgctccgcgatgcccctgaagaagttccatccttcaggctgggtcagcatctttacggcacatacagaacacgtctgcatgaaaacaactggatatgtattcaggaagacactgggttgctgtacttgaaccggagcttggaccactctagctgggaaaagctgtcggtcaggaacagagggttccctcttctcacagtatacctgaaggtgtttctcagcccaacctcccttagagagggggagtgtcagtggcccggttgcgccagggtgtatttcagcttttttaacacctccttccctgcttgcagctctcttaagcctcgcgagctgtgctttcccgagacgcgcccttctttccgcatacgcgagaatcgccctccaggcacatttcaccagtttaggctcctacctgtgcagttcttgtgccccaatatcagtgtggcttatcgcctcctcgagggtgaaggcctgcccttcaggtgcgcccctgattcacttgaggtgtctacccgctgggctctcgatcgggagcagcgcgaaaaatacgagctggtagccgtctgtacagttcatgccggtgccagagaggaggtcgtcatggttccctttcccgtcacagtgtatgatgaggatgattcggctcctacctttcctgcaggcgtggataccgcgagcgctgtcgttgagttcaaacgcaaagaggatacggtcgtcgctacgctgcgcgtcttcgatgccgacgtggtgccggcttctggtgagttagttcgtcgctacaccagtacactgcttcctggtgacacctgggcccagcagaccttccgggtcgagcactggcccaatgaaacatctgttcaggctaatggaagcttcgtgcgagcaactgtccacgactacaggttagttctgaaccggaacctgtctatctccgaaaatcgcacaatgcagctcgccgtgctggttaatgactctgatttccaggggccaggcgctggagttctcttactgcactttaatgtctccgtcctgcctgtttcactgcacctgcccagcacctactcgctgagcgtttcacggagggctaggagatttgcacagattggaaaagtttgtgtcgagaactgtcaggccttctccgggattaacgttcagtataagcttcatagtagcggagctaactgctcaacgctaggggtggtgacttccgcagaggataccagcgggattttatttgttaatgatactaaggctctgagaagaccaaaatgcgccgaactgcactacatggtagtcgcgacggaccaacagacgtcccggcaggcacaggcgcagctattagtgacagtggagggctcttatgtcgccgaggaagccggttgtcccttatcttgtgccgtttccaagcgcagactcgaatgtgaagagtgcggcggactaggatccccaacaggcaggtgcgagtggagacagggcgatggcaaagggattaccaggaatttttccacttgctctccatctacgaaaacttgcccggatgggcactgtgacgtagtggagacccaggacataaatatatgccctcaagattgcctgcggggttccattgtagggggtcatgagcctggggaaccacggggaatcaaagccggatatggaacttgtaactgcttccctgaggaggaaaaatgtttctgcgaacccgaagatatccaggacccgctctgtgatgagctttgtagaacagtcatcgcagctgccgtgctgtttagtttcatcgtgtctgtgttactgagcgctttctgcatccactgttatcataaattcgcacacaaaccccctatctcaagcgccgagatgactttccgacggcctgcccaggcattccctgtctcatactcatcaagtggggcaaggagacccagcctcgattccatggaaaaccaagtgagcgttgatgcgtttaagatcttggaagaccccaagtgggaatttcccaggaagaacctcgtgcttggcaagactttgggagagggagaatttgggaaagttgttaaggctacagcttttcacctcaagggcagggcgggttacacaacagtggctgttaagatgctcaaagagaatgcatcccccagcgagctgcgggacctacttagcgagtttaacgtgctgaagcaggtaaatcatccgcacgtgattaaactgtatggggcttgcagccaggatgggccattactgctgatcgtggagtatgccaaatacggctctctgcgagggtttctgcgggagtcacggaaggtgggaccgggatatctgggctccggaggttctaggaactcctctagtctcgaccacccagacgagcgcgctcttacaatgggggatctgatttcttttgcctggcagatcagtcagggtatgcagtaccttgccgagatgaaactcgttcatcgtgacctggccgctaggaacatcctcgtagctgaggggcgaaaaatgaaaatctccgatttcggtctgtcccgcgacgtgtacgaggaagactcatacgtcaaaagatctcagggtaggattccagtaaaatggatggctattgagtctctatttgatcatatctacacgacgcagtccgacgtgtggagttttggggtgttactgtgggagattgttaccctagggggaaacccttatcccggtataccgcctgaacggttgttcaatctcctgaaaaccggacatcgcatggagcgcccagacaattgctcagaagaaatgtatcggttgatgctgcaatgctggaaacaagagcctgacaagcggccagttttcgcggatatttctaaggacttggaaaagatgatggtgaaacgcagggactatttggatctggctgctagcacaccatcagatagtctgatatatgacgatggactgtccgaagaggagaccccactggttgattgcaataacgcccctctccctcgcgcacttccctctacatggatcgaaaacaaattatatggaagaatcagtcacgccttcactcgcttttag

SEQ ID NO: 238403 - DNA, 3345 bp, Artificial Sequence
  Description of Artificial Sequence: Synthetic coding sequence
atggccaaagctacctcaggcgctgcgggtctgcgattgctgctgctactgctgctccctctcctcggcaaggtcgcactcggcctgtatttctcccgcgacgcctactgggaaaagctgtatgtggatcaggctgcaggtacccccctgctctacgtccacgcccttcgcgatgctcctgaggaggtgccatcttttagattaggacagcatctttacgggacgtatcgaacccggttacacgaaaacaattggatctgcatccaagaggatacaggcctgctgtatctgaataggagcttggaccattctagctgggaaaaactgtccgtccggaatcggggatttcctttattaacagtttatcttaaagtctttctgtctcccacgtcgcttagggaaggagagtgccagtggcccggatgcgccagggtgtacttctccttttttaacacttccttccccgcttgttcctcactgaaaccacgagagctgtgctttcccgagaccagaccgtccttcaggattcgtgagaatcggccacccggaaccttccatcagtttagactgctgcctgtgcagttcttatgtccaaacattagtgtggcctatcggttgctggagggggaaggtctgcctttccggtgtgcgccagacagcctcgaagtgtcgacccgttgggctctcgatcgagagcagagagagaaatacgagctcgtggcagtctgtacagtacacgcaggcgctagagaagaggtggtgatggtcccgttccccgttacagtatacgacgaagatgacagcgcccctaccttccccgctggtgtcgacactgcctcagccgtcgtggagttcaaaagaaaggaagacactgtggtggccactctgcgcgtgttcgacgccgacgttgttccggcttccggtgagctggtgcgacgttacacttctacattgcttcccggagatacctgggctcagcagactttcagagtggagcattggcctaacgagacctcagtacaggctaacggcagttttgtccgggctacagtgcacgactatagattagtgcttaatcggaatttgagtatcagcgaaaaccgtaccatgcagcttgccgtcctggtcaatgactccgattttcaggggccaggggctggggtgctccttctccatttcaacgtaagtgtcctccccgtgtccctccaccttccttccacttactctttaagcgtgagccggagggcaaggaggttcgcacagattgggaaagtgtgcgttgagaactgccaggccttttccgggataaacgtgcaatataagctccattccagtggggctaactgttcaacgttaggggtggtgacttccgctgaagatacctctggcattctgttcgttaacgataccaaggcactgaggcgaccgaagtgcgcagaactgcactacatggtcgtggccacagaccaacagacatcccggcaggcccaagctcagctcttagtgacagtggaggggagttacgtcgcagaagaagctggttgcccactgtcttgtgccgtgagcaagcggaggttggaatgcgaggagtgcgggggtctgggctcaccaaccggtcgctgtgaatggagacaaggcgatggcaaggggattaccagaaactttagcacctgcagtccctcgaccaaaacttgtcccgacggacattgtgatgtggtagagacccaggacataaacatctgtccgcaagattgtctgaggggcagtattgttggagggcatgaacccggtgaaccccgaggcattaaagccggatacgggacttgcaattgttttcctgaagaggaaaagtgtttctgcgaacctgaggacatacaagatccgctctgtgacgagctctgtaggacagtgatcgctgctgcagtgctattttcattcatcgtgtccgtgctgctgagcgctttctgcattcactgctaccataaatttgcccataaacctcctattagctcggctgaaatgacattccgcagaccagcacaggccttcccagtttcttactcgtcctctggagctcggaggccttccctggacagcatggagaaccaggtgtcggtggatgccttcaagattctagaagatcccaagtgggagttccctcgtaagaacctcgtgcttggaaagaccttaggagaaggggaatttggtaaggtggtcaaagcgaccgcatttcatcttaagggaagggccggatatacaacggtggcggtcaagatgctgaaagagaacgctagcccctcagagctacgcgacttgctgtccgaattcaatgttttgaaacaggtgaatcatcctcacgttatcaagctctacggagcctgtagccaggacgggccactactgctgatcgtggagtatgcaaagtacgggtctttgaggggatttctccgcgaatcccggaaggtcgggcctgggtacctgggcagtgggggaagcaggaattcgtcaagtctcgatcacccagacgaaagggcccttaccatgggcgacctcatctccttcgcatggcagatctcccagggcatgcagtacctggccgaaatgaaactggtgcatcgagacctggccgctcggaacatcctcgtcgctgagggccgaaagatgaagatttctgatttcgggctctcgagggatgtctatgaagaggatagctacgtcaaacgcagccaaggaaggatcccagttaagtggatggctattgagagccttttcgatcacatatacactactcagtccgatgtttggtccttcggcgtgctgctctgggagatcgttacccttgggggaaacccgtaccccggaatacctccagagcgtctcttcaatctgctaaagacagggcatagaatggagcgccctgataactgtagcgaagagatgtatcggctgatgcttcagtgttggaagcaggagccggacaagcggcctgtgttcgctgacatctcgaaagacctcgagaagatgatggttaagagaagggactatctggacctggccgcttctacaccatctgatagtctgatctatgacgatggattgagtgaggaagagacaccgctggttgattgcaataatgctcctctacctagagcgctgccaagcacgtggatcgagaataagctgtacggcatgagtgacccgaattggccaggtgaatcccctgtgccgctcacaagagccgacgggacaaataccgggttcccacgctacccgaatgatagcgtatacgccaattggatgctgtcaccttccgccgctaagctgatggacacctttgacagctag

SEQ ID NO: 238404 - DNA, 1377 bp, Artificial Sequence
  Description of Artificial Sequence: Synthetic coding sequence
atggccaaagctacttcaggcgctgctggcctccggttgctattgctgctgctccttcccctcctcggaaaagtggcccttggtttgtattttagtcgggacgcatattgggagaaattatacgtcgatcaagcggcaggcactccccttttgtatgtacatgcgctgagagacgcccctgaagaggtgccatcatttcgacttgggcagcacctgtatgggacctaccgtaccagattacacgaaaataactggatctgcatccaggaagacaccgggctcctgtacctgaacaggagtctggaccactccagctgggagaaactaagcgtccggaaccgcggtttccctctgctgaccgtctacttgaaagtgttcctgtctcccacttctctgagagagggggagtgccaatggcctggatgtgcgcgagtgtattttagttttttcaacacctctttccccgcatgctcctcgctgaaacctagggagctctgtttccctgagacacgccctagttttcggatacgggagaacaggccccctggaactttccatcaattcaggcttctgcccgtgcaattcctatgtccgaatatcagtgtagcatataggctgctggaaggagaaggattaccattcagatgtgctccagactcacttgaagtctctactagatgggctttggatagggagcagcgcgagaagtacgaactcgttgctgtctgtacggttcacgcaggtgccagagaggaggtagttatggtgccgtttccagtaaccgtgtacgatgaagatgactctgcgccaacatttccagccggtgtcgataccgcgtctgctgtggtagagttcaaacgcaaggaggataccgtcgtagctactcttcgtgtgtttgacgccgatgtggtgccagctagcggagaactggttcgcaggtacacatccaccctgctgccaggcgacacgtgggcccagcagaccttcagggtggaacattggcccaacgaaactagcgttcaggccaacggctcatttgtgcgggcaacagtgcacgattatcgcctggttctgaatcgcaaccttagcatcagcgagaaccgcaccatgcaacttgctgtactcgtcaacgactcagatttccaggggcctggagcaggtgtgctgcttttgcattttaacgttagtgtgctgccggtctcgttgcatctcccttcaacctattccctctcggtaagccgcagagccaggcggttcgcccagattggtaaagtgtgcgtcgaaaactgtctggccgacctcactggggatgccgtgtccgggagggacgaggccagatcgtctggtcttggatctcagaaacaccccggttcatag

SEQ ID NO: 238405 - DNA, 786 bp, Artificial Sequence
  Description of Artificial Sequence: Synthetic coding sequence
atggatgaggcccttgaaactcagctgaaaaccagtcgcggtcgattttcagcaactgagtcactccccaccctcgagctactatcacaagtcgatatggactgccgcgttcacatgagaccaattggtcttacttgggtactgcagttaaccctggcctggattctgcttgaagcttgtgggggttcccgcccactgcaggccagatctcagcagcatcatggcctggccgctgatctgggaaaagggaagcttcatctagccggaccatgttgcccttctgagatggataccacggagacctctgggccaggaaatcaccccgagaggtgtggggtgcccagtcctgagtgcgaatcctttttggagcatctgcagagagctctgagatcacgcttccggctgagactgctcggcgtaaggcaagcacaacctttgtgtgaagagctgtgccaggcttggtttgccaattgtgaagatgacattacttgtggccctacgtggttgcctctctcagaaaaacggggatgcgagccctcctgtttaacttacgggcagacttttgccgatgggactgatctctgtaggagtgccctcggacatgccttgcctgttgccgctcctggagcacgacattgcttcaatatttcgatatccgccgtgcctagaccccgaccgggaaggcggggaagagaggcccctagccgcaggagtagatctcctagaactagcattttggacgcagcaggaagcggtagtggctctggatctgggagcggcccttag

SEQ ID NO: 238406 - DNA, 675 bp, Artificial Sequence
  Description of Artificial Sequence: Synthetic coding sequence
atgggatggcagctcatctgggccaaagcttcatgcacctggcaggatctagtcgtgccccaacggtggacccaacagaggcaccgggctctggaaactatacagaatgccgtggaatgtagggccctgaacgctaatccaagttggaatacatccaatgtgccgttcgccgtcgccagcgcctgtggatattggggctatgcccgtcactccaggtcagcaaggagctccgctagacccggtagccccaccgccaagatgatttccccggcagccagactgggatcccactctcagaagaaaggagccgtttcaccggcagccctgcccatggacaggttggagtgttccggcgcaataagcgccagatgtaacctacggcttcgcggaagcagcgacagccccgcagccacgtccagaatcgctggcatttctggcgcttgccatcatgctcaactaattttcgtgttcctcgtggaatcagccttccatcacgtcggccaggcgggattcgagctactgacctcgggtgatccacctacaagcgcaagtcagtccgtgggtattaccggcgtgagtcacagacccagaccgcctccctcttcatttttgccgtgcttagatcctcgggatagaatcggtaccccccaggtgccagctcccacacttccctag

SEQ ID NO: 238407 - DNA, 690 bp, Artificial Sequence
  Description of Artificial Sequence: Synthetic coding sequence
atggactgccgggtccacatgagacctatcggcctcacctgggttttgcaactgactcttgcctggattctgctggaggcgtgtggtggcagcaggccactgcaggctcgcagtcagcagcaccacggccttgctgccgacctcgggaaaggcaaactgcacctggcagggccatgttgtccttcggaaatggacaccacagagactagtgggccagggaatcaccccgagcgatgcggggtgccatcaccagagtgtgagagttttctggaacatctccagagggctttgagaagtcgatttcggctccgactcttgggagtgagacaggcccagcccttgtgcgaggagctgtgtcaggcctggttcgccaattgtgaggatgatattacttgcggacctacatggctgccactgtcagaaaaacgcggatgcgaaccatcttgtctgacatacggccagaccttcgcagacggaaccgatctctgtcgcagcgcccttgggcacgccctgccggtggctgcccctggggctagacactgtttcaatatctccataagcgccgtgccccgacccaggcccggacgcaggggaagggaagcgccttccaggagatcgaggtctccgaggaccagtatcctcgacgccgctgggagtggctctggcagcggttcaggaagcggtccctag

SEQ ID NO: 238408 - DNA, 618 bp, Artificial Sequence
  Description of Artificial Sequence: Synthetic coding sequence
atggatgaggccttagaaacccagctcaagactagccgcggtcgcttttctgccacagagagcttaccgacgttggagctcttgtctcaggttgatatggattgtagagtacatatgaggcccattgggcttacttgggttctacagctcacgctagcctggatcctgctagaggcgtgtggcggaagccggcctcttcaggccagatctcagcaacaccacggcttagctgctgatttgggaaagggcaagctgcacttggccggaccgtgctgtccttctgagatggatactactgaaacttccggcccaggcaatcatccagaacgttgcggtgtccccagccccgagtgtgaatccttcctcgagcaccttcagcgagccctgagaagcaggtttagactccgccttctcggggtgaggcaggcccagccactgtgcgaggagctctgccaggcctggttcgcaaactgcgaagacgacatcacctgtggcccaacttggctgccgctgtcagagaagagaggatgtgagccttcttgtcttacatacggacaggctggcgttcagtggcgggacttgtcgtctatgcagccaccccctccaggcttcaaatag

SEQ ID NO: 238409 - DNA, 720 bp, Artificial Sequence
  Description of Artificial Sequence: Synthetic coding sequence
atggcaagacagcttctgagtcaggtggacatggattgccgtgtgcacatgagaccgatcggcctgacctgggtcctgcagttaaccctcgcttggatcctcttggaagcctgtggcggatcccggcctctacaggcaagaagtcaacagcatcacgggctagccgctgatctgggcaaagggaaattgcacctggctggaccatgttgtccaagtgagatggacacaaccgagacctcaggccctggaaaccatcctgaaagatgcggcgtgccaagtcccgaatgcgaaagctttctggaacatctgcaacgcgcactgcgatcacggttcagactgaggctgttaggtgtgcggcaggcacagcctctgtgtgaagaactatgtcaggcgtggtttgccaactgtgaagatgatataacatgtggaccaacttggctccctttgagtgagaagaggggatgtgagccttcatgcctaacatacggacagacatttgccgacggcacagacttgtgccgttctgctctgggccacgcgctcccagtcgcagcaccaggcgcacgccattgcttcaacattagcataagtgcagtgccgcgtcccaggccgggacgacggggacgagaggctccatcaagacgttcccggtcccctcgcacgagcattcttgacgccgctgggtcgggttctgggagcggaagcggatccgggccttag

SEQ ID NO: 238410 - DNA, 996 bp, Artificial Sequence
  Description of Artificial Sequence: Synthetic coding sequence
atggccagggggggtagaggccgtagactcggtttggcattaggcttgctcctggcgttggtgctggctccacgggtgctgcgcgctaagcccacggttaggaaggaaagagtggtgcgtccagattccgaactgggtgaacggcctccggaggacaatcagagctttcagtatgatcacgaggccttcctgggtaaggaagactccaaaactttcgaccagctgacacctgacgaatcaaaggagcgtctgggtaaaatcgttgaccggattgacaatgatggggacggtttcgtgaccacagaagaactgaaaacctggatcaagcgggttcaaaaacgctacattttcgacaacgtggccaaggtctggaaggactacgacagggacaaagatgataagatttcctgggaagagtataagcaagccacatatggatattatcttggtaatcctgcagagttccacgattccagcgatcaccacacatttaagaagatgctcccaagggatgaaaggcggttcaaggccgctgacctgaacggcgatctgaccgccacaagggaagaattcacggctttcctccaccccgaggagttcgaacatatgaaagagatcgtagtccttgagaccctggaagacattgataaaaacggagacgggttcgtggaccaggacgaatacatcgccgacatgttttcccatgaagagaacggcccagaacccgattgggtgctatcagaacgggaacaattcaacgaatttagggatctgaacaaagatggaaaattagacaaggacgagatccgccactggattctgcctcaggactacgaccatgcgcaggcagaagctagacacttggtgtacgagtcagataagaataaggacgaaaagctgacgaaggaggaaattctcgagaattggaacatgtttgtgggcagccaggcaactaattacggggaggaccttacaaaaaaccacgacgaactgtag

SEQ ID NO: 238411 - DNA, 87 bp, Artificial Sequence
  Description of Artificial Sequence: Synthetic coding sequence
gagatcctagaaaactggaatatgttcgtggggagccaggccactaactatggcgaagatctgacaaagaatcacgacgaattatag

SEQ ID NO: 238412 - DNA, 954 bp, Artificial Sequence
  Description of Artificial Sequence: Synthetic coding sequence
atgaggctggggcctcggaccgccgctctgggacttttactcctgtgcgctgcagcagcaggagcaggaaaggctgaagaactacactatccgttgggagagcgcagatccgattacgacagagaggccctcctgggagttcaggaagacgtggatgagtatgttaaattagggcatgaggagcagcagaaacgactgcaggccattattaagaagattgaccttgactccgatggttttttgacggaatccgagctgtcctcctggatccagatgtcttttaaacattatgctatgcaggaagccaaacagcagttcgtggaatacgacaaaaattccgacgatacggtcacctgggacgaatacaacatccagatgtacgaccgggtgattgactttgacgaaaacacagccctggacgatgccgaggaggagagctttagaaaattacacttgaaggacaagaaaagatttgagaaggctaaccaggattccggtcctggcttatcactagaggagtttatagccttcgagcaccctgaagaagtcgattacatgaccgaattcgttattcaggaggcattggaagagcacgacaaaaacggggatggcttcgtttccctggaggaatttttaggcgactataggtgggaccctacagcaaacgaagacccagagtggatccttgtcgaaaaagataggtttgttaatgattacgataaagacaatgatgggaggctggacccccaggagctgctgccttgggtggttccaaataaccagggaattgcccaggaggaggccctgcatctgatagacgagatggacttaaatggcgataagaaactgtctgaggaagaaatccttgaaaatccagaccttttcctgacgtccgaggcaactgattacgggagacagcttcacgacgactacttttatcacgatgaactgtag

SEQ ID NO: 238413 - DNA, 2331 bp, Artificial Sequence
  Description of Artificial Sequence: Synthetic coding sequence
atggccgcacccggtgatccacaggatgaactgctccccctggccggtccgggatcccagtggcttcggcacagaggcgagggcgagaacgaggccgttactcccaagggtgctacaccagcccctcaggctggcgaaccgtctcctggcttaggcgctagagccagggaggccgctagcagagaagccggaagcggacccgcacgtcagtcaccagtggccatggaaactgctagcaccggggtggctggagtgtcttcagctatggatcacacattcagtacgacctctaaggatggcgaaggtagctgttacaccagtctcatctccgacatctgctatccaccccaggaagactctacttacttcaccgggatccttcagaaggaaaatggtcacgtgaccatctccgaaagtcctgaagagctagggaccccaggccctagcctgcccgacgtgcccggaatcgagagtagagggctcttctctagcgatagtggcattgagatgaccccagccgagtcaacagaggtcaataagattcttgcagatcctctggaccagatgaaggccgaggcctacaagtatatcgacatcaccaggcccgaggaggtgaagcaccaagaacagcaccatcccgaattagaagacaaggacttggactttaaaaataaggacaccgatatcagcataaagcccgaaggcgtgcgcgagcccgataaaccagccccagtggaaggaaagatcatcaaagaccacctgctggaagaatccaccttcgccccttacatcgacgacctttctgaagagcagcgcagggcccctcaaataaccaccccggtgaagataaccttgacggaaattgagccctcagtagagactaccacccaggaaaagaccccagaaaagcaggacatctgtctgaaaccctcaccagatacagtgccaactgttaccgtgtctgagcctgaggatgactcgcctggcagtatcaccccaccatcttcggggaccgagcccagtgccgctgagtcacagggcaagggaagtatttcagaagacgagctcatcactgcaatcaaggaggccaagggtctgagctacgagactgctgaaaacccacgcccagtgggacaactcgccgatcgcccagaggtgaaggctaggtccggccctccaactatcccatctccactggaccacgaggcctcctcagcggagtctggcgattctgagatcgagctcgtaagtgaggaccccatggctgctgaggacgccctgccctctgggtacgtgagtttcggacacgtgggtggacccccaccttcccccgcatctccttccattcagtatagtatcctccgggaggaacgtgaggccgaactagactcagaactgataattgaatcctgtgacgcatccagtgcctcggaagagtcccctaagcgcgagcaggacagtccacctatgaagccctcagccttggacgccatccgcgaggaaaccggagtccgcgctgaggagcgggctccttcccgacggggacttgctgagcccggttcctttcttgattacccaagcactgagcctcaaccagggccagaactgccccctggcgacggagcgctggagccagaaacaccgatgctgcccaggaagcctgaagaagacagttcatctaaccagtcgccagccgcaaccaagggccctggtcccctgggcccaggcgctccaccgccattattatttctgaacaagcagaaggccattgatctcctctactggcgggacataaaacagaccggcattgtgtttggttcgtttctgttgctcttgttctcgctgacccagttcagtgtggtgtcagtggtggcctaccttgctctcgccgcactctcagctaccatttcgttcaggatttataaatcggtgctccaggcggtccagaaaactgacgagggtcaccccttcaaagcctacttagagctcgaaattacactctcacaggagcagattcagaagtatactgattgtctgcagttctacgtcaactcaacattgaaagagttacgacggctgttcctggtgcaggacctggtcgattctctcaaatttgcggtgctcatgtggcttctgacatacgtgggagcccttttcaatggtcttacacttttgctgatggcagtggtgtccatgttcacgctacctgtggtctatgtaaaacaccaggctcagatcgaccagtacctgggcttggttagaactcatataaacgccgtggtggcgaaaatccaggcaaagatccccggagcgaaaaggcatgcagaatag

SEQ ID NO: 238414 - DNA, 627 bp, Artificial Sequence
  Description of Artificial Sequence: Synthetic coding sequence
atgcaggccaccgcagattctaccaaaatggattgcgtatggtctaactggaagagtcaggccatcgacttgctttattggcgggatatcaagcagacgggaatcgtgtttggctccttccttctattgctttttagtctgactcagtttagtgtggttagtgtcgtggcctacttggctctcgccgcactgagcgccaccatatccttccggatctataagagtgttctccaagccgtgcagaagactgacgagggacatccgtttaaggcatacttggaactcgagattaccctatcacaagagcagattcagaagtacacagactgtctgcagttctacgtaaattccactctcaaagaactgcggaggttgttcttagttcaggacctcgtggacagcttgaaattcgcagtgttgatgtggcttctcacatacgtgggagcgttgtttaatggtttgactctcctgttgatggccgtcgtctcgatgttcaccctgccagttgtgtacgtgaagcatcaggcgcaaatcgaccagtacctggggctggtgcgcacccatatcaacgcggtagtagccaaaatccaggccaaaatacccggtgcgaaacgtcacgcagagtag

SEQ ID NO: 238415 - DNA, 1071 bp, Artificial Sequence
  Description of Artificial Sequence: Synthetic coding sequence
atggcagccgaggatgccctgcctagtgggtacgtgtcattcggtcacgtgggaggtccccctcctagccccgcttctcctagcatccagtactctattctccgggaagagcgggaagcagaattggatagcgagcttatcatcgagagctgcgatgcaagttcagcaagtgaagagtcccctaagcgcgaacaagactctccaccaatgaagccctcagcgctggatgctatcagagaggagacaggcgtccgggctgaagagcgagcgccatcccgacggggattggcagagccaggcagctttctcgactatcccagtaccgagccccagcctgggcctgagctgcctcccggtgacggggctcttgagcccgaaacacctatgttgccaaggaaacctgaagaggactcctcctcaaatcaatcccctgctgctaccaagggaccaggccctctgggaccaggtgcgccacccccactgctgttccttaataagcaaaaagcaatcgacctgctgtactggcgggacatcaagcagacagggatcgtgtttgggtcatttctcctgctgctttttagcttgacccaattctccgtggtgagcgtcgtcgcttacctggcactcgcggctttgtctgccactatctcgtttagaatttacaagtccgtcctgcaagccgtgcagaagaccgatgagggccatccattcaaggcttatctcgagctggaaatcacgctgtcacaagaacagatacagaagtacaccgactgccttcagttctatgtgaactctactctcaaagagctgaggaggctgttcctggttcaggatttggtcgacagccttaagtttgccgtcctaatgtggttgcttacatatgtgggagccctgtttaatgggcttacactattgcttatggccgtcgtgagtatgttcaccctgcccgtagtctacgttaagcaccaggcccagatcgatcaatacctcggactagtgaggactcacattaacgcggtggtggccaagatacaagctaagattcctggcgctaaacgccatgccgagtag

SEQ ID NO: 238416 - DNA, 2109 bp, Artificial Sequence
  Description of Artificial Sequence: Synthetic coding sequence
atggagacagcgagtaccggtgtcgcgggtgtgagcagcgccatggaccacaccttctccaccacctctaaggatggtgagggtagttgttacacatcccttatctcagacatttgttatcctccgcaggaagactcaacatattttacgggaatcttgcagaaagaaaatgggcacgttacaatttctgagtctccagaagagttgggtactccaggaccgagtttgccggacgtgcctggcatagagtctcgcggactgttttccagcgactccggcatcgagatgacccccgctgagtcaactgaggtgaataagattttggccgacccacttgatcagatgaaagccgaagcctacaagtatatcgatattacacgcccagaggaggtcaagcatcaggaacagcatcaccccgagctggaggataaggacctggacttcaaaaacaaagatacggacatttccatcaaacccgaaggtgtgagggagccagacaagcccgcacctgtggaggggaagatcattaaggatcacttattagaagaaagtacttttgccccatatatcgacgacctgagcgaagaacagcggagagccccacagatcaccaccccggtgaaaattacattaaccgaaatcgagccctctgttgagaccaccacccaggaaaagaccccagagaagcaagacatctgccttaagcccagcccagatactgtgccaaccgtgaccgttagtgagcctgaggacgactcgcccggatcgatcaccccaccatcatcaggcaccgagccctccgctgccgaatcccaggggaaggggtccatcagtgaggatgaactgataaccgcaattaaggaagcaaaaggattgagctacgaaactgcagaaaatcctcgacctgtgggccagctggccgaccggccagaggttaaagctagaagcggccctcctacaatcccatctccactggaccatgaggcctcaagcgctgaatccggggatagtgagattgaacttgtgtcagaggatcctatggcagcggaagacgccctgcctagtggatacgtgagcttcggccacgtcggcggaccacccccaagccccgcttccccctctattcagtatagcatcctgcgggaggagagggaggctgagctagactctgaacttatcatagaatcttgcgatgcttcatcagcctccgaagagagtcctaaacgggaacaggattctccccctatgaaaccaagcgccctggatgcaattcgggaggagactggggttagggctgaagaaagagccccttcccgcagaggactcgccgaaccaggatctttcttagactaccccagcaccgagcctcagcctggcccagagttgccccctggcgacggggcactagaacctgaaactccaatgctgccgcgtaaacctgaggaagatagcagtagtaatcagagtcctgctgcaactaagggcccaggacccctgggtccaggagcaccacccccacttcttttcctgaataagcagaaggccatcgatttgctatattggcgagatattaaacagactggtattgtgtttggcagcttcctgctcttgctgtttagccttacacaatttagcgtcgtgtcagtggttgcatatctggccttggccgctctcagtgcgaccatcagttttaggatctacaagagcgttttgcaggccgtgcagaagacagatgaaggacatcccttcaaggcttacctggagcttgaaatcaccctgtctcaggaacagattcaaaagtacactgattgcttacagttctacgttaattccactctgaaagagctccgcaggctgttccttgtacaagatctagtggacagtctgaaatttgcagtgttaatgtggctcctgacatacgtgggggcactgttcaacgggctcaccttactgctgatggccgtcgtctctatgtttacactgcccgttgtctatgtaaagcatcaggcgcagatcgaccagtacctgggccttgtgcgcactcacatcaatgcagtggtcgccaagatccaagcaaagatccctggagctaaacgccatgcagagtag

SEQ ID NO: 238417 - DNA, 1638 bp, Artificial Sequence
  Description of Artificial Sequence: Synthetic coding sequence
atgggccaggttctaccagtgtttgctcactgtaaggaagccccaagtacggcttcaagcacgcccgatagcaccgaaggcggaaatgatgatagcgattttcgggaactgcataccgcccgagagtttagcgaggaggatgaggaggaaactacatcgcaagattggggcacccctagggagctaacattctcttacattgcattcgatggggtggtaggtagcgggggacgtcgtgactctactgccaggagacctcgtccgcaaggtagatctgtctctgagcctagggaccaacatccccagccttctctcggtgactctctcgaatctattccaagtttgtcgcagagtcctgaacccggaagaagaggtgacccagataccgcgccaccttctgaaaggccccttgaggatcttaggctgcgtctcgatcatctcgggtgggtcgccagaggtacaggctcaggcgaagactcatcaacatcttcttccactccactcgaggacgaagagccccaggaaccaaacaggctggagactggggaggcaggggaagagttggacctccgcctacgactggcccagcccagcagcccagaagtgcttacccctcagctgagccctgggtcaggcacgcctcaagccggaacgcctagtcccagcaggagcagggatagtaactcgggcccagaggagcctctgctcgaggaggaggagaaacagtggggtccactggaaagagaacccgttagaggacagtgcttggactccactgaccagctggagttcacggttgagcccagactcttggggactgccatggagtggctcaaaacttctctattgctggcagtgtacaagacagtccctatattggagctgagccccccactgtggactgcaattggatgggtgcagcgaggacctacccccccaacgcccgtgcttcgcgtgttgttgaagtgggctaaaagccctagaagcagcggagtcccaagtttaagtcttggagctgatatggggtccaaggtggccgacctactgtactggaaagatacgagaacaagcggggtcgtattcacggggcttatggtttctctgctgtgtcttctccacttctccatagtttcagttgccgcacatctggcactgctcctgctgtgcggtacaatttccttgcgggtgtataggaaggtgctacaggccgtgcaccgcggagacggcgcaaaccccttccaggcataccttgacgtggacctcactttgacaagggagcagaccgagagactttcacatcagatcacgtctcgcgtagtcagcgcggctacccagctccggcatttcttcctcgtcgaggatctggttgactctctaaaattggctcttctcttttatatactgactttcgtgggcgcaattttcaacggcttaaccctactcatcttaggcgttatcgggttgtttaccatcccactactgtaccgccaacaccaggcgcagatcgatcaatacgttggactggtgactaatcagctgtcccacattaaggcaaagattcgggcaaagatacctgggaccggggctttagcctctgcggctgcagccgtttccggctcaaaggccaaagctgaatag

SEQ ID NO: 238418 - DNA, 1419 bp, Artificial Sequence
  Description of Artificial Sequence: Synthetic coding sequence
atgggacaagttctccccgtgttcgcccactgcaaggaggctcccagcaccgcaagcagcactcctgacagcaccgaagggggaaatgatgattccgatttcagggagttgcacaccgccagggaatttagcgaagaggatgaagaggaaacaactagccaggactgggggacccctcgcgaactgaccttctcttatattgcttttgacggcgtcgtcggaagtggcggtaggagagattccactgctagacgacctcggcctcaggggaggtctgttagcgaacctcgtgaccagcatcctcagccctctcttggcgactccctcgagtccattcctagcctgagtcagtctccagagcctggccgaaggggggatccagatactgcacccccatctgaacggcctttggaggatctccgcctccgcctagatcatctcggttgggtcgcgagaggaacgggaagcggcgaagattcctccacatctagctccaccccactggaggacgaagaaccccaggagcccaaccgtctcgagactggcgaggccggtgaagaactagacttgcgactacgtttagcccagccaagcagcccagaggtactgacgcctcagttatcgccgggatcaggtactccacaggcgggaacacctagcccgagtcgatctagagactctaacagcggccctgaggagcctctgctggaggaggaggagaagcagtgggggcctttagagagggagccggtgcgcggacagtgtttggattccacagaccagttggagttcacagtggaacccagactcctggtggccgacctcctgtattggaaagatacaagaacttcaggtgtggtgttcacaggcctcatggtctccctcctctgcctgcttcattttagcatagtgagtgtggcggctcacctcgcgctcctgctgttgtgcggaaccatcagtctgagggtgtaccgcaaagttctacaggccgtacacaggggtgatggggctaacccgtttcaagcctatctcgacgtggacctgaccctgactagggaacagactgaacgactctcccatcagatcacttcacgcgtcgtgtccgctgccacacaactcaggcactttttcctagtcgaagacctggttgacagcctgaagctagctctgttgttttacattctaacattcgtgggcgcaatttttaatgggctgaccctgctgattttgggggttataggactcttcactattcctctactgtaccggcagcatcaggcacagatagaccagtacgtcgggctggtcaccaaccagctcagtcacatcaaggctaagatacgtgcaaaaattcccggaaccggcgctcttgcttctgctgcagctgccgtgagtgggagtaaagctaaagccgagtag

SEQ ID NO: 238419 - DNA, 618 bp, Artificial Sequence
  Description of Artificial Sequence: Synthetic coding sequence
atgggcagcaaggttgcggacctgttgtactggaaggacaccagaacgtctggcgtagtttttacaggcctaatggttagcctgttgtgcctcctgcactttagtattgtgtcggtcgctgcgcatcttgcccttctacttctttgcggcactattagtctcagggtttatcgcaaggtcctccaggcggttcacaggggagatggcgctaatccttttcaagcatacctggatgttgatttgacgctaacccgcgagcagaccgaacgtctgtctcatcaaatcaccagccgagtggtatcagctgccacacagctgaggcacttttttttggtggaggacttggtagatagtttgaagctggccctgctgttctatattctcaccttcgtaggtgccattttcaacggcttaaccttgctcatcctgggggtcattggtctttttactattcctcttctctatcggcagcatcaggcgcagattgatcagtatgttggcttggtgaccaaccagctgtcccatattaaggcgaaaatcagggccaaaatcccgggaaccggcgcactggccagcgccgctgccgctgttagcggtagtaaggccaaggcagaatag

SEQ ID NO: 238420 - DNA, 3042 bp, Artificial Sequence
  Description of Artificial Sequence: Synthetic coding sequence
atggccgaaccatcagcagccacacaatcccattccatctcaagcagcagctttggcgcagagccttccgcgcctgggggaggcggttcgcctggggcttgccccgcactcggaactaagagctgcagctcaagttgtgcagaaggactctctagtctgtgttctgacgagccttcttccgagatcatgacgagctcattccttagctcttccgagatccataatacgggtttaacaatcctacacggagagaagagccacgtactgggctcacagccaattttggcaaaagagggtaaggatcacttggacctgctggatatgaagaaaatggagaaaccccagggaacaagtaacaatgtaagcgactctagtgtgtccttggccgcaggagtgcactgtgaccggccaagcattcctgcctctttccccgaacatcctgcctttttgtccaagaagatcgggcaagtggaggagcaaatcgataaggagacaaagaatcctaacggcgtgagctctagggaggccaaaacggcactcgacgctgatgaccggttcaccctgctgacggcccagaagccacccacggagtatagtaaagtggaaggcatctacacctatagcctttctccctctaaggtaagcggagatgatgtcatagagaaagactcccccgagtcccccttcgaggttattattgacaaagccgctttcgacaaagagttcaaggacagctacaaggaatcaaccgacgactttggtagctggtcagtgcataccgataaagaatcatccgaggatatctctgaaaccaacgataaactgttcccattgcggaataaagaagccggacggtatcctatgtccgcgctcctctcaaggcagtttagccatacgaatgcagcactcgaggaggtaagtaggtgcgtgaacgatatgcataatttcactaatgaaatcctgacctgggatcttgttccacaggtgaagcagcaaactgataagagttccgactgcattactaagaccaccggactggacatgtccgagtacaattccgagatcccagttgtcaacctgaagacaagtacccaccagaaaactcctgtgtgttcaattgatggatccactcctattacaaaaagtacaggggactgggcagaagcctctttacaacaggaaaatgctattacagggaagcctgtacccgacagcctgaatagtacaaaggaattctccattaaaggagttcagggaaatatgcagaagcaagatgacaccctggccgaactgcccggttcgcctcccgaaaagtgcgacagtctaggcagcggagtagccacagtaaaggtagtccttcctgacgaccacttgaaagatgaaatggattggcagtcctccgcgctgggtgaaatcacagaagcggattcatcaggcgagtctgatgatacagtaatcgaggatattacagcagatacttcgttcgagaataacaaaattcaggccgagaagccagtgagcatcccctctgccgtcgtgaaaaccggtgagcgcgagatcaaggaaatccctagttgcgagagagaggagaagacttctaagaatttcgaagagctggtgtccgatagcgaactgcatcaggatcagccagacatcttagggagatctccggcttccgaggcagcctgctctaaggtcccagatacaaacgtatctctggaagatgtatcagaggttgcacccgaaaagcctatcacgactgaaaatcctaagctcccgagcacagtgagcccgaacgtattcaacgagacagagttctccttgaacgtaaccacgtccgcttatctcgagagcttgcacggcaagaacgtaaagcatatagacgattcctcacccgaggatttgatcgcggctttcacagagacccgcgacaaaggtattgtggattcagaacgcaatgcatttaaagccatatcagaaaagatgaccgattttaagactacgcctcccgtcgaggttctgcatgaaaacgagagtggcggttccgagattaaggacatcgggtcgaagtattctgagcaatctaaagagacaaacggatcagaacctctgggagtattccctacacaggggaccccagtggcctcacttgatcttgagcaggaacagctgactattaaagcactgaaagaactgggcgagcgtcaggtcgaaaaaagtaccagcgcccagagggatgcagaacttccttccgaggaggtcctgaagcagaccttcacctttgctcctgagagctggccgcaacgtagttacgatatattggagaggaacgttaaaaatgggagcgatctcggaatcagccaaaagcctattaccatacgtgaaaccacccgggtcgacgcagtgtcttcactgtccaaaaccgagttggtcaaaaagcacgtgttggcaagattgctgaccgacttttccgttcatgacttgattttctggagagatgtgaagaagactgggtttgtgtttggcacaaccttgatcatgttgctgagcttggcagccttctctgtgatttccgtagtcagctatctgatcttggccctgctgtctgtcactataagcttcaggatctataagagcgtgatccaagctgtccagaagtccgaagagggacatccatttaaggcataccttgatgttgatatcactctctcgtcagaagcctttcataattacatgaacgccgctatggtgcacatcaatagagcccttaaactaataatccggctgttcctcgtggaggacctggtggacagtctgaaacttgctgtgtttatgtggctgatgacttacgtcggcgctgtcttcaatggtattactctactcatactggccgaactgctgattttctccgtacctatagtatatgagaagtataaaacccaaatagaccattacgtcgggatcgccagagaccagactaaatccatcgtcgagaagatccaagctaaactgcctgggattgctaaaaagaaggccgaatag

SEQ ID NO: 238421 - DNA, 726 bp, Artificial Sequence
  Description of Artificial Sequence: Synthetic coding sequence
atggccgaaccctcagctgccactcaatcacactcaatcagtagttcaagcttcggcgctgaaccctctgcccctggtggtgggggatctccaggtgcttgcccggctcttggcacaaaatcttgttccagctcctgtgctgtgcatgacctgattttttggagagatgttaagaaaactggattcgtattcggcaccacacttattatgctcctcagcctggccgcatttagtgtgatttccgttgtaagttatctgatccttgctcttctctccgtgaccatatcctttcggatttacaagtccgtcattcaggccgtacagaaatccgaggagggacatcccttcaaggcgtacctggatgtcgatattaccctgtctagcgaggccttccataattatatgaatgccgcaatggtgcacataaacagagccttgaagttgatcatcaggttgtttctagttgaggaccttgtggactctctgaagttggctgtctttatgtggctgatgacctacgtcggagccgtcttcaatgggattaccctgctcattctggcagaactgctgatctttagtgttccaatcgtttatgagaaatataaggacccttccaagactccctggaaccgtcagaagaagggcaggatctctacctggaagcctgaaatgcaacagcttttgaaacaccacctgatcgtgattacctctctattggtgctgtag

SEQ ID NO: 238422 - DNA, 645 bp, Artificial Sequence
  Description of Artificial Sequence: Synthetic coding sequence
atggccgagccatcagccgctacccagtctcacagtatatctagctcaagtttcggtgcagagccatctgcacctgggggtggtgggtcccctggcgcatgtcccgcacttggaacaaaaagctgcagtagcagctgcgctgtacatgatctgatcttctggcgcgatgtgaagaaaactggcttcgtgttcgggaccaccctgattatgctgctgtctctagctgctttctctgtgataagtgtagtctcctacttgatcttagctctcctctccgtgacaatctcatttagaatctacaagtctgtgatccaagcagttcagaagtccgaagagggacacccatttaagccacgacttatcactatgttagccagccctgagattcgcccttctcaactgctaaagcgcagcaaacagaatagccttgaatcccccaagaagcggcagaataaatacatggagacacgaaacgccaccgtgaccaagacaccgtttaactcgtacaatgtcgtaacctgtactatgaaggagaacacacaatgccagttggagcctgccttccaggcgttcttccttatttggtgtttcttgcctagcttcccctttaatccccagtaccaggcacagaaactgatggactag

SEQ ID NO: 238423 - DNA, 768 bp, Artificial Sequence
  Description of Artificial Sequence: Synthetic coding sequence
atggcggagccgagcgcggctacccaatcccattccatatcgagctcaagttttggggctgagccgagcgcaccgggagggggtggcagtcccggagcatgccctgctctcggcacgaagagctgcagctcctcttgcgccgatagctttgtgagtagtagctcttcccagcccgttagtctgttttctacgtcccaagtccacgacctcatcttctggagagatgtgaagaagaccggattcgtattcggaaccaccttaattatgcttctgagcctcgccgctttcagtgtaatttccgtggtgagttacctaattctcgctctgttaagtgtgaccatcagcttcagaatctataagtcagtcattcaagccgtgcaaaaaagtgaggagggccatcctttcaaggcatacctggacgttgacattacactgtcttctgaggcctttcataattacatgaatgctgctatggtgcacatcaatcgcgcattgaagctcattattcgattattcctggtggaggacctggtggacagcctgaagctagccgtctttatgtggttgatgacctatgtcggggcagtgtttaacggtataactctcctgatcctggccgagctgctcatcttttcagttcccatcgtgtatgagaaatacaaaacccaaattgatcactacgtcggaatcgccagggatcaaaccaaatctatagtggagaagatccaggcaaaactcccaggaatagcaaagaaaaaagccgagtag

SEQ ID NO: 238424 - DNA, 3099 bp, Artificial Sequence
  Description of Artificial Sequence: Synthetic coding sequence
atggccgaaccaagcgcagcaactcaatctcactcaatttcaagctcttctttcggtgctgagccatcagcccctggtggcggaggctcccctggagcatgcccagcgctgggcaccaagtcctgcagctctagctgcgcagattccttcgtttcaagtagcagctcacagcctgtttctttgttttctacttcacaggaggggctctcgtccttgtgcagcgacgagccaagttcagaaattatgaccagctccttcctgagcagcagcgagatccataatactgggctgactatcctgcatggcgaaaagagccatgtgctcggaagccagcccatcctggctaaagagggcaaagatcatctagatctactggatatgaagaaaatggaaaagcctcagggtacttctaacaatgttagcgatagcagcgttagcctggcggcaggggtacattgcgatcgtccttcgattcctgcttcatttccagaacatcctgccttcctgtcaaaaaagataggccaagtcgaagagcagatcgacaaagagaccaagaatcccaatggagtgagttcacgagaggccaagaccgcactcgatgccgatgatcggtttacactgctgacagcccaaaaaccgcctacggaatattccaaagtggaagggatctatacgtatagcctcagccccagtaaagtgagcggagatgacgtgatcgagaaagattcccctgagagcccttttgaggtcattatcgacaaagcggcttttgacaaagaattcaaggacagttataaagaatctacagatgatttcgggtcctggagcgttcacactgataaagagtccagcgaagatatatcagagaccaacgacaagctcttccccctgaggaacaaagaggcgggtagataccctatgtctgccctactgagtagacagttttcccacacaaacgcagccctcgaggaggtgagccggtgcgtgaatgatatgcacaactttactaacgaaattctgacctgggatcttgttccgcaggttaaacagcagaccgacaagtcatctgactgcataacgaaaaccacaggcttggacatgtctgaatataacagcgagatcccagtcgtaaatctgaaaactagcactcaccaaaaaacaccggtgtgcagcattgacggatctacgccaataaccaaaagcacgggggattgggcggaagccagtctacagcaggagaacgccatcacaggaaagcccgtcccggattccctaaattcgaccaaagagtttagcatcaaaggggtgcagggcaacatgcagaagcaagatgatacattggcagaactgcctggtagtccccctgaaaaatgcgattccctaggaagcggagtggccactgtaaaagtagtcctgccagatgatcatctcaaggacgaaatggattggcaatctagcgctctgggagaaattacagaagctgactctagcggcgaatccgacgacactgtcatcgaggacattactgctgatacctcctttgagaacaacaagatacaggccgagaagcccgtgagcattccaagtgcagtggtgaagacaggagaacgcgaaataaaggagattccaagttgtgaacgtgaggagaagacaagcaagaactttgaggagctcgtgagcgactccgagctacaccaagaccaacctgatatcctgggaagatctcccgctagtgaggccgcatgcagcaaagttcccgacacaaacgtgtctttagaggacgtgagcgaagtcgctccagaaaagcccataaccactgaaaatcccaagctgccatcaaccgtaagtccgaacgtctttaacgagaccgaattctccctcaatgtgaccactagcgcgtatctggagagtctgcacgggaagaacgttaagcatatcgatgattcttctcctgaggatctgattgcagcttttacagaaacacgagacaaaggcatagtggatagcgagcgtaatgcctttaaggcaatcagtgaaaaaatgacagacttcaaaaccaccccccctgtggaggttctgcacgaaaacgagtccggaggtagtgaaatcaaggatatcgggtccaagtactctgagcagagcaaggagacaaatgggagtgaacctctgggtgtgtttcccactcagggaacaccagttgcaagcctggacctggagcaggaacagctgacaatcaaggctctgaaggaattaggcgagagacaggtggaaaaaagcacgagcgcacaacgtgacgctgaattgccctctgaggaagtgctaaagcagaccttcactttcgcaccagagtcatggccccaacgatcgtatgacatcctggagcgtaacgtgaaaaatggttccgacttgggcatttcgcagaaacccatcactatccgggagaccaccagggtggacgcagtcagcagcctcagcaagaccgagctcgtgaaaaagcatgtcttggctaggctgttgaccgattttagcgtccatgatctgatcttctggcgggacgtaaagaaaacaggattcgtgttcggaactacgctaattatgctgctttccttagcagctttcagcgttataagtgtcgtgtcctatttaattcttgcgctgctgtctgttactataagtttcaggatctacaaaagcgtcattcaggccgttcagaagagtgaggagggacatccatttaaggcctacctggatgtcgatattactctgtcctcggaggcctttcataattacatgaatgctgctatggtgcacatcaaccgagcccttaagcttatcatccgactgttcctggtcgaagaccttgtggacagtctcaagctggcggtgtttatgtggctgatgacatacgtgggagccgtgtttaatggtatcactctccttatcttggccgagctccttattttctcagttccaattgtttacgagaagtacaaaacccaaattgaccactacgtaggcatcgctagagaccaaactaaatccattgtcgaaaaaatccaggcaaagctgccaggcattgctaaaaaaaaggctgagtag

SEQ ID NO: 238425 - DNA, 372 bp, Artificial Sequence
  Description of Artificial Sequence: Synthetic coding sequence
atggctgagcctagtgcggcaacccagtcacattccatctcatcctcttcatttggggcagagcctagcgcccctgggggtggcggaagccccggagcctgtccagctctcggcaccaagtcatgctcgtccagttgcgcagtccatgaccttatcttttggcgtgatgtcaaaaaaaccgggttcgtattcgggaccacactgattatgctgttgtccctggctgcattttccgtaatctccgttgtgtcatacctaattctggcattgctctccgtgaccatttcctttcgaatctacaagagcgtgattcaggcggttcaaaaaagcgaggaaggacatcccttcaactggttgagctcctgcggctag

SEQ ID NO: 238426 - DNA, 711 bp, Artificial Sequence
  Description of Artificial Sequence: Synthetic coding sequence
atggccgagccctccgccgctacccagtctcattctattagctcttcctccttcggagcggagccgtctgcacctggcggaggaggcagtcctggtgcctgtcccgctctaggaaccaaatcctgcagtagtagctgtgccgtccacgatctgattttttggcgggacgtgaagaaaactggcttcgtctttggcactaccttaatcatgcttctctctcttgccgcattcagcgtcatcagcgtggtaagctatctaatactcgcactcctgtctgtgaccatctcgttccggatttacaaatctgtcattcaggccgttcagaaatcggaagaagggcaccctttcaaggcgtatctggacgttgacattaccctgagctccgaggcctttcacaattatatgaacgcggcaatggtccacatcaaccgggcactcaaactgattataagactctttctcgtagaggatctggtggattcactgaagctcgccgttttcatgtggctgatgacttatgtgggcgctgtctttaatggaatcaccctcctaatcttggcagaactgctcattttcagcgtgccaatcgtatacgagaagtacaagactcagattgaccactacgtgggaatcgctcgcgatcagacaaaatcaattgttgagaaaatccaggccaaactccccggtatcgccaaaaaaaaggcagaatag

SEQ ID NO: 238427 - DNA, 1122 bp, Artificial Sequence
  Description of Artificial Sequence: Synthetic coding sequence
atggaggacctggaccagtcaccgctggtgagctcttcggattcgcctccaaggccgcagccagccttcaagtaccagtttgtgcgagagccagaggacgaggaggaagaggaggaggaagaagaggaggacgaagatgaggacttagaggagctcgaagtgctggagcgtaaaccggctgccggtctttctgctgccccagtgcccactgcccctgcagcaggtgccccactgatggactttggaaatgatttcgtaccaccagcgccacggggacccctcccagcggctcccccagtagcaccggagaggcagcccagttgggatccttctccagtgagctctaccgtgccagcgccttctcctctgtcggcagccgcagtctcacccagtaagctccccgaagacgacgagcctccagcacgcccacctcctcctccacctgccagcgtgagtccacaggcagagccagtgtggacccctcccgctccagctccggctgctcctccctcaaccccagcagctcccaaacgcagaggtagcagtgggtctgttgtggtggaccttctctactggagggatattaagaagacaggcgtggttttcggtgccagtcttttccttctgctatcactgaccgttttctccattgtgagtgtgactgcatatatcgcccttgccctactgtcagttacgatatcatttagaatttataaaggggttatccaggccatccagaagagcgacgagggacaccccttccgggcataccttgagtctgaggtggcaattagtgaagagctagtgcagaagtactcaaactcagccctgggccatgtcaactgtacaattaaagaactccgcagattattcctggtggatgacctggttgattccctcaaatttgcggtgctcatgtgggtgttcacttatgtaggtgcactgttcaatggccttacactgctgatcctggctttgataagccttttcagtgtccccgtgatctacgagaggcatcaggcacagatcgaccactatctggggctcgcaaacaaaaacgttaaagacgcaatggcgaagattcaggcaaaaatccctggccttaaacgcaaggctgagtag

SEQ ID NO: 238428 - DNA, 3579 bp, Artificial Sequence
  Description of Artificial Sequence: Synthetic coding sequence
atggaagatcttgaccagtccccgcttgtttcgtccagcgactccccaccacgccctcaaccagccttcaaatatcagtttgtgcgggagccagaagacgaggaagaggaagaagaggaagaggaggaggatgaagacgaggacctcgaggagctggaggtgctcgagaggaaaccggctgccggtctttccgcagcccctgttcccactgcacctgcggcaggcgctcctctgatggattttggaaacgactttgtccctccagctcccaggggaccgctgcctgctgcacccccagtagcacctgaaaggcagccctcatgggatccaagccctgtgtcttctaccgtgcccgcaccctctccactttctgccgcagctgtatccccttcgaagctgcctgaagatgacgagccacccgcacgtcccccaccacctcctccagcgagcgtatctccccaggccgagccagtctggactcccccagcccctgccccagcagcgcctccatccacaccagcagcccctaaaaggcggggaagctcaggatcagtggatgaaaccctgtttgcactgcctgccgcatccgagcccgtgatccggtcctccgctgagaacatggatttgaaagagcagccgggtaatacgatttccgctggccaggaagatttccccagtgtgctgctggagactgcagctagcctgcctagtttatctccactgagtgctgcaagtttcaaggaacacgaatacctgggtaatctgtccactgtgctgcctaccgaaggtaccctgcaggaaaatgtctctgaggcctcgaaggaagtgtcagaaaaggcaaaaacacttcttattgatcgtgacctgactgaattttcagaactcgagtactccgagatgggcagcagcttctcagtgtctcctaaagcagaatctgcagttattgtcgcgaaccccagagaagaaataatcgtgaagaataaggatgaagaggagaagttagtctccaataatattttgcacaatcagcaggagctgcctaccgcccttacaaagctggttaaggaggatgaagtggtgtcatcggaaaaggccaaggacagcttcaatgaaaagagagtcgcggtggaggcaccaatgcgggaggagtacgccgatttcaagccttttgagagagtgtgggaagtcaaggactctaaagaggactctgatatgctggccgcaggcggaaagattgagtctaatttagagtccaaggtagataagaaatgctttgccgacagcctggaacaaacgaatcatgagaaagactccgaaagcagcaacgacgatacatccttcccatccacgcctgagggaattaaggatcggtctggagcctacattacgtgcgccccatttaaccccgctgcaacggaatctatcgctacaaatatattcccactgctgggtgatcccacatcagagaacaagacagatgagaagaagatcgaagaaaaaaaagcccagatcgtcaccgaaaagaacacctcaaccaagacctcaaatcccttcctcgtggcagcccaggattccgagacagattatgtcaccaccgataatctcacgaaagttacggaggaagtggttgccaatatgccagaaggacttaccccagatttagttcaggaggcgtgcgaaagcgaattgaacgaagtgacagggaccaaaattgcctatgaaacaaagatggacttggtgcagacatcagaggtgatgcaagaatcattataccccgcagcgcagttgtgtccttctttcgaagaatcggaggctactccatctcccgtcctcccggacattgttatggaggctcctttgaattccgccgtccctagcgccggagcttccgtgatacaaccatctagctctcctctcgaagcttccagcgtcaactatgaatccatcaaacatgagccagaaaacccacctccctacgaggaggccatgagtgtgtctcttaagaaggtctccggcattaaggaagagattaaggaacctgagaacatcaacgccgcactccaagaaacagaggcaccttacatatccatcgcttgcgatctgatcaaggagaccaagctctctgcggaacccgctcccgacttcagcgattattccgaaatggcgaaggtagaacagccggtgcctgatcacagcgaactagttgaggacagctccccagactctgaacctgtggatctgttctccgatgatagcattccggatgtgccccagaaacaggatgaaacagtgatgttagttaaggagagcctaactgaaacatctttcgaatcaatgattgagtacgagaacaaggagaagttgtccgctctccctcccgagggaggcaagccctatctcgagtctttcaagctgagcctcgataatactaaggatacgctgttgccggacgaggtttcaacattaagtaagaaggaaaagatccccctgcaaatggaagagctcagcaccgcagtctattctaatgacgatctatttattagcaaagaggcccagattcgcgagactgaaacattcagcgactccagtcccatcgagattatagacgagtttccaacgctgatttcctctaaaacagacagtttcagcaaattggcgcgagaatacactgacctagaggttagtcacaaaagcgagattgctaacgccccagacggggctggtagcttgccttgtaccgaattgccccacgatctgtctctgaagaacattcagcctaaggtggaggagaagattagcttctctgatgatttctccaagaacggttctgccacttctaaagtactcctcctccctccagatgtgagtgccctggcaacacaggccgagattgaatcgattgtaaaacccaaagtcctggttaaggaggctgaaaaaaagctgccgtccgacactgaaaaggaggaccgcagtccctcagcgatcttcagcgcagagctgtcaaaaacttctgtcgtggacctgttatactggagggacataaaaaagacaggggtagtgtttggggcatccttgtttttgctacttagcctgaccgtcttcagtattgtaagcgtcaccgcctacatcgccttagcccttctgagtgtcactatatcctttaggatttacaaaggggtgatccaggctatccagaaatctgacgaaggccaccctttcagggcatatctggagagcgaggtggccatctctgaggaattagttcaaaagtactcgaattctgctctaggacacgtgaactgtacgattaaagagctgaggcgcctattccttgtggacgatttggtggattcattaaaatttgcagtgctgatgtgggtattcacatacgtcggagccctgtttaacggacttacgctcttaatccttgcattaatctctctattctctgttccagtaatttacgaacggcaccaagcgcagatcgaccactatctcgggctggccaacaaaaatgtgaaagacgccatggccaagatacaagccaagattcctggtctgaagcgtaaggccgagtag

SEQ ID NO: 238429 - DNA, 2883 bp, Artificial Sequence
  Description of Artificial Sequence: Synthetic coding sequence
atggaagacctggatcagagtccacttgtttctagttccgactctcccccacgaccccagccagcgtttaaataccagttcgtgcgagaaccggaagacgaggaagaagaggaagaggaagaggaggaagatgaagatgaggacctcgaggaactcgaggtgttggaacgcaagcagtttagcgaactagaatactcagagatgggctccagcttctcagtgtcccccaaagccgaaagcgccgttatcgtggcaaatccccgagaggagataatcgtgaagaataaagacgaagaagaaaagctggtctccaacaatatcctgcataatcagcaggagctgccgacggccctcactaagctcgtgaaggaagacgaagttgtcagcagtgagaaggcaaaagactcgttcaatgaaaaacgggtggctgtggaagcccctatgagggaggaatacgcggacttcaagccgtttgagcgggtttgggaagtgaaagacagtaaagaagactctgacatgcttgccgctgggggtaagatcgaaagcaacttagaatccaaagtggacaagaaatgcttcgctgactccctcgagcagacaaatcacgagaaagattctgagtcatccaatgatgatactagctttccaagtaccccagaaggcatcaaagatcggtctggtgcctacattacatgtgccccatttaatccggcagctacagagtctatagccaccaatatcttccccttattaggtgaccccacgtccgaaaacaagacagacgagaagaaaatcgaggaaaaaaaggcccagatcgttaccgaaaaaaatacatcgactaaaacatcaaatccttttttagtggccgcacaagacagcgaaacagactatgttacaactgacaatctgactaaggtcaccgaagaagtggtggcaaacatgcctgagggacttacccccgatcttgttcaagaagcctgcgagagtgagctgaacgaagtgacgggtacaaaaattgcctacgagaccaagatggatttggtccaaaccagtgaagtaatgcaggaatccctgtatcccgctgcccagctctgtccatcgttcgaagagtccgaggccaccccgtctccagtacttcccgatatagtgatggaagccccactcaactccgccgttccctcggcaggcgcttctgtaatccagcctagcagttcaccacttgaagcaagttccgttaactacgagtccatcaaacatgagcccgagaatccgcctccatatgaagaggcgatgagcgtgagcctcaaaaaggtgtccgggattaaagaagaaattaaggaacctgaaaatatcaatgccgctctgcaggagacagaagcgccttacatatctattgcctgcgacctgataaaagaaactaagctctctgcagaacccgcacccgatttctcagattacagcgaaatggccaaagtggagcaacctgtgcctgaccacagcgaattggttgaagactcgtctccggacagtgaaccagtggaccttttctctgatgattcaatccctgatgtcccacagaaacaggacgagaccgtcatgttggtgaaagagagcctgaccgaaacatctttcgaaagcatgattgagtacgagaataaggagaaactgtctgccctgccaccagaagggggtaaaccgtatctggaaagtttcaagctgtcgctggataatactaaggatactcttctccctgacgaagtctccaccttgtccaagaaggagaaaattccacttcagatggaggagctgtcaaccgcagtgtactccaatgacgacttgttcattagtaaggaggcccagatccgagaaacggagactttcagcgattccagtcccatcgaaatcatcgatgaatttccgacgcttatctctagtaagactgattccttttccaaactggcacgagaatacaccgacctcgaagtctcccataagtccgaaattgctaacgcgcctgatggtgctggaagcctcccctgcacggagctgccacacgacctgtctttgaaaaacatccaaccgaaagtagaggagaaaatctcattcagtgacgacttcagcaagaacgggtctgccacatccaaggttctgcttttaccacccgacgtatctgccctcgccactcaggccgaaattgagagcatcgtgaagcccaaagtcctggttaaggaggctgaaaaaaagctcccaagcgatacagaaaaagaggacagatccccaagcgccattttttccgcagaattgagcaagacctctgtggtggatctgctgtactggagggatataaagaaaactggtgtggtgtttggggcatcgctgtttttattgttgtccctgactgtcttctcaattgtgtcagtgacggcatacatcgcgctcgccctcctaagcgttacgatctccttcaggatttacaagggcgtaattcaggccatccagaagtcagacgaggggcacccgtttagggcctaccttgagtctgaagtagccatctctgaagagcttgtgcagaaatatagtaattctgctctggggcacgtaaattgtacaataaaagaactgcggagactgttccttgttgatgatcttgtggacagtttgaaattcgctgtgctcatgtgggtgttcacgtatgtgggcgcattgttcaacggattgacccttctgattctcgctttgattagtctgttcagcgttcccgtcatctatgagcgccaccaggcccaaatcgatcattatttggggctcgccaacaaaaacgtcaaagatgctatggctaaaattcaagcgaagattcccggactgaaaaggaaggccgagtag

SEQ ID NO: 238430 - DNA, 2961 bp, Artificial Sequence
  Description of Artificial Sequence: Synthetic coding sequence
atggatctgaaggaacagccaggtaatacaatcagcgccggacaggaagatttcccctccgtccttctggagacagcggcaagtctgcctagcctgtcacctctgtccgccgctagcttcaaggaacatgagtacttaggtaatctgagtacggtgctgccaacagaaggcactctacaagaaaacgtgagcgaggcttctaaagaggtttccgaaaaggctaagacacttctcatcgatagagatcttaccgaatttagcgaacttgagtacagcgagatgggctcaagttttagtgtgagcccgaaggccgaaagcgccgtgatagtggccaacccgagggaggagatcattgtgaaaaataaagatgaggaagaaaagctggtgtcgaacaacattctgcacaaccagcaagaattgcccacggccctgactaagctggtaaaagaggatgaggttgtgtccagcgaaaaggccaaagactcttttaacgaaaagcgagttgctgtcgaagctccaatgagggaggagtatgctgacttcaaaccttttgaacgggtgtgggaggtcaaagactccaaggaagattctgacatgctggccgcagggggaaagattgagtcaaacctggagtcaaaagtggacaaaaagtgtttcgctgatagcctggagcagacaaaccacgagaaggactccgagagcagcaatgacgacacatcttttccttctacacctgagggaattaaagaccgtagcggagcctatattacatgtgcaccattcaaccccgcagcgacagaaagtatcgcaaccaatatctttcccctgctgggtgaccctacgtccgaaaacaaaacggacgagaaaaaaatagaagagaaaaaagcccagatcgttacagagaagaacacctcaacaaaaacgtcgaacccatttctggtggccgctcaggattccgagactgattatgtcaccactgataatctaaccaaggtgacagaggaggtcgtagcaaatatgccagaaggcctgaccccagacctcgtccaggaggcatgcgagtcagagctgaatgaggtgaccggaacaaagatcgcgtacgaaaccaagatggacctggtacaaactagtgaggtcatgcaagaatcactgtaccccgctgctcagctctgtccatcatttgaagaaagcgaagcaaccccaagtcccgtcctgccagacatcgtgatggaggctccactgaacagcgctgtcccatctgcaggcgcttccgtcatccagccaagcagctccccgctggaggcgtcaagtgtgaattacgagtcaataaaacatgagccagaaaatcctcccccatatgaagaagccatgagcgtttcactgaagaaggtgtccggaataaaggaggagatcaaggagccagagaacatcaacgcagcgctccaggagactgaagccccatatatctccatcgcttgtgacctgattaaagaaacgaagttgagcgctgaacccgctcccgacttcagcgactactccgagatggctaaggtggaacaacccgtacccgaccattctgagctagttgaagattcatcacctgactctgaaccagtggaccttttctccgacgattccattccagatgtgccacagaagcaggacgaaactgtcatgctggtgaaggaaagtctgacagagacctcattcgaaagtatgattgaatatgaaaataaagaaaaactctcggccttacctcccgaaggagggaaaccttacctcgaatcctttaagctgtccttagacaacacgaaggatactttgctgccggatgaagtgtcgactctgtcgaagaaggaaaagataccccttcagatggaggagctttccacagctgtatactccaacgacgacctgtttatctccaaggaggcacagatccgcgagactgagactttttccgattcctcacctattgaaatcatcgacgagttccctacattaattagctccaaaactgactctttcagcaaactcgccagagagtacaccgatcttgaggtgagccataaatcagaaattgcaaatgccccagacggtgctggtagcctgccctgtacggagttgcctcacgaccttagcttgaaaaatatacagccaaaggtggaggagaagatcagcttttccgacgatttcagcaaaaacggcagcgccacctccaaagtgttgctgttgcctccagacgtgagcgctctcgccacccaggcagaaatcgaaagcatcgtgaaacctaaggtcctagtgaaagaggctgagaagaagctgcccagcgatactgagaaagaagaccgtagccccagcgcaatcttctcggccgaactgagtaaaacttcggtggtagatttactgtactggagagacataaagaaaacaggagttgtttttggggcttctctgtttttacttctgtccctgaccgtgttctccattgtatcggtcaccgcctacatagctttggctctactttcagttaccatctcatttagaatctataagggcgtgattcaggccatacaaaagtctgacgagggacatccatttcgggcttacctcgaatctgaggtcgccatctccgaagagttagtgcagaagtatagcaactctgccctgggacacgtgaattgtacaattaaggagctccgccgtctcttcctggttgacgatttagtggattctctcaagttcgcagtgctgatgtgggtttttacatatgtgggtgcccttttcaacggcctcacccttctcatcctggctctgatatcactgttttcagtgcccgtcatctacgagcggcaccaggcccagatcgatcattatctcggcctagccaacaagaacgtcaaagatgcaatggcaaaaatccaagctaagatcccaggcctgaaacgcaaagccgaatag

SEQ ID NO: 238431 - DNA, 1179 bp, Artificial Sequence
  Description of Artificial Sequence: Synthetic coding sequence
atggaagatcttgatcaatcccctctagtctcctccagtgactctccgccaaggccgcagccggctttcaagtaccagtttgtgagagaaccagaggatgaggaagaggaagaggaagaggaggaagaggatgaagatgaggatcttgaagagctggaggtgctggagcgaaagccggcagctggcctgtctgccgcacccgtcccgacagccccagccgctggagctccgctgatggattttggaaacgacttcgtaccccctgcgccacggggtccacttcctgcagctccacctgtagcccctgagagacagccttcctgggaccccagtccggtgagctctacggtgcctgcaccttccccactctcagctgctgccgtgtcgccctcgaagctcccggaggacgacgaacccccagccaggccacctcctccacccccagcgtccgtttcacctcaggctgagcccgtgtggaccccaccggctcccgctcctgccgctcctccttccacccctgcggctccaaagaggcgtggatcgtctggtagcgtggatgagactttgtttgctcttccagctgctagtgagcctgtgatccgctcttccgccgtggtagatttgctgtattggcgggatatcaaaaagaccggcgtggtttttggagcttccttattcttactgctttccctaacagtcttctccatagtcagcgtgacggcctatattgccctggcacttctatcagtaactatttctttccggatctacaagggggtcattcaggccattcaaaaatctgacgagggtcacccctttcgagcttacctagagtctgaagtggccatttctgaggaactggtccagaaatattccaattctgctctgggtcatgtcaattgtaccattaaagagctgcgcagactcttcctggtggacgatctggttgactctcttaaattcgccgtgttaatgtgggttttcacctacgtcggcgctcttttcaacgggctgactctgctgattttagcactaatatcactgtttagcgtgcccgttatatatgaaaggcatcaggcacagatcgatcattatctaggcctggcaaataagaacgttaaagatgcgatggctaaaatccaggccaagatccctgggctaaagaggaaagcggaatag

SEQ ID NO: 238432 - DNA, 600 bp, Artificial Sequence
  Description of Artificial Sequence: Synthetic coding sequence
atggacggacagaagaagaattggaaggataaggtggtggacctcctgtattggcgcgatattaagaagaccggggttgtctttggtgcaagtttgttcctgcttctttcacttaccgtgttctccatagtgtccgtcaccgcttacattgcactggctttgttaagcgttaccatctcgtttcgtatatataaaggcgtaatccaggccatccagaaatccgacgaggggcacccctttcgcgcatacctcgagtctgaggttgccatctcagaagaactcgtgcagaagtacagcaactctgcccttggacacgttaattgcacaatcaaagaactgcgcaggctctttttggtcgatgatctcgtggattccctgaagtttgcagtcctcatgtgggtgttcacttacgttggggctctatttaacgggttaaccttactgatcctggcgctgatatccttgttctcagtgcccgttatttatgagcgccatcaggcgcagatcgatcattacctcgggctggccaacaagaatgtaaaggacgcaatggctaagatccaggccaagattcctggcctcaagcgaaaggcagaatag

SEQ ID NO: 238433 - DNA, 2961 bp, Artificial Sequence
  Description of Artificial Sequence: Synthetic coding sequence
atggaccttaaggagcagccaggaaatacaatcagtgccggacaggaagactttccgtcggtcctgctggagaccgccgcttcattgccaagtctgtcccccctgtccgctgcgagcttcaaagagcacgaatatttaggcaatctgtccaccgtgctcccgaccgagggaaccttgcaggagaacgtgagtgaggcgtccaaagaagtctccgaaaaggcgaagaccttgctgatcgaccgcgatttgacagagttttcagaactcgagtacagcgagatggggtctagtttttctgtgtcccccaaagcggagtctgctgttatagtggccaacccacgggaggaaattattgtgaagaacaaggacgaagaagagaaattggttagcaacaatatcctgcacaatcaacaggaattacctacagcattgacaaagctggttaaggaagacgaggtagtgtctagtgaaaaggctaaagactctttcaatgagaagagagttgccgtagaagctcccatgcgcgaagagtatgctgattttaaacctttcgaacgagtgtgggaggtgaaggactccaaagaggacagcgatatgctagccgcaggaggaaagatagagagcaacctagaatccaaagttgataagaagtgctttgccgactctttggaacagactaaccatgagaaagacagcgagtccagtaacgacgacacctcatttcctagtactccagagggaatcaaggatcgctctggagcatatataacatgtgccccatttaatccagcagccacagagagcattgccacgaatatcttccccttgctgggcgacccgaccagtgagaacaagacagatgagaagaaaatcgaagagaagaaagcgcagatcgtgaccgagaagaacacctctactaaaacatctaacccgttcctggtcgcagctcaggactctgagacagactacgttacaactgacaatctcacaaaggtgacagaggaagttgtggctaacatgcccgagggcctgacaccagacctcgtgcaagaagcttgtgaatccgaacttaatgaggtgactggaaccaaaattgcctacgagactaagatggacctggtgcagactagcgaggtgatgcaggagtctctgtacccggctgcccagctctgtccaagtttcgaggaatccgaagccaccccttcaccagtacttccggatattgtcatggaggccccactgaactctgccgttccatccgcaggggcttcagtgatccaaccatccagctcaccactggaggctagttccgtgaactacgagtcaatcaagcatgaacccgaaaatcccccaccgtacgaggaagcaatgagtgtgtcactcaagaaggtgtccggaatcaaggaggagatcaaagaacccgagaatatcaatgccgctctgcaggagacagaagcgccatacatcagtatcgcttgtgacctgataaaagagaccaagctatcagctgagcccgctccagatttctcggactatagtgagatggctaaagtagagcagcccgtcccagatcattcagaactcgttgaagattcttctccagattctgagcctgtcgatttattttccgacgacagtattccagacgtcccccaaaaacaggacgagactgtcatgctcgtgaaagagtccttgacagaaacttcttttgaatccatgatagaatacgagaataaagagaaattgtctgccctgccaccagaaggcggtaagccatatctggagtcctttaagctctccttagacaacacaaaggacaccctcttacctgacgaggtaagcaccctctccaaaaaagagaaaattcccctgcagatggaagagctctccactgcagtgtatagcaacgacgacttatttatctcaaaagaggctcagattagggaaaccgagacattcagcgactcctcacctatcgaaataatcgatgagttcccgaccctgattagttcgaagactgacagcttctccaagctcgctagggagtacaccgatttagaggttagtcataaatctgagatcgccaacgccccagatggcgcaggcagcttgccgtgcaccgagctaccacatgatctttcactgaagaacatacagcccaaggtcgaggagaagatatctttctcagatgatttttctaagaacggcagcgccacctctaaggtgctccttttaccccctgatgtttccgcattggccacacaggcggagatcgagtccatcgttaagccaaaagttttagttaaggaagcggaaaaaaagctccctagcgatactgaaaaggaggaccgatcccctagcgccatctttagcgcggagctgagtaagaccagcgtggtagacctactctactggagggacataaagaaaaccggggtagtatttggtgcatcattatttctgctgctcagtctcacagttttctctatcgtctcagtcacagcttatatcgctctggctctgcttagcgtgactatatccttccgcatctacaaaggcgtgatccaggccattcaaaagtccgacgaggggcacccatttagggcctacctcgaaagcgaggtagctatctccgaagagttggtgcaaaaatattcaaattctgctctcggacacgtgaattgcacaataaaggagctgagacgcctgtttctcgttgacgacctggtcgacagcctcaagtttgcagttctgatgtgggtgttcacatacgtgggggctctgttcaacgggctgacccttctgattcttgccctcatctcactgttcagcgtccccgtgatttatgagcgccatcaagctcagattgaccactatctgggactggccaataaaaatgtaaaggatgcgatggccaaaatccaggccaagatccctggcctgaaaagaaaagccgagtag

SEQ ID NO: 238434 - DNA, 1038 bp, Artificial Sequence
  Description of Artificial Sequence: Synthetic coding sequence
atggagcccgaggatgaggaggaggaagaagaagaggaggaggaagatgaggacgaagacctggaagagctggaggtactggagcgaaagcctgcagctgggctcagcgccgcacctgttccgacagctcccgctgcaggcgcaccgttgatggacttcggcaatgatttcgtccctcctgccccacgcggtccccttcctgcagctcctcctgtcgccccagaacgccagccttcctgggacccttctcccgttagttcaactgtgcccgcacccagcccactctcggcggctgcagtgtctccctcaaaactccctgaagacgacgagccccctgcaaggccccctcctccaccaccagctagtgtgtcacctcaagcagagcccgtatggacacccccagcccctgcccctgcagcaccaccctccacccccgctgcacccaagcggagaggttcctctggatctgtagtcgtggatctcctatattggcgcgacatcaagaagactggagttgtgtttggggctagccttttcctcctgctgtctcttacggtcttcagcatcgtctcggtgactgcctacatagccctcgccctcctctccgtcactattagtttccggatctataaaggcgtcatccaggccatccaaaagtccgatgagggccacccatttcgcgcatacttggagtcagaggtggctatctctgaggaattggtgcagaaatacagtaacagcgcgctcggccatgtgaattgtacaatcaaggagttgaggcgacttttcttggtagacgatctagtggacagcctgaaatttgccgtactgatgtgggtcttcacttatgtgggcgctctgttcaatggactgacacttctgattctggcactgatctccctgttcagtgttcctgtgatatatgaacgacaccaggcccagatcgaccattatttgggactcgctaataagaacgtaaaggacgcgatggccaaaatccaggcaaagattccaggtctgaagcgtaaggcagaatag

SEQ ID NO: 238435 - DNA, 2961 bp, Artificial Sequence
  Description of Artificial Sequence: Synthetic coding sequence
atggatcttaaagagcaaccaggcaatactatttctgcaggtcaggaggacttcccctcagtgcttctggagacagccgcttctttgccgtcactgtcccctctgtcagccgcttcttttaaggaacacgaatatttaggtaatctgtcaaccgtcctcccaacagagggcactctccaggaaaacgtaagtgaagcaagtaaggaggtctccgagaaggcaaagactttgctgatcgatcgcgacctgaccgagttctctgagcttgagtacagcgagatgggctcatcattctcagtgagtcctaaggccgagagcgctgtgatcgttgctaaccctcgcgaagagatcatcgtcaagaataaggacgaagaggaaaagttagtttccaataacatactgcataatcagcaagagctcccaacggcgctgacaaagctagtaaaggaggacgaggtggtgtcaagcgagaaggccaaagactctttcaacgaaaaacgggtggccgttgaggcccctatgagggaggagtacgcggactttaaaccttttgaacgtgtgtgggaggtgaaggatagtaaggaagactctgacatgctcgctgcaggcggaaagattgagagtaatctggagagtaaggtggataaaaaatgttttgccgactcgttggaacaaacgaaccacgagaaggacagtgaaagcagcaatgatgacacaagcttccctagcacaccagaaggcataaaggataggtccggggcatacatcacctgtgccccttttaaccccgctgcaactgagtcgatcgcgaccaacatctttccactgctgggtgaccctacatcagagaataagacagacgaaaagaaaatcgaggaaaaaaaagcccagatcgtgaccgagaaaaacacctcaacaaaaacaagcaaccctttcttggtggccgcacaagattccgaaactgactacgtcacaaccgataacttgaccaaggttacggaggaggtcgtcgcaaatatgcccgaggggctgactccagacctggtccaggaggcttgcgagtctgagctcaatgaggtgacggggactaagatcgcctatgagaccaagatggacctggtacaaacaagcgaggttatgcaagaatctctgtaccccgctgcacagttatgtccaagctttgaggaatcagaggccacgccttcacccgtcctgcccgatatcgtgatggaagctccgcttaattccgccgtcccaagtgctggagctagcgtgattcagccctccagtagtcctctggaagcaagctcagtcaactacgagagcatcaagcatgagccggagaatcctcccccatatgaggaagccatgagtgtttctctgaaaaaagtttctggaatcaaggaagaaattaaagagcccgagaatataaacgcagcgctgcaagaaactgaggcaccgtatatttcaatcgcctgcgatttaatcaaggagactaagctgagcgccgagcccgcaccagactttagtgactactctgagatggccaaggttgaacaacctgtcccagaccactcagaactggtggaggattcctcccccgactccgagcccgttgatcttttctctgacgattcaatacccgacgttcctcagaagcaggacgaaaccgtcatgttagtaaaggagtccctgaccgaaaccagcttcgaatcaatgatcgagtacgagaacaaagagaagctgtccgcacttccacccgagggaggaaaaccatatctggagtcttttaaactgtccctggacaatacaaaagacacactacttcccgacgaagtgtccaccctctctaaaaaagaaaagatacctctccagatggaagagctgtcaacagccgtctattctaacgacgacttgttcatcagtaaggaggcacagattagagagacagagaccttttccgactcttctcccatagagataatcgacgaattccccacgctcattagttctaagaccgattctttttcaaagttggctagagagtacaccgacttagaagtatcccataagtctgagattgccaacgccccagatggggcagggtccctgccctgcactgaactcccccacgatctgtcgctcaaaaacattcagcctaaagtggaggagaagatctctttctccgatgatttctccaagaatggcagcgccacttctaaggtcttgctgcttccaccagacgttagtgccttggccacccaggcggagattgagtcgatcgtcaaacctaaggtgctggtgaaggaggctgaaaagaagcttccctctgatactgagaaagaggatagatcccctagcgcaattttttctgcggagcttagcaaaacctcggttgtagatctgctctactggcgggatatcaagaagactggtgttgtgtttggcgcatcgttattcctgctgctttctcttactgtgtttagtatagtgtctgtcactgcatacatcgccctcgcactgctgtcagtgaccatttcctttagaatctacaagggcgtgatacaggccatacagaagagcgacgaaggacaccccttccgggcatatctggagtcagaagtggccatttccgaagagctagtgcagaagtattccaacagtgccctcggtcacgtgaactgcaccatcaaggaattgcggcgactgttcctggttgacgacttagttgatagtctgaagttcgctgtgctgatgtgggtcttcacctatgtgggtgcactgttcaacggactcactttattgattctagcactcatctccctgtttagtgtgcccgtaatctacgaacgacatcaagcccagatcgaccattatctcggcctggctaacaagaacgttaaggatgcaatggctaaaattcaagctaagatccccggactgaagaggaaggccgaatag

SEQ ID NO: 238436 - DNA, 2961 bp, Artificial Sequence
  Description of Artificial Sequence: Synthetic coding sequence
atggacctgaaagagcaacccggaaataccatcagtgcgggtcaggaagattttccatcagtgcttctcgagaccgccgcatcactgccttcactctcgcccttaagcgcagcctctttcaaagagcatgaatacctgggaaatctgtccacagtgctgccaaccgaaggaactctgcaggaaaatgtctcagaagcatctaaagaagtgtctgaaaaagcgaaaacattattaattgaccgggacctaaccgagttctccgagctggaatactctgagatggggagttcattcagcgtgtccccgaaggctgagagtgctgtgatcgttgctaacccacgtgaggaaattattgtgaagaataaagatgaagaggagaaactggtgtccaacaatattcttcacaatcagcaagagctcccaacagccttaacaaagctggtgaaagaggacgaggtggtgagctcagagaaggcgaaggactccttcaatgagaagcgggtggctgtagaagcgcctatgcgagaggaatacgctgacttcaaaccttttgagcgtgtttgggaggtgaaggatagcaaagaggactctgatatgcttgctgctgggggaaagatcgagtcgaatctggagtccaaagttgacaagaagtgcttcgccgattccctggagcagaccaaccatgaaaaagatagcgaaagcagcaacgacgataccagctttccatctacccccgaaggaattaaagatagaagcggggcttacattacctgcgcaccgttcaaccccgctgccaccgagtctatcgcaaccaacatttttccgctccttggagaccctactagcgagaacaaaaccgatgagaaaaagatcgaagaaaagaaggcccagatagttacagaaaaaaatacttctaccaaaacgtcaaacccctttttggtagcagcacaagacagcgagaccgactatgtcacgacagataatctgactaaagtgactgaggaagtggtcgccaatatgcccgagggtctgacacctgatctggttcaggaggcatgtgaatctgagctcaacgaagttacaggaaccaaaatcgcctatgagaccaaaatggatctggtacaaaccagcgaagtcatgcaagagagcctctatcctgctgcccagctgtgtccttctttcgaggaaagcgaagccactcccagcccagtcttgcctgatatcgtgatggaggctcccctcaatagtgcggttccatctgcaggtgcctccgtgatccagcctagcagctcaccccttgaagcatccagcgttaactatgagagcattaaacacgaaccagagaatccccctccttatgaagaagcaatgtctgtgagtcttaaaaaagttagtggcataaaggaggagataaaggagcccgagaatatcaacgcagcgcttcaggagacagaagctccttacatttcaatcgcctgcgatctgatcaaggaaactaaactgagcgcagagcctgccccagacttctcagactactctgagatggcaaaagttgagcagccagttccagatcattcagaattagtagaggatagctcacctgatagtgagcctgttgacctgtttagcgacgactccattccggacgttccccagaagcaagacgagactgttatgctcgtgaaagagtcgctaaccgaaactagttttgagtctatgatcgagtatgagaataaggagaagctcagcgcgttgcctccagaaggtggaaaaccttatttagagtccttcaagctgtctttagataacaccaaagatacgctcctcccagacgaggttagtaccctgagcaaaaaggagaagatccctttgcagatggaagagctgtccacagctgtctattcgaacgacgacttgttcatttcaaaggaagcccagatccgagagaccgaaacattttccgacagcagtccaattgaaataattgacgagtttccaacccttatcagttccaagactgattccttctccaagctggctagggagtacactgatctggaggtcagtcacaaaagcgaaattgctaacgctccagacggagccggatcacttccgtgcaccgagctccctcatgacctcagtcttaagaacattcagcccaaagtagaggagaaaatctcttttagtgacgactttagcaagaatggcagcgcaacgtccaaagttttactcctgcctcccgatgtgagcgcccttgcaacccaagcagagatcgagagtatcgttaagccaaaggtgcttgtaaaggaggctgagaaaaaactgccatccgacacggagaaggaggacaggtcaccgagtgccatctttagcgcagagctgagtaagaccagcgtggtggacctgctctactggagagatatcaaaaaaacaggagttgtgtttggagccagtctgttcctgttgctatctttgacagtattttccatagtgagcgtcaccgcttacatcgcactggcattgctcagtgtgaccatttcttttcggatctataagggagtgatccaggcaattcagaagtctgatgagggccatccttttcgagcatatctggaatctgaagtcgctatttcagaggagcttgtgcagaaatacagcaatagtgccctgggtcatgtaaactgcaccataaaggagttgagaagactcttcttggtggacgacttggtagactccctgaagtttgccgtgcttatgtgggtcttcacttatgttggcgctctgtttaacggactgaccctgcttatactggccctgatcagcctgttttccgtcccggtcatttatgaaaggcaccaggcccagatagatcactacctcggtctcgcgaacaagaacgtcaaggatgcaatggccaagattcaggctaagatcccgggtcttaaaaggaaggcggaatag

SEQ ID NO: 238437 - DNA, 276 bp, Artificial Sequence
  Description of Artificial Sequence: Synthetic coding sequence
atggatcttaaggagcagccaggcaatacaattagcgcaggacaagaagacttcccttccgtccttcttgaaacagctgcctccctcccaagtctgtcccccctctccgcggcatcgttcaaggagcacgagtatctcggaaacctctccaccgtactgcccacagagggcacattacaggagaatgtgtctgaggcctccaaggaggtgagtgaaaaagcgaagaccctcctaatagatagagatctcaccgaattctcagagctggagtattag

SEQ ID NO: 238438 - DNA, 1191 bp, Artificial Sequence
  Description of Artificial Sequence: Synthetic coding sequence
atggaatttctcaagacctgcgtactgaggagaaacgcctgcactgccgtgtgtttttggcggagcaaagtggttcagaaaccatccgtccggcgaattagcactacaagcccacgcagtactgtgatgcctgcatgggtcatcgacaaatatggaaagaacgaggtactccgattcactcaaaatatgatgatgcccatcatacactacccgaatgaggtgatagtcaaggtgcatgcagctagtgtgaatcccattgacgtgaacatgagaagcggctacggtgctaccgctctaaacatgaaaagagatcccttacatgtcaagatcaagggcgaggaattccctttaacactcggaagggacgtctctggagtagtgatggagtgcggcctggatgtaaaatattttaaaccaggcgacgaagtttgggctgccgtgcccccatggaagcaggggaccctttcagagttcgtagtggtgagtggcaatgaggtgtctcataagcccaagtctcttacccatacccaagcggcatctcttccctacgttgccctgacagcgtggtcggcgatcaataaagtgggcggactaaatgacaaaaattgtactggcaagcgcgtgttgatcctgggagcctctggaggagtcgggacattcgccatccaggtaatgaaagcctgggatgcccacgtgactgcagtgtgtagccaggacgccagcgaacttgtcagaaaattaggtgctgacgacgtcattgactataagtccggatccgtcgaggagcaactgaagtcactcaaaccattcgatttcattctcgacaacgtcggcggatccacggagacttgggccccagatttccttaagaaatggtcaggggcaacatacgttaccttagttactccctttctgcttaatatggatcgactgggtattgccgacggcatgctgcagacgggcgtgactgtggggtccaaagctttgaagcatttctggaagggggtgcattatagatgggcattctttatggcctcaggtccgtgcctggacgatattgcggagctagtggatgctggcaaaatccgtcccgtgatcgaacaaaccttcccattcagtaaggtccctgaggcgttcctaaaagtggagcggggacacgcgcgaggtaaaacggtgataaacgtggtgtag

SEQ ID NO: 238439 - DNA, 681 bp, Artificial Sequence
  Description of Artificial Sequence: Synthetic coding sequence
atggaattcttgaagacctgcgtcctcagacgtaacgcttgtactgccgtatgcttttggaggtccaaggtcgtgcagaagccttccgtgagaagaatttccaccacgtcccctcgcagtactgtaatgccagcctgggttatcgacaagtacggcaagaatgaggttctgagattcacccagaacatgatgatgcctattattcattacccaaacgaggtgatcgtcaaggtccacgctgccagtgtgaacccaattgacgtgaatatgcggagtggttacggcgcaaccgccctcaacatgaagcgtgaccctctgcacgttaaaatcaaaggcgaagagtttccccttactctgggccgtgatgtgtcaggcgtggtgatggaatgtggtttggacgtcaagtattttaaacccggtgatgaagtgtgggctgcagtgccaccctggaaacagggcaccttgtccgagttcgttgtagtcagcggtaacgaagtgtcccacaagcctaagtcactcacgcacacccaagctgcttctctgccctacgtggctctcacagcgtggagcgcaataaacaaagtcgggggattgaatgacaaaaactgcaccgggaaacgaatctctggtaaagaatcaataatagctggccatttctcatggcctgtggctcatgtgtag

SEQ ID NO: 238440 - DNA, 1422 bp, Artificial Sequence
  Description of Artificial Sequence: Synthetic coding sequence
atgaaaagagcctccgcaggcggaagtaggctgctcgcatgggtattgtggctgcaggcctggcaggtggcagctccttgtcctggtgcatgtgtgtgctataacgaacccaaagtcacaacctcctgccctcagcagggactgcaagccgtaccagtgggaatccccgctgcttcacagcgcatattcctgcatggcaaccggatttcgcacgtacccgctgcgagcttccgagcatgtcgtaacttgaccatcttatggttgcactccaatgttctggctcgtatcgatgctgctgcgtttaccggtttggccctgttggaacagctggacctgtctgataatgcccagctacggtctgtggatccagccaccttccatggactgggccgtctgcacacacttcacttggacagatgcgggctgcaggaactggggccaggtctcttcagggggttggccgcactgcagtacctgtacctgcaagacaacgccctgcaggcgctgcccgatgacaccttccgcgatcttggaaatctaactcacctatttctgcatggtaacagaatctcgtcagtgccagagcgcgcattccggggattgcactcgctggaccgattgcttctgcatcaaaacagagtggcacatgtccatccccacgcctttagggacctcgggcgtttgatgacgctttatctgttcgcgaataacctgagtgccctccccactgaagccctggccccactgagagccctgcaatacctgagattaaacgacaacccttgggtgtgcgactgcagggcccgacctttatgggcctggctgcaaaaattcagggggtcctccagtgaagtgccttgtagcctgcctcagcgcttagccggacgggacctgaagcgcctggcggcaaacgacctgcaggggtgtgccgtagccacgggtccatatcacccaatttggaccgggagagctactgatgaggaaccactgggcctgcctaagtgttgtcagcctgatgctgccgacaaggctagcgtgctggagcccggacgcccagcaagtgccggtaacgcgctcaaaggtagagtgccaccaggagacagtccaccaggtaacggatccgggccacgacacattaacgattcacctttcgggacgttacctgggtctgcagagccccctctgactgctgttcgacccgagggcagcgagcccccagggttccccacatcggggcctagaaggagaccgggatgctctcgaaaaaatagaacacgctcccactgcagactgggacaggcaggctcgggaggtggtggaacgggcgactctgaagggtctggcgctctgccgtccctgacgtgttcattgacacctctcggcctcgccctggtcctgtggacagtactggggccatgctag

SEQ ID NO: 238441 - DNA, 1041 bp, Artificial Sequence
  Description of Artificial Sequence: Synthetic coding sequence
atgcacctcccaggctgcgcgccagcaatggctgacggatccttcagtctggccggacatctgctgcgttcccctgggggatccacttctcggctccactcaattgaggcaatattgggtttcactaaagacgatggaatcctcggtacttttcctgctgaacggggagctaggggtgccaaggagagggatcggagattgggggctcgaccagcttgccccaaggctcctgaagagggatccgagcccagccccccaccagccccagctcctgcacctgaatacgaggcacccaggccctattgtcctaaagagcctggcgaggcacggccaagccctggccttcctgtagggcctgctaccggcgaggccaaactctctgaggaggaacagccaaaaaaaaagcataggcgtaatcgcactacttttaccacttaccaactgcatgagctcgagcgcgcattcgagaagtcgcattaccctgacgtctactctcgggaagagctggctggtaaggtaaacctgcctgaggtcagggtgcaagtttggtttcagaaccgtcgagcaaaatggagaagacaggagaagttggaggtgtcctctatgaagctccaggattcacctcttctcagcttctcgcggagccccccaagcgcgaccctgagcccgcttggtgcaggtccgggttcaggcggaggaccagcagggggtgcactcccgctggaatcttggctgggccctcctttacccggtgggggtgcaacagccctgcagagtttgcccggttttggccctcctgcacagtctctgcccgcatcctatactccaccgcctcctccccctccattcctgaacagcccccctctgggcccaggcctgcaaccgctggccccacctccccctagctacccttgtggccctggctttggagacaaattccccctggatgaggcagatccacgcaacagctcgatagctgcattgcgtctcaaggccaaggagcacattcaggcaattggtaaaccctggcaggctctctag

SEQ ID NO: 238442 - DNA, 225 bp, Artificial Sequence
  Description of Artificial Sequence: Synthetic coding sequence
atgcatctgcccggatgcgctcctgccatggcagatgggtcgttcagcctcgccggtcacctactgcggagccccggtggcagcacgagccgcctccattcaatagaggctattcttggctttacaaaggacgatggcatcctcgggacttttcctgctgagaggggcgcaaggggtgcaaaggagcgggatagacgcctgggggcacggccagcatgcccttag

SEQ ID NO: 238443 - DNA, 588 bp, Artificial Sequence
  Description of Artificial Sequence: Synthetic coding sequence
atgtcactgatctcctggttgaggtggaatgaagcgccaagcaggcttagtacacggtcccctgctgagatggtgcttgaaactctgatgatggagctcaccggccaaatgagggaggcagaacggcaacagagagaacggagcaatgccgtgagaaaggtctgcactggggtcgactattcatggctggcttcgacaccgaggtccacatatgatttaagtcccatcgagcggctgcagttggaggacgtgtgcgtcaaaattcacccttcatattgcggccctgccattctgcgtttccgccaattgcttgcagagcaagagcccgaagttcaggaagtgagccagctgttccgctctgtgctccaggaggtgttggagaggatgaagcaggaagaggaggctcataaactgacaagacagtggagcctgcgtccaaggggatcccttgccaccttcaaaaccagggcccgaatctccccctttgcctccgatattaggacgatttcagaagacgtggaacgcgacacaccccctccattgagatcatggagtatgccagagttcagagcgccaaaagccgattag

SEQ ID NO: 238444 - DNA, 762 bp, Artificial Sequence
  Description of Artificial Sequence: Synthetic coding sequence
atggcagagacatccgccctgccaacaggattcggcgagctcgaggtgctggccgttggcatggtcttgctcgtggaggctctctcaggactgtccttgaatacactgacaattttctctttctgtaagacacccgaattgaggacaccctgccatctcttggtgctgagtctcgctctggcagacagcgggatttcgctgaacgcacttgtagcagcgaccagctcccttcttaggcgctggccctacggctcggatggatgccaggcccatgggtttcaaggatttgtcacagccctggccagtatctgtagtagtgcagccattgcctggggcagatatcatcactattgcacgcgcagtcagctcgcttggaattctgctgtgtcattagtgctttttgtctggttaagtagtgccttttgggccgcactgcccctgctggggtggggccactacgactacgagccactcggtacatgctgtaccctggactatagcaaaggtgaccgcaatttcaccagtttcttattcactatgtctttctttaacttcgccatgcctcttttcatcacaatcacctcatatagccttatggagcagaagttgggaaagtctggtcatctacaggtgcccgcattaattgcgaaaatggtgcctaccatcaacgccataaactacgctttgggtaacgaaatggtctgtcgaggcatctggcaatgtctctcaccacagaagagggaaaaggatcgcacaaaatag

SEQ ID NO: 238445 - DNA, 888 bp, Artificial Sequence
  Description of Artificial Sequence: Synthetic coding sequence
atggccgaaacctctgcgctgccaactggctttggggagttggaagtgctggccgtcgggatggttctgctcgttgaggctctttctggactctcgctgaatacactgacaattttctcattctgcaagacgcctgaacttaggaccccttgtcatttgcttgtccttagtctggccttggcagactctggaattagtcttaatgccctggtagccgcaacttctagtctgctgagagtgtcccatcggcgatggccatacggctccgacgggtgccaggcacatggcttccagggttttgtgacggccctggccagtatctgctcgtctgccgctatagcatggggcagataccatcactactgtactagaagtcagttggcctggaatagcgcggtgtctttggtcctctttgtgtggttgtcatcggcattctgggccgctttgcctcttttgggctgggggcactatgactacgaacctctcggcacctgctgcactctagactacagcaagggtgatcgcaatttcacttcttttttgttcactatgagttttttcaacttcgcaatgcccctttttattacaataacctcatatagtctgatggagcagaagctggggaaatctggtcatctgcaggtgaacacaacactgccagctcgaactctgctcctcgggtgggggccttatgccatcctgtacctgtatgctgtgatagccgatgtcacttctatttcgcccaaacttcagatggtgcctgctctaatagctaaaatggtgcccacgataaacgccataaattatgctctaggtaatgaaatggtgtgccgcggaatctggcaatgtctcagccctcagaaacgggaaaaagataggacgaaatag

SEQ ID NO: 238446 - DNA, 363 bp, Artificial Sequence
  Description of Artificial Sequence: Synthetic coding sequence
atggctgagacgtctgcgctcccaacgggattcggcgaactcgaggtgttagccgtgggcatggtgctgttggttgaggatcccggtgcagctgacagccttccgccaaccggggcagaactcggttcctgcgggcagtgggatcagcccgagtgtccaagatgcagtcatatccagccctctccctgcctccctcaggctctggccctgagattaggccgacttccaggctctcggctgccagggctgtgtgacagcgtcggccagcacctgcagcagtgttcccatcggatgggcgctctgagtcccctactgcacccgccaaagtgttgtcaccgatcgcaccatttcgagtggcgatag

SEQ ID NO: 238447 - DNA, 1056 bp, Artificial Sequence
  Description of Artificial Sequence: Synthetic coding sequence
atggctccggtccttccactggtgctgccactgcagcctaggatcaggctggctcaaggactgtggctgttgagctggttactggctctggcagggggtgtcattctgctgtgtagtggtcacttgctcgtccagcttcgtcatttagggacttttctggctccttcttgccagtttcccgtgctgccacaagctgcactcgccgctggggcagttgcactggggaccggtctcgtgggggtcggtgcaagcagggcttctctgaacgctgctctatatcctccttggcgcggagtgctaggccctctactggtggcaggaacagccggtggaggcggtctgctggtcgttggtctgggactagctctggccctcccgggaagcttagacgaagccctggaagaaggattagtgactgccctggctcattacaaggataccgaagtccccggtcactgccaggctaagaggctggttgacgagctacagctgaggtatcactgttgcggacgccacggatacaaggattggtttggagtgcagtgggtctcaagcagatatttggacccaggagacagggacgtggcggatcggattcagagcaatgtggaggggctgtacctgacagacggtgtccctttttcttgctgcaacccccactccccgcgtccctgcctgcagaacagattatctgattcttatgctcaccccctattcgacccgaggcagcccaatcagaatctctgggcccaggggtgccacgaggtcctgctggagcacctccaggaccttgcaggaactcttgggtccatgctggctgtgactttcttactgcaggcactggtgctcctagggcttcggtatctccaaacagcgttggagggactgggaggagtcattgacgcagggggagagactcaagggtacctattccctagtgggctgaaagatatgctcaaaacagcttggctgcagggcggagttgcctgtagacctgccccagaagaggcgccaccaggcgaggcccctcccaaggaggacctgagtgaggcctag

SEQ ID NO: 238448 - DNA, 1602 bp, Artificial Sequence
  Description of Artificial Sequence: Synthetic coding sequence
atgtccatacaggtcgagcaccccgcaggcggatacaaaaaattgtttgagaccgtcgaggagctttcaagtccactcactgctcatgtgactggcaggatcccactatggctcacaggctctttactgaggtgtggcccaggcctgttcgaggtcggcagcgaaccattctaccacctttttgacggccaagcactcctgcataagtttgacttcaaagaagggcacgttacctatcaccgtaggttcattagaaccgatgcttatgtgagggcaatgacagaaaaaaggatcgtcatcacagagttcggcacctgcgcttttccggatccctgcaagaatatttttagtagattctttagttactttcgaggtgttgaggtgaccgacaatgcactcgtcaatgtgtacccagtgggggaggattattatgcctgcactgagaccaattttattactaaaatcaatccagagactctcgagactatcaaacaggtggatctgtgcaactacgtgagtgtcaacggagccaccgctcatccacatatcgagaatgatgggacagtttacaacatcggcaattgttttggaaagaatttttcaatcgcgtacaatatcgtgaaaatcccccctcttcaggctgacaaagaagaccctataagcaaatcagaaatcgtggtgcagtttccttgctccgacaggtttaaaccttcctatgttcacagcttcggccttacccccaattacattgttttcgtcgaaacacctgtgaagattaacttgtttaagtttctgtctagctggagtctgtggggcgcaaactacatggattgctttgaaagcaatgaaactatgggtgtctggttgcacatagctgataaaaagcgcaaaaagtacctgaacaacaagtatcgcacgtctcctttcaacctgttccatcacatcaacacatacgaggacaacggctttctgatagtcgacttatgctgttggaaaggctttgagttcgtgtacaattatttatatcttgcgaatcttcgggaaaattgggaggaggtgaagaaaaatgccaggaaagcacctcagcctgaagtgcgcaggtacgtgctccctctgaacattgacaaagctgacactggtaagaacctggtgaccttacccaacaccaccgccacagcaatcctgtgctcagacgagacaatttggctcgaacccgaggtgctcttctccggtccaagacaggcatttgagttcccgcagataaactatcagaagtactgtggaaagccctatacgtacgcatacgggttaggtctaaatcatttcgtacctgaccggttatgtaaactgaatgtaaagaccaaggagacgtgggtctggcaagagcccgattcatatccttctgaacctatctttgtctctcaccccgatgcattggaagaggatgatggagtggtgctatctgtggtcgtcagccccggtgctggacagaagccagcttacctgctgatcctgaacgctaaggacttatccgaggttgcccgtgccgaggttgaaataaacattcccgtgacctttcatggactctttaaaaagtcttag

SEQ ID NO: 238449 - DNA, 954 bp, Artificial Sequence
  Description of Artificial Sequence: Synthetic coding sequence
atgtcggaaggggtgggtaccttccggatggtgcccgaagaagagcaggagctccgggctcagctggagcagctgaccacaaaggatcacggccctgtattcgggccatgctctcagctgccacgccacactcttcagaaagccaaggacgaacttaacgagagggaggaaacccgagaagaagctgtaagggagctgcaggaaatggtacaagcacaggctgccagtggggaggaactggccgtggcagtcgcggaaagggtgcaggagaaggattctggcttcttcctccgatttataagagcccgtaaatttaacgtcggcagagcttacgagctcctgagaggatacgtgaactttcgcctgcagtatcctgaattgtttgactctctgagtcccgaggcggtgaggtgtacaatcgaggcaggttaccctggggtgctaagtagcagggataagtacggaagggtggtgatgctgtttaacattgaaaattggcagtctcaggagatcaccttcgacgagattctgcaggcttactgctttatccttgaaaaactcctggaaaatgaggagacgcagataaacgggttttgtataatagaaaattttaaagggttcactatgcaacaagccgcttctctcagaacttccgatctcagaaagatggttgatatgttgcaagattccttccctgctcggtttaaggcgatacatttcatacaccagccgtggtactttaccactacgtataatgtagtgaaaccattcttaaaatcgaagctcctcgagcgggtttttgtgcatggcgatgatctttccggattttatcaggagatcgacgagaacattctcccttctgatttcggagggaccctgccaaaatatgatgggaaggctgtcgcggaacagttatttggcccacaagcccaggccgagaacacagccttttag

SEQ ID NO: 238450 - DNA, 807 bp, Artificial Sequence
  Description of Artificial Sequence: Synthetic coding sequence
atggccgagctggatattggtcaacactgtcaagtggaacactgtcggcagagagactttttaccttttgtgtgcgatgattgtagtggtattttctgcctagagcataggtctcgggaaagtcacgggtgtccggaggtaaccgtgatcaacgagcggttgaagacagaccagcatactagctatccatgctcgtttaaagactgcgccgagagagaactggtcgccgtaatatgcccctattgtgagaaaaatttttgtctgcggcacaggcatcagtccgatcatgagtgcgaaaaactggaaatccccaagcccaggatggcagccacccagaagctagtgaaagacataattgacagtaagactggagagacagcctccaaaaggtggaaaggcgctaagaattccgagactgcagcaaaggtcgcattaatgaagctgaagatgcacgctgatggggataaaagcctcccgcagaccgagaggatctactttcaagtgttcctccccaagggttctaaggagaagagtaaacccatgtttttctgccatagatggagcataggtaaggcaattgacttcgcagcgtctctcgctcgacttaaaaatgataataataagttcacggccaaaaaactgaggctatgtcacataaccagcggagaggccctgcccttagatcataccctggagacttggatcgctaaagaggactgccccctctataacggcggtaacattattctggaatacctaaacgatgaagagcagttctgcaaaaacgtggagtcatacctggaatag

SEQ ID NO: 238451 - DNA, 2751 bp, Artificial Sequence
  Description of Artificial Sequence: Synthetic coding sequence
atgcagcgacctgtggtaaaattgtatgctaccgacggtcgcagagtcccttctctccaggctgtgatcctgtcctctggcgctgtcgtcgcggctggtcgggaaccattcaaaccgggaaactacgacatccagaagtatctattgcccgcacgcctgcccggtatcagccagagagtgtatcccaaaggcaatgctaagtcagaaagccgtaaatcctctaactggaaagtttttattattacaagcgatctgccggatgccggaacatcaagtcaaatctatatcatcctctatggccaacatagatccagcgcgccaatctacctgtacgggacagatggagcccgattccaagtcggacatgaggatatattcacaattacagtcggagatatcggggctttgttcaaaatccgaatcggacacacaaactcaggctctagccccagctggcattgcaaggagattcaactgcacaacatgaatagcggcaagcagttttatgttcccgtgcagcggtggctggcgagggatcaggaggacggcgagatttgtagagagtttcctttgctgagcaagggccagccagtgctgccggtcaccatctacgaggttaacgtggccaccggagaactttggaacgcaggaaccgtcgcaaacgtgtatatctcaattcatggcgagaagggtgatacaggttcaagacagctgttcagaagtaagtccagcttcaactttttgagagggcaaaccgatacattttttttggaagcggtgcacttgggcgacctctgtaaaattgtgatcggacacgatggcctgggaccaggaaatgggtggtttctggatgatgtggtcattaaggacccgaccaccaactacgagtatgccttcttctgtcataggtggctggatcagggagaagatgattgcaagatcgttagagaactctatgcacgggataactccatcttttccgccaggcagaaattagagctgaagcggaaagagacgtggacggccgagtcatggaaattcaccaagggcaatacactgcaattctataataagctgaccgggggattcgtgcggctacatccagatgggacggtggatgccattggagagaagacggataagtacggcgtgtttgatgtcatcttcaataaaaggaatatttgcatcttccagtcccacgagatgcgtcacctgagtctagcactggacaatggcattgtgacgggaatggtctccggtgaagctactacggaattgagggtgctttatcaaccaaaccggtgtgctctgctggagagtgcactggtgcctggccacactgtcgtgttcgacagacacgggaagatcgctgatgcttccagcgccggatatgcaaatttgtcaaaggagtttgtgatatttgtgaagggcgtttttctcaactcggcagtcgtgctccttgccacctccctgtgtcaggcgctgtgtttgcagcccgacggaagctgcacaggtgtcggtagtcaatcagagaaaagttactggaaggtgcacaagatcagtagcgggatctgcatgttcgaaagtgtcaaaaacgcacaaatgtatctgaggataaaagacggacgttgcgacggcaccgggaccggagacgtcgactgtcactttaagattaaaaagaacctcaagaatgcatctatctccttggagagtaccaaaagccccggtttgtttgtcggattacaatccgatggccaggcgaagcccatgatctataccaaggatgagaatgtgtgtttctatcctcaggtcatccagtttggcagagagaaccctatgggcatgtccgcaactcccagtcaggaagaagagaagatccacgagagcaagaagcagaagaagatccctcccgagagcgaagcgagatctccacttccttcctctacagctaaagagattcgccactttcagagcagcgaaaccctcctgagtgaagacgagtggaaagttctggttctgaccggaaatacaggaacccaggccaatgtgactctctgggtgtacggagataaaggagtgacaggccctatttcacttcggaaagactcctcagagcagcttttccttcccggacacgaagacgagttccaagtagagatcaggaacacaggcaacatttataagatcaggatcgggcatgacgggacaagcgagcagcctgaatggaatctccagcgcgttactatgcagcatatgaaatccaaaaagattctggactttgccgctaatgtttggctctcgcgaatacaagcggatggtgatgtggtgtgtgagctacctgtcgtgaagggcggacaggccatcttccccctagtaagatatcaggtggacgtgtacactggccagctcaaacatgcggaaaccgagagcgaggtcttcctttgcctattcggtgaacggggagactcgggactcaggcagctgtacaagtccaatatgcaggttaaatttcagcgcggacagatcgataaattccaggttgcagctgtcagtctgggcaaattacagaaggtgctcctgcgatgtgaggcctccgacaagtcccaatattggtattgtgagcaggtgatcgtgagagagccgggtactacatctgaaagcatctttacttgccagcggtggttaccgtttatgagccaggggatcattcacagcgagatcgaactgtacctgcaaggggaagactattag

SEQ ID NO: 238452 - DNA, 7202 bp, Artificial Sequence
  Description of Artificial Sequence: Synthetic coding sequence
atgaattcaacacccagaaatgcccaggcacccagccatcgcgaatgctttctcccatccgtagctcgcaccccaagcgtgacaaaagtaacccccgcaaagaaaatcacgttccttaaacgtggggatccaagattcgctggtgttcgtctagcagtccatcagagagcttttaaaacatttagtgccttgatggatgaactttcgcagcgtgtgccactctcattcggggtgcgaagcgttaccactcctaggggcctgcattcgctgtccgctctggagcaactggaggacggcggatgttacctgtgctcagacaaaaaaccgccaaagacaccctcaggcccagggcgaccccaggagcggaaccccactgctcagcagctacgcgatgtcgaaggacagagagaggccccaggcacatcctcgtccagaaaatccttgaaaaccccgaggagaatattgcttataaagaatatggatcctcggctccagcagacagtagtgctgtcacatagaaacacccgtaacctggccgctttcttaggcaaggccagcgatttgttgcgcttccctgtcaaacagctgtacacaacctcaggaaaaaaagtcgattctctacaggccctcttgcattcgccctctgtgctggtgtgcgctggacatgaagctttcagaacacctgccatgaaaaacgccagacgctctgaggctgaaacactgagcggactaacatcaaggaacaagaacggttcctggggcccaaagacaaaaccttctgtcattcatagcaggagtccccctgggtcaacccccagactaccagagcggccaggcccttccaacccacccgtgggacctgctcccggtaggcacccccaggacactcccgctcaatccggtccattggttgccggagacgacatgaagaagaaggtgcgcatgaatgaggatggttccctgtccgtggagatgaaggttcgctttcatctggtcggcgaagacactctgctatggtcaaggcgtatgggacgcgctagcgcactgaccgctgcctcaggtgaagaccctgtcttaggcgaagtcgaccccctctgttgcgtctgggaaggctacccatggggattctcggagcccggagtctggggcccaaggccgtgccgggtgggctgcagggaggtctttgggcgaggaggacagcccggtccaaagtatgagatctggacaaatccccttcacgcaagtcaaggggaaagagtcgctgcacgaaagagatgggggctggcccaacatgttaggtgctcgggtctgtggggccacggaaccgccggaagagaaaggtgcagccaagatagcgcgagtcctgcttcatccacagggctgccagaggggtctgaacccgaaagttcttgctgtccccgaactccagaggacggagtggattcagcctctccatccgcccagattggggctgaacgcaaagcaggcggtagcctgggcgaagatcccggactgtgcatcgacggtgctggcctcggaggacctgagcaaggagggagacttacaccacgagcacgatccgaagaaggcgctagcagcgactccagtgcatcaactggcagccatgagggaagctccgaatggggtgggaggccccagggctgccccggaaaagctcgcgcagagacttctcagcaggaggcgtctgagggcggagaccccgctagcccagccctgtcactaagctccttgcgctcagatgacctccaggcagagacgcagggccaggggacggaacaggccactggggcagcagtgactcgcgaaccacttgtgctggggctatcctgttcctgggactctgagggcgctagcagcactccatctacgtgtacttcttcacagcagggccagcgaaggcaccggtccagggcgagtgctatgtcctctccgtccagtcctggacttggtagggtagctcctcgcggacaccccagacactcccactatcgcaaagacacacattctcccctggactcatctgtaaccaagcaggtgccgcgaccccctgagcgcagaagggcttgccaggatggcagcgtgccgcgatatagcgggagctctagctccacccgtacgcaggcttctggcaatctgagaccacctagctccggctccctcccatcacaggacctgttaggaacgagtagcgccacggttaccccagctgtccattccgacttcgtgagcggagtaagcccccacaatgccccttcagccggttgggccggagatgctggcagtagaacttgtagtcccgctccaatccctccccacaccagtgattcttgttcgaagtccggagctgcctcactgggagaagaggcaagggacaccccacagccaagtagtccccttgttctgcaggttggcaggcctgaacagggggctgtgggtccccatcggagtcactgctgttctcagcccggaacacagcccgcacaggaagcccagcggggaccctcaccggaagcctcctggctctgcggtcggtattgtcccaccccgcctagaggcagaccttgcccgcagcggcgatcctctagctgcggcagcacaggctcaagtcatcagtccactgctagaggccctggtggcagcccccaggaaggtacaaggcagccaggcccaaccccttcacctgggccaaattccggagcttcacggagatcctctgcttcccaaggcgctggatccagaggcctttccgaagaaaaaaccctgcgatcaggagggggaccacaaggtcaggaggaagccagcggggtctctccgtcctcgctcccccgatcaagtccagaggccgtggtcagagagtggctcgacaacatccccgaggagcccatattaatgacttatgagttagctgatgaaaccaccggagcggctggaggtgggctgcggggaccagaggtagatccaggcgacgaccacagcctggaaggcctgggagagcctgcccaggccggacaacagagtcttgagggggaccctggacaggacccagaaccagaaggagccttgttaggctcatcagacacaggtccgcagagcggggaaggggttcctcaaggagcggcacctgaaggtgtctccgaagcccctgcagaagcaggcgctgaccgggaagccccagctggttgccgcgtaagcttgcgagccttgcccggaagagtatccgccagcacacagattatgcgagctctcatggggagtaaacaaggtagaccaagcagcgtaccagaggtgtcgcgtccgatggctagaaggttgagctgcagtgccggagcactcatcacttgcttggcttctctgcagctctttgaggaagaccttgggtcccccgcaagtaaggtgagatttaaggattctcctcgataccaggaacttctgtccatctccaaggatctatggcccggatgcgatgtcggcgaggaccagttggacagtggtctgtgggagctgacatggtcacaagcactgccagatctgggatctcacgccatgacagaaaactttactcctacctcaagtagcggagtagatatcagttcgggatctgggggatccggcgaatcatctgtgccttgcgcaatggatgggaccttagtcactcaagggacagaattgcctctgaaaacctccaatcagcgtcctgatagtaggacctatgaatcacccggtgatctggaaaaccagcagcagtgctgtttccccacattcttgaatgcaagagcatgtgcctgtgccacgaatgaggacgaagcggagcgcgattcagaggagcagcgggcatcctcgaatctggagcagttggcagagaatactgtccaagaggaagtccagcttgaagaaactaaggaagggaccgaaggagaaggccttcaggaggaagcagtacagctggaagagactaagacagaagaggggcttcaggaggagggcgtgcaacttgaggagaccaaggaaacagagggagagggtcagcaggaggaagaggcccagctcgaagagatagaggaaactgggggtgagggactgcaggaagagggggtccagctcgaggaagtcaaagagggccctgaggggggtttgcaaggagaggctctagaagaaggcctgaaagaggaaggccttccggaagaagggagcgtgcacggtcaggagcttagtgaggcatctagccccgatggcaagggatcacaggaggacgatccagtccaggaggaagaggctggtagagcttcggcgagcgctgagccctgtccggctgagggaacagaggagccaaccgagcctcccagccatctttctgaaacggaccccagcgcttccgaacggcagagtggctcccagttggagccagggttagaaaagccacccggagctaccatgatgggtcaggagcacacccaggcgcagcccacccagggagctgcggaaagaagcagctctgtggcctgcagcgctgctcttgactgtgaccccatctgggtgtccgttctccttaagaaaaccgagaaggcttttcttgctcacctggccagcgccgtagccgaactgagggccagatgggggttgcaggataatgacctgctggaccagatggctgccgaactgcagcaggacgtagcccagcggttacaggattcaactaagcgggagttacaaaaactgcagggtagagcgggacgtatggtcctcgaaccccctagagaggcattaacaggggagctgctgttacaaacgcagcagcgaagacatcgcctgcgaggccttagaaatttgtcagccttttccgagagaaccctcgggttgggcccattgtcatttaccctcgaagacgagcctgccctgtcaacggccctggggtctcagctaggcgaggaggctgaaggcgaggagttttgtccctgcgaagcgtgtgtcagaaagaaggtgagtcccatgtctcctaaagccacgatgggagctacccgcggaccgattaaagaggcctttgacctccaacagatcctgcagcggaaacgcggtgaacacaccgacggtgaggctgcggaagtagcaccaggcaagacccataccgacccaacaagtacaaggacggtgcaaggagcagagggaggtttaggacctggtctaagccaaggccctggcgtggatgagggcgaggacggcgagggcagtcagcggctgaatcgagacaaagatcccaagctcggtgaagcagagggtgatgcaatggcccaggaacgcgaaggaaagacccacaactccgaaacctctgcagggtctgaattgggggaagccgagcaagagggggaagggatatctgaaagaggcgagaccggcggacagggctcgggccacgaagataatttacagggggaggcagcagcaggcggagaccaggatcctggtcagtctgacggcgctgagggcatagaagcacccgaagccgaaggcgaggcccaaccagagtctgagggtgttgaagccccagaagccgagggcgacgctcaggaagccgaaggagaggcacagcccgaaagcgaggacgttgaggcacccgaggctgagggcgaggcccagccagaaagcgaggatgtggagactcccgaggctgaatgggaagtgcaacccgagagcgagggcgctgaggccccagaggcagagaaggaggcccagcctgaaactgagtccgttgaggccctggaaaccgaaggagaggacgaaccagagtctgaaggggctgaggcacaggaagcagaagaagccgctcaggaagctgaagggcaaacgcagcccgaaagtgaagttattgagtctcaagaggccgaggaagaggcccagccagaatccgaagacgtggaggctctggaggtggaggtggagactcaggaggccgagggggaggcccaacccgaaagcgaggacgttgaagctccggaggccgagggtgaaatgcaggaggccgaggaggaggcgcaacccgagagcgatggggtggaggctcagccaaaatcagagggtgaggaagctcaggaggtcgaaggtgaaacacagaaaacagagggcgacgctcagcccgaatccgacggggttgaggcccctgaggcagaggaagaggcccaggaggcagaaggggaggttcaagaagctgagggcgaagctcaccccgaatcagaagatgtggacgcccaggaggcggagggcgaggcccagcctgagagcgagggagtggaagctccggaagcggaaggtgaggcccagaaggctgaaggaatcgaggctccggagacagaaggggaagctcagcctgagtctgaaggcatcgaggcgccagaggctgagggcgaagctcagccagaaagcgaaggcgtcgaagctcaagatgccgaaggcgaggcccagcccgaatctgaaggcatcgaggcacaagaggccgaggaagaagcccaacccgaactggaaggtgtcgaggcacccgaggccgagggcgaagcacagcctgaatccgaagggatcgaagcacctgaggctgaaggtgaagcccagcccgaacttgagggagttgaggctcccgaggccgaggaggaagcacagccagaacccgagggggttgagactcctgaagcggagggcgaagcccaaccggagagcgagggtgaaacccagggggaaaagaagggcagcccacaggtgagtttaggcgacggacagtcagaagaggctagtgagagcagttcacccgtaccggaggatcgccctacccccccacccagccctgggggtgacacaccacaccagcgcccaggctcacagactgggccaagtagttctcgcgcttcatcttgggggaactgttggcagaaggatagcgagaatgaccacgtcctgggagataccaggtctccagatgctaagagcacggggacacctcatgccgaaagaaaggcgaccaggatgtacccggaatcaagtaccagtgagcaagaggaggcccctctggggtctagaactccggaacagggggctagcgaaggctatgacctgcaggaagaccaagcactgggatctctggcacctaccgaggctgtgggaagggctgacgggttcggacaggacgacctggacttcta

SEQ ID NO: 238453 - DNA, 5019 bp, Artificial Sequence
  Description of Artificial Sequence: Synthetic coding sequence
atgaaggtagatcgtacgaaactaaaaaaaacacccacggaagctcccgctgactgcagggctctgatcgacaagctgaaagtctgtaatgatgagcagctgctgcttgagctgcaacagattaagacctggaatatcgggaagtgcgagctgtatcattgggttgatttgctggatagattcgacggcattctggctgatgccggacagacagttgagaacatgagctggatgttagtgtgcgaccgcccagaacgtgagcagctgaaaatgctcctgctcgctgtgctcaactttacagctttgttgatagaatacagtttctctcgccatttgtatagcagtattgaacacctaaccacactgctcgcgagcagcgacatgcaggtggtgcttgccgtgctgaatctgctgtatgttttttccaagagatctaattatatcaccagactcggatcagacaaaaggacaccactgctgacccgactccagcatttggcggagagttgggggggtaaggaaaacggatttggcctggctgagtgttgccgagacctccacatgatgaaataccctccatctgcaactaccctgcacttcgagttttatgccgatccaggggctgaagtgaagatagaaaagcggaccacttcaaatacgttacactacatccatatcgagcagctggacaaaatctcagagtcccccagtgagattatggaatctcttacaaaaatgtacagcatcccgaaggataagcagatgctgctttttacgcatatccggctggcccacgggtttagcaaccataggaaaaggctccaggcggtccaggcgaggttgcacgcgatcagtattctagtgtattccaacgccctgcaggaaagcgccaactccatcctctacaacggccttatcgaggaattggtggatgtgctccagattacagataaacagctcatggaaataaaggctgcttctctccggacattaaccagcatcgttcacctagagagaacccctaaactgagctctattatagattgcacgggaacagcttcataccatgggttcctgccagtgctggtgagaaactgtatacaggccatgatcgaccccagtatggacccgtacccgcatcaatttgctactgccctcttcagctttctttaccacctcgccagctatgacgctggcggagaagcactggtttcttgcggcatgatggaggcattacttaaggtgatcaaatttctaggggacgagcaggaccagataacattcgtgaccagggcggtgcgggtcgtcgatctcattacaaacctcgacatggcagcattccaatctcacagtggcctgtccatatttatctatcgactagagcatgaggtcgacctatgccggaaagagtgccctttcgtgatcaagcctaaaattcaacgtcctaacaccacacaggaaggggaggagatggaaaccgacatggatggtgtgcaatgcattccccagcgagcagctcttctcaagtcaatgttaaacttcctcaagaaggccatccaagacccagctttctccgatgggatacgccacgtgatggatggtagtctgcctaccagcctgaagcacatcatcagcaacgctgagtactacggccctagtttgtttctgttggcgaccgaggtggttacggtgtttgtctttcaagaaccaagcttgttatcaagcctgcaagacaacgggttgacggacgtgatgctgcacgcactgctgatcaaggatgtacccgcaacaagagaggtgctgggaagcctgccgaatgtctttagcgccctttgcctgaacgcccgtggtctgcagagcttcgttcagtgtcaaccctttgagagactgttcaaggtgctcctgtcacctgactatctgcccgctatgcgccgacggagatcttccgacccgttgggcgacaccgcatcaaaccttggcagcgcagtcgacgagctgatgagacaccagcccactctgaagaccgacgccaccactgccatcattaagctcctcgaggaaatctgtaacttgggacgtgaccccaagtatatatgccagaaaccttctatccagaaggccgacggaaccgcaacggccccacccccacgatccaatcatgccgctgaagaagcttcctctgaagacgaagaggaggaggaggtccaggctatgcaatctttcaacagcacgcagcagaacgagaccgagcctaatcagcaggttgtggggacagaggaacgtatcccaatacccttgatggattacattttaaacgtgatgaaattcgtggagagcatcctgtctaataacactactgatgatcactgtcaggaattcgtcaatcagaagggcctgctgcctctggtaacaatcctgggcctgccaaacctacctattgattttccaacgtctgccgcatgccaagctgtggctggggtgtgcaaatcaatactgacgctgtcccacgagccaaaggtccttcaggagggactcttacaattagattcaatcttgtctagcctcgaacccttgcaccggccaatagagtcccccggagggagcgttctgttacgggagctggcctgcgcaggcaatgtcgccgacgcgacactgtccgcacaagccactcccctgcttcacgctctgactgccgcacatgcctacatcatgatgttcgtgcatacatgtcgggtcggacagtctgagatcaggtctatttccgtcaaccaatggggaagccagttaggcttatccgttctttctaagttgtctcagttatactgctctctggtgtgggaatcaacagtactgctgagcttgtgcacccctaattcactgccctctgggtgcgagtttggacaggccgacatgcagaaattagtgcctaaggacgaaaaagcagggaccacacaaggcggaaaacgaagcgatggcgagcaggatggggctgctggctccatggatgcgtctactcaaggactgctcgagggcataggactcgacggtgacaccctggccccaatggaaaccgatgaacccactgcatcagattctaagggcaagagcaaaataactcccgcaatggcggctcgtataaagcagatcaagccactactgtcggcaagttcgagattggggagagccctcgcagagttgttcgggctcttggtcaaattgtgtgtggggtcccccgtccggcaacgtcggagccaccacgctgcatcaactactacagcacccacacccgctgccaggtctaccgcctctgcgctcaccaaattactgaccaagggattgtcctggcagcccccaccatatacccccaccccccgattcagactcactttcttcatctgtagcgtgggctttacctcaccgatgctgttcgacgagcgtaagtatccatatcacctcatgctccagaagttcctctgcagcggcggtcacaatgcacttttcgaaacctttaactgggcactctcaatggggggaaaggtccccgtgagtgaaggtttggaacattctgatctgccagacggcacaggcgaattcctcgacgcttggttgatgctggttgaaaaaatggtaaaccccactacagttctggaatctccgcatagcctgccggctaagttgcccggtggcgtgcagaacttccctcaattctccgcactcaggttcctggtggtcacccagaaggctgctttcacatgtattaaaaatctgtggaacaggaaaccactcaaggtgtacgggggtcgcatggccgaatctatgctagcgattctatgtcatatcttgaggggggaaccggttattcgggagagactgtctaaggagaaagagggctcccgtggcgaggaagacaccgggcaggaagagggaggaagccgcagagagccacaggttaatcagcaacagttacagcagttaatggacatggggtttacgagggagcatgctatggaggcactactgaacaccagtactatggaacaggccaccgaatacttactcacccatccaccccctatcatgggcggagtggtacgtgacctttctatgagtgaagaggaccagatgatgcgagccatcgcaatgtccttaggtcaggacatccctatggatcagcgtgccgaaagccccgaagaggtggcatgcagaaaagaagaagaggagcgcaaagccagagaaaagcaagaggaagaagaggccaagtgtctggaaaaattccaggacgctgatccgctggagcaggatgaattgcataccttcacagacacaatgctgccaggctgtttccacctcctggacgaactgccagacaccgtataccgagtctgcgatctcattatgacggcaattaagcgcaatggcgcagattacagagacatgatcctgaagcaggtggttaaccaagtctgggaggccgcagacgtattgatcaaggcagcactccctctgacgacatccgacaccaagactgtgagtgaatggatcagccaaatggctactctgcctcaggccagcaatcttgccacacgaatcctcctccttacgttactcttcgaggaactgaagctcccatgtgcatgggtggtggagtcaagtggtatcctgaacgtgctcataaaacttctggaggtggtccagccctgtttgcaggccgctaaagaacaaaaagaagtgcagacaccgaagtggattacgcccgttctgctgctgatcgatttttatgagaagactgccatctcgtccaaacggagggcccaaatgaccaagtatctgcaatccaatagcaataattggagatggttcgatgacagatccggacgttggtgtagctatagcgcttctaacaattccactatagatagcgcgtggaagagtggggagaccagcgtccgctttacagccggtcgaaggaggtacacagtccagttcactaccatggtgcagggcacaagcgcagaatag

SEQ ID NO: 238454 - DNA, 666 bp, Artificial Sequence
  Description of Artificial Sequence: Synthetic coding sequence
atgagcagcaggcccggaagggaggatgttggagcggctggcgctcgcaggccgagagagcctccagagcaggagttacagcggaggagagagcaaaagagaagacgacacgatgcccagcagctccagcaactgaaacatctagagagcttctacgaaaagccccctcctgggctcatcaaggaggacgaaacgaaacccgaggattgcatcccggatgtaccagggaatgagcacgccagagaattcctggcccatgctcctactaaggggctgtggatgcctctggggaaggaggtcaaggtcatgcagtgttggaggtgcaaaaggtatggccaccgcacaggcgataaagagtgtcccttctttatcaaggggaaccagaagctggaacagtttagagtggcccacgaggatcccatgtacgatattatccgggataataagaggcatgaaaaggacgtgaggatccaacagctgaagcagttgctcgaagacagcactagcgacgaggaccgaagcagcagctccagtagcgagggcaaggagaagcataagaaaaaaaagaaaaaagagaagcacaagaagcgaaagaaggagaagaagaagaaaaaaaagcgcaagcacaagtcatcaaagagtaacgagggaagtgacagtgaatag

SEQ ID NO: 238455 - DNA, 2262 bp, Artificial Sequence
  Description of Artificial Sequence: Synthetic coding sequence
atgcgggagcctgaagagctcatgccagactctggcgcagttttcacatttggaaagtcaaagttcgcagaaaacaaccctggtaaattttggtttaagaatgacgtgcccgtgcatctgagctgtggggacgaacattcggccgtcgtcacaggtaataacaagttatatatgttcggttccaataattgggggcagttggggctgggaagcaagtccgccatctctaagcccacgtgcgtgaaagcattaaagcctgaaaaggtgaagcttgccgcttgtggccgaaaccatacgctggtgtctacggagggaggcaacgtctatgcaacaggagggaataacgagggccagttaggactgggggataccgaggagagaaatacatttcatgtcataagtttttttacaagtgaacacaagatcaagcagctcagtgctggttccaacacttcagctgcccttactgaggatggaaggttattcatgtggggagacaactcggaggggcagataggtctcaagaacgtgtcaaacgtgtgtgttccccagcaggtgaccatcggcaagcctgtgtcttggatctcatgcggctattaccacagcgcattcgttacgacagacggcgaactttacgtttttggcgagccagagaacggcaagcttggattgccaaatcagctgctcgggaaccaccggacgccccagctggtgtcggagatccctgaaaaagtcattcaagtggcatgcggtggcgaacacaccgtggtactgaccgaaaatgcagtctacaccttcggcttgggacagtttggccagctgggcctgggcactttccttttcgaaacgtccgaaccaaaagtgatcgaaaacatacgggaccagaccatctcttatatttcatgcggtgaaaatcatacagccctgataaccgacataggattgatgtatacattcggcgacggcaggcatgggaaactgggcctggggctggagaatttcaccaaccatttcatccccaccctatgctctaattttctgcggtttatcgtgaagctggagagaagccccgacagcttctctatgaggcgtacgttaccgccaatcgaaggtaccctgggtttgagtgcatgctttttgcccaattctgtcttcccacgttgttccgagaggaatcttcaagagtctgtcttgtcagaacaggatctgatgcagcccgaagagcccgactacctcttggacgagatgactaaagaggccgagattgacaatagttctactgtggagtctctaggagaaaccaccgacatcctgaacatgacccacataatgagtcttaacagcaacgaaaagtctttgaagcttagccccgtacaaaaacagaaaaaacaacagacaattggtgaactcacgcaggacacagccctcaccgagaatgacgattccgatgagtacgaggagatgtcagaaatgaaggaaggaaaggcctgtaaacagcacgtaagtcagggcatcttcatgactcagcccgcaaccactattgaagcattcagtgacgaggaggtcgagattcccgaggagaaagagggagcagaggactcaaaggggaacgggattgaagaacaggaggtggaagccaacgaagaaaatgtgaaagtgcatggaggccgtaaggaaaaaacggaaattttatccgatgacctcactgataaggcagaagatcacgaattcagcaaaacggaagagctcaaactcgaggacgtggacgaggagatcaatgccgagaatgtggaatcaaagaagaagactgtaggagacgacgaaagcgtccctaccggctaccattcaaagaccgaaggcgctgagcggaccaacgacgactccagcgcggagacgatcgaaaagaaggagaaagccaatctggaggagcgagcaatctgcgaatataacgaaaaccccaaggggtacatgctcgatgacgcagattcctcctccctcgagattctggagaacagcgagaccacacctagtaaggatatgaaaaaaaccaagaaaatcttcctgtttaagagagtcccatcaatcaaccagaaaatcgtcaaaaacaataacgaaccactgccagaaattaagagtatcggcgatcagatcatcctgaagtccgacaataaggacgcagatcaaaaccatatgagtcagaaccaccagaacattcctccgacaaacacagaaagaaggtcaaagtcctgtacgattctgtag

SEQ ID NO: 238456 - DNA, 2448 bp, Artificial Sequence
  Description of Artificial Sequence: Synthetic coding sequence
atgagggaaccagaggaattgatgcctgattctggcgcagtgttcactttcggcaaatctaagttcgctgagaacaatcccggaaagttctggtttaaaaacgacgtccccgtgcacctgagctgcggcgacgaacactcggcggttgtcacagggaataacaaactctatatgtttggaagtaataattggggccagctggggctgggctccaagtccgccatttccaagccaacctgcgtgaaagctctcaagccagaaaaagtgaagttggccgcttgtggcaggaatcatacgctggtgtccaccgaaggcggtaacgtgtacgcgacaggcggaaataatgagggccagctggggcttggggatacagaggagcggaatacctttcacgttatcagcttttttacctctgagcataagatcaagcagcttagcgccggttccaacacttcggccgctctgaccgaggatggcaggcttttcatgtggggggacaatagtgaagggcagattgggctgaaaaatgtgtcaaatgtatgcgtgccacagcaggtgactatagggaaaccagtctcctggatctcctgtggctactaccatagtgcattcgtcacaaccgacggtgagctatacgtttttggagaacccgagaatgggaagttgggacttcctaaccagcttttgggcaaccaccgtacccctcagctggtgtccgaaattcctgagaaagtgatacaggtcgcctgtggaggtgaacatactgtggtactgactgaaaatgcagtatacaccttcggtctcggacagttcggccagcttgggctcggcaccttcctgtttgaaacaagcgaacccaaggttatcgagaacattcgggaccagaccataagctatatatcttgtggggagaaccatacagcactaattacagacatcggcctgatgtatacttttggcgatggaaggcacggcaagctggggctcggcctggagaactttacaaaccacttcattcccaccctatgttctaatttcttgcgttttatcgtcaagttagtggcctgcggtgggtgtcatatggttgtgttcgcggctccccatcgaggtgtggccaaagagattgagtttgatgagatcaacgacacctgcttgtcagttgcgacatttctcccttactcctcactgacttcaggcaacgtactccagcgaactctgtctgctcggatgcggaggagagagcgggagcgatccccagattctttcagcatgcgcagaaccctaccccctattgagggtacactgggactgagtgcgtgttttttgcctaatagcgttttcccacgctgctccgaacgcaacctccaagaaagcgtactgagtgagcaggacctcatgcagcccgaagaaccagattacttgttggatgagatgacaaaggaggccgagatagataacagctcaactgtggagtccttgggggagacgacagatatcctgaatatgacgcacattatgtccctgaattcgaatgaaaagtcgctgaaactctcacctgtgcaaaagcaaaaaaaacaacagactatcggggagctcactcaagacacagccctgactgaaaacgatgatagtgatgagtatgaggaaatgtctgagatgaaagagggcaaagcctgcaaacagcacgtgtcacagggtatctttatgacccagcctgccaccaccattgaggccttctccgatgaagaagtggagattcccgaagagaaagaaggcgctgaggattctaagggcaacggtatcgaggagcaagaggtagaggccaatgaggaaaacgttaaggtgcacggcggaaggaaagagaagactgagattctgagtgacgacctcaccgataaagcggaggaccacgagtttagcaagactgaggagcttaaactggaggacgttgacgaagagattaacgcagaaaacgttgaatctaagaagaagaccgtcggtgatgacgagtcggtgcctactggataccattccaaaactgaaggggctgaacggactaacgatgactcgagtgcagagacgatcgagaagaaggaaaaagcaaacttagaggaacgcgctatctgtgaatacaacgagaacccaaagggctatatgctggatgatgcagattcttcctcgcttgagatccttgagaactccgagaccacgcccagtaaggacatgaaaaaaacaaaaaaaatctttttgtttaaacgggttccgagcatcaatcaaaagatcgttaagaacaataatgagcctttaccagaaattaagtcaatcggcgaccagatcattcttaagagcgataataaggatgcggaccagaaccacatgtcccagaatcaccagaacatcccccctactaacaccgagcgcagaagcaaatcttgtacaattctgtag

SEQ ID NO: 238457 - DNA, 1443 bp, Artificial Sequence
  Description of Artificial Sequence: Synthetic coding sequence
atgcgtgaacccgaggagctcatgcctgattcaggcgctgttttcacctttgggaaaagtaagttcgcagagaataatcccggtaagttctggttcaagaacgacgttcccgtgcacctcagctgtggcgacgagcattcggccgtggtcacgggaaataacaaactttacatgttcggatctaataactgggggcagctcggactgggatcaaagtcagcaatctctaaacccacctgcgtcaaagcgcttaaaccggagaaggtgaagctggctgcctgcgggaggaaccacaccctcgtatctacggaggggggtaatgtgtatgctactgggggtaataatgagggccagctggggctgggagataccgaggaaagaaataccttccacgtgatttcctttttcactagcgagcacaaaatcaagcagctgtctgctggctccaacacgtctgcagcattgaccgaggatgggaggctattcatgtggggggacaactcagagggacaaatcgggctgaagaacgtgagcaatgtgtgtgtccctcagcaggtgacaattgggaagccggtgtcctggatctcctgtggctactaccattctgcttttgtgacaacagacggggagctctatgtctttggggagcctgaaaacgggaaactgggactgccaaaccagctattaggcaaccacagaactccgcagttagtcagcgagatcccagagaaagtgatccaggtagcttgcggtggtgaacatacagtggtgcttaccgagaatgcagtgtacacattcggactgggacagttcggccaactggggttggggactttcctattcgaaactagtgagcctaaagtcatagagaacatcagagaccagactatttcttatattagctgtggtgaaaaccacactgctctcatcaccgacatcggcttgatgtacacgttcggcgatggtcgccacggcaaactgggtctcggtcttgagaattttaccaaccacttcatcccaacactttgttctaattttttgcggtttatagtgaagctggtggcttgcggaggttgccacatggtggttttcgcggctccacaccgaggggttgctaaagaaatcgagttcgatgagattaacgacacgtgcctttctgtagctaccttcttgccctactccagcctgacatctggaaacgtgctgcagcgcaccctcagcgcacggatgagaagacgtgagagggaaagatcccctgactcattctccatgcgccgaacacttccgcctatcgagggaactctgggcctgagtgcctgctttctccccaactcggttttcccaaggtgttctgagcgaaacctccaagaaagtgtgttaagtgagcaagatcttatgcaacctgaagaacctgacacgcaccatgagccggaatttcagtag

SEQ ID NO: 238458 - DNA, 3063 bp, Artificial Sequence
  Description of Artificial Sequence: Synthetic coding sequence
atgcgagaacccgaagagctgatgcctgattcaggcgcagtgtttacatttggcaaaagtaagttcgctgagaacaacccgggaaaattttggttcaaaaacgatgtgccagtacatctgtcttgtggtgacgaacattcagcggtggttacaggcaataataagctatacatgttcgggagtaacaattggggacagcttggattaggatcaaaatccgctattagtaaaccaacatgcgtgaaagctctgaagcctgaaaaagtaaagcttgcagcctgtggcaggaaccatacgctcgtaagtactgaaggcggaaacgtctatgccaccgggggtaacaacgaagggcagctcggtctgggcgatactgaggagcgaaatacctttcacgtcattagttttttcacatccgagcataagataaaacagctctctgcgggatccaacacctcagctgcactaaccgaggatggccgactgtttatgtggggtgataatagcgaaggtcagattggcctgaagaacgtcagtaacgtatgcgtgcctcaacaggtgactatcggcaaaccagtgtcatggatatcctgcgggtactaccattctgctttcgtgacaaccgatggcgagctctacgtctttggcgagccggagaatgggaagttggggcttccaaatcagctcctgggtaatcaccgaactcctcagctggtgagtgagattcctgagaaggtgatccaggtggcttgcggtggggaacacacagtcgttcttactgagaacgccgtctacaccttcgggctgggtcaatttggacagctaggccttggaacatttctcttcgaaacgtcagaaccaaaagtcatagagaatattagagatcagaccatcagttacatctcttgcggggagaaccatactgctctgattacagacattgggctaatgtataccttcggcgacggacggcacggtaagcttggactgggccttgaaaactttaccaatcatttcatccccactctctgctctaattttttgcggtttatagtgaaactggtggcctgtggaggctgtcacatggttgtgttcgcagccccacataggggcgtggcaaaagaaattgagtttgatgagatcaatgatacatgcctgtctgtggccacgttcctcccatatagttccctgacatcaggaaatgttttgcaacgcacgctttcagcccgaatgaggaggcgggagcgggagaggtcccctgacagtttctcaatgcgcagaacattgccaccaatagaaggtaccctgggtctgtctgcttgctttctgcctaatagtgtttttccaagatgctctgaacggaatctgcaggagagcgtccttagcgaacaggacctcatgcagcccgaggagccagactacctccttgacgagatgaccaaggaggccgaaatcgataattctagcacggtggaatcactgggtgaaactactgatatcctgaatatgacgcatattatgtccttgaactctaatgagaaatctctcaagcttagccctgttcagaaacagaagaagcaacaaactatcggggaacttacgcaagatacagccctgaccgaaaatgatgacagtgatgagtatgaagagatgtccgaaatgaaagagggaaaagcgtgcaagcagcacgtgtcccagggaatttttatgacacagcccgcaacaacaatcgaggcattttctgacgaagaagttgggaacgatacaggacaggttggccctcaggctgatacggacggagaaggcctgcagaaagaggtgtatagacacgagaacaataatggggtggatcaacttgacgcgaaggagattgaaaaagagtccgacggcggacatagccagaaggaaagcgaggccgaagagattgacagtgagaaagagaccaagctggctgagattgcaggcatgaaagatctgcgggagcgggaaaaatcgacaaaaaagatgtctccattcttcggaaatctgcccgaccggggaatgaacaccgagagcgaggaaaacaaagacttcgtgaagaagagagagagttgcaagcaggatgtgattttcgactcagaacgagagagcgttgagaaaccagacagctacatggaaggtgcatcggagtctcagcagggtattgcagatggattccagcagccagaggcgattgagttttcatccggcgaaaaggaagatgatgaggtggaaacagaccaaaacatccggtatggtcgtaaactaattgagcaggggaacgagaaggagacaaagccaattatctctaaatcaatggccaaatacgattttaaatgtgacagacttagtgagatacccgaggagaaggagggagccgaggactctaaaggcaacggtatcgaagagcaggaagtggaggccaatgaggaaaacgtcaaagtccatggcggaagaaaagagaaaactgagattcttagtgatgatctgacagacaaagcggaggatcacgagttttctaaaacagaagagctcaagcttgaggatgtggacgaggaaataaatgctgagaatgtggagtccaagaagaagacagtgggggacgacgaaagtgttcctaccgggtatcattctaagaccgagggagctgagagaacaaatgatgacagttccgcagagaccatcgaaaagaaagagaaagctaacctcgaagagcgcgcaatttgtgaatataacgaaaatccgaagggatacatgcttgatgacgccgatagcagttctctcgaaatccttgagaattcagagaccacaccgtccaaagatatgaagaagaccaaaaaaatattccttttcaaaagggtcccctccattaaccaaaagattgttaagaataacaacgagcccttgcccgaaattaagagcattggggatcagataattctgaagtccgacaacaaagacgccgatcagaatcacatgagtcagaaccatcagaacatcccgccaactaacacagagcgtcgctctaagagctgcacaatattgtag

SEQ ID NO: 238459 - DNA, 1941 bp, Artificial Sequence
  Description of Artificial Sequence: Synthetic coding sequence
atgcgggaacccgaagaactgatgccggactcaggcgcagtgttcacattcgggaagtccaaatttgccgagaataatcctgggaagttctggttcaagaacgacgttcctgtgcacttgagttgtggggatgagcactccgcggttgttaccggcaataataagctgtacatgtttggaagcaataattggggtcagttaggactcgggagtaagtccgccatttctaaaccgacatgtgtaaaggccctcaaaccagagaaagtgaaactcgccgcttgcgggaggaatcatactttggtgtccacggaagggggtaatgtgtacgccaccggaggaaacaacgaaggacagctgggccttggggataccgaggagcgaaacacttttcacgtaatctcttttttcacgtccgaacataaaattaaacagctcagcgccggatcaaatacgtccgcggcactgactgaggacggcaggctgttcatgtggggcgacaactccgagggacagattgggttgaaaaacgtatccaacgtgtgtgtgccacagcaggtgaccatcggaaagccagtttcttggatttcttgcggctactaccattccgcatttgtgaccaccgatggggagctctatgtcttcggcgagccagagaatggtaaattgggtctgccaaatcagcttctgggaaaccacagaactcctcaattggtgtctgaaatcccagaaaaagtgatccaggtggcttgcggcggtgagcatactgttgtccttactgagaacgcagtctatactttcgggctggggcagttcggccagctgggcctgggtaccttcctgtttgaaacatctgaaccgaaagtaatagagaatattagggaccagaccatttcctatatctcatgtggcgagaatcacaccgccctcataacagatattggattgatgtataccttcggggacggcaggcacggaaaattggggttgggtctggagaatttcaccaaccacttcattccaacactgtgctcaaacttcttgcgcttcatcgtcaagctggttgcatgtggcggatgccatatggtcgtgtttgccgctcctcatcgcggtgtggcaaaagagatcgaattcgacgagatcaacgacacttgcctgtcagtcgctacattcctgccgtactcaagccttacctccgggaatgtgctacagcgtactttgtccgcaagaatgcggcgacgcgagcgggaacggagccctgatagtttttctatgaggcggaccctgcctcccattgagggaaccttgggcttatctgcatgttttctccctaactcagtatttcctaggtgtagcgaacggaatctgcaggagtccgtgctctcagaacaggacttgatgcagcccgaagagcctgattacctgctcgacgagatgacaaaggaggctgagattgacaactctagtacggttgagtccctcggcgaaactactgatattctgaacatgacgcacatcatgtccctgaacagtaacgagaagtccttgaagctcagcccagtgcagaagcagaaaaagcaacagacaattggggaactgacacaggacacggcactaactgagaacgacgattcagacgagtacgaagagatgagcgaaatgaaggaaggtaaagcatgtaagcaacatgtttcccagggcattttcatgactcagcccgcaaccaccattgaagcctttagcgacgaggaggtcgagattcctgaggagaaagaaggcgctgaggatagcaagggtaatggaatcgaggagcaggaagtggaggccaatgaagagaatgtaaaggtgcacggagggaggaaagagaagacggagatcctctcagacgatctgactgataaggccgaatactccgccagtcatagccagattgtatccgtatag

SEQ ID NO: 238460 - DNA, 3459 bp, Artificial Sequence
  Description of Artificial Sequence: Synthetic coding sequence
atgagagaacctgaggagttgatgccagatagcggtgcagtattcaccttcggcaaaagtaagtttgctgagaacaaccccggaaaattctggtttaaaaatgacgtacctgtccatctgtcttgcggtgatgagcatagcgccgtggtgacaggcaataataaactgtacatgttcgggtcgaacaactgggggcagttgggccttggatctaagagcgctataagtaagccaacttgtgtcaaggccctcaaacccgagaaagtgaagttggcagcttgcggccgtaatcacacacttgtatccacggagggtggaaacgtgtatgcgacggggggtaacaatgaggggcagctcgggctgggagatacggaggagcgcaacacgtttcacgtgatcagctttttcacctcagagcacaagattaaacagctgagcgcaggctctaatacatctgctgcactgacagaggatggcaggctgttcatgtggggggacaactccgaaggccaaattggcttgaagaacgtctctaatgtatgcgtcccccaacaggtgacaattggtaagccggtctcatggatatcttgcggctattatcatagtgcgtttgtgacgacagacggcgaactgtatgtgtttggggagcctgagaatggcaaactcggactgccaaatcagttgctcgggaatcacagaacaccccagctagtgagcgagattccagaaaaggtgatccaggtggcctgtgggggagaacacactgtggtcttgaccgaaaacgcagtctacacctttgggcttggccagttcggccagctgggtttggggacctttttattcgaaacatcggagcctaaggtaattgagaatattcgggaccagaccatcagctatatcagctgcggggagaatcacactgcactgataaccgatatcggtcttatgtacacttttggcgatgggagacacggcaaactggggttaggtctagagaacttcacaaaccatttcatccccactctgtgctctaacttcctacgtttcatagtcaaacttgtagcatgcggcggttgccatatggtcgtcttcgccgctccgcacagaggtgtggcaaaggagattgagtttgatgagatcaatgacacttgtctgtcagtggcaacatttctgccctattcctctctgacttctggcaacgtgttgcaaagaacgctttccgcacggatgcggaggcgggaaagggaacgctcccctgattcttttagtatgagaaggacactgcctcccattgaaggcacactaggcctttccgcttgcttcctgcctaactccgtgttccctcgctgttccgagcgcaacctacaggaatcagttctgagcgagcaggatctgatgcagcccgaagaaccagattatcttttagacgagatgaccaaggaggccgaaattgacaattcctctaccgtggaatctctcggtgagacgacagatattctgaacatgactcacatcatgtctctcaactccaatgaaaaatcacttaagttgagcccggttcagaagcaaaagaagcagcaaacaatcggcgaactgacccaagatacagctcttactgagaacgatgacagcgatgagtatgaagagatgtccgaaatgaaggaaggaaaagcctgtaagcaacacgtaagccagggaatcttcatgactcagcccgctaccaccatcgaggcatttagcgatgaggaggtcgagattcccgaggaaaaggagggggctgaggatagtaaggggaatggaatagaagagcaagaggtagaggcgaatgaagaaaatgtgaaagtgcatggcggacgtaaggagaagaccgagattctgagcgatgatctgacagacaaagccgaggtgtccgagggcaaggctaagagtgtcggagaggctgaggacggccctgagggacgtggcgatggaacctgtgaggaaggaagcagtggggcagagcactggcaggacgaggagcgcgagaagggtgagaaggacaagggcaggggcgagatggaacgcccaggggagggcgagaaggaacttgcagagaaagaggagtggaagaagcgagacggcgaggaacaggagcagaaagagagagagcagggacaccagaaggaaaggaaccaagagatggaggaaggaggtgaggaggagcatggggagggcgaagaggaagaaggagatcgcgaagaggaggaggagaaagaaggcgagggcaaggaggaaggagagggcgaagaggtggaaggcgaacgagagaaggaagaaggcgagcggaagaaagaggagagggcaggcaaagaagaaaagggcgaggaagagggagatcagggggagggcgaagaagaagagactgaggggagaggggaagagaaagaggagggaggcgaggttgaaggaggagaggttgaggagggaaaaggcgaaagagaggaagaagaggaggagggcgagggcgaagaagaagagggggaaggggaagaggaagaaggagagggcgaagaagaggagggcgagggtaaaggcgaagaggagggagaagagggggaaggggaagaggagggagaagaaggagaaggtgagggtgaggaggaagagggcgagggagagggagaggaggaaggcgagggggagggtgaggaagaagagggggaaggcgagggggaagaagaaggggagggagaaggtgaagaggaggaaggcgaagggaagggtgaagaagaaggcgaagaaggcgaaggagagggagaggaagaagagggggagggtgagggagaggacggggagggggagggcgaggaggaagagggggagtgggaaggcgaggaggaagagggggaaggggaaggcgaggaggagggggagggggaaggagaagagggcgagggggagggcgaagaggaggagggagagggtgagggagaggaagaggagggggaggaggagggcgaggaggaaggggaaggcgaggaagaaggtgagggcgaaggcgaagaggaagaggaaggggaagtagaaggcgaggttgaaggggaggagggcgagggtgaaggagaggaggaagaaggggaagaagagggtgaggagagggaaaaggaaggggagggcgaggagaataggcggaaccgagaagaagaagaggaggaagagggaaagtaccaggaaactggagaagaagagaatgaaaggcaggatggggaagagtacaagaaagtttctaaaataaaaggcagtgtgaaatatggaaaacataagacttaccagaaaaagtctgtgaccaatacccaaggcaacggtaaggaacagcgctccaaaatgcccgtgcagagtaaacgcctattgaagaacggaccatccggttccaaaaagttttggaataatgtactgccccattacctcgaacttaaatag

SEQ ID NO: 238461 - DNA, 2121 bp, Artificial Sequence
  Description of Artificial Sequence: Synthetic coding sequence
atgaacgagtccaagcctggcgattctcagaacttagcgtgtgtgttctgccgcaagcatgacgactgtcctaacaagtatggggaaaagaaaacaaaagagaagtggaacttgactgtgcattattattgcctgttgatgagcagtgggatctggcaacgcggaaaggaggaggagggcgtgtatggttttctcattgaagatattcggaaggaagttaacagagcttccaagctcaaatgctgtgtgtgcaaaaagaatggagcctccatcggatgcgttgcgccaaggtgcaaaagaagttaccattttccttgcggcctacaacgcgagtgcatcttccagttcaccggcaatttcgcttccttttgctgggatcatcggccagtgcagataatcacgtctaacaactatcgagaatccttgccgtgcactatctgcctagagtttattgaacccatacccagctacaacatcctgaggtctccctgctgcaagaacgcctggtttcatcgggactgtctgcaggttcaagcaattaacgctggtgttttcttcttccggtgtaccatatgtaacaattcggacatctttcagaaggaaatgctgaggatggggatccatattcccgaaaaagacgcctcttgggaactggaagagaatgcctatcaagagctcctacagcactatgagcgatgtgatgttcgtaggtgccgctgcaaggaggggagagactacaatgcacccgatagcaaatgggaaattaagagatgtcagtgttgtggctcatcgggcacacatcttgcgtgtagttccctgagatcctgggagcagaactgggaatgcctcgagtgccgtggtatcatttacaatagtggagagtttcagaaggccaaaaagcatgtgctgcccaatagcaataacgttggtatcaccgattgcctcctggaggagtccagtcctaagctgccaaggcagagtcctggtagtcagtcaaaagatctgcttaggcaaggctcaaaattccgcagaaacgtcagtaccctgcttatagagcttgggttccagataaagaaaaaaacaaaacggctctatatcaataaagccaatatttggaactctgccctcgacgcttttagaaacaggaattttaatccctcctacgcaatcgaggtggcctatgtcatcgagaatgacaatttcgggtccgaacaccctggcagcaagcaggaattcctttccctgttgatgcagcaccttgagaattccagccttttcgagggatccttgagcaaaaatctgtccctgaactcccaggcactgaaggaaaacttgtactatgaagcaggaaagatgctcgcgatatccctggtgcacggcggacctagccctggcttctttagcaaaacccttttcaactgcctggtgtatggcccagagaatacccagcccatcttggatgatgtctctgatttcgatgtcgctcagatcattatccgaattaataccgcgaccaccgtggcagacctgaaaagtatcataaatgagtgttacaattacctggagctcatcggatgcctcaggctgattacaactctttccgataaatacatgcttgtaaaggatattctgggataccacgttatccagcgcgttcatacaccatttgagagttttaaacagggtttaaaaacactcggcgtgctagaaaagatccaggcctatcccgaggctttctgctctatcctttgccataaacctgaatctttgtccgctaagattctttccgaactgtttaccgtacacacacttcccgacgtgaaagctttaggattttggaacagctatctgcaggccgtggaagatggcaagtccactacaaccatggaagacatcctgatcttcgccacaggctgcagtagcattcccccagccggattcaaacccacaccctctatcgagtgcctgcatgtggatttccccgtgggcaacaaatgtaacaactgcctggcaatccctattacaaacacctataaggaattccaggagaacatggatttcactataagaaacacactgaggctcgagaaagaggaaagcagtcattatatcggccattag

SEQ ID NO: 238462 - DNA, 1938 bp, Artificial Sequence
  Description of Artificial Sequence: Synthetic coding sequence
atgctgttgatggcccctgacaggtgtagatacgtgtggaaacactgccaacctatggaaatgcggatcaaatggatatttctgtgctgcatccgccctctgtacgatttcaccagccagtacgttatggagactgattccctgttcttgcattacctgcaagaagccagcgcacgtctggacatccatcaggccatggccagtgaacatagcaccctcgctgcaggttggatatgctttgaccgcgtgctggagaccgtcgaaaaagtccacggcctggcaaccctcattggggctgggggagaagagtttggagtattggagtactggatgcgcctccgttttcccattaagcccagtctacaggcttgcaataaacggaaaaaagctcaagtctacctgtccactgacgttcttggcggacgcaaagctcaggaagaggagttcaggagtgagtcctgggagccccagaacgagctgtggatcgaaatcaccaagtgttgcggcctccgatcacgctggctgggtacccagccctcgccttatgccgtttaccgcttctttaccttttcggatcacgataccgcgattatccccgcaagcaataacccatactttcgcgatcaggcccgattcccagtcctggtgacgtccgacttggaccactatctgcgacgggaagccctgtccatccatgtttttgacgatgaggacctggagccagggtcgtatctgggaagagcaagagtaccgctcctgccgttagcaaagaacgagagtatcaagggcgactttaacctcaccgatccggctgagaagcctaatgggtccattcaggtgcaacttgattggaaatttccctacattccaccagagtcctttctgaagccagaagcccaaaccaaaggaaaggataccaaggatagctccaaaattagttccgaagaggaaaaggcatccttcccttcccaggatcaaatggcttctccagaagttccaattgaggcgggacagtaccgtagcaagaggaagccccctcatggaggcgaaagaaaagagaaggagcatcaggtggtgtcctactcccggcgtaagcacggcaagcgcattggcgtgcaaggaaaaaaccgaatggagtatctctcactgaacattctgaatggcaatacaccagagcaggttaattacacagaatggaagttttccgaaaccaacagctttattggcgacggcttcaaaaaccagcacgaagaagaggagatgaccctgtcccattcagcgttgaagcagaaggagccattacatcccgtcaatgacaaagagagttcagagcaggggagtgaagtgagcgaggctcagaccaccgactccgacgatgtcatcgtcccacctatgtctcagaaataccccaaagcggatagcgaaaagatgtgcattgagattgtatccctggcattttacccagaagctgaggttatgagcgacgaaaacattaagcaagtgtatgttgagtacaagttctacgatctcccgttgtcagaaacagagacccccgtaagtttgcgtaagccacgggctggcgaagagatccatttccacttttccaaggttattgacctcgaccctcaggaacagcaggggcgaaggcgtttcctttttgatatgcttaacggacaggaccccgaccagggccatttgaaattcaccgtcgtgtctgatcctctggatgaggagaagaaagagtgcgaagaggtaggttacgcttacctgcagctgtggcagattctggaaagtgggcgagacattcttgagcaagaacttgatatcgtcagcccagaggatctggcgacacccattggtcgtctgaaggtctccctacaggccgctgctgtcttgcacgcaatttacaaagaaatgaccgaggacctgtttagctag

SEQ ID NO: 238463 - DNA, 1839 bp, Artificial Sequence
  Description of Artificial Sequence: Synthetic coding sequence
atgttgaagctcgacaacaaagatgttattagtcacccactgggatatcctagcgagtcattgttgtcaatcgccagcatgttagactcttccgattcaagttctcagccacactggagtaacgaactcattgcagagcagctgcagcagcaggtgagtcagcttcaggaccagctggatgctgaactggaggataaaaggaaagtcctgcttgagctgtcccgggagaaggctcagaatgaggacctgaaattggaggtgacaaacattttacagaaacacaaacaggaggtggagctcctacagaatgctgcgaccattagccagccccctgaccgtcaatctgagcccgctactcaccctgccgtgttgcaggaaaacacacagatcgagccctctgaaccaaagaatcaggaggaaaagaagctcagccaagtcctgaacgagctccaagtttcccatgccgaaaccacattggagctcgaaaagacaagggacatgctaatactgcagcgtaaaatcaatgtttgttaccaagaggagcttgaggcaatgatgactaaagccgacaatgataatcgcgatcataaagagaagttggaaagattgactcgattactggacttgaaaaacaacagaattaaacaactcgaagggatcctccgttctcacgacttgcccacatccggagatttcaacctgactgatccagccgagaagcctaatggatctattcaggttcagctggattggaagtttccctacatcccacccgaaagtttcttgaagccagaggcgcagactaaaggcaaagatactaaggacagcagtaagatctcctctgaggaggagaaggctagcttcccctcccaggaccaaatggcgtcccccgaagtacccatcgaggcagggcagtacaggtctaagcgcaaacccccacatggcggtgaacgaaaggaaaaagagcatcaggttgtttcatattcgcgccgtaagcacggcaagcggattggggtacagggaaaaaataggatggaatacctgagcctgaatatccttaatggcaacaccccagagcaggtaaactacacagagtggaaattcagtgagacgaattcattcattggagacgggtttaagaaccagcacgaggaagaagagatgaccctttcgcattcggcacttaaacagaaggagccccttcaccccgttaacgacaaagaatcatctgagcagggcagcgaggtgtcggaggcccagaccacagattctgacgacgtaatagtaccaccaatgtcgcagaagtacccgaaggctgatagcgagaagatgtgcatagaaatagtgtccctggcattttacccagaggcagaagtgatgtcagacgagaacataaagcaagtttacgtggaatataaattctacgacctacccctgtctgaaaccgagacccccgtctccctgaggaagccgagggcaggcgaagaaattcatttccacttttctaaggtgatcgacctcgacccccaggagcaacagggaaggaggcggttcctgtttgatatgctaaatggtcaggatcccgaccagggccacctgaagttcacagtggtatccgatccgctggatgaagagaagaaggagtgcgaggaggtgggctacgcatatctgcagctgtggcagatccttgaaagcggccgtgacatcctggaacaagagctggacatcgtgtctcctgaagacctggcaacacccatcgggcgtctgaaagtctcactccaggctgccgcagtgctacacgccatatacaaagaaatgactgaggatcttttcagctag

SEQ ID NO: 238464 - DNA, 3861 bp, Artificial Sequence
  Description of Artificial Sequence: Synthetic coding sequence
atgtcacacctggtggatcctacaagtggcgacctgcccgtgagagatatcgatgccattccgctcgttctccctgcttcaaagggcaagaacatgaaaacgcaacccccattatctagaatgaatagggaggaactggaggatagcttttttcgcctgagagaggatcacatgctagtaaaagagctgtcctggaagcagcaggacgaaattaagcgactcaggactactttgttgcgactaactgccgctgggcgtgatctgcgggtcgctgaggaagcggcaccgctgtccgagaccgctcgacgcggacagaaggcagggtggcggcagagactttccatgcatcagcggccacagatgcatagacttcaaggacactttcactgcgtaggaccagcgtcaccccgaagagctcagcctcgagttcaggtcgggcatcgccagctgcacactgctggagccccagtgcccgagaagccaaagcgcggacctagggataggttatcctacactgccccacccagcttcaaggagcacgctacaaacgagaatagaggtgaggtggcttcaaaaccctcagaactcgtgagtgggtcaaattctatcatttccttctcttcagtcataagtatggctaagcccatcggactgtgcatgcccaatagcgctcatatcatggcctctaacactatgcaagttgaagagcctcctaagtccccagaaaagatgtggcctaaagatgagaacttcgagcaaagatcgagtctggagtgcgcccaaaaggctgcagaattaagggctagcataaaggagaaagtggaactcatcaggctgaagaaactcctgcatgagagaaatgcctccctcgtgatgacaaaggcccaactcacagaggtccaggaggcctacgagacgttgttgcagaaaaaccagggcatcctctctgcggctcatgaagctcttcttaaacaggtgaacgagctccgagccgaactcaaggaggaatctaagaaagcagttagcctaaaatcccagctcgaagatgtttctatcctgcaaatgactctcaaggagttccaggagcgagttgaagatctcgagaaagagcgcaaattgcttaacgataattacgataaactcctggagtcaatgctcgatagtagtgacagcagttctcagcctcattggagcaacgaattgatagctgaacagttgcagcagcaagttagtcaattacaggatcagttggatgcagaactggaggacaagaggaaggtgttgctcgaactgtctcgggagaaagcccagaacgaagatttaaagctggaagtgactaacatcctccaaaagcacaagcaggaagtggaactcttgcagaacgcagcaacaatctcccagccgcctgacagacagtccgagccagctacccatcccgctgttctccaagagaacacccagatcgaaccttcagaaccaaaaaaccaggaggagaagaaactctcccaggtgctgaatgagctgcaggtaagtcatgcagaaactaccttagagctggagaagaccagggatatgctcatcctccagagaaaaattaatgtatgctaccaagaagagctggaggctatgatgaccaaagcggacaacgacaatcgggatcacaaggaaaaacttgaaagacttactcgcctcctggacctgaagaataaccggatcaagcagctagagggcatcttgagatcgcacgatttacccactagcgagcagctcaaggacgtagcgtatggtacacgcccactgagtctgtgcttggagactctgcctgcccatggcgatgaggataaagtggatatttctctgctgcatcaaggcgaaaatctgtttgaactgcatatccaccaggcgtttcttacatccgctgccctggcccaggccggtgatacacagcccacaaccttttgcacgtacagtttttatgacttcgagacgcactgtactccattgagcgtaggtccgcagccgctctacgatttcacgtcccaatatgtgatggagacagattccctctttcttcactatttgcaggaggcctccgctcgactggacatccaccaggctatggcatcagagcatagcaccttggctgccggatggatttgcttcgatcgcgttctggagaccgttgagaaagtacacggactggcgactctcatcggggctggtggggaggagttcggtgtgcttgagtattggatgaggttacgattccctataaagccatctcttcaagcatgcaataagagaaaaaaagcacaggtgtacttaagtaccgatgttctgggaggtaggaaggcccaggaggaagagttccgtagcgagtcttgggaaccccaaaatgagctttggatcgaaatcactaagtgttgcggcctgaggtctcgttggctggggactcagcctagcccgtatgcagtgtaccgttttttcactttctccgatcacgatactgcaatcattcccgcatctaacaatccttattttcgggaccaggctcgattccccgttctggtcacatcagacttagatcactacttgaggcgggaggccttgagcatccacgtgtttgacgacgaggatctcgaacccggttcctacttagggagggccagggttccccttttacctttagccaaaaacgaatcaataaaaggggactttaatctgaccgatcccgctgagaagccaaatggaagtattcaggtgcagctagactggaaatttccctacattcctcccgagagcttcctcaagccggaggcgcaaacaaagggaaaggacaccaaggatagttcgaagattagctctgaagaagagaaagcaagttttcccagccaggatcagatggcatctcccgaggtcccaattgaagccggtcagtacaggtctaagcggaagccaccccacgggggagaaaggaaggagaaagagcaccaggtggtttcgtactcccggcgtaagcacggtaagcggatcggagttcagggcaaaaacaggatggagtacttgtcgctgaatatattgaatggaaacacgccagagcaggtaaactataccgagtggaagttctcagaaacaaactccttcattggtgacgggttcaaaaatcagcacgaggaagaggagatgactctcagccactcagcactaaagcagaaggaacccctgcacccagtgaacgataaggaatctagtgagcaaggcagtgaggtgtccgaggctcagacgacagattctgatgacgtgattgtaccaccgatgagccagaagtaccccaaagcggattcggagaaaatgtgcattgagatcgtctccctggcgttttatcccgaagcagaggttatgagcgatgagaatatcaagcaagtgtacgtggagtataaattctacgacctgcctctcagtgagacggagacacctgtctcgctgcggaaacctagagccggtgaagaaattcacttccactttagcaaagtaatcgatcttgacccgcaggagcagcagggtaggcgccgttttctttttgacatgctcaacggccaagaccccgaccaaggccatctgaagttcaccgtggtaagcgatccgctggatgaggagaaaaaagagtgcgaggaagttggctacgcttacttgcagctgtggcaaattctggagagcggtcgggacatactggagcaagaactcgacattgtgtcccctgaggacctggcaactcctatcggacggcttaaggtgtccctccaggcagccgctgtgctacatgctatatacaaagagatgacggaagatttgtttagttag

SEQ ID NO: 238465 - DNA, 1617 bp, Artificial Sequence
  Description of Artificial Sequence: Synthetic coding sequence
atgaatctggagctcttggaaagcttcggccagaactaccctgaagaagccgacggcactctggactgcattagcatggcccttacctgtacgtttaatagatggggcacgctactggctgtgggctgtaatgatggcagaatcgtgatttgggacttcctcaccagaggaatcgctaagatcatttcagcccacatccatccagtttgctccctctgctggtctcgagacggtcacaaacttgtgagtgcctccaccgacaatattgtttcacagtgggacgtgctgtccggagattgcgatcagcgctttcggttccccagcccgattttgaaggtgcagtaccatccaagggaccagaataaagtgctggtttgtccaatgaagagcgccccagtgatgctgacactgtctgacagtaagcacgtggtacttccagttgatgacgactccgatttgaatgtggtagcttcctttgaccgtcggggagagtatatctatactggcaacgcgaaagggaagatcctggtcctcaagaccgactcccaggacttggttgcatcatttagggtcaccactggaacatcgaacaccactgccattaaatccatcgagttcgccaggaagggctcttgttttttgataaatactgcagatcgcatcatccgagtgtacgatggtcgcgagattctgacatgtggacgagacggagaaccggaacctatgcaaaaactgcaggacctggttaaccgaacaccctggaaaaaatgttgcttctcgggcgatggggaatatatcgtggcgggaagcgccaggcagcacgcactgtatatctgggagaagtctatcgggaacttggtgaagatcctgcacggaacaagaggagagctgttgcttgatgttgcatggcacccggtgcgcccaattatcgcatcaatctcatctggtgtcgtctctatatgggcccagaatcaggtggagaattggtccgccttcgcacccgatttcaaagagttggacgagaacgtcgaatatgaggagcgtgaatccgaattcgacattgaggacgaggacaaatcagaaccagagcagactggtgcagatgcggcagaagacgaggaggtggacgtaacctctgtggatcctattgcagcgttttgttcctcagacgaagagctggaggattcaaaagcacttctctatctgccaatcgcaccagaagtggaagacccagaggaaaacccatatgggccaccacccgacgcagtgcagactagcttgatggacgaaggagcttcatccgaaaaaaaacggcagtccagcgccgacggctctcagccacccaaaaagaagccaaagacaaccaacatagaactccagggtgtccctaatgatgaagtgcatccattactgggtgtgaaaggtgacggcaagagtaagaaaaagcaagccggtagacccaagggatccaagggaaaggagaaagactctcctttcaagcctaagttgtataagggagatcgcggactccccctggaaggctctgctaaaggtaaggtgcaagcagagctgtctcaacctctcactgccggtggggctatatctgagttgctttag

SEQ ID NO: 238466 - DNA, 1503 bp, Artificial Sequence
  Description of Artificial Sequence: Synthetic coding sequence
atgaatctcgagctcttggagtcattcggacagaactatccggaagaggccgacggaaccttggactgcatctccatggctttaacttgcacctttaaccgctggggcactctgctggccgttggctgtaacgatggcaggatcgtcatttgggattttctgactagagggattgctaaaatcatctcggcacatatccacccagtatgctccctgtgctggtcccgcgatggtcacaagctcgtgtctgccagcacggacaatattgtgtcccagtgggacgtgctgagtggagactgtgaccagcggttccgctttccgtcccctatccttaaagtgcaatatcaccctagagaccagaataaagttctcgtctgtccgatgaaatctgcgccagtcatgctaacattgtccgattctaagcacgtggtgcttcctgtcgacgatgactctgatctcaacgtagtggcatctttcgatagaagaggggaatacatttacaccgggaacgcaaagggcaaaatcctcgtactgaagacggattctcaagacctggttgcatcgtttcgggtgacgaccggtacatccaatacgaccgccattaagtctatcgaatttgctcgcaaagggagttgcttcctcatcaatactgccgaccgcatcattcgggtgtatgatggcagggagattctgacttgcggtcgcgatggcgagcctgagccaatgcagaagctacaggatttagtaaacagaactccctggaagaaatgttgtttttcaggggacggagaatacattgtggctggcagtgcacgccaacatgccctttatatctgggagaaatccattggcaatctggttaaaattctccacggaaccaggggggagttgctgctagacgtggcttggcacccagtcagaccaatcatagcttccatatcatcaggagtggtctcgatctgggcgcagaatcaggtggagaactggagcgcattcgcacctgattttaaagagttggacgagaacgtcgagtacgaggagcgcgagtctgaattcgacatcgaagatgaggacaaatctgagccggaacagaccggagcagatgctgctgaagatgaagaggttgacgttactagcgttgatccaattgccgctttctgctcttccgacgaggagctcgaagacagtaaagctctgctgtacctcccaatcgccccagaggtggaagaccccgaagaaaacccctacggcccacctcccgacgccgtccagacaagtttgatggatgagggagcgtcttcagagaaaaagaggcagagcagcgcggacgggtctcagcctcctaagaagaaacctaagacaactaacattgagctacaaggtgtccccaatgacgaggtgcatcctttgcttggggtcaagggagacggaaagtcaaaaaaaaagcaggcaggacgccctaagggcagtaaagcgggaggggctatttccgaattgctttag

SEQ ID NO: 238467 - DNA, 5378 bp, Artificial Sequence
  Description of Artificial Sequence: Synthetic coding sequence
atgagttgcgttcattacaagtttagctctaagcttaactatgacactgttaccttcgacggccttcacatttcattgtgcgatctcaagaaacagatcatgggcagggagaagctgaaggcagcagactgtgatttacagataaccaacgcgcaaacaaaggaagaatatacagatgacaatgcactgattccaaagaattcttcagtcattgtcagaaggattcctatcggaggcgtgaagtcaacctctaaaacatacgtcatctcaagaactgagccagccatggcaactactaaggctatcgacgattcaagcgcaagtattagcctggctcagctgacaaagactgccaacctcgctgaagcaaatgccagcgaggaggacaaaatcaaagcaatgatgagccaatctggccatgagtacgaccctattaattacatgaaaaaaccactgggaccaccgcctcctagttatacgtgctttcggtgtggcaaaccaggccattacatcaagaattgccctaccaacggcgacaaaaatttcgagagcggaccgaggatcaagaagagtaccggcatcccaagatcctttatgatggaagtgaaagaccctaatatgaagggcgcaatgcttaccaatacaggcaaatacgccattcccactattgacgctgaggcttatgctatcgggaagaaggagaagcctccatttctgcctgaggagccatcttcgtcctcggaagaggacgatcctattccggatgaactactgtgcctgatatgcaaggacattatgaccgacgctgtcgtaattccatgctgcggcaactcttattgcgatgagtgcatccgcaccgctctcctggagagcgacgaacatacctgccctacctgtcatcagaatgatgtgtctcccgatgccctgattgcaaataagtttttacgtcaggccgtcaacaacttcaagaatgagaccggctataccaagcgcctgcggaaacagctcccaccaccaccaccaccaatccctccccctaggcccctgatccagcgaaatcttcagcctttaatgcgttctcctatctccagacagcaagaccccctaatgatcccggtgacctcctcttctacccatccagccccatcaatctcttctctgacgtccaaccagtctagcctcgctccccctgtcagcggaaacccatcttcagctcccgctcctgtgccagatatcaccgcaacggtctctatctccgtgcatagtgaaaagtccgacggcccttttcgcgactctgacaataagattttacccgctgctgcgctggcttccgagcactcgaaagggacatcaagtatcgcgattacggcattgatggaggagaagggctatcaggtgccagtgctggggactccctccttgttggggcagtcactactacacggccagctcataccaacaactgggcctgtcagaattaatacggcaagacccggtggagggaggcctggctgggaacatagtaacaaactgggatatttggtatccccaccgcagcagattcgccgtggagagcgatcttgttaccgtagtatcaatagaggtcgccaccatagcgaacggagccaacgaacacaagggccttctttgcccgctaccccagtgtttgtgcctgtgccccctccaccactgtacccaccgcctcctcacacgctgccactccccccaggcgtgccacccccacagttcagtccacagtttcctcctggtcaaccccctccggcaggatatagcgtgccaccccctggcttcccacccgcaccagctaacctcagtacgccatgggtgtcttccggagtgcagactgcacactccaacaccataccgaccactcaggcccctccgctgtctagagaggaattctatcgggaacagagacgtctcaaggaagaggagaagaaaaagagtaagcttgacgaatttactaacgacttcgcaaaggagttgatggagtacaaaaaaatacagaaggagcggaggagatccttctcgagatccaagagcccctatagcgggtcatcatattctcggagctcatacacatacagcaagtcacgttccggttcaacacggtcccggtcgtacagtcggtccttcagcaggagccattcacggagttattcccgctcccccccttaccctcggagaggtcgaggtaaaagtagaaactatagatcgcgatcccgctcacacggctatcacagatcacgttctcggtccccaccgtatagaagatatcattctcgctcgagatccccccaggcgttccgagggcagtcacctaacaaaaggaatgtaccccagggtgagaccgaaagagagtatttcaaccgctaccgagaggttcctccaccttacgatatgaaagcttattacgggagatctgtggatttccgggacccttttgaaaaggagcgctacagagagtgggagcgcaaatatagggaatggtacgaaaaatactacaaaggctacgctgctggagctcagcccagacccagcgccaatagagagaattttagtcccgagcggtttttacccctgaacattcgcaattccccattcactcgcggacggagagaagactacgtcggcggacagtcgcaccgctcacgcaacatagggtctaattaccccgagaagctgtcggctagagatggtcacaaccagaaggataatactaaaagtaaggagaaagagtctgaaaacgctcctggagacggcaagggaaataagcacaagaagcatcggaaacgacgaaaaggggaagagtctgagggcttcctgaatccagagctccttgaaaccagcagaaaaagcagagagccaacaggcgtggaggaaaataagaccgatagtctgttcgttcttccatctcgggacgatgctactccagtgagagatgagcctatggatgcagagtcaataaccttcaagtccgtctcagaaaaagataagcgcgagcgagacaaacctaaggccaagggggataagacaaagcgcaaaaatgatggcagtgccgtgagcaagaaggagaatatagtgaagcctgccaaaggaccccaagaaaaagtggacggcgaacgagaacgtagtccacgcagtgaaccgcctattaaaaaagccaaagaagagacgcctaaaaccgacaatactaagagctccagtagtagccaaaaagatgaaaaaattactggaacacctcgaaaggcccattccaaaagcgctaaggaacatcaagagaccaaacctgtaaaggaggaaaaggtgaagaaggactacagcaaggacgttaagagcgagaagttaacaaccaaggaagagaaagccaagaaacctaacgagaaaaataaacccttggacaacaagggggagaaaaggaaaagaaagaccgaagagaagggcgttgataaggacttcgagagctcttcaatgaaaatatcaaaattggaagttaccgaaatagtgaagccaagtcccaagcgcaagatggagcccgatactgaaaagatggacagaacccctgaaaaggacaaaatttctttatctgcacccgctaagaaaatcaaactgaatagggagacgggtaaaaaaattggtagtactgaaaacatcagcaatacgaaagagccatcagaaaagctggagtccacctcaagcaaggtgaaacaggagaaggtaaaggggaaagtgcggaggaaagtgaccggaacggagggctcttcctctactctggtagactatacttccacctcctcaacaggaggatcaccggtccgaaaaagcgaggagaagacagataccaagcgcacggtgatcaaaactatggaggaatacaataatgacaacacggcccctgccgaggatgttataattatgattcaggtgccccagagcaaatgggacaaggatgactttgagtcagaggaagaggacgtgaagtcaactcaacccatttcctcagtgggcaaacctgcctctgtcatcaagaacgtgtctacgaaaccttccaacattgtgaaatacccagagaaggagtctgagcccagcgaaaagattcagaagttcacgaaggacgtgagccacgagatcattcagcacgaagtaaagtccagtaagaacagtgcgagctcagagaaaggaaagactaaagaccgtgattacagtgtgttggaaaaagagaaccccgagaaaaggaagaattccacacagccagagaaggaatccaacctggatagattgaatgagcagggcaacttcaagagcctgtcacagtcttctaaagaggcacgcacttccgacaaacacgacagcacacgggcatctagtaacaaggacttcacccccaacagagataagaagaccgattacgatacccgtgaatattcctcaagcaagcgccgtgacgaaaagaatgagctgacacgccgtaaagattcaccctcacggaacaaagactcagctagtggacaaaagaataaacctagggaggagagggaccttcccaaaaagggtactggtgattcgaaaaaaagcaattcatctcctagcagagacagaaagcctcatgatcataaagctacatacgacaccaagcgccctaacgaagaaaccaagagtgtggacaaaaacccttgtaaggaccgggagaagcacgttctcgaggcacggaacaataaggaaagctctggcaacaaactgctgtacatcctaaacccccctgagacccaggtggagaaggagcagattaccggccagatagataaatccacagtgaagcctaagccccaattaagtcattcctctcgcctgagctctgatcttacccgggaaactgacgaggcagcatttgagcctgactacaacgagtcagattctgagagcaacgtgagcgtgaaggaggaagagtctagcggaaacatcagcaaagacctgaaggacaaaatcgtggagaaagccaaggagagcttagacactgctgccgtcgtgcaagtcggcatcagcaggaatcaatcccattcgtcccccagcgtctctccttctcgctctcacagtccaagtggctcccagacccgaagccattctagtagcgcttcttccgccgaatctcaggacagcaaaaagaaaaagaaaaagaaggaaaagaaaaagcataaaaaacacaagaagcataagaaacacaagaaacacgcaggcacagaagtggaactagagaagtcccagaaacataagcacaaaaagaagaaatccaaaaaaaacaaggataaagagaaggaaaaggaaaaagacgaccaaaaagtaaaaagtgtcacggtgta

SEQ ID NO: 238468 - DNA, 5276 bp, Artificial Sequence
  Description of Artificial Sequence: Synthetic coding sequence
atgtcatgcgtgcattataagttctcaagcaaactaaactacgacaccgtgacgttcgatggcctgcacatcagtctctgcgatctaaagaagcagatcatgggccgagaaaagcttaaagcagctgactgtgatctccagattactaacgcccagaccaaagaggagtacaccgatgacaatgcccttatacccaagaacagttccgttatagtgagaagaatccctataggtggggtgaaaagcacttcgaaaacctatgttatatcccggacagagcctgcaatggccacgacaaaggccatcgatgactcctctgcaagcatcagcctggcccagttaacaaagacagccaacttggcagaagcgaacgcttctgaagaggataaaatcaaagccatgatgtctcaaagtggccacgagtatgatcctataaattacatgaaaaaacctctcggcccacctccaccctcctatacctgtttcagatgcggaaagcctggtcactacatcaagaactgtcctacaaacggcgacaaaaacttcgaatccggaccgcgaatcaagaagtctactgggatcccacgtagtttcatgatggaagtgaaagacccaaacatgaaaggcgctatgctcacaaacactggcaagtacgcaattccgacgattgatgctgaggcatacgccatcgggaagaaggaaaaaccgccattcctgcctgaagaaccatcctcctcaagcgaggaggatgatccaattccagatgagctgctgtgcctaatctgtaaggacatcatgactgacgccgtggttatcccttgttgcggaaatagctactgtgacgaatgcatcagaacagccttactggagtccgacgaacacacctgccccacttgccaccagaacgatgtctcacccgatgccttgatcgctaacaagttcctccgtcaggctgtgaataatttcaagaacgagactggctacaccaagcgactccgcaagcaactgccgcctcctccccctccgatcccaccccctcggccattgattcagcggaacttacagcctttaatgagatcccccatttcccgccagcaggaccccctgatgattccagtcacaagctcctccacgcatcccgctccctctattagctctttgacatccaatcagagcagcctggcgccacccgtgagcggaaaccctagtagtgccccagcccctgttcccgatataaccgctaccgtcagcatcagcgttcactccgaaaaaagtgacgggccttttagggacagcgacaataaaatcctgccagccgcagcacttgcctcagagcacagcaaggggacctcctcaatcgctattacagctttaatggaagagaagggctatcaggtgcctgtgttgggcacacccagcctcctgggccagtctttactgcacgggcagttgatcccgactaccgggccagtgcggatcaataccgctcggcctgggggtggccgtcccggatgggagcattccaataaactcggatatctggtctctccacctcagcagattagaagaggcgaaagaagctgttacagaagtattaatcggggtaggcatcactctgagcgcagtcaacgcacacaggggccatctttgccagccacccccgtcttcgtcccggtcccgccaccccctctgtacccccctccaccccacacactgccactgccacctggtgttccaccacctcaattctctccccagttcccacctggacaaccgcctccggctggctacagtgtaccgccaccaggattcccacctgctcctgccaacctatctacaccttgggtgagttccggcgtccagactgctcactccaataccatccctacaactcaagcccctccactctcacgggaagagttttaccgggagcagagaagactgaaggaagagagtaaaagcccatactccggaagcagctattcacgtagttcctacacctattctaagtcaagaagtggctcaaccagaagccgatcatacagcaggagtttcagccgctcgcacagtaggagctattcgcggtcccccccttacccgagaagaggcaggggcaagagcagaaattataggagtcgcagtcgtagtcacggctaccaccgatctcggagcaggagccccccatatcggaggtaccactcaagatctaggtccccccaagccttcaggggtcagtcaccaaacaaacggaacgttccccagggcgaaacagaaagagagtactttaatagataccgagaggtgccacccccatatgacatgaaagcttactacggacgtagcgtcgatttcagggaccctttcgagaaggagcggtatagagagtgggagagaaagtaccgggagtggtatgagaagtattataaggggtacgcagccggtgctcagccacgaccttctgctaacagggagaatttcagccctgaaaggttcctgcctctgaacattcgcaactctccttttacgcggggacggagagaggattatgtcggtgggcagagccataggtctagaaatatcggatcaaattacccggagaagctgagtgccagggacggtcataaccagaaggacaacactaagtctaaggagaaggagagcgagaatgctccaggagacggaaagggcaacaaacacaagaaacacagaaaaaggaggaagggcgaggagtcagagggttttctgaaccccgagctgctggaaacctctaggaaaagcagggaaccaaccggtgtcgaggaaaacaagacagactctctttttgtcctgccatccagagatgacgccactcccgtgagggatgagcctatggatgccgagagtattacttttaagagcgtgtctgaaaaagataaacgggagcgggataaaccaaaggctaagggcgataaaactaaacgaaaaaatgacgggagcgcagtgagtaaaaaggaaaacatagtgaaacccgctaaaggtccccaggagaaggtggatggggagcgcgagagatcccctcgtagcgaacctccaataaagaaagctaaagaggaaacccctaaaaccgataatacgaagagtagctccagttctcagaaggatgagaaaattaccggcactccccgaaaagcacactctaagtccgcaaaggaacaccaggaaacgaaaccagtgaaagaggaaaaggtgaagaaggactatagcaaggatgtcaaatctgagaagttgacaactaaggaagagaaggccaagaaaccaaacgagaagaataaacctctggataacaagggtgagaaacgcaaaaggaagaccgaagagaagggggtggataaagacttcgagagctcctctatgaaaatctccaaactggaggtcaccgaaattgtaaagccaagcccaaaaaggaaaatggaaccagatactgagaaaatggacagaactcccgagaaagacaagatatcactgtccgctcctgcgaaaaaaattaaactgaaccgggaaaccggtaaaaagatcggctcgaccgaaaacattagtaatactaaagaaccatccgaaaagttagagtcgacctcctctaaagtgaaacaggagaaggtaaaaggaaaagtgaggaggaaggtgacaggtacagaaggcagttctagcaccctcgtggattatacgagcacttcatcaactgggggtagcccggtgaggaagtcggaagaaaagaccgatacaaagcggactgtgatcaaaaccatggaggaatataataacgataatacagcccctgctgaggacgtcatcatcatgatccaagttccgcaaagtaaatgggacaaggatgactttgaatccgaggaggaggacgttaagtctacacagccaatctcctcagttggaaagcctgccagcgttataaaaaacgtgagcactaagccgtccaacattgtcaaatacccagagaaggaatctgagcctagcgagaaaattcagaaattcacgaaagacgtatctcatgaaattatccagcacgaagtgaagtccagcaaaaattcggcatcctccgaaaaaggcaagacgaaagatcgcgattacagtgtattggaaaaagagaatcccgagaagcgcaagaattccacccaaccagaaaaagagagcaatcttgaccgcctaaacgaacagggcaatttcaagtcactgtcccaatcatcaaaggaagccaggacaagcgacaaacacgacagcacgcgagccagttccaataaggatttcactcccaatcgcgataagaagacagactatgatactcgtgaatactcatctagtaagcggagggacgaaaagaacgaacttacccgccgaaaggactcacctagccgaaataaggactccgccagtggacagaagaataagccccgagaagagcgagacttgcccaagaaaggaacaggtgattccaagaaatcaaatagttcaccatctcgtgataggaagccccacgaccacaaagctacgtatgatacaaaacgtcctaacgaggagacaaagagtgtggacaagaacccttgtaaagacagggagaagcatgtgttggaggctcggaacaacaaagaatccagcggaaacaagctcttatacatactgaatccccctgaaactcaggtggaaaaggaacagatcacaggtcagattgacaaaagtactgtcaaacccaagcctcagctgtcacattcgagtcggctgagctccgatctgacaagagagacagatgaggccgctttcgagcccgactataatgagtccgattccgagagtaatgtgagtgtgaaagaggaggaatcgagcggaaatatatcgaaggatcttaaagacaagattgttgaaaaggccaaggaaagcctcgataccgccgctgtcgtgcaagtcggcatatcccggaatcagtcccactcatccccatcggtgtcgccatcgagatcccacagccctagtgggtcgcagactcggtcacacagcagctctgccagctccgccgaaagccaggacagtaaaaaaaagaagaaaaaaaaagagaagaaaaagcacaaaaagcacaaaaaacataaaaagcataaaaagcatgccggtactgaggttgaattagagaaatcccagaagcataagcataagaagaagaagtccaaaaagaacaaggacaaggagaaggagaaagaaaaggacgatcagaaggtcaaatccgtgaccgtcta

SEQ ID NO: 238469 - DNA, 2859 bp, Artificial Sequence
  Description of Artificial Sequence: Synthetic coding sequence
atgtcctgtgtacattacaagttttcatcaaaactcaattatgacacagtgacatttgatgggcttcacatcagtttgtgtgacttaaagaaacaaatcatggggcgagaaaaacttaaggccgctgactgcgatttacaaatcaccaacgctcagactaaggaggaatatactgatgataatgctctaatccccaagaactccagcgtaattgtgaggaggatcccaataggaggagtgaagtccacaagcaaaacgtacgtcatttcaagaaccgaaccagctatggcaaccactaaagcgatagatgacagctcggcttcaattagcctggctcagctgaccaaaactgccaacctggctgaagcaaatgccagcgaggaagacaagataaaggcaatgatgtcccagagcggccacgaatatgatccaattaactacatgaaaaaaccactggggcctccacccccaagctacacctgctttcggtgtggtaagcctgggcattacattaagaactgcccgactaacggagacaaaaacttcgagagcggtcctaggatcaaaaagagcactggtatcccgagatcttttatgatggaggtgaaggaccccaacatgaaaggcgctatgctgactaacacaggtaagtatgccataccaactatcgatgccgaagcttacgccatcggcaagaaagaaaagcccccattcctgcctgaggagccgagcagctcgtctgaggaagatgatcctataccagacgagctgctctgcctcatatgcaaagacatcatgacagatgcagtcgtgattccgtgctgcggtaactcttactgcgatgagtgtattagaacagccctgctcgaatctgacgaacatacctgtcctacttgtcaccaaaacgacgtatctcctgacgctctgatagctaataagttcctcagacaagcggtgaacaactttaagaacgaaaccggatacacaaagcgcctgaggaagcaactgcctcctcctcctccccctattccccctccaagacccctaattcagcggaatctccaaccactgatgaggtctcccatcagccggcagcaagatccacttatgataccagtcacatctagcagcactcacccagcgccaagcattagcagtctcacttcaaaccagtcaagcctggctcccccagtttcgggcaatcccagcagcgccccagccccagtgcctgacatcactgcaactgtgagcatatcagttcattctgagaagtctgacggaccgttcaggacctcatccactggtggatccccagtccgtaaaagcgaggaaaagacagatactaagaggaccgtgatcaagacaatggaggaatacaacaacgacaacaccgcacctgccgaggacgtgatcattatgattcaggttccgcagagcaaatgggacaaggacgattttgaaagtgaggaagaagatgtaaaatccacccaacccatctcctccgtgggcaagccagctagtgtgattaagaacgtttccactaagcccagcaatatcgtgaagtatcccgagaaggagtctgaaccatctgagaagatccagaaattcactaaggacgtgagtcatgaaattatccagcacgaggtgaaatcctcgaagaactctgcctcctctgagaaggggaagactaaagatagggactatagtgtgctggaaaaggagaacccggagaaacggaagaatagcacacagcctgaaaaagaatccaatctggacagattaaacgaacaaggcaatttcaaatccttgtcccagagcagcaaagaggcgagaacctcggataagcacgattccactcgggctagcagtaacaaagactttacacccaatcgtgacaagaagacagactatgacacgcgggaatactccagttccaagaggcgcgatgagaaaaacgaactgaccaggcgcaaagacagccccagccggaataaagacagcgcttccgggcagaaaaataaacctcgtgaagaacgggacctgcccaaaaaaggaacaggagacagcaaaaaatctaattctagcccatcaagggaccgcaagccccatgaccacaaggctacctatgataccaaacggcctaatgaggagactaagtctgtcgacaagaatccatgcaaagatcgagagaagcacgttttagaagcacgcaacaacaaagaaagcagcggaaataaattattgtacatcctgaatcctccagaaacacaggtcgaaaaagaacagataaccggacaaatcgataagtcaacagtgaagccaaaaccccagctgtcccatagctctagactgtcaagcgatttgacaagagagaccgacgaagccgctttcgaacctgactacaacgagtcggattccgagtcgaacgtgagcgtcaaagaagaggagtcatctggcaatatctcaaaggaccttaaagacaaaattgtggaaaaggctaaagagagcctcgataccgcagccgtggtgcaggtggggatatctcggaaccagagccatagctcaccgtcagtgtcccccagcaggagccattctccttcaggtagccagaccagatctcattcttcttcagctagctccgccgaatcccaggatagcaagaagaaaaagaagaaaaaagagaaaaagaagcacaagaaacataagaaacacaaaaagcataagaaacatgccggaactgaagttgagcttgagaagagtcagaagcacaagcataagaaaaagaagtccaaaaagaataaggacaaggagaaggagaaagagaaagatgatcagaaagttaaaagcgttaccgtttag

SEQ ID NO: 238470 - DNA, 357 bp, Artificial Sequence
  Description of Artificial Sequence: Synthetic coding sequence
atgagttgtgtccactacaaattttcttccaaactgaattacgatacagtgacgttcgacggtctccatatttctctgtgtgatctaaagaaacagattatgggtagagaaaaactaaaagctgctgactgtgatctccagattacgaacgcacagacgaaagaagagtatactgacgataatgcactaatcccaaagaactcatcagtgatcgtcagaaggatccccatcggtggggtgaagagtacctcaaagacatatgtgatatctaggactgagccagccatggcgacgacaaaagcggtgtgcaagaatacaatcagccattttttttacacactccttcttccgctgtag

SEQ ID NO: 238471 - DNA, 1410 bp, Artificial Sequence
  Description of Artificial Sequence: Synthetic coding sequence
atggccgcagaggccggagtcgttggcgcaggcgcatcccccgacggagactggcgcgaccaggcgtgcgggctgttgctgcacgtgcacctctcaagccggctcgggcgagcagccccagtgcggacggggaggcaccttagaacagtgttcgaggatacagtagaagagcgcgttattaacgaagagtacaagatttggaagaagaataccccctttctctacgacctggtgatgacgcatgcccttcagtggcccagtctcactgtgcagtggcttcccgaagtgaccaaacccgaaggaaaggactatgcactgcactggctagtactgggcacacatacatcagacgaacaaaatcatttggtagttgctagggtgcacattccaaacgacgatgcacagttcgatgcttcacactgcgactctgataagggtgagtttggtgggttcggctccgtgaccgggaaaatagagtgtgagatcaagatcaatcatgagggcgaggtgaaccgggcacgctacatgccccagaaccctcacatcattgcaactaaaacgcccagtagcgacgtgctggtcttcgactatacgaaacatcctgcgaagccggatcctagcggggagtgtaaccccgacttacgcctgaggggccatcaaaaggaggggtacggcctgagctggaacagtaatctttcagggcacctactaagtgcctcagatgaccatactgtttgtctctgggatataaacgctggacctaaggagggcaagatcgtggatgccaaggcaatattcactggacattccgccgttgttgaggatgttgcctggcacctgttgcatgagtcacttttcggtagcgtcgccgacgaccagaaactaatgatctgggacaccaggagcaacaccaccagcaaaccttcacatctcgttgacgcccacaccgccgaggtaaactgtcttagttttaatccatatagcgaatttatcctggcaaccggctcagctgacaagaccgtcgctctgtgggacctgaggaatctgaagcttaagctgcacacattcgagagccacaaggatgagatcttccaggtccattggtctccacacaacgaaaccatcctggcttcaagtggaacagaccggaggctgaatgtgtgggatctgtccaaaatcggggaagaacagagcgccgaggatgcagaggacggcccacccgagctcttgtttatccatggaggtcacacagcgaagattagcgatttcagctggaaccctaatgagccttgggtgatatgctccgttagtgaagataatataatgcagatctggcaaatggcagaaaatatatacaatgacgaagagagcgacgttacaacatcagagctggaaggccagggtagttag

SEQ ID NO: 238472 - DNA, 1278 bp, Artificial Sequence
  Description of Artificial Sequence: Synthetic coding sequence
atggcgtccaaagaaatgtttgaagacactgtcgaggaacgcgtgataaatgaagagtataagatctggaagaagaacactccttttttatatgatctggtgatgacgcatgcactgcaatggccaagcctgactgtgcagtggctacctgaggtgactaagccagagggcaaagactatgctctgcactggctggtgctggggacacacacaagtgatgagcaaaaccatctagtcgttgctcgggtgcacataccaaacgacgacgcacagttcgacgcatcccactgcgactcggacaagggagagttcggcggattcggaagtgttaccggcaaaatcgagtgtgaaatcaagattaaccatgaaggcgaggtcaaccgggcacgctacatgccccagaatccacacatcatagcaactaagacaccttcctcagacgtgctcgtgtttgactacaccaaacatcctgcgaagcctgatccgagcggggagtgtaaccccgatcttcggcttagagggcaccagaaagagggttacggcctgtcatggaacagtaacttgtccgggcacctcctatctgcctcagacgatcataccgtttgtctttgggacataaacgcgggtcccaaggagggcaagatagtcgatgctaaagccatttttactggtcactcagcagtggtcgaggacgtggcctggcatctgcttcacgaatcactattcggcagtgtggctgacgatcagaagctgatgatctgggataccaggtccaatacaacttccaagccctcacatctcgtggatgcgcacactgctgaagtgaattgcttgtcttttaacccttacagtgaattcatcctggcaaccgggtcagccgacaaaactgtggccttgtgggaccttcggaatcttaaactgaagctgcatactttcgagtctcataaagatgaaatctttcaggtccactggagtccccacaacgagaccatactggcctcctcaggcacagataggcggttaaacgtgtgggacctgagcaagattggagaggaacagtccgccgaggacgccgaggatgggccacccgaacttctctttattcatggtgggcacactgctaaaattagtgacttctcctggaatccgaacgagccatgggtgatctgctctgtgtccgaggataatatcatgcagatctggcaaatggcggaaaatatctacaacgatgaggagtccgacgtcacaactagcgagttagaggggcaaggaagctag

SEQ ID NO: 238473 - DNA, 1251 bp, Artificial Sequence
  Description of Artificial Sequence: Synthetic coding sequence
atggccagcaaagagatgtttgaggatactgtggaggagagggtgatcaacgaggaatacaaaatctggaaaaaaaacacgccctttctgtatgacctggtaatgacccacgcactgcagtggccctcactgacggtccagtggctgcccgaggtgaccaagcctgagggcaaagattatgctctccactggctggtcctgggaacacataccagcgacgaacaaaaccacctggtcgtggccagggtgcacataccaaatgacgacgcgcagttcgatgcctcccattgtgatagtgataagggtggcaaaatcgagtgtgagattaagatcaaccacgaaggagaggtgaacagggccagatacatgccccagaacccacatattattgcaacgaagaccccaagttctgatgtcctagtttttgattacaccaagcaccctgcgaaaccggatccctccggcgagtgcaacccagacctgcgtttgcgagggcatcagaaggagggctacggcctatcttggaactcaaacctgtccggccacctgctgtcagcctcagatgatcacacggtttgcctgtgggatatcaatgctggaccaaaagaggggaagatcgtagacgctaaggctatctttacaggccactctgccgtggtggaagacgtggcatggcacctcctccatgagtccctatttggctcggtggccgacgaccagaaactaatgatctgggacactagaagcaacacaacctccaagccatcccatcttgttgacgcccacaccgcggaagtcaactgcctctcgtttaatccctacagcgaatttatactagccactggctcagccgataagacagttgccctgtgggacctgagaaaccttaaactgaagctgcatacctttgagagccacaaagacgagatattccaggtccattggtctccccacaatgaaacaattctagccagttccgggacggacaggcgcctgaacgtttgggacctgtctaaaataggcgaggagcaatctgctgaagatgctgaagacggcccaccggagctgctcttcatccatggcggtcatacagccaaaatcagtgactttagctggaatccaaatgagccttgggtaatctgcagtgtgagtgaggataatattatgcagatttggcaaatggccgagaatatttacaatgatgaagaaagtgatgtcacaaccagcgagctggagggccaggggtcttag

SEQ ID NO: 238474 - DNA, 561 bp, Artificial Sequence
  Description of Artificial Sequence: Synthetic coding sequence
atggcgtctccaagtaaggcggtgatcgtgcccggtaacggtgggggtgacgtcactacccacggttggtacgggtgggtcaagaaagaactcgaaaagatccccggttttcagtgcttggccaagaacatgcctgaccctatcaccgccagagagtctatttggctgccctttatggagacagaactgcattgtgacgagaagacgattattatcggccacagcagtggtgccattgcagctatgagatacgctgaaactcacagagtctatgctatcgtgttagtgtccgcctatacatctgacctaggagacgaaaacgagcgagcttccgggtatttcacgcggccatggcagtgggaaaaaatcaaagccaattgcccctatatcgttcaattcggcagtacagatgatccttttctgccatggaaagagcagcaggaagtcgccgaccggctggaaaccaagctgcacaagttcacagactgcggtcatttccagaacaccgagtttcacgagcttatcacagtggttaaaagtttactgaaagtaccagcatag

SEQ ID NO: 238475 - DNA, 519 bp, Artificial Sequence
  Description of Artificial Sequence: Synthetic coding sequence
atggcctctccttcaaaggcagtgattgtgcccggaaatggcggtggagacgtgacaacccatggatggtacggctgggtgaaaaaagagctggaaaaaatacctggtttccagtgcctcgcaaagaacatgcctgatcccatcacagcccgagagtccatttggctgccatttatggaaacagaactccactgtgacgaaaagacaataattattggccacagcagcggcgctattgccgctatgcgatacgctgaaacccatcgggtgtatgccattgtgttggtaagtgcctacacttctgatctcggcgatgagaatgaacgcgcttcaggctattttacccgaccctggcaatgggaaaaaataaaggccaactgcccatacattgtgcaattcggaagcacagatgaccccttcctgccatggaaggagcaacaggaggtggctgattggaagccaaactgcactaactctctgacagtggccacctttagaacgcagagctttatgaattag

SEQ ID NO: 238476 - DNA, 741 bp, Artificial Sequence
  Description of Artificial Sequence: Synthetic coding sequence
atggctgccgcagccattcccgcactacttttgtgtcttccgctgttgtttctgctatttggttggtctcgcgctcggagggacgacccacattcactgtgttacgatattaccgtaataccgaagttccgccctggccctagatggtgcgcagtgcaggggcaggttgacgaaaagacatttctacactacgactgtggaaacaaaactgtcacacctgtgagcccactcgggaagaaacttaatgtgacaatggcgtggaaagcgcagaatcctgttttaagagaggtggtcgacatactgactgagcagctgctcgacattcaactggagaactatacaccaaaggaaccgctcactctccaggctaggatgtcttgcgaacagaaagccgaggggcatagctccggctcctggcagttttccatcgatggtcagacatttctgctgttcgatagcgagaagcgcatgtggaccacagttcaccctggagccagaaagatgaaagagaaatgggagaatgataaagatgttgccatgtccttccactatatatctatgggggactgtatcggttggttagaagactttcttatgggtatggattcaactctggagcccagcgcaggagctccacttgccatgtctagcggtaccacccagctgagggctacagccacaaccctgatcttgtgctgcctgctgatcattctcccctgctttattctgcccggaatctag

SEQ ID NO: 238477 - DNA, 741 bp, Artificial Sequence
  Description of Artificial Sequence: Synthetic coding sequence
atggccgctgcagccatccccgctctgcttctgtgtttgccattactatttcttctgtttggatggtctcgcgctaggagagatgatcctcactccctctgctacgacatcactgtgatccccaaattcaggccaggaccacggtggtgtgcggttcagggacaggtggacgagaaaacattccttcattatgactgcggaaacaaaactgtgacaccagtgtctccactaggaaagaaactgaatgtaacgatggcctggaaggcacagaaccccgtattgcgagaggttgtggatatcctaaccgagcagctattggatatccagctcgagaattatacacccaaggagccacttacactgcaagccagaatgtcgtgcgagcagaaagccgaaggccattcaagtggaagttggcagttttccatcgacgggcagacctttctcctttttgacagcgagaaacgaatgtggaccacagtgcacccaggcgctcgcaagatgaaagagaagtgggagaacgataaggacgtggcaatgtcattccactacatttccatgggggactgcataggctggctagaggatttcctgatgggcatggactctacgctagaaccaagcgctggtgccccacttgccatgtcttccggaactactcagctgagagccaccgccaccacactgattctttgttgcctgcttatcatcctgccgtgcttcattctcccaggcatttag

SEQ ID NO: 238478 - DNA, 4923 bp, Artificial Sequence
  Description of Artificial Sequence: Synthetic coding sequence
atgcagagctttagagagaggtgcggattccacggaaaacagcagaattaccagcagactagccaagaaacgtccaggctggagaactacaggcagccctcgcaagccggtctttcgtgcgaccggcagcggctactggcaaaggattattacaaccctcagccctaccctagctacgagggcggagccggaactccatctggcaccgccgctgccgtggccgcagacaaatatcacagggggtctaaggctcttcccacccaacaagggctgcaaggtcgccctgcttttcccggttacggggtccaggatagctctccctatccaggacgctacgcaggagaagagtcactgcaggcttggggagccccacagcccccacccccacagccacaacccctgcccgcaggagtggcgaaatatgacgagaatctcatgaaaaaaactgcggttcctccatccaggcagtacgcagaacagggagctcaagtgccctttaggacacactctctacatgttcagcaaccacctccaccacagcagcctttggcatatcccaaactgcaacggcaaaagctgcagaacgatatcgcatcccccctgccttttccacaggggacccatttcccccaacattctcagtctttccccacctcttcgacatattcatctagtgttcagggcggaggtcagggggctcatagctacaaatcttgcacggcccctaccgcccaaccccatgatcggccattgacagcgtcatctagtctcgcgccaggacagcgcgtccagaacctccatgcttaccagagcggtcgactctcgtacgaccagcaacagcagcagcaacagcagcagcaacagcagcagcaggctttgcagagcaggcatcatgcccaagaaacactccactaccagaatctggccaagtaccagcactacgggcagcaggggcaaggctattgtcagcccgacgctgccgtcaggacacctgagcagtattaccagacattctccccctcctcctcacacagcccagcacggagcgtgggaagatcaccaagctatagctcaacccccagccctcttatgccaaatctggagaattttccatattcgcagcagcccctatccactggagctttccccgcaggtattaccgatcacagtcatttcatgcccctgttgaatcccagccccactgatgctaccagttccgtcgacacacaagccggaaattgcaaacccctgcagaaagataagttgccagaaaatctccttagtgacctctctctacaaagcctgaccgccctgacgagccaggtggagaatattagtaatactgtgcagcagctgcttctgagcaaggccgcagtgcctcagaagaagggtgtcaagaacctagtctcacgcacacccgaacaacataaaagccagcactgcagccccgaaggaagcggctattctgcagaaccggctggaaccccactgtctgagccgccatcttccactccccagagcactcacgcagaacctcaggaagccgactatttaagcggctctgaagaccctctggagaggtcctttctctactgcaaccaagccagaggaagtcctgctagggtgaacagtaattcaaaggccaagccggaaagtgtatcaacatgtagcgtgactagcccagacgacatgtctaccaagtccgatgacagtttccagtctttacatggctctcttcccttggactcatttagtaagtttgtggcaggcgaacgggactgtccacgtttactcctgagcgccctagcccaagaggatctcgcttcggagattttagggctgcaggaagcaatcggagagaaggcagataaggcctgggccgaggctccatcactggtaaaagatagttcaaaaccaccttttagtctggaaaaccacagcgcttgtcttgattcggtcgctaagtccgcctggcctaggccaggggagcctgaggctctgcccgacagcctccagctggataaaggcggtaatgccaaagacttctcgcctggcctgtttgaggatccttccgtggcttttgcgacgcctgatccgaaaaagaccaccggtccactgtccttcgggacaaaacctaccctgggtgttcccgctccagatcctaccaccgccgcattcgattgtttccctgatacaacggctgcttccagtgcagactctgccaaccctttcgcttggccagaagagaacctgggagatgcgtgccctaggtggggattacaccccggagaacttaccaaggggctcgaacaaggcggtaaggcatcagatggtatatctaaaggagacacgcatgaggcatctgcctgcctgggattccaggaggaggatcctccaggggaaaaagtcgcttctcttcctggagacttcaagcaagaggaagtggggggtgtcaaagaggaagcaggcggtctgctgcaatgccccgaggtggccaaagccgacaggtggctggaggattctaggcattgctgctctacagccgacttcggggacctcccattactcccacctacaagccgtaaagaagacttagaagccgaggaggagtattcatccctgtgtgaactcctggggtctcctgaacaacgccctgggatgcaggaccctctgtcccccaaagcccctcttatctgtacaaaggaagaagtcgaggaggtgttggattctaaggcgggatggggatcaccctgccacctgagcggcgagtcagtaatactcctgggaccaaccgtcggaaccgagtcgaaggtccaatcttggttcgaatccagcctgagccacatgaagcccggagaagaagggccagatggagaacgcgctcccggagattccaccacaagcgacgctagcctcgctcaaaaacctaacaaaccagccgtgccggaagcgcctatagccaagaaagagccagtgccaagggggaaatccctgaggtccaggcgagtgcacaggggcctgccagaggctgaagatagcccttgcagggcgccagttctcccaaaagacctactgcttccggagagttgtaccggccctccacagggacaaatggagggagctggcgcacctggaaggggggcttccgagggacttccgagaatgtgtaccaggtctctgacagctctttctgaacctcgaacccccggaccacccggactgactactacacccgctccacctgacaaactggggggaaagcagagagccgctttcaaaagcggcaagcgtgtggggaaaccctcgccgaaggcggcaagcagccctagcaaccctgcagcgttacctgtggcgtcagattcctcccccatgggatcgaaaacaaaggagactgactcaccatctacccctggaaaagaccaacgctctatgattctgcgctccagaactaagactcaggagattttccacagcaagaggagaaggcccagcgaaggccgactgcccaactgcagggctacaaagaaactgctcgacaactcacatttgcccgctaccttcaaagtctcctctagcccacagaaagaagggagggtgagtcagcgggctcgcgtacctaagcccggagcgggatctaaactgagtgatcggcctctgcatgctcttaagcgcaagagtgcctttatggcacccgtccccactaagaaacgaaacctggtattaaggtcgaggagctcgagctcaagcaacgcgtccggaaatggcggagacggaaaagaggaacggcctgagggcagcccaacactgttcaaacgaatgtcctcacctaagaaggccaaacccacaaagggtaatggggaacccgcaaccaagctgccccctcctgagacccccgacgcctgcctgaaactcgcgagccgagcagcatttcagggagcaatgaagacaaaggtgctacctcctcggaagggacgtggattaaaactcgaagccatagtgcagaaaattaccagcccgtccctgaaaaaatttgcttgcaaggcacccggtgccagcccaggcaatcctcttagtcctagcctttctgataaggataggggcctaaaaggagccggaggatcccctgtcggagtggaagaggggctcgttaacgtgggtaccggacagaaactcccgaccagcggagcagaccccctgtgtcggaatccgacaaatcgcagccttaaaggaaagctgatgaactctaagaaattaagttccaccgattgctttaaaaccgaagccttcacaagcccagaagcgctccagcccggtggcacggcgctggctcctaagaagaggagtcgcaaagggagggctggagcccacggcctgagcaagggtccgctcgaaaaacggccatacctgggacctgccctgttgctgacccccagagacagggccagcggaacacagggagcctctgaagacaacagcgggggtgggggtaagaagcccaaaatggaggagctgggccttgcctcccaacccccagaagggagaccctgccagccacagaccagggcacaaaaacagcccggtcacacaaactatagttcatactcaaaaagaaagcgactcacacgaggaagggccaagaatactaccagcagtccttgcaagggcagagcaaagagacgccgtcaacagcaggtactacctcttgacccagctgaaccagagatccgtctgaaatatataagttcgtgcaaaaggttgaggagcgacagccgtactcccgcatttagcccttttgaacccagtctcggcgcacagaatcctagaagtggccagaacgcgcctcccgcaccagccgacgccagacccctctgtactacccgggataggagggcctattcagcgcgagagcagggacagcgttag

SEQ ID NO: 238479 - DNA, 5588 bp, Artificial Sequence
  Description of Artificial Sequence: Synthetic coding sequence
atgcaatcttttcgcgaaagatgcgggtttcatggaaaacagcagaattaccagcagacatcacaagagactagccgacttgagaactaccgacagccgagtcaggctgggctgagttgtgacagacagcgattacttgctaaagactactacaacccacaaccttacccgtcctatgaaggaggggctggcaccccctccgggacagccgcagcagtggctgctgataaatatcatagagggagcaaagcgctcccaactcaacaaggcctgcagggcagaccagcttttcccggttacggtgtgcaggactcgtcaccgtatccagggagatatgctggcgaggaatctctgcaagcttggggggcaccacagcccccaccccctcaaccgcagcccttgccagctggtgtggcaaagtatgacgaaaatctcatgaagaaaaccgcagtgccgcctagccgccagtacgctgagcagggagcacaagtcccattccgcacacattccttacacgtgcaacagcctcctccccctcagcagcctctcgcttacccaaaactacagagacagaaactgcaaaatgatattgcctccccattgccgttccctcaaggatggtgggccggacacagctacaaatcctgcactgccccaacggctcaaccacacgacagacccctgactgccagcagctccttggcacccggacagagagtgcagaatctccacgcatatcaaagcggaagattgtcttacgatcaacagcaacagcagcaacagcagcaacagcagcaacaacaggcgctgcaaagtcggcaccacgcccaggagacactgcactatcaaaaccttgccaagtaccagcactatggccagcaaggccagggatattgtcagcctgacgcagctgtgcgtacaccggaacagtactaccagacatttagccctagcagtagccactcacctgccagatcagtcggacgttccccttcttactcatccaccccatcccctctgatgccaaacctcgagaatttcccctacagtcaacagccattgtcaactggagcttttcctgctggtatcacagaccattcgcattttatgcccctactcaacccgtctcccactgatgccacgtctagcgtggatagcctgacagccttgacctcccaggtggaaaacatatctaatacagtacagcagctgctgctctctaaggctgccgtgccccaaaaaaagggcgtgaagaacctcgtttccagaacccccgaacagcacaaatctcagcactgctccccggagggctcaggttactctgccgagcctgcaggaacaccgctgtctgaacccccttcaagcacccctcaatcaacacacgccgagccccaggaagcagattacctcagtggctcagaggatccactggagcggtctttcctgtattgcaatcaagcacgcggatctcctgcacgggtcaattctaactctaaagccaaacccgaaagcgtgagcacctgttctgtgacatccccggacgacatgagcactaagagtgacgacagcttccagtctctccatggctctctgcctctcgactcattctctaagtttgtggccggagaacgcgattgtcctagactgctcctctccgcattagcccaagaggacttggcaagcgagatccttggactgcaggaggcgattggagagaaagctgacaaggcctgggcagaggccccttccctcgtcaaagattcctcaaagccacccttctctctggagaaccattcggcctgcctggacagtgtagcgaaaagtgcatggcccaggccaggagagccagaggccctcccggattcgctgcagctagacaaaggcggtaatgctaaggacttctctcccggtttgttcgaggacccatcagtcgccttcgccacccccgaccctaagaagaccactggcccattaagcttcggaacaaagccaactctgggtgttccagctcctgatccaacaacagcagcttttgattgcttcccagataccactgcggctagttccgccgattctgctaatcccttcgcgtggccagaggaaaatttgggcgatgcctgcccgaggtgggggctgcaccccggtgagctgactaaggggctggaacaggggggtaaagctagtgatggtatttctaagggggatactcacgaagcctcagcatgccttggcttccaggaagaggatcctccaggggagaaagtagcttccttaccaggcgactttaagcaagaggaggttggtggagtcaaggaggaagctggcggtctcctgcaatgtcccgaggtcgccaaagccgacaggtggctggaggattcaagacactgttgtagtactgctgacttcggcgatctgcccctgttgccacctacctctcggaaggaagatctcgaggccgaagaggagtactcctcactctgtgagctgctgggctctcctgaacagcgtccgggaatgcaggacccactctcccccaaggccccactgatctgtaccaaggaagaggttgaggaggttcttgatagcaaggccggatggggatctccttgccacttgtctggggagtctgttatcttactgggacccactgtaggcacagaaagcaaagtgcagtcatggttcgagagctcacttagccatatgaagcccggagaggaggggccagacggtgaacgggctcccggagactccacaacatcggatgcaagtctcgctcagaaaccaaacaagccggctgtgcctgaagctccaatcgctaaaaaagagccagtcccacgcggtaaaagcttgaggtctcggagggttcatcgagggctgccagaggccgaggatagtccgtgtagagcgccagtcctccctaaggacctgctcctcccggaaagctgcacaggtcctccacaagggcagatggaaggcgctggagcacctgggcgaggcgcttctgaagggctaccacgaatgtgcactcggtccttaactgcactctccgagccccgaacgcccggtcccccagggcttacaacgactcctgctccacctgacaagttaggaggaaagcagcgagccgcattcaagagtgggaagagggtgggaaagccctcccctaaggccgcttcctcacccagtaaccccgcagctctcccggtggccagcgattcatcccccatggggtcaaagactaaggaaacagacagtccctctacaccaggtaaggatcagcgctcaatgatcctgagatcacgaacaaaaacacaggaaatattccactctaagcgcaggcgcccaagcgaaggacggctgcctaattgcagggccaccaagaagctcctggataactctcaccttcctgccacctttaaagtgagctcttctccacagaaggaaggaagggtgagccaacgtgcacgagtgcctaaacctggtgccggaagcaaactctcagatcggccactacacgctctcaagcggaaaagcgcatttatggctcctgtgccaacgaagaagcggaatctggttctgcgcagtcgctccagctcaagttctaacgccagcggtaacgggggtgatggaaaggaagagcggccagagggttcccccacactgttcaaacggatgtcctcacccaaaaaggctaaacctacgaagggaaatggtgagcctgccaccaagcttcctccacccgaaacacccgacgcctgcctgaagctggcaagtcgcgctgctttccagggtgctatgaagacaaaggtgctgccccctcgaaagggccgtggtctcaaacttgaagctattgtgcagaaaatcaccagtcccagcctcaagaagttcgcttgcaaggctcctggagctagtccgggaaatccactttcaccatccttgagcgacaaggatagagggctgaagggggcaggtggatcccctgtgggcgtcgaagaaggcctcgtgaatgtaggaaccggccaaaaacttcccacatctggcgctgaccctctgtgtagaaatcctacgaacagatcactgaaaggaaagttaatgaataaccgcgctagcggaacccaaggggcatcagaggacaactccggcggtggaggtaagaaacctaagatggaagagttggggctcgcttcccagccacccgagggacgtccgtgtcagcctcagacccgagctcaaaagcagccgggacataccaattattcctcatatagcaaacggaaaagactgaccagaggcagagctaaaaatacaaccagtagcccttgcaaaggccgagccaaaaggaggcggcaacaacaagtgctccccttggatccggctgagcccgagattaggttgaaatatatttctagttgtaagagactgagatcagattccaggacacctgctttctcaccgttcgtgcgagtcgagaagcgcgatgctttcacgaccatttgtaccgttgtcaattcgcccggagacgcacctaaaccccataggaaaccgtcatcatctgcctcatcatcttcttcctcatcgagcttctctctggatgctgcaggcgcaagccttgccaccctgcctgggggttcgatcctgcagcccaggcccagcctccccctcagctccaccatgcacctggggccagtcgtgagtaaagccctctcaaccagctgtctagtatgttgtctctgtcaaaaccccgctaattttaaggatctaggtgacctgtgtggcccatactaccccgagcactgtctgcccaaaaaaaagcctaagctgaaagaaaaagtgcgtccagagggtacgtgcgaagaagcttcactgccattggaacgtaccctcaagggtccggagtgtgccgcagccgcaaccgctggcaagccgcctcgccctgatggcccagctgatccagcaaaacaaggcccacttaggacaagtgccaggggactgagccgacgcctccagtcctgttattgctgtgacggacgtgaggacgggggtgaggaagcggctcctgctgacaagggtcactgggtccatgaggcctgcgctgtttggacaggtggagtttaccttgtagctgggaaacttttcggactccaggaggcaatgaaagtggcagtcgatatgcatggagggacagttgcactcgcacctggggatttttcccttcccggattgaggtttgcaagtctgttccagggcccatcttggtgtgactgtcctgtactggcaacttctaccccttcatcatggtcccgatgcgtgcccgctgccaagaaacccggaccacctctgggcgcagcaaccaaggacgcttccacgcctactacgacacgcgtccccgcaatgcaagtgcgggcacgcccaggaacaggcggtcactggagccctagtaaacagtcacgcggaacactgcccggacactccagtcctaaccctggtcctatctccttgttcagctttcctccactcctgccccaacagttcttctatccatccgtttgtcttgacctgtgctgggcgatgccaggcacctggaagta

SEQ ID NO: 238480 - DNA, 5720 bp, Artificial Sequence
  Description of Artificial Sequence: Synthetic coding sequence
atgcagagtttccgcgagcgatgcgggttccacggcaagcaacagaattatcagcaaacctctcaggaaacgtctcgcttggagaattacagacaaccatctcaagcagggctatcatgtgaccgccaacgccttctggccaaagactattataatcctcagccatacccatcctatgaggggggtgcaggcacccccagcggcaccgcagccgctgtcgccgctgataagtatcatcgcggatcgaaagccctcccaacacagcaagggctgcagggaaggcccgcatttcctggttatggggtgcaagatagttcaccttaccctgggcgatatgcgggtgaggaatcgctgcaggcctggggcgctcctcagccccctccccctcagcctcagcccctgccagctggcgtggctaaatacgacgagaatctgatgaaaaaaacagccgtccccccatctcgacagtacgctgagcagggtgcacaagtccctttcaggacgcacagcctgcacgttcagcaacctccaccaccacagcaaccgctggcttatccaaagcttcagcggcaaaagcttcagaatgatatcgcatccccgcttccctttccccagggtactcacttccctcagcacagccagtcgttccccactagttcgacgtatagctcttctgtacaggggggtgggcagggcgctcacagttataaatcatgcacagcaccaactgcccagcctcacgaccgaccgttgaccgcatcctcttctcttgcacccggacagagagtgcagaatttgcatgcctaccagagtggacgcttgtcctatgatcagcagcaacaacagcagcagcagcagcagcagcagcagcaagccctgcagagcagacatcacgcgcaggaaaccctccactatcagaatttggccaagtaccaacactacgggcagcaggggcaaggatactgccagcccgatgccgctgtgaggacacccgagcagtactaccagaccttttccccttcaagtagccacagtcccgcacggtctgtcggacgaagtcccagctattcaagtactcccagtccactcatgccaaacctggagaacttcccgtacagccagcagcccttaagcactggcgctttcccagccggaataacagaccactcgcattttatgccccttcttaatcctagccctacagacgccacgtcatcagtggacacgcaggccggaaactgcaaacccctgcaaaaagataagctccccgagaatctgctgagcgacctgagcctgcagagtttaaccgcgctaacttctcaggttgagaatatcagcaacaccgtccaacaactactgctttccaaagctgcggttccgcagaagaaaggagtgaaaaacctggtctcacggacaccggaacagcataagagtcaacactgtagccctgaggggagcggctacagcgcagagcccgcaggcacccccctgtctgagccgccttcatccaccccacagtcgacgcacgccgaaccccaggaagcagattacttgagtggctccgaagaccctctggagcgctcatttctgtattgcaaccaggctagaggttcccccgcacgggtcaactctaatagtaaagccaaacccgagtccgtgagtacatgtagcgtgaccagccccgatgacatgtctacaaaaagtgatgactcttttcagtccttgcatgggagtttgcctctggattctttctcaaaattcgttgcgggagaacgtgattgcccacgtctgcttctctccgccctggcccaggaggatctggcaagcgaaattcttgggctgcaggaagcaatcggagaaaaagctgacaaagcatgggcggaggccccatccttagtgaaggattcctctaagccgcctttttctttggaaaatcacagcgcatgcctggacagcgttgctaaatcggcgtggcctcgccctggggaacccgaagcgctcccggattccttacagctggataaaggaggcaatgccaaagacttcagtcccggactgttcgaggacccaagcgttgcgttcgctactcccgatcccaaaaaaaccacaggaccacttagcttcggcaccaaacccaccctgggggtgccggcacctgatcccacgacagcagctttcgattgcttcccggacacaaccgcggcaagctccgccgactccgctaacccctttgcctggccagaagagaatttgggagatgcttgcccacgttggggcctccatcctggggaactgaccaaaggactggagcagggaggaaaggccagcgatggaatttccaagggggatacacacgaggcatcagcctgcctcggctttcaagaggaggatccgcctggagagaaggtggcatcgttaccgggtgacttcaaacaggaagaagtaggcggagtcaaggaggaggcaggtggactcctgcaatgtcctgaggttgcaaaagccgaccgatggttagaggattcccggcattgttgtagcacagccgacttcggggatctacctctgctgccaccgacaagccggaaggaggatttggaggccgaggaggagtattcttctctttgtgagttgctgggctctcctgaacaaaggccaggtatgcaagaccctctgagccccaaggcaccactcatctgcaccaaggaagaagtggaggaagtgttggatagcaaggccggatggggttcaccctgtcacctgagcggcgaatctgttatcctgttgggcccaaccgttggtacggaatccaaagttcaatcgtggtttgaatcgtctctgtctcacatgaaaccaggcgaagagggaccggatggcgagagggcccctggcgactctacaaccagcgacgcatccttggcacagaagccaaataagcctgcggtgccagaggcccctatcgcaaagaaggaacccgtacccagaggcaaatctctgaggtccaggcgagtccacagaggacttcccgaagccgaagattccccttgccgcgcacctgtgctacccaaggatctgttactgcctgagagctgcacaggccctcctcaaggtcagatggaaggcgcaggcgctcccggacggggtgcttcagaggggctgcctcgtatgtgtactagatcccttacggcattgtcagaacctagaactcccggacccccaggacttacgacaactcccgctccccctgacaaactgggaggcaaacagagggctgccttcaaatcgggcaaacgcgtgggcaagcccagcccaaaagccgctagtagtcctagtaatccagcagctttacctgtggcaagtgacagctctcctatgggttcaaaaacgaaggaaacagattctccgtcaaccccaggcaaggatcagaggagtatgattctccgatctagaaccaagacccaggaaatcttccatagtaagaggcggaggccctctgagggacgcctgcctaactgccgcgctaccaagaaattactcgacaactcccatctcccggcaacatttaaggtgtcctcttctccccagaaagagggccgtgtgagccagcgagctagggtacctaagcctggggctgggtctaaactgagcgaccgcccactccacgcactcaagaggaagtccgcatttatggctcccgtccccacaaagaagcggaatctggtgctcagaagccgttcctcatccagttctaatgctagtggcaacgggggagatggcaaggaggagcgccctgaagggagccctaccctgttcaaaaggatgagttcacccaagaaagcaaaaccaacgaagggcaacggagagcccgctacaaagctccctccacccgagactccagacgcttgtctcaaacttgcgtctagggccgctttccagggggctatgaagactaaagtcctgccccctcggaagggcagggggctaaaactcgaggcaatcgtgcagaagattacaagcccgtccctcaaaaagttcgcttgcaaggcaccaggtgcctcacctggaaatcccctgtctccaagcctttcagacaaagacagaggcttgaaaggtgccggaggatcccctgtgggtgtggaagagggcttagtcaacgtggggaccggccagaaactgcccacatcaggggcagaccccttatgtagaaaccctaccaataggtcactcaagggtaagttgatgaatagtaagaaactcagcagcacagactgctttaaaactgaggccttcacctccccggaagccctccagcccggaggcacagccctcgcaccaaaaaagcgtagccggaagggaagggccggagcgcacggcctcagcaagggtccgcttgaaaagcggccatacttgggacccgctctccttctaaccccccgagatcgtgccagcggcacacagggagcatccgaagataacagtgggggaggaggtaagaagccaaaaatggaggaactcggcctggcttctcagccacccgagggcaggccttgccagccccaaacgcgggctcagaaacagccaggccacaccaactatagctcctattccaagcggaagaggttgactcgcggacgggcaaaaaatacaactagctcaccatgcaaaggtagagcgaagcgaaggcggcagcagcaagttctgccactggacccggctgagcccgaaatcagactaaagtatatatcgtcatgcaaacggttgaggtcggattcacgcactccggcattttctcctttcgtgcgggtggagaagcgggatgcctttacaacaatctgcactgtagtgaacagccctggcgacgcccctaaacctcacaggaaaccgtccagcagcgcttcatcatcttcatcatcaagctctttctccttggatgctgcaggggcaagcctggccaccctgccgggagggagcatcttgcagccacggccatcgttaccactgagtagcacgatgcatctggggcctgttgtttctaaagcactgagtacttcttgcctcgtgtgctgcctgtgtcagaacccagccaactttaaggacctgggagatttatgtggcccttattatccagagcactgcttgcccaaaaagaagcctaagttaaaagaaaaggtccgtcctgagggcacatgcgaggaggcctcccttccactagagcgcacactcaagggccctgagtgcgccgcagctgctactgccggtaagccacccagaccagacggaccagccgatccggctaagcagggaccgcttcgcaccagcgcaaggggcctgagccggcgattgcagtcttgttattgttgcgacggcagggaagacgggggagaggaggccgcacccgcagacaagggtagaaaacacgagtgctccaaagaggcaccagccgagccgggaggcgaggctcaggagcactgggtacacgaggcgtgtgctgtgtggacaggtggggtgtatctagtagctggaaagctgttcggccttcaagaggccatgaaggtcgcagttgacatgatgtgtagttcttgtcaggaggccggagccaccatcggctgttgccacaaaggctgcctgcacacgtatcactacccttgcgccagcgatgctgggtgcatatttattgaagaaaacttttccttgaagtgccccaagcataagaggctccccta

SEQ ID NO: 238481 - DNA, 2901 bp, Artificial Sequence
  Description of Artificial Sequence: Synthetic coding sequence
atgcagagctttcgggagagatgtggattccatggaaaacagcagaattaccagcagacatctcaagaaacaagccgtctagaaaattaccgacagcccagccaggcgggattgtcctgtgaccgccagaggcttctcgcaaaagattactataatccacaaccctatccatcttatgagggcggagccggaacgccaagcggtacagccgcagctgtagccgctgataaatatcatagagggtccaaagccttaccaacccagcaagggcttcagggcaggccggcttttccgggatatggcgtgcaggactcaagcccttaccccggtcggtacgcgggagaggagtccctccaggcttggggcgctccgcagccccctccaccccagcctcagccgctgcctgccggtgtcgctaaatacgatgagaacttgatgaagaagactgctgtccctccaagtcggcagtatgcggagcaaggagcccaagttccattcaggacccactctctccacgtacagcagccccctccaccccagcagcccttagcttacccaaagcttcagcggcaaaagcttcagaatgacatagcttctccgctgccctttccccaagggacgcatttccctcaacacagtcagtctttccctactagctccacgtacagcagcagcgtccagggaggagggcaaggggcacattcgtataaatcctgtacggccccaactgctcaaccccatgaccggcctctgaccgcgtcatcaagtctagctccaggccagcgagttcagaatctgcacgcctaccagagtggacgactcagctatgaccagcagcagcagcagcagcagcagcagcagcaacagcagcaggccctgcagtctaggcaccacgctcaagagactttgcactaccaaaacctggccaagtaccagcactacggccagcagggccagggttactgtcagccggatgcagcggtgaggacccctgagcagtattatcagactttctctccctcatcatcgcactcccccgcacgctcggtagggcgaagccccagctacagttccaccccatccccactgatgcctaatctggagaacttcccttattcgcagcagccactgtccactggcgcatttcccgctggcattacagaccattctcactttatgccacttctcaacccatcaccaacagacgcaacgagctccgttgatacccaggctgggaactgcaagcctctgcagaaggacaaactgcctgaaaatttgctgagcgacctgtccctgcagtccttgacagccttgacctcacaagttgagaatatcagcaacaccgtgcagcagctgctgctttcaaaggccgctgtcccgcagaaaaagggagtcaagaatttagtgagtcggacacctgaacagcacaaatcacagcattgtagtccagaaggcagcggatacagtgctgaacccgctggtacccccctatcggagccaccatcttcaactcctcaatctacacatgctgaacctcaggaagcagactatctgagtggctcagaggatcccctcgaaagatcatttttatactgcaaccaggcacgcggtagccctgcaagagttaactccaatagtaaagccaaacccgagtccgtttcaacgtgttccgtgacctccccagatgatatgagcaccaagtctgatgactcgtttcaatctctccacggaagcctgccattagacagcttttctaagtttgtggctggggagcgcgattgtcctaggctcctactaagcgcgctcgcccaggaagatctcgcaagcgaaatcttaggactgcaggaggccatcggagaaaaggcggataaggcctgggctgaggcccctagcctggtgaaggacagttccaagccccctttcagcctggagaatcactctgcttgtctcgacagtgtggctaaaagcgcgtggccgagacctggggagcctgaggcccttccggactctctgcagctcgataaggggggaaatgccaaggatttctctccgggactgtttgaagatccaagcgtggctttcgcgacaccagatccaaagaagaccaccgggcctctgtctttcggaactaaaccgaccctaggcgtaccggctcccgatccaacaactgccgctttcgattgctttccggacacgacggcagcctcgtccgcagatagcgcgaacccatttgcctggccagaagaaaatttgggcgacgcttgtcccaggtggggcttacaccctggcgagttaaccaagggcttggaacaggggggaaaagcgagtgacggaatttcgaaaggcgatacacacgaggcctccgcatgcctcggatttcaggaggaggatccccctggcgagaaagtggcatccttaccaggcgatttcaaacaggaagaggtcggaggggtcaaggaggaagccggaggactcttgcagtgccctgaggtcgccaaggccgaccggtggctggaggacagcaggcattgctgcagcactgccgactttggtgatctaccgctgttgccccctactagccggaaagaagatctcgaggccgaggaagagtattcctcactgtgcgagcttctcggatccccagagcagagacccggtatgcaagatccgctgtccccaaaggcgcctctgatctgcacgaaagaggaagtagaagaagtcctcgacagcaaagcaggctgggggagcccatgccatctgagcggggagtctgtgattctcttggggcctacagtgggcacagaatcaaaagtccagagctggtttgaagcctcactctacagcgtctacatctgcatccacatccacatttataacatctacgaggactgtaagtgctag

SEQ ID NO: 238482 - DNA, 2829 bp, Artificial Sequence
  Description of Artificial Sequence: Synthetic coding sequence
atgcaatcttttagggagaggtgcggttttcatgggaaacagcagaattaccagcaaacatcccaggagacaagtcggttggagaactatagacagccttctcaggccggactgagttgcgatagacagagactgctcgcaaaggactattacaacccgcaaccctatccttcgtatgagggaggggctggaaccccgagcggaactgccgctgccgtggctgccgacaagtatcatagaggctccaaggccctccctacccaacagggactccaaggacgtccagctttcccaggctatggagtccaggacagctctccctatcctggaaggtatgctggagaggagtcactgcaagcttggggcgctccacaacctccaccccctcagccacagccgctgcccgcaggagtggctaaatacgatgaaaacctgatgaagaagacagcagtacccccatccagacagtacgcggaacaaggggctcaagtgcccttcagaacccattctctccacgtgcagcaaccaccacccccacagcaaccattggcttaccctaaattgcagcgacagaagctgcaaaatgacatagccagtcctttgccattcccccagggtacgcacttcccccagcacagccaatccttccctacaagttcaacatacagcagctctgtccagggagggggacagggtgcacatagctataagagttgtaccgccccaactgctcagcctcatgataggccactgactgcaagcagttcactagccccagggcagcgtgtgcagaatcttcatgcctatcaatccggccgactgtcttacgaccagcagcagcagcaacagcagcagcagcagcagcagcagcaggcccttcagagtcggcaccatgcccaggagaccctccactatcagaacctggctaagtaccagcactatggccagcaaggacagggctattgccagcccgatgccgcagtccgaacccctgaacagtattatcagaccttctctcccagctcatcccacagccctgctaggagtgtcgggagatccccaagttacagtagtacaccttctcctctgatgccaaatctcgagaatttcccgtacagccagcagcctctgtccactggcgcatttcctgccggaattactgaccacagtcatttcatgcccctgctcaatccgtcccccactgacgctacctcttctgtggacacccaggccggaaactgcaagcccctccagaaggacaagctgcccgagaaccttctctcagatctcagtcttcagtcacttacagccttgacatctcaggtggaaaacatttctaacacggtgcagcagttgcttctgtcgaaggctgccgtgccacagaagaaaggagtgaagaaccttgtctctcgcacccctgaacaacataagtcccaacactgctcccctgaaggctccggatactctgccgagcctgctggaacacccctcagtgagccaccatcttctacgccacagtcaactcatgcagaaccgcaagaggcggattatctgtccggctcggaggaccccctggaacgctccttcctgtactgtaatcaggcacgcggttcccccgctcgcgtgaattcaaactccaaggccaagcctgagtccgtctctacatgtagcgtgacttcccctgacgacatgtccaccaaaagcgacgacagcttccagtcactgcacggatctctacccctggactcattttccaagttcgtcgctggtgaacgagactgtcccaggctgctcctcagcgctctggcccaagaggacctggccagcgagattctgggcctgcaggaggcaatcggcgaaaaggctgataaggcctgggcagaagcgccttccctggtgaaagacagctccaaaccaccatttagccttgaaaatcatagcgcttgcctggacagcgtagccaaaagcgcctggcctcgacctggagagcccgaagccctgccggacagtctgcagcttgacaaggggggaaacgcaaaggacttctctccgggtctgtttgaggacccctcggtcgccttcgctacccccgaccctaaaaagacgaccgggccactgtcatttggcaccaagcctaccctcggagtcccagcacccgaccctacaacagccgcatttgattgtttccctgacactacggcggcaagttccgccgattccgcgaacccatttgcctggccagaggagaacctaggcgacgcctgcccacgttggggactgcaccctggggagctgaccaagggactggaacagggtggtaaagcgtcagacggcatcagtaagggcgatacccacgaagcttctgcttgcctgggctttcaggaggaagaccccccaggagaaaaggtagctagcctcccaggagacttcaaacaagaggaggtaggaggtgtcaaggaagaggccggaggacttctgcagtgcccagaggttgctaaggctgatagatggctggaagacagccggcactgttgttctaccgctgacttcggagatttacctctcctgccacccactagccgcaaggaggatctggaagccgaggaggaatattcatccctgtgtgaattgctgggatctcccgaacaacgtcctgggatgcaggaccccctctcgcccaaggcaccactgatctgtactaaggaggaggtggaggaggtgctcgactctaaagcagggtggggatcaccttgtcatctgagcggagaaagtgtgattctcctggggccaactgtgggtaccgagagcaaagtgcaatcctggttttag

SEQ ID NO: 238483 - DNA, 5981 bp, Artificial Sequence
  Description of Artificial Sequence: Synthetic coding sequence
atgcagtcattcagggagaggtgcggattccacggaaaacaacagaactaccagcaaacttcccaggagaccagccggttggaaaattaccgccagccatcacaggcaggtctctcttgtgacaggcaaagactccttgccaaagattactacaacccccagccctacccctcctatgagggcggtgctggaactcccagcggcacagcagcagctgtcgctgccgacaagtaccaccgtggctctaaggcacttccaactcaacagggactgcagggcaggcccgcattccctggctatggcgtgcaggatagttccccatacccaggcagatacgctggagaggagtcactacaggcttggggcgcaccccaaccacccccaccacaaccccaaccgctgcctgcaggggtggctaaatatgacgaaaatctgatgaaaaagacagcagttccacccagcaggcagtatgcagagcagggagcccaggtgccgtttagaacgcatagtctgcacgtccaacaaccgcctccaccacagcagcccctcgcctaccctaagctccaacgtcagaaattgcagaacgacatcgccagccccctacctttcccacaggggacccatttccctcagcattctcagagcttccccacttcaagtacgtacagctccagcgtccaaggaggtggacagggggctcactcatacaaaagctgcacagcacccactgcacaaccacacgaccggcctttgacagcatccagcagcctggcgccaggtcaacgcgtgcagaacctccatgcctaccagtcggggagacttagttatgaccagcagcagcagcagcagcaacaacaacaacagcaacaacaggcgctgcagtcgcggcaccacgcccaggagactctccattatcagaatcttgccaagtaccaacactatggacaacagggccagggctactgccagcccgacgccgcagtgcggaccccagaacagtactaccagacctttagcccctcgtccagccatagccccgcaagaagcgtcgggagatcccccagttattccagcaccccctctcctcttatgccaaacctcgaaaacttcccatattctcagcaaccgctgagtactggcgcatttccagctggaattactgatcactctcactttatgccattgctgaatccatctcctaccgacgctacaagttccgtggacacacaggccggtaattgtaaacctttgcaaaaggataaactgcctgaaaacctcctatctgacctcagtttacagagcctgacagcacttaccagccaggtggaaaatatcagcaacacagtccaacagttgctgctctcaaaggccgcagtcccacagaagaaaggcgtgaaaaatctcgtgtcccgcactccagaacagcataaaagccagcattgctctccagaaggttccgggtactcagcggagcctgcaggcaccccactctcggaaccgccaagtagcacaccgcaatccacccacgcagagccccaggaagctgattacctttctggctctgaggaccctcttgaaaggagttttttatattgtaaccaggctcgaggtagtcccgctagggtgaatagcaattctaaggcaaagccagaatccgtcagcacatgttccgtgaccagcccagacgatatgtccactaagtccgacgacagctttcagtctttgcacggaagtctcccgctggattccttttctaagttcgtagccggtgagcgtgactgtccaagactgctgctttctgcccttgcccaggaagatctagccagcgaaatattaggcctgcaagaggccattggggagaaagcggacaaggcctgggcagaggctccatcactggttaaagacagctcaaaaccaccattttccctggaaaatcactccgcatgcctagactccgtcgcaaagagcgcctggccacgccctggagagcccgaggccctgccagatagcctgcagctggataagggtggcaatgcgaaagatttttctcccggtctatttgaggatccatcagtggcgttcgcaaccccagaccccaaaaagactactggccctctgtccttcgggaccaagcccacactgggagtgccagcaccggatcctaccactgcggctttcgactgcttcccagacaccaccgccgcttcctcggccgattcagcaaacccatttgcatggcctgaggagaatctcggggatgcttgcccacggtggggtctgcatccgggtgagcttaccaagggactggaacaggggggaaaagcctccgacggcatatcaaaaggggatacacatgaggcttccgcgtgcctcgggttccaggaagaggacccccctggagagaaagttgcaagcctgcctggggacttcaagcaagaggaagtagggggtgtaaaggaagaggcaggcggtctgctgcagtgccccgaggttgctaaggctgatcgttggttggaagacagccggcactgttgttccaccgctgacttcggcgacctgcccctccttcctccgacgtcgcgtaaggaagatttagaagccgaagaggagtacagttccttatgtgaactccttgggtcccctgagcaacgcccaggcatgcaagatcctctttcccctaaagcaccccttatttgcaccaaagaggaggtggaagaggtgctggacagcaaggcaggatggggaagcccctgccacttgtccggcgagagcgtgatcctcttgggtcctaccgtgggcaccgagtccaaagtgcagagctggttcgaatcttcgctttctcacatgaagcccggagaggaaggccctgatggcgaaagagccccaggggattccacgaccagcgatgccagcctcgcacagaagcccaataaaccagctgtgcctgaggctcccatcgccaaaaaggaacctgtgcctcgcggaaaaagcctgcggtcccgccgagttcaccgcggattacccgaggcggaggacagcccttgtagggcccctgtcctcccaaaggaccttctcttacccgagagctgcaccggccctccacagggtcaaatggagggtgcgggtgcccctgggagaggcgctagcgaggggcttcccagaatgtgcacccgctctcttacagccttatctgaacccagaacacctggccctccaggcctgacaaccacccctgcaccccctgataaactgggcggaaagcagcgggctgcctttaaaagcgggaagagggttggcaagccatccccaaaggcagcctcctcgccctccaatcccgctgctctccctgtggcaagcgactcctcacccatgggatccaagactaaggaaacagacagtccttccacccctggcaaagaccagagatccatgatacttcggagcaggaccaagacccaggagatttttcacagtaaacggagacgccctagtgaagggagacttccgaattgtcgggctactaaaaaacttttagacaacagccatctgccagcaactttcaaggtgagctcgtcccctcaaaaagaggggcgagtctcccagagggcgagggtgcccaagcctggggctggcagcaaactgtcagacagaccgttgcacgcactgaaacggaagagtgcgtttatggcacccgtgcctactaaaaaacgtaaccttgtcctgcggagccggtctagctcttctagtaatgctagtgggaacggcggtgatggaaaggaggaaaggcctgaaggctctcctactctgtttaagcggatgtcttcccctaagaaagctaagccaaccaagggtaatggtgagcctgcaactaaactccctcctccagaaacgcctgacgcttgtctaaagctcgccagccgcgcagctttccaaggcgcaatgaaaaccaaagtcctgcccccaagaaaagggagaggacttaagctggaagcgatagtgcagaaaataacctccccgtctttgaagaagttcgcatgcaaagcacctggagcctcgcccggaaatcccctatcgccttccctgtcagataaggatcggggattgaagggcgcaggaggttccccagtcggcgtggaggaaggcctggtgaatgttggcaccggtcagaagctgccaacgtctggcgcagatccactctgccgcaaccctacaaatagaagcctgaagggcaagttaatgaactctaagaaactgtcttcaacagactgctttaaaacagaggcattcacctcccccgaggctctccaaccaggtgggaccgctctcgcacctaagaagcgcagtcggaaaggtagagcaggcgctcatgggctgagcaaggggccattggagaaaaggccatacctgggcccagctctcttgttaacccctcgcgatcgggcatccggaactcagggcgcatcagaggacaactcaggcggtgggggtaaaaagcctaagatggaagagctgggcctggcctcccagcctccagaaggccgaccatgtcagccacagacgcgggcacagaaacagcccggacacacaaactactccagttactctaagcgaaagcgtctgacaaggggtagggccaagaacacaacttcgagcccttgcaaaggaagagccaagcgtagacgacagcagcaggtgctgcctctggaccccgctgagccagaaatccggttgaaatacatcagttcatgcaagcgattacgcagcgactccagaactcctgcattttcacccttcgtacgagtcgagaagagagacgcatttactacaatctgcaccgttgtgaactctcctggtgatgcaccaaagccacacaggaagcccagctcatctgccagttcgtcatctagtagttcaagtttctcactggatgcggctggcgcttcactagcaaccctgccaggcggatctatcctccagcccaggcccagccttccccttagtagcaccatgcatttgggaccagtagtttcgaaagccctgagcaccagctgtctcgtctgttgcctgtgtcaaaatccagctaacttcaaagacttaggagatctctgtggcccttactaccctgagcactgcctgcctaagaaaaagccaaaattgaaagagaaagtgcgtccagaggggacatgcgaggaggctagtctccccctggaacggacacttaagggacccgaatgtgccgctgcggctacagcgggaaagcctccacggcctgacggtcccgcagaccctgccaagcagggccctctccggaccagcgccaggggattatcaagaaggttacaaagttgttattgctgcgacggaagggaggacgggggagaggaggctgcgcctgcagataagggaagaaagcatgagtgttctaaagaggcccctgctgaaccaggtggcgaggcccaggagcactgggtacatgaagcgtgtgccgtctggaccggtggagtgtaccttgtggcaggaaagttgtttgggttgcaggaggccatgaaggtcgccgtggacatgcacggcggtacagttgctctcgcgccaggagatttcagcttgcctggcttgagattcgcgtccctgtttcagggaccctcctggtgtgattgcccagtgctggctacgtccacgccttcctcttggtctcggtgtgtacctgccgctaagaaaccagggcctcctctcggtgccgctaccaaggacgcctcaacacctaccaccactcgcgtccccgcaatgcaggtacgggctcgcccaggtaccggaggccactggagtccatctaaacagagtaggggcaccctgcccggacattcatcacccaatcctgggccaataagtttgttcagttttccgccactactccctcagcagtttttctacccttctgtgtgcctcgacctctgttgggccatgcccggaacctggaaata
